United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 16

SEQ ID NO: 676496 - RNA, 22 nt, Human
ugagguaugguaagguaaaauc

SEQ ID NO: 676497 - RNA, 23 nt, Human
agggccaggugcggaaacagcuc

SEQ ID NO: 676498 - RNA, 22 nt, Human
ucagccuggugauuccucuguc

SEQ ID NO: 676499 - RNA, 22 nt, Human
uugagagaaaaaauuuauuggu

SEQ ID NO: 676500 - RNA, 23 nt, Human
uuguccugccgaucucugagaau

SEQ ID NO: 676501 - RNA, 22 nt, Human
caaagugcagaaggaacugggu

SEQ ID NO: 676502 - RNA, 22 nt, Human
ccugaggcccuggcugugcuga

SEQ ID NO: 676503 - RNA, 19 nt, Human
gcccugaccuuggcugcuc

SEQ ID NO: 676504 - RNA, 22 nt, Human
cacagcagacagggaggcggcu

SEQ ID NO: 676505 - RNA, 22 nt, Human
ggugaaguaauaccagguguac

SEQ ID NO: 676506 - RNA, 22 nt, Human
gaaucccuugcaaguuguugua

SEQ ID NO: 676507 - RNA, 22 nt, Human
uggagcuggaauuugagcugga

SEQ ID NO: 676508 - RNA, 22 nt, Human
ugcaaacaguuaagaugcaggc

SEQ ID NO: 676509 - RNA, 22 nt, Human
gaugaggggucauuggcuggga

SEQ ID NO: 676510 - RNA, 22 nt, Human
ucuuggccagaugcacuuccuc

SEQ ID NO: 676511 - RNA, 22 nt, Human
ggcuucagugagcugagcucac

SEQ ID NO: 676512 - RNA, 22 nt, Human
auuuagcaaaaaaugaugaagc

SEQ ID NO: 676513 - RNA, 22 nt, Human
cacuuggaggaaggccuauuca

SEQ ID NO: 676514 - RNA, 22 nt, Human
cacauaagaaaugaauaugaga

SEQ ID NO: 676515 - RNA, 22 nt, Human
augucagagcuuccacaauagu

SEQ ID NO: 676516 - RNA, 22 nt, Human
ccaccccugggugcagggagcg

SEQ ID NO: 676517 - RNA, 22 nt, Human
uggguccacaaacaucagauau

SEQ ID NO: 676518 - RNA, 22 nt, Human
aagacauugucauuuuauaauu

SEQ ID NO: 676519 - RNA, 22 nt, Human
cagcuugcaguacuuguuuuug

SEQ ID NO: 676520 - RNA, 22 nt, Human
uagcagagcacaucuucauucu

SEQ ID NO: 676521 - RNA, 22 nt, Human
cagacagcugcuuucuugcugu

SEQ ID NO: 676522 - RNA, 22 nt, Human
cuuucccugcuuagaaggauuu

SEQ ID NO: 676523 - RNA, 22 nt, Human
cauagauucuuauuuccaucuu

SEQ ID NO: 676524 - RNA, 22 nt, Human
aacaggaaacaaguuguuagga

SEQ ID NO: 676525 - RNA, 22 nt, Human
agacaacaugaucagcaguccu

SEQ ID NO: 676526 - RNA, 21 nt, Human
agagaagggauuccaggcccu

SEQ ID NO: 676527 - RNA, 22 nt, Human
uuggcugugaaagcuucucaaa

SEQ ID NO: 676528 - RNA, 22 nt, Human
ucuguggcugucuuuccagagg

SEQ ID NO: 676529 - RNA, 22 nt, Human
cccaggcugucuguccuuugcu

SEQ ID NO: 676530 - RNA, 22 nt, Human
auacaauaguguuuguuuugag

SEQ ID NO: 676531 - RNA, 22 nt, Human
aacaaauggggccuuguaugaa

SEQ ID NO: 676532 - RNA, 22 nt, Human
gaaaccuguccccucuuccuca

SEQ ID NO: 676533 - RNA, 22 nt, Human
uucuugcaggucacucacugag

SEQ ID NO: 676534 - RNA, 22 nt, Human
cagauucaaccuaagacaaucu

SEQ ID NO: 676535 - RNA, 22 nt, Human
ugaaaauucucaggcucacccc

SEQ ID NO: 676536 - RNA, 22 nt, Human
uucuucaaauagcagggaguca

SEQ ID NO: 676537 - RNA, 22 nt, Human
ucucuucugaaaccugucuuua

SEQ ID NO: 676538 - RNA, 22 nt, Human
augcuuaacucuguacauaguu

SEQ ID NO: 676539 - RNA, 21 nt, Human
cauuucuauugaugagaaaag

SEQ ID NO: 676540 - RNA, 21 nt, Human
gcagccacagccaccaagcua

SEQ ID NO: 676541 - RNA, 22 nt, Human
uuuaaaagggguauuaagucca

SEQ ID NO: 676542 - RNA, 22 nt, Human
guauuuuucauuccaagugaga

SEQ ID NO: 676543 - RNA, 22 nt, Human
gucuucuuuaaccuacuaaagc

SEQ ID NO: 676544 - RNA, 22 nt, Human
gugagggcagcuuggucagugu

SEQ ID NO: 676545 - RNA, 22 nt, Human
uuugcaaagaaauuauugcugu

SEQ ID NO: 676546 - RNA, 22 nt, Human
gugucacaagagcccaggaaac

SEQ ID NO: 676547 - RNA, 22 nt, Human
uggucuaagagccuaacugcug

SEQ ID NO: 676548 - RNA, 22 nt, Human
uggagagaacagugucugaaag

SEQ ID NO: 676549 - RNA, 22 nt, Human
ucucacacuauuucaggugacu

SEQ ID NO: 676550 - RNA, 20 nt, Human
gcauccauauaugcaugugu

SEQ ID NO: 676551 - RNA, 22 nt, Human
uuaaaugucuguagaugugcug

SEQ ID NO: 676552 - RNA, 22 nt, Human
uaaaguuuguagcaauugauau

SEQ ID NO: 676553 - RNA, 22 nt, Human
uaguaaguucucgcauuguuau

SEQ ID NO: 676554 - RNA, 22 nt, Human
agacuucacucccagagauucu

SEQ ID NO: 676555 - RNA, 19 nt, Human
aggagaaguagcagaaauu

SEQ ID NO: 676556 - RNA, 22 nt, Human
ccaggccucaccugcccaccua

SEQ ID NO: 676557 - RNA, 22 nt, Human
uugguggagucauuggcauaug

SEQ ID NO: 676558 - RNA, 22 nt, Human
caggacugauguuccuccagcc

SEQ ID NO: 676559 - RNA, 22 nt, Human
uuccaggaacacucuguguccc

SEQ ID NO: 676560 - RNA, 22 nt, Human
ucaguauagcuaaaaguuuguc

SEQ ID NO: 676561 - RNA, 22 nt, Human
gaccacagaagccuugauaggg

SEQ ID NO: 676562 - RNA, 21 nt, Human
uccuggcuuuaugcuaccucu

SEQ ID NO: 676563 - RNA, 22 nt, Human
cccugcacagccuggcucucuu

SEQ ID NO: 676564 - RNA, 22 nt, Human
caaucccaucaccaucugcucu

SEQ ID NO: 676565 - RNA, 22 nt, Human
ucugcauauuguuaauggaaug

SEQ ID NO: 676566 - RNA, 22 nt, Human
cuguccccugugcuuucacuug

SEQ ID NO: 676567 - RNA, 22 nt, Human
acuuccuuuucaaccauacagc

SEQ ID NO: 676568 - RNA, 22 nt, Human
aguacugucagcaggguguuga

SEQ ID NO: 676569 - RNA, 21 nt, Human
agguggggcugcaccucugcu

SEQ ID NO: 676570 - RNA, 22 nt, Human
gagucaggaguccugugugaga

SEQ ID NO: 676571 - RNA, 22 nt, Human
gcaaaaacugcaauuacuuuug

SEQ ID NO: 676572 - RNA, 22 nt, Human
agggccagggaaacgaucagca

SEQ ID NO: 676573 - RNA, 22 nt, Human
ggcuuggcagaggugggugcuu

SEQ ID NO: 676574 - RNA, 22 nt, Human
cacauauaugaaaugaggaauu

SEQ ID NO: 676575 - RNA, 22 nt, Human
agugaguggagagcucuagguu

SEQ ID NO: 676576 - RNA, 22 nt, Human
uagucacaaccuucaaguuguc

SEQ ID NO: 676577 - RNA, 22 nt, Human
ucuucagagcauuucugaggua

SEQ ID NO: 676578 - RNA, 21 nt, Human
uccaggaguucuaauaggugu

SEQ ID NO: 676579 - RNA, 22 nt, Human
uacauaugaacuuuauaacuug

SEQ ID NO: 676580 - RNA, 21 nt, Human
uacagaugaggagaccaaggc

SEQ ID NO: 676581 - RNA, 22 nt, Human
guggcccugagcccuuugacag

SEQ ID NO: 676582 - RNA, 22 nt, Human
agaguucaguuguagccauauu

SEQ ID NO: 676583 - RNA, 22 nt, Human
gacccggcuccaggcccagcag

SEQ ID NO: 676584 - RNA, 22 nt, Human
uucuguuagaauuuugaaaaua

SEQ ID NO: 676585 - RNA, 22 nt, Human
gagaaggaguagcugaccuggg

SEQ ID NO: 676586 - RNA, 22 nt, Human
gguuggaggugggaauagcuag

SEQ ID NO: 676587 - RNA, 21 nt, Human
gcuaugaauguagaaaauuau

SEQ ID NO: 676588 - RNA, 23 nt, Human
acauacauggagauaaagugaug

SEQ ID NO: 676589 - RNA, 22 nt, Human
aacaucacaauuucauuuaugc

SEQ ID NO: 676590 - RNA, 22 nt, Human
uugaaaguuaggauuuagcugg

SEQ ID NO: 676591 - RNA, 22 nt, Human
acuaagaugcaggaaaugcuag

SEQ ID NO: 676592 - RNA, 22 nt, Human
uuucaaggccuucugguucagu

SEQ ID NO: 676593 - RNA, 22 nt, Human
ucauucugcaucacucuugcuc

SEQ ID NO: 676594 - RNA, 22 nt, Human
agugggcccuugucacacugau

SEQ ID NO: 676595 - RNA, 22 nt, Human
auugggaugccggcugauaaga

SEQ ID NO: 676596 - RNA, 20 nt, Human
ucuggcaggugaacgagcug

SEQ ID NO: 676597 - RNA, 22 nt, Human
uaaaaaguugaaaggacuuauc

SEQ ID NO: 676598 - RNA, 22 nt, Human
aggugggguguuggauguuuau

SEQ ID NO: 676599 - RNA, 21 nt, Human
cccaggaguccuauuuaaaug

SEQ ID NO: 676600 - RNA, 22 nt, Human
aagguuaaauagguauuuucca

SEQ ID NO: 676601 - RNA, 22 nt, Human
ugcuucagaggaaaggcaaaag

SEQ ID NO: 676602 - RNA, 22 nt, Human
guggccugaugccagcccugug

SEQ ID NO: 676603 - RNA, 21 nt, Human
ugcagcugacacugguaugcc

SEQ ID NO: 676604 - RNA, 22 nt, Human
ggaacauucuagaguguuguga

SEQ ID NO: 676605 - RNA, 22 nt, Human
gcucccacaaccuucuugcucc

SEQ ID NO: 676606 - RNA, 22 nt, Human
uagaaaagaagucuggccggga

SEQ ID NO: 676607 - RNA, 22 nt, Human
agucugggagaaggugagauua

SEQ ID NO: 676608 - RNA, 22 nt, Human
uucucacauucagaacuuuuau

SEQ ID NO: 676609 - RNA, 21 nt, Human
acacaagcacucguacauacg

SEQ ID NO: 676610 - RNA, 22 nt, Human
uccuggaggcaaaugaagacuc

SEQ ID NO: 676611 - RNA, 20 nt, Human
uaaucacuuauaagacaaug

SEQ ID NO: 676612 - RNA, 20 nt, Human
ucugugcauugccugcuggu

SEQ ID NO: 676613 - RNA, 22 nt, Human
cccagaggugacaucccauucu

SEQ ID NO: 676614 - RNA, 22 nt, Human
uuucuugagcuaggaaccuggg

SEQ ID NO: 676615 - RNA, 22 nt, Human
guuucuuaaaagaggaguuaga

SEQ ID NO: 676616 - RNA, 22 nt, Human
uaugucuuuaguaucuuuugga

SEQ ID NO: 676617 - RNA, 22 nt, Human
gggacccagguaauccugugcu

SEQ ID NO: 676618 - RNA, 22 nt, Human
ugauuuccugugcgcccuuagg

SEQ ID NO: 676619 - RNA, 22 nt, Human
gugguccaucaugcagagcucc

SEQ ID NO: 676620 - RNA, 22 nt, Human
uuucugauauacuguagaaucc

SEQ ID NO: 676621 - RNA, 22 nt, Human
gcagggcagagggagaaucucu

SEQ ID NO: 676622 - RNA, 22 nt, Human
uuccauaauaaccugagagaaa

SEQ ID NO: 676623 - RNA, 22 nt, Human
gaggggcuugaggcccugaugg

SEQ ID NO: 676624 - RNA, 22 nt, Human
ugauucaagagaguugggguau

SEQ ID NO: 676625 - RNA, 22 nt, Human
uaaguaaauuuauaaugugauu

SEQ ID NO: 676626 - RNA, 22 nt, Human
ucccaaggccucuaguugauua

SEQ ID NO: 676627 - RNA, 20 nt, Human
uguaaacaauaguguucuug

SEQ ID NO: 676628 - RNA, 22 nt, Human
aucuggagugggacacagaaau

SEQ ID NO: 676629 - RNA, 22 nt, Human
ucugugaaaucacccagguuua

SEQ ID NO: 676630 - RNA, 22 nt, Human
cagcagcccacgcgugcugucc

SEQ ID NO: 676631 - RNA, 22 nt, Human
cccugggagaaguugagggcug

SEQ ID NO: 676632 - RNA, 22 nt, Human
gccugccuuuuggaggcacauu

SEQ ID NO: 676633 - RNA, 22 nt, Human
gcuggagcugaguucccugggc

SEQ ID NO: 676634 - RNA, 22 nt, Human
cacagaggugauaguggucaag

SEQ ID NO: 676635 - RNA, 20 nt, Human
uuggaugugcauggccgugc

SEQ ID NO: 676636 - RNA, 22 nt, Human
uugccaggagcucaucugaggg

SEQ ID NO: 676637 - RNA, 22 nt, Human
agaaaucuauguuuugguuaga

SEQ ID NO: 676638 - RNA, 22 nt, Human
auaugcuagugugcuuauacuu

SEQ ID NO: 676639 - RNA, 22 nt, Human
ugggaugauagguaaguaauua

SEQ ID NO: 676640 - RNA, 22 nt, Human
aguuuauuguauaugguaguuu

SEQ ID NO: 676641 - RNA, 22 nt, Human
gagagcacggucuugggcaugg

SEQ ID NO: 676642 - RNA, 22 nt, Human
auuguguccucauugaccuuca

SEQ ID NO: 676643 - RNA, 16 nt, Human
gcacacagccagccuu

SEQ ID NO: 676644 - RNA, 22 nt, Human
cuucauuacuugcucguagcac

SEQ ID NO: 676645 - RNA, 22 nt, Human
gcagcuggccccuuuccuuguu

SEQ ID NO: 676646 - RNA, 22 nt, Human
gcuuccagggcucagucacugc

SEQ ID NO: 676647 - RNA, 22 nt, Human
cuacugucuuccuugguaacaa

SEQ ID NO: 676648 - RNA, 22 nt, Human
uuaaccuguuaugcccccagag

SEQ ID NO: 676649 - RNA, 22 nt, Human
uggcacugacagggugcucaag

SEQ ID NO: 676650 - RNA, 18 nt, Human
ggguucaccugccuuugg

SEQ ID NO: 676651 - RNA, 22 nt, Human
gucugccugcuaguggcugccu

SEQ ID NO: 676652 - RNA, 20 nt, Human
gcucugaccauaucaagaca

SEQ ID NO: 676653 - RNA, 19 nt, Human
agagccagacagcauagga

SEQ ID NO: 676654 - RNA, 22 nt, Human
uggaagugcucuucugaccaac

SEQ ID NO: 676655 - RNA, 22 nt, Human
uccaggcauagaaggcacgcac

SEQ ID NO: 676656 - RNA, 22 nt, Human
ugaagcccugucuuauggaaga

SEQ ID NO: 676657 - RNA, 23 nt, Human
cccugcagucagggugagauggu

SEQ ID NO: 676658 - RNA, 23 nt, Human
ugacaacagcucucagccauguc

SEQ ID NO: 676659 - RNA, 22 nt, Human
ucucacucauuuccuaggucuu

SEQ ID NO: 676660 - RNA, 22 nt, Human
ccuuuguggggcgguggguaau

SEQ ID NO: 676661 - RNA, 22 nt, Human
uccaggcaaaaggaacugcuug

SEQ ID NO: 676662 - RNA, 22 nt, Human
gacacugucccacagaauucga

SEQ ID NO: 676663 - RNA, 22 nt, Human
ugcucagacaagcugaacagua

SEQ ID NO: 676664 - RNA, 22 nt, Human
cagggccacacggaagggaaca

SEQ ID NO: 676665 - RNA, 22 nt, Human
auguacagccacuucacaguua

SEQ ID NO: 676666 - RNA, 22 nt, Human
agaccacuaaaacuuucucuau

SEQ ID NO: 676667 - RNA, 22 nt, Human
uucugccuucaguccucugacu

SEQ ID NO: 676668 - RNA, 22 nt, Human
acagucuaggugugugauuuaa

SEQ ID NO: 676669 - RNA, 20 nt, Human
gcccucugccucccucagcg

SEQ ID NO: 676670 - RNA, 22 nt, Human
aagucacauucugagguauugg

SEQ ID NO: 676671 - RNA, 22 nt, Human
cagugcccucaucuaugaaauc

SEQ ID NO: 676672 - RNA, 22 nt, Human
auucauggcagugguaacguuu

SEQ ID NO: 676673 - RNA, 22 nt, Human
gcaaagaaaguuuuaaugaggu

SEQ ID NO: 676674 - RNA, 22 nt, Human
agagaaucuagaauguuuauac

SEQ ID NO: 676675 - RNA, 22 nt, Human
guggggaaaggaguggggcuca

SEQ ID NO: 676676 - RNA, 20 nt, Human
aacuugucuuccuguuuggc

SEQ ID NO: 676677 - RNA, 22 nt, Human
cccagagggaagggaaugaggu

SEQ ID NO: 676678 - RNA, 22 nt, Human
augacccuuacugcaucauaca

SEQ ID NO: 676679 - RNA, 22 nt, Human
gacccugagcaaaagcaguucu

SEQ ID NO: 676680 - RNA, 22 nt, Human
uuguaaaguucuuaggaagcuc

SEQ ID NO: 676681 - RNA, 22 nt, Human
caggcauuucgcaaaggcugag

SEQ ID NO: 676682 - RNA, 22 nt, Human
cccugaggaccaggaaggaggg

SEQ ID NO: 676683 - RNA, 21 nt, Human
ucacuagugccuucugucauu

SEQ ID NO: 676684 - RNA, 22 nt, Human
aacucuuuggucucaggaaagg

SEQ ID NO: 676685 - RNA, 22 nt, Human
agaaaaaucuuggcgcuugucu

SEQ ID NO: 676686 - RNA, 22 nt, Human
agcuauugugugcccagcagga

SEQ ID NO: 676687 - RNA, 22 nt, Human
ucauccauauagaaagaugauu

SEQ ID NO: 676688 - RNA, 22 nt, Human
gguucacauauugagaguauuc

SEQ ID NO: 676689 - RNA, 22 nt, Human
aacuacaguaguuugcccuucu

SEQ ID NO: 676690 - RNA, 22 nt, Human
cuauuuaucuauuucugaauga

SEQ ID NO: 676691 - RNA, 22 nt, Human
acagcucugcauggcaguuauu

SEQ ID NO: 676692 - RNA, 22 nt, Human
uuucugcuuccuugagaaggag

SEQ ID NO: 676693 - RNA, 22 nt, Human
agaagggagagaaaguugguua

SEQ ID NO: 676694 - RNA, 22 nt, Human
cccaggcagcccuucugacgca

SEQ ID NO: 676695 - RNA, 22 nt, Human
ucccucacugguucugcauccc

SEQ ID NO: 676696 - RNA, 22 nt, Human
gaacauugcuuuauuucuucua

SEQ ID NO: 676697 - RNA, 22 nt, Human
ucaauauuuuuaugagcauaga

SEQ ID NO: 676698 - RNA, 22 nt, Human
aacacauugccagagaucagca

SEQ ID NO: 676699 - RNA, 22 nt, Human
aucaucuuaucugacucauuuu

SEQ ID NO: 676700 - RNA, 22 nt, Human
gucugaggccugaggcccuggg

SEQ ID NO: 676701 - RNA, 22 nt, Human
gaaaauacuucaguguucuggc

SEQ ID NO: 676702 - RNA, 22 nt, Human
auaucuuuguuuuugccaagau

SEQ ID NO: 676703 - RNA, 22 nt, Human
ccaggcucugccaggcccuuga

SEQ ID NO: 676704 - RNA, 22 nt, Human
gaaaauaggcagaugcauugua

SEQ ID NO: 676705 - RNA, 22 nt, Human
cuggcucucugauuucacauuc

SEQ ID NO: 676706 - RNA, 22 nt, Human
agaguguguggggcugagguca

SEQ ID NO: 676707 - RNA, 22 nt, Human
aaacacagauuucuuuguccca

SEQ ID NO: 676708 - RNA, 22 nt, Human
acucuguguuuugguggcagca

SEQ ID NO: 676709 - RNA, 22 nt, Human
gaagcacagggcucgaucucag

SEQ ID NO: 676710 - RNA, 23 nt, Human
acauauugaaugcugagaauuuu

SEQ ID NO: 676711 - RNA, 22 nt, Human
ggcaggcgugguggccucagaa

SEQ ID NO: 676712 - RNA, 21 nt, Human
ccugugugugucccuuuaaga

SEQ ID NO: 676713 - RNA, 22 nt, Human
ucugggucuaugaucucacuuc

SEQ ID NO: 676714 - RNA, 20 nt, Human
cauauggaaagauauuguuc

SEQ ID NO: 676715 - RNA, 22 nt, Human
gaggagaaugcgcaccacauau

SEQ ID NO: 676716 - RNA, 23 nt, Human
acagggcuagcugacagugguau

SEQ ID NO: 676717 - RNA, 21 nt, Human
uuucugucucugccacuaguu

SEQ ID NO: 676718 - RNA, 22 nt, Human
ucuuuucacagacaaauggaga

SEQ ID NO: 676719 - RNA, 22 nt, Human
guuguauauguagagaaugguc

SEQ ID NO: 676720 - RNA, 22 nt, Human
ugaggaacucaccaggcagaga

SEQ ID NO: 676721 - RNA, 22 nt, Human
agcaucuggucaugagugagaa

SEQ ID NO: 676722 - RNA, 22 nt, Human
ggccagagagccgcuguuagga

SEQ ID NO: 676723 - RNA, 22 nt, Human
ggucuucuggaaagcagacugu

SEQ ID NO: 676724 - RNA, 22 nt, Human
ggagaggaaaugccagcacuuc

SEQ ID NO: 676725 - RNA, 19 nt, Human
uccucagugacaaccucag

SEQ ID NO: 676726 - RNA, 22 nt, Human
augugugcucuugagccuucac

SEQ ID NO: 676727 - RNA, 22 nt, Human
caguuuaguguugcauuuggag

SEQ ID NO: 676728 - RNA, 20 nt, Human
caagcccucuuuagccugcc

SEQ ID NO: 676729 - RNA, 22 nt, Human
ucuuuaaggugauuucugcuac

SEQ ID NO: 676730 - RNA, 22 nt, Human
uucucucugugucauuauggac

SEQ ID NO: 676731 - RNA, 23 nt, Human
uggcccugaaucuguccuggagg

SEQ ID NO: 676732 - RNA, 22 nt, Human
guguagguaagcaugcagcuga

SEQ ID NO: 676733 - RNA, 22 nt, Human
ugggccuccuuuccauucagag

SEQ ID NO: 676734 - RNA, 22 nt, Human
ccucaggcugcucacacuuguc

SEQ ID NO: 676735 - RNA, 22 nt, Human
ggacaggugacugcccagagug

SEQ ID NO: 676736 - RNA, 22 nt, Human
agcagcugguaggaguggccac

SEQ ID NO: 676737 - RNA, 22 nt, Human
acacuguuccacacuaagaagg

SEQ ID NO: 676738 - RNA, 22 nt, Human
ggcagaccucuccagccccaca

SEQ ID NO: 676739 - RNA, 22 nt, Human
ugacaguauacuugugauggga

SEQ ID NO: 676740 - RNA, 22 nt, Human
ccaggcucugagccucacucuu

SEQ ID NO: 676741 - RNA, 22 nt, Human
gaaacauucauaugagaaaccu

SEQ ID NO: 676742 - RNA, 22 nt, Human
cagaaauguuuaugcuuuugaa

SEQ ID NO: 676743 - RNA, 22 nt, Human
gugggagaaauuagcucuaguu

SEQ ID NO: 676744 - RNA, 22 nt, Human
auguccagagccggccugcuga

SEQ ID NO: 676745 - RNA, 22 nt, Human
gugcuucuuucuccucaagccu

SEQ ID NO: 676746 - RNA, 22 nt, Human
augggaggcagacacuaaguuc

SEQ ID NO: 676747 - RNA, 22 nt, Human
uuccuccacgugacaggagcca

SEQ ID NO: 676748 - RNA, 20 nt, Human
uccagcugggaacagcugau

SEQ ID NO: 676749 - RNA, 20 nt, Human
agggccuguugcaagcguuu

SEQ ID NO: 676750 - RNA, 22 nt, Human
gguguucuuaguggcacuggca

SEQ ID NO: 676751 - RNA, 19 nt, Human
ucuggcuccugccaggcug

SEQ ID NO: 676752 - RNA, 20 nt, Human
guuuccuauuuaccuccuca

SEQ ID NO: 676753 - RNA, 19 nt, Human
cuucagggaggggccaggc

SEQ ID NO: 676754 - RNA, 22 nt, Human
accaucaguacuggaugcugac

SEQ ID NO: 676755 - RNA, 22 nt, Human
ugauacagagcaagcaucuuuu

SEQ ID NO: 676756 - RNA, 22 nt, Human
cauggccacauuggaccgaagc

SEQ ID NO: 676757 - RNA, 21 nt, Human
cuacccucacucccauuccuc

SEQ ID NO: 676758 - RNA, 22 nt, Human
gcuaggaagaagggugcuugaa

SEQ ID NO: 676759 - RNA, 18 nt, Human
agauuuugagaaauacaa

SEQ ID NO: 676760 - RNA, 22 nt, Human
uauauguugauacuaauucugg

SEQ ID NO: 676761 - RNA, 22 nt, Human
agacauuuugauaccccuaccg

SEQ ID NO: 676762 - RNA, 22 nt, Human
ugaacucuaauggugcuuuucu

SEQ ID NO: 676763 - RNA, 22 nt, Human
guucaaauucuaugaaauaugu

SEQ ID NO: 676764 - RNA, 21 nt, Human
ugcaggaaguauggugccuau

SEQ ID NO: 676765 - RNA, 19 nt, Human
gggguggcuggggcuccag

SEQ ID NO: 676766 - RNA, 22 nt, Human
uggagcauauucuggagcuugg

SEQ ID NO: 676767 - RNA, 22 nt, Human
ucacauuuguuccucugcacuu

SEQ ID NO: 676768 - RNA, 22 nt, Human
uuugaauguuuuagguacuuaa

SEQ ID NO: 676769 - RNA, 22 nt, Human
aagcaggcauuccagagacaau

SEQ ID NO: 676770 - RNA, 22 nt, Human
acaaggaccaugaggcagaccc

SEQ ID NO: 676771 - RNA, 22 nt, Human
acuucuaaucagaaggucuggu

SEQ ID NO: 676772 - RNA, 22 nt, Human
uaauaauuggcuaacccuggga

SEQ ID NO: 676773 - RNA, 22 nt, Human
aacagucacauuguucaacuuu

SEQ ID NO: 676774 - RNA, 22 nt, Human
uguauuuaauuguaucaucaca

SEQ ID NO: 676775 - RNA, 22 nt, Human
uaagagaauguuguggcuaggu

SEQ ID NO: 676776 - RNA, 22 nt, Human
uaugcuuuaacccucuuauauu

SEQ ID NO: 676777 - RNA, 22 nt, Human
caugcagggacuagagaacagg

SEQ ID NO: 676778 - RNA, 22 nt, Human
ggaacuccugcuccaagcagcu

SEQ ID NO: 676779 - RNA, 22 nt, Human
gagagcccugcuccuaucccag

SEQ ID NO: 676780 - RNA, 22 nt, Human
gggcagcugcagggauggugac

SEQ ID NO: 676781 - RNA, 22 nt, Human
acaggucagauaaaggcuggug

SEQ ID NO: 676782 - RNA, 22 nt, Human
ugcuuuggaucuauuugcugag

SEQ ID NO: 676783 - RNA, 22 nt, Human
cccaguggugcuggcaucugug

SEQ ID NO: 676784 - RNA, 22 nt, Human
gccucugcccuccugggacugc

SEQ ID NO: 676785 - RNA, 22 nt, Human
uccugggacaagccguggaagu

SEQ ID NO: 676786 - RNA, 22 nt, Human
uguucugcaagcccugccaccu

SEQ ID NO: 676787 - RNA, 22 nt, Human
uccuuaauaaguacuucauugu

SEQ ID NO: 676788 - RNA, 22 nt, Human
agauaucaccucuaggcuggug

SEQ ID NO: 676789 - RNA, 22 nt, Human
cuucucuaucuuuggcacauca

SEQ ID NO: 676790 - RNA, 22 nt, Human
uuggacuccucuuuccucuugg

SEQ ID NO: 676791 - RNA, 22 nt, Human
ucuuuagcuagaaauacucuaa

SEQ ID NO: 676792 - RNA, 20 nt, Human
aacacagauaccaaagguug

SEQ ID NO: 676793 - RNA, 22 nt, Human
cagugcuauuuggacacaggga

SEQ ID NO: 676794 - RNA, 22 nt, Human
uucugcugguguuuugugaggc

SEQ ID NO: 676795 - RNA, 22 nt, Human
uggcuucaucacucgggcugcc

SEQ ID NO: 676796 - RNA, 22 nt, Human
gauccugucuguggagucagca

SEQ ID NO: 676797 - RNA, 22 nt, Human
ugagagaaacguuccuuacauc

SEQ ID NO: 676798 - RNA, 22 nt, Human
aguuggagugaacaugagauug

SEQ ID NO: 676799 - RNA, 21 nt, Human
acagcuggccgcgcgggucgg

SEQ ID NO: 676800 - RNA, 22 nt, Human
uauuuacuguauuugaaguuga

SEQ ID NO: 676801 - RNA, 22 nt, Human
uacaaacuguccagcccagagg

SEQ ID NO: 676802 - RNA, 22 nt, Human
aggcaagggggcgccaccuucc

SEQ ID NO: 676803 - RNA, 22 nt, Human
gaauaacagcaaguuugcaggc

SEQ ID NO: 676804 - RNA, 22 nt, Human
auggagacgcaagggaccuagg

SEQ ID NO: 676805 - RNA, 22 nt, Human
guuauugagguggagucucacu

SEQ ID NO: 676806 - RNA, 21 nt, Human
aauggcuuauacagaaguaag

SEQ ID NO: 676807 - RNA, 22 nt, Human
ccuuggagacagguuugcuuuc

SEQ ID NO: 676808 - RNA, 22 nt, Human
uaugagcuuccaguguugcaug

SEQ ID NO: 676809 - RNA, 22 nt, Human
gaaauuuacaacuuucucaugg

SEQ ID NO: 676810 - RNA, 20 nt, Human
cugggcucgguggcccuggc

SEQ ID NO: 676811 - RNA, 22 nt, Human
gccaggcugccuuaucucuagc

SEQ ID NO: 676812 - RNA, 22 nt, Human
ccaggccuggccaggggaugcc

SEQ ID NO: 676813 - RNA, 19 nt, Human
uccuuccccccagcacaga

SEQ ID NO: 676814 - RNA, 22 nt, Human
ugugcucuugggcaauagcugc

SEQ ID NO: 676815 - RNA, 19 nt, Human
gcugagguggaggaaggag

SEQ ID NO: 676816 - RNA, 22 nt, Human
uagggcagauucgguggaguuu

SEQ ID NO: 676817 - RNA, 22 nt, Human
caagcagagaagucucuaggcu

SEQ ID NO: 676818 - RNA, 22 nt, Human
ugcugcaggcagccccucuacu

SEQ ID NO: 676819 - RNA, 22 nt, Human
uucaagcaccaaauuaguaggc

SEQ ID NO: 676820 - RNA, 22 nt, Human
aaacuguagugcuucgaucuga

SEQ ID NO: 676821 - RNA, 22 nt, Human
uuugaacagggaauguuccaca

SEQ ID NO: 676822 - RNA, 22 nt, Human
aacauucuuuggaggauuauuc

SEQ ID NO: 676823 - RNA, 22 nt, Human
ucugcguggcgugguucugugc

SEQ ID NO: 676824 - RNA, 18 nt, Human
guucaucuuuuucuaaag

SEQ ID NO: 676825 - RNA, 22 nt, Human
agcacugauuuuguugcacuua

SEQ ID NO: 676826 - RNA, 22 nt, Human
ucucccauucagcuugcaguca

SEQ ID NO: 676827 - RNA, 22 nt, Human
agcaaggcucggucagggugau

SEQ ID NO: 676828 - RNA, 22 nt, Human
aggugauaaguguuaaauaaag

SEQ ID NO: 676829 - RNA, 19 nt, Human
gcaugcuugguggcuucug

SEQ ID NO: 676830 - RNA, 22 nt, Human
ugugguggggucugguauucca

SEQ ID NO: 676831 - RNA, 22 nt, Human
ucauugcauuuauucacuggca

SEQ ID NO: 676832 - RNA, 22 nt, Human
ucaagauaccaccauuauaugu

SEQ ID NO: 676833 - RNA, 22 nt, Human
uccuccaggucuaggguggcuu

SEQ ID NO: 676834 - RNA, 22 nt, Human
aucaagaauugggagcuauuga

SEQ ID NO: 676835 - RNA, 22 nt, Human
aagccauuuguuguccuucagg

SEQ ID NO: 676836 - RNA, 22 nt, Human
aaaguuggauuucauccucaug

SEQ ID NO: 676837 - RNA, 22 nt, Human
ugggccacgugacccuuacccu

SEQ ID NO: 676838 - RNA, 22 nt, Human
uagcaacgguaugcaaucuguc

SEQ ID NO: 676839 - RNA, 18 nt, Human
ggaugcugugugcuccuu

SEQ ID NO: 676840 - RNA, 22 nt, Human
uaucucuugucuguuuugcaaa

SEQ ID NO: 676841 - RNA, 22 nt, Human
gugguaggcacagagaacaaga

SEQ ID NO: 676842 - RNA, 22 nt, Human
augugacaguguuugacagaug

SEQ ID NO: 676843 - RNA, 22 nt, Human
ucuggagaaucugucagugugg

SEQ ID NO: 676844 - RNA, 22 nt, Human
uaggugagguuacaagaguuca

SEQ ID NO: 676845 - RNA, 22 nt, Human
caguggugaagagcaggggcuc

SEQ ID NO: 676846 - RNA, 20 nt, Human
uccuaauaaccugaagaaau

SEQ ID NO: 676847 - RNA, 19 nt, Human
agcagccaucgaccaugga

SEQ ID NO: 676848 - RNA, 22 nt, Human
aagccgaggccacacagcagga

SEQ ID NO: 676849 - RNA, 22 nt, Human
uggcuucucccuccccaucuag

SEQ ID NO: 676850 - RNA, 22 nt, Human
agcugcuccuuggcugugguuc

SEQ ID NO: 676851 - RNA, 22 nt, Human
gguccguuuuugaagacagugg

SEQ ID NO: 676852 - RNA, 22 nt, Human
uggcugaguuccuggcacacgg

SEQ ID NO: 676853 - RNA, 22 nt, Human
augcaaaaacugcacuuacgcu

SEQ ID NO: 676854 - RNA, 22 nt, Human
guuaacaaauguaaagcaauua

SEQ ID NO: 676855 - RNA, 22 nt, Human
uaggcuuccgagucuugguauc

SEQ ID NO: 676856 - RNA, 22 nt, Human
cugggucuggaggccaagggug

SEQ ID NO: 676857 - RNA, 22 nt, Human
caaacuauuuacaauggaauca

SEQ ID NO: 676858 - RNA, 22 nt, Human
ucccaucaucuguucuggcuac

SEQ ID NO: 676859 - RNA, 20 nt, Human
ccccacacuauugagcacuu

SEQ ID NO: 676860 - RNA, 22 nt, Human
uuaccugguguuuaugguccau

SEQ ID NO: 676861 - RNA, 22 nt, Human
ccaggccugcauucccucucag

SEQ ID NO: 676862 - RNA, 22 nt, Human
caggcucuagguuaguaggaga

SEQ ID NO: 676863 - RNA, 22 nt, Human
agucuccuuaaauauuucccag

SEQ ID NO: 676864 - RNA, 22 nt, Human
uucagagaguuugugaguccuu

SEQ ID NO: 676865 - RNA, 22 nt, Human
uuucacagcgucuuucucuugc

SEQ ID NO: 676866 - RNA, 22 nt, Human
ugugaggccucugcaggagcag

SEQ ID NO: 676867 - RNA, 22 nt, Human
uaaaacuagaccgugagucuaa

SEQ ID NO: 676868 - RNA, 22 nt, Human
cagagacacuuaacaggaaugg

SEQ ID NO: 676869 - RNA, 22 nt, Human
gcuuacaggugaggcagcaaga

SEQ ID NO: 676870 - RNA, 22 nt, Human
aaggugcucguuauggccagug

SEQ ID NO: 676871 - RNA, 22 nt, Human
aggugcuguuggcagcgggcag

SEQ ID NO: 676872 - RNA, 22 nt, Human
gguccagguauguggugugaau

SEQ ID NO: 676873 - RNA, 21 nt, Human
gaucuuuacuuuccuacuuac

SEQ ID NO: 676874 - RNA, 22 nt, Human
cugugcaagacuuacuuuaaua

SEQ ID NO: 676875 - RNA, 22 nt, Human
cugccuggugcggugcccaccc

SEQ ID NO: 676876 - RNA, 22 nt, Human
gccacagguaggaaccuaccuc

SEQ ID NO: 676877 - RNA, 22 nt, Human
gacagcaguuuuucucuagggu

SEQ ID NO: 676878 - RNA, 22 nt, Human
uuaacauuaaaagcagcauuuu

SEQ ID NO: 676879 - RNA, 22 nt, Human
cagauggcugccaagaugggcu

SEQ ID NO: 676880 - RNA, 22 nt, Human
cuucauuggcuuccauagaugc

SEQ ID NO: 676881 - RNA, 22 nt, Human
agguccaggauuuguggggucu

SEQ ID NO: 676882 - RNA, 22 nt, Human
uuuaaugauagcuguuucacau

SEQ ID NO: 676883 - RNA, 20 nt, Human
cugugccuaaaccuccgggu

SEQ ID NO: 676884 - RNA, 19 nt, Human
agcuguggggccuagcacc

SEQ ID NO: 676885 - RNA, 20 nt, Human
agugggagagggcagacugc

SEQ ID NO: 676886 - RNA, 22 nt, Human
aggcacugaaagguggccagag

SEQ ID NO: 676887 - RNA, 22 nt, Human
ugcaggaacugggagggauagu

SEQ ID NO: 676888 - RNA, 22 nt, Human
augggggccugaacaggcaaaa

SEQ ID NO: 676889 - RNA, 22 nt, Human
auuucuucaggucagaaauaga

SEQ ID NO: 676890 - RNA, 22 nt, Human
gacuguuaccuauauuuaugug

SEQ ID NO: 676891 - RNA, 20 nt, Human
gcugaggucauuaugccuca

SEQ ID NO: 676892 - RNA, 22 nt, Human
uuacagaguagggaauugaagu

SEQ ID NO: 676893 - RNA, 22 nt, Human
aggaacugaugagcagccaggg

SEQ ID NO: 676894 - RNA, 23 nt, Human
ugccguguuagaaauguuuuaca

SEQ ID NO: 676895 - RNA, 22 nt, Human
cggggcagagggucuucuccag

SEQ ID NO: 676896 - RNA, 22 nt, Human
augagagacuguguguugggag

SEQ ID NO: 676897 - RNA, 22 nt, Human
ugaggauggcagugugcucagc

SEQ ID NO: 676898 - RNA, 22 nt, Human
ggggagaguccuuuccaguucc

SEQ ID NO: 676899 - RNA, 22 nt, Human
ucuggcuuggcgcugcccucug

SEQ ID NO: 676900 - RNA, 22 nt, Human
agccucucugaugugacagcua

SEQ ID NO: 676901 - RNA, 22 nt, Human
acucaguggcacuuuggaauuu

SEQ ID NO: 676902 - RNA, 22 nt, Human
cagaggguugaugugaggcuua

SEQ ID NO: 676903 - RNA, 22 nt, Human
uggcccugguggcacagccugc

SEQ ID NO: 676904 - RNA, 22 nt, Human
cugaagaggacgcagcagcaag

SEQ ID NO: 676905 - RNA, 22 nt, Human
uuggcuuccaggaucucagcag

SEQ ID NO: 676906 - RNA, 22 nt, Human
ucaagggaggagacacagcccu

SEQ ID NO: 676907 - RNA, 22 nt, Human
gugcugagaacaaaaguggaca

SEQ ID NO: 676908 - RNA, 22 nt, Human
cacagcaggcagaacgugggca

SEQ ID NO: 676909 - RNA, 21 nt, Human
uagaaagucaaagcuaucagc

SEQ ID NO: 676910 - RNA, 22 nt, Human
ggucucuguuuggggcuggcaa

SEQ ID NO: 676911 - RNA, 22 nt, Human
aucauguucaucguauuuaggc

SEQ ID NO: 676912 - RNA, 22 nt, Human
acugugggacaucccucccuau

SEQ ID NO: 676913 - RNA, 22 nt, Human
aggaauuuuucuagccggaguu

SEQ ID NO: 676914 - RNA, 22 nt, Human
uggcugugugccaggcugucug

SEQ ID NO: 676915 - RNA, 22 nt, Human
uggcaauuguccacugucugcc

SEQ ID NO: 676916 - RNA, 22 nt, Human
aggauucuguaaucugugaaau

SEQ ID NO: 676917 - RNA, 22 nt, Human
ccucaaagcgguaugcagacgg

SEQ ID NO: 676918 - RNA, 22 nt, Human
uauacagugccucuuccauuag

SEQ ID NO: 676919 - RNA, 22 nt, Human
uggguccuggcuuugucagggu

SEQ ID NO: 676920 - RNA, 22 nt, Human
gggggaagacugggcuagugau

SEQ ID NO: 676921 - RNA, 22 nt, Human
acagaaaaaugagggagcugga

SEQ ID NO: 676922 - RNA, 22 nt, Human
caggcacuucugcugcuugucu

SEQ ID NO: 676923 - RNA, 22 nt, Human
ggguccaccugagcagcagccu

SEQ ID NO: 676924 - RNA, 22 nt, Human
gguuucaaaguggacaguuagu

SEQ ID NO: 676925 - RNA, 22 nt, Human
agugagacaguauacugagcag

SEQ ID NO: 676926 - RNA, 22 nt, Human
ugauuugcgucucauuugaaau

SEQ ID NO: 676927 - RNA, 22 nt, Human
cgcuuuaacgugagaagaaggg

SEQ ID NO: 676928 - RNA, 22 nt, Human
agcugucuaccugcagaguccu

SEQ ID NO: 676929 - RNA, 22 nt, Human
uguccugugccaccuuccugag

SEQ ID NO: 676930 - RNA, 22 nt, Human
cuuggugcauuacucaaucugu

SEQ ID NO: 676931 - RNA, 22 nt, Human
gauggcuugcuuagugacagca

SEQ ID NO: 676932 - RNA, 22 nt, Human
gucuccagggcugcuggcgccu

SEQ ID NO: 676933 - RNA, 22 nt, Human
uaaaggauuuuguauaauauaa

SEQ ID NO: 676934 - RNA, 22 nt, Human
ugucagugucuaugaagaauuu

SEQ ID NO: 676935 - RNA, 22 nt, Human
ggaccugccagaacucaggcua

SEQ ID NO: 676936 - RNA, 22 nt, Human
acuugccauaaaugaaaauacu

SEQ ID NO: 676937 - RNA, 22 nt, Human
ugugaguucuuagaaagucagu

SEQ ID NO: 676938 - RNA, 22 nt, Human
acaccagggccuagccagggcg

SEQ ID NO: 676939 - RNA, 22 nt, Human
acaagccaauuacugugccagg

SEQ ID NO: 676940 - RNA, 22 nt, Human
cugggcaguuuacauuccuacc

SEQ ID NO: 676941 - RNA, 22 nt, Human
cuuuguuuuacucagaggcaug

SEQ ID NO: 676942 - RNA, 19 nt, Human
gcaggguguugacuguccc

SEQ ID NO: 676943 - RNA, 22 nt, Human
agaggccagguccagaguuugu

SEQ ID NO: 676944 - RNA, 22 nt, Human
uccaggccucuagccccuaucu

SEQ ID NO: 676945 - RNA, 22 nt, Human
uagagcauuuagaggggcagga

SEQ ID NO: 676946 - RNA, 22 nt, Human
gagagcugcagccgagaggggg

SEQ ID NO: 676947 - RNA, 22 nt, Human
agauuuacaaaggauuugcuuu

SEQ ID NO: 676948 - RNA, 23 nt, Human
augaaacaucacaaugguaccau

SEQ ID NO: 676949 - RNA, 22 nt, Human
cauggccucucuccuggaaugg

SEQ ID NO: 676950 - RNA, 22 nt, Human
acagcauuuaaagaaaaugaac

SEQ ID NO: 676951 - RNA, 21 nt, Human
uggcucugagccucauggcug

SEQ ID NO: 676952 - RNA, 22 nt, Human
uccaucuggagacuuccugguc

SEQ ID NO: 676953 - RNA, 22 nt, Human
uguggggcuuacaaaggcagau

SEQ ID NO: 676954 - RNA, 22 nt, Human
aggcagugcucaagacagcagc

SEQ ID NO: 676955 - RNA, 22 nt, Human
aaugcuguugaguuguuccugu

SEQ ID NO: 676956 - RNA, 22 nt, Human
uaaaaaucuuaugaauggcaag

SEQ ID NO: 676957 - RNA, 22 nt, Human
ccuucugcucccuggccagggc

SEQ ID NO: 676958 - RNA, 22 nt, Human
ucauguuuuaguaaagugaagg

SEQ ID NO: 676959 - RNA, 22 nt, Human
caggguugggguagauaagaaa

SEQ ID NO: 676960 - RNA, 21 nt, Human
agaauucuuaaguauucuaau

SEQ ID NO: 676961 - RNA, 22 nt, Human
cugccugcuuaccaugcaucag

SEQ ID NO: 676962 - RNA, 22 nt, Human
uagacuuuccagccugcugcuu

SEQ ID NO: 676963 - RNA, 22 nt, Human
aaaccuuucucagugcuaaaau

SEQ ID NO: 676964 - RNA, 22 nt, Human
uauagcaaaguacuaccaacuc

SEQ ID NO: 676965 - RNA, 22 nt, Human
cuggcccuucucuugcuuccug

SEQ ID NO: 676966 - RNA, 22 nt, Human
acaggcuggugguccuggccau

SEQ ID NO: 676967 - RNA, 22 nt, Human
auugucugaauccaaagcucug

SEQ ID NO: 676968 - RNA, 22 nt, Human
uacacuaauguuuuugcaaagc

SEQ ID NO: 676969 - RNA, 22 nt, Human
acucauuuaaacauuuacugaa

SEQ ID NO: 676970 - RNA, 22 nt, Human
uuauuagaucuguuagggaucc

SEQ ID NO: 676971 - RNA, 22 nt, Human
cugggaccagugaagcaacuca

SEQ ID NO: 676972 - RNA, 22 nt, Human
uuuuugucaucuauuucuggug

SEQ ID NO: 676973 - RNA, 22 nt, Human
augauaacaacagcagugcugg

SEQ ID NO: 676974 - RNA, 22 nt, Human
ggugagaggcagugcuguggaa

SEQ ID NO: 676975 - RNA, 22 nt, Human
ugcagcucauugguguccuggu

SEQ ID NO: 676976 - RNA, 22 nt, Human
ugccaaauuagaguucccaggc

SEQ ID NO: 676977 - RNA, 22 nt, Human
gccucagguaaaacuugaguuu

SEQ ID NO: 676978 - RNA, 22 nt, Human
cagcuucuagcaucggcuuuga

SEQ ID NO: 676979 - RNA, 21 nt, Human
cagcuccacuaaagcagcugu

SEQ ID NO: 676980 - RNA, 22 nt, Human
ggagccaggcauaucggggcac

SEQ ID NO: 676981 - RNA, 19 nt, Human
gagcacagcggcauuuggu

SEQ ID NO: 676982 - RNA, 22 nt, Human
ucccuccauaacagaggugagc

SEQ ID NO: 676983 - RNA, 17 nt, Human
agacugaggacacagga

SEQ ID NO: 676984 - RNA, 22 nt, Human
auaaccuggauauaaacagaug

SEQ ID NO: 676985 - RNA, 22 nt, Human
gggcugagcacauacugacagc

SEQ ID NO: 676986 - RNA, 22 nt, Human
guguuuccuaguuuaaugaaug

SEQ ID NO: 676987 - RNA, 22 nt, Human
cuucucucugcauaggcauggg

SEQ ID NO: 676988 - RNA, 22 nt, Human
gugcauuaacaacccagaacuc

SEQ ID NO: 676989 - RNA, 22 nt, Human
cacaagagagugcgcguugcaa

SEQ ID NO: 676990 - RNA, 22 nt, Human
acaauuuauccauuguauaguu

SEQ ID NO: 676991 - RNA, 18 nt, Human
uccuucacagcaggaagg

SEQ ID NO: 676992 - RNA, 22 nt, Human
ugguggcagucuccuggcugug

SEQ ID NO: 676993 - RNA, 22 nt, Human
guaggaaagggagugaagggaa

SEQ ID NO: 676994 - RNA, 22 nt, Human
augugagaacucaggaaauacu

SEQ ID NO: 676995 - RNA, 22 nt, Human
gggaugaggaucaaucagggag

SEQ ID NO: 676996 - RNA, 22 nt, Human
gaggcagcugggcuggugguuu

SEQ ID NO: 676997 - RNA, 22 nt, Human
uauguguauugagcauuguuac

SEQ ID NO: 676998 - RNA, 22 nt, Human
ccugaguaacauggugagaacc

SEQ ID NO: 676999 - RNA, 17 nt, Human
ugcauuguuggaaauuu

SEQ ID NO: 677000 - RNA, 22 nt, Human
uacagagggauuaucuaagggu

SEQ ID NO: 677001 - RNA, 22 nt, Human
auugcuuucuuuggggaacugu

SEQ ID NO: 677002 - RNA, 21 nt, Human
cucacaggaugcaguguuacu

SEQ ID NO: 677003 - RNA, 22 nt, Human
aagugcuugaucauaguucuca

SEQ ID NO: 677004 - RNA, 22 nt, Human
uggcuucaaagguagcauacaa

SEQ ID NO: 677005 - RNA, 22 nt, Human
cucugggguggaggaggcugac

SEQ ID NO: 677006 - RNA, 22 nt, Human
guuagggaucaggaacaagagc

SEQ ID NO: 677007 - RNA, 20 nt, Human
aguggccacugcagagaugc

SEQ ID NO: 677008 - RNA, 22 nt, Human
uacaaagauggaagguuauguu

SEQ ID NO: 677009 - RNA, 22 nt, Human
cuucagcugcaguuauguuuag

SEQ ID NO: 677010 - RNA, 22 nt, Human
uagugcuuuaaguuuacagaga

SEQ ID NO: 677011 - RNA, 22 nt, Human
ucccaggguccucuucuggaau

SEQ ID NO: 677012 - RNA, 22 nt, Human
uuggaaggguuucaguuagucu

SEQ ID NO: 677013 - RNA, 22 nt, Human
gaaauuauugcuagagacugca

SEQ ID NO: 677014 - RNA, 17 nt, Human
gacugagguaaggugag

SEQ ID NO: 677015 - RNA, 22 nt, Human
aacacugguucugacuacacag

SEQ ID NO: 677016 - RNA, 22 nt, Human
ugaagcaggaaacuucuuguuu

SEQ ID NO: 677017 - RNA, 21 nt, Human
gauuaaauuuaagcuacaugc

SEQ ID NO: 677018 - RNA, 22 nt, Human
cacagggaaccaaggcugggcc

SEQ ID NO: 677019 - RNA, 22 nt, Human
aacagaauaucaaaagauuaug

SEQ ID NO: 677020 - RNA, 22 nt, Human
acaggaagugcuggcacuuaca

SEQ ID NO: 677021 - RNA, 22 nt, Human
ugucuuuacuuaauaaauauac

SEQ ID NO: 677022 - RNA, 22 nt, Human
aagccaugguagaaaacucagu

SEQ ID NO: 677023 - RNA, 22 nt, Human
uguuaaaaauucagcucuagau

SEQ ID NO: 677024 - RNA, 21 nt, Human
ccuggacuaaaaccaggccac

SEQ ID NO: 677025 - RNA, 22 nt, Human
gguuggugagugcaggguguua

SEQ ID NO: 677026 - RNA, 22 nt, Human
acccucagacauauuccaucau

SEQ ID NO: 677027 - RNA, 22 nt, Human
gcugccugcacagagcugcuuu

SEQ ID NO: 677028 - RNA, 22 nt, Human
gugccagggggcacugaacaga

SEQ ID NO: 677029 - RNA, 22 nt, Human
uauaauccugcuucacauugaa

SEQ ID NO: 677030 - RNA, 21 nt, Human
uucugcuguucaccaccaccc

SEQ ID NO: 677031 - RNA, 22 nt, Human
acugucuuguuccaagacuaaa

SEQ ID NO: 677032 - RNA, 22 nt, Human
cuaggccacagggcaaaaagga

SEQ ID NO: 677033 - RNA, 22 nt, Human
uuuguacacaggauguuauaau

SEQ ID NO: 677034 - RNA, 22 nt, Human
uggauauccuuguuaacuuucu

SEQ ID NO: 677035 - RNA, 22 nt, Human
cagcacaggucaguuuuuuaag

SEQ ID NO: 677036 - RNA, 22 nt, Human
ggcugccugguuuagugcugac

SEQ ID NO: 677037 - RNA, 22 nt, Human
gucucuaucauagcugaacccu

SEQ ID NO: 677038 - RNA, 20 nt, Human
ggccggggagcucuccaggg

SEQ ID NO: 677039 - RNA, 22 nt, Human
uucuggcuuuacuucccaucca

SEQ ID NO: 677040 - RNA, 22 nt, Human
agucccagcucugccacuuacu

SEQ ID NO: 677041 - RNA, 22 nt, Human
uggaacaagggcguggcggucg

SEQ ID NO: 677042 - RNA, 22 nt, Human
uugcaaauucauggaucugaau

SEQ ID NO: 677043 - RNA, 22 nt, Human
agacaauuguucuaaguaaaaa

SEQ ID NO: 677044 - RNA, 22 nt, Human
auucaaguacaguuuucuucuu

SEQ ID NO: 677045 - RNA, 22 nt, Human
uuagggacaaauuugcagaacc

SEQ ID NO: 677046 - RNA, 22 nt, Human
gcuggagaccucagagaaccca

SEQ ID NO: 677047 - RNA, 22 nt, Human
augcacacaagcuuauguauua

SEQ ID NO: 677048 - RNA, 22 nt, Human
gagagccaugguggagaugggg

SEQ ID NO: 677049 - RNA, 22 nt, Human
ucccuccugcaugaggcucggc

SEQ ID NO: 677050 - RNA, 22 nt, Human
ggagaggauguuuuaguaacuu

SEQ ID NO: 677051 - RNA, 22 nt, Human
auuucucuuccuccuaggguug

SEQ ID NO: 677052 - RNA, 22 nt, Human
ugcuucuagacacugcaauuga

SEQ ID NO: 677053 - RNA, 22 nt, Human
cagagcugcacauucuaugaug

SEQ ID NO: 677054 - RNA, 22 nt, Human
ggaguggccacgacugggagau

SEQ ID NO: 677055 - RNA, 22 nt, Human
ucagcugggaaguucucgcuug

SEQ ID NO: 677056 - RNA, 23 nt, Human
ucacugugcccauugagguagag

SEQ ID NO: 677057 - RNA, 22 nt, Human
acucacuuuccauucaagcacc

SEQ ID NO: 677058 - RNA, 22 nt, Human
agcaggaaagaaaaaucugugu

SEQ ID NO: 677059 - RNA, 22 nt, Human
gcuccuggagagauugagaaag

SEQ ID NO: 677060 - RNA, 22 nt, Human
caagcuggcugggagaggcacg

SEQ ID NO: 677061 - RNA, 22 nt, Human
gaucuuuucagucuugguaguu

SEQ ID NO: 677062 - RNA, 22 nt, Human
agcccuuaguacauuucucaag

SEQ ID NO: 677063 - RNA, 22 nt, Human
ucccuguggcuaagacaugaca

SEQ ID NO: 677064 - RNA, 20 nt, Human
ucaggaugugcugagugaag

SEQ ID NO: 677065 - RNA, 22 nt, Human
ugguagcaacaucucaguggcu

SEQ ID NO: 677066 - RNA, 19 nt, Human
uccugggcugcgucuugcc

SEQ ID NO: 677067 - RNA, 22 nt, Human
uccuccagaaacugaggcagaa

SEQ ID NO: 677068 - RNA, 22 nt, Human
ucugggcagccucaggccaggg

SEQ ID NO: 677069 - RNA, 22 nt, Human
cagggccagccgcagcauccac

SEQ ID NO: 677070 - RNA, 22 nt, Human
agugaauuuaaaacacugagga

SEQ ID NO: 677071 - RNA, 22 nt, Human
agaccugugaucacauggaaug

SEQ ID NO: 677072 - RNA, 22 nt, Human
aacuguaagacaaaugacuucu

SEQ ID NO: 677073 - RNA, 22 nt, Human
gaaggagacccugaagaugcug

SEQ ID NO: 677074 - RNA, 22 nt, Human
ucugggugcuacaaacaguauu

SEQ ID NO: 677075 - RNA, 22 nt, Human
gugucccaggccucuggaauua

SEQ ID NO: 677076 - RNA, 22 nt, Human
aauugacaaaucauacuuguau

SEQ ID NO: 677077 - RNA, 22 nt, Human
cagugcaaacucccugaggugg

SEQ ID NO: 677078 - RNA, 22 nt, Human
ugcuggaauuuugcucuugcaa

SEQ ID NO: 677079 - RNA, 22 nt, Human
uagaaucauugagaauaacagg

SEQ ID NO: 677080 - RNA, 22 nt, Human
acaaugucaaaauaggaaacau

SEQ ID NO: 677081 - RNA, 22 nt, Human
gaggggaaagugugaggcugcg

SEQ ID NO: 677082 - RNA, 19 nt, Human
gcauaaaaugucaaugugu

SEQ ID NO: 677083 - RNA, 22 nt, Human
uacauagcaaggaaaugacaga

SEQ ID NO: 677084 - RNA, 22 nt, Human
ugggggugaaagucuggacagu

SEQ ID NO: 677085 - RNA, 22 nt, Human
aggaaggcaugagguguucaca

SEQ ID NO: 677086 - RNA, 20 nt, Human
uuugcuguggguguaagaau

SEQ ID NO: 677087 - RNA, 22 nt, Human
gcugccugaaugaaccuuguuc

SEQ ID NO: 677088 - RNA, 22 nt, Human
uggcauggcaacccugcaggga

SEQ ID NO: 677089 - RNA, 19 nt, Human
ccuuccccuucagccucug

SEQ ID NO: 677090 - RNA, 19 nt, Human
acuguguggaagugugauu

SEQ ID NO: 677091 - RNA, 23 nt, Human
ggagaucagagacuagggcaguu

SEQ ID NO: 677092 - RNA, 22 nt, Human
ccauugaaggcacuugagcaga

SEQ ID NO: 677093 - RNA, 22 nt, Human
uacccaggagaaacagcagggc

SEQ ID NO: 677094 - RNA, 22 nt, Human
auguacaaaaugccacugaauu

SEQ ID NO: 677095 - RNA, 22 nt, Human
uuucauugaacuaaagaaucug

SEQ ID NO: 677096 - RNA, 22 nt, Human
agagguuucuuaggggcuuccu

SEQ ID NO: 677097 - RNA, 22 nt, Human
cuuguacaucacuggcagaugg

SEQ ID NO: 677098 - RNA, 22 nt, Human
agugaauauuuuuagacaccca

SEQ ID NO: 677099 - RNA, 22 nt, Human
uuguagacaucuguaucauuuu

SEQ ID NO: 677100 - RNA, 22 nt, Human
gccacagcuuuuaaccucgggg

SEQ ID NO: 677101 - RNA, 22 nt, Human
cuguuuauugagcaaucugcca

SEQ ID NO: 677102 - RNA, 22 nt, Human
uuucugcugugcuuucuugcgu

SEQ ID NO: 677103 - RNA, 23 nt, Human
gaagucagcccuacagagagcag

SEQ ID NO: 677104 - RNA, 22 nt, Human
ucugcugccugcagggcagaga

SEQ ID NO: 677105 - RNA, 22 nt, Human
aggagccaguuccaccccagga

SEQ ID NO: 677106 - RNA, 20 nt, Human
aggcucagauacccagggaa

SEQ ID NO: 677107 - RNA, 22 nt, Human
auuccagugugcuuccuugcua

SEQ ID NO: 677108 - RNA, 22 nt, Human
cugcccaccgugugcacgugcg

SEQ ID NO: 677109 - RNA, 22 nt, Human
gcagcugauggaaguccuauug

SEQ ID NO: 677110 - RNA, 20 nt, Human
guaaaauauggucuuugggu

SEQ ID NO: 677111 - RNA, 22 nt, Human
agaccacagucaggcuccuggu

SEQ ID NO: 677112 - RNA, 22 nt, Human
uugcucaggcuggugugcagug

SEQ ID NO: 677113 - RNA, 22 nt, Human
cugugacaguuucucagacuuu

SEQ ID NO: 677114 - RNA, 22 nt, Human
cugucacuuaaauucaggcuga

SEQ ID NO: 677115 - RNA, 20 nt, Human
acaauuuccucacuauaugc

SEQ ID NO: 677116 - RNA, 22 nt, Human
ccccuucuguguccugucagcc

SEQ ID NO: 677117 - RNA, 22 nt, Human
gugaacaaaauagcacauauua

SEQ ID NO: 677118 - RNA, 22 nt, Human
gucucccacuuucuggccucuu

SEQ ID NO: 677119 - RNA, 22 nt, Human
guggucagccccggugagcccu

SEQ ID NO: 677120 - RNA, 22 nt, Human
aggcuuuacugccucaggacuc

SEQ ID NO: 677121 - RNA, 22 nt, Human
ucugaagaacugucuagagaac

SEQ ID NO: 677122 - RNA, 22 nt, Human
ccugacgaaaggcgugcuggag

SEQ ID NO: 677123 - RNA, 20 nt, Human
agugacagagacuguguggc

SEQ ID NO: 677124 - RNA, 22 nt, Human
ugucuugucugugagggcauug

SEQ ID NO: 677125 - RNA, 22 nt, Human
aggacaauuagucuggcuuggc

SEQ ID NO: 677126 - RNA, 22 nt, Human
caguggcuguuucuggaaggca

SEQ ID NO: 677127 - RNA, 22 nt, Human
gguggccuccagggcauaggug

SEQ ID NO: 677128 - RNA, 22 nt, Human
agggugcaaaagcaaggacagu

SEQ ID NO: 677129 - RNA, 22 nt, Human
ggagggcuguagaggagaccug

SEQ ID NO: 677130 - RNA, 22 nt, Human
cuuucagucaguuaacucagaa

SEQ ID NO: 677131 - RNA, 22 nt, Human
gcaaggacucccugggucauuc

SEQ ID NO: 677132 - RNA, 22 nt, Human
ucaaaguuuuugagaauuacau

SEQ ID NO: 677133 - RNA, 22 nt, Human
cagcacagaguauuuuauugau

SEQ ID NO: 677134 - RNA, 19 nt, Human
gcugcuggcucuggcugga

SEQ ID NO: 677135 - RNA, 22 nt, Human
guacagauuaauaauauacuga

SEQ ID NO: 677136 - RNA, 22 nt, Human
cuguuggagucauuccuuccag

SEQ ID NO: 677137 - RNA, 19 nt, Human
agagaccacagagcugccu

SEQ ID NO: 677138 - RNA, 22 nt, Human
aaauagcugaaaguuccuagau

SEQ ID NO: 677139 - RNA, 22 nt, Human
aguguuccacacaucuggggaa

SEQ ID NO: 677140 - RNA, 22 nt, Human
uacauuuauaaggcuucucugu

SEQ ID NO: 677141 - RNA, 22 nt, Human
guguguggcaaacugggccugc

SEQ ID NO: 677142 - RNA, 22 nt, Human
gugggcuucccuuaagccagag

SEQ ID NO: 677143 - RNA, 22 nt, Human
aauaaauguuuguuggauguuu

SEQ ID NO: 677144 - RNA, 22 nt, Human
uuagagucaaaauggcauguua

SEQ ID NO: 677145 - RNA, 21 nt, Human
ucagcaaaauaagcaaaugga

SEQ ID NO: 677146 - RNA, 22 nt, Human
ugaggccagacugaaaccaaca

SEQ ID NO: 677147 - RNA, 22 nt, Human
cagcaugguggagcugcucuuu

SEQ ID NO: 677148 - RNA, 22 nt, Human
cuugacaacuggcagauauaua

SEQ ID NO: 677149 - RNA, 22 nt, Human
cucucaaaugucauuccucuau

SEQ ID NO: 677150 - RNA, 22 nt, Human
ugcucuguaacaaauugacaug

SEQ ID NO: 677151 - RNA, 22 nt, Human
ccuggcuucugggucugugaga

SEQ ID NO: 677152 - RNA, 22 nt, Human
ccucauggaccucagacugucc

SEQ ID NO: 677153 - RNA, 22 nt, Human
cggggcugcgcucuuccugccg

SEQ ID NO: 677154 - RNA, 22 nt, Human
gaauucugguccuguccaaggu

SEQ ID NO: 677155 - RNA, 22 nt, Human
ucugccgugcgaggucccacca

SEQ ID NO: 677156 - RNA, 22 nt, Human
uggaguuagauaaaccugggua

SEQ ID NO: 677157 - RNA, 21 nt, Human
gacaaagugaagcaggcagga

SEQ ID NO: 677158 - RNA, 19 nt, Human
ggcggguggacuggagccc

SEQ ID NO: 677159 - RNA, 22 nt, Human
agccccucuguagcuaauagua

SEQ ID NO: 677160 - RNA, 22 nt, Human
aaguauauuuuuugaagcauau

SEQ ID NO: 677161 - RNA, 22 nt, Human
guguggcugccagccaagaggc

SEQ ID NO: 677162 - RNA, 22 nt, Human
ucaaacagaggaacaauuguuu

SEQ ID NO: 677163 - RNA, 20 nt, Human
aggcucagagcaguaguaca

SEQ ID NO: 677164 - RNA, 22 nt, Human
guucccaccccugagcuccgau

SEQ ID NO: 677165 - RNA, 22 nt, Human
gcaguaaaaaaggauaugugca

SEQ ID NO: 677166 - RNA, 21 nt, Human
acaggcaaauuuuagacaaug

SEQ ID NO: 677167 - RNA, 22 nt, Human
aaaggucauugaaaaggaggaa

SEQ ID NO: 677168 - RNA, 22 nt, Human
aagaauucacugguagagucaa

SEQ ID NO: 677169 - RNA, 22 nt, Human
aacuuucuuugcaucuaaguuu

SEQ ID NO: 677170 - RNA, 23 nt, Human
gagagagauugcuaaaccacucc

SEQ ID NO: 677171 - RNA, 22 nt, Human
cuggcuggcagaugcucuugcu

SEQ ID NO: 677172 - RNA, 22 nt, Human
ggacacuguauaaguuagagua

SEQ ID NO: 677173 - RNA, 22 nt, Human
cugugacuuccacuacugauca

SEQ ID NO: 677174 - RNA, 22 nt, Human
aguugaagguuggcugauccau

SEQ ID NO: 677175 - RNA, 22 nt, Human
gaagccaagccagcugauggag

SEQ ID NO: 677176 - RNA, 22 nt, Human
uugggaaacaguauagcuaaca

SEQ ID NO: 677177 - RNA, 22 nt, Human
ugaaugauaugugaaaaggaac

SEQ ID NO: 677178 - RNA, 20 nt, Human
acuggagccaucucagccua

SEQ ID NO: 677179 - RNA, 22 nt, Human
agccuucucugaaauucuguuu

SEQ ID NO: 677180 - RNA, 22 nt, Human
ucucuucuaauuaggguccaug

SEQ ID NO: 677181 - RNA, 22 nt, Human
caggaacaccugcagcuagugg

SEQ ID NO: 677182 - RNA, 22 nt, Human
uuaaagccaucuagauuuugag

SEQ ID NO: 677183 - RNA, 20 nt, Human
ugaauagagagcacauaugc

SEQ ID NO: 677184 - RNA, 22 nt, Human
ucucuuuaaagacucagagauu

SEQ ID NO: 677185 - RNA, 22 nt, Human
uuccagaggagugauucagagg

SEQ ID NO: 677186 - RNA, 22 nt, Human
aggagccauuuuccaagggcga

SEQ ID NO: 677187 - RNA, 21 nt, Human
uacaugaguguaugagcauau

SEQ ID NO: 677188 - RNA, 22 nt, Human
augugucuagauugcuguaccg

SEQ ID NO: 677189 - RNA, 22 nt, Human
ugcuuauugcuuucaagacugu

SEQ ID NO: 677190 - RNA, 22 nt, Human
gaaggcugaguggguacggagg

SEQ ID NO: 677191 - RNA, 22 nt, Human
gaauuuaucuacguuaaguaug

SEQ ID NO: 677192 - RNA, 19 nt, Human
gcugcagcagagaaacugg

SEQ ID NO: 677193 - RNA, 22 nt, Human
uugacaaagauauauucaugcu

SEQ ID NO: 677194 - RNA, 22 nt, Human
acauagcucagcauaaucgugg

SEQ ID NO: 677195 - RNA, 22 nt, Human
cuauuuaugugcuauuuuguau

SEQ ID NO: 677196 - RNA, 22 nt, Human
agucacugcuuugucccugugu

SEQ ID NO: 677197 - RNA, 22 nt, Human
agggucuguauuucuggcaagc

SEQ ID NO: 677198 - RNA, 22 nt, Human
gguguuaacuuguuuaugacaa

SEQ ID NO: 677199 - RNA, 21 nt, Human
gggccacaccuucugcagacc

SEQ ID NO: 677200 - RNA, 21 nt, Human
uuccuggaggcagaaacguga

SEQ ID NO: 677201 - RNA, 22 nt, Human
ccucagaacggaaaugguuuug

SEQ ID NO: 677202 - RNA, 22 nt, Human
auucagcaaugagcuuggauuu

SEQ ID NO: 677203 - RNA, 22 nt, Human
auguuuaugaccuccauaagga

SEQ ID NO: 677204 - RNA, 17 nt, Human
uugagucuggggucuac

SEQ ID NO: 677205 - RNA, 18 nt, Human
agggagcaucugguugcc

SEQ ID NO: 677206 - RNA, 22 nt, Human
ugucaauaguuuugaguucucu

SEQ ID NO: 677207 - RNA, 23 nt, Human
ugauucugcuuugagaaucaugg

SEQ ID NO: 677208 - RNA, 22 nt, Human
agucacauuugggggugucaaa

SEQ ID NO: 677209 - RNA, 19 nt, Human
uucuaccuuacuguaggcu

SEQ ID NO: 677210 - RNA, 22 nt, Human
cuucccuucugugcagggcaga

SEQ ID NO: 677211 - RNA, 22 nt, Human
acaccaugaugagugauguagc

SEQ ID NO: 677212 - RNA, 22 nt, Human
gagaaggcuggucuuaagucga

SEQ ID NO: 677213 - RNA, 22 nt, Human
gagccaggagauaccuaagggg

SEQ ID NO: 677214 - RNA, 22 nt, Human
ucuggaguggagcugaucauuu

SEQ ID NO: 677215 - RNA, 22 nt, Human
gcgcucagaaaagauuuucuuc

SEQ ID NO: 677216 - RNA, 22 nt, Human
aagggccauugcugagagcagu

SEQ ID NO: 677217 - RNA, 22 nt, Human
acaugugaggugugagugauac

SEQ ID NO: 677218 - RNA, 23 nt, Human
caacacugccuucaggugaagaa

SEQ ID NO: 677219 - RNA, 22 nt, Human
gacuuuauucguuaacuguuaa

SEQ ID NO: 677220 - RNA, 22 nt, Human
ugagcaggcgcagcaggagguc

SEQ ID NO: 677221 - RNA, 22 nt, Human
uuugauucuguaaaauaacagg

SEQ ID NO: 677222 - RNA, 22 nt, Human
auucuucacaaauauauagaag

SEQ ID NO: 677223 - RNA, 22 nt, Human
uuaguacaagagauuaauuacu

SEQ ID NO: 677224 - RNA, 22 nt, Human
uccagcuucuugacuugguggu

SEQ ID NO: 677225 - RNA, 22 nt, Human
cuucaagauauuucuagaauca

SEQ ID NO: 677226 - RNA, 22 nt, Human
gugccagagaugacaggccugc

SEQ ID NO: 677227 - RNA, 22 nt, Human
uacaucaugaaagcauacauca

SEQ ID NO: 677228 - RNA, 22 nt, Human
cugccugcucaccagggcucug

SEQ ID NO: 677229 - RNA, 22 nt, Human
cuuguacacucaguacuucuag

SEQ ID NO: 677230 - RNA, 22 nt, Human
uagugccaccuuccaaguauca

SEQ ID NO: 677231 - RNA, 22 nt, Human
ucucccacugcaagcccaggcu

SEQ ID NO: 677232 - RNA, 22 nt, Human
cagaggaaggcucugggaaugu

SEQ ID NO: 677233 - RNA, 22 nt, Human
ccuguuuacaucaucaaggacu

SEQ ID NO: 677234 - RNA, 22 nt, Human
uuaguuuucucaucuaucucac

SEQ ID NO: 677235 - RNA, 22 nt, Human
ugcuggggguucagaugaguaa

SEQ ID NO: 677236 - RNA, 22 nt, Human
ccaggcccugcuccucacacca

SEQ ID NO: 677237 - RNA, 22 nt, Human
aaaugcuguguuuuaacauaga

SEQ ID NO: 677238 - RNA, 22 nt, Human
ccugccacuucuugcuauggag

SEQ ID NO: 677239 - RNA, 22 nt, Human
uaguagcaggaaucugaaggua

SEQ ID NO: 677240 - RNA, 22 nt, Human
gguggcaguggucucugacaga

SEQ ID NO: 677241 - RNA, 22 nt, Human
gaggggauuggaaggaacaccc

SEQ ID NO: 677242 - RNA, 22 nt, Human
ugacagcauaacacuggucuug

SEQ ID NO: 677243 - RNA, 21 nt, Human
cucuuuauauaguaaagauau

SEQ ID NO: 677244 - RNA, 23 nt, Human
cagcagagagcagaccuuugugu

SEQ ID NO: 677245 - RNA, 22 nt, Human
uggaaauguuucuugagcucag

SEQ ID NO: 677246 - RNA, 22 nt, Human
aggacaugugccuccagggcag

SEQ ID NO: 677247 - RNA, 17 nt, Human
cucuguggagguguuua

SEQ ID NO: 677248 - RNA, 22 nt, Human
cugggauccacgggcucccaag

SEQ ID NO: 677249 - RNA, 22 nt, Human
gaaaccugagugcagaucagga

SEQ ID NO: 677250 - RNA, 22 nt, Human
gggaacuguuuaacagggguuu

SEQ ID NO: 677251 - RNA, 22 nt, Human
aguaacagaaggccugacuuaa

SEQ ID NO: 677252 - RNA, 22 nt, Human
gaaagaguaugggagcuuuacu

SEQ ID NO: 677253 - RNA, 22 nt, Human
aacaaacucaaauggaagagug

SEQ ID NO: 677254 - RNA, 22 nt, Human
acaaaggcagccaaucaucugc

SEQ ID NO: 677255 - RNA, 22 nt, Human
ggcagcaaauauugucagcugu

SEQ ID NO: 677256 - RNA, 18 nt, Human
uucagcagcagacacacu

SEQ ID NO: 677257 - RNA, 22 nt, Human
ugugggaaguuuggagggaaag

SEQ ID NO: 677258 - RNA, 22 nt, Human
uauuucagguauggugugaaau

SEQ ID NO: 677259 - RNA, 22 nt, Human
auuugucacugagagaguuaga

SEQ ID NO: 677260 - RNA, 22 nt, Human
ucagagauucacgucaguccca

SEQ ID NO: 677261 - RNA, 22 nt, Human
ucuguagcuucuugagaggcca

SEQ ID NO: 677262 - RNA, 22 nt, Human
agcagguggccacgaggaggag

SEQ ID NO: 677263 - RNA, 20 nt, Human
ccagaggcugacagacuuug

SEQ ID NO: 677264 - RNA, 22 nt, Human
augggaggaaggaggcccuuga

SEQ ID NO: 677265 - RNA, 22 nt, Human
agagccugaggccaggaaaaug

SEQ ID NO: 677266 - RNA, 22 nt, Human
ucccacauaugcaauccugaau

SEQ ID NO: 677267 - RNA, 22 nt, Human
aacagcagaggagcgauggcug

SEQ ID NO: 677268 - RNA, 22 nt, Human
ccuggcacagagcgguggucac

SEQ ID NO: 677269 - RNA, 22 nt, Human
uuaauaaacaggugcagcugaa

SEQ ID NO: 677270 - RNA, 22 nt, Human
ucugauucauucaugugcacca

SEQ ID NO: 677271 - RNA, 22 nt, Human
cugagguaugugggacuagccu

SEQ ID NO: 677272 - RNA, 22 nt, Human
gcucacugcaaccucugcuucc

SEQ ID NO: 677273 - RNA, 22 nt, Human
gagcugguggugagaaagcucu

SEQ ID NO: 677274 - RNA, 22 nt, Human
acugggcucaagugauuguccu

SEQ ID NO: 677275 - RNA, 22 nt, Human
auguaaauuguacugacacacg

SEQ ID NO: 677276 - RNA, 22 nt, Human
uuuugguucugggauacagaga

SEQ ID NO: 677277 - RNA, 22 nt, Human
ugugugcauuagcauucuaggg

SEQ ID NO: 677278 - RNA, 22 nt, Human
ggggccagguccagcuuccaaa

SEQ ID NO: 677279 - RNA, 22 nt, Human
aggaccuuggaauaacaaauuc

SEQ ID NO: 677280 - RNA, 22 nt, Human
gauguuuucuggaaaaugaaug

SEQ ID NO: 677281 - RNA, 22 nt, Human
cauuuuaaaugauuuaagccaa

SEQ ID NO: 677282 - RNA, 22 nt, Human
gaggcuguuagggccugaggua

SEQ ID NO: 677283 - RNA, 21 nt, Human
gacagcaacuguaguccucuu

SEQ ID NO: 677284 - RNA, 22 nt, Human
gcaauaaacucucucaagccac

SEQ ID NO: 677285 - RNA, 22 nt, Human
gccugccuggagcuugagguga

SEQ ID NO: 677286 - RNA, 21 nt, Human
ugcaccuguucacugcaguuc

SEQ ID NO: 677287 - RNA, 22 nt, Human
auggcagucagagacaggcaga

SEQ ID NO: 677288 - RNA, 22 nt, Human
gcauugguuuacacagggugaa

SEQ ID NO: 677289 - RNA, 22 nt, Human
ugcagucuggauguccucagau

SEQ ID NO: 677290 - RNA, 22 nt, Human
ucagggaacaauguuauggcuu

SEQ ID NO: 677291 - RNA, 22 nt, Human
uuuuauuaucuuugaaugggac

SEQ ID NO: 677292 - RNA, 22 nt, Human
ugggaacauuuugagcugagag

SEQ ID NO: 677293 - RNA, 22 nt, Human
aaaugcacugaacacauguugu

SEQ ID NO: 677294 - RNA, 22 nt, Human
uggucauaacaugauuaguagg

SEQ ID NO: 677295 - RNA, 19 nt, Human
cuugguuaugguaugaugc

SEQ ID NO: 677296 - RNA, 23 nt, Human
auagaagauuauugcaacagucc

SEQ ID NO: 677297 - RNA, 22 nt, Human
guccagaguagucgaguauucu

SEQ ID NO: 677298 - RNA, 22 nt, Human
ugaugucucucuauacucuaac

SEQ ID NO: 677299 - RNA, 22 nt, Human
cagaugcugccugggaaugucu

SEQ ID NO: 677300 - RNA, 22 nt, Human
uuucucaguuacuagcuguggu

SEQ ID NO: 677301 - RNA, 22 nt, Human
uuccccugucacagugguucuc

SEQ ID NO: 677302 - RNA, 21 nt, Human
ugaauuucgguauggcuauaa

SEQ ID NO: 677303 - RNA, 22 nt, Human
aaucacaugaaaacuguguguu

SEQ ID NO: 677304 - RNA, 22 nt, Human
cugccccucgaccaagcgcguc

SEQ ID NO: 677305 - RNA, 22 nt, Human
caacugaacugauaucaacuau

SEQ ID NO: 677306 - RNA, 22 nt, Human
aaaaggcauggagguugauagu

SEQ ID NO: 677307 - RNA, 22 nt, Human
uagcugccagaccauucuuacu

SEQ ID NO: 677308 - RNA, 22 nt, Human
cucaggaggaggaaguucauug

SEQ ID NO: 677309 - RNA, 23 nt, Human
ucugaguuauguccuuacauuug

SEQ ID NO: 677310 - RNA, 22 nt, Human
cuccaggggccagaagccuggc

SEQ ID NO: 677311 - RNA, 22 nt, Human
uacuuuuaugugaugaaaucug

SEQ ID NO: 677312 - RNA, 22 nt, Human
uuacaauggguauacuuccauu

SEQ ID NO: 677313 - RNA, 22 nt, Human
uauacuauuauugucaguuuau

SEQ ID NO: 677314 - RNA, 22 nt, Human
gaggaagggcugccugccgggc

SEQ ID NO: 677315 - RNA, 22 nt, Human
caaauccuggagccaugguaac

SEQ ID NO: 677316 - RNA, 22 nt, Human
uuuagcaaaaaagcucugcgua

SEQ ID NO: 677317 - RNA, 22 nt, Human
acagaagcagcgcggcucuucu

SEQ ID NO: 677318 - RNA, 22 nt, Human
gcugccagcccagcaaggugug

SEQ ID NO: 677319 - RNA, 22 nt, Human
uuugaaaauuagacacaggcua

SEQ ID NO: 677320 - RNA, 22 nt, Human
caggaggaacaagagguucugg

SEQ ID NO: 677321 - RNA, 22 nt, Human
aagauacacggucaacucucaa

SEQ ID NO: 677322 - RNA, 22 nt, Human
cuagaacagaaaguacaggaaa

SEQ ID NO: 677323 - RNA, 22 nt, Human
aagcacaauuucaccuucuugu

SEQ ID NO: 677324 - RNA, 22 nt, Human
aaugcucugucucugacagugg

SEQ ID NO: 677325 - RNA, 22 nt, Human
ucugggaaugaauaagaccugu

SEQ ID NO: 677326 - RNA, 19 nt, Human
gggagagccaggcucaccc

SEQ ID NO: 677327 - RNA, 22 nt, Human
ucuuaaagccaagcauaaacca

SEQ ID NO: 677328 - RNA, 22 nt, Human
acuguguuaaauacagagaugg

SEQ ID NO: 677329 - RNA, 22 nt, Human
auacuuucugaccaauuaauug

SEQ ID NO: 677330 - RNA, 22 nt, Human
uugucugaauauguauguaucc

SEQ ID NO: 677331 - RNA, 22 nt, Human
aguguacaucagaacauaucaa

SEQ ID NO: 677332 - RNA, 22 nt, Human
acauacauaugacaacuuuccu

SEQ ID NO: 677333 - RNA, 22 nt, Human
uucauuuaaucagaaucucuaa

SEQ ID NO: 677334 - RNA, 22 nt, Human
uuaauucagucaaagaaaccau

SEQ ID NO: 677335 - RNA, 22 nt, Human
acaaauuguugggacucagccc

SEQ ID NO: 677336 - RNA, 20 nt, Human
cugugcuuuggaaccuggaa

SEQ ID NO: 677337 - RNA, 22 nt, Human
guaacacagaaaugaaauucca

SEQ ID NO: 677338 - RNA, 22 nt, Human
acacaggaacucugagaggugg

SEQ ID NO: 677339 - RNA, 22 nt, Human
guugaggaggcacucacuguca

SEQ ID NO: 677340 - RNA, 22 nt, Human
uuuuaguuuggauuucuaaagc

SEQ ID NO: 677341 - RNA, 22 nt, Human
uccuucuuucccccuagucauu

SEQ ID NO: 677342 - RNA, 22 nt, Human
auugcaagugcuagcuaaaaua

SEQ ID NO: 677343 - RNA, 22 nt, Human
gaggaaaucauuccagaaaagg

SEQ ID NO: 677344 - RNA, 22 nt, Human
aacauuuaggaaggaccuccuc

SEQ ID NO: 677345 - RNA, 22 nt, Human
ccugcucaugggucccuggcag

SEQ ID NO: 677346 - RNA, 22 nt, Human
aaggucacugaucaguugagua

SEQ ID NO: 677347 - RNA, 22 nt, Human
augacuuuccuggcaaaaguug

SEQ ID NO: 677348 - RNA, 18 nt, Human
ucucucugauaacauuuu

SEQ ID NO: 677349 - RNA, 22 nt, Human
gcagcucacagucuccgccauc

SEQ ID NO: 677350 - RNA, 22 nt, Human
guggcagggagaagccauuggg

SEQ ID NO: 677351 - RNA, 22 nt, Human
auggccauagccuuauagcagg

SEQ ID NO: 677352 - RNA, 22 nt, Human
uaggcaccaccuagggugaccc

SEQ ID NO: 677353 - RNA, 22 nt, Human
ucauaaauucuggugcugugag

SEQ ID NO: 677354 - RNA, 22 nt, Human
caauaacuaguaauuauuccgg

SEQ ID NO: 677355 - RNA, 22 nt, Human
aacuacuaccaguaguaguagu

SEQ ID NO: 677356 - RNA, 22 nt, Human
ggcuggaaccagagugaggcag

SEQ ID NO: 677357 - RNA, 22 nt, Human
auacacauaucagguguauaca

SEQ ID NO: 677358 - RNA, 22 nt, Human
cuucccacuaguaucacagagc

SEQ ID NO: 677359 - RNA, 22 nt, Human
ucauggcauuguuaaggguuuu

SEQ ID NO: 677360 - RNA, 22 nt, Human
uacuuuaaaaacugauaauuca

SEQ ID NO: 677361 - RNA, 22 nt, Human
ccugcagaaaggguccccagga

SEQ ID NO: 677362 - RNA, 22 nt, Human
cccagcucccugguauuugugc

SEQ ID NO: 677363 - RNA, 22 nt, Human
aaacacuucuuaggucuuaagu

SEQ ID NO: 677364 - RNA, 22 nt, Human
cuggagcuuauugggagcagaa

SEQ ID NO: 677365 - RNA, 22 nt, Human
uggcuaagcuggggaggccugg

SEQ ID NO: 677366 - RNA, 22 nt, Human
auucuuuccagacacugauugc

SEQ ID NO: 677367 - RNA, 22 nt, Human
uuggaagacagugaaacagcac

SEQ ID NO: 677368 - RNA, 20 nt, Human
cuagucucacaucccuggca

SEQ ID NO: 677369 - RNA, 22 nt, Human
aaggcagccauagcaccaucca

SEQ ID NO: 677370 - RNA, 22 nt, Human
ggcuuugacaugcugaauuaaa

SEQ ID NO: 677371 - RNA, 22 nt, Human
aggcagugcagaguccucuucu

SEQ ID NO: 677372 - RNA, 22 nt, Human
uugcuuuguggugguucuucca

SEQ ID NO: 677373 - RNA, 22 nt, Human
ggcagaggaaggaugaauucac

SEQ ID NO: 677374 - RNA, 19 nt, Human
aaggcagaaguuggauaug

SEQ ID NO: 677375 - RNA, 22 nt, Human
uaucacuugcguuuuggcagag

SEQ ID NO: 677376 - RNA, 23 nt, Human
ucaauaacucggguuaaaauaga

SEQ ID NO: 677377 - RNA, 22 nt, Human
ugccuacccugcccgcagacac

SEQ ID NO: 677378 - RNA, 17 nt, Human
ucugaggugaggaugca

SEQ ID NO: 677379 - RNA, 17 nt, Human
ggagcagauccaccauu

SEQ ID NO: 677380 - RNA, 22 nt, Human
agguaugccaauuaggucaagu

SEQ ID NO: 677381 - RNA, 17 nt, Human
agucagaggaguaucug

SEQ ID NO: 677382 - RNA, 22 nt, Human
agugcuuugaauguucugggca

SEQ ID NO: 677383 - RNA, 22 nt, Human
aaacaagucacuuuaucuugaa

SEQ ID NO: 677384 - RNA, 22 nt, Human
auguuugacugaguuuggcaga

SEQ ID NO: 677385 - RNA, 22 nt, Human
uuuggaauuggaaagugcugug

SEQ ID NO: 677386 - RNA, 21 nt, Human
ugucagcucccuguccugugu

SEQ ID NO: 677387 - RNA, 22 nt, Human
cagggcucagggacugcagaaa

SEQ ID NO: 677388 - RNA, 22 nt, Human
aggcucucacccucugaccaga

SEQ ID NO: 677389 - RNA, 22 nt, Human
cuggcuggaacgccgaggcggc

SEQ ID NO: 677390 - RNA, 22 nt, Human
gggcgaggacugacucugggca

SEQ ID NO: 677391 - RNA, 22 nt, Human
acacuagagagcaggcauuccc

SEQ ID NO: 677392 - RNA, 22 nt, Human
ugcuggggucucuccggugccc

SEQ ID NO: 677393 - RNA, 22 nt, Human
cugcagcugccagugauuucag

SEQ ID NO: 677394 - RNA, 22 nt, Human
gagcugccaguguaugaauucu

SEQ ID NO: 677395 - RNA, 22 nt, Human
uguaaccugacugcuuugcucu

SEQ ID NO: 677396 - RNA, 22 nt, Human
augucugugugaucuuggauaa

SEQ ID NO: 677397 - RNA, 22 nt, Human
ggucucagcaguugcuuugacu

SEQ ID NO: 677398 - RNA, 22 nt, Human
cccagggacagaugggcagcua

SEQ ID NO: 677399 - RNA, 22 nt, Human
ccaggcugagcaugauuggagc

SEQ ID NO: 677400 - RNA, 22 nt, Human
ggcaccaggggauguaaugucc

SEQ ID NO: 677401 - RNA, 22 nt, Human
gucaauaauugauagauauugg

SEQ ID NO: 677402 - RNA, 22 nt, Human
auucugaugcuucacaaaggua

SEQ ID NO: 677403 - RNA, 22 nt, Human
cucggagaugcuggcugagauc

SEQ ID NO: 677404 - RNA, 22 nt, Human
aggcaacaggaaaccacaugau

SEQ ID NO: 677405 - RNA, 22 nt, Human
cagaugaggcaaccucauugcu

SEQ ID NO: 677406 - RNA, 18 nt, Human
ucagaggagauaccuaaa

SEQ ID NO: 677407 - RNA, 22 nt, Human
uguacagagacuaccauuaaua

SEQ ID NO: 677408 - RNA, 22 nt, Human
caagcuccuuacauccacaggg

SEQ ID NO: 677409 - RNA, 22 nt, Human
guggcucacagcaauguuuccu

SEQ ID NO: 677410 - RNA, 22 nt, Human
guccagaguauucaaguaacuu

SEQ ID NO: 677411 - RNA, 22 nt, Human
gauuacaaaacucaucuaugac

SEQ ID NO: 677412 - RNA, 22 nt, Human
ugcuggaaagugaggugaauga

SEQ ID NO: 677413 - RNA, 22 nt, Human
uagggcuggguacacucuugcc

SEQ ID NO: 677414 - RNA, 22 nt, Human
cacagugugggcauggugccug

SEQ ID NO: 677415 - RNA, 22 nt, Human
aagcaccugcaccggucgccuu

SEQ ID NO: 677416 - RNA, 22 nt, Human
ccccuuccgucucuugaguguc

SEQ ID NO: 677417 - RNA, 18 nt, Human
ggccucagccuggccgga

SEQ ID NO: 677418 - RNA, 22 nt, Human
ggccugugcugagaaccuggcu

SEQ ID NO: 677419 - RNA, 22 nt, Human
acaucacacgccuuccaggagg

SEQ ID NO: 677420 - RNA, 22 nt, Human
uccugaauccaggagaguaggg

SEQ ID NO: 677421 - RNA, 22 nt, Human
ugguccuuuaagucuuucucug

SEQ ID NO: 677422 - RNA, 22 nt, Human
agaggaaucugucuagacacaa

SEQ ID NO: 677423 - RNA, 22 nt, Human
uccaggccugccugguguuugc

SEQ ID NO: 677424 - RNA, 22 nt, Human
aauuuuaugccuugcacguugg

SEQ ID NO: 677425 - RNA, 22 nt, Human
cucucaaaguaagguguauaca

SEQ ID NO: 677426 - RNA, 22 nt, Human
gccuuggacuaccacucccaca

SEQ ID NO: 677427 - RNA, 23 nt, Human
cgcccagccucagugaccugggc

SEQ ID NO: 677428 - RNA, 22 nt, Human
uaugaagaaaccuauccucuag

SEQ ID NO: 677429 - RNA, 22 nt, Human
caucaagauggaagagcaaaua

SEQ ID NO: 677430 - RNA, 22 nt, Human
cagugcuguugggcccagagag

SEQ ID NO: 677431 - RNA, 22 nt, Human
ugggagagugcucaaugugcaa

SEQ ID NO: 677432 - RNA, 18 nt, Human
gcugcaggcgccugcggu

SEQ ID NO: 677433 - RNA, 22 nt, Human
ugaagccagucaauguuaaguu

SEQ ID NO: 677434 - RNA, 22 nt, Human
ccugagcacacaucagaaucac

SEQ ID NO: 677435 - RNA, 22 nt, Human
gagaggcuccaugaccccggca

SEQ ID NO: 677436 - RNA, 22 nt, Human
aaccucuacauccaggaaagga

SEQ ID NO: 677437 - RNA, 22 nt, Human
aacagcuuuagaggauaauagu

SEQ ID NO: 677438 - RNA, 21 nt, Human
cccaacccauuuccaguucau

SEQ ID NO: 677439 - RNA, 22 nt, Human
agauaauuaugucaauuucuug

SEQ ID NO: 677440 - RNA, 22 nt, Human
uccugguguaaugguaagcaug

SEQ ID NO: 677441 - RNA, 22 nt, Human
agcagugagugggaggaccaug

SEQ ID NO: 677442 - RNA, 22 nt, Human
gcugagguggaggaaggagacc

SEQ ID NO: 677443 - RNA, 19 nt, Human
uccugcccaccagccaggg

SEQ ID NO: 677444 - RNA, 18 nt, Human
ggucugagaucguuuuuc

SEQ ID NO: 677445 - RNA, 22 nt, Human
uugcuuccuggcagggcgagcg

SEQ ID NO: 677446 - RNA, 22 nt, Human
ccagaggugggagugaucuggu

SEQ ID NO: 677447 - RNA, 22 nt, Human
cacuaauuccaucuccuuuucc

SEQ ID NO: 677448 - RNA, 22 nt, Human
auucccagguaaaaguagagcu

SEQ ID NO: 677449 - RNA, 18 nt, Human
agagagaauuccaguagg

SEQ ID NO: 677450 - RNA, 22 nt, Human
cuuuacuguuuggugcucuauu

SEQ ID NO: 677451 - RNA, 22 nt, Human
uacaguaacuggaauucuucuu

SEQ ID NO: 677452 - RNA, 22 nt, Human
cucagaagaacccaggguccca

SEQ ID NO: 677453 - RNA, 22 nt, Human
aaucuacauagagaucaaauga

SEQ ID NO: 677454 - RNA, 22 nt, Human
cgaacacacuugggaguucuga

SEQ ID NO: 677455 - RNA, 22 nt, Human
ucauuuaucgcugccuuuuaaa

SEQ ID NO: 677456 - RNA, 22 nt, Human
ggucugugaucuuauggauucu

SEQ ID NO: 677457 - RNA, 22 nt, Human
cugagccaaccacagcaggagc

SEQ ID NO: 677458 - RNA, 22 nt, Human
gagauuucuuuugaugccuguc

SEQ ID NO: 677459 - RNA, 22 nt, Human
cacacugaccugaacuuagcau

SEQ ID NO: 677460 - RNA, 22 nt, Human
ugggagugauacaguauggaau

SEQ ID NO: 677461 - RNA, 22 nt, Human
uacagucaagcauaagaaguca

SEQ ID NO: 677462 - RNA, 22 nt, Human
acuuugcacuaaguuacucauu

SEQ ID NO: 677463 - RNA, 19 nt, Human
uguguccuagcagccaguc

SEQ ID NO: 677464 - RNA, 22 nt, Human
aguuauuacucuuuaacauauu

SEQ ID NO: 677465 - RNA, 22 nt, Human
auguguguguauauacacacau

SEQ ID NO: 677466 - RNA, 22 nt, Human
cuggccucauagccaagcugug

SEQ ID NO: 677467 - RNA, 22 nt, Human
ugggaagggccgauggagccuc

SEQ ID NO: 677468 - RNA, 22 nt, Human
uuuaucagaggcuauguuucau

SEQ ID NO: 677469 - RNA, 22 nt, Human
gaggauggugagcaggacccag

SEQ ID NO: 677470 - RNA, 22 nt, Human
aacaggcuucuucugggcuccu

SEQ ID NO: 677471 - RNA, 22 nt, Human
uggccucugggaaagcagauuc

SEQ ID NO: 677472 - RNA, 22 nt, Human
agagucaccuuuuccucaggau

SEQ ID NO: 677473 - RNA, 22 nt, Human
agcugggaagaguuuucugcag

SEQ ID NO: 677474 - RNA, 22 nt, Human
cugcauugaucaggcagaaucu

SEQ ID NO: 677475 - RNA, 22 nt, Human
gaacagagcugacuacaaggca

SEQ ID NO: 677476 - RNA, 22 nt, Human
ucuauuuaccaaauguaguucc

SEQ ID NO: 677477 - RNA, 22 nt, Human
aucugcaguuuguuuucucuug

SEQ ID NO: 677478 - RNA, 22 nt, Human
ucauccuguauccucagaccau

SEQ ID NO: 677479 - RNA, 22 nt, Human
ugaagcaggcauugacugauga

SEQ ID NO: 677480 - RNA, 22 nt, Human
gcugacugguugcacagagggu

SEQ ID NO: 677481 - RNA, 22 nt, Human
ucauuuauagaagugggcagua

SEQ ID NO: 677482 - RNA, 22 nt, Human
agaggccaccacugucagggac

SEQ ID NO: 677483 - RNA, 22 nt, Human
augugcuuucuuuccaaggggc

SEQ ID NO: 677484 - RNA, 22 nt, Human
ucugcugagucagaccucuggg

SEQ ID NO: 677485 - RNA, 22 nt, Human
ucaguuuauaaauuguauuuag

SEQ ID NO: 677486 - RNA, 22 nt, Human
acuucacagauauuuauuuggu

SEQ ID NO: 677487 - RNA, 18 nt, Human
cccugaagggcaagauaa

SEQ ID NO: 677488 - RNA, 22 nt, Human
guacuucuuaaauuaggaucaa

SEQ ID NO: 677489 - RNA, 22 nt, Human
gcucagcugggaccaauguguu

SEQ ID NO: 677490 - RNA, 20 nt, Human
uuucaguugguuaauggcau

SEQ ID NO: 677491 - RNA, 22 nt, Human
ggcagcagggcugucucccuac

SEQ ID NO: 677492 - RNA, 22 nt, Human
ucagaggaucaugucccuacuc

SEQ ID NO: 677493 - RNA, 22 nt, Human
uguggcuggucuccgagcgucg

SEQ ID NO: 677494 - RNA, 22 nt, Human
ccauccaugguguugguuguau

SEQ ID NO: 677495 - RNA, 22 nt, Human
acucuucacuuccccugccagc

SEQ ID NO: 677496 - RNA, 22 nt, Human
ucacagaagagauauugacaga

SEQ ID NO: 677497 - RNA, 22 nt, Human
gcaggagucagcccuaccuuga

SEQ ID NO: 677498 - RNA, 22 nt, Human
ggcagugccugaugcugcagga

SEQ ID NO: 677499 - RNA, 22 nt, Human
gcuaggcuucaaaaucucccug

SEQ ID NO: 677500 - RNA, 22 nt, Human
gucuccuccauggagaugguau

SEQ ID NO: 677501 - RNA, 23 nt, Human
ugccaggguuuguuugugguuca

SEQ ID NO: 677502 - RNA, 22 nt, Human
acugagcucuugacugggaguu

SEQ ID NO: 677503 - RNA, 22 nt, Human
uauggaaaaauguaucuuguca

SEQ ID NO: 677504 - RNA, 22 nt, Human
ucaugugacaggcacuguucug

SEQ ID NO: 677505 - RNA, 22 nt, Human
ucccacaggaggaguuggaaau

SEQ ID NO: 677506 - RNA, 22 nt, Human
agggccacaguggggccugaga

SEQ ID NO: 677507 - RNA, 22 nt, Human
uucccuuccucacucuacuugu

SEQ ID NO: 677508 - RNA, 23 nt, Human
uugauuuagcugggauugcaugc

SEQ ID NO: 677509 - RNA, 22 nt, Human
ggcacugggaaugcagugauga

SEQ ID NO: 677510 - RNA, 22 nt, Human
cccaggugggcaccucgaggaa

SEQ ID NO: 677511 - RNA, 17 nt, Human
ugagcuucaaucaggug

SEQ ID NO: 677512 - RNA, 22 nt, Human
ucagauggcacacagagccugc

SEQ ID NO: 677513 - RNA, 22 nt, Human
aucuagaaaguguugaagauca

SEQ ID NO: 677514 - RNA, 22 nt, Human
caguaguaguuaaacuguguau

SEQ ID NO: 677515 - RNA, 22 nt, Human
uuacagauggaucuagcaaaau

SEQ ID NO: 677516 - RNA, 22 nt, Human
uuauuuaggaggaaacugaggu

SEQ ID NO: 677517 - RNA, 19 nt, Human
uccuggggauguggucacc

SEQ ID NO: 677518 - RNA, 22 nt, Human
cagggcuuacuggaggcugcuu

SEQ ID NO: 677519 - RNA, 22 nt, Human
ugcaugugcccacucuggcuua

SEQ ID NO: 677520 - RNA, 22 nt, Human
gggcagaugucuggacaccuca

SEQ ID NO: 677521 - RNA, 22 nt, Human
gagcucauacccucuucucuuu

SEQ ID NO: 677522 - RNA, 22 nt, Human
gugcugucaauugcuuucagua

SEQ ID NO: 677523 - RNA, 23 nt, Human
aaaguguagccagguuaagaacc

SEQ ID NO: 677524 - RNA, 20 nt, Human
ugugcccaauguccagguuc

SEQ ID NO: 677525 - RNA, 22 nt, Human
caaaggagguaaugggugugag

SEQ ID NO: 677526 - RNA, 18 nt, Human
uagaggggaagaccuuua

SEQ ID NO: 677527 - RNA, 19 nt, Human
ggauccagaggaucugcca

SEQ ID NO: 677528 - RNA, 22 nt, Human
uauggcuaauucuuuacugacc

SEQ ID NO: 677529 - RNA, 22 nt, Human
aaggaggaauuucagggugaau

SEQ ID NO: 677530 - RNA, 22 nt, Human
ugucaguuuggcucuaaaguuu

SEQ ID NO: 677531 - RNA, 22 nt, Human
uagcucauguaauccgaacaua

SEQ ID NO: 677532 - RNA, 22 nt, Human
uagauucuccacauguagcaau

SEQ ID NO: 677533 - RNA, 22 nt, Human
aggcacugaccugcuuccuuga

SEQ ID NO: 677534 - RNA, 22 nt, Human
gccugcucagaccuagcaggcc

SEQ ID NO: 677535 - RNA, 22 nt, Human
uguccucuaauuggccucuugc

SEQ ID NO: 677536 - RNA, 22 nt, Human
caugggcucuucuggacugcac

SEQ ID NO: 677537 - RNA, 22 nt, Human
ccugagauggggauuauuccaa

SEQ ID NO: 677538 - RNA, 22 nt, Human
uccucugccaaagggaguugcc

SEQ ID NO: 677539 - RNA, 22 nt, Human
cauaauuucccaagagauugaa

SEQ ID NO: 677540 - RNA, 19 nt, Human
agucauauuguucaucuug

SEQ ID NO: 677541 - RNA, 20 nt, Human
ucucauuauauccaagaggc

SEQ ID NO: 677542 - RNA, 22 nt, Human
ucucacacuauuuauucugcuu

SEQ ID NO: 677543 - RNA, 22 nt, Human
cuggccaauccauuaauuuguu

SEQ ID NO: 677544 - RNA, 22 nt, Human
caacagagggaauggaucucau

SEQ ID NO: 677545 - RNA, 22 nt, Human
ucaguguagcagacuuguagcc

SEQ ID NO: 677546 - RNA, 22 nt, Human
acucccuugugaacucauucuu

SEQ ID NO: 677547 - RNA, 20 nt, Human
uuauuuccaguccagguccu

SEQ ID NO: 677548 - RNA, 22 nt, Human
ucuuccucucuaauugaucaga

SEQ ID NO: 677549 - RNA, 23 nt, Human
ccaggcaguagcuauugaaguga

SEQ ID NO: 677550 - RNA, 22 nt, Human
agcacagaguugcagagagcgu

SEQ ID NO: 677551 - RNA, 22 nt, Human
agaggggguguuccagaagcau

SEQ ID NO: 677552 - RNA, 22 nt, Human
gcagcccugcaggcagcuccag

SEQ ID NO: 677553 - RNA, 22 nt, Human
uaauaauuaacagugauggguc

SEQ ID NO: 677554 - RNA, 22 nt, Human
uuaaggcauucuccuacuaaua

SEQ ID NO: 677555 - RNA, 22 nt, Human
cccugaggcaaaggcuagaguu

SEQ ID NO: 677556 - RNA, 22 nt, Human
cuggcugggagcucgccugcgg

SEQ ID NO: 677557 - RNA, 20 nt, Human
gcugggcuuugacugacaca

SEQ ID NO: 677558 - RNA, 21 nt, Human
guuuucaugauagagucugua

SEQ ID NO: 677559 - RNA, 22 nt, Human
ggucagggcucuuccaguggcu

SEQ ID NO: 677560 - RNA, 22 nt, Human
aguccccucuaacccaacuuua

SEQ ID NO: 677561 - RNA, 20 nt, Human
uguggaaaaacagaagcaga

SEQ ID NO: 677562 - RNA, 22 nt, Human
aucuacaacggguggaguaggg

SEQ ID NO: 677563 - RNA, 22 nt, Human
gaaagcuuccauuuuguacauu

SEQ ID NO: 677564 - RNA, 17 nt, Human
ucaaagaaugcaugcag

SEQ ID NO: 677565 - RNA, 22 nt, Human
cacuugaagugaauugcucacc

SEQ ID NO: 677566 - RNA, 22 nt, Human
caggugcugcguggcggagcug

SEQ ID NO: 677567 - RNA, 22 nt, Human
gacagcaaugacggggcagcug

SEQ ID NO: 677568 - RNA, 22 nt, Human
ccugcuguagggccccuggggc

SEQ ID NO: 677569 - RNA, 22 nt, Human
aggcuacauguugggguggaag

SEQ ID NO: 677570 - RNA, 23 nt, Human
uccuggguuugaauucuagucuu

SEQ ID NO: 677571 - RNA, 22 nt, Human
ggcaacaacuggacauagcugg

SEQ ID NO: 677572 - RNA, 22 nt, Human
caguaaugggcaagacaauaug

SEQ ID NO: 677573 - RNA, 22 nt, Human
cuguccucaccuuggcaggggg

SEQ ID NO: 677574 - RNA, 22 nt, Human
cucugcaggccuugaguguggu

SEQ ID NO: 677575 - RNA, 22 nt, Human
uauuacauccacuuuuauugca

SEQ ID NO: 677576 - RNA, 22 nt, Human
cggggagaacacuguguccuuc

SEQ ID NO: 677577 - RNA, 22 nt, Human
cugaggggaaaagucaggauga

SEQ ID NO: 677578 - RNA, 22 nt, Human
gcuggcuggaggagggagguug

SEQ ID NO: 677579 - RNA, 22 nt, Human
cuggaguccugcauuugcucuu

SEQ ID NO: 677580 - RNA, 22 nt, Human
uggcaaagacgcuagcuaagau

SEQ ID NO: 677581 - RNA, 20 nt, Human
ggaaaaguacuccuccuuaa

SEQ ID NO: 677582 - RNA, 22 nt, Human
uguguauuaauguuuguauaug

SEQ ID NO: 677583 - RNA, 22 nt, Human
ccacccuggacucgaggcccga

SEQ ID NO: 677584 - RNA, 22 nt, Human
agaguuuggagguguuccugga

SEQ ID NO: 677585 - RNA, 22 nt, Human
ccaaggcugucauucaguagcu

SEQ ID NO: 677586 - RNA, 22 nt, Human
gagaacacuaaugguuucuuaa

SEQ ID NO: 677587 - RNA, 17 nt, Human
cagaaggaagcauggca

SEQ ID NO: 677588 - RNA, 22 nt, Human
ucagaggcugcauuuuuaucca

SEQ ID NO: 677589 - RNA, 22 nt, Human
gcuauucaucaauuguucuagc

SEQ ID NO: 677590 - RNA, 22 nt, Human
gagccagccgcaagagcuguga

SEQ ID NO: 677591 - RNA, 22 nt, Human
ugucuuacaugagucaccccaa

SEQ ID NO: 677592 - RNA, 22 nt, Human
gcgggcgcucaggcugcagcug

SEQ ID NO: 677593 - RNA, 22 nt, Human
uuuauguaauuucauaggugug

SEQ ID NO: 677594 - RNA, 22 nt, Human
gaugagacagaauagcccaagg

SEQ ID NO: 677595 - RNA, 22 nt, Human
agaguucugucugccacacgaa

SEQ ID NO: 677596 - RNA, 20 nt, Human
auccuuaaagagaauuucua

SEQ ID NO: 677597 - RNA, 22 nt, Human
uguguguucucaauuauugaug

SEQ ID NO: 677598 - RNA, 22 nt, Human
uugguuuaggaacuggcuugga

SEQ ID NO: 677599 - RNA, 22 nt, Human
agcaacauuuuucaauuaacau

SEQ ID NO: 677600 - RNA, 22 nt, Human
gcugcucugcuguguaagcagg

SEQ ID NO: 677601 - RNA, 22 nt, Human
ccugggagagccaucuguggcc

SEQ ID NO: 677602 - RNA, 22 nt, Human
ugauucuagguccauuauuugc

SEQ ID NO: 677603 - RNA, 22 nt, Human
ugguguguacauuuuugcuucu

SEQ ID NO: 677604 - RNA, 22 nt, Human
accuuaaaggccgaaguaaaga

SEQ ID NO: 677605 - RNA, 20 nt, Human
gcuuccaggagggcugauau

SEQ ID NO: 677606 - RNA, 22 nt, Human
cuccagcucgcgagcucugcuc

SEQ ID NO: 677607 - RNA, 22 nt, Human
ucaaguucacagucuggucgcu

SEQ ID NO: 677608 - RNA, 22 nt, Human
aggcccuggucaggucuggcug

SEQ ID NO: 677609 - RNA, 22 nt, Human
gccucgaggcugagaaggcaca

SEQ ID NO: 677610 - RNA, 22 nt, Human
uauuugcaacauaaaacucuga

SEQ ID NO: 677611 - RNA, 17 nt, Human
aauugcuuguacuccca

SEQ ID NO: 677612 - RNA, 21 nt, Human
gagcaucuccuuccuccugcu

SEQ ID NO: 677613 - RNA, 17 nt, Human
uccuucagugccucugc

SEQ ID NO: 677614 - RNA, 16 nt, Human
aguggcagauaauacc

SEQ ID NO: 677615 - RNA, 22 nt, Human
gcacagggcccugugcguaggu

SEQ ID NO: 677616 - RNA, 22 nt, Human
cuggcugccacuucagggucuu

SEQ ID NO: 677617 - RNA, 22 nt, Human
uucaaaacagcuagauauugga

SEQ ID NO: 677618 - RNA, 22 nt, Human
ugggagcagcugggaacacagc

SEQ ID NO: 677619 - RNA, 22 nt, Human
ucgggguagacgccagcucgga

SEQ ID NO: 677620 - RNA, 22 nt, Human
cagggcucugccuugagggaug

SEQ ID NO: 677621 - RNA, 22 nt, Human
cuuccucucaauaagaugagaa

SEQ ID NO: 677622 - RNA, 23 nt, Human
gggggagcuggacuccuagaucc

SEQ ID NO: 677623 - RNA, 22 nt, Human
cagagggcuguguaaggauguu

SEQ ID NO: 677624 - RNA, 22 nt, Human
ggucccaagcaaugcccuuggc

SEQ ID NO: 677625 - RNA, 22 nt, Human
aaagcuaugaggcaugcauuuc

SEQ ID NO: 677626 - RNA, 22 nt, Human
aagcacuaggucacacaaguua

SEQ ID NO: 677627 - RNA, 22 nt, Human
uaauccguacauuauucugaac

SEQ ID NO: 677628 - RNA, 21 nt, Human
agaaaaacacgauauaagccc

SEQ ID NO: 677629 - RNA, 22 nt, Human
agaggccagcagugccuaucug

SEQ ID NO: 677630 - RNA, 22 nt, Human
caugcuaaccagagacauaaag

SEQ ID NO: 677631 - RNA, 22 nt, Human
ucucugggccucccuuuccaag

SEQ ID NO: 677632 - RNA, 22 nt, Human
auuuucugaguccagaauuuac

SEQ ID NO: 677633 - RNA, 22 nt, Human
gugaugucagcaagaauaggaa

SEQ ID NO: 677634 - RNA, 22 nt, Human
acaggucugugugcacagugcu

SEQ ID NO: 677635 - RNA, 23 nt, Human
ucuccaggccuuacuccaggccu

SEQ ID NO: 677636 - RNA, 22 nt, Human
auacaugucaucauauguuugu

SEQ ID NO: 677637 - RNA, 22 nt, Human
auucuacacaacaugaugaugg

SEQ ID NO: 677638 - RNA, 22 nt, Human
uagaaucauaccucuaggaaca

SEQ ID NO: 677639 - RNA, 22 nt, Human
gguaccaugagaugccacuaau

SEQ ID NO: 677640 - RNA, 22 nt, Human
uucaagaguccaggagagucug

SEQ ID NO: 677641 - RNA, 22 nt, Human
aagcuccccgaaacccaccucu

SEQ ID NO: 677642 - RNA, 22 nt, Human
cuggccuucagacucggacuga

SEQ ID NO: 677643 - RNA, 22 nt, Human
uggagagguugaauaacuuguc

SEQ ID NO: 677644 - RNA, 22 nt, Human
cugacccuuuaggguauguuua

SEQ ID NO: 677645 - RNA, 22 nt, Human
guaaaacaagcuuuaugguucc

SEQ ID NO: 677646 - RNA, 22 nt, Human
aggcacagauuuggggaaagca

SEQ ID NO: 677647 - RNA, 17 nt, Human
gccagggagaggaagcc

SEQ ID NO: 677648 - RNA, 22 nt, Human
uuccuuccucuuucacaacagc

SEQ ID NO: 677649 - RNA, 22 nt, Human
uuuaggucuucuuaagagucaa

SEQ ID NO: 677650 - RNA, 22 nt, Human
ccuucaaauuuagaacaaguga

SEQ ID NO: 677651 - RNA, 22 nt, Human
guggaacauguccauauacauu

SEQ ID NO: 677652 - RNA, 22 nt, Human
aaguguccucauucaacaugca

SEQ ID NO: 677653 - RNA, 22 nt, Human
ucaaucaaagcacugggcuuug

SEQ ID NO: 677654 - RNA, 22 nt, Human
caugaacaccaggcaugaacaa

SEQ ID NO: 677655 - RNA, 22 nt, Human
uuacacucauauugcacuuacc

SEQ ID NO: 677656 - RNA, 22 nt, Human
gccaguggguaguuggagcugg

SEQ ID NO: 677657 - RNA, 22 nt, Human
gcaccacuagaguagagauggu

SEQ ID NO: 677658 - RNA, 22 nt, Human
cugucauuucuuuagcaauggg

SEQ ID NO: 677659 - RNA, 22 nt, Human
agaccacuggccuccugcagac

SEQ ID NO: 677660 - RNA, 22 nt, Human
ugcuccgggaaagagcagccgc

SEQ ID NO: 677661 - RNA, 22 nt, Human
ugaguccagaugggccagcagg

SEQ ID NO: 677662 - RNA, 22 nt, Human
uaccaaauguaaucauucuaau

SEQ ID NO: 677663 - RNA, 22 nt, Human
cuccuccagugggucccucagg

SEQ ID NO: 677664 - RNA, 22 nt, Human
guagcccaccuggggagggcga

SEQ ID NO: 677665 - RNA, 22 nt, Human
uggguacuccuauuaguucagu

SEQ ID NO: 677666 - RNA, 22 nt, Human
cagaaagcucuuucaaucuugc

SEQ ID NO: 677667 - RNA, 22 nt, Human
agaagugcuccagugaguuggg

SEQ ID NO: 677668 - RNA, 22 nt, Human
ugaucuuuccucuuguuugucu

SEQ ID NO: 677669 - RNA, 22 nt, Human
cuccaggcuggauccaagucaa

SEQ ID NO: 677670 - RNA, 22 nt, Human
cauuugcauaugaagaaguaag

SEQ ID NO: 677671 - RNA, 22 nt, Human
uggauccagcugcuccuaugag

SEQ ID NO: 677672 - RNA, 22 nt, Human
caguauaugcucuuucaucaaa

SEQ ID NO: 677673 - RNA, 22 nt, Human
agccugggcaugggacgggagg

SEQ ID NO: 677674 - RNA, 22 nt, Human
cagcuucugcucauggaggggu

SEQ ID NO: 677675 - RNA, 22 nt, Human
uagaaacaaaaucugaugacuc

SEQ ID NO: 677676 - RNA, 22 nt, Human
ucacacaugcuaagccagagau

SEQ ID NO: 677677 - RNA, 19 nt, Human
uggcugagcuggacugagg

SEQ ID NO: 677678 - RNA, 22 nt, Human
ggucccuagagugggaugacuu

SEQ ID NO: 677679 - RNA, 22 nt, Human
cugcugugcauauuuaucuagg

SEQ ID NO: 677680 - RNA, 22 nt, Human
cagugaggaguccagggcagag

SEQ ID NO: 677681 - RNA, 22 nt, Human
uuaguugaugcuaagggauccc

SEQ ID NO: 677682 - RNA, 22 nt, Human
caagguuuacauugggcuauca

SEQ ID NO: 677683 - RNA, 22 nt, Human
agagggugaaugagauagaaaa

SEQ ID NO: 677684 - RNA, 22 nt, Human
cagggcaguaacgggaacaucu

SEQ ID NO: 677685 - RNA, 22 nt, Human
ugcugcaguguuugcugaaguu

SEQ ID NO: 677686 - RNA, 22 nt, Human
auucuucauuguugauucaugu

SEQ ID NO: 677687 - RNA, 22 nt, Human
ucauuuucccacugaagcuguc

SEQ ID NO: 677688 - RNA, 22 nt, Human
ucauguauuugugauagaugac

SEQ ID NO: 677689 - RNA, 22 nt, Human
gacagagauugaaucaggaaau

SEQ ID NO: 677690 - RNA, 22 nt, Human
guccuugaguaagucauggugg

SEQ ID NO: 677691 - RNA, 22 nt, Human
ccacugcucugccaggagcugg

SEQ ID NO: 677692 - RNA, 22 nt, Human
gccaccagggggugcaaggucc

SEQ ID NO: 677693 - RNA, 19 nt, Human
acccucucagugccugagg

SEQ ID NO: 677694 - RNA, 22 nt, Human
aacuuguauauguuauucagag

SEQ ID NO: 677695 - RNA, 22 nt, Human
ccaggaugacccccacuuuccu

SEQ ID NO: 677696 - RNA, 22 nt, Human
cugaggagcccccucucagcau

SEQ ID NO: 677697 - RNA, 22 nt, Human
uggauuauuguaagacaaagua

SEQ ID NO: 677698 - RNA, 22 nt, Human
cagaagggacaggguuuguaga

SEQ ID NO: 677699 - RNA, 22 nt, Human
uuggcuucaaugucagagacag

SEQ ID NO: 677700 - RNA, 19 nt, Human
cugggccagagcuguccuc

SEQ ID NO: 677701 - RNA, 22 nt, Human
aaaugcauuucacuaauguuuc

SEQ ID NO: 677702 - RNA, 20 nt, Human
gccuggaggcaaugggaaga

SEQ ID NO: 677703 - RNA, 22 nt, Human
ucuggcccagccccugauccca

SEQ ID NO: 677704 - RNA, 22 nt, Human
gacaaacugaaguauauuuaga

SEQ ID NO: 677705 - RNA, 22 nt, Human
cuguagcagacagacccuaggu

SEQ ID NO: 677706 - RNA, 22 nt, Human
ucuuccugcuuuggugaggcuu

SEQ ID NO: 677707 - RNA, 20 nt, Human
ugcugcugccuccgccucug

SEQ ID NO: 677708 - RNA, 17 nt, Human
ucagcaggggccaagcu

SEQ ID NO: 677709 - RNA, 22 nt, Human
ccaggcaauguucuaagugauu

SEQ ID NO: 677710 - RNA, 22 nt, Human
gcuucgcugcuagcuaguuggu

SEQ ID NO: 677711 - RNA, 22 nt, Human
uuauuuucagcuaggaaagcca

SEQ ID NO: 677712 - RNA, 22 nt, Human
gguccucuccagcgccacagug

SEQ ID NO: 677713 - RNA, 22 nt, Human
ggcugggagcuggacaggccgg

SEQ ID NO: 677714 - RNA, 22 nt, Human
ugaauucuuaaugaaaucuacu

SEQ ID NO: 677715 - RNA, 22 nt, Human
agcccuggggcuggucuuggaa

SEQ ID NO: 677716 - RNA, 22 nt, Human
aggcuccauuuuccugcagcug

SEQ ID NO: 677717 - RNA, 22 nt, Human
uuauguacaauguuaauguaaa

SEQ ID NO: 677718 - RNA, 22 nt, Human
ucccagccuuccuuguggugaa

SEQ ID NO: 677719 - RNA, 22 nt, Human
aggauccuguauggagaagcug

SEQ ID NO: 677720 - RNA, 22 nt, Human
uucccugagucucccugagucu

SEQ ID NO: 677721 - RNA, 22 nt, Human
gagcaggaugggagcuggggcc

SEQ ID NO: 677722 - RNA, 22 nt, Human
cuucugcugccgccucggcaca

SEQ ID NO: 677723 - RNA, 22 nt, Human
aggcacagugccuggaaucaaa

SEQ ID NO: 677724 - RNA, 22 nt, Human
cuccagccucaucuccuggcug

SEQ ID NO: 677725 - RNA, 22 nt, Human
aucuaagagagagagcaugucu

SEQ ID NO: 677726 - RNA, 22 nt, Human
acucuggcgggcgggcgagcca

SEQ ID NO: 677727 - RNA, 22 nt, Human
uuucagaaagcugaacauauga

SEQ ID NO: 677728 - RNA, 22 nt, Human
cugcuggcuucuagucauucaa

SEQ ID NO: 677729 - RNA, 22 nt, Human
uguggcagaggaggcagcgucc

SEQ ID NO: 677730 - RNA, 23 nt, Human
acuuuauugaccccaggucaguu

SEQ ID NO: 677731 - RNA, 22 nt, Human
ugaggugaagaguggagcucag

SEQ ID NO: 677732 - RNA, 22 nt, Human
ggggugagguuuauguucuggg

SEQ ID NO: 677733 - RNA, 22 nt, Human
uuuagcaucgaaguaaauuuag

SEQ ID NO: 677734 - RNA, 22 nt, Human
ccuggugcuuaccagagcuuuu

SEQ ID NO: 677735 - RNA, 20 nt, Human
augaagacaaauccgacuug

SEQ ID NO: 677736 - RNA, 23 nt, Human
acagccaggaugggagcagaagc

SEQ ID NO: 677737 - RNA, 22 nt, Human
cuucaguuagaguuuacaaagu

SEQ ID NO: 677738 - RNA, 22 nt, Human
auucaagaggaacaaugaagau

SEQ ID NO: 677739 - RNA, 22 nt, Human
uguccuggggacaagaggcccu

SEQ ID NO: 677740 - RNA, 22 nt, Human
uuauuguuuaaagccauguaaa

SEQ ID NO: 677741 - RNA, 22 nt, Human
gggaagggagggaccucagucu

SEQ ID NO: 677742 - RNA, 21 nt, Human
cugccaggauagcaugcaggc

SEQ ID NO: 677743 - RNA, 22 nt, Human
aggucucugaguacugcuggac

SEQ ID NO: 677744 - RNA, 22 nt, Human
gggcacuggcagucggggacgc

SEQ ID NO: 677745 - RNA, 18 nt, Human
gugcaugcaugcucugcc

SEQ ID NO: 677746 - RNA, 22 nt, Human
caguaguggggagcccaguguc

SEQ ID NO: 677747 - RNA, 22 nt, Human
ggaggccaccugaccugcuguu

SEQ ID NO: 677748 - RNA, 22 nt, Human
guccuucagggagucaaacacu

SEQ ID NO: 677749 - RNA, 22 nt, Human
caccagcuugggcuguggaaau

SEQ ID NO: 677750 - RNA, 22 nt, Human
uuugaaagcaggugugggaggg

SEQ ID NO: 677751 - RNA, 22 nt, Human
gcaggaugggagcuucacuuug

SEQ ID NO: 677752 - RNA, 22 nt, Human
acaggccucaagacacccaggu

SEQ ID NO: 677753 - RNA, 22 nt, Human
caggugaaaaagcaaccauauu

SEQ ID NO: 677754 - RNA, 22 nt, Human
ggcaggugccuucugugcuagc

SEQ ID NO: 677755 - RNA, 22 nt, Human
agaggucauaucucagaagaga

SEQ ID NO: 677756 - RNA, 22 nt, Human
gccuccggagucacagugucuu

SEQ ID NO: 677757 - RNA, 22 nt, Human
uacauaauuaaucuuuaaguuc

SEQ ID NO: 677758 - RNA, 22 nt, Human
aggcugugggguucugcuuuca

SEQ ID NO: 677759 - RNA, 22 nt, Human
agcacuggaguuuagugggauu

SEQ ID NO: 677760 - RNA, 22 nt, Human
cucuaaauccacgguauaguug

SEQ ID NO: 677761 - RNA, 22 nt, Human
uaauuuuccacucuguuuaucu

SEQ ID NO: 677762 - RNA, 22 nt, Human
aaggccagauucucucuagggg

SEQ ID NO: 677763 - RNA, 22 nt, Human
gaggcaccagccccgcuagccu

SEQ ID NO: 677764 - RNA, 19 nt, Human
gugucugccuuugugccac

SEQ ID NO: 677765 - RNA, 22 nt, Human
ugagccugcaauaagcacagcc

SEQ ID NO: 677766 - RNA, 23 nt, Human
auggagcugguacuagcuaccuc

SEQ ID NO: 677767 - RNA, 22 nt, Human
cuucccuuggugaacagagcau

SEQ ID NO: 677768 - RNA, 22 nt, Human
agaggccagcacugcagggaag

SEQ ID NO: 677769 - RNA, 22 nt, Human
ugcucaguuccaugaguggagu

SEQ ID NO: 677770 - RNA, 22 nt, Human
augcuauacucaaagaaauuca

SEQ ID NO: 677771 - RNA, 22 nt, Human
uuggcagaaauguggcugggag

SEQ ID NO: 677772 - RNA, 23 nt, Human
ucuuggcuggacaagucacucac

SEQ ID NO: 677773 - RNA, 22 nt, Human
cuucucagaucucagcuuugag

SEQ ID NO: 677774 - RNA, 22 nt, Human
gccacaugcaauugcagcacgu

SEQ ID NO: 677775 - RNA, 22 nt, Human
aucaggugaagucacugagugg

SEQ ID NO: 677776 - RNA, 22 nt, Human
acagggaaagggacagcagcag

SEQ ID NO: 677777 - RNA, 22 nt, Human
ugcccuggcuccucccacgcug

SEQ ID NO: 677778 - RNA, 22 nt, Human
ggguccagaaugagaaugggcu

SEQ ID NO: 677779 - RNA, 22 nt, Human
augucugagucugcuccaguug

SEQ ID NO: 677780 - RNA, 22 nt, Human
cacaggaaucgucacuuagcgc

SEQ ID NO: 677781 - RNA, 22 nt, Human
ucagugcuuccuggaggaagcc

SEQ ID NO: 677782 - RNA, 22 nt, Human
gagggugcugugccaagaugac

SEQ ID NO: 677783 - RNA, 22 nt, Human
uuuucuccuuucaagauagcau

SEQ ID NO: 677784 - RNA, 22 nt, Human
acaguugacagggagaggguua

SEQ ID NO: 677785 - RNA, 22 nt, Human
uauugacaauuugugaaacuau

SEQ ID NO: 677786 - RNA, 22 nt, Human
ugagccugaguucaaggcugca

SEQ ID NO: 677787 - RNA, 22 nt, Human
guuuccugaaauagaguacugg

SEQ ID NO: 677788 - RNA, 22 nt, Human
ucuucagugcaccugaugucuu

SEQ ID NO: 677789 - RNA, 22 nt, Human
acucucugucuaaaugcaguuu

SEQ ID NO: 677790 - RNA, 22 nt, Human
gcucccagguucuugggccuug

SEQ ID NO: 677791 - RNA, 22 nt, Human
guacuuuagaguaaaauagacc

SEQ ID NO: 677792 - RNA, 22 nt, Human
caugugucaaaugauguagcug

SEQ ID NO: 677793 - RNA, 20 nt, Human
agggucuggcccuguuccuu

SEQ ID NO: 677794 - RNA, 22 nt, Human
cucgcaggacagugcuaggacu

SEQ ID NO: 677795 - RNA, 23 nt, Human
ccugaagggucaggguccucagc

SEQ ID NO: 677796 - RNA, 19 nt, Human
uucucaguucaggagaaga

SEQ ID NO: 677797 - RNA, 22 nt, Human
agaggacacaucuuuccucaaa

SEQ ID NO: 677798 - RNA, 22 nt, Human
uauuuuacaugacagguguuua

SEQ ID NO: 677799 - RNA, 22 nt, Human
uuccagagcaguuuucagauca

SEQ ID NO: 677800 - RNA, 22 nt, Human
ccucccucuguuagagcugucu

SEQ ID NO: 677801 - RNA, 22 nt, Human
uuggaaggaauuaaggucauga

SEQ ID NO: 677802 - RNA, 18 nt, Human
uuaauguggcuuacuaug

SEQ ID NO: 677803 - RNA, 22 nt, Human
ugcaauaaggaguaauaguaaa

SEQ ID NO: 677804 - RNA, 22 nt, Human
ucugggcaguucggauccucug

SEQ ID NO: 677805 - RNA, 19 nt, Human
guacagugguaagcuauga

SEQ ID NO: 677806 - RNA, 22 nt, Human
gcuaggugcagcagacagcuua

SEQ ID NO: 677807 - RNA, 22 nt, Human
aagccagggguugguaugcuau

SEQ ID NO: 677808 - RNA, 22 nt, Human
ggccugagaauguaccagaucu

SEQ ID NO: 677809 - RNA, 22 nt, Human
acagauuuuauuauucagguau

SEQ ID NO: 677810 - RNA, 22 nt, Human
ucagaagcaggagugugcacaa

SEQ ID NO: 677811 - RNA, 22 nt, Human
cagaaacaggcaacgugugcac

SEQ ID NO: 677812 - RNA, 22 nt, Human
ggcuggacuuucugcugggcuc

SEQ ID NO: 677813 - RNA, 18 nt, Human
uggagccagcucuaggau

SEQ ID NO: 677814 - RNA, 22 nt, Human
ucauuaaauguuuguugugcca

SEQ ID NO: 677815 - RNA, 22 nt, Human
guccugugaccugcauccugag

SEQ ID NO: 677816 - RNA, 22 nt, Human
aaguucaaggaagccuccaguu

SEQ ID NO: 677817 - RNA, 22 nt, Human
cugggaggcggagguuguagug

SEQ ID NO: 677818 - RNA, 21 nt, Human
gcauuaaaagcaguuguuggu

SEQ ID NO: 677819 - RNA, 22 nt, Human
agggugugcuguugggucuuuc

SEQ ID NO: 677820 - RNA, 23 nt, Human
cguuuuuuccucagauguucugg

SEQ ID NO: 677821 - RNA, 22 nt, Human
agacacauaggaccacacugug

SEQ ID NO: 677822 - RNA, 22 nt, Human
uacuuuuccuggaaccacugcu

SEQ ID NO: 677823 - RNA, 22 nt, Human
aguccucugcugugcgucuuug

SEQ ID NO: 677824 - RNA, 22 nt, Human
uggaaagaaaguaaaggcguau

SEQ ID NO: 677825 - RNA, 22 nt, Human
aaagaggauggaguagucagcu

SEQ ID NO: 677826 - RNA, 22 nt, Human
auacauuccuacugacuagcua

SEQ ID NO: 677827 - RNA, 22 nt, Human
gcauuucagagaaaaucugcuu

SEQ ID NO: 677828 - RNA, 22 nt, Human
aguuuauuuuugauaagucuug

SEQ ID NO: 677829 - RNA, 22 nt, Human
ucucccaguccucugugcuuac

SEQ ID NO: 677830 - RNA, 20 nt, Human
accucccucuguggguggga

SEQ ID NO: 677831 - RNA, 22 nt, Human
ucugcuuugcugccuccugauc

SEQ ID NO: 677832 - RNA, 22 nt, Human
uucaggaagugcugccuggugu

SEQ ID NO: 677833 - RNA, 22 nt, Human
ccugcacaugugugcgccugua

SEQ ID NO: 677834 - RNA, 22 nt, Human
ccugcacuucucacagcugcug

SEQ ID NO: 677835 - RNA, 20 nt, Human
ucagggcaugggacagcccc

SEQ ID NO: 677836 - RNA, 22 nt, Human
ggcagcagaacuggcccuguau

SEQ ID NO: 677837 - RNA, 22 nt, Human
gaugcaaagaggaccuucagua

SEQ ID NO: 677838 - RNA, 20 nt, Human
auuaacacugagcuaugggu

SEQ ID NO: 677839 - RNA, 22 nt, Human
gccaccccauagguguuaggug

SEQ ID NO: 677840 - RNA, 22 nt, Human
cauccuucaaaggcuacaauua

SEQ ID NO: 677841 - RNA, 20 nt, Human
cuggcccaggaugauggcgc

SEQ ID NO: 677842 - RNA, 22 nt, Human
gugucugcuugcugagcauuua

SEQ ID NO: 677843 - RNA, 22 nt, Human
ugcugagagccagggcuggcau

SEQ ID NO: 677844 - RNA, 22 nt, Human
uuuucacaaggguccaacuagu

SEQ ID NO: 677845 - RNA, 22 nt, Human
gucccagggagguucagggcuu

SEQ ID NO: 677846 - RNA, 22 nt, Human
gcuguacaaggccucugccauc

SEQ ID NO: 677847 - RNA, 22 nt, Human
gaacuacaggugcagcaaguga

SEQ ID NO: 677848 - RNA, 22 nt, Human
uucucaaagaaagcugucauua

SEQ ID NO: 677849 - RNA, 22 nt, Human
gguccuggaaauugacggaaag

SEQ ID NO: 677850 - RNA, 22 nt, Human
aucccuggacggcgccucccca

SEQ ID NO: 677851 - RNA, 22 nt, Human
agaaugcaguuugaaauaaggu

SEQ ID NO: 677852 - RNA, 22 nt, Human
uugcugaugcccuuguccaggc

SEQ ID NO: 677853 - RNA, 22 nt, Human
augugugguacagucccguuua

SEQ ID NO: 677854 - RNA, 22 nt, Human
uacaaaguauauuucuagcugu

SEQ ID NO: 677855 - RNA, 22 nt, Human
uuccuguaugucagugaagagc

SEQ ID NO: 677856 - RNA, 22 nt, Human
aaaacaggaguuuugguaggcu

SEQ ID NO: 677857 - RNA, 22 nt, Human
agucagaugaugugaggagugg

SEQ ID NO: 677858 - RNA, 22 nt, Human
uauguauaaaugcaugugugga

SEQ ID NO: 677859 - RNA, 22 nt, Human
caguggguggcuaaguggcuga

SEQ ID NO: 677860 - RNA, 22 nt, Human
agcaggcuaggaaccucacugc

SEQ ID NO: 677861 - RNA, 22 nt, Human
caguaggagguucugagguucu

SEQ ID NO: 677862 - RNA, 22 nt, Human
ugugcagauagugauuucagaa

SEQ ID NO: 677863 - RNA, 22 nt, Human
ucuagucauauuuuuucaguau

SEQ ID NO: 677864 - RNA, 22 nt, Human
agcugcaggaaguagaagcgga

SEQ ID NO: 677865 - RNA, 22 nt, Human
caggacugaagggcacagggaa

SEQ ID NO: 677866 - RNA, 22 nt, Human
gacccaggguuucugcacaggg

SEQ ID NO: 677867 - RNA, 22 nt, Human
auuugaaugcagguagcugagu

SEQ ID NO: 677868 - RNA, 23 nt, Human
acaugauacacaauuagcaaacc

SEQ ID NO: 677869 - RNA, 22 nt, Human
gaggcugggaaguccaagacca

SEQ ID NO: 677870 - RNA, 22 nt, Human
ggggagaccaucugaaggugau

SEQ ID NO: 677871 - RNA, 22 nt, Human
ucuaugaaccucugcaaugaca

SEQ ID NO: 677872 - RNA, 22 nt, Human
auggaacaagaacucagauuua

SEQ ID NO: 677873 - RNA, 22 nt, Human
caauaguucgguccugaaggcc

SEQ ID NO: 677874 - RNA, 22 nt, Human
aucauuacuccuguaaaauugu

SEQ ID NO: 677875 - RNA, 22 nt, Human
ccagagccagagaggugccugc

SEQ ID NO: 677876 - RNA, 22 nt, Human
cagucaccuugaggacucagac

SEQ ID NO: 677877 - RNA, 22 nt, Human
augcagcagccccuugaggugc

SEQ ID NO: 677878 - RNA, 22 nt, Human
agaggcaggagguugacuugag

SEQ ID NO: 677879 - RNA, 22 nt, Human
ugcagauagcgucauucuugcu

SEQ ID NO: 677880 - RNA, 18 nt, Human
accacaugauaucuugcc

SEQ ID NO: 677881 - RNA, 22 nt, Human
cucauccaccgcagccccucag

SEQ ID NO: 677882 - RNA, 22 nt, Human
uguucacaggggagccauuuau

SEQ ID NO: 677883 - RNA, 22 nt, Human
ucaucucuccccagugucuuua

SEQ ID NO: 677884 - RNA, 22 nt, Human
uucagcuauggagucuuaguua

SEQ ID NO: 677885 - RNA, 22 nt, Human
cuauugaaaguguacaauucaa

SEQ ID NO: 677886 - RNA, 22 nt, Human
cuucuuucuuuugaucacaggu

SEQ ID NO: 677887 - RNA, 22 nt, Human
uucaaacaggggucagggagau

SEQ ID NO: 677888 - RNA, 22 nt, Human
agagaagcugacaggggcgugc

SEQ ID NO: 677889 - RNA, 18 nt, Human
guguccuggcugcggcgc

SEQ ID NO: 677890 - RNA, 22 nt, Human
ccucaggccagggggcggccag

SEQ ID NO: 677891 - RNA, 22 nt, Human
auuugcuuugggacagcuuaaa

SEQ ID NO: 677892 - RNA, 22 nt, Human
gaaaucugaacucuguauccuu

SEQ ID NO: 677893 - RNA, 22 nt, Human
agagaccuuuguuauucuagga

SEQ ID NO: 677894 - RNA, 22 nt, Human
ggaugcugauuccagucuccag

SEQ ID NO: 677895 - RNA, 22 nt, Human
ccaggacuuuaaguccagcacu

SEQ ID NO: 677896 - RNA, 21 nt, Human
gaaaggucuuaacuuacagag

SEQ ID NO: 677897 - RNA, 22 nt, Human
caggcacuggccagucagcaca

SEQ ID NO: 677898 - RNA, 22 nt, Human
gacauuaauuucuuugguaauu

SEQ ID NO: 677899 - RNA, 22 nt, Human
cugagggagaagucacgggcag

SEQ ID NO: 677900 - RNA, 22 nt, Human
ugcaggcugugucauuuaguga

SEQ ID NO: 677901 - RNA, 22 nt, Human
cacuuaucucauuuaaucacca

SEQ ID NO: 677902 - RNA, 22 nt, Human
aaguaaggcagugaaugagauu

SEQ ID NO: 677903 - RNA, 22 nt, Human
aacagcuuuuuuggucagcauu

SEQ ID NO: 677904 - RNA, 20 nt, Human
uuuccuuucauuuuaguacc

SEQ ID NO: 677905 - RNA, 22 nt, Human
cauaauccuguccuggauucuu

SEQ ID NO: 677906 - RNA, 22 nt, Human
ugaaucuuuuuggaaauaaaga

SEQ ID NO: 677907 - RNA, 22 nt, Human
cuauuuggccagaagaggguca

SEQ ID NO: 677908 - RNA, 22 nt, Human
uucagcaaugggauggugcagg

SEQ ID NO: 677909 - RNA, 18 nt, Human
uuauuuguuacagcacau

SEQ ID NO: 677910 - RNA, 22 nt, Human
caguacuuugcaucauuccacu

SEQ ID NO: 677911 - RNA, 22 nt, Human
uuuacaguccccaggugaggau

SEQ ID NO: 677912 - RNA, 22 nt, Human
acauguaagacuagcuuaaagu

SEQ ID NO: 677913 - RNA, 22 nt, Human
cccagcagaaucugaugagggc

SEQ ID NO: 677914 - RNA, 22 nt, Human
augccagucaaagaagaugaca

SEQ ID NO: 677915 - RNA, 22 nt, Human
cauggccaggcccagggcccag

SEQ ID NO: 677916 - RNA, 23 nt, Human
gggcagguuuuuauaggcuucag

SEQ ID NO: 677917 - RNA, 22 nt, Human
ccuggacucagaggugcuggug

SEQ ID NO: 677918 - RNA, 22 nt, Human
augauacauugcaaaauuuuaa

SEQ ID NO: 677919 - RNA, 22 nt, Human
uuugaaguguuauuucuaucac

SEQ ID NO: 677920 - RNA, 22 nt, Human
uucuagaugcuuauaggcauau

SEQ ID NO: 677921 - RNA, 22 nt, Human
auggcuugauagaaagcuaguu

SEQ ID NO: 677922 - RNA, 20 nt, Human
cucuccucacccgugucagg

SEQ ID NO: 677923 - RNA, 21 nt, Human
agcuuguguguaucacagugu

SEQ ID NO: 677924 - RNA, 19 nt, Human
uauauauuuugggguugug

SEQ ID NO: 677925 - RNA, 22 nt, Human
ucgcagaggcacgagugcagaa

SEQ ID NO: 677926 - RNA, 23 nt, Human
ugcuggcuuccagcugcucccuc

SEQ ID NO: 677927 - RNA, 22 nt, Human
ugcuucuuuacuauaggcaauu

SEQ ID NO: 677928 - RNA, 22 nt, Human
ucccagcagagccagcaagccg

SEQ ID NO: 677929 - RNA, 22 nt, Human
agcaggcuaaucuugcugaaca

SEQ ID NO: 677930 - RNA, 22 nt, Human
ugcaaggguguuugagcugccc

SEQ ID NO: 677931 - RNA, 22 nt, Human
gcucacugccugggcaacaaga

SEQ ID NO: 677932 - RNA, 22 nt, Human
cccaggaguaagugacauuguu

SEQ ID NO: 677933 - RNA, 22 nt, Human
aagugguaggaagagagcacug

SEQ ID NO: 677934 - RNA, 22 nt, Human
agggccagccaggcccuacaaa

SEQ ID NO: 677935 - RNA, 22 nt, Human
gaugcagggcuggcaggagcuu

SEQ ID NO: 677936 - RNA, 22 nt, Human
cagcaagaaaauucacaugcuc

SEQ ID NO: 677937 - RNA, 22 nt, Human
cgucauccuuuggaugaaucac

SEQ ID NO: 677938 - RNA, 22 nt, Human
ccccacaccugccgggcagcag

SEQ ID NO: 677939 - RNA, 22 nt, Human
uucucugggcuuuucggauccg

SEQ ID NO: 677940 - RNA, 22 nt, Human
uaaacagaaagcagauguacuu

SEQ ID NO: 677941 - RNA, 22 nt, Human
cuuuuugucucuguccugauga

SEQ ID NO: 677942 - RNA, 22 nt, Human
agaagcagggcagggaaaagca

SEQ ID NO: 677943 - RNA, 22 nt, Human
auccugaagcaugaaugucaaa

SEQ ID NO: 677944 - RNA, 22 nt, Human
ccagacagcaguuaaaggacau

SEQ ID NO: 677945 - RNA, 22 nt, Human
aaugaagcaagcugcuguguuu

SEQ ID NO: 677946 - RNA, 22 nt, Human
cuuccucccccacacacucacu

SEQ ID NO: 677947 - RNA, 22 nt, Human
cagagccccccuucugaucaca

SEQ ID NO: 677948 - RNA, 22 nt, Human
ugagaugcuaaagggcugcuca

SEQ ID NO: 677949 - RNA, 22 nt, Human
ccucaggcaggaaacugucccg

SEQ ID NO: 677950 - RNA, 22 nt, Human
aggcuucaaggacagcagccac

SEQ ID NO: 677951 - RNA, 22 nt, Human
auguaaguuuaagcacaacaag

SEQ ID NO: 677952 - RNA, 22 nt, Human
ucugcagacuugauaaccacug

SEQ ID NO: 677953 - RNA, 18 nt, Human
agggagagaccgcggguc

SEQ ID NO: 677954 - RNA, 22 nt, Human
cucuuggccagacacagaggca

SEQ ID NO: 677955 - RNA, 22 nt, Human
agcccagccggauucccaguuc

SEQ ID NO: 677956 - RNA, 22 nt, Human
ucagaacaggacuggcugccau

SEQ ID NO: 677957 - RNA, 22 nt, Human
uguuuuaucaagauggcauguc

SEQ ID NO: 677958 - RNA, 22 nt, Human
gcuuggagaugggggaugagcc

SEQ ID NO: 677959 - RNA, 22 nt, Human
ugagcuggaggacaggagggua

SEQ ID NO: 677960 - RNA, 22 nt, Human
guucucauaguggaaaauaggu

SEQ ID NO: 677961 - RNA, 22 nt, Human
agaguccagaaaacagugugcu

SEQ ID NO: 677962 - RNA, 21 nt, Human
uuugcauuuuacaugugggga

SEQ ID NO: 677963 - RNA, 22 nt, Human
uuuaauuuucugggcccagcag

SEQ ID NO: 677964 - RNA, 22 nt, Human
ucccacaggagccugaguccca

SEQ ID NO: 677965 - RNA, 19 nt, Human
ucccaggaaccuuuuauuu

SEQ ID NO: 677966 - RNA, 22 nt, Human
ccuccacucuggccucucaggu

SEQ ID NO: 677967 - RNA, 22 nt, Human
agcugagcucaggcugauguaa

SEQ ID NO: 677968 - RNA, 22 nt, Human
ccuggaaggcaggcauggauug

SEQ ID NO: 677969 - RNA, 22 nt, Human
gagauggagaaggaagcuguuu

SEQ ID NO: 677970 - RNA, 22 nt, Human
caaucacucugcaacauuccug

SEQ ID NO: 677971 - RNA, 22 nt, Human
aggagacccaaugccagaaaga

SEQ ID NO: 677972 - RNA, 22 nt, Human
ggaugggcagacaggacggcac

SEQ ID NO: 677973 - RNA, 22 nt, Human
uuccugaggcucaucggagucg

SEQ ID NO: 677974 - RNA, 22 nt, Human
ccaguguuggaggauggcuugc

SEQ ID NO: 677975 - RNA, 22 nt, Human
uucuuugguguuacccagcuca

SEQ ID NO: 677976 - RNA, 22 nt, Human
acacugacaccugcccucaggu

SEQ ID NO: 677977 - RNA, 22 nt, Human
cuguucauggaaaaauaguugg

SEQ ID NO: 677978 - RNA, 22 nt, Human
ccugccugccugcuggccggga

SEQ ID NO: 677979 - RNA, 22 nt, Human
agagcagaguggcuguagcuug

SEQ ID NO: 677980 - RNA, 22 nt, Human
aaacuucagugaaugacuuaug

SEQ ID NO: 677981 - RNA, 22 nt, Human
uuuugccugcacuguauauaua

SEQ ID NO: 677982 - RNA, 20 nt, Human
ccugggaaggcagccccagc

SEQ ID NO: 677983 - RNA, 22 nt, Human
gacauuuagcuguuuugcauuu

SEQ ID NO: 677984 - RNA, 22 nt, Human
ugugaaauuacuuaaaggaaau

SEQ ID NO: 677985 - RNA, 22 nt, Human
aguaggcagaaguggcauucgg

SEQ ID NO: 677986 - RNA, 22 nt, Human
ucuaaacugcgagcaugccccc

SEQ ID NO: 677987 - RNA, 22 nt, Human
ugcuucugggucccagccuggc

SEQ ID NO: 677988 - RNA, 22 nt, Human
ucucacaucugcccugugcugg

SEQ ID NO: 677989 - RNA, 22 nt, Human
uugggcccugcucugaguugcu

SEQ ID NO: 677990 - RNA, 22 nt, Human
ggaggaaaugaaaggaggguuu

SEQ ID NO: 677991 - RNA, 20 nt, Human
gccugcagagaaggucagag

SEQ ID NO: 677992 - RNA, 17 nt, Human
cugugcucgagugaugg

SEQ ID NO: 677993 - RNA, 22 nt, Human
gacagggacgaggcuucaggca

SEQ ID NO: 677994 - RNA, 18 nt, Human
cugccugcucuccagcuu

SEQ ID NO: 677995 - RNA, 21 nt, Human
uuaguucuaccacuugcauuc

SEQ ID NO: 677996 - RNA, 22 nt, Human
ucucagaaccucaguuugcucu

SEQ ID NO: 677997 - RNA, 22 nt, Human
cuggccagguuuugaacaguug

SEQ ID NO: 677998 - RNA, 22 nt, Human
aaaggauaagguuaucaauuuu

SEQ ID NO: 677999 - RNA, 22 nt, Human
cccagggcuuuucucacuagac

SEQ ID NO: 678000 - RNA, 22 nt, Human
agcuagagaaugacagagucug

SEQ ID NO: 678001 - RNA, 22 nt, Human
gguguccaucaggcugugcuuc

SEQ ID NO: 678002 - RNA, 22 nt, Human
ggugcccugccaggaugugcca

SEQ ID NO: 678003 - RNA, 22 nt, Human
gucacuggaauuacaggcaugc

SEQ ID NO: 678004 - RNA, 22 nt, Human
guggucaggcagugggagagaa

SEQ ID NO: 678005 - RNA, 22 nt, Human
guucacaguuuuauaccugaga

SEQ ID NO: 678006 - RNA, 22 nt, Human
ugcuuaaaauuuuccaaggauu

SEQ ID NO: 678007 - RNA, 22 nt, Human
aaaacucugcaguuaguuucua

SEQ ID NO: 678008 - RNA, 22 nt, Human
gugcacagagcccagggccgcg

SEQ ID NO: 678009 - RNA, 22 nt, Human
uucugucacuuaggaggucaua

SEQ ID NO: 678010 - RNA, 22 nt, Human
aggccuccuggcuccaggccuu

SEQ ID NO: 678011 - RNA, 22 nt, Human
guccaggucuggacccugagcc

SEQ ID NO: 678012 - RNA, 22 nt, Human
uuauucaccaguguaaaacacu

SEQ ID NO: 678013 - RNA, 22 nt, Human
cugugauuguuaguuccuauac

SEQ ID NO: 678014 - RNA, 22 nt, Human
ucuaaagauuuggauucauuug

SEQ ID NO: 678015 - RNA, 20 nt, Human
acauguacuaaugaauacag

SEQ ID NO: 678016 - RNA, 22 nt, Human
uggcccuguggaggucagugag

SEQ ID NO: 678017 - RNA, 20 nt, Human
ggccugagcauggcuggcag

SEQ ID NO: 678018 - RNA, 21 nt, Human
ugcaggcuguuuaagaggcaa

SEQ ID NO: 678019 - RNA, 22 nt, Human
caaugcuucucauuagccaaug

SEQ ID NO: 678020 - RNA, 22 nt, Human
cccugugccuaguuggccuaaa

SEQ ID NO: 678021 - RNA, 22 nt, Human
guggauggauuuugaggaaugg

SEQ ID NO: 678022 - RNA, 22 nt, Human
ucauugaauucuggggguugag

SEQ ID NO: 678023 - RNA, 22 nt, Human
cagcagcaucaggucugugguu

SEQ ID NO: 678024 - RNA, 22 nt, Human
aauguauggauucaugucugug

SEQ ID NO: 678025 - RNA, 22 nt, Human
augcuuccacuguucugcucuc

SEQ ID NO: 678026 - RNA, 20 nt, Human
ccuuuagaaacucauaugua

SEQ ID NO: 678027 - RNA, 22 nt, Human
uccaaguugauguuucuuaaau

SEQ ID NO: 678028 - RNA, 22 nt, Human
aagucugaucauuucuucuaua

SEQ ID NO: 678029 - RNA, 22 nt, Human
agagccagagaccuggguucac

SEQ ID NO: 678030 - RNA, 22 nt, Human
cugagccaccggcagggacauc

SEQ ID NO: 678031 - RNA, 22 nt, Human
ccagagucaggagcucauguga

SEQ ID NO: 678032 - RNA, 22 nt, Human
uacauaauugucuuuguccuca

SEQ ID NO: 678033 - RNA, 22 nt, Human
aagugcuuuaaaauuuccugag

SEQ ID NO: 678034 - RNA, 22 nt, Human
gagcugagaucgugccauugca

SEQ ID NO: 678035 - RNA, 22 nt, Human
ggccuccucacccugcucaggc

SEQ ID NO: 678036 - RNA, 22 nt, Human
ucacagggcauuauggcuccag

SEQ ID NO: 678037 - RNA, 22 nt, Human
acugagaacucaagagaaaagg

SEQ ID NO: 678038 - RNA, 22 nt, Human
uacaaucaggauaauaauagug

SEQ ID NO: 678039 - RNA, 22 nt, Human
caaauacuggguaaguuaauuu

SEQ ID NO: 678040 - RNA, 22 nt, Human
aaagccuggguuccucacuauc

SEQ ID NO: 678041 - RNA, 22 nt, Human
ggacaaagggcuagccacaacu

SEQ ID NO: 678042 - RNA, 22 nt, Human
uuggaaagaagggcugagcaag

SEQ ID NO: 678043 - RNA, 22 nt, Human
ugucuuauuccuucuguucagc

SEQ ID NO: 678044 - RNA, 22 nt, Human
aagugauucuagucaugauucu

SEQ ID NO: 678045 - RNA, 22 nt, Human
guccuggguccccgcaggucag

SEQ ID NO: 678046 - RNA, 22 nt, Human
aacugcauuuaacaaauacucu

SEQ ID NO: 678047 - RNA, 22 nt, Human
uguucccaagauaagauuauga

SEQ ID NO: 678048 - RNA, 19 nt, Human
gcaccccaucuuccuccug

SEQ ID NO: 678049 - RNA, 22 nt, Human
aagguuaguaauauuucuauau

SEQ ID NO: 678050 - RNA, 22 nt, Human
ugcuccagugagcuggccaucc

SEQ ID NO: 678051 - RNA, 22 nt, Human
cucagcagagaccagggaggaa

SEQ ID NO: 678052 - RNA, 22 nt, Human
uaguccagccuuggguguagcc

SEQ ID NO: 678053 - RNA, 22 nt, Human
agaaggccagauggacggggcu

SEQ ID NO: 678054 - RNA, 22 nt, Human
gaaggcaggcuucugauuaggu

SEQ ID NO: 678055 - RNA, 22 nt, Human
uuuccaggaaguaaggauaauc

SEQ ID NO: 678056 - RNA, 22 nt, Human
ggaaaaaugacacauaucucaa

SEQ ID NO: 678057 - RNA, 22 nt, Human
acauugcaauuagguaccuaug

SEQ ID NO: 678058 - RNA, 20 nt, Human
ucucuggcaagaagcugcag

SEQ ID NO: 678059 - RNA, 22 nt, Human
gcuuccuagaucugugguacuc

SEQ ID NO: 678060 - RNA, 22 nt, Human
aggcagcuggaggcagagacua

SEQ ID NO: 678061 - RNA, 22 nt, Human
gauuucaauccagcuuucuucu

SEQ ID NO: 678062 - RNA, 22 nt, Human
acauucuauucugcaggacaag

SEQ ID NO: 678063 - RNA, 22 nt, Human
agggcuuucuuuguaaaagaag

SEQ ID NO: 678064 - RNA, 22 nt, Human
gcacagcccuggucggggcccc

SEQ ID NO: 678065 - RNA, 22 nt, Human
gaggcugcuuuccuccuauccu

SEQ ID NO: 678066 - RNA, 22 nt, Human
aaggguugaagauaaauaaggu

SEQ ID NO: 678067 - RNA, 22 nt, Human
uccuggcccgaucccugugaag

SEQ ID NO: 678068 - RNA, 22 nt, Human
ucaggccaggagaucagauuga

SEQ ID NO: 678069 - RNA, 22 nt, Human
cugggcucagaugagaggaagg

SEQ ID NO: 678070 - RNA, 22 nt, Human
aaugggagagaacacaaagucc

SEQ ID NO: 678071 - RNA, 22 nt, Human
cagcccaccuggcacguguguu

SEQ ID NO: 678072 - RNA, 22 nt, Human
uaacaacuugcuuuuaucuuag

SEQ ID NO: 678073 - RNA, 22 nt, Human
acuuauuagacaucuucauugu

SEQ ID NO: 678074 - RNA, 22 nt, Human
uuucuugagugaugcuuagugu

SEQ ID NO: 678075 - RNA, 23 nt, Human
ugcuuggacaagacucuauuaag

SEQ ID NO: 678076 - RNA, 23 nt, Human
aggcaaggguguaaaggaaauga

SEQ ID NO: 678077 - RNA, 22 nt, Human
aacaguguguuuuguuauuaag

SEQ ID NO: 678078 - RNA, 22 nt, Human
ccauggccgccgcugcucagga

SEQ ID NO: 678079 - RNA, 22 nt, Human
auuuacagaaacuuaaucauag

SEQ ID NO: 678080 - RNA, 22 nt, Human
accuuaaaacugacacauggag

SEQ ID NO: 678081 - RNA, 22 nt, Human
cagaggcgaggcagcugaaccu

SEQ ID NO: 678082 - RNA, 22 nt, Human
ggacccuggagacccacuggga

SEQ ID NO: 678083 - RNA, 22 nt, Human
cuggcucuugcgacucagcuug

SEQ ID NO: 678084 - RNA, 22 nt, Human
ugagugggauuaaaugagguga

SEQ ID NO: 678085 - RNA, 22 nt, Human
auauauaaccuggauaaggcuu

SEQ ID NO: 678086 - RNA, 22 nt, Human
cuccuguggucaagggugggac

SEQ ID NO: 678087 - RNA, 22 nt, Human
ccuggcacauaguaaguacuag

SEQ ID NO: 678088 - RNA, 22 nt, Human
uuagcuaaacuguaacuagaau

SEQ ID NO: 678089 - RNA, 22 nt, Human
uuuucuuacugucugugauccu

SEQ ID NO: 678090 - RNA, 22 nt, Human
cuuacacuuuccgaaagcuugu

SEQ ID NO: 678091 - RNA, 22 nt, Human
cccaggaggcggagguuguggu

SEQ ID NO: 678092 - RNA, 22 nt, Human
ccugggaggcggagguugcagu

SEQ ID NO: 678093 - RNA, 22 nt, Human
cuuuuucacuguguccucacac

SEQ ID NO: 678094 - RNA, 22 nt, Human
agauaagauaguccagcacaau

SEQ ID NO: 678095 - RNA, 22 nt, Human
ugggaauacaaguuauucaccu

SEQ ID NO: 678096 - RNA, 22 nt, Human
augugcuuuuacuccccagagu

SEQ ID NO: 678097 - RNA, 22 nt, Human
ggagagaggcuggccgugauga

SEQ ID NO: 678098 - RNA, 22 nt, Human
acacauucuuuaaaugucuguu

SEQ ID NO: 678099 - RNA, 22 nt, Human
ggcuucauggaggaggugaguc

SEQ ID NO: 678100 - RNA, 22 nt, Human
gccaggcugacucccccggccu

SEQ ID NO: 678101 - RNA, 22 nt, Human
uacuauaaagucuuaaugaguc

SEQ ID NO: 678102 - RNA, 19 nt, Human
agucagguggcuggugcca

SEQ ID NO: 678103 - RNA, 22 nt, Human
uggggccagguggcugcagguc

SEQ ID NO: 678104 - RNA, 21 nt, Human
uucucuccauaugcccagccc

SEQ ID NO: 678105 - RNA, 22 nt, Human
uccaggcuccugacuuuuuggg

SEQ ID NO: 678106 - RNA, 22 nt, Human
cacagaauaauucacauggcuc

SEQ ID NO: 678107 - RNA, 22 nt, Human
ucuugaaagcaugagauggaca

SEQ ID NO: 678108 - RNA, 22 nt, Human
uugagaaaagcuguguaaggau

SEQ ID NO: 678109 - RNA, 22 nt, Human
auguggauuugggagugaucag

SEQ ID NO: 678110 - RNA, 22 nt, Human
gaggcacaguguuuggucagug

SEQ ID NO: 678111 - RNA, 21 nt, Human
uggcugccuacaugcugcagg

SEQ ID NO: 678112 - RNA, 22 nt, Human
gggcuuggguauugugagaggu

SEQ ID NO: 678113 - RNA, 19 nt, Human
aggugaugugacucuagaa

SEQ ID NO: 678114 - RNA, 22 nt, Human
aucucuaauuuaaaaaguaaca

SEQ ID NO: 678115 - RNA, 22 nt, Human
cucugcugguagcucauuccau

SEQ ID NO: 678116 - RNA, 20 nt, Human
cuccaguguucaggggagug

SEQ ID NO: 678117 - RNA, 22 nt, Human
uugcuuggcaggcuuccagucu

SEQ ID NO: 678118 - RNA, 22 nt, Human
gaucggguggguucugccauca

SEQ ID NO: 678119 - RNA, 22 nt, Human
aggaaaaagaguugcugccuuc

SEQ ID NO: 678120 - RNA, 22 nt, Human
caagcuacuuagaaagcacagu

SEQ ID NO: 678121 - RNA, 22 nt, Human
aggaagaaaacuaauuagaugg

SEQ ID NO: 678122 - RNA, 22 nt, Human
cucuccucagaacaggcccucu

SEQ ID NO: 678123 - RNA, 22 nt, Human
acaggcugguuuguaaaagaug

SEQ ID NO: 678124 - RNA, 22 nt, Human
gaggagaaauuuggggaccuga

SEQ ID NO: 678125 - RNA, 22 nt, Human
ucccucaggacccaacuuguaa

SEQ ID NO: 678126 - RNA, 22 nt, Human
uguguacacaaguauauauaca

SEQ ID NO: 678127 - RNA, 22 nt, Human
ugcaugcauaaauguacacaca

SEQ ID NO: 678128 - RNA, 22 nt, Human
ccagagguccugugaugcugca

SEQ ID NO: 678129 - RNA, 20 nt, Human
uucuccacaggguggaggag

SEQ ID NO: 678130 - RNA, 22 nt, Human
cauucacaauggauugcuucaa

SEQ ID NO: 678131 - RNA, 17 nt, Human
agcagggagucaaggga

SEQ ID NO: 678132 - RNA, 22 nt, Human
aaauuagaccagggcuccugga

SEQ ID NO: 678133 - RNA, 22 nt, Human
cagauuucaaggaggcacucca

SEQ ID NO: 678134 - RNA, 22 nt, Human
ccccaggagcuuguuuuagaga

SEQ ID NO: 678135 - RNA, 22 nt, Human
uucauuuguugacagagacaug

SEQ ID NO: 678136 - RNA, 22 nt, Human
uugaagaggacuuugcagcugu

SEQ ID NO: 678137 - RNA, 20 nt, Human
ggcagcaauucacccuaucc

SEQ ID NO: 678138 - RNA, 22 nt, Human
aaagccaggaggagggcgcucg

SEQ ID NO: 678139 - RNA, 22 nt, Human
ugaaacaggcaaaacugcagau

SEQ ID NO: 678140 - RNA, 22 nt, Human
ucaggucuauacuaugagaggc

SEQ ID NO: 678141 - RNA, 22 nt, Human
ucccacugcuuugcucugcuca

SEQ ID NO: 678142 - RNA, 22 nt, Human
aagugucugauggagcgaaaug

SEQ ID NO: 678143 - RNA, 22 nt, Human
uggaguccuaguauuggaaaca

SEQ ID NO: 678144 - RNA, 22 nt, Human
cagccuggacagcgaccagagu

SEQ ID NO: 678145 - RNA, 20 nt, Human
ugugaggagcauggccgcug

SEQ ID NO: 678146 - RNA, 22 nt, Human
aaagagccagcuaccucaguuu

SEQ ID NO: 678147 - RNA, 22 nt, Human
aagggccauaacuugcaguguu

SEQ ID NO: 678148 - RNA, 22 nt, Human
ggagauuuauagcacacuucag

SEQ ID NO: 678149 - RNA, 22 nt, Human
uugccuuugacggugcagcagu

SEQ ID NO: 678150 - RNA, 22 nt, Human
guguccuuuuaugugacugguu

SEQ ID NO: 678151 - RNA, 22 nt, Human
gaauuguaugcaguuacuugga

SEQ ID NO: 678152 - RNA, 22 nt, Human
ugcaggagggaggguuacaguu

SEQ ID NO: 678153 - RNA, 23 nt, Human
agcccaccuuguuaguccugugg

SEQ ID NO: 678154 - RNA, 23 nt, Human
uggggccaagugaggaagggucu

SEQ ID NO: 678155 - RNA, 20 nt, Human
ggcucuggaaucuggugggc

SEQ ID NO: 678156 - RNA, 22 nt, Human
ucuguggccugccuccucauuu

SEQ ID NO: 678157 - RNA, 22 nt, Human
cuggagucuccccaggagcgug

SEQ ID NO: 678158 - RNA, 22 nt, Human
uguggcagaaccagaauucaaa

SEQ ID NO: 678159 - RNA, 22 nt, Human
uuuuacaccucagaugagcaga

SEQ ID NO: 678160 - RNA, 22 nt, Human
uuggaacuggaggaacaugcua

SEQ ID NO: 678161 - RNA, 22 nt, Human
ucacaacucacagccaccggug

SEQ ID NO: 678162 - RNA, 22 nt, Human
uaaagagccauuguaugguuuu

SEQ ID NO: 678163 - RNA, 22 nt, Human
ucuggcuugagcuucgaccagu

SEQ ID NO: 678164 - RNA, 22 nt, Human
acaucccuugcucggggccccu

SEQ ID NO: 678165 - RNA, 21 nt, Human
cucaggcuggcagcaggcuag

SEQ ID NO: 678166 - RNA, 22 nt, Human
aggcagaagccagccagggucc

SEQ ID NO: 678167 - RNA, 22 nt, Human
agcacaugcacagugcuacacu

SEQ ID NO: 678168 - RNA, 22 nt, Human
guggcagggcuuugcuguucuu

SEQ ID NO: 678169 - RNA, 22 nt, Human
uuggaucacucugaagccuuac

SEQ ID NO: 678170 - RNA, 22 nt, Human
ggucacugcucuaaacaaaagu

SEQ ID NO: 678171 - RNA, 22 nt, Human
uggggacauucaugcagguugu

SEQ ID NO: 678172 - RNA, 22 nt, Human
guuccuugggaacaacgcugaa

SEQ ID NO: 678173 - RNA, 18 nt, Human
aguguucucguuuuauaa

SEQ ID NO: 678174 - RNA, 22 nt, Human
accaggcccauguggauuacua

SEQ ID NO: 678175 - RNA, 22 nt, Human
cagcucuggcuuuggggagcuu

SEQ ID NO: 678176 - RNA, 17 nt, Human
agcagcuggcacaggag

SEQ ID NO: 678177 - RNA, 22 nt, Human
uccagggaccucccugagagcu

SEQ ID NO: 678178 - RNA, 22 nt, Human
ggcagugguuagaaacaugagc

SEQ ID NO: 678179 - RNA, 22 nt, Human
acagcagcuuccugacuguacu

SEQ ID NO: 678180 - RNA, 22 nt, Human
ugcuuaaaauaguucauuuuug

SEQ ID NO: 678181 - RNA, 22 nt, Human
ucagaggaauuugcuuuucaug

SEQ ID NO: 678182 - RNA, 22 nt, Human
uggagccagcaggacucagagg

SEQ ID NO: 678183 - RNA, 22 nt, Human
augcagaauugcuaaguaucug

SEQ ID NO: 678184 - RNA, 22 nt, Human
acuaggagaaaacuuacacuga

SEQ ID NO: 678185 - RNA, 22 nt, Human
aggacagagggaccagagccca

SEQ ID NO: 678186 - RNA, 22 nt, Human
gccuuugcugugacaaugcugg

SEQ ID NO: 678187 - RNA, 17 nt, Human
uaucaagaagucuggcc

SEQ ID NO: 678188 - RNA, 22 nt, Human
ucagcuggauguggaagugcua

SEQ ID NO: 678189 - RNA, 22 nt, Human
ggcuucaccgcgggguugcagg

SEQ ID NO: 678190 - RNA, 22 nt, Human
uucugggcuuggcuguuuccau

SEQ ID NO: 678191 - RNA, 22 nt, Human
acaguuuagaaugccacauagu

SEQ ID NO: 678192 - RNA, 22 nt, Human
gguauuuacugagagccacucu

SEQ ID NO: 678193 - RNA, 22 nt, Human
uuaagagacaggagaaugaugu

SEQ ID NO: 678194 - RNA, 22 nt, Human
agaauuguucuguagcuuggcu

SEQ ID NO: 678195 - RNA, 22 nt, Human
uagcaauguguguguauaaauu

SEQ ID NO: 678196 - RNA, 22 nt, Human
aagugcuuagaaguugcauuag

SEQ ID NO: 678197 - RNA, 22 nt, Human
aggcccagcugggccaggaaca

SEQ ID NO: 678198 - RNA, 22 nt, Human
caaggccuaugcacaccuagga

SEQ ID NO: 678199 - RNA, 22 nt, Human
caguuuuaaauuuugaaugucu

SEQ ID NO: 678200 - RNA, 20 nt, Human
ugucuucauuauggugcccu

SEQ ID NO: 678201 - RNA, 22 nt, Human
guggcagaaaugggacuuugag

SEQ ID NO: 678202 - RNA, 22 nt, Human
ggaucuggggcucugcugcuca

SEQ ID NO: 678203 - RNA, 22 nt, Human
uuucauugccuuuggaaggucu

SEQ ID NO: 678204 - RNA, 22 nt, Human
auauuucaugggguuccauacu

SEQ ID NO: 678205 - RNA, 22 nt, Human
ucuguacaaaggcuauuuggag

SEQ ID NO: 678206 - RNA, 22 nt, Human
ugggcagacgggagcuugccuu

SEQ ID NO: 678207 - RNA, 23 nt, Human
uuucugaaguugagauggacuuu

SEQ ID NO: 678208 - RNA, 22 nt, Human
ugcaaaaacagccuugaggccu

SEQ ID NO: 678209 - RNA, 22 nt, Human
uuaaaaugaauauugauuagca

SEQ ID NO: 678210 - RNA, 22 nt, Human
ucuguccuccggagcucccagu

SEQ ID NO: 678211 - RNA, 22 nt, Human
uacuuuuagccuauuugauucu

SEQ ID NO: 678212 - RNA, 22 nt, Human
uugcauaaagauuuuauugcau

SEQ ID NO: 678213 - RNA, 22 nt, Human
cugaggagcugaaggcccucca

SEQ ID NO: 678214 - RNA, 22 nt, Human
auuguacauaugauguauguaa

SEQ ID NO: 678215 - RNA, 22 nt, Human
agcacccuggggaagcacaaag

SEQ ID NO: 678216 - RNA, 22 nt, Human
ccaggugguucaggucaccaua

SEQ ID NO: 678217 - RNA, 22 nt, Human
augcgcuuugugugaagcagug

SEQ ID NO: 678218 - RNA, 22 nt, Human
uucuuuguggcagugagcuggg

SEQ ID NO: 678219 - RNA, 22 nt, Human
uggaaggaaagguagcagagaa

SEQ ID NO: 678220 - RNA, 22 nt, Human
cucccuggucuuucccaucauu

SEQ ID NO: 678221 - RNA, 22 nt, Human
agugucauuccagggacccucg

SEQ ID NO: 678222 - RNA, 22 nt, Human
cugugagaaaggugauggaggu

SEQ ID NO: 678223 - RNA, 22 nt, Human
uuuggaaaauauugaacugguu

SEQ ID NO: 678224 - RNA, 22 nt, Human
gggguagggcgauugcugcuuu

SEQ ID NO: 678225 - RNA, 22 nt, Human
acaguggaaagaaacgaauuag

SEQ ID NO: 678226 - RNA, 22 nt, Human
gucaggaucucccaguacauau

SEQ ID NO: 678227 - RNA, 22 nt, Human
ucuagaaacaugacauugaucu

SEQ ID NO: 678228 - RNA, 22 nt, Human
ucuucagagauguaacauaugg

SEQ ID NO: 678229 - RNA, 22 nt, Human
uguuuccuuucuggugagcaua

SEQ ID NO: 678230 - RNA, 22 nt, Human
cacacaucaaccuagacauugu

SEQ ID NO: 678231 - RNA, 22 nt, Human
gccuggcuuggggcucaguggu

SEQ ID NO: 678232 - RNA, 22 nt, Human
aaaguucucuaugguguaaaaa

SEQ ID NO: 678233 - RNA, 22 nt, Human
guuuccaggcuuugguaugguu

SEQ ID NO: 678234 - RNA, 22 nt, Human
ucagcuuucucuucuaucgaua

SEQ ID NO: 678235 - RNA, 22 nt, Human
aaaugcuguaacugauauucug

SEQ ID NO: 678236 - RNA, 22 nt, Human
agguggcagacuaacagaagga

SEQ ID NO: 678237 - RNA, 22 nt, Human
ugcauauuugauugagauaccu

SEQ ID NO: 678238 - RNA, 22 nt, Human
ggccugggcccacugucaagag

SEQ ID NO: 678239 - RNA, 22 nt, Human
uuguuaaaauuggagccgagag

SEQ ID NO: 678240 - RNA, 22 nt, Human
gcggagggagauaggccuugcu

SEQ ID NO: 678241 - RNA, 22 nt, Human
ugucaucucacugauauagaug

SEQ ID NO: 678242 - RNA, 22 nt, Human
acaggcugauagaccauaaaua

SEQ ID NO: 678243 - RNA, 22 nt, Human
gagucaggcaugaagguaauua

SEQ ID NO: 678244 - RNA, 20 nt, Human
ugggcucugcuuccuggagu

SEQ ID NO: 678245 - RNA, 22 nt, Human
gacuggaaagccuguccucaga

SEQ ID NO: 678246 - RNA, 22 nt, Human
ggcacagggaggcccuggugug

SEQ ID NO: 678247 - RNA, 22 nt, Human
uaguggagguggucugugaacu

SEQ ID NO: 678248 - RNA, 23 nt, Human
ucagccucuuaggacuucucacc

SEQ ID NO: 678249 - RNA, 22 nt, Human
cucuuuggauguuuaugauaag

SEQ ID NO: 678250 - RNA, 22 nt, Human
gcugugcacuaccuauacaucc

SEQ ID NO: 678251 - RNA, 22 nt, Human
ggcucugugagaacaaaggcua

SEQ ID NO: 678252 - RNA, 22 nt, Human
ugcugucugauucagggugauu

SEQ ID NO: 678253 - RNA, 22 nt, Human
gacaguccuugcccaguaucua

SEQ ID NO: 678254 - RNA, 22 nt, Human
agggcagcagcuccuccuagcu

SEQ ID NO: 678255 - RNA, 22 nt, Human
gccuggccugaacuaggaggug

SEQ ID NO: 678256 - RNA, 17 nt, Human
gaauaaguggauggcac

SEQ ID NO: 678257 - RNA, 22 nt, Human
ccaggaagaaacagucuuuaua

SEQ ID NO: 678258 - RNA, 22 nt, Human
caggugggagccacagcguaca

SEQ ID NO: 678259 - RNA, 22 nt, Human
cuggaucaugcauugcuugucc

SEQ ID NO: 678260 - RNA, 22 nt, Human
ggaggccuggacuuccugaugg

SEQ ID NO: 678261 - RNA, 22 nt, Human
ccagcuuuccugcgaguugauu

SEQ ID NO: 678262 - RNA, 21 nt, Human
ugcuuuaugggaaaaauguca

SEQ ID NO: 678263 - RNA, 22 nt, Human
ucugcccuggggucagccucca

SEQ ID NO: 678264 - RNA, 22 nt, Human
aggcucagggacggggccccuu

SEQ ID NO: 678265 - RNA, 22 nt, Human
uaacacuguccaaagaauucca

SEQ ID NO: 678266 - RNA, 22 nt, Human
cccugaggcacaggccacguau

SEQ ID NO: 678267 - RNA, 22 nt, Human
cuggagauacugcucuccauau

SEQ ID NO: 678268 - RNA, 22 nt, Human
ggacaaagcucugcugccuccc

SEQ ID NO: 678269 - RNA, 22 nt, Human
gagcuucagcgugugcuaaggg

SEQ ID NO: 678270 - RNA, 22 nt, Human
uggcucugcugaaccuagugca

SEQ ID NO: 678271 - RNA, 20 nt, Human
uggaauggguccuugaaaaa

SEQ ID NO: 678272 - RNA, 22 nt, Human
cugugucugccugggauccauu

SEQ ID NO: 678273 - RNA, 22 nt, Human
auuucuccuccagauggugguu

SEQ ID NO: 678274 - RNA, 22 nt, Human
cacacacuguuaauguaggagu

SEQ ID NO: 678275 - RNA, 22 nt, Human
ugcuacacuuaaaucagucacc

SEQ ID NO: 678276 - RNA, 23 nt, Human
uggacaggguaacuggugguuuu

SEQ ID NO: 678277 - RNA, 22 nt, Human
aguucucuuuagcucauauggu

SEQ ID NO: 678278 - RNA, 22 nt, Human
ucagaaaccagcucucucaauu

SEQ ID NO: 678279 - RNA, 22 nt, Human
cagugacagguuccaugccgca

SEQ ID NO: 678280 - RNA, 22 nt, Human
accaucuuaaggggacuucuua

SEQ ID NO: 678281 - RNA, 22 nt, Human
uaauugcuaaaugaaggagaag

SEQ ID NO: 678282 - RNA, 22 nt, Human
uggcugcaguugggcccucaga

SEQ ID NO: 678283 - RNA, 22 nt, Human
acagacacaggcguggagucgc

SEQ ID NO: 678284 - RNA, 22 nt, Human
gcaagcugaugugauagugaaa

SEQ ID NO: 678285 - RNA, 23 nt, Human
uucuucucaauuaguugauucag

SEQ ID NO: 678286 - RNA, 21 nt, Human
acaaaggaagucucuuuuaag

SEQ ID NO: 678287 - RNA, 22 nt, Human
uugggguaaguuugucaagcug

SEQ ID NO: 678288 - RNA, 22 nt, Human
aaaggagacuucagaucuccuu

SEQ ID NO: 678289 - RNA, 22 nt, Human
ugccucuguugagccuuggcug

SEQ ID NO: 678290 - RNA, 22 nt, Human
cagccacuacaauugguuccau

SEQ ID NO: 678291 - RNA, 22 nt, Human
ccugacuuaagucuccuguugg

SEQ ID NO: 678292 - RNA, 22 nt, Human
acauauuaacugcacuacacua

SEQ ID NO: 678293 - RNA, 22 nt, Human
uuuagacauagcugaaaucauu

SEQ ID NO: 678294 - RNA, 22 nt, Human
uccacuucauccagggucacca

SEQ ID NO: 678295 - RNA, 22 nt, Human
uccacauccauugcuugacuuu

SEQ ID NO: 678296 - RNA, 22 nt, Human
uuggagguuauuaacacuggcc

SEQ ID NO: 678297 - RNA, 22 nt, Human
agccagggugggugaaugcuau

SEQ ID NO: 678298 - RNA, 22 nt, Human
ccuggcugugugaccuuggcaa

SEQ ID NO: 678299 - RNA, 22 nt, Human
ucagccagggcucuggccucag

SEQ ID NO: 678300 - RNA, 22 nt, Human
cagcagcuccucugcggcuaug

SEQ ID NO: 678301 - RNA, 22 nt, Human
aggcaggcaaguucauaugagg

SEQ ID NO: 678302 - RNA, 22 nt, Human
uuuauacauggagaauuuuugc

SEQ ID NO: 678303 - RNA, 22 nt, Human
gaacaaauuggagaaaucagga

SEQ ID NO: 678304 - RNA, 22 nt, Human
ggcaguagccagggacuggcag

SEQ ID NO: 678305 - RNA, 22 nt, Human
ccuacaggaaauuguaucaaaa

SEQ ID NO: 678306 - RNA, 22 nt, Human
aaugaaaugaagauaugaucag

SEQ ID NO: 678307 - RNA, 23 nt, Human
uccaggcacgcauuucuucuagc

SEQ ID NO: 678308 - RNA, 22 nt, Human
uguuugcucugacuaucuugcg

SEQ ID NO: 678309 - RNA, 22 nt, Human
aaggaagagucuagaacaggca

SEQ ID NO: 678310 - RNA, 22 nt, Human
agccagcacuuuuucucugggc

SEQ ID NO: 678311 - RNA, 22 nt, Human
uguuuaugcaucguuaauacca

SEQ ID NO: 678312 - RNA, 22 nt, Human
uggguccauggaacagaggugc

SEQ ID NO: 678313 - RNA, 22 nt, Human
aacagugcugauuauuuuaccu

SEQ ID NO: 678314 - RNA, 22 nt, Human
ugggauauaaucugaaaaguau

SEQ ID NO: 678315 - RNA, 22 nt, Human
gcagugaaucuggcaagaauuu

SEQ ID NO: 678316 - RNA, 22 nt, Human
ccugaagagcacucuagaguug

SEQ ID NO: 678317 - RNA, 22 nt, Human
auacaacuuuacaugcaauucc

SEQ ID NO: 678318 - RNA, 22 nt, Human
cuuauucuacuccacaagcucu

SEQ ID NO: 678319 - RNA, 22 nt, Human
ucaguguuagacaaguuuggaa

SEQ ID NO: 678320 - RNA, 22 nt, Human
gcaguacacacauauguauucg

SEQ ID NO: 678321 - RNA, 22 nt, Human
caguaagucaacaaacaugggg

SEQ ID NO: 678322 - RNA, 22 nt, Human
ucagccagguaauguggagaug

SEQ ID NO: 678323 - RNA, 22 nt, Human
uugagacacuuugggcaucacu

SEQ ID NO: 678324 - RNA, 21 nt, Human
uucauucauggcauaauauag

SEQ ID NO: 678325 - RNA, 22 nt, Human
acuccugccacacagaugcugu

SEQ ID NO: 678326 - RNA, 22 nt, Human
gucugauaucagaaaaaguaaa

SEQ ID NO: 678327 - RNA, 22 nt, Human
cuaaacuuuguuuauacucuga

SEQ ID NO: 678328 - RNA, 23 nt, Human
cagcuccagugcacucagguagc

SEQ ID NO: 678329 - RNA, 21 nt, Human
gcagaaaggaaucuuaggucc

SEQ ID NO: 678330 - RNA, 22 nt, Human
gcugccaguguggcaugaugca

SEQ ID NO: 678331 - RNA, 22 nt, Human
ccuccuggggugaaggauggga

SEQ ID NO: 678332 - RNA, 22 nt, Human
cuaauuauguuguuauaaucaa

SEQ ID NO: 678333 - RNA, 22 nt, Human
agcaggcuuacuuucugauuag

SEQ ID NO: 678334 - RNA, 22 nt, Human
ucucucugccaacucacagcca

SEQ ID NO: 678335 - RNA, 22 nt, Human
agaggccaggcagcccaaggug

SEQ ID NO: 678336 - RNA, 22 nt, Human
uuuacaauugguuuucucuaau

SEQ ID NO: 678337 - RNA, 22 nt, Human
caucuugacugggauaagggau

SEQ ID NO: 678338 - RNA, 22 nt, Human
uauguucugucuguacagauuu

SEQ ID NO: 678339 - RNA, 22 nt, Human
caugugugaagacugcgggcca

SEQ ID NO: 678340 - RNA, 22 nt, Human
gggaguggagagcaauggauga

SEQ ID NO: 678341 - RNA, 22 nt, Human
uaguuuagcuuagccuucuggu

SEQ ID NO: 678342 - RNA, 22 nt, Human
aguguguacauuuggugcaguu

SEQ ID NO: 678343 - RNA, 22 nt, Human
ucuggcuuucugacucuacaac

SEQ ID NO: 678344 - RNA, 22 nt, Human
ugcaacagacuuuauuaacucu

SEQ ID NO: 678345 - RNA, 22 nt, Human
ucagggacauuuagacacugau

SEQ ID NO: 678346 - RNA, 22 nt, Human
cuauauuucuuggcuuuaaaca

SEQ ID NO: 678347 - RNA, 22 nt, Human
aaaccuuucugcucucagcgua

SEQ ID NO: 678348 - RNA, 22 nt, Human
aacaugaaguuuucuauaguga

SEQ ID NO: 678349 - RNA, 22 nt, Human
agaauucucuuccauugaaaca

SEQ ID NO: 678350 - RNA, 22 nt, Human
uuugauauccuauacaaguaaa

SEQ ID NO: 678351 - RNA, 22 nt, Human
auauucuucuuguucagacuau

SEQ ID NO: 678352 - RNA, 19 nt, Human
guugaaaguaggugagggu

SEQ ID NO: 678353 - RNA, 22 nt, Human
agaaucaauuagauucuaugag

SEQ ID NO: 678354 - RNA, 22 nt, Human
aagcuuguagaguuugacuucc

SEQ ID NO: 678355 - RNA, 22 nt, Human
ucuuuccagaggaauuuuuaga

SEQ ID NO: 678356 - RNA, 22 nt, Human
aaaacacugccugcuugacuga

SEQ ID NO: 678357 - RNA, 22 nt, Human
uggccuuguguuuuagagaaag

SEQ ID NO: 678358 - RNA, 20 nt, Human
gggagucuggaugaaagaug

SEQ ID NO: 678359 - RNA, 22 nt, Human
gugcccaguugaggccaggacu

SEQ ID NO: 678360 - RNA, 22 nt, Human
agucuugcauuuucugaagaug

SEQ ID NO: 678361 - RNA, 22 nt, Human
gcuggagcugcagccugggccu

SEQ ID NO: 678362 - RNA, 22 nt, Human
augaguucauacuuucaguacc

SEQ ID NO: 678363 - RNA, 22 nt, Human
acccaggagcucugggguccuc

SEQ ID NO: 678364 - RNA, 22 nt, Human
gugauaaaggggaggaagugug

SEQ ID NO: 678365 - RNA, 21 nt, Human
aauuuugaaggaagauuaagg

SEQ ID NO: 678366 - RNA, 22 nt, Human
ggucugaaaugugacuuuugaa

SEQ ID NO: 678367 - RNA, 22 nt, Human
agagacauggagaggcaaaguu

SEQ ID NO: 678368 - RNA, 22 nt, Human
uuugcuuaaaguucuuucuggu

SEQ ID NO: 678369 - RNA, 22 nt, Human
ggugucuguugccuccugguua

SEQ ID NO: 678370 - RNA, 22 nt, Human
ccucauggccuugagcugaggg

SEQ ID NO: 678371 - RNA, 22 nt, Human
aaaauacuacugucuucuuccc

SEQ ID NO: 678372 - RNA, 21 nt, Human
ugaggccaauagccccuggac

SEQ ID NO: 678373 - RNA, 22 nt, Human
acucccuugguggagaaugcaa

SEQ ID NO: 678374 - RNA, 22 nt, Human
agggcagcagcccauggcucug

SEQ ID NO: 678375 - RNA, 18 nt, Human
aaaauaacaaaguuggcu

SEQ ID NO: 678376 - RNA, 20 nt, Human
aacagggggcugcagagggc

SEQ ID NO: 678377 - RNA, 22 nt, Human
auggcagacgaggcagcagggg

SEQ ID NO: 678378 - RNA, 22 nt, Human
agguucuugguguccagauuuc

SEQ ID NO: 678379 - RNA, 22 nt, Human
cugccuguauugucugcuuggg

SEQ ID NO: 678380 - RNA, 22 nt, Human
ugcagaaauaaagauauuauca

SEQ ID NO: 678381 - RNA, 22 nt, Human
gaaagccagagagaaagggcuc

SEQ ID NO: 678382 - RNA, 22 nt, Human
gcagcagaugcuuucauggaca

SEQ ID NO: 678383 - RNA, 19 nt, Human
gaggugucuuuccugagua

SEQ ID NO: 678384 - RNA, 22 nt, Human
aagcucugggguacacaucugc

SEQ ID NO: 678385 - RNA, 22 nt, Human
ucauuucuguugugcaucacug

SEQ ID NO: 678386 - RNA, 22 nt, Human
ccucaggcccugucccugcgcc

SEQ ID NO: 678387 - RNA, 22 nt, Human
ugggcgggcaggagcgcaccug

SEQ ID NO: 678388 - RNA, 22 nt, Human
agaacacacgucagaguuuccu

SEQ ID NO: 678389 - RNA, 23 nt, Human
acagucguagguauccuuuuccu

SEQ ID NO: 678390 - RNA, 17 nt, Human
gcagccucuugguagug

SEQ ID NO: 678391 - RNA, 22 nt, Human
uguuuaaguucugcuccuuauu

SEQ ID NO: 678392 - RNA, 22 nt, Human
ucacacugugaagagacaagca

SEQ ID NO: 678393 - RNA, 22 nt, Human
cauuaucugagaguguccuaca

SEQ ID NO: 678394 - RNA, 22 nt, Human
cuggcuccacucccugccugac

SEQ ID NO: 678395 - RNA, 22 nt, Human
gggcacuguguucagagugcag

SEQ ID NO: 678396 - RNA, 22 nt, Human
auacuuaacuguggagucauug

SEQ ID NO: 678397 - RNA, 22 nt, Human
aggcuguguggucaugguggcu

SEQ ID NO: 678398 - RNA, 22 nt, Human
ucagaaagguugagucaugugc

SEQ ID NO: 678399 - RNA, 22 nt, Human
cugauagacaaucaccauggga

SEQ ID NO: 678400 - RNA, 22 nt, Human
aucacaaaggucucagagcaca

SEQ ID NO: 678401 - RNA, 22 nt, Human
caaccucuaucggucaggaagc

SEQ ID NO: 678402 - RNA, 22 nt, Human
aguuaaacuugccuuuauuccu

SEQ ID NO: 678403 - RNA, 22 nt, Human
cagugaaguuuaaaguguagau

SEQ ID NO: 678404 - RNA, 22 nt, Human
agguccuggacugcucuuguua

SEQ ID NO: 678405 - RNA, 20 nt, Human
uugagcuuuuaguacagaca

SEQ ID NO: 678406 - RNA, 22 nt, Human
aggcacugggaauaugcugagg

SEQ ID NO: 678407 - RNA, 22 nt, Human
aagauguugggugccuccggaa

SEQ ID NO: 678408 - RNA, 22 nt, Human
ggguuaaacaugcuauaugagu

SEQ ID NO: 678409 - RNA, 20 nt, Human
ugucugaaaaggaagcuauc

SEQ ID NO: 678410 - RNA, 22 nt, Human
gaggaagucucucuacaagaaa

SEQ ID NO: 678411 - RNA, 22 nt, Human
aucugcuuagaauucauugucc

SEQ ID NO: 678412 - RNA, 22 nt, Human
auagcuguuagauuggggucga

SEQ ID NO: 678413 - RNA, 22 nt, Human
uacagcuugacccauaaugucu

SEQ ID NO: 678414 - RNA, 22 nt, Human
ugaaauguagauuaggcauucu

SEQ ID NO: 678415 - RNA, 22 nt, Human
uuuggccuuaguccagaagaag

SEQ ID NO: 678416 - RNA, 22 nt, Human
agacccuggggaaagucacuuc

SEQ ID NO: 678417 - RNA, 22 nt, Human
agcugcugagccauguccugcu

SEQ ID NO: 678418 - RNA, 22 nt, Human
uguccugggaaaucccuuaggc

SEQ ID NO: 678419 - RNA, 22 nt, Human
gcauuucuuccuggugugagcc

SEQ ID NO: 678420 - RNA, 21 nt, Human
ccagguacauggagaaugugg

SEQ ID NO: 678421 - RNA, 22 nt, Human
augacaguagguaaaugauagc

SEQ ID NO: 678422 - RNA, 22 nt, Human
guggccaauaggagcagcuauc

SEQ ID NO: 678423 - RNA, 20 nt, Human
uucaggauucuagaccacac

SEQ ID NO: 678424 - RNA, 19 nt, Human
uuucucugugcaccuuuuc

SEQ ID NO: 678425 - RNA, 18 nt, Human
uuaucugcugcaaagggu

SEQ ID NO: 678426 - RNA, 22 nt, Human
ucagcaucagguugucugaauu

SEQ ID NO: 678427 - RNA, 22 nt, Human
gccagcaguauguccuggcagu

SEQ ID NO: 678428 - RNA, 22 nt, Human
caggcuuaggagucagccugcu

SEQ ID NO: 678429 - RNA, 22 nt, Human
gcaaguacaaacgcaucggcug

SEQ ID NO: 678430 - RNA, 22 nt, Human
uguggcugcaggcgauggagga

SEQ ID NO: 678431 - RNA, 22 nt, Human
aagugucuacauuugcuaacca

SEQ ID NO: 678432 - RNA, 22 nt, Human
auucuauuuuuuaagaaguagu

SEQ ID NO: 678433 - RNA, 22 nt, Human
cugcugugcaggugccuaugau

SEQ ID NO: 678434 - RNA, 22 nt, Human
gugggcuucuguuagggaggcu

SEQ ID NO: 678435 - RNA, 22 nt, Human
uguccuuauaagaaaaggaaau

SEQ ID NO: 678436 - RNA, 22 nt, Human
ugucccugauccacuggacccc

SEQ ID NO: 678437 - RNA, 18 nt, Human
cccugaggcuagcaugcu

SEQ ID NO: 678438 - RNA, 22 nt, Human
caggcccucgcccgcagcgacc

SEQ ID NO: 678439 - RNA, 20 nt, Human
agacccuguguccuguggcc

SEQ ID NO: 678440 - RNA, 22 nt, Human
ucacagaacacaaaugccacuu

SEQ ID NO: 678441 - RNA, 18 nt, Human
uggacacauggccugggu

SEQ ID NO: 678442 - RNA, 22 nt, Human
ucucugggaucguuuugggcuc

SEQ ID NO: 678443 - RNA, 22 nt, Human
uuuaccaucugccacagauaug

SEQ ID NO: 678444 - RNA, 22 nt, Human
gcuguucauagaaauggucuca

SEQ ID NO: 678445 - RNA, 22 nt, Human
cugugaucauucuugauuuaag

SEQ ID NO: 678446 - RNA, 22 nt, Human
uucaaagugcauguuccucaga

SEQ ID NO: 678447 - RNA, 22 nt, Human
ugagaauucuacaauagaucaa

SEQ ID NO: 678448 - RNA, 22 nt, Human
auccaguuaagaugaggucaua

SEQ ID NO: 678449 - RNA, 19 nt, Human
augcacagucauuuguaag

SEQ ID NO: 678450 - RNA, 22 nt, Human
uucuggaaauggguauagagca

SEQ ID NO: 678451 - RNA, 21 nt, Human
ugcuggcugaaaggcacagag

SEQ ID NO: 678452 - RNA, 22 nt, Human
acaugagaagcugcaacaugac

SEQ ID NO: 678453 - RNA, 22 nt, Human
aaugugauuuucccaguagaau

SEQ ID NO: 678454 - RNA, 22 nt, Human
uuuaggagucaaauguuuuagg

SEQ ID NO: 678455 - RNA, 22 nt, Human
auggccaguguugagaucaggc

SEQ ID NO: 678456 - RNA, 22 nt, Human
acugagcacucacuuuuguuau

SEQ ID NO: 678457 - RNA, 22 nt, Human
gccucugcggggcccgagcccg

SEQ ID NO: 678458 - RNA, 22 nt, Human
cugugagcuggguggccaggac

SEQ ID NO: 678459 - RNA, 21 nt, Human
cagcagugugucugagcuaga

SEQ ID NO: 678460 - RNA, 22 nt, Human
acucccacuccagaguagaagc

SEQ ID NO: 678461 - RNA, 21 nt, Human
uucugccuucgaggucucagg

SEQ ID NO: 678462 - RNA, 22 nt, Human
uuucucuaaauagggaggcuua

SEQ ID NO: 678463 - RNA, 22 nt, Human
agcugagagguggcaagcugua

SEQ ID NO: 678464 - RNA, 22 nt, Human
acauuucuuagccuaguuccag

SEQ ID NO: 678465 - RNA, 22 nt, Human
aaaugccuguguaaauucuagc

SEQ ID NO: 678466 - RNA, 22 nt, Human
gcucaggagcucuugguggcgc

SEQ ID NO: 678467 - RNA, 22 nt, Human
cugucauugagccugucagggc

SEQ ID NO: 678468 - RNA, 18 nt, Human
ucagccuguugucugccu

SEQ ID NO: 678469 - RNA, 21 nt, Human
ccuggcugcacaguugcuggu

SEQ ID NO: 678470 - RNA, 22 nt, Human
aaagugcuuuaggauauuugga

SEQ ID NO: 678471 - RNA, 22 nt, Human
uuugauccguugcuggugagga

SEQ ID NO: 678472 - RNA, 22 nt, Human
gggagccaaggagagaggccuu

SEQ ID NO: 678473 - RNA, 22 nt, Human
gaugaagccugacuucucggug

SEQ ID NO: 678474 - RNA, 23 nt, Human
gguagagccgcgcccugggggaa

SEQ ID NO: 678475 - RNA, 22 nt, Human
aucuuugcuauuguaaaucacg

SEQ ID NO: 678476 - RNA, 22 nt, Human
ccauuugugguuuauuugcucu

SEQ ID NO: 678477 - RNA, 22 nt, Human
caggagaccugguaagccaagu

SEQ ID NO: 678478 - RNA, 20 nt, Human
agcugccccugggcacugcc

SEQ ID NO: 678479 - RNA, 22 nt, Human
cccagcagggucucugugucua

SEQ ID NO: 678480 - RNA, 22 nt, Human
auggggcucugcggcugcuccc

SEQ ID NO: 678481 - RNA, 22 nt, Human
ugggcucagccuucauguggcc

SEQ ID NO: 678482 - RNA, 22 nt, Human
aaauuagucauguuguauuacu

SEQ ID NO: 678483 - RNA, 22 nt, Human
uucauucuguuuggaaaggugg

SEQ ID NO: 678484 - RNA, 22 nt, Human
gugcaaccaucaccacugacuc

SEQ ID NO: 678485 - RNA, 22 nt, Human
acaacacagcuuuccucaaguu

SEQ ID NO: 678486 - RNA, 22 nt, Human
cuggcccugccuaauguacuug

SEQ ID NO: 678487 - RNA, 22 nt, Human
aaacagauaaugcuauaaaugg

SEQ ID NO: 678488 - RNA, 22 nt, Human
aaugcaccuaccuugauucugc

SEQ ID NO: 678489 - RNA, 22 nt, Human
uucacuguaugagagggcuuga

SEQ ID NO: 678490 - RNA, 22 nt, Human
acacaguucuuagcaggugucu

SEQ ID NO: 678491 - RNA, 22 nt, Human
gucagcuaauaggguguguguc

SEQ ID NO: 678492 - RNA, 22 nt, Human
aggcgcugcaugugaaggaguu

SEQ ID NO: 678493 - RNA, 22 nt, Human
caggcuuggagggcaguggcau

SEQ ID NO: 678494 - RNA, 22 nt, Human
gcucugacuggugggccacagu

SEQ ID NO: 678495 - RNA, 22 nt, Human
ugaggacaugagugggacagag

SEQ ID NO: 678496 - RNA, 22 nt, Human
uaacacaaaagaauaugugugu

SEQ ID NO: 678497 - RNA, 22 nt, Human
ugaggggagcuagcaugccuug

SEQ ID NO: 678498 - RNA, 22 nt, Human
uuuucuccagggaacaagguga

SEQ ID NO: 678499 - RNA, 22 nt, Human
uauaauaugaggcaggagugau

SEQ ID NO: 678500 - RNA, 22 nt, Human
caguccugugucccuugguggg

SEQ ID NO: 678501 - RNA, 22 nt, Human
gaaggagagagacaucgucccu

SEQ ID NO: 678502 - RNA, 22 nt, Human
ccuccuggccugugcagagccc

SEQ ID NO: 678503 - RNA, 22 nt, Human
ggaagugguagagccaugagug

SEQ ID NO: 678504 - RNA, 22 nt, Human
cagaguguuagcgcugguuggg

SEQ ID NO: 678505 - RNA, 22 nt, Human
ccaguggguaggccauggugag

SEQ ID NO: 678506 - RNA, 22 nt, Human
uaaaugagauuuguucuuuugu

SEQ ID NO: 678507 - RNA, 22 nt, Human
aacaagcagaugcaaugcacuu

SEQ ID NO: 678508 - RNA, 22 nt, Human
ggucuccagcugggacccugca

SEQ ID NO: 678509 - RNA, 22 nt, Human
cugggccuugccuugcccacag

SEQ ID NO: 678510 - RNA, 22 nt, Human
auugaacucugcaggagcugcc

SEQ ID NO: 678511 - RNA, 22 nt, Human
uggggagagguaucauugagau

SEQ ID NO: 678512 - RNA, 22 nt, Human
auaggaaaucgcuauuaaccua

SEQ ID NO: 678513 - RNA, 19 nt, Human
gagaaaccccgucuuuagg

SEQ ID NO: 678514 - RNA, 22 nt, Human
ucaauacauacaauguauagug

SEQ ID NO: 678515 - RNA, 22 nt, Human
ccuggcucauuaugugccccca

SEQ ID NO: 678516 - RNA, 22 nt, Human
aaucuguuuccauuagagucau

SEQ ID NO: 678517 - RNA, 22 nt, Human
uucuucugauugccuucugcaa

SEQ ID NO: 678518 - RNA, 22 nt, Human
gagcugugacacgcagcccagg

SEQ ID NO: 678519 - RNA, 22 nt, Human
ugucuuuucuacuguaagcaua

SEQ ID NO: 678520 - RNA, 22 nt, Human
gagcacagaaucuucccaugca

SEQ ID NO: 678521 - RNA, 22 nt, Human
uggcaguagagcuggaacuuga

SEQ ID NO: 678522 - RNA, 19 nt, Human
cacuaagaugagauauagc

SEQ ID NO: 678523 - RNA, 22 nt, Human
gcuuuacagagaaaguuugccu

SEQ ID NO: 678524 - RNA, 22 nt, Human
uauuagaaagcuuaauaucgug

SEQ ID NO: 678525 - RNA, 22 nt, Human
uuuuggcucugucuguaucuuu

SEQ ID NO: 678526 - RNA, 22 nt, Human
ggucccaggcugcgggcuggug

SEQ ID NO: 678527 - RNA, 22 nt, Human
cugggccuugcaucccagagcc

SEQ ID NO: 678528 - RNA, 22 nt, Human
gcauuguccugcuucugagugu

SEQ ID NO: 678529 - RNA, 22 nt, Human
aaggcuggguaaccuguccacu

SEQ ID NO: 678530 - RNA, 22 nt, Human
cccugagaugugaauuucagag

SEQ ID NO: 678531 - RNA, 22 nt, Human
agaccuggagugaagaguuccc

SEQ ID NO: 678532 - RNA, 22 nt, Human
ucugcaggugggccccuagaau

SEQ ID NO: 678533 - RNA, 22 nt, Human
augcuuuauugcuucugggcac

SEQ ID NO: 678534 - RNA, 22 nt, Human
ucuugcuaaagaccaacacauu

SEQ ID NO: 678535 - RNA, 22 nt, Human
ggauaagaaaauuguaauaacu

SEQ ID NO: 678536 - RNA, 22 nt, Human
aacaucuacagugagauguuag

SEQ ID NO: 678537 - RNA, 21 nt, Human
acacaaaccuccucagccugg

SEQ ID NO: 678538 - RNA, 22 nt, Human
uugauucaaaggggacaagugg

SEQ ID NO: 678539 - RNA, 22 nt, Human
auaugcagagagcaugaauagg

SEQ ID NO: 678540 - RNA, 22 nt, Human
ccacaucagaaauguuuacuca

SEQ ID NO: 678541 - RNA, 22 nt, Human
uggaaaacaugcacauuggauu

SEQ ID NO: 678542 - RNA, 22 nt, Human
cuugggugcucagggaaagcuu

SEQ ID NO: 678543 - RNA, 22 nt, Human
gauauuuacauuaagcacauug

SEQ ID NO: 678544 - RNA, 22 nt, Human
aauaaagcaggguccuugcacu

SEQ ID NO: 678545 - RNA, 22 nt, Human
uguaugaauauguuggggaggu

SEQ ID NO: 678546 - RNA, 21 nt, Human
agcugcuccagggagcucagg

SEQ ID NO: 678547 - RNA, 22 nt, Human
cacagagaauacugcucuugcu

SEQ ID NO: 678548 - RNA, 22 nt, Human
cacauaaauggugccauguuuu

SEQ ID NO: 678549 - RNA, 22 nt, Human
aucucuuugauggcuccuguga

SEQ ID NO: 678550 - RNA, 22 nt, Human
agugcugacucugggcacagug

SEQ ID NO: 678551 - RNA, 22 nt, Human
ugcaggcuuuagccccauggcu

SEQ ID NO: 678552 - RNA, 17 nt, Human
gccuucucugcccucac

SEQ ID NO: 678553 - RNA, 22 nt, Human
acugcuuuuagaaaucuauaga

SEQ ID NO: 678554 - RNA, 22 nt, Human
acauaugugucugcacaugccc

SEQ ID NO: 678555 - RNA, 22 nt, Human
uugcagggcuggaacauggaau

SEQ ID NO: 678556 - RNA, 22 nt, Human
cagauuucuuuagcaagcuaag

SEQ ID NO: 678557 - RNA, 22 nt, Human
ugucaaaaccagcaauuuuguu

SEQ ID NO: 678558 - RNA, 22 nt, Human
agccaguuggcuaugaggagga

SEQ ID NO: 678559 - RNA, 22 nt, Human
uacucacauucuguuucuugcu

SEQ ID NO: 678560 - RNA, 22 nt, Human
gugauaagacaguaggcacaag

SEQ ID NO: 678561 - RNA, 20 nt, Human
aggcagcuggccaggcaggu

SEQ ID NO: 678562 - RNA, 22 nt, Human
ucauugaaugcucugcagguug

SEQ ID NO: 678563 - RNA, 22 nt, Human
ucagugcugaguagcgugcacc

SEQ ID NO: 678564 - RNA, 22 nt, Human
uggcucaguuucaguccugguu

SEQ ID NO: 678565 - RNA, 22 nt, Human
acaauaauguauugccaaaagu

SEQ ID NO: 678566 - RNA, 22 nt, Human
gggugaggagcugccagucaug

SEQ ID NO: 678567 - RNA, 22 nt, Human
ggcaguggaggacccugugucu

SEQ ID NO: 678568 - RNA, 22 nt, Human
uuagugucuucuucauccucug

SEQ ID NO: 678569 - RNA, 22 nt, Human
agggcucugugacuaucacugc

SEQ ID NO: 678570 - RNA, 23 nt, Human
acugggucuaucuccagagaaga

SEQ ID NO: 678571 - RNA, 22 nt, Human
aagaaaagaaaccugaggcuuu

SEQ ID NO: 678572 - RNA, 22 nt, Human
uuaagacaguguauuuguuuuc

SEQ ID NO: 678573 - RNA, 22 nt, Human
augagucacucagcagaaaagg

SEQ ID NO: 678574 - RNA, 22 nt, Human
aggaccuguguuuuccuugaau

SEQ ID NO: 678575 - RNA, 18 nt, Human
gcuuugcacucauguugu

SEQ ID NO: 678576 - RNA, 22 nt, Human
agccaggcggggcagguuuccu

SEQ ID NO: 678577 - RNA, 22 nt, Human
aagaagcuguagggauuaacuc

SEQ ID NO: 678578 - RNA, 22 nt, Human
augcacacguacccuacaaggc

SEQ ID NO: 678579 - RNA, 22 nt, Human
aacaauguaaucuacucugcuc

SEQ ID NO: 678580 - RNA, 18 nt, Human
auccuuggggcugcugcu

SEQ ID NO: 678581 - RNA, 22 nt, Human
uuuccuucuuagcgguguucuu

SEQ ID NO: 678582 - RNA, 22 nt, Human
uuauggaauggagaaagucugc

SEQ ID NO: 678583 - RNA, 22 nt, Human
gaggaagccccauugaagccag

SEQ ID NO: 678584 - RNA, 22 nt, Human
cauuucuccugggugauaaauu

SEQ ID NO: 678585 - RNA, 22 nt, Human
uccucacaagcaagcacaggua

SEQ ID NO: 678586 - RNA, 23 nt, Human
ugcccagugggugcaggggguau

SEQ ID NO: 678587 - RNA, 22 nt, Human
aucaagcacuucuacaugacau

SEQ ID NO: 678588 - RNA, 22 nt, Human
agugaacaguuuggaacacaug

SEQ ID NO: 678589 - RNA, 22 nt, Human
uguacacauuuuuauguuaaca

SEQ ID NO: 678590 - RNA, 22 nt, Human
uugcuaaucauauuucaucacu

SEQ ID NO: 678591 - RNA, 22 nt, Human
aagggaaauccucagcccagga

SEQ ID NO: 678592 - RNA, 22 nt, Human
cugggaggcacuauucaggagg

SEQ ID NO: 678593 - RNA, 22 nt, Human
augugugcuacaggugugggaa

SEQ ID NO: 678594 - RNA, 22 nt, Human
auacauucagcagugcucauga

SEQ ID NO: 678595 - RNA, 22 nt, Human
aggacaguggcaaggcaggaca

SEQ ID NO: 678596 - RNA, 22 nt, Human
caccugcccagcaccugggauc

SEQ ID NO: 678597 - RNA, 20 nt, Human
uacaauacacaugcauauga

SEQ ID NO: 678598 - RNA, 22 nt, Human
agcugcugggaccccagaucca

SEQ ID NO: 678599 - RNA, 22 nt, Human
agccagggugagagggcuuugu

SEQ ID NO: 678600 - RNA, 22 nt, Human
aggaacaacugauucagucaac

SEQ ID NO: 678601 - RNA, 22 nt, Human
cauggcugcgagaagagugggu

SEQ ID NO: 678602 - RNA, 22 nt, Human
cugcagaggucuugcugauggu

SEQ ID NO: 678603 - RNA, 21 nt, Human
ucucccaaggagguccugagg

SEQ ID NO: 678604 - RNA, 22 nt, Human
gcagacacagggaaggcaagga

SEQ ID NO: 678605 - RNA, 22 nt, Human
gaagcacaaaguguaguuccga

SEQ ID NO: 678606 - RNA, 21 nt, Human
caggaacauucuuuacauuua

SEQ ID NO: 678607 - RNA, 22 nt, Human
cugugccaucuuuuugcuaccu

SEQ ID NO: 678608 - RNA, 22 nt, Human
aagaaguuaauaauggugagaa

SEQ ID NO: 678609 - RNA, 22 nt, Human
ccagucccgcaugguccagaau

SEQ ID NO: 678610 - RNA, 22 nt, Human
ucagagucugugcauucugcua

SEQ ID NO: 678611 - RNA, 22 nt, Human
agcuuuauggugccucacuuga

SEQ ID NO: 678612 - RNA, 22 nt, Human
aguguggguuuuauggagcccu

SEQ ID NO: 678613 - RNA, 22 nt, Human
uggcucuguucgccaucaggag

SEQ ID NO: 678614 - RNA, 20 nt, Human
cuguguagugcucagguaag

SEQ ID NO: 678615 - RNA, 22 nt, Human
aggaagggugucaugagcccuu

SEQ ID NO: 678616 - RNA, 22 nt, Human
agcugguucagaaauuagaugg

SEQ ID NO: 678617 - RNA, 22 nt, Human
uggcuucaggagcaccuggcuu

SEQ ID NO: 678618 - RNA, 22 nt, Human
guuuucaugucuauugggcaua

SEQ ID NO: 678619 - RNA, 22 nt, Human
caaauguaauaaggaguuuccc

SEQ ID NO: 678620 - RNA, 22 nt, Human
cacaguccagacuccuggaguu

SEQ ID NO: 678621 - RNA, 22 nt, Human
ccagccucaucauauuccugcu

SEQ ID NO: 678622 - RNA, 22 nt, Human
ggcucagaggagcuggaacggu

SEQ ID NO: 678623 - RNA, 22 nt, Human
aggcagugcaugcaaaggucgg

SEQ ID NO: 678624 - RNA, 22 nt, Human
agaucaaaaacuuaauggcuuu

SEQ ID NO: 678625 - RNA, 22 nt, Human
cuuccaagaugaacagcaagcg

SEQ ID NO: 678626 - RNA, 19 nt, Human
agacagagacugaaauaga

SEQ ID NO: 678627 - RNA, 22 nt, Human
acaauucucucauaucuuauua

SEQ ID NO: 678628 - RNA, 22 nt, Human
cccuuccugggugucccggagu

SEQ ID NO: 678629 - RNA, 22 nt, Human
cugugaaugcuaguaagagugc

SEQ ID NO: 678630 - RNA, 21 nt, Human
cuguggaagggaacuagaggg

SEQ ID NO: 678631 - RNA, 22 nt, Human
ugucugguggguugacaggcag

SEQ ID NO: 678632 - RNA, 20 nt, Human
gacauucauaguuauuacca

SEQ ID NO: 678633 - RNA, 22 nt, Human
aguaacacuauuuucauaugua

SEQ ID NO: 678634 - RNA, 22 nt, Human
ugaaugaguuuggcugcuguuc

SEQ ID NO: 678635 - RNA, 22 nt, Human
aucauguuuuaauuagcaaacu

SEQ ID NO: 678636 - RNA, 22 nt, Human
cccuucagugcuaggcugccug

SEQ ID NO: 678637 - RNA, 22 nt, Human
uucuuauaaguuaauauuucca

SEQ ID NO: 678638 - RNA, 22 nt, Human
aucaggugaugcucugguuccc

SEQ ID NO: 678639 - RNA, 20 nt, Human
agagugggugucacaggcug

SEQ ID NO: 678640 - RNA, 18 nt, Human
ggauaggaccuuaggcag

SEQ ID NO: 678641 - RNA, 22 nt, Human
ggaauacuaugacacacaggug

SEQ ID NO: 678642 - RNA, 22 nt, Human
uugcuucagagggagacacuuu

SEQ ID NO: 678643 - RNA, 22 nt, Human
aaucuagaguucccagcauaaa

SEQ ID NO: 678644 - RNA, 22 nt, Human
agggucucuggagagcugagga

SEQ ID NO: 678645 - RNA, 22 nt, Human
ugcaaagauaugagaagcugua

SEQ ID NO: 678646 - RNA, 22 nt, Human
uacaagucacuuccuuucuaaa

SEQ ID NO: 678647 - RNA, 22 nt, Human
uggcuucaguuccuguguuguu

SEQ ID NO: 678648 - RNA, 18 nt, Human
uugaauucuucuacaugu

SEQ ID NO: 678649 - RNA, 22 nt, Human
ucccaggaugaagacaguguug

SEQ ID NO: 678650 - RNA, 22 nt, Human
uagcuauuguugguaguuaccc

SEQ ID NO: 678651 - RNA, 22 nt, Human
agugcaggagccuggccagagc

SEQ ID NO: 678652 - RNA, 22 nt, Human
uuccagaguugggggagugguu

SEQ ID NO: 678653 - RNA, 22 nt, Human
gccacuguacuccagccugcga

SEQ ID NO: 678654 - RNA, 22 nt, Human
caucuuauuuucuucuagugcu

SEQ ID NO: 678655 - RNA, 22 nt, Human
cagagcggccacuagagggcgc

SEQ ID NO: 678656 - RNA, 22 nt, Human
uauuuucuggacagucuugcuu

SEQ ID NO: 678657 - RNA, 22 nt, Human
guugggguccaaugaagcgagc

SEQ ID NO: 678658 - RNA, 22 nt, Human
auuugccaugaagaguguuuga

SEQ ID NO: 678659 - RNA, 22 nt, Human
agagaagggggaaagaucucac

SEQ ID NO: 678660 - RNA, 22 nt, Human
uagaaauggagaacagauuaau

SEQ ID NO: 678661 - RNA, 23 nt, Human
ugggcaucuccucugugccaggc

SEQ ID NO: 678662 - RNA, 22 nt, Human
aaauguguuuagaugguuuauu

SEQ ID NO: 678663 - RNA, 22 nt, Human
agaguuauggacuuaaugcagg

SEQ ID NO: 678664 - RNA, 22 nt, Human
cagucccacuagugccaauacc

SEQ ID NO: 678665 - RNA, 22 nt, Human
gaggccagaaugagucucuggg

SEQ ID NO: 678666 - RNA, 22 nt, Human
uaaugcaacgugagauaauuaa

SEQ ID NO: 678667 - RNA, 21 nt, Human
ugguaauguucaguauccacu

SEQ ID NO: 678668 - RNA, 22 nt, Human
gaaugcagugacggaggcuuac

SEQ ID NO: 678669 - RNA, 22 nt, Human
agcauuugauauguuuaaaaag

SEQ ID NO: 678670 - RNA, 22 nt, Human
ugggaauagaacaagauagaga

SEQ ID NO: 678671 - RNA, 22 nt, Human
ucaaagaauguuaugaggguag

SEQ ID NO: 678672 - RNA, 22 nt, Human
gugcuucaaguucuuaauguuu

SEQ ID NO: 678673 - RNA, 22 nt, Human
uuacacagcuucuauccuugaa

SEQ ID NO: 678674 - RNA, 22 nt, Human
aagaauguucuuguagucauga

SEQ ID NO: 678675 - RNA, 22 nt, Human
cucuguggguauuuauauguau

SEQ ID NO: 678676 - RNA, 18 nt, Human
aacuguugaaauagcuug

SEQ ID NO: 678677 - RNA, 22 nt, Human
auugacaauguauuuguaucug

SEQ ID NO: 678678 - RNA, 22 nt, Human
cacaauuccauggcauucuuug

SEQ ID NO: 678679 - RNA, 22 nt, Human
uacauacacaaaugcugaaugg

SEQ ID NO: 678680 - RNA, 21 nt, Human
caguuuaauaacaaagaagga

SEQ ID NO: 678681 - RNA, 22 nt, Human
uguaauugcuuguuuaccugcu

SEQ ID NO: 678682 - RNA, 22 nt, Human
ucacauuuguucuugaaucuaa

SEQ ID NO: 678683 - RNA, 22 nt, Human
aacauguugcuuuaauaauauu

SEQ ID NO: 678684 - RNA, 22 nt, Human
ccagcugcccaagaggcauccu

SEQ ID NO: 678685 - RNA, 22 nt, Human
accaugcacagcuguucuauua

SEQ ID NO: 678686 - RNA, 22 nt, Human
gccuggaaugcaaugugacgaa

SEQ ID NO: 678687 - RNA, 22 nt, Human
ccugucagcugauggcuaugua

SEQ ID NO: 678688 - RNA, 22 nt, Human
acaguuugaauaauuuagauag

SEQ ID NO: 678689 - RNA, 22 nt, Human
cugcagagggguugaagggucc

SEQ ID NO: 678690 - RNA, 22 nt, Human
ucuuaacagugcuacagagcag

SEQ ID NO: 678691 - RNA, 19 nt, Human
cucuggagcagacacugga

SEQ ID NO: 678692 - RNA, 22 nt, Human
cugcucagcggaaggaagagcg

SEQ ID NO: 678693 - RNA, 22 nt, Human
caaagcugacgaggucagcauc

SEQ ID NO: 678694 - RNA, 22 nt, Human
augcucuggaguacgugaaauu

SEQ ID NO: 678695 - RNA, 22 nt, Human
gaaagggucuuugauuucccuc

SEQ ID NO: 678696 - RNA, 22 nt, Human
cagaggaggcgguauacacugc

SEQ ID NO: 678697 - RNA, 22 nt, Human
agcuuuauauuuaaugaauucu

SEQ ID NO: 678698 - RNA, 22 nt, Human
ucugccaucuuaauucucuuuu

SEQ ID NO: 678699 - RNA, 23 nt, Human
ucauucaaggcugguaucuuuca

SEQ ID NO: 678700 - RNA, 22 nt, Human
gugacauuuacgaaucuuaucc

SEQ ID NO: 678701 - RNA, 20 nt, Human
ucugauaacugguugugauu

SEQ ID NO: 678702 - RNA, 22 nt, Human
ucaaaguagggguaagccaggc

SEQ ID NO: 678703 - RNA, 21 nt, Human
cuguccuggucuagaggcaca

SEQ ID NO: 678704 - RNA, 22 nt, Human
uuauagugcauaauuaacaugg

SEQ ID NO: 678705 - RNA, 22 nt, Human
guuuucucugagaugccuuucu

SEQ ID NO: 678706 - RNA, 22 nt, Human
cucuugccagagaugagacucu

SEQ ID NO: 678707 - RNA, 22 nt, Human
ucucucuugucaccccaucugc

SEQ ID NO: 678708 - RNA, 22 nt, Human
uucaaaguccugucagguagcc

SEQ ID NO: 678709 - RNA, 22 nt, Human
aguaaagcggugucacagaaug

SEQ ID NO: 678710 - RNA, 22 nt, Human
uguuuagaugcaaagucucaca

SEQ ID NO: 678711 - RNA, 22 nt, Human
ugcccacaucugcuuauuucau

SEQ ID NO: 678712 - RNA, 22 nt, Human
auugacaaaaacaggugguuga

SEQ ID NO: 678713 - RNA, 22 nt, Human
ucuucaugucucugcuugaguc

SEQ ID NO: 678714 - RNA, 22 nt, Human
cacacuuucagguccucuuugc

SEQ ID NO: 678715 - RNA, 19 nt, Human
gagcugagaguagcacugg

SEQ ID NO: 678716 - RNA, 20 nt, Human
uguaaauaggcauuguaguu

SEQ ID NO: 678717 - RNA, 22 nt, Human
ucuuacauauagcaugaguaca

SEQ ID NO: 678718 - RNA, 22 nt, Human
gggcucucaugaguguguggua

SEQ ID NO: 678719 - RNA, 22 nt, Human
cuuucuugguccugaagauggc

SEQ ID NO: 678720 - RNA, 22 nt, Human
gccugccuagaauugcagcuuu

SEQ ID NO: 678721 - RNA, 22 nt, Human
guucagcuaggaauggagaugc

SEQ ID NO: 678722 - RNA, 22 nt, Human
uuggaauucagcuugcuuauaa

SEQ ID NO: 678723 - RNA, 22 nt, Human
acauugaccugauuuugaagac

SEQ ID NO: 678724 - RNA, 22 nt, Human
cuggccugagcacagcggcugc

SEQ ID NO: 678725 - RNA, 22 nt, Human
ucagugcucaggggagccgagg

SEQ ID NO: 678726 - RNA, 22 nt, Human
cagaauugagagaggcuguucu

SEQ ID NO: 678727 - RNA, 22 nt, Human
ggucuggagcuaaucuuguugg

SEQ ID NO: 678728 - RNA, 22 nt, Human
ugucagcaucauuuguugaagg

SEQ ID NO: 678729 - RNA, 22 nt, Human
ccugggaguggcacucacagca

SEQ ID NO: 678730 - RNA, 22 nt, Human
aaaacacacuggaccaauuuaa

SEQ ID NO: 678731 - RNA, 22 nt, Human
cagaggugacccauaguaccuc

SEQ ID NO: 678732 - RNA, 22 nt, Human
uacugcaaaccauuuacaguag

SEQ ID NO: 678733 - RNA, 22 nt, Human
ugaaaugucaguguuuuauaag

SEQ ID NO: 678734 - RNA, 22 nt, Human
gugggacucuucuuuggcagug

SEQ ID NO: 678735 - RNA, 22 nt, Human
uccaaauugacaguagugauua

SEQ ID NO: 678736 - RNA, 22 nt, Human
uagguuuuccuaaaauucuggu

SEQ ID NO: 678737 - RNA, 22 nt, Human
uucucucuuuuggguaggaggu

SEQ ID NO: 678738 - RNA, 22 nt, Human
agcugcugagagucugccgggc

SEQ ID NO: 678739 - RNA, 22 nt, Human
cuuuccucuggcacugucuggu

SEQ ID NO: 678740 - RNA, 22 nt, Human
acgaauaagagauaaagcaagg

SEQ ID NO: 678741 - RNA, 23 nt, Human
cagaaauaaacugguuuguagau

SEQ ID NO: 678742 - RNA, 22 nt, Human
aguaugaagauuauaauuuuuc

SEQ ID NO: 678743 - RNA, 22 nt, Human
aauagugcuuacauuaucauga

SEQ ID NO: 678744 - RNA, 22 nt, Human
ggucuuccgagaggccugugcu

SEQ ID NO: 678745 - RNA, 22 nt, Human
ggagguggcagggaacauaauu

SEQ ID NO: 678746 - RNA, 22 nt, Human
guuuagaaaauagugaagcaag

SEQ ID NO: 678747 - RNA, 22 nt, Human
cuuggcaccaccaaguggccau

SEQ ID NO: 678748 - RNA, 22 nt, Human
agauuucacaugcugcucuauu

SEQ ID NO: 678749 - RNA, 22 nt, Human
uuuaaggaaaaaauguacuuag

SEQ ID NO: 678750 - RNA, 21 nt, Human
gggacaccaacuccagggcuu

SEQ ID NO: 678751 - RNA, 22 nt, Human
uaggcuccugaguccacagcac

SEQ ID NO: 678752 - RNA, 22 nt, Human
cacuuuuaacaggagaauuccc

SEQ ID NO: 678753 - RNA, 22 nt, Human
aaaccucuuaauggccuguaau

SEQ ID NO: 678754 - RNA, 19 nt, Human
gaacacuuacuauauuucu

SEQ ID NO: 678755 - RNA, 22 nt, Human
agcuggagaguuuccaggaagg

SEQ ID NO: 678756 - RNA, 22 nt, Human
ucacaugagguuaugacaaagc

SEQ ID NO: 678757 - RNA, 22 nt, Human
cauuucacacauaaacuugggu

SEQ ID NO: 678758 - RNA, 20 nt, Human
guugaaaguaauaugaugcu

SEQ ID NO: 678759 - RNA, 22 nt, Human
uccaggcaggguuaaggguccu

SEQ ID NO: 678760 - RNA, 22 nt, Human
aggccugccuggagccuggcug

SEQ ID NO: 678761 - RNA, 22 nt, Human
uggagucagcuagaccuguguu

SEQ ID NO: 678762 - RNA, 22 nt, Human
ucuggcccaaguuuucggugag

SEQ ID NO: 678763 - RNA, 22 nt, Human
gaggacucugcaggcugcuccu

SEQ ID NO: 678764 - RNA, 19 nt, Human
ugaggccagcuggcauuuu

SEQ ID NO: 678765 - RNA, 22 nt, Human
cugcccauaaacuuuccaccug

SEQ ID NO: 678766 - RNA, 22 nt, Human
cacaguuucugaacacuuugca

SEQ ID NO: 678767 - RNA, 22 nt, Human
uggugcagaugcaggucacugg

SEQ ID NO: 678768 - RNA, 22 nt, Human
cauccugaagaagccgcacugu

SEQ ID NO: 678769 - RNA, 22 nt, Human
ucuccagggcccccgagcguug

SEQ ID NO: 678770 - RNA, 22 nt, Human
augcugaauauuagccucauga

SEQ ID NO: 678771 - RNA, 22 nt, Human
ugauaaacauuuuaggaacuaa

SEQ ID NO: 678772 - RNA, 22 nt, Human
uggcaccaaaagcagacguauu

SEQ ID NO: 678773 - RNA, 22 nt, Human
ugaguuaaaugagaacaugaaa

SEQ ID NO: 678774 - RNA, 22 nt, Human
auccguuuuuaugaaaugucca

SEQ ID NO: 678775 - RNA, 22 nt, Human
gcugagccacaggcagugcacu

SEQ ID NO: 678776 - RNA, 22 nt, Human
uaacaacucaguuuguuccuug

SEQ ID NO: 678777 - RNA, 22 nt, Human
caaaccuugcagaacugggcag

SEQ ID NO: 678778 - RNA, 21 nt, Human
agaaauguaucauucuuuucc

SEQ ID NO: 678779 - RNA, 22 nt, Human
uuggaaaugauuucuauuauua

SEQ ID NO: 678780 - RNA, 22 nt, Human
uucuugaguaucugcacagugc

SEQ ID NO: 678781 - RNA, 22 nt, Human
cuucuccuaaggucagaauugc

SEQ ID NO: 678782 - RNA, 22 nt, Human
uggucccuaaagaugucuacau

SEQ ID NO: 678783 - RNA, 22 nt, Human
uguccuuguuccuaauguaaaa

SEQ ID NO: 678784 - RNA, 22 nt, Human
auuagaaugacagaaaugaggc

SEQ ID NO: 678785 - RNA, 20 nt, Human
gaggcucugggcauggcgcc

SEQ ID NO: 678786 - RNA, 22 nt, Human
caaggcagcuguagggauuugg

SEQ ID NO: 678787 - RNA, 22 nt, Human
gcaggucuaucaggcugcaggu

SEQ ID NO: 678788 - RNA, 22 nt, Human
gggaggaggaauguuuugugua

SEQ ID NO: 678789 - RNA, 22 nt, Human
cagaccucaguccucaguagga

SEQ ID NO: 678790 - RNA, 22 nt, Human
gggggugaggacaggagcacug

SEQ ID NO: 678791 - RNA, 22 nt, Human
ggagugagagaguuuaagguca

SEQ ID NO: 678792 - RNA, 22 nt, Human
acccacgaagaugagcggcaug

SEQ ID NO: 678793 - RNA, 22 nt, Human
ucaguguuuaccguauguuguu

SEQ ID NO: 678794 - RNA, 22 nt, Human
auguccuuuuaaaaugugagaa

SEQ ID NO: 678795 - RNA, 21 nt, Human
gacauccaugugaguggcagu

SEQ ID NO: 678796 - RNA, 22 nt, Human
gcagacaauuuauuagcagauu

SEQ ID NO: 678797 - RNA, 22 nt, Human
agccuaggguucugaugucacu

SEQ ID NO: 678798 - RNA, 22 nt, Human
uucucuggacagugaagagagg

SEQ ID NO: 678799 - RNA, 22 nt, Human
aacuucauguaauuuaaaacag

SEQ ID NO: 678800 - RNA, 22 nt, Human
ccacauuuuugauacucucacu

SEQ ID NO: 678801 - RNA, 22 nt, Human
ucacuucuucccuugcacauau

SEQ ID NO: 678802 - RNA, 22 nt, Human
uagcucugaccaagagacugag

SEQ ID NO: 678803 - RNA, 22 nt, Human
uggggaggacgggcgccuuccu

SEQ ID NO: 678804 - RNA, 17 nt, Human
caguccucugcucuaag

SEQ ID NO: 678805 - RNA, 22 nt, Human
cuucuucagaggccagccucug

SEQ ID NO: 678806 - RNA, 22 nt, Human
gcuggaguaucuggggaaggag

SEQ ID NO: 678807 - RNA, 22 nt, Human
cauagaaaucaggugagaaucu

SEQ ID NO: 678808 - RNA, 22 nt, Human
guuauuguccauuuauuuagca

SEQ ID NO: 678809 - RNA, 22 nt, Human
ucucagaaauacuauguuguca

SEQ ID NO: 678810 - RNA, 22 nt, Human
gcuggccugggcagaggcuaug

SEQ ID NO: 678811 - RNA, 22 nt, Human
uaaaugcaguacaaauuguucu

SEQ ID NO: 678812 - RNA, 22 nt, Human
aguggagacaggacagucgaua

SEQ ID NO: 678813 - RNA, 22 nt, Human
gggcccagcccucugcucacug

SEQ ID NO: 678814 - RNA, 19 nt, Human
ucaugcauuucuaagugca

SEQ ID NO: 678815 - RNA, 22 nt, Human
uggaggccauaccuccugacau

SEQ ID NO: 678816 - RNA, 22 nt, Human
cuauggcuguguucaugcuaca

SEQ ID NO: 678817 - RNA, 22 nt, Human
gggugcgguccccacagcccgu

SEQ ID NO: 678818 - RNA, 22 nt, Human
ccaggcuggucugaauuucuag

SEQ ID NO: 678819 - RNA, 22 nt, Human
ccaccaggcucuguccgagcgg

SEQ ID NO: 678820 - RNA, 22 nt, Human
auuauuguuuuaauaguagaga

SEQ ID NO: 678821 - RNA, 22 nt, Human
ucugagaguacgggcugcgcgc

SEQ ID NO: 678822 - RNA, 22 nt, Human
gguaaauuuuauguuauguaua

SEQ ID NO: 678823 - RNA, 22 nt, Human
auguuucuguccuacgagauaa

SEQ ID NO: 678824 - RNA, 22 nt, Human
aguguacaagaccuuauuguug

SEQ ID NO: 678825 - RNA, 22 nt, Human
cagcuuugcaggcuggucagug

SEQ ID NO: 678826 - RNA, 22 nt, Human
aaugggaagccagaagacaagg

SEQ ID NO: 678827 - RNA, 22 nt, Human
uuaauuaugagaaagggaaaag

SEQ ID NO: 678828 - RNA, 22 nt, Human
ggaaggaaguaaaugaugcuau

SEQ ID NO: 678829 - RNA, 22 nt, Human
ugugggacagggacagugauau

SEQ ID NO: 678830 - RNA, 22 nt, Human
cccagcucuaggagugguggca

SEQ ID NO: 678831 - RNA, 22 nt, Human
ccucccugggugacgggcuccu

SEQ ID NO: 678832 - RNA, 23 nt, Human
aaguaacagggauaauagcaguu

SEQ ID NO: 678833 - RNA, 22 nt, Human
guuuaugaauugcauucccuuu

SEQ ID NO: 678834 - RNA, 22 nt, Human
gacagugaguaccucaaaggcc

SEQ ID NO: 678835 - RNA, 22 nt, Human
gaugaaaaauugcugugucaua

SEQ ID NO: 678836 - RNA, 22 nt, Human
aacacugaaacauugauugaca

SEQ ID NO: 678837 - RNA, 22 nt, Human
aauacuauguagccaaaauaau

SEQ ID NO: 678838 - RNA, 22 nt, Human
caggcuggagugcagugucgcc

SEQ ID NO: 678839 - RNA, 22 nt, Human
aaacaugaugucauauaugcca

SEQ ID NO: 678840 - RNA, 22 nt, Human
ugggcagaguugugaugaacug

SEQ ID NO: 678841 - RNA, 22 nt, Human
uucuacaugagaaaauguauuu

SEQ ID NO: 678842 - RNA, 22 nt, Human
guauaggcauuuugauuagagu

SEQ ID NO: 678843 - RNA, 22 nt, Human
cccugacucggcgcgcucccgu

SEQ ID NO: 678844 - RNA, 22 nt, Human
ucccugagcuucaucaggcuuu

SEQ ID NO: 678845 - RNA, 21 nt, Human
ugucacauguggaugguauuu

SEQ ID NO: 678846 - RNA, 22 nt, Human
uuuaagacuuagauuuauuggg

SEQ ID NO: 678847 - RNA, 22 nt, Human
cugaggcaccggcaauguucug

SEQ ID NO: 678848 - RNA, 22 nt, Human
cauccagaccgugccaugcugc

SEQ ID NO: 678849 - RNA, 22 nt, Human
cagaauuauaguugcuuuuuaa

SEQ ID NO: 678850 - RNA, 22 nt, Human
guggcugguuuccugcaugcaa

SEQ ID NO: 678851 - RNA, 22 nt, Human
caacuauagggagagugguuaa

SEQ ID NO: 678852 - RNA, 22 nt, Human
gcccacagaggcaccaccaggc

SEQ ID NO: 678853 - RNA, 19 nt, Human
gcaggauaggcugagacua

SEQ ID NO: 678854 - RNA, 22 nt, Human
uaguuuguagaaaucuagaaau

SEQ ID NO: 678855 - RNA, 18 nt, Human
gucuguguggcuugggga

SEQ ID NO: 678856 - RNA, 22 nt, Human
aaacaguguuuuuaugauuuau

SEQ ID NO: 678857 - RNA, 22 nt, Human
cagcccugcagcuggaucucac

SEQ ID NO: 678858 - RNA, 22 nt, Human
cucuuccuuucccuugagggug

SEQ ID NO: 678859 - RNA, 22 nt, Human
ugaacagaucaauagaacugac

SEQ ID NO: 678860 - RNA, 22 nt, Human
aaacaggcuuccauuagagcaa

SEQ ID NO: 678861 - RNA, 22 nt, Human
agcucugacauugauucucagc

SEQ ID NO: 678862 - RNA, 22 nt, Human
aauucucaggaauuucaucugu

SEQ ID NO: 678863 - RNA, 21 nt, Human
guucuuaguuauauucucaau

SEQ ID NO: 678864 - RNA, 22 nt, Human
gacaggcuuugagucccagaac

SEQ ID NO: 678865 - RNA, 17 nt, Human
ugucuucugaagagagc

SEQ ID NO: 678866 - RNA, 21 nt, Human
gaucucuggaaggagaaagcu

SEQ ID NO: 678867 - RNA, 22 nt, Human
cuucugggcagaaguuuugaga

SEQ ID NO: 678868 - RNA, 22 nt, Human
ucaggagucugugcaguuccac

SEQ ID NO: 678869 - RNA, 22 nt, Human
gacauagucucugucuucaugg

SEQ ID NO: 678870 - RNA, 22 nt, Human
uaccaugauguuugaguuacua

SEQ ID NO: 678871 - RNA, 22 nt, Human
acaaauauuuacugaauccacu

SEQ ID NO: 678872 - RNA, 20 nt, Human
uucugaaagcagcagaggga

SEQ ID NO: 678873 - RNA, 22 nt, Human
aaugugaucgcuuuagaagcuu

SEQ ID NO: 678874 - RNA, 22 nt, Human
cgggggcacccacaaaugagga

SEQ ID NO: 678875 - RNA, 22 nt, Human
ucaggcugaggucaucugcauc

SEQ ID NO: 678876 - RNA, 22 nt, Human
gauacaagacuaauaggaaaca

SEQ ID NO: 678877 - RNA, 21 nt, Human
ugacuuuauuugacagcccag

SEQ ID NO: 678878 - RNA, 22 nt, Human
cugggagaggaaccucgagggu

SEQ ID NO: 678879 - RNA, 19 nt, Human
aaagugaaugcuguuuucu

SEQ ID NO: 678880 - RNA, 22 nt, Human
ggcuggaaaggauauuuuaggu

SEQ ID NO: 678881 - RNA, 22 nt, Human
uguggaugagggagugaacaaa

SEQ ID NO: 678882 - RNA, 22 nt, Human
ccuggccacccagccuuggcca

SEQ ID NO: 678883 - RNA, 22 nt, Human
guuauaaauaccuaauaggauu

SEQ ID NO: 678884 - RNA, 22 nt, Human
ggagcugugcugggugaucagg

SEQ ID NO: 678885 - RNA, 22 nt, Human
cuuccagagcugggcugaccuu

SEQ ID NO: 678886 - RNA, 20 nt, Human
ucagcccagggugagcaucu

SEQ ID NO: 678887 - RNA, 22 nt, Human
uuauugugaggaauaagugaga

SEQ ID NO: 678888 - RNA, 22 nt, Human
cacugcaguuccccagugcgca

SEQ ID NO: 678889 - RNA, 22 nt, Human
cagagcagccuccagggggagc

SEQ ID NO: 678890 - RNA, 22 nt, Human
cagauucuuaauuuaugggauu

SEQ ID NO: 678891 - RNA, 22 nt, Human
uaacaugcuaauuugcagauag

SEQ ID NO: 678892 - RNA, 22 nt, Human
gcccugcccugagccguagacc

SEQ ID NO: 678893 - RNA, 22 nt, Human
aucugcuugaaacuucuuauac

SEQ ID NO: 678894 - RNA, 22 nt, Human
ugagccagucugucugggugaa

SEQ ID NO: 678895 - RNA, 22 nt, Human
aucuuguuauaagagauaaugg

SEQ ID NO: 678896 - RNA, 22 nt, Human
cagucaccaccagguggcagua

SEQ ID NO: 678897 - RNA, 22 nt, Human
aguuuuauggcucaaccuaaua

SEQ ID NO: 678898 - RNA, 22 nt, Human
cugcuuuaauguaagauauacc

SEQ ID NO: 678899 - RNA, 22 nt, Human
caaccucuggaaaguauggaca

SEQ ID NO: 678900 - RNA, 19 nt, Human
agaggcagucuccaacagg

SEQ ID NO: 678901 - RNA, 22 nt, Human
cagcucaaguuucccaggucag

SEQ ID NO: 678902 - RNA, 22 nt, Human
gaaccucuuugugcuucagcuu

SEQ ID NO: 678903 - RNA, 22 nt, Human
ucauucuuuaccaaguugucac

SEQ ID NO: 678904 - RNA, 22 nt, Human
ugugaaaucaauuagcugcaga

SEQ ID NO: 678905 - RNA, 22 nt, Human
auguagaccuuucuuugugauu

SEQ ID NO: 678906 - RNA, 22 nt, Human
uuagccauuuuauacaagugua

SEQ ID NO: 678907 - RNA, 23 nt, Human
ucugggcauaucuagucacaucg

SEQ ID NO: 678908 - RNA, 20 nt, Human
cacucuaaccauauuuccuc

SEQ ID NO: 678909 - RNA, 21 nt, Human
ggcaggugggucucuguugcu

SEQ ID NO: 678910 - RNA, 22 nt, Human
agaauuguaauaauaauagcau

SEQ ID NO: 678911 - RNA, 22 nt, Human
gaauauauuauucagcuuuuca

SEQ ID NO: 678912 - RNA, 22 nt, Human
gccuggcugggcugaaugcuua

SEQ ID NO: 678913 - RNA, 17 nt, Human
augcuccauucagaagc

SEQ ID NO: 678914 - RNA, 22 nt, Human
aaucuuuuaggggauccugagg

SEQ ID NO: 678915 - RNA, 22 nt, Human
gguggcagcgucuaucugacau

SEQ ID NO: 678916 - RNA, 22 nt, Human
uagcaucuccuuaggguaagga

SEQ ID NO: 678917 - RNA, 22 nt, Human
uauguacagggauagaacuuga

SEQ ID NO: 678918 - RNA, 22 nt, Human
ucaauguucugauucuuuugca

SEQ ID NO: 678919 - RNA, 19 nt, Human
cugucccucccagguauga

SEQ ID NO: 678920 - RNA, 22 nt, Human
uuuacacugcuugaacaaucuc

SEQ ID NO: 678921 - RNA, 22 nt, Human
aaacaguuuucucauuuagugu

SEQ ID NO: 678922 - RNA, 22 nt, Human
ugugaaaagggcuuuguacaaa

SEQ ID NO: 678923 - RNA, 22 nt, Human
aaucagcagaagagaggucuua

SEQ ID NO: 678924 - RNA, 22 nt, Human
aaugaacauggacaaguuaaua

SEQ ID NO: 678925 - RNA, 22 nt, Human
auguacauuuagaucauuucug

SEQ ID NO: 678926 - RNA, 22 nt, Human
ccauggagcaccucacagaggc

SEQ ID NO: 678927 - RNA, 22 nt, Human
gcaacuuaggaguuagagcaug

SEQ ID NO: 678928 - RNA, 22 nt, Human
uuagcugaguggugcuggcuca

SEQ ID NO: 678929 - RNA, 22 nt, Human
gggcugugaggugagaacuuac

SEQ ID NO: 678930 - RNA, 22 nt, Human
ugcaaacuauugguagagaugg

SEQ ID NO: 678931 - RNA, 22 nt, Human
cuauuugucaguuuggcuuuaa

SEQ ID NO: 678932 - RNA, 22 nt, Human
ugggaaugugagcauucauuca

SEQ ID NO: 678933 - RNA, 22 nt, Human
aagcacagugggcagagcagcc

SEQ ID NO: 678934 - RNA, 22 nt, Human
uucuccucugcaaugacuggca

SEQ ID NO: 678935 - RNA, 21 nt, Human
auugaaagucaacaaucaguu

SEQ ID NO: 678936 - RNA, 19 nt, Human
ugcuucuggaaugcaaggc

SEQ ID NO: 678937 - RNA, 22 nt, Human
cuguggcucuccaauggaggga

SEQ ID NO: 678938 - RNA, 22 nt, Human
agggaagccaagccuuagagaa

SEQ ID NO: 678939 - RNA, 21 nt, Human
ucugggcagcccaguccugag

SEQ ID NO: 678940 - RNA, 22 nt, Human
uauugcugccucguccaggcug

SEQ ID NO: 678941 - RNA, 22 nt, Human
aaaacugagguuuccugaagaa

SEQ ID NO: 678942 - RNA, 22 nt, Human
uaccuggaauagagucucucca

SEQ ID NO: 678943 - RNA, 22 nt, Human
agugcuguccaguuucacaggu

SEQ ID NO: 678944 - RNA, 22 nt, Human
ucugagaguagagcugccucuu

SEQ ID NO: 678945 - RNA, 22 nt, Human
uugacaaucccuguuagaagug

SEQ ID NO: 678946 - RNA, 22 nt, Human
gugccuggaaugcgccucggcg

SEQ ID NO: 678947 - RNA, 22 nt, Human
ggcaucagcccgguccugggcu

SEQ ID NO: 678948 - RNA, 22 nt, Human
ccaggagccugggccaggcugg

SEQ ID NO: 678949 - RNA, 22 nt, Human
uaucauuuguuauuauuagugg

SEQ ID NO: 678950 - RNA, 22 nt, Human
ccauccuggccucgcuguccac

SEQ ID NO: 678951 - RNA, 22 nt, Human
augguuucacaaacaaaagguu

SEQ ID NO: 678952 - RNA, 22 nt, Human
aggaaacuaauuaguagaauaa

SEQ ID NO: 678953 - RNA, 22 nt, Human
cucuuuaguuugaaauccacau

SEQ ID NO: 678954 - RNA, 22 nt, Human
uguuuucugaugguuaaugagu

SEQ ID NO: 678955 - RNA, 22 nt, Human
cucuggacacuggcaugggguc

SEQ ID NO: 678956 - RNA, 20 nt, Human
ucucugaguuuccuaauuug

SEQ ID NO: 678957 - RNA, 22 nt, Human
uuuacagaaugucaauuucuau

SEQ ID NO: 678958 - RNA, 22 nt, Human
cucugggagaggacacuuggag

SEQ ID NO: 678959 - RNA, 22 nt, Human
aauguauaaccauaggaaauuu

SEQ ID NO: 678960 - RNA, 22 nt, Human
gaagauuggggccucugcaccc

SEQ ID NO: 678961 - RNA, 22 nt, Human
aauuccagcugauugacuuucc

SEQ ID NO: 678962 - RNA, 22 nt, Human
uugccuggagggacauggagac

SEQ ID NO: 678963 - RNA, 22 nt, Human
cagcccuggccccagguggucu

SEQ ID NO: 678964 - RNA, 22 nt, Human
aauguguuaguauugauuuguc

SEQ ID NO: 678965 - RNA, 22 nt, Human
uaaaugcuaucgcauaaaaccu

SEQ ID NO: 678966 - RNA, 22 nt, Human
auccaggcugcgggucucaagu

SEQ ID NO: 678967 - RNA, 22 nt, Human
aacuauacucuguaaaugugcu

SEQ ID NO: 678968 - RNA, 22 nt, Human
gucuggguggcugcuuucagcu

SEQ ID NO: 678969 - RNA, 22 nt, Human
acugaacagccuuucaaacuua

SEQ ID NO: 678970 - RNA, 20 nt, Human
ccugccugccucggcucauu

SEQ ID NO: 678971 - RNA, 22 nt, Human
uggcucuggugcgggcuccugc

SEQ ID NO: 678972 - RNA, 22 nt, Human
acucuggagauggaugucagga

SEQ ID NO: 678973 - RNA, 22 nt, Human
gcagaaguaggcucuguguagg

SEQ ID NO: 678974 - RNA, 22 nt, Human
aauauagauuuacucaagagaa

SEQ ID NO: 678975 - RNA, 21 nt, Human
uccugcagaaugccuuccuac

SEQ ID NO: 678976 - RNA, 22 nt, Human
aaagcagcggugucuuuacugc

SEQ ID NO: 678977 - RNA, 22 nt, Human
aagcacagagaugggcacgccu

SEQ ID NO: 678978 - RNA, 22 nt, Human
acuuagaagaugcaguaaagca

SEQ ID NO: 678979 - RNA, 22 nt, Human
caugucuuuguuaugcucacca

SEQ ID NO: 678980 - RNA, 22 nt, Human
auugucaucgauguuagccagu

SEQ ID NO: 678981 - RNA, 22 nt, Human
cuguggcuuugugucuauugua

SEQ ID NO: 678982 - RNA, 22 nt, Human
aaagcuuucuagcuauguucua

SEQ ID NO: 678983 - RNA, 22 nt, Human
aucaccacuacaaacaucauug

SEQ ID NO: 678984 - RNA, 22 nt, Human
uugcacagaugcacaugguugc

SEQ ID NO: 678985 - RNA, 17 nt, Human
gaaaggaggcaacacug

SEQ ID NO: 678986 - RNA, 22 nt, Human
auaugugugcacauauguauuu

SEQ ID NO: 678987 - RNA, 22 nt, Human
ugagcugcagugagcugagaug

SEQ ID NO: 678988 - RNA, 22 nt, Human
caugaguuuuuuaguucaugca

SEQ ID NO: 678989 - RNA, 23 nt, Human
agcuaaggaagcugaggcacagu

SEQ ID NO: 678990 - RNA, 22 nt, Human
ccagucaaguugacacaccaag

SEQ ID NO: 678991 - RNA, 22 nt, Human
guggcagaguucaggcguuugg

SEQ ID NO: 678992 - RNA, 22 nt, Human
auauguuuuucacagguuuaag

SEQ ID NO: 678993 - RNA, 22 nt, Human
cacuggcauuagucacgaggca

SEQ ID NO: 678994 - RNA, 22 nt, Human
uccagguagauuuauuccagcc

SEQ ID NO: 678995 - RNA, 22 nt, Human
gcagucacagggagauggugac

SEQ ID NO: 678996 - RNA, 22 nt, Human
caaugauguuuagauaaaaucc

SEQ ID NO: 678997 - RNA, 22 nt, Human
uaaaugacauucuuaagucuug

SEQ ID NO: 678998 - RNA, 22 nt, Human
gaacagggaguacggcacauuu

SEQ ID NO: 678999 - RNA, 20 nt, Human
accagguggcugaugacacc

SEQ ID NO: 679000 - RNA, 22 nt, Human
cagucuaccuuucagacauuga

SEQ ID NO: 679001 - RNA, 22 nt, Human
ugggccaggucugugucagcug

SEQ ID NO: 679002 - RNA, 22 nt, Human
cuggaagagcauuugcauaggg

SEQ ID NO: 679003 - RNA, 22 nt, Human
agaucagaaauguaauggcagu

SEQ ID NO: 679004 - RNA, 22 nt, Human
uguuuauuuucaggauggauug

SEQ ID NO: 679005 - RNA, 22 nt, Human
accaggaguaacagugaguggu

SEQ ID NO: 679006 - RNA, 22 nt, Human
cauuuuauguuuauggagugcu

SEQ ID NO: 679007 - RNA, 22 nt, Human
agacacuguguacagaaaaaga

SEQ ID NO: 679008 - RNA, 22 nt, Human
uagacauuuggcaugguuuuca

SEQ ID NO: 679009 - RNA, 22 nt, Human
ugcagggccgcuggaggucaug

SEQ ID NO: 679010 - RNA, 22 nt, Human
uguugcacggccuucacagagc

SEQ ID NO: 679011 - RNA, 21 nt, Human
ccuauugaauauaggaagauu

SEQ ID NO: 679012 - RNA, 22 nt, Human
gaagccagauuaucacaagcca

SEQ ID NO: 679013 - RNA, 22 nt, Human
uagguuuacugaauuaguggaa

SEQ ID NO: 679014 - RNA, 22 nt, Human
ucucaucugcgagcucugccag

SEQ ID NO: 679015 - RNA, 22 nt, Human
cugcccucuagaggaggacuga

SEQ ID NO: 679016 - RNA, 22 nt, Human
aacagcagcuuucaggaucauc

SEQ ID NO: 679017 - RNA, 22 nt, Human
uacuuugucauucuaaccuucc

SEQ ID NO: 679018 - RNA, 22 nt, Human
cagcuucugcuaucgaacaucu

SEQ ID NO: 679019 - RNA, 22 nt, Human
auuucugcuacugcacccuagu

SEQ ID NO: 679020 - RNA, 22 nt, Human
gccuggcagugaugucuuuugg

SEQ ID NO: 679021 - RNA, 17 nt, Human
uaucagaauguguuuac

SEQ ID NO: 679022 - RNA, 22 nt, Human
caucacuguccucagcauucca

SEQ ID NO: 679023 - RNA, 22 nt, Human
aagggcagcuuaaauugguagc

SEQ ID NO: 679024 - RNA, 22 nt, Human
auguggggacucugagagaauu

SEQ ID NO: 679025 - RNA, 22 nt, Human
ccagucagccaagcugcagcgg

SEQ ID NO: 679026 - RNA, 22 nt, Human
cuuucacaguccugacugagcg

SEQ ID NO: 679027 - RNA, 22 nt, Human
accccaggucaucugagagucc

SEQ ID NO: 679028 - RNA, 22 nt, Human
uguacauagaucuugaaaauua

SEQ ID NO: 679029 - RNA, 15 nt, Human
gccccaggaaucaaa

SEQ ID NO: 679030 - RNA, 22 nt, Human
auaaggaaugauguaucaguuu

SEQ ID NO: 679031 - RNA, 22 nt, Human
uuuguaacaaguugaucuggua

SEQ ID NO: 679032 - RNA, 22 nt, Human
aacagcuuugcuucuggagaca

SEQ ID NO: 679033 - RNA, 22 nt, Human
auacacauguuauuguggaagc

SEQ ID NO: 679034 - RNA, 22 nt, Human
ggcuccuguggcaagacagcuu

SEQ ID NO: 679035 - RNA, 22 nt, Human
ccugagcucaaagggugccugg

SEQ ID NO: 679036 - RNA, 22 nt, Human
cagaguggcacucugcuggaug

SEQ ID NO: 679037 - RNA, 22 nt, Human
ugcuuaauguacgugaguguac

SEQ ID NO: 679038 - RNA, 22 nt, Human
gaaucacgguauucugcacggg

SEQ ID NO: 679039 - RNA, 22 nt, Human
ugugaugucagugguaucaaag

SEQ ID NO: 679040 - RNA, 22 nt, Human
ggggccuguagagcuucaggga

SEQ ID NO: 679041 - RNA, 22 nt, Human
aguuuuaugcaguguucugaua

SEQ ID NO: 679042 - RNA, 22 nt, Human
caggaggcagagguugcagcga

SEQ ID NO: 679043 - RNA, 22 nt, Human
gaaaucuuuuaaccauucauuu

SEQ ID NO: 679044 - RNA, 22 nt, Human
uccccagaggaauaugagauug

SEQ ID NO: 679045 - RNA, 23 nt, Human
ucugggcaccuuguugacaugau

SEQ ID NO: 679046 - RNA, 22 nt, Human
cagaucugugguaucucuauuu

SEQ ID NO: 679047 - RNA, 20 nt, Human
uccugagccuccaccauguc

SEQ ID NO: 679048 - RNA, 22 nt, Human
ugcagcagguauggcaagcucc

SEQ ID NO: 679049 - RNA, 22 nt, Human
cagcugcaggcugugcaggaag

SEQ ID NO: 679050 - RNA, 21 nt, Human
cagcacaguacugggucuugc

SEQ ID NO: 679051 - RNA, 22 nt, Human
gaauucugucgcuuacuagaug

SEQ ID NO: 679052 - RNA, 22 nt, Human
uuggcagaauuaaccacugaag

SEQ ID NO: 679053 - RNA, 22 nt, Human
ggccaggcuggucucagacuuc

SEQ ID NO: 679054 - RNA, 22 nt, Human
ucccugugagucaacuaaacaa

SEQ ID NO: 679055 - RNA, 20 nt, Human
gcugggcuaccacuggcccu

SEQ ID NO: 679056 - RNA, 22 nt, Human
gagcugcuggcuccucagguua

SEQ ID NO: 679057 - RNA, 22 nt, Human
gguaacugaggccauauucuga

SEQ ID NO: 679058 - RNA, 22 nt, Human
ugguggcagcaggagggccccu

SEQ ID NO: 679059 - RNA, 22 nt, Human
ggcuggaaggcccuuuguugau

SEQ ID NO: 679060 - RNA, 22 nt, Human
gugcacagaagcagaagcuaga

SEQ ID NO: 679061 - RNA, 19 nt, Human
ccugcugcaccacuuguua

SEQ ID NO: 679062 - RNA, 19 nt, Human
agcccagcuuauuugucag

SEQ ID NO: 679063 - RNA, 22 nt, Human
ugggaacaacaugcacugccac

SEQ ID NO: 679064 - RNA, 22 nt, Human
uagaaucaagcaguagagcaga

SEQ ID NO: 679065 - RNA, 22 nt, Human
gccugagauuggacauuauuua

SEQ ID NO: 679066 - RNA, 22 nt, Human
ugauuucucauauuguucaaaa

SEQ ID NO: 679067 - RNA, 22 nt, Human
uaguuaggaaaguccagggagc

SEQ ID NO: 679068 - RNA, 22 nt, Human
ucacacauacucaugugugagu

SEQ ID NO: 679069 - RNA, 22 nt, Human
auguacaguggaaacuaacaaa

SEQ ID NO: 679070 - RNA, 21 nt, Human
uagcacagcuguagacaguuu

SEQ ID NO: 679071 - RNA, 22 nt, Human
agggcucagaaagcagguuuuc

SEQ ID NO: 679072 - RNA, 22 nt, Human
aaguucaagucuccugaguaua

SEQ ID NO: 679073 - RNA, 22 nt, Human
uuucucugaguuguuacaaaac

SEQ ID NO: 679074 - RNA, 22 nt, Human
gaagaaauguguucaagguagg

SEQ ID NO: 679075 - RNA, 23 nt, Human
ggacccuguggagggugagaguc

SEQ ID NO: 679076 - RNA, 21 nt, Human
gggcuccagagauguagcuuc

SEQ ID NO: 679077 - RNA, 20 nt, Human
cccuggccuguuucaugccc

SEQ ID NO: 679078 - RNA, 22 nt, Human
agcucucccauagggcaagauc

SEQ ID NO: 679079 - RNA, 22 nt, Human
uuauuaggaaaaggucagaugu

SEQ ID NO: 679080 - RNA, 22 nt, Human
gccugggagagggauagugcag

SEQ ID NO: 679081 - RNA, 22 nt, Human
gggaagagugucgguugaagug

SEQ ID NO: 679082 - RNA, 22 nt, Human
ucugccaugcuaacuucaguau

SEQ ID NO: 679083 - RNA, 23 nt, Human
aagaacugcgaauggagaaagua

SEQ ID NO: 679084 - RNA, 22 nt, Human
agcacauucugccuugcuuugc

SEQ ID NO: 679085 - RNA, 22 nt, Human
uuguuuguaaggcucuuagaau

SEQ ID NO: 679086 - RNA, 22 nt, Human
ugcaggaguuccccucugccug

SEQ ID NO: 679087 - RNA, 22 nt, Human
aaggaggcagaacucacaugga

SEQ ID NO: 679088 - RNA, 22 nt, Human
ggcucuagagacucuagagaaa

SEQ ID NO: 679089 - RNA, 22 nt, Human
aucuucaacuugaucauuugaa

SEQ ID NO: 679090 - RNA, 22 nt, Human
uuuaggaaguuucagauaggaa

SEQ ID NO: 679091 - RNA, 22 nt, Human
ucucucagacuccccaugguuu

SEQ ID NO: 679092 - RNA, 19 nt, Human
aggugaggggcaccauguc

SEQ ID NO: 679093 - RNA, 22 nt, Human
aacaguauaugaaauguuagga

SEQ ID NO: 679094 - RNA, 20 nt, Human
acacaugcauagagagagag

SEQ ID NO: 679095 - RNA, 22 nt, Human
uugcaggggaaggagcagagcu

SEQ ID NO: 679096 - RNA, 22 nt, Human
agugugagcuaauagcagagcc

SEQ ID NO: 679097 - RNA, 22 nt, Human
augaaacaugcuuuguggauga

SEQ ID NO: 679098 - RNA, 22 nt, Human
caggaggagcauuagcgucuca

SEQ ID NO: 679099 - RNA, 22 nt, Human
uauuucugucagccagauaugg

SEQ ID NO: 679100 - RNA, 22 nt, Human
ggcucaggcuggagugcagugg

SEQ ID NO: 679101 - RNA, 22 nt, Human
augcacaguaaugagcugguug

SEQ ID NO: 679102 - RNA, 22 nt, Human
uaucacacuagccuauagugga

SEQ ID NO: 679103 - RNA, 22 nt, Human
augaaauggugguuuuccauuu

SEQ ID NO: 679104 - RNA, 23 nt, Human
uuuuccuguggagacaugacugg

SEQ ID NO: 679105 - RNA, 22 nt, Human
cuaguuuaaagcagcugaaagg

SEQ ID NO: 679106 - RNA, 22 nt, Human
gggucuccugagagaagaugcu

SEQ ID NO: 679107 - RNA, 22 nt, Human
gcagguggucacucauccccag

SEQ ID NO: 679108 - RNA, 22 nt, Human
uuacaauugagucuauuguaug

SEQ ID NO: 679109 - RNA, 22 nt, Human
ucacuguauuuggaagggaugg

SEQ ID NO: 679110 - RNA, 22 nt, Human
ccugauucugaugccucaugga

SEQ ID NO: 679111 - RNA, 19 nt, Human
auucagcauucugcacuuc

SEQ ID NO: 679112 - RNA, 22 nt, Human
uccuuuaaacuccuuucaaguc

SEQ ID NO: 679113 - RNA, 22 nt, Human
cagcccugucccugagggaccu

SEQ ID NO: 679114 - RNA, 22 nt, Human
gcacacauucuagccuuuugug

SEQ ID NO: 679115 - RNA, 22 nt, Human
acugaaaaugaauuagaaacag

SEQ ID NO: 679116 - RNA, 22 nt, Human
ccauuuguucgcccagcuccaa

SEQ ID NO: 679117 - RNA, 22 nt, Human
gaccucagugaauggucaugua

SEQ ID NO: 679118 - RNA, 22 nt, Human
uaugcagugguaucauuuuaaa

SEQ ID NO: 679119 - RNA, 22 nt, Human
cuggcagcgugagcagcaucca

SEQ ID NO: 679120 - RNA, 22 nt, Human
gaaacaacuacuauugauuucu

SEQ ID NO: 679121 - RNA, 22 nt, Human
gcuccccagcuuagcccuggcu

SEQ ID NO: 679122 - RNA, 22 nt, Human
uuaugcuaaaugaaucaaguca

SEQ ID NO: 679123 - RNA, 22 nt, Human
gccucccuggcccacagcagcg

SEQ ID NO: 679124 - RNA, 22 nt, Human
ccaagggaaggauguauaugau

SEQ ID NO: 679125 - RNA, 23 nt, Human
agcucugcucgggcaugcccugc

SEQ ID NO: 679126 - RNA, 22 nt, Human
ccaaaggccaagcucagguaaa

SEQ ID NO: 679127 - RNA, 22 nt, Human
aucugagucaaauauuucauuu

SEQ ID NO: 679128 - RNA, 22 nt, Human
ugaacccugaccucuggaagga

SEQ ID NO: 679129 - RNA, 22 nt, Human
ugaggugguucaagagccuugu

SEQ ID NO: 679130 - RNA, 19 nt, Human
ccuuccuccccagggccau

SEQ ID NO: 679131 - RNA, 22 nt, Human
gaacagcuauaaucaucugucc

SEQ ID NO: 679132 - RNA, 22 nt, Human
aauacugucuuucacagauauu

SEQ ID NO: 679133 - RNA, 22 nt, Human
ugcaccauguaaguggccacgu

SEQ ID NO: 679134 - RNA, 22 nt, Human
uguacacauuaagcucuuuaga

SEQ ID NO: 679135 - RNA, 22 nt, Human
gcagggacaaggcagguguucu

SEQ ID NO: 679136 - RNA, 22 nt, Human
cuuccagugcauagguagauca

SEQ ID NO: 679137 - RNA, 22 nt, Human
cagcaggcagccauuucacugu

SEQ ID NO: 679138 - RNA, 22 nt, Human
ucaugcaagaauaauaggaagg

SEQ ID NO: 679139 - RNA, 22 nt, Human
auucauuuagguauucacuuac

SEQ ID NO: 679140 - RNA, 22 nt, Human
ggagccugagcggcccagggcc

SEQ ID NO: 679141 - RNA, 22 nt, Human
gacagcaggugcuugggaaagg

SEQ ID NO: 679142 - RNA, 22 nt, Human
agacuauuaccuaaaagauaca

SEQ ID NO: 679143 - RNA, 22 nt, Human
uuuauucacuggggucugcccg

SEQ ID NO: 679144 - RNA, 22 nt, Human
uguuaaacagcugucuucuuca

SEQ ID NO: 679145 - RNA, 20 nt, Human
gaaucuuuccccaugcaaug

SEQ ID NO: 679146 - RNA, 21 nt, Human
uggcugcacuguggcuuucau

SEQ ID NO: 679147 - RNA, 22 nt, Human
aguguggacuuuuccuaggagg

SEQ ID NO: 679148 - RNA, 22 nt, Human
ugccucugugggccuuccuggc

SEQ ID NO: 679149 - RNA, 21 nt, Human
cacaccaaacaggaacaggga

SEQ ID NO: 679150 - RNA, 22 nt, Human
uggcucagaagaaaagguaaac

SEQ ID NO: 679151 - RNA, 22 nt, Human
cuaggcuggagugcaguggcau

SEQ ID NO: 679152 - RNA, 19 nt, Human
ugggcuuccccagggcaga

SEQ ID NO: 679153 - RNA, 22 nt, Human
gcugucuugaugauuggaugcu

SEQ ID NO: 679154 - RNA, 22 nt, Human
uucugggggaauacagcuauga

SEQ ID NO: 679155 - RNA, 22 nt, Human
augcauauuuucuacuauaucg

SEQ ID NO: 679156 - RNA, 22 nt, Human
aagugucuuaacuccuuuuggg

SEQ ID NO: 679157 - RNA, 22 nt, Human
agggaugggaacuccuccagca

SEQ ID NO: 679158 - RNA, 22 nt, Human
acaguggaaagaacauggauuu

SEQ ID NO: 679159 - RNA, 22 nt, Human
gggcugacucugcacugagcca

SEQ ID NO: 679160 - RNA, 22 nt, Human
aaaucacuaaguuauagugugg

SEQ ID NO: 679161 - RNA, 21 nt, Human
ucccagcugggucagugcugc

SEQ ID NO: 679162 - RNA, 22 nt, Human
auauuuucuggaacuaugccug

SEQ ID NO: 679163 - RNA, 22 nt, Human
ggucagccccugcucaaggccg

SEQ ID NO: 679164 - RNA, 22 nt, Human
aaauguaguauguugcauguau

SEQ ID NO: 679165 - RNA, 22 nt, Human
cuggccagugacugcucacccg

SEQ ID NO: 679166 - RNA, 22 nt, Human
uaaugcuuuguuuugaucuaac

SEQ ID NO: 679167 - RNA, 21 nt, Human
agguuccagcagccagagaau

SEQ ID NO: 679168 - RNA, 22 nt, Human
aaaugugagacugaguuuuccu

SEQ ID NO: 679169 - RNA, 22 nt, Human
aauaauauuccucugugugcgu

SEQ ID NO: 679170 - RNA, 22 nt, Human
ucucuugauauauuacauagag

SEQ ID NO: 679171 - RNA, 22 nt, Human
auaauucagguuuucuggcaca

SEQ ID NO: 679172 - RNA, 17 nt, Human
ggaccagggguugccau

SEQ ID NO: 679173 - RNA, 22 nt, Human
aggaagaggugugcaauggugu

SEQ ID NO: 679174 - RNA, 22 nt, Human
aaaggcaggacugcagcauagg

SEQ ID NO: 679175 - RNA, 22 nt, Human
acauuuaaccaaacuguuuaau

SEQ ID NO: 679176 - RNA, 22 nt, Human
gaggaacccagcugggguugcc

SEQ ID NO: 679177 - RNA, 22 nt, Human
accucuggccuucaggcaucau

SEQ ID NO: 679178 - RNA, 20 nt, Human
aggucugauuccagaaucag

SEQ ID NO: 679179 - RNA, 22 nt, Human
uccuguuuaucugugugacucg

SEQ ID NO: 679180 - RNA, 22 nt, Human
ucaaugauagacaagaucuaag

SEQ ID NO: 679181 - RNA, 22 nt, Human
ugcauguuaagaaaauauugag

SEQ ID NO: 679182 - RNA, 22 nt, Human
aucauucaagugcucuaaaaug

SEQ ID NO: 679183 - RNA, 22 nt, Human
guuucucagcaacuauaugacu

SEQ ID NO: 679184 - RNA, 22 nt, Human
ccucagugugcagcagcaucug

SEQ ID NO: 679185 - RNA, 22 nt, Human
caggagugucuccacacagcaa

SEQ ID NO: 679186 - RNA, 22 nt, Human
ugcuccugagugugcaggagau

SEQ ID NO: 679187 - RNA, 22 nt, Human
gugguaccaguaggucagccau

SEQ ID NO: 679188 - RNA, 22 nt, Human
agccuggcuguaaccucauggu

SEQ ID NO: 679189 - RNA, 22 nt, Human
uaagcauuaacucugcugcaag

SEQ ID NO: 679190 - RNA, 22 nt, Human
ccuggacagggccaggccaugc

SEQ ID NO: 679191 - RNA, 22 nt, Human
gcugucaccaaagcaggcacug

SEQ ID NO: 679192 - RNA, 22 nt, Human
auaggcaagggauacaauauac

SEQ ID NO: 679193 - RNA, 22 nt, Human
gcucaaagaccagacagaggag

SEQ ID NO: 679194 - RNA, 22 nt, Human
agaagagccuggggaccauggc

SEQ ID NO: 679195 - RNA, 22 nt, Human
aauguucucaacaaaaggaagc

SEQ ID NO: 679196 - RNA, 22 nt, Human
ucccuggcagcuguccuuucag

SEQ ID NO: 679197 - RNA, 22 nt, Human
gaaauuaaccaccuuuggcuuu

SEQ ID NO: 679198 - RNA, 22 nt, Human
ucaguugcuagaagggggaacc

SEQ ID NO: 679199 - RNA, 19 nt, Human
uguucagauaugucagcuu

SEQ ID NO: 679200 - RNA, 22 nt, Human
caccagcuacagacuacugugu

SEQ ID NO: 679201 - RNA, 22 nt, Human
acagcagguuacaguggcacag

SEQ ID NO: 679202 - RNA, 18 nt, Human
ucacaugauuacccuggg

SEQ ID NO: 679203 - RNA, 22 nt, Human
gaggaacuuaugauauucuacu

SEQ ID NO: 679204 - RNA, 22 nt, Human
accuggcugguugugauuccca

SEQ ID NO: 679205 - RNA, 18 nt, Human
agcuccuggucucaggga

SEQ ID NO: 679206 - RNA, 20 nt, Human
caguuuaucuuuccggagcu

SEQ ID NO: 679207 - RNA, 22 nt, Human
uuauggagugcuuaccugccag

SEQ ID NO: 679208 - RNA, 22 nt, Human
aagcacagggugucugcauuca

SEQ ID NO: 679209 - RNA, 22 nt, Human
ucaaggaaaagauaacuugaug

SEQ ID NO: 679210 - RNA, 22 nt, Human
agugcuaaugugcaauauagag

SEQ ID NO: 679211 - RNA, 22 nt, Human
aaaggccacacagagcagggag

SEQ ID NO: 679212 - RNA, 22 nt, Human
caagaugaucccugaaggcagc

SEQ ID NO: 679213 - RNA, 22 nt, Human
aggcuccaagagguuaagucac

SEQ ID NO: 679214 - RNA, 22 nt, Human
agcacuguggggaacucacaga

SEQ ID NO: 679215 - RNA, 22 nt, Human
aguacacuggcaaauguggugg

SEQ ID NO: 679216 - RNA, 22 nt, Human
uuucauauuauuccuugagucu

SEQ ID NO: 679217 - RNA, 22 nt, Human
aaguggggccuggugguacagu

SEQ ID NO: 679218 - RNA, 22 nt, Human
gcagcaagaauaauuuggguag

SEQ ID NO: 679219 - RNA, 22 nt, Human
ccucccacauccuagcucugcu

SEQ ID NO: 679220 - RNA, 22 nt, Human
gcucucucgugaacaggugguu

SEQ ID NO: 679221 - RNA, 22 nt, Human
acugugugcuggacaugauguu

SEQ ID NO: 679222 - RNA, 22 nt, Human
acuguacauauggauucuaaga

SEQ ID NO: 679223 - RNA, 22 nt, Human
gccaggcucuugguuauguuuu

SEQ ID NO: 679224 - RNA, 22 nt, Human
uguggcaguauaagagcuagaa

SEQ ID NO: 679225 - RNA, 22 nt, Human
agagccaggacugugucucacu

SEQ ID NO: 679226 - RNA, 22 nt, Human
uacagaaaucacaucgcuuuga

SEQ ID NO: 679227 - RNA, 22 nt, Human
aucuucucauguguaaugaggu

SEQ ID NO: 679228 - RNA, 22 nt, Human
aauaacagugccaugaaauuga

SEQ ID NO: 679229 - RNA, 22 nt, Human
guauuuggucuauuuggcaucc

SEQ ID NO: 679230 - RNA, 22 nt, Human
agaauagaauucucauagaauu

SEQ ID NO: 679231 - RNA, 22 nt, Human
agaggggcccgguucuccgucu

SEQ ID NO: 679232 - RNA, 22 nt, Human
accccccagauaaucccuugag

SEQ ID NO: 679233 - RNA, 22 nt, Human
ucugaaagcccuaguuuguaau

SEQ ID NO: 679234 - RNA, 21 nt, Human
ucaggcugucugcugguucca

SEQ ID NO: 679235 - RNA, 22 nt, Human
caauucaaccuaagugcaucca

SEQ ID NO: 679236 - RNA, 22 nt, Human
uuauccaagcagaagcugcaca

SEQ ID NO: 679237 - RNA, 19 nt, Human
uucaggauugacccuacug

SEQ ID NO: 679238 - RNA, 22 nt, Human
uuccuuccauagcaaaacaugc

SEQ ID NO: 679239 - RNA, 20 nt, Human
agaucuuuucuauagaagug

SEQ ID NO: 679240 - RNA, 22 nt, Human
aaggcagaggaaggucuaguuu

SEQ ID NO: 679241 - RNA, 19 nt, Human
gaaagauuucaguugagga

SEQ ID NO: 679242 - RNA, 22 nt, Human
auuugccucugcuuucaaggau

SEQ ID NO: 679243 - RNA, 22 nt, Human
agauacauugaguuuccuccug

SEQ ID NO: 679244 - RNA, 22 nt, Human
ucacugggagaugugggaaggg

SEQ ID NO: 679245 - RNA, 22 nt, Human
guuugcauaaaguggaugcagg

SEQ ID NO: 679246 - RNA, 22 nt, Human
gacuuuauaaaugagaggcgga

SEQ ID NO: 679247 - RNA, 22 nt, Human
uucuuucccuuccagcagcucc

SEQ ID NO: 679248 - RNA, 22 nt, Human
cuuccuaaaagcuucaagagaa

SEQ ID NO: 679249 - RNA, 22 nt, Human
caaugcaagcaagauggucaca

SEQ ID NO: 679250 - RNA, 22 nt, Human
gaauuuacaaguugaauaacaa

SEQ ID NO: 679251 - RNA, 22 nt, Human
ccugagagagugagcccugaca

SEQ ID NO: 679252 - RNA, 22 nt, Human
cuguauuugaaagaaaagauuu

SEQ ID NO: 679253 - RNA, 22 nt, Human
gagcccgagcgcguacccggcg

SEQ ID NO: 679254 - RNA, 22 nt, Human
aacuucucagccugcaccuggc

SEQ ID NO: 679255 - RNA, 22 nt, Human
caguauuuuuaagcugcuuugu

SEQ ID NO: 679256 - RNA, 23 nt, Human
ugcagguagggcccagcagucuu

SEQ ID NO: 679257 - RNA, 22 nt, Human
ucuaugugcccuuugugugaug

SEQ ID NO: 679258 - RNA, 22 nt, Human
agaaaugaagcaggaguuauua

SEQ ID NO: 679259 - RNA, 22 nt, Human
augauacucuaggugauuuaca

SEQ ID NO: 679260 - RNA, 22 nt, Human
cucugggugggcagcagaugga

SEQ ID NO: 679261 - RNA, 22 nt, Human
augugaaauauuaagccgagga

SEQ ID NO: 679262 - RNA, 22 nt, Human
agcagcuuaucuuggagaggca

SEQ ID NO: 679263 - RNA, 22 nt, Human
uggcucagccauucguguugcc

SEQ ID NO: 679264 - RNA, 22 nt, Human
gagcccaggcagagguugcagu

SEQ ID NO: 679265 - RNA, 23 nt, Human
ucuuuacagcagcaggauuugga

SEQ ID NO: 679266 - RNA, 22 nt, Human
acacucacccucccacugccug

SEQ ID NO: 679267 - RNA, 22 nt, Human
cuuaauuucaaacugcuaguga

SEQ ID NO: 679268 - RNA, 22 nt, Human
gcugggaacacagccaugagag

SEQ ID NO: 679269 - RNA, 22 nt, Human
ccucugaguccucccugguugc

SEQ ID NO: 679270 - RNA, 22 nt, Human
ugggacucacucuuuuggccag

SEQ ID NO: 679271 - RNA, 22 nt, Human
cagaagcaaaugccuugcugag

SEQ ID NO: 679272 - RNA, 22 nt, Human
aagaugaaucaguauguguccu

SEQ ID NO: 679273 - RNA, 20 nt, Human
guguuucaugugauacaaug

SEQ ID NO: 679274 - RNA, 22 nt, Human
gugagcguggucuucugugggu

SEQ ID NO: 679275 - RNA, 22 nt, Human
uugcaggguuaaaguaagguag

SEQ ID NO: 679276 - RNA, 22 nt, Human
ggagccagaaaugcugugguug

SEQ ID NO: 679277 - RNA, 22 nt, Human
acucucugugauggaggccagc

SEQ ID NO: 679278 - RNA, 22 nt, Human
ugucucagaguaucccugaacu

SEQ ID NO: 679279 - RNA, 22 nt, Human
gcccugugguuccaggaagcaa

SEQ ID NO: 679280 - RNA, 22 nt, Human
cagcacccucggaggcugccgu

SEQ ID NO: 679281 - RNA, 22 nt, Human
uucaaugauuuuuagggaucau

SEQ ID NO: 679282 - RNA, 22 nt, Human
agggagcucgaugccugagugu

SEQ ID NO: 679283 - RNA, 22 nt, Human
acuguaaagaaguaaguauggg

SEQ ID NO: 679284 - RNA, 22 nt, Human
cugcuggggaggcgccucgacg

SEQ ID NO: 679285 - RNA, 22 nt, Human
agcacccucagccuuauccaga

SEQ ID NO: 679286 - RNA, 22 nt, Human
ccaaagugcugagauuacaggu

SEQ ID NO: 679287 - RNA, 22 nt, Human
gugauuucagguuuuucauacu

SEQ ID NO: 679288 - RNA, 22 nt, Human
cugugucucccaaggaggguca

SEQ ID NO: 679289 - RNA, 22 nt, Human
uggagagccuucccggcaucgc

SEQ ID NO: 679290 - RNA, 22 nt, Human
uuaagaggugaggccuuuaaga

SEQ ID NO: 679291 - RNA, 22 nt, Human
aucucauuuugguuucuacuua

SEQ ID NO: 679292 - RNA, 22 nt, Human
cugggcccuauggaagaaaggg

SEQ ID NO: 679293 - RNA, 22 nt, Human
cuuuguaagucuuucuccaaga

SEQ ID NO: 679294 - RNA, 22 nt, Human
ucagcacugauguuucagaaga

SEQ ID NO: 679295 - RNA, 22 nt, Human
uuccuggucccguucuucacug

SEQ ID NO: 679296 - RNA, 22 nt, Human
auugauucuguaagucaacaau

SEQ ID NO: 679297 - RNA, 22 nt, Human
aggggcugacuggaaagugcca

SEQ ID NO: 679298 - RNA, 22 nt, Human
aggcagucagcccugcuagggu

SEQ ID NO: 679299 - RNA, 22 nt, Human
ggagcugcuuugaucugaagaa

SEQ ID NO: 679300 - RNA, 22 nt, Human
uggcccugcacccagagcaguu

SEQ ID NO: 679301 - RNA, 22 nt, Human
cagugcaugaaacaauaugcag

SEQ ID NO: 679302 - RNA, 23 nt, Human
uccaagggcuacaaacacagacc

SEQ ID NO: 679303 - RNA, 22 nt, Human
cagcugcccauccugggaaaug

SEQ ID NO: 679304 - RNA, 22 nt, Human
ugacagaguccagaaguagugu

SEQ ID NO: 679305 - RNA, 22 nt, Human
agaaguaggcagggcuguauca

SEQ ID NO: 679306 - RNA, 23 nt, Human
ugggauggauucaccagugugcu

SEQ ID NO: 679307 - RNA, 22 nt, Human
gugguccuuuagaggauguaau

SEQ ID NO: 679308 - RNA, 22 nt, Human
accagcaucaccuggaggccug

SEQ ID NO: 679309 - RNA, 22 nt, Human
ucuaaagaagaggguucugcgg

SEQ ID NO: 679310 - RNA, 22 nt, Human
gcccagagggaagaggugucau

SEQ ID NO: 679311 - RNA, 20 nt, Human
gggugugugcagggccuggu

SEQ ID NO: 679312 - RNA, 22 nt, Human
caaucacuccacaauaugguuc

SEQ ID NO: 679313 - RNA, 22 nt, Human
aaugcuguaaagaugcuaucug

SEQ ID NO: 679314 - RNA, 22 nt, Human
uugccuuguuauucucucagaa

SEQ ID NO: 679315 - RNA, 22 nt, Human
uuuuucuuaaauguggguuggc

SEQ ID NO: 679316 - RNA, 22 nt, Human
cugaauucugccuugaggccuu

SEQ ID NO: 679317 - RNA, 20 nt, Human
caucaacaccuugucagccu

SEQ ID NO: 679318 - RNA, 21 nt, Human
gaaaaccauuugcaucaugag

SEQ ID NO: 679319 - RNA, 22 nt, Human
ugcugcauuuaucuucucaaac

SEQ ID NO: 679320 - RNA, 22 nt, Human
uagacauuuucucaacaucucu

SEQ ID NO: 679321 - RNA, 22 nt, Human
cagaaauaugugccaugccuua

SEQ ID NO: 679322 - RNA, 22 nt, Human
caguggguccugcgucugccag

SEQ ID NO: 679323 - RNA, 17 nt, Human
uuccccugaccaagccu

SEQ ID NO: 679324 - RNA, 22 nt, Human
gccugccugcugucaucugccu

SEQ ID NO: 679325 - RNA, 22 nt, Human
ccugggcaauauagugaggccc

SEQ ID NO: 679326 - RNA, 22 nt, Human
gcuucuuuccuugggcuggaac

SEQ ID NO: 679327 - RNA, 22 nt, Human
uagaacacuugaccacugcucc

SEQ ID NO: 679328 - RNA, 22 nt, Human
gcaaugucugugcuaaaaacug

SEQ ID NO: 679329 - RNA, 22 nt, Human
ugcagaagaauguaggcauaag

SEQ ID NO: 679330 - RNA, 22 nt, Human
aauauccauugggagcaaaugg

SEQ ID NO: 679331 - RNA, 22 nt, Human
ugcagcugugccugaaaaguac

SEQ ID NO: 679332 - RNA, 22 nt, Human
uccuugaaaaucuugguuuaga

SEQ ID NO: 679333 - RNA, 22 nt, Human
uagugaauaguccaaucccgca

SEQ ID NO: 679334 - RNA, 22 nt, Human
aacugcauguguguggcaugau

SEQ ID NO: 679335 - RNA, 22 nt, Human
uacaguguuucccccaggauag

SEQ ID NO: 679336 - RNA, 22 nt, Human
uccaggcaucuguauuuuuuaa

SEQ ID NO: 679337 - RNA, 22 nt, Human
augcaugaaagaauccaagccu

SEQ ID NO: 679338 - RNA, 22 nt, Human
acagaauuaaaguguuugugga

SEQ ID NO: 679339 - RNA, 21 nt, Human
cucugguuugcauuggauuau

SEQ ID NO: 679340 - RNA, 22 nt, Human
ccugaagauccauuauagacac

SEQ ID NO: 679341 - RNA, 22 nt, Human
gugcauauauaugggagggagc

SEQ ID NO: 679342 - RNA, 22 nt, Human
auuuaucaccaguuagcugacu

SEQ ID NO: 679343 - RNA, 22 nt, Human
acuuuacauuugaucucucuaa

SEQ ID NO: 679344 - RNA, 22 nt, Human
uauuucaugugcaccauaauuc

SEQ ID NO: 679345 - RNA, 22 nt, Human
aggcgcugaguaggcaaggagg

SEQ ID NO: 679346 - RNA, 22 nt, Human
cugcagccuccugggguacaug

SEQ ID NO: 679347 - RNA, 22 nt, Human
cagcccuucuuccaaccagcuu

SEQ ID NO: 679348 - RNA, 22 nt, Human
gcagcagaguagacagagcccu

SEQ ID NO: 679349 - RNA, 22 nt, Human
gcagcagagaacacaaugaugg

SEQ ID NO: 679350 - RNA, 22 nt, Human
agaggcugagaaacccucuucu

SEQ ID NO: 679351 - RNA, 22 nt, Human
cuauugaauagcccaaaucauu

SEQ ID NO: 679352 - RNA, 22 nt, Human
ucacugaaccagggaucucuag

SEQ ID NO: 679353 - RNA, 22 nt, Human
uccugggauucugcauuucuaa

SEQ ID NO: 679354 - RNA, 22 nt, Human
ucuuggcucugccacuaauuag

SEQ ID NO: 679355 - RNA, 22 nt, Human
ucaggccuagggagccacacca

SEQ ID NO: 679356 - RNA, 18 nt, Human
aggcaggcggaucacaag

SEQ ID NO: 679357 - RNA, 19 nt, Human
cacacccaugcuugccaag

SEQ ID NO: 679358 - RNA, 22 nt, Human
ucuggcaggguguguauuuaca

SEQ ID NO: 679359 - RNA, 22 nt, Human
caggagauaaaagagaugcuuu

SEQ ID NO: 679360 - RNA, 23 nt, Human
cacuccuguuucuaagccagcau

SEQ ID NO: 679361 - RNA, 22 nt, Human
uggacucaaguccaaguucacg

SEQ ID NO: 679362 - RNA, 22 nt, Human
gggugcaagcaaguggcacaga

SEQ ID NO: 679363 - RNA, 22 nt, Human
caaaaguucucacccagacaug

SEQ ID NO: 679364 - RNA, 19 nt, Human
uccucaggggcucacagac

SEQ ID NO: 679365 - RNA, 22 nt, Human
ggacugagcugacaucuguugg

SEQ ID NO: 679366 - RNA, 22 nt, Human
ucugucauuucaauaugguuaa

SEQ ID NO: 679367 - RNA, 20 nt, Human
ucaaguuuugcuugacaaga

SEQ ID NO: 679368 - RNA, 22 nt, Human
uuucuucuugaguaaccagauu

SEQ ID NO: 679369 - RNA, 22 nt, Human
acacagggggcauucuaggagu

SEQ ID NO: 679370 - RNA, 22 nt, Human
auuucuugauuccaccagugaa

SEQ ID NO: 679371 - RNA, 22 nt, Human
gguacaaaguuagauuuaacuu

SEQ ID NO: 679372 - RNA, 22 nt, Human
ucagaaucuuucuagagucuag

SEQ ID NO: 679373 - RNA, 22 nt, Human
ucuuccagaaugcauucucuuu

SEQ ID NO: 679374 - RNA, 20 nt, Human
agcaaggcuaaaucaugauu

SEQ ID NO: 679375 - RNA, 22 nt, Human
uuggcagagggaccagccuaca

SEQ ID NO: 679376 - RNA, 18 nt, Human
gagcugggagaaggaagg

SEQ ID NO: 679377 - RNA, 22 nt, Human
agcagcaggauuuucguuggga

SEQ ID NO: 679378 - RNA, 22 nt, Human
cugccuuuggggaguuagaggg

SEQ ID NO: 679379 - RNA, 22 nt, Human
gccaaagcccaggagacagcca

SEQ ID NO: 679380 - RNA, 22 nt, Human
uguaaacugcuucucaccaagg

SEQ ID NO: 679381 - RNA, 22 nt, Human
aauuccacagcugcacagaggu

SEQ ID NO: 679382 - RNA, 22 nt, Human
guggucagugguacaguuugaa

SEQ ID NO: 679383 - RNA, 22 nt, Human
ggcacuggaaggaucaugugag

SEQ ID NO: 679384 - RNA, 18 nt, Human
aaguaacagaagagcaca

SEQ ID NO: 679385 - RNA, 22 nt, Human
uuuuaugugucaaagcaguggu

SEQ ID NO: 679386 - RNA, 22 nt, Human
agagagggaauauuugggguau

SEQ ID NO: 679387 - RNA, 22 nt, Human
auccagagacuggggcugggau

SEQ ID NO: 679388 - RNA, 22 nt, Human
auauuuguauuucgugugugua

SEQ ID NO: 679389 - RNA, 22 nt, Human
gacagggaggaaagagacugcu

SEQ ID NO: 679390 - RNA, 23 nt, Human
acuguuggugcagaagugccuug

SEQ ID NO: 679391 - RNA, 22 nt, Human
cgcgcucauuuccgccuccuuc

SEQ ID NO: 679392 - RNA, 22 nt, Human
gaggaagcugcguggcauuuca

SEQ ID NO: 679393 - RNA, 22 nt, Human
ggaggucacaaggugaguaaag

SEQ ID NO: 679394 - RNA, 22 nt, Human
cuacagucuggcaggaauguua

SEQ ID NO: 679395 - RNA, 22 nt, Human
uggaggcaguaacugagcaaca

SEQ ID NO: 679396 - RNA, 22 nt, Human
ucaggagugccaguaccuuuug

SEQ ID NO: 679397 - RNA, 22 nt, Human
guacagaauuaugccaugaggg

SEQ ID NO: 679398 - RNA, 22 nt, Human
augugaaaauccaauggcagca

SEQ ID NO: 679399 - RNA, 22 nt, Human
aaugucuauuugcuacaaagcc

SEQ ID NO: 679400 - RNA, 18 nt, Human
agcaggacuguggggugg

SEQ ID NO: 679401 - RNA, 22 nt, Human
uucauaguguuuccuuccagug

SEQ ID NO: 679402 - RNA, 22 nt, Human
ugguacuuggaggcagaaaaau

SEQ ID NO: 679403 - RNA, 20 nt, Human
uuuaacuggccuucuggcuc

SEQ ID NO: 679404 - RNA, 23 nt, Human
aucuccugagaacccacaguggu

SEQ ID NO: 679405 - RNA, 20 nt, Human
caaggcagaccagagugagu

SEQ ID NO: 679406 - RNA, 22 nt, Human
ggccagguccaguggaaggccc

SEQ ID NO: 679407 - RNA, 18 nt, Human
gucaggcaugaaucuggg

SEQ ID NO: 679408 - RNA, 22 nt, Human
acauuucagauucaugaaguga

SEQ ID NO: 679409 - RNA, 22 nt, Human
agagucagaaagcagacagggg

SEQ ID NO: 679410 - RNA, 22 nt, Human
acagggagugcaauucauauug

SEQ ID NO: 679411 - RNA, 22 nt, Human
ucccagagccucugccacucug

SEQ ID NO: 679412 - RNA, 22 nt, Human
aggaaacagugaacuuggcagg

SEQ ID NO: 679413 - RNA, 22 nt, Human
ugcuccagcaugacccucaaug

SEQ ID NO: 679414 - RNA, 21 nt, Human
gccaccccuggcacaggugcu

SEQ ID NO: 679415 - RNA, 22 nt, Human
gauucuuacuucuaagcaagcu

SEQ ID NO: 679416 - RNA, 22 nt, Human
guacaguaaucccguucuucug

SEQ ID NO: 679417 - RNA, 22 nt, Human
uuuagucugacuauuaccucca

SEQ ID NO: 679418 - RNA, 22 nt, Human
uuagaggacaagaggccuggcu

SEQ ID NO: 679419 - RNA, 22 nt, Human
ggcaggugugagcuguaaagga

SEQ ID NO: 679420 - RNA, 22 nt, Human
agggcuccaggggaccaucagu

SEQ ID NO: 679421 - RNA, 22 nt, Human
cugggagggguagccaauccua

SEQ ID NO: 679422 - RNA, 22 nt, Human
gagaggcccugaagcccacaga

SEQ ID NO: 679423 - RNA, 22 nt, Human
uccaguggguugcugagggagg

SEQ ID NO: 679424 - RNA, 22 nt, Human
acucagaggaaaguugagauug

SEQ ID NO: 679425 - RNA, 22 nt, Human
acaguaauauugaugcucguca

SEQ ID NO: 679426 - RNA, 22 nt, Human
agucuggcuuuuugaugagcuu

SEQ ID NO: 679427 - RNA, 22 nt, Human
agcagcacauggggcuggcaac

SEQ ID NO: 679428 - RNA, 22 nt, Human
aaucagaauuuguccccugagu

SEQ ID NO: 679429 - RNA, 20 nt, Human
gcacaguuugggaaccaugg

SEQ ID NO: 679430 - RNA, 22 nt, Human
augcaauauguguuucuguuua

SEQ ID NO: 679431 - RNA, 22 nt, Human
gagcaggcaaagaugaaaggag

SEQ ID NO: 679432 - RNA, 22 nt, Human
accucuuaauauugcaccuucu

SEQ ID NO: 679433 - RNA, 22 nt, Human
ccagggagcccacaggacaaug

SEQ ID NO: 679434 - RNA, 22 nt, Human
ucuguuuagaugcuuuaucugu

SEQ ID NO: 679435 - RNA, 22 nt, Human
gagcuguggaaggcagggacca

SEQ ID NO: 679436 - RNA, 22 nt, Human
cuucccagaacaauguaggcuu

SEQ ID NO: 679437 - RNA, 22 nt, Human
ccagcuccccucagcagguaau

SEQ ID NO: 679438 - RNA, 22 nt, Human
uuuucuuauagagcuuaaaguu

SEQ ID NO: 679439 - RNA, 22 nt, Human
augcaguguuuggaagcuuaag

SEQ ID NO: 679440 - RNA, 22 nt, Human
ccccacacucuuuacauucaua

SEQ ID NO: 679441 - RNA, 22 nt, Human
uuauucagucugucuagggagu

SEQ ID NO: 679442 - RNA, 22 nt, Human
cauuugugugggaacccaucag

SEQ ID NO: 679443 - RNA, 22 nt, Human
cagagucuggacugcaggcucc

SEQ ID NO: 679444 - RNA, 22 nt, Human
agcagaagaaagccacaugacu

SEQ ID NO: 679445 - RNA, 22 nt, Human
cugcugucaaaggaaauauuug

SEQ ID NO: 679446 - RNA, 22 nt, Human
acaucucagaacugaguaaccg

SEQ ID NO: 679447 - RNA, 22 nt, Human
agcugucaccaggagccggacc

SEQ ID NO: 679448 - RNA, 22 nt, Human
ccaggagagcaggcgugcagcu

SEQ ID NO: 679449 - RNA, 22 nt, Human
agcaggcuccaggcuggccauc

SEQ ID NO: 679450 - RNA, 22 nt, Human
agcucccagcagagcuggccac

SEQ ID NO: 679451 - RNA, 22 nt, Human
uugcaagggcaugugugcgugu

SEQ ID NO: 679452 - RNA, 22 nt, Human
uugcagggcaaauggucagaua

SEQ ID NO: 679453 - RNA, 22 nt, Human
aucuguacaagauuuuaugcgu

SEQ ID NO: 679454 - RNA, 22 nt, Human
gcacagccugucccuguccugg

SEQ ID NO: 679455 - RNA, 22 nt, Human
uaaguggaagguuauaugcuaa

SEQ ID NO: 679456 - RNA, 22 nt, Human
uugaaguccuugccucuugcac

SEQ ID NO: 679457 - RNA, 22 nt, Human
aggcagggaccaguuguuuucu

SEQ ID NO: 679458 - RNA, 22 nt, Human
ggucuggaccauggacgccggg

SEQ ID NO: 679459 - RNA, 22 nt, Human
cucagggaggccucugcugguu

SEQ ID NO: 679460 - RNA, 22 nt, Human
gcccugcucuggucucugcccg

SEQ ID NO: 679461 - RNA, 22 nt, Human
ccucuccagcggccucagggcc

SEQ ID NO: 679462 - RNA, 22 nt, Human
uguguucaagauuaguucuagu

SEQ ID NO: 679463 - RNA, 22 nt, Human
cagcagccauguaccacacuca

SEQ ID NO: 679464 - RNA, 22 nt, Human
ucacacagauugguagagcuga

SEQ ID NO: 679465 - RNA, 22 nt, Human
uuuaccaaaugagacuauuguu

SEQ ID NO: 679466 - RNA, 22 nt, Human
uguaaacaguaggacuaaagag

SEQ ID NO: 679467 - RNA, 22 nt, Human
ccagagaaccaucugcuugagg

SEQ ID NO: 679468 - RNA, 22 nt, Human
uuagcaaacaaaugaaaugguu

SEQ ID NO: 679469 - RNA, 22 nt, Human
uuauucacaugggcucauucua

SEQ ID NO: 679470 - RNA, 22 nt, Human
uugcagggcaucuaugucuggu

SEQ ID NO: 679471 - RNA, 23 nt, Human
agcagcuggggugcucuuuuguc

SEQ ID NO: 679472 - RNA, 22 nt, Human
agaccaagacuauaaugagagg

SEQ ID NO: 679473 - RNA, 22 nt, Human
augcagauguuugguucauugu

SEQ ID NO: 679474 - RNA, 22 nt, Human
cuacugucucaucaguguuauu

SEQ ID NO: 679475 - RNA, 22 nt, Human
agcagaugggagauggagcugc

SEQ ID NO: 679476 - RNA, 22 nt, Human
uuggaaauugcaagugauuugc

SEQ ID NO: 679477 - RNA, 22 nt, Human
aagauguuuuaauauuucgagg

SEQ ID NO: 679478 - RNA, 22 nt, Human
agcaccagagcuaugggccugc

SEQ ID NO: 679479 - RNA, 23 nt, Human
ucuucauggccaucugguucuuc

SEQ ID NO: 679480 - RNA, 22 nt, Human
uggcaggugaaguuguuaggga

SEQ ID NO: 679481 - RNA, 22 nt, Human
gcugggcugcgucggggaagcc

SEQ ID NO: 679482 - RNA, 23 nt, Human
uucuuacaaggcuggcccacuug

SEQ ID NO: 679483 - RNA, 22 nt, Human
agcagcagggacaaaggaacag

SEQ ID NO: 679484 - RNA, 22 nt, Human
ucucagcucagcuuccacagag

SEQ ID NO: 679485 - RNA, 22 nt, Human
ugggcuggcugaggcauucacu

SEQ ID NO: 679486 - RNA, 22 nt, Human
uguuauuaucuguuagguguuc

SEQ ID NO: 679487 - RNA, 22 nt, Human
uaauugucaucguaguaaacau

SEQ ID NO: 679488 - RNA, 22 nt, Human
cugaagcaaaugaaacagcucu

SEQ ID NO: 679489 - RNA, 22 nt, Human
ccugggcucaggcuugggcagc

SEQ ID NO: 679490 - RNA, 21 nt, Human
ugcaguauguauuuguaucca

SEQ ID NO: 679491 - RNA, 22 nt, Human
caaaaccaagaacauucauuuc

SEQ ID NO: 679492 - RNA, 22 nt, Human
acagggucuuagagaucaccug

SEQ ID NO: 679493 - RNA, 22 nt, Human
uuacaugaauacauaaccauuc

SEQ ID NO: 679494 - RNA, 22 nt, Human
uccuuaauauggaagaguucuc

SEQ ID NO: 679495 - RNA, 22 nt, Human
uguuccaucaguuuuugguuga

SEQ ID NO: 679496 - RNA, 22 nt, Human
uuuaaacaucuuguugccuuaa

SEQ ID NO: 679497 - RNA, 22 nt, Human
agugucugaaggauuuggcuuc

SEQ ID NO: 679498 - RNA, 18 nt, Human
gcaggagauggguggggu

SEQ ID NO: 679499 - RNA, 22 nt, Human
uagauuucucauucauagauug

SEQ ID NO: 679500 - RNA, 22 nt, Human
aaugccaguguguugauuccag

SEQ ID NO: 679501 - RNA, 22 nt, Human
uucagaaguuuucaaaacuaag

SEQ ID NO: 679502 - RNA, 23 nt, Human
ugcugggcagagcuggugcugag

SEQ ID NO: 679503 - RNA, 21 nt, Human
ucuggcaggaagacggauggg

SEQ ID NO: 679504 - RNA, 22 nt, Human
ccaaaugcuccacugacuuugg

SEQ ID NO: 679505 - RNA, 22 nt, Human
cuacauuucccagcugccuucc

SEQ ID NO: 679506 - RNA, 22 nt, Human
ccuaggccuuacuuuccugugc

SEQ ID NO: 679507 - RNA, 22 nt, Human
aacuguugcuuguaauaugugc

SEQ ID NO: 679508 - RNA, 22 nt, Human
aggacaguuaguuaggaaguuu

SEQ ID NO: 679509 - RNA, 22 nt, Human
acaggccugugugcacacgagg

SEQ ID NO: 679510 - RNA, 22 nt, Human
agcuggcacagaccaggagauc

SEQ ID NO: 679511 - RNA, 21 nt, Human
agcagacagcccaagaaaauc

SEQ ID NO: 679512 - RNA, 22 nt, Human
aacacagguugcugggccucac

SEQ ID NO: 679513 - RNA, 22 nt, Human
ccccugagauucuggcuuggga

SEQ ID NO: 679514 - RNA, 22 nt, Human
ccagaagcuucuacacaggaga

SEQ ID NO: 679515 - RNA, 22 nt, Human
cagaugcuauguauuauguaug

SEQ ID NO: 679516 - RNA, 22 nt, Human
gcuccagggaacagaauguacu

SEQ ID NO: 679517 - RNA, 18 nt, Human
ugucucaggcugaaacag

SEQ ID NO: 679518 - RNA, 22 nt, Human
agugacaggggaggcaggugug

SEQ ID NO: 679519 - RNA, 20 nt, Human
uggaagacacugaagggcca

SEQ ID NO: 679520 - RNA, 22 nt, Human
ugaggcagaaauuccuguuuuc

SEQ ID NO: 679521 - RNA, 22 nt, Human
uuuuuccaccguacuuccugag

SEQ ID NO: 679522 - RNA, 18 nt, Human
aaagaaggauuggagagc

SEQ ID NO: 679523 - RNA, 22 nt, Human
uuugcaaauaccaugaaacuug

SEQ ID NO: 679524 - RNA, 22 nt, Human
gaggcagagucacaaagagucu

SEQ ID NO: 679525 - RNA, 22 nt, Human
aaagacuaaccaguugucaaaa

SEQ ID NO: 679526 - RNA, 22 nt, Human
uaucagauuuagaggagucaua

SEQ ID NO: 679527 - RNA, 18 nt, Human
ugggcacaaugaacagca

SEQ ID NO: 679528 - RNA, 23 nt, Human
ucauggaaugaauucuucuguua

SEQ ID NO: 679529 - RNA, 22 nt, Human
uagaggaaauuuccaaggugag

SEQ ID NO: 679530 - RNA, 22 nt, Human
aucucugguccaaauguuaccu

SEQ ID NO: 679531 - RNA, 23 nt, Human
uugcuuucaucaugagaugcucc

SEQ ID NO: 679532 - RNA, 22 nt, Human
uaccuggaaauggcuuuaguua

SEQ ID NO: 679533 - RNA, 22 nt, Human
uagcuucugggaguguuuacua

SEQ ID NO: 679534 - RNA, 22 nt, Human
cagccccuuguccgguagccac

SEQ ID NO: 679535 - RNA, 22 nt, Human
aaggcugagccagggccccuau

SEQ ID NO: 679536 - RNA, 22 nt, Human
gcugcccugugguccagcaggu

SEQ ID NO: 679537 - RNA, 22 nt, Human
cacaagaaauaagcugccuuuc

SEQ ID NO: 679538 - RNA, 22 nt, Human
gggaggugauuaggaccaugua

SEQ ID NO: 679539 - RNA, 22 nt, Human
cacagugcaugaugggcagaag

SEQ ID NO: 679540 - RNA, 17 nt, Human
uaaagccagucaaguca

SEQ ID NO: 679541 - RNA, 22 nt, Human
ugacuggauugucauuacgacg

SEQ ID NO: 679542 - RNA, 19 nt, Human
acucaagucuaaugaaauc

SEQ ID NO: 679543 - RNA, 22 nt, Human
cccugaaaguacacugggacgg

SEQ ID NO: 679544 - RNA, 22 nt, Human
ugaggcucagagaagugcuguu

SEQ ID NO: 679545 - RNA, 22 nt, Human
ucucucuucagagauaccuugc

SEQ ID NO: 679546 - RNA, 22 nt, Human
agaguccauauauugauuuguu

SEQ ID NO: 679547 - RNA, 22 nt, Human
uucauuuauucagcagguauuu

SEQ ID NO: 679548 - RNA, 22 nt, Human
cuucuuguuuuagcccucauac

SEQ ID NO: 679549 - RNA, 22 nt, Human
gaaaggccacgugccaagauua

SEQ ID NO: 679550 - RNA, 22 nt, Human
uaagacauaccaaguuguguga

SEQ ID NO: 679551 - RNA, 22 nt, Human
acuuccagcugcccugugugcu

SEQ ID NO: 679552 - RNA, 22 nt, Human
ucuggcuuuuauucaguuggca

SEQ ID NO: 679553 - RNA, 22 nt, Human
ucuggcaucuguuuucauauuu

SEQ ID NO: 679554 - RNA, 22 nt, Human
cauccauagauugagagauggu

SEQ ID NO: 679555 - RNA, 22 nt, Human
uggucugaacacauuuuaggua

SEQ ID NO: 679556 - RNA, 22 nt, Human
agucucagccacacagaccuau

SEQ ID NO: 679557 - RNA, 22 nt, Human
agccccucuccgcccugagucg

SEQ ID NO: 679558 - RNA, 22 nt, Human
auugaacuguagucuucugucu

SEQ ID NO: 679559 - RNA, 22 nt, Human
gagggcugauguugccaccuca

SEQ ID NO: 679560 - RNA, 22 nt, Human
guuuccugcgugugccacucau

SEQ ID NO: 679561 - RNA, 22 nt, Human
gcuuuagauacucccaaugucc

SEQ ID NO: 679562 - RNA, 22 nt, Human
cucccuggaggcccagaccugg

SEQ ID NO: 679563 - RNA, 22 nt, Human
agaaugcaagauaaacuuuauu

SEQ ID NO: 679564 - RNA, 22 nt, Human
ggaggggagucucccaaagccg

SEQ ID NO: 679565 - RNA, 22 nt, Human
acagacagaggcuccaugagga

SEQ ID NO: 679566 - RNA, 22 nt, Human
cccagcaguacccaagcccuug

SEQ ID NO: 679567 - RNA, 22 nt, Human
ggaacacuggcucaauuauauc

SEQ ID NO: 679568 - RNA, 22 nt, Human
uugauucaaccacuuaauaauc

SEQ ID NO: 679569 - RNA, 22 nt, Human
uucucuggaacugaaacaagau

SEQ ID NO: 679570 - RNA, 22 nt, Human
gagcugaacaaauugcgagugg

SEQ ID NO: 679571 - RNA, 22 nt, Human
guagcaucuguuggcugcuccu

SEQ ID NO: 679572 - RNA, 22 nt, Human
ucugggucucagagugaccaug

SEQ ID NO: 679573 - RNA, 22 nt, Human
aaaauucauggcuugggaaaag

SEQ ID NO: 679574 - RNA, 22 nt, Human
gaucauuuacuuguucuggacu

SEQ ID NO: 679575 - RNA, 22 nt, Human
augauauuugcaaugugcuugc

SEQ ID NO: 679576 - RNA, 22 nt, Human
cuucacaaaauauuucauuaua

SEQ ID NO: 679577 - RNA, 22 nt, Human
agguggcuccucccauggcugg

SEQ ID NO: 679578 - RNA, 22 nt, Human
auguggcuuuuccuggguuccu

SEQ ID NO: 679579 - RNA, 22 nt, Human
uccugggcuugcuccuccagcu

SEQ ID NO: 679580 - RNA, 22 nt, Human
gcaaguccuuugcaugcaggga

SEQ ID NO: 679581 - RNA, 23 nt, Human
ugccucugccucccuagucugca

SEQ ID NO: 679582 - RNA, 22 nt, Human
uauuauguagaguaaggguuaa

SEQ ID NO: 679583 - RNA, 22 nt, Human
ugagaguucucucuucaggugg

SEQ ID NO: 679584 - RNA, 22 nt, Human
caaaaugcaucugagaccaggc

SEQ ID NO: 679585 - RNA, 22 nt, Human
ugaaaucuccucuuuauauauc

SEQ ID NO: 679586 - RNA, 23 nt, Human
ggagugcaauggcgccaucucgg

SEQ ID NO: 679587 - RNA, 22 nt, Human
ucucaaaguagcucccacagau

SEQ ID NO: 679588 - RNA, 22 nt, Human
uggucacccacugggacugcgg

SEQ ID NO: 679589 - RNA, 22 nt, Human
auaaagcauuuccccugugugg

SEQ ID NO: 679590 - RNA, 22 nt, Human
cugaacucaugauaugcuuuug

SEQ ID NO: 679591 - RNA, 22 nt, Human
ucauucaucaguugguagagau

SEQ ID NO: 679592 - RNA, 23 nt, Human
ucuguacaauugagaagagaaca

SEQ ID NO: 679593 - RNA, 17 nt, Human
ucagcaaagacaaagga

SEQ ID NO: 679594 - RNA, 22 nt, Human
guaaaauucuagcaucugaaag

SEQ ID NO: 679595 - RNA, 22 nt, Human
ggagcucucuugugguacuccc

SEQ ID NO: 679596 - RNA, 22 nt, Human
auaacagaugugaagugcuaau

SEQ ID NO: 679597 - RNA, 22 nt, Human
uugaaugaccaugaugcaaggg

SEQ ID NO: 679598 - RNA, 22 nt, Human
gugugucuuuauaagaagaggg

SEQ ID NO: 679599 - RNA, 21 nt, Human
aaucugcuucccugugacuug

SEQ ID NO: 679600 - RNA, 22 nt, Human
auugaggcagcauaguucaggg

SEQ ID NO: 679601 - RNA, 19 nt, Human
ccaggccucuggggccugu

SEQ ID NO: 679602 - RNA, 22 nt, Human
uguaggaauggauucuagaagg

SEQ ID NO: 679603 - RNA, 22 nt, Human
cugcucacgccaccguucauca

SEQ ID NO: 679604 - RNA, 22 nt, Human
aauucacaguucugcaccuuac

SEQ ID NO: 679605 - RNA, 22 nt, Human
gcaggaugagugaguacauuua

SEQ ID NO: 679606 - RNA, 22 nt, Human
cagcagguauguuuguucagca

SEQ ID NO: 679607 - RNA, 22 nt, Human
guuuaugaauguuacuauagag

SEQ ID NO: 679608 - RNA, 22 nt, Human
uugcccugcggguccugcgcaa

SEQ ID NO: 679609 - RNA, 22 nt, Human
uucaggauaguggugaguggca

SEQ ID NO: 679610 - RNA, 22 nt, Human
ccaggguugcuuuagauucuga

SEQ ID NO: 679611 - RNA, 22 nt, Human
gccuucugugcuccuggccuuu

SEQ ID NO: 679612 - RNA, 22 nt, Human
acugggaacaaggugcucagcg

SEQ ID NO: 679613 - RNA, 22 nt, Human
uugcaggguacauucuuagaau

SEQ ID NO: 679614 - RNA, 22 nt, Human
ucauguuugcccuaagaaaaag

SEQ ID NO: 679615 - RNA, 22 nt, Human
cuccucagagagcagcuugggg

SEQ ID NO: 679616 - RNA, 22 nt, Human
gaaaguaugccaucuaccucuu

SEQ ID NO: 679617 - RNA, 22 nt, Human
auucuagaacagagguuucuaa

SEQ ID NO: 679618 - RNA, 22 nt, Human
uaacaguauccccauuugcaag

SEQ ID NO: 679619 - RNA, 21 nt, Human
ucacaacuuugaauuucaaua

SEQ ID NO: 679620 - RNA, 22 nt, Human
auguaacauugaauuauauagu

SEQ ID NO: 679621 - RNA, 22 nt, Human
agaaguauucugcauguacuga

SEQ ID NO: 679622 - RNA, 21 nt, Human
ugcaaugcauugacagcagca

SEQ ID NO: 679623 - RNA, 22 nt, Human
acacaugugucugcaugcagug

SEQ ID NO: 679624 - RNA, 22 nt, Human
aauugcauaaauuucauagcau

SEQ ID NO: 679625 - RNA, 22 nt, Human
uuuggacuaucuguguggcuuu

SEQ ID NO: 679626 - RNA, 23 nt, Human
ccucccaccuauuucacuuucuu

SEQ ID NO: 679627 - RNA, 22 nt, Human
acacuaaucuuuuauuugguuu

SEQ ID NO: 679628 - RNA, 22 nt, Human
ucuuggcuaguaccuuccugcc

SEQ ID NO: 679629 - RNA, 22 nt, Human
ugcuuauaauguuacugacaac

SEQ ID NO: 679630 - RNA, 23 nt, Human
agcugggccagguggucagaccu

SEQ ID NO: 679631 - RNA, 23 nt, Human
uaauuagauguugauuccugaga

SEQ ID NO: 679632 - RNA, 22 nt, Human
aagacagcagcaccucucguuu

SEQ ID NO: 679633 - RNA, 22 nt, Human
acagccccagcgcggcgggguc

SEQ ID NO: 679634 - RNA, 22 nt, Human
cugaggggauguuuuugacgga

SEQ ID NO: 679635 - RNA, 22 nt, Human
uggucugaagguggauuugaga

SEQ ID NO: 679636 - RNA, 22 nt, Human
uacagguuacacuuuuaaaagu

SEQ ID NO: 679637 - RNA, 22 nt, Human
auuuaauuaaucauggugaauu

SEQ ID NO: 679638 - RNA, 22 nt, Human
cauuuagagucuugcaauuuua

SEQ ID NO: 679639 - RNA, 22 nt, Human
ugugcccuuuccugcuccucca

SEQ ID NO: 679640 - RNA, 22 nt, Human
ucccaggcuggggccaggugac

SEQ ID NO: 679641 - RNA, 22 nt, Human
uggcuucucugugugagggaga

SEQ ID NO: 679642 - RNA, 22 nt, Human
agaguucugaauuuuauucucu

SEQ ID NO: 679643 - RNA, 22 nt, Human
aaccccaguaccccaggauaug

SEQ ID NO: 679644 - RNA, 18 nt, Human
aggucaggaaagcagagu

SEQ ID NO: 679645 - RNA, 22 nt, Human
ccacagcuagggcaaucugauu

SEQ ID NO: 679646 - RNA, 22 nt, Human
acacugugcuuagaugcugaac

SEQ ID NO: 679647 - RNA, 22 nt, Human
gggaucagacucugggauguag

SEQ ID NO: 679648 - RNA, 20 nt, Human
cacaggaaagcuacucaguu

SEQ ID NO: 679649 - RNA, 22 nt, Human
uuuguuuagaugguaaaucagu

SEQ ID NO: 679650 - RNA, 22 nt, Human
uuuuuauaugaaggauagugcg

SEQ ID NO: 679651 - RNA, 22 nt, Human
gaaauucaaaaugucaguauag

SEQ ID NO: 679652 - RNA, 22 nt, Human
auauuguguguacaaguaguua

SEQ ID NO: 679653 - RNA, 22 nt, Human
gcuggcacagguggaugcuggc

SEQ ID NO: 679654 - RNA, 22 nt, Human
cccaggcagugcugaucccuca

SEQ ID NO: 679655 - RNA, 23 nt, Human
cuggggcuuucaaaucugggcag

SEQ ID NO: 679656 - RNA, 22 nt, Human
uuagugguacucagggagggaa

SEQ ID NO: 679657 - RNA, 22 nt, Human
ccugggaggcggagguugcagg

SEQ ID NO: 679658 - RNA, 22 nt, Human
gcauucuugagguguggacuca

SEQ ID NO: 679659 - RNA, 22 nt, Human
acaucuguuuaacgaaggcauu

SEQ ID NO: 679660 - RNA, 22 nt, Human
aggcacagaauggcauucagug

SEQ ID NO: 679661 - RNA, 22 nt, Human
uucugcuuauucaaaugaucuu

SEQ ID NO: 679662 - RNA, 22 nt, Human
aagcuggauguaggaucccccu

SEQ ID NO: 679663 - RNA, 22 nt, Human
ucagagguaagggcugagagga

SEQ ID NO: 679664 - RNA, 22 nt, Human
cuuuucucugcgggucuuucau

SEQ ID NO: 679665 - RNA, 22 nt, Human
uguuaucugagcaacgucgacg

SEQ ID NO: 679666 - RNA, 22 nt, Human
uggcuccucaucacaguuggug

SEQ ID NO: 679667 - RNA, 22 nt, Human
ggggucugggcuuagcuggaau

SEQ ID NO: 679668 - RNA, 22 nt, Human
agucacagguucuugggauuag

SEQ ID NO: 679669 - RNA, 22 nt, Human
aagugcuuaggucaaaggacau

SEQ ID NO: 679670 - RNA, 22 nt, Human
ccacuugaaacuuaguggcaua

SEQ ID NO: 679671 - RNA, 22 nt, Human
aauguuuggacuggaagguccc

SEQ ID NO: 679672 - RNA, 22 nt, Human
agcagcuggggccugugacgau

SEQ ID NO: 679673 - RNA, 22 nt, Human
ucagauccgagugugccaagga

SEQ ID NO: 679674 - RNA, 22 nt, Human
uauauuaccugccugaucuaua

SEQ ID NO: 679675 - RNA, 19 nt, Human
uuucaggagcuaugcaggg

SEQ ID NO: 679676 - RNA, 22 nt, Human
ucuguucaguugauuagacaga

SEQ ID NO: 679677 - RNA, 22 nt, Human
acuuccagcuagguucugcuaa

SEQ ID NO: 679678 - RNA, 22 nt, Human
gggacaugaagcaucggaggca

SEQ ID NO: 679679 - RNA, 22 nt, Human
aaacucuuuccacgauuacuuu

SEQ ID NO: 679680 - RNA, 22 nt, Human
aggcugugauggauguaaagga

SEQ ID NO: 679681 - RNA, 21 nt, Human
ucuguggcggacucuaggccc

SEQ ID NO: 679682 - RNA, 22 nt, Human
gaaaugcagauucugauucugu

SEQ ID NO: 679683 - RNA, 22 nt, Human
ccucaggcugggcugccccugg

SEQ ID NO: 679684 - RNA, 22 nt, Human
ggccugaggcaauagucagaca

SEQ ID NO: 679685 - RNA, 22 nt, Human
ggcucacgcaauuaucccggcc

SEQ ID NO: 679686 - RNA, 22 nt, Human
aaguugaagcaugaaccaaggu

SEQ ID NO: 679687 - RNA, 22 nt, Human
ucccagagguugagucacuuau

SEQ ID NO: 679688 - RNA, 22 nt, Human
aggauuuggccauggcuucggg

SEQ ID NO: 679689 - RNA, 22 nt, Human
ccugucuggccuuccacggggg

SEQ ID NO: 679690 - RNA, 22 nt, Human
gaugcgggcccgcuccacugcc

SEQ ID NO: 679691 - RNA, 22 nt, Human
cagagcaccagugggagacaag

SEQ ID NO: 679692 - RNA, 22 nt, Human
cccaggcauuuucaacuuuagu

SEQ ID NO: 679693 - RNA, 22 nt, Human
uauacagaacugcacgugcacg

SEQ ID NO: 679694 - RNA, 22 nt, Human
ucacgagggcccugggcagcug

SEQ ID NO: 679695 - RNA, 22 nt, Human
uccagaaaaaguaauuuauuug

SEQ ID NO: 679696 - RNA, 22 nt, Human
agcucccugagaugccacagca

SEQ ID NO: 679697 - RNA, 22 nt, Human
ucacuuuacagaugggaaaacu

SEQ ID NO: 679698 - RNA, 22 nt, Human
ugguacacauguccaaggucag

SEQ ID NO: 679699 - RNA, 22 nt, Human
ucagacuucuacuuugcagagc

SEQ ID NO: 679700 - RNA, 22 nt, Human
uuaaaauuuccccaccauguau

SEQ ID NO: 679701 - RNA, 22 nt, Human
gcccagcgagcagagguggacg

SEQ ID NO: 679702 - RNA, 22 nt, Human
uuaggaaaaucaugagagauga

SEQ ID NO: 679703 - RNA, 22 nt, Human
cagguggggagaguguggagca

SEQ ID NO: 679704 - RNA, 17 nt, Human
gcaaucucagucuccuu

SEQ ID NO: 679705 - RNA, 22 nt, Human
uguacagacuguauuuacaagu

SEQ ID NO: 679706 - RNA, 19 nt, Human
ugauggaauuugacauucc

SEQ ID NO: 679707 - RNA, 22 nt, Human
ccugggcucaccaugccuugga

SEQ ID NO: 679708 - RNA, 22 nt, Human
acauaugcucaucugcauuccc

SEQ ID NO: 679709 - RNA, 21 nt, Human
uucuccuguuuugcaccacag

SEQ ID NO: 679710 - RNA, 19 nt, Human
cuccaggauggcugggcga

SEQ ID NO: 679711 - RNA, 22 nt, Human
cggcuggagcugagaaaggagc

SEQ ID NO: 679712 - RNA, 22 nt, Human
agccagacauggcuccugcucc

SEQ ID NO: 679713 - RNA, 22 nt, Human
uuuaguguagcauucagaguca

SEQ ID NO: 679714 - RNA, 22 nt, Human
agggcccauagaucgucagcuu

SEQ ID NO: 679715 - RNA, 22 nt, Human
ucucuguaagcugccuucucgu

SEQ ID NO: 679716 - RNA, 22 nt, Human
acuuccuugucaggugcaucau

SEQ ID NO: 679717 - RNA, 22 nt, Human
gugaaggacuagcauggagggc

SEQ ID NO: 679718 - RNA, 22 nt, Human
ccuggcagcagcacaugccuuc

SEQ ID NO: 679719 - RNA, 22 nt, Human
ggacagcuccugcacuugagua

SEQ ID NO: 679720 - RNA, 22 nt, Human
gggcaguguggucgugccuuug

SEQ ID NO: 679721 - RNA, 22 nt, Human
gggcuucagauccagggaccuc

SEQ ID NO: 679722 - RNA, 22 nt, Human
uuggaagcgagcacauggagga

SEQ ID NO: 679723 - RNA, 22 nt, Human
uagauaauuuggcaucauauug

SEQ ID NO: 679724 - RNA, 18 nt, Human
ugcauauacugccuaucu

SEQ ID NO: 679725 - RNA, 22 nt, Human
ugaacacugccauauuuaagaa

SEQ ID NO: 679726 - RNA, 20 nt, Human
gaacagucuucugagccaca

SEQ ID NO: 679727 - RNA, 22 nt, Human
aggugccaagaugucacagaca

SEQ ID NO: 679728 - RNA, 22 nt, Human
cuccguuuuugaccggcacuga

SEQ ID NO: 679729 - RNA, 22 nt, Human
gccacagcucacguuccccauu

SEQ ID NO: 679730 - RNA, 22 nt, Human
ccauggccucgcucuacguggg

SEQ ID NO: 679731 - RNA, 22 nt, Human
agagagaggcagcagugcucac

SEQ ID NO: 679732 - RNA, 22 nt, Human
ugccccuucuacccgucucugu

SEQ ID NO: 679733 - RNA, 22 nt, Human
aucaguuuuuauuaauguagcu

SEQ ID NO: 679734 - RNA, 22 nt, Human
ugguggcagcugggacagaggu

SEQ ID NO: 679735 - RNA, 22 nt, Human
ccugccuguacuagagacccag

SEQ ID NO: 679736 - RNA, 22 nt, Human
gagcugugaaaagugccugggg

SEQ ID NO: 679737 - RNA, 22 nt, Human
cuggcucccaugagcucucacg

SEQ ID NO: 679738 - RNA, 22 nt, Human
cccugcacacucgugucuugac

SEQ ID NO: 679739 - RNA, 22 nt, Human
uucuuguuccaugaaagacaga

SEQ ID NO: 679740 - RNA, 22 nt, Human
guuucucaagcuugaaugcaca

SEQ ID NO: 679741 - RNA, 22 nt, Human
cagguaaggucacauucugaag

SEQ ID NO: 679742 - RNA, 22 nt, Human
caggcaccuuugugcaugggca

SEQ ID NO: 679743 - RNA, 22 nt, Human
gggccuccgugugcuggugcuc

SEQ ID NO: 679744 - RNA, 22 nt, Human
agauaaucucuaggcuucaugu

SEQ ID NO: 679745 - RNA, 22 nt, Human
uauaguacacuuagguacuuca

SEQ ID NO: 679746 - RNA, 22 nt, Human
augcaaaagacuauuuguugcu

SEQ ID NO: 679747 - RNA, 22 nt, Human
aggcaaauccagauuuuuccac

SEQ ID NO: 679748 - RNA, 22 nt, Human
uccuggcuggaauuucucacuc

SEQ ID NO: 679749 - RNA, 22 nt, Human
ggccugaaauagcucugagguu

SEQ ID NO: 679750 - RNA, 21 nt, Human
gcagggaccgcgacuucuggg

SEQ ID NO: 679751 - RNA, 22 nt, Human
cugggcucagugucucacuccu

SEQ ID NO: 679752 - RNA, 22 nt, Human
aucuggguuucaaagaagccuu

SEQ ID NO: 679753 - RNA, 22 nt, Human
ugcaguggcgccaucucagcuc

SEQ ID NO: 679754 - RNA, 22 nt, Human
gcacugcagguggguggagagg

SEQ ID NO: 679755 - RNA, 22 nt, Human
ggccucagaccggagcuggcca

SEQ ID NO: 679756 - RNA, 20 nt, Human
agcacuagguguggcaggug

SEQ ID NO: 679757 - RNA, 22 nt, Human
uugaaauauggauugaccuuga

SEQ ID NO: 679758 - RNA, 22 nt, Human
ccacagugaguucuguacucug

SEQ ID NO: 679759 - RNA, 22 nt, Human
ggaaagagggacccagcuuggu

SEQ ID NO: 679760 - RNA, 20 nt, Human
acugcaaaguacucuuucag

SEQ ID NO: 679761 - RNA, 22 nt, Human
ccucagccccugaauggagaga

SEQ ID NO: 679762 - RNA, 22 nt, Human
aaugaugaguucuaauagaccc

SEQ ID NO: 679763 - RNA, 22 nt, Human
cagcucuggggcagagugacua

SEQ ID NO: 679764 - RNA, 22 nt, Human
cucauugcagcugcauuacugu

SEQ ID NO: 679765 - RNA, 22 nt, Human
ucuuugcaucccuuccauaguu

SEQ ID NO: 679766 - RNA, 22 nt, Human
acauuaaacuugcuuggcugua

SEQ ID NO: 679767 - RNA, 22 nt, Human
aaagaucagucugaagcaacau

SEQ ID NO: 679768 - RNA, 22 nt, Human
aguauaaugaaaugugucagua

SEQ ID NO: 679769 - RNA, 22 nt, Human
cagugagguggauggauggccu

SEQ ID NO: 679770 - RNA, 22 nt, Human
augauggaggccgugauggacg

SEQ ID NO: 679771 - RNA, 22 nt, Human
augaacucuugcuuuauuucag

SEQ ID NO: 679772 - RNA, 22 nt, Human
aggaaaaugauauucugcuguu

SEQ ID NO: 679773 - RNA, 22 nt, Human
ucugcuuuagugcaaagucuua

SEQ ID NO: 679774 - RNA, 22 nt, Human
ggaagccagagugcugggcagg

SEQ ID NO: 679775 - RNA, 22 nt, Human
cccagugugguucuuuggagaa

SEQ ID NO: 679776 - RNA, 22 nt, Human
ggcucuggcuacuccacccugu

SEQ ID NO: 679777 - RNA, 22 nt, Human
cugugugugagaagcagguuga

SEQ ID NO: 679778 - RNA, 20 nt, Human
cucuuuugacucuuugcaag

SEQ ID NO: 679779 - RNA, 22 nt, Human
aguguacauucuguuugaggua

SEQ ID NO: 679780 - RNA, 22 nt, Human
uuugauuuacuauaagcagcac

SEQ ID NO: 679781 - RNA, 20 nt, Human
cuggcuggaaacuuagccuu

SEQ ID NO: 679782 - RNA, 22 nt, Human
ugugaauauuuccuucuuugga

SEQ ID NO: 679783 - RNA, 22 nt, Human
cagggccugagggcugcucugc

SEQ ID NO: 679784 - RNA, 22 nt, Human
ucaaaaucaaagauacuugaaa

SEQ ID NO: 679785 - RNA, 22 nt, Human
uuguagcagggaucagaauaca

SEQ ID NO: 679786 - RNA, 22 nt, Human
ugccuggaaggcccaugggaag

SEQ ID NO: 679787 - RNA, 22 nt, Human
gcuguaugaguucauguguaga

SEQ ID NO: 679788 - RNA, 22 nt, Human
ucugggucuuaguuuucuugau

SEQ ID NO: 679789 - RNA, 22 nt, Human
aagacuaaauguguucuaaagu

SEQ ID NO: 679790 - RNA, 22 nt, Human
caggguugauuccuucugaggg

SEQ ID NO: 679791 - RNA, 22 nt, Human
ccagcuccugggucuuagucag

SEQ ID NO: 679792 - RNA, 22 nt, Human
gucccaggugggcuccaccucu

SEQ ID NO: 679793 - RNA, 22 nt, Human
ugccugcugauuggaguugaau

SEQ ID NO: 679794 - RNA, 22 nt, Human
cuucacaguauaggucccugag

SEQ ID NO: 679795 - RNA, 22 nt, Human
acuauuagcauaucaugaaugg

SEQ ID NO: 679796 - RNA, 22 nt, Human
uuguuuuaaccuaguguuuaug

SEQ ID NO: 679797 - RNA, 22 nt, Human
aguauaugccagagagauagcu

SEQ ID NO: 679798 - RNA, 22 nt, Human
guuucaaagggaagacgcugga

SEQ ID NO: 679799 - RNA, 22 nt, Human
auuuaccagcugugcacugaua

SEQ ID NO: 679800 - RNA, 17 nt, Human
cagcucugcagacuucc

SEQ ID NO: 679801 - RNA, 22 nt, Human
augccugucucagggucuguuu

SEQ ID NO: 679802 - RNA, 22 nt, Human
ugugaggauuaaaugcauagug

SEQ ID NO: 679803 - RNA, 22 nt, Human
uguauauauuucuuucauucua

SEQ ID NO: 679804 - RNA, 22 nt, Human
gugccaggugcuaagcugugcu

SEQ ID NO: 679805 - RNA, 22 nt, Human
gaggcacaucacuuggugcauu

SEQ ID NO: 679806 - RNA, 22 nt, Human
ugcucugucaagaaaagaugcc

SEQ ID NO: 679807 - RNA, 20 nt, Human
ugguccugucccacccacuc

SEQ ID NO: 679808 - RNA, 22 nt, Human
cagggcucacucggcuggcguc

SEQ ID NO: 679809 - RNA, 22 nt, Human
cucaggauagcugcgcagccug

SEQ ID NO: 679810 - RNA, 22 nt, Human
aucucucugcccaggggcugug

SEQ ID NO: 679811 - RNA, 22 nt, Human
guaaacaccuguuaaauucaga

SEQ ID NO: 679812 - RNA, 22 nt, Human
gacuauuuauuuacagaaagcu

SEQ ID NO: 679813 - RNA, 22 nt, Human
ccugugcuuuaggccucaaacu

SEQ ID NO: 679814 - RNA, 22 nt, Human
gcagcuguucagcuggccagau

SEQ ID NO: 679815 - RNA, 23 nt, Human
agcagggccagaauacuugcugu

SEQ ID NO: 679816 - RNA, 20 nt, Human
gcuuccuucccagcccccac

SEQ ID NO: 679817 - RNA, 22 nt, Human
aucacaucucaccacugcaacc

SEQ ID NO: 679818 - RNA, 22 nt, Human
ucucuggcccuguuuucuaucu

SEQ ID NO: 679819 - RNA, 22 nt, Human
acugucuccucaucaugccugg

SEQ ID NO: 679820 - RNA, 22 nt, Human
cagcccuccuuucacucccagg

SEQ ID NO: 679821 - RNA, 21 nt, Human
agcuggccugguuugagcucc

SEQ ID NO: 679822 - RNA, 22 nt, Human
cagcuugggucaggugccugcu

SEQ ID NO: 679823 - RNA, 22 nt, Human
aucucagacauguuguccauga

SEQ ID NO: 679824 - RNA, 22 nt, Human
gccagccaguuugcugauggcu

SEQ ID NO: 679825 - RNA, 22 nt, Human
auauuuguaaaauucugugucu

SEQ ID NO: 679826 - RNA, 22 nt, Human
ccuggaaacacaugaugaugaa

SEQ ID NO: 679827 - RNA, 23 nt, Human
ugaaugauuguacugagcuuuua

SEQ ID NO: 679828 - RNA, 22 nt, Human
ccccacaacucauguugaaacu

SEQ ID NO: 679829 - RNA, 19 nt, Human
ugccuggcaccagcuccac

SEQ ID NO: 679830 - RNA, 22 nt, Human
uuucagaggaggaaggcaguua

SEQ ID NO: 679831 - RNA, 22 nt, Human
cuguggcugucucuuucccaug

SEQ ID NO: 679832 - RNA, 22 nt, Human
ucauuucuaucuaugcagcuuc

SEQ ID NO: 679833 - RNA, 22 nt, Human
agguggcagaggacuccuccug

SEQ ID NO: 679834 - RNA, 22 nt, Human
cuccuccacagaccuacugaau

SEQ ID NO: 679835 - RNA, 22 nt, Human
ccacaggaggaacaauuagaug

SEQ ID NO: 679836 - RNA, 23 nt, Human
agguggagcugugcagccggggc

SEQ ID NO: 679837 - RNA, 22 nt, Human
acucaggaaaaauguagugaua

SEQ ID NO: 679838 - RNA, 22 nt, Human
gacauaaaauucaauaauuugu

SEQ ID NO: 679839 - RNA, 22 nt, Human
ucugaugcaauguaagucuugg

SEQ ID NO: 679840 - RNA, 22 nt, Human
uuauuaugguauuucuuugcag

SEQ ID NO: 679841 - RNA, 22 nt, Human
aggccugacuugaauuuagggc

SEQ ID NO: 679842 - RNA, 22 nt, Human
auacauaugaaugauuuggcuc

SEQ ID NO: 679843 - RNA, 21 nt, Human
aaaaagcuggggcaugcaugc

SEQ ID NO: 679844 - RNA, 22 nt, Human
ucacaucuugugauguuuucau

SEQ ID NO: 679845 - RNA, 22 nt, Human
caaaaguaauuaugguuuuugc

SEQ ID NO: 679846 - RNA, 22 nt, Human
caccaggagcaucuaggaggcg

SEQ ID NO: 679847 - RNA, 22 nt, Human
uacacuguuuuuggaaagaaga

SEQ ID NO: 679848 - RNA, 22 nt, Human
augaaaacggaccagagcuauu

SEQ ID NO: 679849 - RNA, 22 nt, Human
uguguuuuaucuauuguaucuu

SEQ ID NO: 679850 - RNA, 22 nt, Human
caggcagcaucagucugcugua

SEQ ID NO: 679851 - RNA, 22 nt, Human
ucucccuucucuggauuccguu

SEQ ID NO: 679852 - RNA, 22 nt, Human
gucucugagcucugagcuggcu

SEQ ID NO: 679853 - RNA, 22 nt, Human
cguggcaguggaaggcugggug

SEQ ID NO: 679854 - RNA, 22 nt, Human
ugaagaaaggugugggauacuc

SEQ ID NO: 679855 - RNA, 22 nt, Human
guucucucucuugccugggugg

SEQ ID NO: 679856 - RNA, 18 nt, Human
uuuauauggauagagacc

SEQ ID NO: 679857 - RNA, 22 nt, Human
agggccugggccagcacccuuu

SEQ ID NO: 679858 - RNA, 22 nt, Human
aggagaaggaagugcaucacua

SEQ ID NO: 679859 - RNA, 22 nt, Human
cauuguauugaggauacuuaag

SEQ ID NO: 679860 - RNA, 22 nt, Human
ucuguaggguaguaguggagau

SEQ ID NO: 679861 - RNA, 22 nt, Human
aaugcauuuuauuauaugugac

SEQ ID NO: 679862 - RNA, 22 nt, Human
uccaggcacuauauauacuuuu

SEQ ID NO: 679863 - RNA, 22 nt, Human
cucaggccauucuuccagcugc

SEQ ID NO: 679864 - RNA, 22 nt, Human
agugcugucuccuucccccggg

SEQ ID NO: 679865 - RNA, 22 nt, Human
uucuggaaguguuagaaucugg

SEQ ID NO: 679866 - RNA, 22 nt, Human
uugcuuggcccauugcuucagu

SEQ ID NO: 679867 - RNA, 22 nt, Human
aaaguacaugcaauucuucuga

SEQ ID NO: 679868 - RNA, 19 nt, Human
aaaugugaugguacaauuc

SEQ ID NO: 679869 - RNA, 22 nt, Human
acagcagccugcagcccugugu

SEQ ID NO: 679870 - RNA, 22 nt, Human
aaguuacuggcaagggcugcag

SEQ ID NO: 679871 - RNA, 22 nt, Human
auugguaagcaagauggcaaua

SEQ ID NO: 679872 - RNA, 22 nt, Human
uaucuacuccucuuucagaugc

SEQ ID NO: 679873 - RNA, 22 nt, Human
guacauuucucuuguucuuauu

SEQ ID NO: 679874 - RNA, 22 nt, Human
uccacacacauuucuaugugca

SEQ ID NO: 679875 - RNA, 22 nt, Human
acuguggccugcuguaugggcu

SEQ ID NO: 679876 - RNA, 19 nt, Human
gcugggugaggucguugga

SEQ ID NO: 679877 - RNA, 22 nt, Human
agcuggggcugcagagaacagg

SEQ ID NO: 679878 - RNA, 21 nt, Human
agacaugugaacuaaagguga

SEQ ID NO: 679879 - RNA, 22 nt, Human
auccuugguaagagaguuggau

SEQ ID NO: 679880 - RNA, 22 nt, Human
uuugcuuuguuuaaaaguggua

SEQ ID NO: 679881 - RNA, 22 nt, Human
acaaaguccugguguauggcca

SEQ ID NO: 679882 - RNA, 22 nt, Human
aaugcauuaaaguuagagacuu

SEQ ID NO: 679883 - RNA, 22 nt, Human
auuaggauuugguauggucaua

SEQ ID NO: 679884 - RNA, 22 nt, Human
uuucaagaacaacauucauuca

SEQ ID NO: 679885 - RNA, 22 nt, Human
uuaugaaagacauuucuguugg

SEQ ID NO: 679886 - RNA, 20 nt, Human
acauaugaaugauagagcca

SEQ ID NO: 679887 - RNA, 23 nt, Human
gcuuuuaaaccugugacugccgc

SEQ ID NO: 679888 - RNA, 22 nt, Human
ugauauguaacuacuccuuaua

SEQ ID NO: 679889 - RNA, 18 nt, Human
uggcugcuuccagguaca

SEQ ID NO: 679890 - RNA, 22 nt, Human
gagccugaugaaacaggcagac

SEQ ID NO: 679891 - RNA, 22 nt, Human
agagacuguggcucuuugaagg

SEQ ID NO: 679892 - RNA, 22 nt, Human
cuuugcaauagaggcacacaug

SEQ ID NO: 679893 - RNA, 22 nt, Human
uaauugcagggagccugggggc

SEQ ID NO: 679894 - RNA, 22 nt, Human
ccugcagagcaggagaggcauc

SEQ ID NO: 679895 - RNA, 22 nt, Human
ugcuggcuacugauggcaggcc

SEQ ID NO: 679896 - RNA, 22 nt, Human
cagugccagagguacuagugga

SEQ ID NO: 679897 - RNA, 22 nt, Human
agauggcuuagccuggcuccca

SEQ ID NO: 679898 - RNA, 22 nt, Human
ucugcugaggccuucccacucc

SEQ ID NO: 679899 - RNA, 22 nt, Human
gaaugauauauuagcagauuuu

SEQ ID NO: 679900 - RNA, 22 nt, Human
uuagaaucuuuagagucucacu

SEQ ID NO: 679901 - RNA, 22 nt, Human
cucucucuuuagaagcgucugg

SEQ ID NO: 679902 - RNA, 22 nt, Human
uguggcuuccacgauggucacc

SEQ ID NO: 679903 - RNA, 22 nt, Human
cucucugugguggcugucccau

SEQ ID NO: 679904 - RNA, 22 nt, Human
aacacaaagaagcugcaggauc

SEQ ID NO: 679905 - RNA, 21 nt, Human
ucuuugcaucaguuguuuucu

SEQ ID NO: 679906 - RNA, 22 nt, Human
aggggcucaguuacuuuggcag

SEQ ID NO: 679907 - RNA, 22 nt, Human
ugccuagggccuaaccagagcc

SEQ ID NO: 679908 - RNA, 22 nt, Human
ugacagacuacugccucuauug

SEQ ID NO: 679909 - RNA, 22 nt, Human
auuuugauaaucauguuagaga

SEQ ID NO: 679910 - RNA, 17 nt, Human
gcuugggcugccuguug

SEQ ID NO: 679911 - RNA, 22 nt, Human
cccagugggucacugcaucuca

SEQ ID NO: 679912 - RNA, 22 nt, Human
ggcacugagaggcucuuccuaa

SEQ ID NO: 679913 - RNA, 20 nt, Human
ccuggcugcauucaggacgg

SEQ ID NO: 679914 - RNA, 22 nt, Human
uguuuaaucuucaggacagucu

SEQ ID NO: 679915 - RNA, 19 nt, Human
gcucuaaaagauuuugaag

SEQ ID NO: 679916 - RNA, 22 nt, Human
agagacaaacacugcaacuucu

SEQ ID NO: 679917 - RNA, 22 nt, Human
cuguacaggugaggagggggcu

SEQ ID NO: 679918 - RNA, 22 nt, Human
uauuauuuuagcacugaggauu

SEQ ID NO: 679919 - RNA, 22 nt, Human
uaucucuaggcugccacuuaaa

SEQ ID NO: 679920 - RNA, 22 nt, Human
acagagacaggcagacagucuu

SEQ ID NO: 679921 - RNA, 21 nt, Human
ucugcacagccccgcaggagg

SEQ ID NO: 679922 - RNA, 22 nt, Human
caugaacaauuugcucacugau

SEQ ID NO: 679923 - RNA, 22 nt, Human
aggagggucauguugaagugua

SEQ ID NO: 679924 - RNA, 22 nt, Human
aaauucuaugucaauguuuauu

SEQ ID NO: 679925 - RNA, 22 nt, Human
ggcagcuguuuguccuccuguu

SEQ ID NO: 679926 - RNA, 22 nt, Human
acugcuuuagaccuagagcucu

SEQ ID NO: 679927 - RNA, 22 nt, Human
acuuuugaacaaacuccucugu

SEQ ID NO: 679928 - RNA, 22 nt, Human
auaguggguacaggggcagaga

SEQ ID NO: 679929 - RNA, 22 nt, Human
ucuuuucuccagaccugggauc

SEQ ID NO: 679930 - RNA, 22 nt, Human
cuggagguaagaggcccugggc

SEQ ID NO: 679931 - RNA, 22 nt, Human
caggcugcggccgugugagcau

SEQ ID NO: 679932 - RNA, 19 nt, Human
aacuagaaagguuuugaga

SEQ ID NO: 679933 - RNA, 22 nt, Human
uuggaaaugcaaauauauugaa

SEQ ID NO: 679934 - RNA, 22 nt, Human
uguaugcacauauauagguaca

SEQ ID NO: 679935 - RNA, 21 nt, Human
ugcccacagcaaaugcagagg

SEQ ID NO: 679936 - RNA, 22 nt, Human
aguggcugauguaggcaguggg

SEQ ID NO: 679937 - RNA, 22 nt, Human
aagcuguggcuuggaggaaaca

SEQ ID NO: 679938 - RNA, 22 nt, Human
ucccuucaauaauucaacauua

SEQ ID NO: 679939 - RNA, 22 nt, Human
cacauucaggauuuuccauguc

SEQ ID NO: 679940 - RNA, 23 nt, Human
caguucccacugucugucacaag

SEQ ID NO: 679941 - RNA, 22 nt, Human
uugcuguguaacuccuggccug

SEQ ID NO: 679942 - RNA, 22 nt, Human
uccugggccaagggcugugagg

SEQ ID NO: 679943 - RNA, 22 nt, Human
aagcugugcaggaacugcuugc

SEQ ID NO: 679944 - RNA, 22 nt, Human
agauggcugauuaacuccaugg

SEQ ID NO: 679945 - RNA, 22 nt, Human
ggccuugauccuccagagcacu

SEQ ID NO: 679946 - RNA, 19 nt, Human
caaggccaccauuucuccg

SEQ ID NO: 679947 - RNA, 22 nt, Human
aaggcugaguaaaacagagaac

SEQ ID NO: 679948 - RNA, 22 nt, Human
gccugccuucggugcgcagcgg

SEQ ID NO: 679949 - RNA, 22 nt, Human
uggcagagagacucuccuugau

SEQ ID NO: 679950 - RNA, 22 nt, Human
uagacacaagagaaggguauaa

SEQ ID NO: 679951 - RNA, 22 nt, Human
aauaucuggagaugcuuuuugu

SEQ ID NO: 679952 - RNA, 22 nt, Human
auguaaacaagguuauugucca

SEQ ID NO: 679953 - RNA, 20 nt, Human
cugcuuaaguaagugacaca

SEQ ID NO: 679954 - RNA, 22 nt, Human
cugggccucaaucucagaguuu

SEQ ID NO: 679955 - RNA, 22 nt, Human
ugugaagagaguaauaaaguca

SEQ ID NO: 679956 - RNA, 21 nt, Human
aguugcugcugcugcagguga

SEQ ID NO: 679957 - RNA, 22 nt, Human
cuucuaacauccuacaaugcaa

SEQ ID NO: 679958 - RNA, 22 nt, Human
cuaagacaugcccugcaugaua

SEQ ID NO: 679959 - RNA, 22 nt, Human
aaaugacacucauucaguguca

SEQ ID NO: 679960 - RNA, 22 nt, Human
ugugcccagacugccucaguga

SEQ ID NO: 679961 - RNA, 22 nt, Human
ucaaaggcaccaaggucacugc

SEQ ID NO: 679962 - RNA, 22 nt, Human
ugagcuguggugggguagagga

SEQ ID NO: 679963 - RNA, 22 nt, Human
cucccagauuccugcuguggga

SEQ ID NO: 679964 - RNA, 22 nt, Human
agccacugcccuuagccauuug

SEQ ID NO: 679965 - RNA, 22 nt, Human
auccuucaaggggcugacagcu

SEQ ID NO: 679966 - RNA, 22 nt, Human
agccuggaguucccaggagaag

SEQ ID NO: 679967 - RNA, 21 nt, Human
acuaugucauuuaagucacug

SEQ ID NO: 679968 - RNA, 22 nt, Human
uccaggauggugacgguggcca

SEQ ID NO: 679969 - RNA, 22 nt, Human
aguuucauguagccauauuuac

SEQ ID NO: 679970 - RNA, 22 nt, Human
gacuuucucuccucccaggugu

SEQ ID NO: 679971 - RNA, 22 nt, Human
cuuuggcugacagguuucuggu

SEQ ID NO: 679972 - RNA, 22 nt, Human
gggcuucucccuaaggacucug

SEQ ID NO: 679973 - RNA, 22 nt, Human
uaauugcucuuggccgugccag

SEQ ID NO: 679974 - RNA, 22 nt, Human
ggcaugaguggcagugggcagu

SEQ ID NO: 679975 - RNA, 22 nt, Human
aggggccucgcaggaccgcucc

SEQ ID NO: 679976 - RNA, 22 nt, Human
ucuacuuucacucauacuuauu

SEQ ID NO: 679977 - RNA, 20 nt, Human
uucacauuucuguagugauu

SEQ ID NO: 679978 - RNA, 22 nt, Human
uagcccagauacaaaucaugau

SEQ ID NO: 679979 - RNA, 23 nt, Human
ugggaccuguuugcccacagaug

SEQ ID NO: 679980 - RNA, 22 nt, Human
uuauauaacucaggugggcuca

SEQ ID NO: 679981 - RNA, 20 nt, Human
cauuucauugugucuucacu

SEQ ID NO: 679982 - RNA, 22 nt, Human
ccauuuggcaagaaagagucau

SEQ ID NO: 679983 - RNA, 22 nt, Human
gccugagagacccauggggcaa

SEQ ID NO: 679984 - RNA, 22 nt, Human
gaggcugggaaguccaagauca

SEQ ID NO: 679985 - RNA, 22 nt, Human
acuucacaaagagaucaucuaa

SEQ ID NO: 679986 - RNA, 22 nt, Human
guuuccuuuuucugcccucaau

SEQ ID NO: 679987 - RNA, 22 nt, Human
agauacaaggcagagaugugca

SEQ ID NO: 679988 - RNA, 22 nt, Human
ucaguaaaugaaugaauauaug

SEQ ID NO: 679989 - RNA, 22 nt, Human
gacuucuccagacugccuggua

SEQ ID NO: 679990 - RNA, 22 nt, Human
ggcaggguguggaguugggaca

SEQ ID NO: 679991 - RNA, 22 nt, Human
aaacagcucaagaaguuacucu

SEQ ID NO: 679992 - RNA, 22 nt, Human
uuagccaugcccuagaagagga

SEQ ID NO: 679993 - RNA, 22 nt, Human
caguacuugggaaugcugggga

SEQ ID NO: 679994 - RNA, 23 nt, Human
aaucacacguuuggccaggaugc

SEQ ID NO: 679995 - RNA, 22 nt, Human
ugccuucucccuuggacccuga

SEQ ID NO: 679996 - RNA, 22 nt, Human
ugggcuccagcaccugugcucu

SEQ ID NO: 679997 - RNA, 22 nt, Human
cuuuuuauaccgugccaguuga

SEQ ID NO: 679998 - RNA, 22 nt, Human
cacugggaccuaggacugagcu

SEQ ID NO: 679999 - RNA, 18 nt, Human
cacaggagccacacucac

SEQ ID NO: 680000 - RNA, 20 nt, Human
aacacaggguuaccaucaga

SEQ ID NO: 680001 - RNA, 22 nt, Human
gggcagcugccagaggccaugg

SEQ ID NO: 680002 - RNA, 22 nt, Human
ugcgauggcguagacaaauccc

SEQ ID NO: 680003 - RNA, 22 nt, Human
uggcagcaauuagcuagagcug

SEQ ID NO: 680004 - RNA, 22 nt, Human
gucacacagagcccugugcuca

SEQ ID NO: 680005 - RNA, 22 nt, Human
cacagcuucugagugaggauuu

SEQ ID NO: 680006 - RNA, 22 nt, Human
ccugcuccaugcucaccaucag

SEQ ID NO: 680007 - RNA, 22 nt, Human
auugcaaagaaauacaugcuua

SEQ ID NO: 680008 - RNA, 22 nt, Human
caggaaauaucucaacacuuua

SEQ ID NO: 680009 - RNA, 21 nt, Human
cuccucaggaccagccacagg

SEQ ID NO: 680010 - RNA, 22 nt, Human
guuuucuuugaaugcuucuaga

SEQ ID NO: 680011 - RNA, 22 nt, Human
aaaguuuacagugcacaugggu

SEQ ID NO: 680012 - RNA, 22 nt, Human
uggaacaaauuuuggggaccuu

SEQ ID NO: 680013 - RNA, 22 nt, Human
uagaacucuggucuucucaucc

SEQ ID NO: 680014 - RNA, 22 nt, Human
cagcaggugggcuuugcggaug

SEQ ID NO: 680015 - RNA, 22 nt, Human
caguccugggcacagcccuggg

SEQ ID NO: 680016 - RNA, 22 nt, Human
gccuggaagugugucgugggaa

SEQ ID NO: 680017 - RNA, 21 nt, Human
ccucucucauuguaaugaagu

SEQ ID NO: 680018 - RNA, 22 nt, Human
gacacagggacgugcucugccu

SEQ ID NO: 680019 - RNA, 20 nt, Human
uaugcaguauguguguauaa

SEQ ID NO: 680020 - RNA, 22 nt, Human
cuauacaguaaccacagugauu

SEQ ID NO: 680021 - RNA, 22 nt, Human
guggcccucagcaguugccaag

SEQ ID NO: 680022 - RNA, 22 nt, Human
ggccucggcccacugcugcggu

SEQ ID NO: 680023 - RNA, 23 nt, Human
uuguuucuuuguauugucucuau

SEQ ID NO: 680024 - RNA, 22 nt, Human
aaucagcuaaauaaacuaguca

SEQ ID NO: 680025 - RNA, 22 nt, Human
auacacagcgaugagaggaggc

SEQ ID NO: 680026 - RNA, 22 nt, Human
aggagcuggaguccaggcaagu

SEQ ID NO: 680027 - RNA, 19 nt, Human
gggcaguggcacuagggag

SEQ ID NO: 680028 - RNA, 22 nt, Human
agcagcuguuuguugaauuggu

SEQ ID NO: 680029 - RNA, 22 nt, Human
cagagcuggggacuguuggaug

SEQ ID NO: 680030 - RNA, 22 nt, Human
ucccagcaggaguccaguuccc

SEQ ID NO: 680031 - RNA, 22 nt, Human
aaaaugcaaaccuaccuacaua

SEQ ID NO: 680032 - RNA, 22 nt, Human
aguguucuucuucaaagcucug

SEQ ID NO: 680033 - RNA, 22 nt, Human
agaggucagagcaggaaaggca

SEQ ID NO: 680034 - RNA, 22 nt, Human
ugguaagggguggaaccagagc

SEQ ID NO: 680035 - RNA, 22 nt, Human
cuagaauacucguauuauuccc

SEQ ID NO: 680036 - RNA, 22 nt, Human
acucucagaggguggcagcaau

SEQ ID NO: 680037 - RNA, 22 nt, Human
cagagcuguccaaacccugaca

SEQ ID NO: 680038 - RNA, 22 nt, Human
agugcaauagcaaagaacaaca

SEQ ID NO: 680039 - RNA, 22 nt, Human
cuuggagauucauugccugaaa

SEQ ID NO: 680040 - RNA, 22 nt, Human
ggcccugcugaguggaguggag

SEQ ID NO: 680041 - RNA, 22 nt, Human
uuugagaaguaauucaagacau

SEQ ID NO: 680042 - RNA, 22 nt, Human
ugugguagucucagggcaguau

SEQ ID NO: 680043 - RNA, 22 nt, Human
acuuaguuaaguauuuuggaaa

SEQ ID NO: 680044 - RNA, 22 nt, Human
cuuggagugaaugggggcaggu

SEQ ID NO: 680045 - RNA, 22 nt, Human
aucacaaaggcugcuucaugau

SEQ ID NO: 680046 - RNA, 22 nt, Human
uggcauccuuuaucugcaggcu

SEQ ID NO: 680047 - RNA, 22 nt, Human
uagaaacauauaggauggcagg

SEQ ID NO: 680048 - RNA, 22 nt, Human
uccauuuuagaagaaaauccac

SEQ ID NO: 680049 - RNA, 22 nt, Human
agccuggcccugcugaacucug

SEQ ID NO: 680050 - RNA, 22 nt, Human
ggccuguccagccugccuggcu

SEQ ID NO: 680051 - RNA, 22 nt, Human
uucaugaaagacagcaacugug

SEQ ID NO: 680052 - RNA, 22 nt, Human
auaacugagagcaaucuuucuu

SEQ ID NO: 680053 - RNA, 22 nt, Human
uuucuacaacacuucugaaucu

SEQ ID NO: 680054 - RNA, 22 nt, Human
uaacagcucuguguggcuguaa

SEQ ID NO: 680055 - RNA, 22 nt, Human
gcuccaggccccagcguuccgc

SEQ ID NO: 680056 - RNA, 22 nt, Human
uuccaggcacaucccaacucca

SEQ ID NO: 680057 - RNA, 22 nt, Human
cauccauagccucaauaaauag

SEQ ID NO: 680058 - RNA, 22 nt, Human
uggagcuggcuuguggaaguug

SEQ ID NO: 680059 - RNA, 22 nt, Human
gcagggugaaggucacauagaa

SEQ ID NO: 680060 - RNA, 22 nt, Human
gcucacugccauucucuagaug

SEQ ID NO: 680061 - RNA, 22 nt, Human
aggcagcagggccacuggcuga

SEQ ID NO: 680062 - RNA, 22 nt, Human
cagcagcucaggcugcuuccca

SEQ ID NO: 680063 - RNA, 22 nt, Human
aauccauaauguugugggguuu

SEQ ID NO: 680064 - RNA, 22 nt, Human
ugagaaggguuggagaaauaau

SEQ ID NO: 680065 - RNA, 22 nt, Human
agacucugcuaagaauauaauu

SEQ ID NO: 680066 - RNA, 22 nt, Human
uuuccuuccuugcuagccugag

SEQ ID NO: 680067 - RNA, 22 nt, Human
aagagaaugacaaggagaaccu

SEQ ID NO: 680068 - RNA, 22 nt, Human
gcagcaagucuaguuuguaggc

SEQ ID NO: 680069 - RNA, 22 nt, Human
gcuccugggcucuaccuugcua

SEQ ID NO: 680070 - RNA, 22 nt, Human
caucuuauaggcagaguucagu

SEQ ID NO: 680071 - RNA, 22 nt, Human
aaagaaauagauggcauuuaaa

SEQ ID NO: 680072 - RNA, 22 nt, Human
ugagacaggcuuccuucuuggg

SEQ ID NO: 680073 - RNA, 20 nt, Human
cuugccaguucccuggcaga

SEQ ID NO: 680074 - RNA, 22 nt, Human
auugacaagugagcugggcugc

SEQ ID NO: 680075 - RNA, 22 nt, Human
auuuugaaaccaaguuauuucc

SEQ ID NO: 680076 - RNA, 22 nt, Human
aggacagcagccauuggcaguc

SEQ ID NO: 680077 - RNA, 22 nt, Human
ugagguuauuuauuaugcauga

SEQ ID NO: 680078 - RNA, 22 nt, Human
guccaagucuuccuucccaaac

SEQ ID NO: 680079 - RNA, 22 nt, Human
cagcagccucaaguuuauuuuc

SEQ ID NO: 680080 - RNA, 22 nt, Human
cuggcaguauuaagagaaguga

SEQ ID NO: 680081 - RNA, 22 nt, Human
aguugcugauucugucugugau

SEQ ID NO: 680082 - RNA, 21 nt, Human
ugcugcugaucgggguuggcu

SEQ ID NO: 680083 - RNA, 22 nt, Human
uggggugccgacagggagggca

SEQ ID NO: 680084 - RNA, 22 nt, Human
cccaggcuucccaaucagaagg

SEQ ID NO: 680085 - RNA, 22 nt, Human
acaaaugugauuguuucugaaa

SEQ ID NO: 680086 - RNA, 22 nt, Human
uaguagcaaaacucaucucuuu

SEQ ID NO: 680087 - RNA, 22 nt, Human
ggcacagagcuccagccuuggc

SEQ ID NO: 680088 - RNA, 22 nt, Human
acuaaauauuugagagguguag

SEQ ID NO: 680089 - RNA, 22 nt, Human
agaguuggccaaaaggggcauu

SEQ ID NO: 680090 - RNA, 22 nt, Human
uuccauugaguaccuggagaca

SEQ ID NO: 680091 - RNA, 22 nt, Human
ggguccaggucuucaggcagag

SEQ ID NO: 680092 - RNA, 22 nt, Human
aagaugcagcuuuacaauaagg

SEQ ID NO: 680093 - RNA, 22 nt, Human
agugcagauuuuuagucagcuu

SEQ ID NO: 680094 - RNA, 22 nt, Human
uaggcugggccugccuuccagg

SEQ ID NO: 680095 - RNA, 22 nt, Human
uaccucucuaaacccagggaca

SEQ ID NO: 680096 - RNA, 23 nt, Human
acugggccagcuacuuagcacug

SEQ ID NO: 680097 - RNA, 22 nt, Human
aguuaacacaaguaagauucca

SEQ ID NO: 680098 - RNA, 22 nt, Human
auagcaaauauuuuaaugagca

SEQ ID NO: 680099 - RNA, 22 nt, Human
ucagaagucuggacugcuucuc

SEQ ID NO: 680100 - RNA, 22 nt, Human
uaucuucaauuuauucaaggag

SEQ ID NO: 680101 - RNA, 22 nt, Human
ugaaagcagauagcucuguugu

SEQ ID NO: 680102 - RNA, 22 nt, Human
cuagagaaaaugauagcaggaa

SEQ ID NO: 680103 - RNA, 18 nt, Human
gcaggugccacugcuguu

SEQ ID NO: 680104 - RNA, 22 nt, Human
gaacuguagagaauacauuucu

SEQ ID NO: 680105 - RNA, 22 nt, Human
accccaggagcugugccuaguc

SEQ ID NO: 680106 - RNA, 22 nt, Human
caugcagugaaauugauaucca

SEQ ID NO: 680107 - RNA, 22 nt, Human
uucugagagagccucucauguu

SEQ ID NO: 680108 - RNA, 22 nt, Human
gagggucccgagcccugucaga

SEQ ID NO: 680109 - RNA, 22 nt, Human
gguggcaucucaguucaugggc

SEQ ID NO: 680110 - RNA, 22 nt, Human
agagcagcugugacauggacag

SEQ ID NO: 680111 - RNA, 22 nt, Human
cagcucucacacuuagcuucua

SEQ ID NO: 680112 - RNA, 22 nt, Human
augagguuuugauuggcacagg

SEQ ID NO: 680113 - RNA, 22 nt, Human
gccguggccagagcccagucuc

SEQ ID NO: 680114 - RNA, 18 nt, Human
aggccagcccugcuacug

SEQ ID NO: 680115 - RNA, 22 nt, Human
cauuuccagcuccugcaucaug

SEQ ID NO: 680116 - RNA, 22 nt, Human
cccagggcccuggacagcuaca

SEQ ID NO: 680117 - RNA, 22 nt, Human
uggggccuuggccucauuagau

SEQ ID NO: 680118 - RNA, 22 nt, Human
ccacccagcagaggaggcaaga

SEQ ID NO: 680119 - RNA, 22 nt, Human
uugagguaauaaacagccauuc

SEQ ID NO: 680120 - RNA, 22 nt, Human
agagcuagaaggaagcauuucu

SEQ ID NO: 680121 - RNA, 22 nt, Human
cagaggccccauuggcugugcg

SEQ ID NO: 680122 - RNA, 22 nt, Human
acugcaucugaaacauggguca

SEQ ID NO: 680123 - RNA, 22 nt, Human
aaugauaccgccaauauuacca

SEQ ID NO: 680124 - RNA, 22 nt, Human
agccacugugcaggagcagugu

SEQ ID NO: 680125 - RNA, 22 nt, Human
ugccacacuccccugcugcagu

SEQ ID NO: 680126 - RNA, 22 nt, Human
ccgcgcgcgugggcguccaggg

SEQ ID NO: 680127 - RNA, 22 nt, Human
uaggccacggaaagcagguugc

SEQ ID NO: 680128 - RNA, 22 nt, Human
uucuuucuuagcaaucuauggu

SEQ ID NO: 680129 - RNA, 22 nt, Human
agagucagacuaagccauggug

SEQ ID NO: 680130 - RNA, 22 nt, Human
cccucaguuuuccagugugggc

SEQ ID NO: 680131 - RNA, 22 nt, Human
cccacccagccuggcugagggg

SEQ ID NO: 680132 - RNA, 22 nt, Human
caaaugcagucccuuuguugcu

SEQ ID NO: 680133 - RNA, 22 nt, Human
ucagauacuagcucucagccuc

SEQ ID NO: 680134 - RNA, 22 nt, Human
uguguguacucuccaguccuga

SEQ ID NO: 680135 - RNA, 22 nt, Human
auggccagucuguuggacagca

SEQ ID NO: 680136 - RNA, 22 nt, Human
cagugggauugggauuggaacc

SEQ ID NO: 680137 - RNA, 22 nt, Human
gaccugccugagcugccucugc

SEQ ID NO: 680138 - RNA, 22 nt, Human
uggcccugaaucaaggccagca

SEQ ID NO: 680139 - RNA, 20 nt, Human
ugcagaagaacguucugguu

SEQ ID NO: 680140 - RNA, 22 nt, Human
gaggcucaacccacagggguug

SEQ ID NO: 680141 - RNA, 22 nt, Human
aggcagcaauugaaaucauugu

SEQ ID NO: 680142 - RNA, 22 nt, Human
augagcucauccgagucacacu

SEQ ID NO: 680143 - RNA, 22 nt, Human
uuugggaagaggaaucucugga

SEQ ID NO: 680144 - RNA, 22 nt, Human
agaagucauuuauguuagauga

SEQ ID NO: 680145 - RNA, 22 nt, Human
cuggcuguuucuccuuugucua

SEQ ID NO: 680146 - RNA, 22 nt, Human
acugugagaguuuuucuaggag

SEQ ID NO: 680147 - RNA, 22 nt, Human
uacaaaguuugagaaugcuuuc

SEQ ID NO: 680148 - RNA, 22 nt, Human
auuacucugucugccucugacc

SEQ ID NO: 680149 - RNA, 23 nt, Human
uggccagguagaggagguaguga

SEQ ID NO: 680150 - RNA, 22 nt, Human
ugacuucaaaggcucuacuccu

SEQ ID NO: 680151 - RNA, 22 nt, Human
agccagccgggggaccacagug

SEQ ID NO: 680152 - RNA, 22 nt, Human
cuuguagaauugaaauggucuc

SEQ ID NO: 680153 - RNA, 22 nt, Human
aagcagcagccugaaguacguc

SEQ ID NO: 680154 - RNA, 22 nt, Human
uccugagcugacacuuggggag

SEQ ID NO: 680155 - RNA, 22 nt, Human
uuuaacccaaauaaccacagga

SEQ ID NO: 680156 - RNA, 22 nt, Human
guuaaaugcauuuuccaagcac

SEQ ID NO: 680157 - RNA, 22 nt, Human
gaccugaaagugugggcgaccu

SEQ ID NO: 680158 - RNA, 22 nt, Human
gaaacugaauauaagaaaggua

SEQ ID NO: 680159 - RNA, 22 nt, Human
ugcuggaauuauagaaaaauag

SEQ ID NO: 680160 - RNA, 22 nt, Human
agaaagcuuaugaaugggcaag

SEQ ID NO: 680161 - RNA, 23 nt, Human
ggacacugugcagaugcuagugc

SEQ ID NO: 680162 - RNA, 22 nt, Human
agcagcuguacuuucaucuguu

SEQ ID NO: 680163 - RNA, 22 nt, Human
ugaggccagugacauauauuaa

SEQ ID NO: 680164 - RNA, 22 nt, Human
uacaaaaggaagagggaucuua

SEQ ID NO: 680165 - RNA, 22 nt, Human
cagcagcaguggcugcagaaca

SEQ ID NO: 680166 - RNA, 22 nt, Human
uuguuaaagaugcagauuccau

SEQ ID NO: 680167 - RNA, 22 nt, Human
caggcagcugcgacaagagagc

SEQ ID NO: 680168 - RNA, 19 nt, Human
gcacaggacaucugaugga

SEQ ID NO: 680169 - RNA, 22 nt, Human
uucacauaaugauacaaagcuu

SEQ ID NO: 680170 - RNA, 22 nt, Human
uuuuagaagugccuauccuaug

SEQ ID NO: 680171 - RNA, 22 nt, Human
acugugcacacaaaaauagauu

SEQ ID NO: 680172 - RNA, 22 nt, Human
uuacacaaagcuccccaaauag

SEQ ID NO: 680173 - RNA, 22 nt, Human
aaagaacaaauuagcuguuuua

SEQ ID NO: 680174 - RNA, 22 nt, Human
ggcucccuggcccuggggacac

SEQ ID NO: 680175 - RNA, 22 nt, Human
agugggcaugaucuggugucug

SEQ ID NO: 680176 - RNA, 22 nt, Human
guacaguagagccagguucagu

SEQ ID NO: 680177 - RNA, 22 nt, Human
ucuuucaauccauucauauguc

SEQ ID NO: 680178 - RNA, 22 nt, Human
cuuuuuuccuaaggcaacauga

SEQ ID NO: 680179 - RNA, 22 nt, Human
cugcaggcccccuuccuggagu

SEQ ID NO: 680180 - RNA, 21 nt, Human
uaucaaggcacuuuuuaaaga

SEQ ID NO: 680181 - RNA, 22 nt, Human
cagcagaguauggcacucaacu

SEQ ID NO: 680182 - RNA, 22 nt, Human
gauauuuugagaaauccuauga

SEQ ID NO: 680183 - RNA, 22 nt, Human
aaucagaaauucuacaucacaa

SEQ ID NO: 680184 - RNA, 21 nt, Human
agccaagccuugggagccagg

SEQ ID NO: 680185 - RNA, 22 nt, Human
guuauucaacuugugucucuua

SEQ ID NO: 680186 - RNA, 22 nt, Human
gagugcuggaggugugaguggg

SEQ ID NO: 680187 - RNA, 22 nt, Human
ugugugcacaugauuugaaaug

SEQ ID NO: 680188 - RNA, 22 nt, Human
cagagcauugagggucugccaa

SEQ ID NO: 680189 - RNA, 22 nt, Human
ggcuccugauaggagaaugcgg

SEQ ID NO: 680190 - RNA, 21 nt, Human
ccuuuacaauuuugcauuccu

SEQ ID NO: 680191 - RNA, 22 nt, Human
caugauuuugucuuguguuaau

SEQ ID NO: 680192 - RNA, 21 nt, Human
gcuauacagaauggccagagg

SEQ ID NO: 680193 - RNA, 22 nt, Human
auuagcuguugugaaaggggug

SEQ ID NO: 680194 - RNA, 22 nt, Human
uucaaacuguguaauuuauaaa

SEQ ID NO: 680195 - RNA, 22 nt, Human
aggcacugaagugguaaaugua

SEQ ID NO: 680196 - RNA, 18 nt, Human
aauuucuuugacaacuua

SEQ ID NO: 680197 - RNA, 22 nt, Human
ggauggcagucugcaugagaaa

SEQ ID NO: 680198 - RNA, 22 nt, Human
aguggcuguccuggcucuaacu

SEQ ID NO: 680199 - RNA, 22 nt, Human
gacuguggcaggcucagcacug

SEQ ID NO: 680200 - RNA, 22 nt, Human
gggaguaaacuauggugaggau

SEQ ID NO: 680201 - RNA, 22 nt, Human
cuggaagagugacuuugcauuu

SEQ ID NO: 680202 - RNA, 22 nt, Human
cugggaggacaacuuggagcuc

SEQ ID NO: 680203 - RNA, 22 nt, Human
ucucuuucuuuguaugucuauu

SEQ ID NO: 680204 - RNA, 22 nt, Human
uuuuguauccucccuuucacug

SEQ ID NO: 680205 - RNA, 22 nt, Human
acagcugcauucuuaacaggaa

SEQ ID NO: 680206 - RNA, 22 nt, Human
agcgugugccucgggguacacg

SEQ ID NO: 680207 - RNA, 21 nt, Human
agacuuugcuugcagagaguc

SEQ ID NO: 680208 - RNA, 22 nt, Human
cccuugcaucccauguguggcc

SEQ ID NO: 680209 - RNA, 22 nt, Human
aagcaaaagguuacacuucugg

SEQ ID NO: 680210 - RNA, 22 nt, Human
ucacuggagaaaaguaauguau

SEQ ID NO: 680211 - RNA, 22 nt, Human
cacccccagcagggaaaggagg

SEQ ID NO: 680212 - RNA, 22 nt, Human
caggccuggagugcaauggcac

SEQ ID NO: 680213 - RNA, 22 nt, Human
gucacuuuauuaauuuugguga

SEQ ID NO: 680214 - RNA, 22 nt, Human
agugucugaaccugcaguggga

SEQ ID NO: 680215 - RNA, 19 nt, Human
cccagccaggucuugcauc

SEQ ID NO: 680216 - RNA, 22 nt, Human
cuuuacuguucuucugugggaa

SEQ ID NO: 680217 - RNA, 22 nt, Human
ugucugcccauucaugggcaca

SEQ ID NO: 680218 - RNA, 22 nt, Human
ucuugaaggggggcaguguuga

SEQ ID NO: 680219 - RNA, 22 nt, Human
ggggcugguggugguuucucca

SEQ ID NO: 680220 - RNA, 22 nt, Human
gcuuccagaaugacuaggaugu

SEQ ID NO: 680221 - RNA, 22 nt, Human
ugaaguuauauauguugaaaau

SEQ ID NO: 680222 - RNA, 22 nt, Human
uccagggcgugugugaaggaaa

SEQ ID NO: 680223 - RNA, 22 nt, Human
gacauccaucauuuccuguuga

SEQ ID NO: 680224 - RNA, 22 nt, Human
agagaggcgaguuaccugugcu

SEQ ID NO: 680225 - RNA, 22 nt, Human
ucccugggaauuaauauuugga

SEQ ID NO: 680226 - RNA, 22 nt, Human
cuggcugccuggagugagggag

SEQ ID NO: 680227 - RNA, 22 nt, Human
aguugaacaguauuugcuucug

SEQ ID NO: 680228 - RNA, 18 nt, Human
gaugggguccaggcauag

SEQ ID NO: 680229 - RNA, 22 nt, Human
uacuuuuuagcacagugugugc

SEQ ID NO: 680230 - RNA, 17 nt, Human
uuauuuuuugggcugag

SEQ ID NO: 680231 - RNA, 22 nt, Human
guacaaaaguuauugcgguuuu

SEQ ID NO: 680232 - RNA, 22 nt, Human
cuguggccuuggaccagcaucu

SEQ ID NO: 680233 - RNA, 22 nt, Human
cuguugcuaaguagugcaggua

SEQ ID NO: 680234 - RNA, 22 nt, Human
aguccaggaaaauaagcuaggu

SEQ ID NO: 680235 - RNA, 22 nt, Human
gcucuggagagccauaggcccu

SEQ ID NO: 680236 - RNA, 22 nt, Human
cagcacugcugcuguacacaca

SEQ ID NO: 680237 - RNA, 22 nt, Human
uucugaaggcuccucaggaaag

SEQ ID NO: 680238 - RNA, 21 nt, Human
aacuuuagaaagacugggaag

SEQ ID NO: 680239 - RNA, 22 nt, Human
agggcgaggagacggaggcaca

SEQ ID NO: 680240 - RNA, 22 nt, Human
ugaggcaggagaaucacaugaa

SEQ ID NO: 680241 - RNA, 22 nt, Human
ggcacugagcugccuuggggca

SEQ ID NO: 680242 - RNA, 22 nt, Human
acugugggagcgcaguggcagc

SEQ ID NO: 680243 - RNA, 22 nt, Human
cucuguagaaacagggcagaag

SEQ ID NO: 680244 - RNA, 22 nt, Human
ucagaggagccaaaguucugag

SEQ ID NO: 680245 - RNA, 22 nt, Human
auacuacauacuauguaaacau

SEQ ID NO: 680246 - RNA, 22 nt, Human
accugccucuaagcagcaggug

SEQ ID NO: 680247 - RNA, 22 nt, Human
uggcuccaaaaacaaaugacau

SEQ ID NO: 680248 - RNA, 22 nt, Human
acuuaaaguuauaauuugcuaa

SEQ ID NO: 680249 - RNA, 18 nt, Human
ucucuaccagaagugacg

SEQ ID NO: 680250 - RNA, 20 nt, Human
ugcugcugcuucacccccau

SEQ ID NO: 680251 - RNA, 22 nt, Human
ucagagaggcaauacuguuuaa

SEQ ID NO: 680252 - RNA, 22 nt, Human
aggcaccgcuccucaguccaga

SEQ ID NO: 680253 - RNA, 22 nt, Human
aaaaaugaaacggcugguuggc

SEQ ID NO: 680254 - RNA, 22 nt, Human
agauaucuggaaaaaauguaug

SEQ ID NO: 680255 - RNA, 22 nt, Human
agcagcauggcugacuaaagac

SEQ ID NO: 680256 - RNA, 22 nt, Human
cccagugugaugagguugcuaa

SEQ ID NO: 680257 - RNA, 22 nt, Human
auuguucuggauauuuacauug

SEQ ID NO: 680258 - RNA, 22 nt, Human
ugcaggaaugagguucucaguu

SEQ ID NO: 680259 - RNA, 22 nt, Human
aaguaugugauacauguuaauu

SEQ ID NO: 680260 - RNA, 22 nt, Human
aggcuucuugagccccacaggc

SEQ ID NO: 680261 - RNA, 22 nt, Human
cagacaggguggguuucugggc

SEQ ID NO: 680262 - RNA, 22 nt, Human
ugaagaauguugcagugagcau

SEQ ID NO: 680263 - RNA, 22 nt, Human
agcacaguuucuuuuccuuguc

SEQ ID NO: 680264 - RNA, 22 nt, Human
aggccagcagacgugggacuga

SEQ ID NO: 680265 - RNA, 22 nt, Human
ccugggugacccgugagcgucc

SEQ ID NO: 680266 - RNA, 22 nt, Human
ucugggcuugguuagggcuguu

SEQ ID NO: 680267 - RNA, 22 nt, Human
uggguccucgucuuccaaggca

SEQ ID NO: 680268 - RNA, 21 nt, Human
aaggcugagacaacucaggag

SEQ ID NO: 680269 - RNA, 22 nt, Human
ugagcccagucugucugacaug

SEQ ID NO: 680270 - RNA, 22 nt, Human
aagcagccagccaucaugcccg

SEQ ID NO: 680271 - RNA, 22 nt, Human
uuauaaagauuguuauguaucu

SEQ ID NO: 680272 - RNA, 22 nt, Human
agaucauuaaccaccuguucug

SEQ ID NO: 680273 - RNA, 22 nt, Human
caggaaaccgcaucccaguggg

SEQ ID NO: 680274 - RNA, 21 nt, Human
agcagacagaugcacgcacac

SEQ ID NO: 680275 - RNA, 22 nt, Human
ugggcucugaagucagucugcu

SEQ ID NO: 680276 - RNA, 22 nt, Human
gcuucagauucuuuucaugucu

SEQ ID NO: 680277 - RNA, 22 nt, Human
uugaggucaaagaagugagugg

SEQ ID NO: 680278 - RNA, 22 nt, Human
ucaggcaccccuugaguagggg

SEQ ID NO: 680279 - RNA, 22 nt, Human
ggcucugguugaccaugauggc

SEQ ID NO: 680280 - RNA, 17 nt, Human
agguggguggaucaccu

SEQ ID NO: 680281 - RNA, 22 nt, Human
agcagggagaccaucucuuccu

SEQ ID NO: 680282 - RNA, 22 nt, Human
ucuguguacgcaggcgugcgcg

SEQ ID NO: 680283 - RNA, 22 nt, Human
gggauagguuuggaagaggugg

SEQ ID NO: 680284 - RNA, 22 nt, Human
accuccugaugagaguaaagga

SEQ ID NO: 680285 - RNA, 22 nt, Human
guguuuauaggagugaaugcug

SEQ ID NO: 680286 - RNA, 22 nt, Human
cagucacagugacaggaugugg

SEQ ID NO: 680287 - RNA, 22 nt, Human
ugagccagcaggccuccagugg

SEQ ID NO: 680288 - RNA, 22 nt, Human
cugaggccccucuugugagcau

SEQ ID NO: 680289 - RNA, 22 nt, Human
uauucacagguucuggggauca

SEQ ID NO: 680290 - RNA, 23 nt, Human
uuugcaaauuggacacaaccaca

SEQ ID NO: 680291 - RNA, 22 nt, Human
cagaaauaaacuucucacaucg

SEQ ID NO: 680292 - RNA, 22 nt, Human
agugacugggcagggcagggcc

SEQ ID NO: 680293 - RNA, 22 nt, Human
ggacugggcaugggugcucugc

SEQ ID NO: 680294 - RNA, 22 nt, Human
cucuccauucccuacaguuuuc

SEQ ID NO: 680295 - RNA, 22 nt, Human
agcagcuggaacauaugaagaa

SEQ ID NO: 680296 - RNA, 22 nt, Human
aggcagagagcaguggccgucu

SEQ ID NO: 680297 - RNA, 21 nt, Human
uucuucaugaugauuaauggc

SEQ ID NO: 680298 - RNA, 22 nt, Human
agaaauguggaucguuuuaaaa

SEQ ID NO: 680299 - RNA, 22 nt, Human
ccagccugaaaugccucauccu

SEQ ID NO: 680300 - RNA, 22 nt, Human
augauauauguguugagcuugc

SEQ ID NO: 680301 - RNA, 20 nt, Human
agagaugggguaucaccgua

SEQ ID NO: 680302 - RNA, 22 nt, Human
cucuccagucaggaacucugac

SEQ ID NO: 680303 - RNA, 22 nt, Human
ugugugaagugauuuuaagucu

SEQ ID NO: 680304 - RNA, 22 nt, Human
aagagagaguuccuaggcaaaa

SEQ ID NO: 680305 - RNA, 22 nt, Human
cuugacuuugccuuuuaaaugu

SEQ ID NO: 680306 - RNA, 22 nt, Human
ggucugugucauaggcugaguu

SEQ ID NO: 680307 - RNA, 22 nt, Human
aucuauucucuacaguagacag

SEQ ID NO: 680308 - RNA, 21 nt, Human
ucacugaagccuaagauguuu

SEQ ID NO: 680309 - RNA, 22 nt, Human
acagaauaguagcuuaaaguca

SEQ ID NO: 680310 - RNA, 22 nt, Human
ucugaaauggggcugaagcacu

SEQ ID NO: 680311 - RNA, 22 nt, Human
gaggguggccuuuagagcccau

SEQ ID NO: 680312 - RNA, 22 nt, Human
ugcuccagugccugccccacag

SEQ ID NO: 680313 - RNA, 22 nt, Human
cagcucccuauggugaggcgac

SEQ ID NO: 680314 - RNA, 22 nt, Human
uuucccucugugccagcuucuc

SEQ ID NO: 680315 - RNA, 22 nt, Human
uucucuugugccaaguuguugc

SEQ ID NO: 680316 - RNA, 22 nt, Human
cuggacaucagugugccuggcu

SEQ ID NO: 680317 - RNA, 22 nt, Human
accagcucagagcaggcuccug

SEQ ID NO: 680318 - RNA, 22 nt, Human
uauuugcuccuuaggcauauuu

SEQ ID NO: 680319 - RNA, 18 nt, Human
ggcugcuccucucccuac

SEQ ID NO: 680320 - RNA, 18 nt, Human
gcacauguaagaguaaag

SEQ ID NO: 680321 - RNA, 22 nt, Human
uggaugagauuaaagugagguu

SEQ ID NO: 680322 - RNA, 22 nt, Human
agggagucaacacaguaauguu

SEQ ID NO: 680323 - RNA, 22 nt, Human
acacuuaaucuuacugaggauc

SEQ ID NO: 680324 - RNA, 22 nt, Human
agagccaggccaggccggggca

SEQ ID NO: 680325 - RNA, 22 nt, Human
agccuggcacugccccauccau

SEQ ID NO: 680326 - RNA, 22 nt, Human
ugacaugaaacuguguugcuac

SEQ ID NO: 680327 - RNA, 22 nt, Human
cuauucuagauuacaguauaaa

SEQ ID NO: 680328 - RNA, 22 nt, Human
uccuucaagaugccacagcuuu

SEQ ID NO: 680329 - RNA, 22 nt, Human
ugcuuccagccuucccaaugcu

SEQ ID NO: 680330 - RNA, 22 nt, Human
ggcccagccuugggguuucuuu

SEQ ID NO: 680331 - RNA, 22 nt, Human
ucagcucuguguacaguuagca

SEQ ID NO: 680332 - RNA, 22 nt, Human
gccagagagacugauacaugcu

SEQ ID NO: 680333 - RNA, 22 nt, Human
agaaugggggcuacaggccaca

SEQ ID NO: 680334 - RNA, 22 nt, Human
agaaacuaagucauaacucuuu

SEQ ID NO: 680335 - RNA, 22 nt, Human
gcucuguacgcaggaugagggg

SEQ ID NO: 680336 - RNA, 22 nt, Human
agcacagauguacuuugagggg

SEQ ID NO: 680337 - RNA, 22 nt, Human
uucuuggaugcccucaugccuu

SEQ ID NO: 680338 - RNA, 22 nt, Human
cucuauuuuucuuggcuagugu

SEQ ID NO: 680339 - RNA, 22 nt, Human
gauggcuucugaaucagggccu

SEQ ID NO: 680340 - RNA, 23 nt, Human
ggagccuggcauaugagacgcau

SEQ ID NO: 680341 - RNA, 22 nt, Human
cccuccagcucaaagcaaccgg

SEQ ID NO: 680342 - RNA, 22 nt, Human
ccaguccuuugagccaguucug

SEQ ID NO: 680343 - RNA, 22 nt, Human
uuauucuguugcuuuuacagua

SEQ ID NO: 680344 - RNA, 22 nt, Human
uggcucagucuggguugacuga

SEQ ID NO: 680345 - RNA, 22 nt, Human
aaauagcuucuaagccuuuuga

SEQ ID NO: 680346 - RNA, 22 nt, Human
cacuguauuauuaggaaugaca

SEQ ID NO: 680347 - RNA, 22 nt, Human
ggccuugggauguggcugcagc

SEQ ID NO: 680348 - RNA, 22 nt, Human
agucagagcaaacuggacagac

SEQ ID NO: 680349 - RNA, 23 nt, Human
aggcuucauccauauuuauugcc

SEQ ID NO: 680350 - RNA, 22 nt, Human
aaucacauuuacauugcuaauu

SEQ ID NO: 680351 - RNA, 23 nt, Human
aacuccugaaucgugagccaucu

SEQ ID NO: 680352 - RNA, 22 nt, Human
gcuccccuugguccuccuggga

SEQ ID NO: 680353 - RNA, 18 nt, Human
uaguggaacugcucuggg

SEQ ID NO: 680354 - RNA, 22 nt, Human
caggcagcugacugucagauau

SEQ ID NO: 680355 - RNA, 22 nt, Human
cacacaguaguaugaggcaaaa

SEQ ID NO: 680356 - RNA, 22 nt, Human
cucugaguuucauuucccuccu

SEQ ID NO: 680357 - RNA, 22 nt, Human
aaacuguuauagcagaaaggac

SEQ ID NO: 680358 - RNA, 22 nt, Human
gauguaaaaacuccuuucgaaa

SEQ ID NO: 680359 - RNA, 22 nt, Human
uaaacagaaugcguaagaagug

SEQ ID NO: 680360 - RNA, 22 nt, Human
ucaggcagagcuguggagcucu

SEQ ID NO: 680361 - RNA, 22 nt, Human
uucugaaugauagucuugaacu

SEQ ID NO: 680362 - RNA, 22 nt, Human
ucaugcuuugguugcuguccuu

SEQ ID NO: 680363 - RNA, 20 nt, Human
auaauuauuuacuuuugugc

SEQ ID NO: 680364 - RNA, 22 nt, Human
aguccagggcucucugugggau

SEQ ID NO: 680365 - RNA, 22 nt, Human
cccaggcuccugcuguguugac

SEQ ID NO: 680366 - RNA, 22 nt, Human
uuccucuguaugcuuugcugcu

SEQ ID NO: 680367 - RNA, 22 nt, Human
ggcucaccauggccucccugcu

SEQ ID NO: 680368 - RNA, 22 nt, Human
uucaagucuuccaugguauucu

SEQ ID NO: 680369 - RNA, 22 nt, Human
acagcaugucuaguuaaauacu

SEQ ID NO: 680370 - RNA, 22 nt, Human
ggcagcaacucauuauuccugu

SEQ ID NO: 680371 - RNA, 22 nt, Human
ggccagcugagcugcugcacag

SEQ ID NO: 680372 - RNA, 22 nt, Human
gcagccacucucauuccacgug

SEQ ID NO: 680373 - RNA, 22 nt, Human
ccauuuuucauaaacuauccaa

SEQ ID NO: 680374 - RNA, 22 nt, Human
ucucccacuggccuuguaugau

SEQ ID NO: 680375 - RNA, 22 nt, Human
uuaagaagguacucaaagaucu

SEQ ID NO: 680376 - RNA, 22 nt, Human
cacucugacacaugaacuugau

SEQ ID NO: 680377 - RNA, 22 nt, Human
ccucugagccugugugcggcac

SEQ ID NO: 680378 - RNA, 21 nt, Human
gugcagaggaauguagggggc

SEQ ID NO: 680379 - RNA, 22 nt, Human
gaaaauuuaauucucuucugug

SEQ ID NO: 680380 - RNA, 22 nt, Human
gcagagccugggggucugcgga

SEQ ID NO: 680381 - RNA, 22 nt, Human
ggaguuggaggcuccagggaac

SEQ ID NO: 680382 - RNA, 22 nt, Human
uauggcuucuuuugcaacuacu

SEQ ID NO: 680383 - RNA, 22 nt, Human
ggcugugcaccauccaccuccc

SEQ ID NO: 680384 - RNA, 22 nt, Human
ccagaucuucuuuucagugucu

SEQ ID NO: 680385 - RNA, 23 nt, Human
augcaacauugccaguaugggca

SEQ ID NO: 680386 - RNA, 22 nt, Human
ccugaaaugacuccagcugagu

SEQ ID NO: 680387 - RNA, 19 nt, Human
caggaacauggagggaggg

SEQ ID NO: 680388 - RNA, 22 nt, Human
aaugaucuacucucauuaucuc

SEQ ID NO: 680389 - RNA, 22 nt, Human
cccaggggagguccucagggaa

SEQ ID NO: 680390 - RNA, 22 nt, Human
uacagaggggacauggaagaca

SEQ ID NO: 680391 - RNA, 22 nt, Human
ugccagaagauucucuaucaga

SEQ ID NO: 680392 - RNA, 22 nt, Human
cugaggaucuaauuauuggguc

SEQ ID NO: 680393 - RNA, 22 nt, Human
aagagacaaugucuuuuggaua

SEQ ID NO: 680394 - RNA, 22 nt, Human
cugggcacagcguugggcucuu

SEQ ID NO: 680395 - RNA, 22 nt, Human
auaaaugugaaaugagcaguua

SEQ ID NO: 680396 - RNA, 22 nt, Human
ucugagcuaauccuguugccga

SEQ ID NO: 680397 - RNA, 22 nt, Human
cacugcuuaguugguaaaugug

SEQ ID NO: 680398 - RNA, 22 nt, Human
gguccugggaagaugcucauga

SEQ ID NO: 680399 - RNA, 22 nt, Human
acucugaaugugcauguaaauc

SEQ ID NO: 680400 - RNA, 22 nt, Human
ggaggcagaacuucccgucagu

SEQ ID NO: 680401 - RNA, 22 nt, Human
cacauuucugugagucaauauu

SEQ ID NO: 680402 - RNA, 22 nt, Human
agaagggcuacacgggcucucc

SEQ ID NO: 680403 - RNA, 20 nt, Human
agcauucauucagcaagccu

SEQ ID NO: 680404 - RNA, 22 nt, Human
cugggccagcaacugcaaugga

SEQ ID NO: 680405 - RNA, 22 nt, Human
ccgggggcgggacgagcuugac

SEQ ID NO: 680406 - RNA, 22 nt, Human
auacuugagguagcaacuuaag

SEQ ID NO: 680407 - RNA, 22 nt, Human
caggcagggagcuggaaaggau

SEQ ID NO: 680408 - RNA, 22 nt, Human
uucaacagacccuucuuucuuu

SEQ ID NO: 680409 - RNA, 22 nt, Human
agagcccugaagcagagcuaaa

SEQ ID NO: 680410 - RNA, 19 nt, Human
uccugaagauuuccucagc

SEQ ID NO: 680411 - RNA, 21 nt, Human
ugguccuucuuuacugccucc

SEQ ID NO: 680412 - RNA, 15 nt, Human
ucugggcugugagca

SEQ ID NO: 680413 - RNA, 22 nt, Human
gcccaaagucacucagcuagga

SEQ ID NO: 680414 - RNA, 22 nt, Human
cuaggcuguaaagagcuaggag

SEQ ID NO: 680415 - RNA, 22 nt, Human
ggucccugccugaggcuggccu

SEQ ID NO: 680416 - RNA, 18 nt, Human
aggccugggaagcugagg

SEQ ID NO: 680417 - RNA, 22 nt, Human
uauguacucuaauuugucucau

SEQ ID NO: 680418 - RNA, 22 nt, Human
acacauuuauggaucgcagaaa

SEQ ID NO: 680419 - RNA, 22 nt, Human
gagagcuguaauagucaugucu

SEQ ID NO: 680420 - RNA, 22 nt, Human
cccccaaggccaggcugagacc

SEQ ID NO: 680421 - RNA, 22 nt, Human
gagggaagaaagaauugaugcg

SEQ ID NO: 680422 - RNA, 22 nt, Human
agcuggcuuugagcugggaggu

SEQ ID NO: 680423 - RNA, 22 nt, Human
auggggcuguucucugcccugc

SEQ ID NO: 680424 - RNA, 22 nt, Human
gaacuaaaagcuaacaucaggc

SEQ ID NO: 680425 - RNA, 18 nt, Human
uggcucuggacuugcucc

SEQ ID NO: 680426 - RNA, 22 nt, Human
ucaggaagggugguccacaggg

SEQ ID NO: 680427 - RNA, 22 nt, Human
gcucuugaccuuggagaacucg

SEQ ID NO: 680428 - RNA, 22 nt, Human
uacaugcuccacuuucuccugu

SEQ ID NO: 680429 - RNA, 22 nt, Human
acagcaguuuagaggacagcca

SEQ ID NO: 680430 - RNA, 22 nt, Human
caagagcucccagaccugggca

SEQ ID NO: 680431 - RNA, 22 nt, Human
augucugucaucuuccaggaag

SEQ ID NO: 680432 - RNA, 18 nt, Human
acagaaauagcugugccu

SEQ ID NO: 680433 - RNA, 22 nt, Human
agaggaaacauagguuuuuaaa

SEQ ID NO: 680434 - RNA, 22 nt, Human
aaacaucaauugcaucucccaa

SEQ ID NO: 680435 - RNA, 22 nt, Human
gcuguccucuuggacucagggc

SEQ ID NO: 680436 - RNA, 22 nt, Human
acauggcaggaaucauguguuu

SEQ ID NO: 680437 - RNA, 22 nt, Human
cucugagcagcggugccgaagu

SEQ ID NO: 680438 - RNA, 22 nt, Human
uucuuggcauuuucccauuugg

SEQ ID NO: 680439 - RNA, 22 nt, Human
uucuccagacccuccugcagac

SEQ ID NO: 680440 - RNA, 22 nt, Human
aagugaguggccuggagaggug

SEQ ID NO: 680441 - RNA, 22 nt, Human
ugugggaaugacgaggaagagg

SEQ ID NO: 680442 - RNA, 22 nt, Human
uaagaaucaguagauauagauu

SEQ ID NO: 680443 - RNA, 22 nt, Human
ggguuccagucugaaacuacag

SEQ ID NO: 680444 - RNA, 22 nt, Human
uacaggguauucaaggguaguu

SEQ ID NO: 680445 - RNA, 21 nt, Human
ucauccauggcuuuugugcuu

SEQ ID NO: 680446 - RNA, 22 nt, Human
ucauucaugaggugcuagugcu

SEQ ID NO: 680447 - RNA, 22 nt, Human
uagauuugugcaagaagggauu

SEQ ID NO: 680448 - RNA, 22 nt, Human
ugacauuuacuauuccugguua

SEQ ID NO: 680449 - RNA, 22 nt, Human
agucaguguucuggguuguaau

SEQ ID NO: 680450 - RNA, 22 nt, Human
agaagcucggguaagcuccauu

SEQ ID NO: 680451 - RNA, 23 nt, Human
auccccugccuugggugaguccc

SEQ ID NO: 680452 - RNA, 20 nt, Human
uggacaggggcauagguugc

SEQ ID NO: 680453 - RNA, 22 nt, Human
uguguuggcugccggcacagga

SEQ ID NO: 680454 - RNA, 22 nt, Human
auucuucaucagagaugcacua

SEQ ID NO: 680455 - RNA, 22 nt, Human
aagcccugggguugcacaaggc

SEQ ID NO: 680456 - RNA, 22 nt, Human
cuggaguucuaugugcuuguga

SEQ ID NO: 680457 - RNA, 22 nt, Human
gagggcugauaaaugcgcaugg

SEQ ID NO: 680458 - RNA, 22 nt, Human
cuuuccaggcugaguuugcuug

SEQ ID NO: 680459 - RNA, 22 nt, Human
gagcccaggaaguggaggcuga

SEQ ID NO: 680460 - RNA, 22 nt, Human
cacugcagaucagaggcugaga

SEQ ID NO: 680461 - RNA, 22 nt, Human
ggaccagagcucgggcuucuca

SEQ ID NO: 680462 - RNA, 20 nt, Human
uuacaaagaggcaucgcuuu

SEQ ID NO: 680463 - RNA, 22 nt, Human
aaguccuuguauacagaaucaa

SEQ ID NO: 680464 - RNA, 22 nt, Human
uugcugcuuucauuuauacagu

SEQ ID NO: 680465 - RNA, 22 nt, Human
auuuaagauugcguauucaugu

SEQ ID NO: 680466 - RNA, 22 nt, Human
aaugcaaagcaagcagagauuu

SEQ ID NO: 680467 - RNA, 18 nt, Human
gucacuguguuucugagc

SEQ ID NO: 680468 - RNA, 22 nt, Human
gucacccacucccugcugcugu

SEQ ID NO: 680469 - RNA, 22 nt, Human
gggcagagacucagaaacagaa

SEQ ID NO: 680470 - RNA, 22 nt, Human
uuggcucuaggaaccaaaguga

SEQ ID NO: 680471 - RNA, 22 nt, Human
uaucagaaaugccuuaaauugg

SEQ ID NO: 680472 - RNA, 22 nt, Human
uauuucacuccgagacucuaug

SEQ ID NO: 680473 - RNA, 17 nt, Human
uuuagaauacaauguuu

SEQ ID NO: 680474 - RNA, 22 nt, Human
ucaggucugggcacaugguaca

SEQ ID NO: 680475 - RNA, 22 nt, Human
uggcagagccuugccaaacucc

SEQ ID NO: 680476 - RNA, 18 nt, Human
gcuuccugaaagcugccc

SEQ ID NO: 680477 - RNA, 22 nt, Human
ccaggaggaugaggggcauaga

SEQ ID NO: 680478 - RNA, 22 nt, Human
agacagcucuggguuccacacu

SEQ ID NO: 680479 - RNA, 22 nt, Human
aggcugcuggcaggcguggacg

SEQ ID NO: 680480 - RNA, 20 nt, Human
ucauggcugcugagagguuc

SEQ ID NO: 680481 - RNA, 22 nt, Human
agcuguuuuccugguuagagac

SEQ ID NO: 680482 - RNA, 22 nt, Human
aggagaucagcuuagggaaggu

SEQ ID NO: 680483 - RNA, 22 nt, Human
ugaguuuugucuugcuagaagu

SEQ ID NO: 680484 - RNA, 22 nt, Human
cagggcaggacagauacauuac

SEQ ID NO: 680485 - RNA, 22 nt, Human
acuucugaagcagagauuuggg

SEQ ID NO: 680486 - RNA, 22 nt, Human
cauuccuggacaaacaucaaaa

SEQ ID NO: 680487 - RNA, 22 nt, Human
acagcagcuaaccccugggcca

SEQ ID NO: 680488 - RNA, 22 nt, Human
acacauccugaccaaguucagg

SEQ ID NO: 680489 - RNA, 22 nt, Human
auugacuuucccuucuccucau

SEQ ID NO: 680490 - RNA, 23 nt, Human
aagcugccuucgcaguuggucug

SEQ ID NO: 680491 - RNA, 22 nt, Human
gcuggcagagacaagaagacua

SEQ ID NO: 680492 - RNA, 22 nt, Human
ugugugggagcacgggcuguug

SEQ ID NO: 680493 - RNA, 22 nt, Human
agaaaggucaaaaucgugacau

SEQ ID NO: 680494 - RNA, 22 nt, Human
gccaccauguagcccauuagag

SEQ ID NO: 680495 - RNA, 22 nt, Human
ugaaacauaaaguuaucuucag

SEQ ID NO: 680496 - RNA, 22 nt, Human
agcagagucuucaagggcaggc

SEQ ID NO: 680497 - RNA, 22 nt, Human
ggggcugagaauucagucucgg

SEQ ID NO: 680498 - RNA, 21 nt, Human
uuggaaucuuaggaguguggg

SEQ ID NO: 680499 - RNA, 22 nt, Human
aggaagcgugggucuggcugga

SEQ ID NO: 680500 - RNA, 22 nt, Human
ucugacaaugaacaaucuauag

SEQ ID NO: 680501 - RNA, 22 nt, Human
uuuguaaccuaaagcaccagau

SEQ ID NO: 680502 - RNA, 22 nt, Human
agcuggccucacugcagaaugc

SEQ ID NO: 680503 - RNA, 22 nt, Human
aggccagacuuuggccaaaucc

SEQ ID NO: 680504 - RNA, 22 nt, Human
agcauacacccuaaacugcuua

SEQ ID NO: 680505 - RNA, 22 nt, Human
ugagagaggaugcccucauauu

SEQ ID NO: 680506 - RNA, 22 nt, Human
gccaggcauucuagaaguagug

SEQ ID NO: 680507 - RNA, 22 nt, Human
acuuccugggcaugcagagucc

SEQ ID NO: 680508 - RNA, 22 nt, Human
guuauguaugagggaaugauua

SEQ ID NO: 680509 - RNA, 19 nt, Human
ggucucagugcagcugcag

SEQ ID NO: 680510 - RNA, 22 nt, Human
uaagagauucuaaagcuacugg

SEQ ID NO: 680511 - RNA, 22 nt, Human
ucacugaaagaaugacauuaug

SEQ ID NO: 680512 - RNA, 22 nt, Human
guucuucaggccauccucccag

SEQ ID NO: 680513 - RNA, 22 nt, Human
uggcugcuagccagagcuucag

SEQ ID NO: 680514 - RNA, 22 nt, Human
gucccucugccugugguucucu

SEQ ID NO: 680515 - RNA, 22 nt, Human
uuugaaaccuaguuauaugacu

SEQ ID NO: 680516 - RNA, 22 nt, Human
ccagaugucccucucagguuug

SEQ ID NO: 680517 - RNA, 22 nt, Human
ccaaggagcugcaggcacuugu

SEQ ID NO: 680518 - RNA, 22 nt, Human
ggcucugggccuccaaggucug

SEQ ID NO: 680519 - RNA, 18 nt, Human
acagugguuugaugugcu

SEQ ID NO: 680520 - RNA, 22 nt, Human
cucuuuguggaacggcaguguc

SEQ ID NO: 680521 - RNA, 18 nt, Human
uuuacucauaggccugac

SEQ ID NO: 680522 - RNA, 22 nt, Human
ccuuuccuuuuuagugugggag

SEQ ID NO: 680523 - RNA, 22 nt, Human
ccuuuucugaaccacuuaaaua

SEQ ID NO: 680524 - RNA, 22 nt, Human
gcugcugccuguagccagggug

SEQ ID NO: 680525 - RNA, 17 nt, Human
aacugcuuuuuuuagcc

SEQ ID NO: 680526 - RNA, 23 nt, Human
cuucuagagucagcuccaaguuu

SEQ ID NO: 680527 - RNA, 22 nt, Human
uguuuucucuugaaaagcaguc

SEQ ID NO: 680528 - RNA, 22 nt, Human
agagcuggagcagccccacugg

SEQ ID NO: 680529 - RNA, 22 nt, Human
aggcauggggcugcagucaggu

SEQ ID NO: 680530 - RNA, 19 nt, Human
cugagagaugcuucacaca

SEQ ID NO: 680531 - RNA, 22 nt, Human
cagagcacugcuuggaggauuu

SEQ ID NO: 680532 - RNA, 22 nt, Human
uggaggugagugugguacagca

SEQ ID NO: 680533 - RNA, 22 nt, Human
agauaaauuccuaagauuucag

SEQ ID NO: 680534 - RNA, 22 nt, Human
ugagcagaggagugacguaggu

SEQ ID NO: 680535 - RNA, 22 nt, Human
uccagacauuuuauagcagucu

SEQ ID NO: 680536 - RNA, 22 nt, Human
cuauuacaaucugcuacuauga

SEQ ID NO: 680537 - RNA, 22 nt, Human
uugaaagaggcaaaguuugauc

SEQ ID NO: 680538 - RNA, 23 nt, Human
caugcaaacacuauugcauuugg

SEQ ID NO: 680539 - RNA, 22 nt, Human
agacacaguguugaaggcuagu

SEQ ID NO: 680540 - RNA, 22 nt, Human
agucacagaaugauggcuccag

SEQ ID NO: 680541 - RNA, 22 nt, Human
augccuguaaucccagugcuuu

SEQ ID NO: 680542 - RNA, 22 nt, Human
ucauccaguucacauggugagu

SEQ ID NO: 680543 - RNA, 22 nt, Human
auuucagaugaccaaauggaaa

SEQ ID NO: 680544 - RNA, 22 nt, Human
uggccucuccuggcagcaucca

SEQ ID NO: 680545 - RNA, 22 nt, Human
augccacauaaccaguucacuu

SEQ ID NO: 680546 - RNA, 22 nt, Human
ggcggccugugggucggccuca

SEQ ID NO: 680547 - RNA, 22 nt, Human
gaacuguguacauuguagauaa

SEQ ID NO: 680548 - RNA, 22 nt, Human
cugaggccugggggcguggacg

SEQ ID NO: 680549 - RNA, 22 nt, Human
agcuaaggaaucagaagagguu

SEQ ID NO: 680550 - RNA, 22 nt, Human
cagguggcuaacggccucauag

SEQ ID NO: 680551 - RNA, 22 nt, Human
uuuuauguaauccuuacugucg

SEQ ID NO: 680552 - RNA, 22 nt, Human
cagcucagugaugccuucacag

SEQ ID NO: 680553 - RNA, 22 nt, Human
gcuucacaggcaaguuaagccu

SEQ ID NO: 680554 - RNA, 19 nt, Human
aggcuucuacccuguccag

SEQ ID NO: 680555 - RNA, 22 nt, Human
uggcagugggaagcuggaaguc

SEQ ID NO: 680556 - RNA, 22 nt, Human
uucaggauuauacucucuuccc

SEQ ID NO: 680557 - RNA, 22 nt, Human
ugugggaugguuuugccagaau

SEQ ID NO: 680558 - RNA, 22 nt, Human
ucagugugaggucuuccacccg

SEQ ID NO: 680559 - RNA, 20 nt, Human
aggagaugauccagagucag

SEQ ID NO: 680560 - RNA, 22 nt, Human
cagccagaggcugcgaggggcc

SEQ ID NO: 680561 - RNA, 22 nt, Human
cagaguggcagucccaggccca

SEQ ID NO: 680562 - RNA, 22 nt, Human
cacaggaaugaacagggaaaga

SEQ ID NO: 680563 - RNA, 22 nt, Human
aggcuucagguuugcuuugcag

SEQ ID NO: 680564 - RNA, 19 nt, Human
ugcucaguggcuaaaagca

SEQ ID NO: 680565 - RNA, 22 nt, Human
cucagaguccccaguggguuug

SEQ ID NO: 680566 - RNA, 22 nt, Human
acacuaguggaaauugauuugu

SEQ ID NO: 680567 - RNA, 22 nt, Human
ugggccacugaggguggucauu

SEQ ID NO: 680568 - RNA, 22 nt, Human
cacuguguaagaagaugggcuu

SEQ ID NO: 680569 - RNA, 23 nt, Human
agaggggagcaucugcuggcuga

SEQ ID NO: 680570 - RNA, 20 nt, Human
caguuuaacuuugagcaguu

SEQ ID NO: 680571 - RNA, 22 nt, Human
ugccauuucuuucaauauucuu

SEQ ID NO: 680572 - RNA, 22 nt, Human
auguuccugguauaucaugacc

SEQ ID NO: 680573 - RNA, 22 nt, Human
cugcagggcuuaccuugcucug

SEQ ID NO: 680574 - RNA, 22 nt, Human
caggcuggaguuaccuuuaggg

SEQ ID NO: 680575 - RNA, 22 nt, Human
auccaaagauggaaagaacuuu

SEQ ID NO: 680576 - RNA, 22 nt, Human
aagucacagaguuggaagucag

SEQ ID NO: 680577 - RNA, 22 nt, Human
auucugucuuuuuaaaauaaua

SEQ ID NO: 680578 - RNA, 21 nt, Human
gucuuucuaccucuauguggc

SEQ ID NO: 680579 - RNA, 22 nt, Human
ucagcugguguuucuucuccuu

SEQ ID NO: 680580 - RNA, 22 nt, Human
ugccugcugcuaagcucuuugu

SEQ ID NO: 680581 - RNA, 22 nt, Human
uuuaucugggauuuugcagucu

SEQ ID NO: 680582 - RNA, 22 nt, Human
uugaagcugccguuuuucucca

SEQ ID NO: 680583 - RNA, 19 nt, Human
gcucagagccaugggggcu

SEQ ID NO: 680584 - RNA, 20 nt, Human
cccugagacgacugagcucc

SEQ ID NO: 680585 - RNA, 22 nt, Human
aucagaaacucuuagagcaggg

SEQ ID NO: 680586 - RNA, 22 nt, Human
uuuaugaacuacagauauaacu

SEQ ID NO: 680587 - RNA, 22 nt, Human
gcuuugcuggaaucaacgaaug

SEQ ID NO: 680588 - RNA, 22 nt, Human
ggcuaggcgggcacauggugga

SEQ ID NO: 680589 - RNA, 22 nt, Human
cauuauuaauucagcacaugcu

SEQ ID NO: 680590 - RNA, 22 nt, Human
aagcaucaacacuauauugaug

SEQ ID NO: 680591 - RNA, 22 nt, Human
gcuggcccagugacccacagug

SEQ ID NO: 680592 - RNA, 22 nt, Human
cugcccugggaguaccuguccu

SEQ ID NO: 680593 - RNA, 22 nt, Human
ucugcuucuccuacuucauggg

SEQ ID NO: 680594 - RNA, 22 nt, Human
aacuuguaggacugcacuguag

SEQ ID NO: 680595 - RNA, 23 nt, Human
uuauugcuuucccugccuuccug

SEQ ID NO: 680596 - RNA, 22 nt, Human
aucuacagccagucugguuugu

SEQ ID NO: 680597 - RNA, 22 nt, Human
cuguccaccuuugauaggcucu

SEQ ID NO: 680598 - RNA, 22 nt, Human
augguguagcugucagucauaa

SEQ ID NO: 680599 - RNA, 22 nt, Human
gugcaaaaggcauugugguuuu

SEQ ID NO: 680600 - RNA, 22 nt, Human
cauuuagacauuugauuugggg

SEQ ID NO: 680601 - RNA, 21 nt, Human
uagcaggauuugguuuauuuu

SEQ ID NO: 680602 - RNA, 22 nt, Human
uuuccacucuggccaccaucuu

SEQ ID NO: 680603 - RNA, 20 nt, Human
aggccaggaaauguaguucu

SEQ ID NO: 680604 - RNA, 22 nt, Human
ucacuuugacagagaaaugaau

SEQ ID NO: 680605 - RNA, 22 nt, Human
cugcagaaaccuuuccugauuu

SEQ ID NO: 680606 - RNA, 18 nt, Human
auuaaggaauucuuuaga

SEQ ID NO: 680607 - RNA, 18 nt, Human
guuuacauuacugaauag

SEQ ID NO: 680608 - RNA, 22 nt, Human
gggagcgggacugcgcaggcuu

SEQ ID NO: 680609 - RNA, 22 nt, Human
caucuuuggagaaacuuccguu

SEQ ID NO: 680610 - RNA, 22 nt, Human
ugagcuguagcagaugcuguug

SEQ ID NO: 680611 - RNA, 22 nt, Human
ucaaauguucccuguacuggcc

SEQ ID NO: 680612 - RNA, 22 nt, Human
acagggcagaaauguugcaucu

SEQ ID NO: 680613 - RNA, 22 nt, Human
cacaguggauugggugaugccc

SEQ ID NO: 680614 - RNA, 22 nt, Human
gcuucuggaggagcugggcuga

SEQ ID NO: 680615 - RNA, 22 nt, Human
ggccccucagcaucugagucag

SEQ ID NO: 680616 - RNA, 22 nt, Human
gaagcagcuaggaucuucauuu

SEQ ID NO: 680617 - RNA, 22 nt, Human
ucuccuaggcuggagugcagug

SEQ ID NO: 680618 - RNA, 22 nt, Human
gacuuaaaggcugaauguagga

SEQ ID NO: 680619 - RNA, 22 nt, Human
uaugcuccaaagacauguugcc

SEQ ID NO: 680620 - RNA, 22 nt, Human
auaaacaguagagaaagguggu

SEQ ID NO: 680621 - RNA, 22 nt, Human
ucaggaagauuaguuuccuacc

SEQ ID NO: 680622 - RNA, 19 nt, Human
gcaucagagcagaaggggu

SEQ ID NO: 680623 - RNA, 22 nt, Human
ugacaguguuggggguaaauuu

SEQ ID NO: 680624 - RNA, 22 nt, Human
acagcuaagggcacaggucacc

SEQ ID NO: 680625 - RNA, 22 nt, Human
caauguuucuuguaaccaguga

SEQ ID NO: 680626 - RNA, 22 nt, Human
ucaggaugacuucaaggaggaa

SEQ ID NO: 680627 - RNA, 22 nt, Human
cauuacagaauauguaaugauc

SEQ ID NO: 680628 - RNA, 22 nt, Human
uagauuaacaguuuuguugaag

SEQ ID NO: 680629 - RNA, 22 nt, Human
aaccuggagcacccucauaucu

SEQ ID NO: 680630 - RNA, 20 nt, Human
cugcugugguccuuuauuuu

SEQ ID NO: 680631 - RNA, 22 nt, Human
gauguacacucagaaaagucau

SEQ ID NO: 680632 - RNA, 22 nt, Human
ucauccagagcuucauaaguaa

SEQ ID NO: 680633 - RNA, 22 nt, Human
agagaugaagggcauuccccag

SEQ ID NO: 680634 - RNA, 22 nt, Human
ugcugccagggcucugcccaca

SEQ ID NO: 680635 - RNA, 22 nt, Human
cugauacacucccuaaaauaua

SEQ ID NO: 680636 - RNA, 20 nt, Human
gcagggcgacacgggggagg

SEQ ID NO: 680637 - RNA, 22 nt, Human
agauaugguuugcauaaauaag

SEQ ID NO: 680638 - RNA, 22 nt, Human
uugaagcaaggcgaaucuugug

SEQ ID NO: 680639 - RNA, 22 nt, Human
cagugaggaugauaauuaaggu

SEQ ID NO: 680640 - RNA, 22 nt, Human
ugggaugagaagugcgaggguu

SEQ ID NO: 680641 - RNA, 22 nt, Human
gccagcaguccugcugugugcc

SEQ ID NO: 680642 - RNA, 19 nt, Human
ccagucuccuugcagcauc

SEQ ID NO: 680643 - RNA, 22 nt, Human
cugggagugucccucugguaau

SEQ ID NO: 680644 - RNA, 19 nt, Human
gcauccauggaggccgcuu

SEQ ID NO: 680645 - RNA, 22 nt, Human
uucagaaaggauaauuggaagg

SEQ ID NO: 680646 - RNA, 19 nt, Human
acacugaauguagaauugg

SEQ ID NO: 680647 - RNA, 22 nt, Human
gagggucccugcucagggccag

SEQ ID NO: 680648 - RNA, 22 nt, Human
caggaggcccggccacagccca

SEQ ID NO: 680649 - RNA, 23 nt, Human
gcugagguccugcugaguggugg

SEQ ID NO: 680650 - RNA, 22 nt, Human
caugcuaaaauaucugaagauu

SEQ ID NO: 680651 - RNA, 22 nt, Human
cuagagcagauugcagaguagg

SEQ ID NO: 680652 - RNA, 22 nt, Human
ggguuccaaugaugagcaagag

SEQ ID NO: 680653 - RNA, 22 nt, Human
cagcuggggcagccacgugcgg

SEQ ID NO: 680654 - RNA, 22 nt, Human
augggcagcugcagcaguggug

SEQ ID NO: 680655 - RNA, 22 nt, Human
aucagaaguugugcaugcaugg

SEQ ID NO: 680656 - RNA, 22 nt, Human
ccuggcucugccguaaccacca

SEQ ID NO: 680657 - RNA, 22 nt, Human
cucuuccaccuccuucaggaga

SEQ ID NO: 680658 - RNA, 22 nt, Human
agcucuuuagagucucccuucu

SEQ ID NO: 680659 - RNA, 22 nt, Human
gguacaaugguucauuuuaugu

SEQ ID NO: 680660 - RNA, 22 nt, Human
ggcagagcuuguuccuucuguu

SEQ ID NO: 680661 - RNA, 22 nt, Human
ugggugccaaccucugguggcc

SEQ ID NO: 680662 - RNA, 22 nt, Human
gaggguggggaauagacugcua

SEQ ID NO: 680663 - RNA, 22 nt, Human
agauggagaccuuggaugaacu

SEQ ID NO: 680664 - RNA, 22 nt, Human
cagagcuuaaaacuccauggaa

SEQ ID NO: 680665 - RNA, 22 nt, Human
uguugacaauaaagucuaccau

SEQ ID NO: 680666 - RNA, 22 nt, Human
acagcuguggccacuugcaucc

SEQ ID NO: 680667 - RNA, 22 nt, Human
caguacuuuucaaccaguauga

SEQ ID NO: 680668 - RNA, 21 nt, Human
uauuugcugccaucuuugagg

SEQ ID NO: 680669 - RNA, 22 nt, Human
cuuucacagcuugaaaaguauu

SEQ ID NO: 680670 - RNA, 22 nt, Human
uacacugugguaaacucaaagu

SEQ ID NO: 680671 - RNA, 22 nt, Human
ugucacuuugccuucuggacuu

SEQ ID NO: 680672 - RNA, 22 nt, Human
acuuucaagaacuucuuuaaug

SEQ ID NO: 680673 - RNA, 22 nt, Human
ugggugagccacaggaguuguc

SEQ ID NO: 680674 - RNA, 22 nt, Human
caguuucuuggaugccaauuuc

SEQ ID NO: 680675 - RNA, 22 nt, Human
gaagacauguggauucuaguuu

SEQ ID NO: 680676 - RNA, 22 nt, Human
cacuuguagaggcauuauucca

SEQ ID NO: 680677 - RNA, 22 nt, Human
cauugcccaguaggaucaccag

SEQ ID NO: 680678 - RNA, 22 nt, Human
aaaggagauaaagggcccuuca

SEQ ID NO: 680679 - RNA, 22 nt, Human
ugucccaguucccaggguugcu

SEQ ID NO: 680680 - RNA, 22 nt, Human
ucccugggcacaaucugcuggc

SEQ ID NO: 680681 - RNA, 22 nt, Human
ugaguacucuucucacuacacc

SEQ ID NO: 680682 - RNA, 22 nt, Human
aguggcugugaaauacauggga

SEQ ID NO: 680683 - RNA, 22 nt, Human
aaagugcagggugcucugguau

SEQ ID NO: 680684 - RNA, 22 nt, Human
acauucaaguuucugcucaugg

SEQ ID NO: 680685 - RNA, 22 nt, Human
gaagaaacugaaagggguuggu

SEQ ID NO: 680686 - RNA, 22 nt, Human
caggcgucacugccacggguau

SEQ ID NO: 680687 - RNA, 20 nt, Human
ugaaggccauuuguuccaga

SEQ ID NO: 680688 - RNA, 22 nt, Human
acccccacggaaggccguacgc

SEQ ID NO: 680689 - RNA, 22 nt, Human
gccuucugaucgcuggacugac

SEQ ID NO: 680690 - RNA, 22 nt, Human
augacacccccacagcauuguu

SEQ ID NO: 680691 - RNA, 22 nt, Human
guuugaaaguucaacaggaaaa

SEQ ID NO: 680692 - RNA, 22 nt, Human
uuauuuauucauucugucuguc

SEQ ID NO: 680693 - RNA, 22 nt, Human
uaaagugcuuaugauaaccaag

SEQ ID NO: 680694 - RNA, 22 nt, Human
ccaggaagguaugggaagaaaa

SEQ ID NO: 680695 - RNA, 22 nt, Human
gcucagugguauucggaaacug

SEQ ID NO: 680696 - RNA, 23 nt, Human
ugguccugccaacggugccccuc

SEQ ID NO: 680697 - RNA, 22 nt, Human
uggaggccaugccagagcccua

SEQ ID NO: 680698 - RNA, 23 nt, Human
aguuuuucugcaugguucuguau

SEQ ID NO: 680699 - RNA, 18 nt, Human
acaggcugugggaauggu

SEQ ID NO: 680700 - RNA, 22 nt, Human
acacuucagcaguaugcuuggg

SEQ ID NO: 680701 - RNA, 22 nt, Human
agcucucuuccagauccacuug

SEQ ID NO: 680702 - RNA, 22 nt, Human
cugccucuauaggaguccacca

SEQ ID NO: 680703 - RNA, 22 nt, Human
ugaugguuuuauuaauaggacc

SEQ ID NO: 680704 - RNA, 22 nt, Human
ggccccagauucugggcugggu

SEQ ID NO: 680705 - RNA, 22 nt, Human
gggcuggaggugagcaggacag

SEQ ID NO: 680706 - RNA, 22 nt, Human
aaacuugauuuagaacuaaggc

SEQ ID NO: 680707 - RNA, 22 nt, Human
uauguggaaaaugcacuuaaaa

SEQ ID NO: 680708 - RNA, 22 nt, Human
auauacuguaggccacuauaag

SEQ ID NO: 680709 - RNA, 22 nt, Human
ggguucccugccuggccacucu

SEQ ID NO: 680710 - RNA, 22 nt, Human
aaagcuuuucaguauguucaug

SEQ ID NO: 680711 - RNA, 22 nt, Human
gccuccugagaagccacaggcu

SEQ ID NO: 680712 - RNA, 22 nt, Human
ucuggggaugagguccagugau

SEQ ID NO: 680713 - RNA, 22 nt, Human
aaaucacugauuaaaguuagaa

SEQ ID NO: 680714 - RNA, 22 nt, Human
uucaugugccagagcugaaaau

SEQ ID NO: 680715 - RNA, 22 nt, Human
gggaggcugccauccuucagga

SEQ ID NO: 680716 - RNA, 22 nt, Human
uucaauucaauucuaaauauau

SEQ ID NO: 680717 - RNA, 20 nt, Human
cagcaaaaugaaaauggauu

SEQ ID NO: 680718 - RNA, 22 nt, Human
ugguccuguagcacuugauuag

SEQ ID NO: 680719 - RNA, 22 nt, Human
cugcuguuucucaaaauuaagu

SEQ ID NO: 680720 - RNA, 22 nt, Human
ugcuauuugugagugucuucgu

SEQ ID NO: 680721 - RNA, 22 nt, Human
guggcucuccauugacauggaa

SEQ ID NO: 680722 - RNA, 22 nt, Human
aggccugagguuccugugcuca

SEQ ID NO: 680723 - RNA, 22 nt, Human
auucaucaacugauagccauag

SEQ ID NO: 680724 - RNA, 21 nt, Human
aggcccuggaggucagagaaa

SEQ ID NO: 680725 - RNA, 22 nt, Human
cagacaaagcggaaacuguuua

SEQ ID NO: 680726 - RNA, 22 nt, Human
aaaugcaaguucauauuuuguu

SEQ ID NO: 680727 - RNA, 22 nt, Human
ccaucuccaaauaccaucacau

SEQ ID NO: 680728 - RNA, 22 nt, Human
auccugcugcuguggacuucuc

SEQ ID NO: 680729 - RNA, 22 nt, Human
ucacaauacucacucaauggcu

SEQ ID NO: 680730 - RNA, 22 nt, Human
gcucagagaaguugugccuggc

SEQ ID NO: 680731 - RNA, 22 nt, Human
agcacuuaaguuaauugaacug

SEQ ID NO: 680732 - RNA, 22 nt, Human
auccauuucuaucuugcugagg

SEQ ID NO: 680733 - RNA, 17 nt, Human
ugcuuucuuccugcccu

SEQ ID NO: 680734 - RNA, 22 nt, Human
auuauuaaagcuacaucaagga

SEQ ID NO: 680735 - RNA, 22 nt, Human
uuguaugaauguauccuaauuu

SEQ ID NO: 680736 - RNA, 22 nt, Human
gcagcugcaauaggcaucaagc

SEQ ID NO: 680737 - RNA, 22 nt, Human
ugauggaaacuuggguaaguca

SEQ ID NO: 680738 - RNA, 22 nt, Human
gagcaugguuccauagguuggu

SEQ ID NO: 680739 - RNA, 22 nt, Human
uccaggccacauggauggcgau

SEQ ID NO: 680740 - RNA, 22 nt, Human
acagcagaucuguggagcuuau

SEQ ID NO: 680741 - RNA, 21 nt, Human
acagacaguccagagaaaaga

SEQ ID NO: 680742 - RNA, 23 nt, Human
gcuugucuagugaauucauaucu

SEQ ID NO: 680743 - RNA, 22 nt, Human
uucacaguggcugugccauuug

SEQ ID NO: 680744 - RNA, 22 nt, Human
uauugcugacuuguucaguguu

SEQ ID NO: 680745 - RNA, 22 nt, Human
ucuuuaauucagcaugaugcgg

SEQ ID NO: 680746 - RNA, 22 nt, Human
uuccccaggugauucucauggc

SEQ ID NO: 680747 - RNA, 22 nt, Human
agacaguaauaaaauagguaag

SEQ ID NO: 680748 - RNA, 22 nt, Human
ggacuugcuaagguggcugaac

SEQ ID NO: 680749 - RNA, 22 nt, Human
ugagccuguggggugacaacca

SEQ ID NO: 680750 - RNA, 22 nt, Human
ucagaaagacgaaacagauggg

SEQ ID NO: 680751 - RNA, 22 nt, Human
uaaacugcuucucucagucugu

SEQ ID NO: 680752 - RNA, 22 nt, Human
cacauacaugcacaccuaaaua

SEQ ID NO: 680753 - RNA, 21 nt, Human
gugcuuuuccuuaauguucuu

SEQ ID NO: 680754 - RNA, 22 nt, Human
acugugcuaucuacugaauuau

SEQ ID NO: 680755 - RNA, 22 nt, Human
agaccaugggcucugaagagca

SEQ ID NO: 680756 - RNA, 19 nt, Human
agcuucuuuggaaacauuu

SEQ ID NO: 680757 - RNA, 22 nt, Human
uguguacagcaugguccagcag

SEQ ID NO: 680758 - RNA, 22 nt, Human
gggcucucaaggcagggcccca

SEQ ID NO: 680759 - RNA, 22 nt, Human
aggucacacaacugucagaggc

SEQ ID NO: 680760 - RNA, 22 nt, Human
cagcugccaagaaucuuuucua

SEQ ID NO: 680761 - RNA, 22 nt, Human
auggaagcugaaaaagacacgg

SEQ ID NO: 680762 - RNA, 22 nt, Human
ugucuguguccaaauuuccucu

SEQ ID NO: 680763 - RNA, 21 nt, Human
ugaaaguuggagucaaaugua

SEQ ID NO: 680764 - RNA, 22 nt, Human
ugcugccaccugguggcugaag

SEQ ID NO: 680765 - RNA, 22 nt, Human
ggaggcucuccuggccuugucu

SEQ ID NO: 680766 - RNA, 22 nt, Human
ccacugagugagcagagcaggg

SEQ ID NO: 680767 - RNA, 22 nt, Human
cccugcagcauucucuaacugg

SEQ ID NO: 680768 - RNA, 22 nt, Human
caggauccuggcugcauggacg

SEQ ID NO: 680769 - RNA, 22 nt, Human
auuucaguguugguuagcaagc

SEQ ID NO: 680770 - RNA, 22 nt, Human
uacauugagaaccacugcuuag

SEQ ID NO: 680771 - RNA, 22 nt, Human
ugugagcuuaggacagggcuau

SEQ ID NO: 680772 - RNA, 22 nt, Human
gcagguggaagcagcagacuca

SEQ ID NO: 680773 - RNA, 22 nt, Human
aaacaucuucucuugauucuuu

SEQ ID NO: 680774 - RNA, 22 nt, Human
auaaaggcaacaccaggguaug

SEQ ID NO: 680775 - RNA, 22 nt, Human
cuuauucagcacuugcucugua

SEQ ID NO: 680776 - RNA, 22 nt, Human
acuauacaccaaaauauuaagg

SEQ ID NO: 680777 - RNA, 23 nt, Human
uccucagcauguuuugucaugua

SEQ ID NO: 680778 - RNA, 22 nt, Human
cagucccagaagagccugggag

SEQ ID NO: 680779 - RNA, 17 nt, Human
aaucagauuucugagga

SEQ ID NO: 680780 - RNA, 22 nt, Human
cagauguaguagcuuuauugca

SEQ ID NO: 680781 - RNA, 22 nt, Human
ucccugagggcagcucaagucc

SEQ ID NO: 680782 - RNA, 22 nt, Human
ggugggagagcuugcuuugaug

SEQ ID NO: 680783 - RNA, 22 nt, Human
aagagguggaacagcaauucgu

SEQ ID NO: 680784 - RNA, 22 nt, Human
aagggcccauucucucagaaaa

SEQ ID NO: 680785 - RNA, 22 nt, Human
gcugucuucacuuccugguuuc

SEQ ID NO: 680786 - RNA, 22 nt, Human
ucaggaaagaagaugcucagug

SEQ ID NO: 680787 - RNA, 22 nt, Human
gaaaauuucugccacaugugug

SEQ ID NO: 680788 - RNA, 22 nt, Human
uggagugggcaauguaggcaag

SEQ ID NO: 680789 - RNA, 22 nt, Human
guuucgucaggcuuauucuauc

SEQ ID NO: 680790 - RNA, 17 nt, Human
cgagggcuugcuggcuc

SEQ ID NO: 680791 - RNA, 22 nt, Human
cagcaggaaagacaucugagca

SEQ ID NO: 680792 - RNA, 22 nt, Human
gugaagcagggaaggaaaggau

SEQ ID NO: 680793 - RNA, 22 nt, Human
aggcacuuuacaaugugugaca

SEQ ID NO: 680794 - RNA, 22 nt, Human
acagcuuuguguuaaugggaag

SEQ ID NO: 680795 - RNA, 22 nt, Human
gucccuggaaaagagcugguga

SEQ ID NO: 680796 - RNA, 22 nt, Human
agaaugucaacagccucucaag

SEQ ID NO: 680797 - RNA, 22 nt, Human
uguccccagcacucacucucca

SEQ ID NO: 680798 - RNA, 22 nt, Human
cagcaagggauaaagaguuacu

SEQ ID NO: 680799 - RNA, 22 nt, Human
gcccagcuggcuuccagcacau

SEQ ID NO: 680800 - RNA, 22 nt, Human
ucagggaagaaaugggacuuua

SEQ ID NO: 680801 - RNA, 22 nt, Human
cagcuaccaugguuuguuccag

SEQ ID NO: 680802 - RNA, 22 nt, Human
acaugccagccucagcagcagu

SEQ ID NO: 680803 - RNA, 22 nt, Human
cuggcuggccggaggcaucccu

SEQ ID NO: 680804 - RNA, 22 nt, Human
gagacagaucucggcuccaugc

SEQ ID NO: 680805 - RNA, 21 nt, Human
uuauacauauguucucugccu

SEQ ID NO: 680806 - RNA, 22 nt, Human
aucccaugagaccacguuggcu

SEQ ID NO: 680807 - RNA, 22 nt, Human
uucucagauauuuacugagcau

SEQ ID NO: 680808 - RNA, 22 nt, Human
agugugucgagggaggguccag

SEQ ID NO: 680809 - RNA, 22 nt, Human
ucugugguggagugggcaugag

SEQ ID NO: 680810 - RNA, 21 nt, Human
agcucacaguucuguccuguc

SEQ ID NO: 680811 - RNA, 22 nt, Human
cagcugcugauggccugacaga

SEQ ID NO: 680812 - RNA, 19 nt, Human
caggacaguuugccaagaa

SEQ ID NO: 680813 - RNA, 22 nt, Human
cccucucagucagagccagaua

SEQ ID NO: 680814 - RNA, 22 nt, Human
uuccaagugucagaucagauuu

SEQ ID NO: 680815 - RNA, 22 nt, Human
uggccuuccuggugacucauga

SEQ ID NO: 680816 - RNA, 22 nt, Human
acagaccuauggcagcugccau

SEQ ID NO: 680817 - RNA, 22 nt, Human
cugcuucugggaugauggagua

SEQ ID NO: 680818 - RNA, 22 nt, Human
uggacaugagcugagugggugu

SEQ ID NO: 680819 - RNA, 22 nt, Human
gaggccacggaagggagcugug

SEQ ID NO: 680820 - RNA, 22 nt, Human
cauaauuauaaacgcaaguuca

SEQ ID NO: 680821 - RNA, 22 nt, Human
uuacagguacuugcugcugaaa

SEQ ID NO: 680822 - RNA, 22 nt, Human
ggagugugggauggagcucagg

SEQ ID NO: 680823 - RNA, 22 nt, Human
gaggcaggcccugaaugaguca

SEQ ID NO: 680824 - RNA, 22 nt, Human
cugggucacccaaaagggccag

SEQ ID NO: 680825 - RNA, 22 nt, Human
gcugcagaucccacccauuccc

SEQ ID NO: 680826 - RNA, 22 nt, Human
augaaaaguucgaucuagaagg

SEQ ID NO: 680827 - RNA, 22 nt, Human
caccacugaauuguucacuuuc

SEQ ID NO: 680828 - RNA, 22 nt, Human
cauggggagacaccuagggaaa

SEQ ID NO: 680829 - RNA, 22 nt, Human
guguccuguuucccugucuaua

SEQ ID NO: 680830 - RNA, 22 nt, Human
auuguucaauguaauaauuuug

SEQ ID NO: 680831 - RNA, 22 nt, Human
augcuccuuggcuucaaagcca

SEQ ID NO: 680832 - RNA, 22 nt, Human
uuauguucagcaucugcuuuau

SEQ ID NO: 680833 - RNA, 22 nt, Human
uugcaaaugugaauaauuacac

SEQ ID NO: 680834 - RNA, 22 nt, Human
auggucuugugagaguaacagu

SEQ ID NO: 680835 - RNA, 22 nt, Human
cggucaggugcagcguuggcac

SEQ ID NO: 680836 - RNA, 22 nt, Human
cagcacaguacaaggcacggau

SEQ ID NO: 680837 - RNA, 23 nt, Human
aucugggcaucuggagugguccu

SEQ ID NO: 680838 - RNA, 19 nt, Human
uuucuguuagaaggauaca

SEQ ID NO: 680839 - RNA, 22 nt, Human
gcauggcuuacagaggcugcag

SEQ ID NO: 680840 - RNA, 22 nt, Human
ggccacaacuugcuccuagccc

SEQ ID NO: 680841 - RNA, 23 nt, Human
uugcagggauggaguucaaaaug

SEQ ID NO: 680842 - RNA, 22 nt, Human
ggggagcuugguuauucaugca

SEQ ID NO: 680843 - RNA, 22 nt, Human
aagucccuggugcuggcugcgc

SEQ ID NO: 680844 - RNA, 22 nt, Human
uuucugcuuucuauccuuguca

SEQ ID NO: 680845 - RNA, 22 nt, Human
ugcauggaguaauugaugcuug

SEQ ID NO: 680846 - RNA, 22 nt, Human
auauuagggucucuaaauucua

SEQ ID NO: 680847 - RNA, 22 nt, Human
cagggcucagaagacagaccuc

SEQ ID NO: 680848 - RNA, 22 nt, Human
agcauuuaccucaaugcaucug

SEQ ID NO: 680849 - RNA, 22 nt, Human
aacagcgucuuuccagcuguuc

SEQ ID NO: 680850 - RNA, 22 nt, Human
uguauucuuaguuuuaaucaga

SEQ ID NO: 680851 - RNA, 20 nt, Human
agcacugucugaccaguggc

SEQ ID NO: 680852 - RNA, 22 nt, Human
ucugagggcuugaggggaagua

SEQ ID NO: 680853 - RNA, 22 nt, Human
aguguuuccugaguguuaucau

SEQ ID NO: 680854 - RNA, 22 nt, Human
acauuguuugagaauacagaug

SEQ ID NO: 680855 - RNA, 22 nt, Human
uggcaugggcaaaccagggaaa

SEQ ID NO: 680856 - RNA, 22 nt, Human
auucuuucaaggaauaguuauu

SEQ ID NO: 680857 - RNA, 20 nt, Human
cuccugugccucucugggcc

SEQ ID NO: 680858 - RNA, 23 nt, Human
gacagagugagaccuugucuuac

SEQ ID NO: 680859 - RNA, 20 nt, Human
agaggcuuucuuguagucag

SEQ ID NO: 680860 - RNA, 22 nt, Human
cucugcuucauccaccacuggc

SEQ ID NO: 680861 - RNA, 22 nt, Human
uagacagauuucuuguuagaca

SEQ ID NO: 680862 - RNA, 22 nt, Human
ugucuguacaaauuuucugugu

SEQ ID NO: 680863 - RNA, 19 nt, Human
ggagccuggagcacgugcc

SEQ ID NO: 680864 - RNA, 22 nt, Human
ugggaguggggcauagaaggua

SEQ ID NO: 680865 - RNA, 22 nt, Human
ccugugucugaccaugcacaug

SEQ ID NO: 680866 - RNA, 22 nt, Human
ccacuguaaccauuaucaccau

SEQ ID NO: 680867 - RNA, 22 nt, Human
uacaaagugagcaaccucuuuu

SEQ ID NO: 680868 - RNA, 22 nt, Human
uuauuguuuggguauaauuuga

SEQ ID NO: 680869 - RNA, 22 nt, Human
guauacauacuucuagauuaaa

SEQ ID NO: 680870 - RNA, 22 nt, Human
ccuuacaccuaaaaugagaguu

SEQ ID NO: 680871 - RNA, 22 nt, Human
caaauguguuuuuucuucuaca

SEQ ID NO: 680872 - RNA, 22 nt, Human
uuucagagaugcagaauucagg

SEQ ID NO: 680873 - RNA, 22 nt, Human
aucccugaaugcuccugacugg

SEQ ID NO: 680874 - RNA, 22 nt, Human
auuaaauuagcaaacugugaaa

SEQ ID NO: 680875 - RNA, 22 nt, Human
uagagcuguaucaaagagccuu

SEQ ID NO: 680876 - RNA, 22 nt, Human
uggcaguggcucagagugcaga

SEQ ID NO: 680877 - RNA, 23 nt, Human
ucauuucagguugcaugguacca

SEQ ID NO: 680878 - RNA, 22 nt, Human
cugccagcagaggccagcgcug

SEQ ID NO: 680879 - RNA, 22 nt, Human
ugagcagagcaggcugcgcccu

SEQ ID NO: 680880 - RNA, 22 nt, Human
cgucugcccgacuguucuucac

SEQ ID NO: 680881 - RNA, 22 nt, Human
ggugccagccuagugcaguggu

SEQ ID NO: 680882 - RNA, 22 nt, Human
ucugggagagucacaggcauug

SEQ ID NO: 680883 - RNA, 22 nt, Human
caggagaaacauaauuuucugg

SEQ ID NO: 680884 - RNA, 22 nt, Human
ucugccugugcuguguuuucau

SEQ ID NO: 680885 - RNA, 22 nt, Human
ugagaagcaguuucaguaagaa

SEQ ID NO: 680886 - RNA, 19 nt, Human
auguaugaggucuucugcu

SEQ ID NO: 680887 - RNA, 22 nt, Human
ggccugagucacaucaggagag

SEQ ID NO: 680888 - RNA, 22 nt, Human
uagggacacugcucaugaguuc

SEQ ID NO: 680889 - RNA, 23 nt, Human
uggcucugugucacauacaggau

SEQ ID NO: 680890 - RNA, 22 nt, Human
agagaugacugauggcugauua

SEQ ID NO: 680891 - RNA, 22 nt, Human
uuacaauguaaggcaugguucu

SEQ ID NO: 680892 - RNA, 21 nt, Human
aaggucuguaaagugacagga

SEQ ID NO: 680893 - RNA, 23 nt, Human
ucauuccacaaauacuuaucuag

SEQ ID NO: 680894 - RNA, 22 nt, Human
gaauguaauagucaguagaaca

SEQ ID NO: 680895 - RNA, 22 nt, Human
uguaagauaugaguacauguaa

SEQ ID NO: 680896 - RNA, 23 nt, Human
auaaugcaaguggugguaaucug

SEQ ID NO: 680897 - RNA, 22 nt, Human
auuagagagagcauauuacugg

SEQ ID NO: 680898 - RNA, 22 nt, Human
auuguauuauaauuaggccaaa

SEQ ID NO: 680899 - RNA, 22 nt, Human
gaaucauucauugcucaauuaa

SEQ ID NO: 680900 - RNA, 22 nt, Human
ugaguaaaaauucuacauuucc

SEQ ID NO: 680901 - RNA, 22 nt, Human
agggcuuguuaacauagagauu

SEQ ID NO: 680902 - RNA, 22 nt, Human
agggcucagaacaaugagugua

SEQ ID NO: 680903 - RNA, 22 nt, Human
aaggggcaugcuuuugccagga

SEQ ID NO: 680904 - RNA, 22 nt, Human
aggcccuggguuagggcccacu

SEQ ID NO: 680905 - RNA, 22 nt, Human
uuuacagugucuuguugacugu

SEQ ID NO: 680906 - RNA, 22 nt, Human
acuggcagaggauagcacuaau

SEQ ID NO: 680907 - RNA, 22 nt, Human
gacagacuaaauggcuguagga

SEQ ID NO: 680908 - RNA, 22 nt, Human
cuggaacaguguuggagcuuga

SEQ ID NO: 680909 - RNA, 22 nt, Human
gcuaggucugugcgcagccgcu

SEQ ID NO: 680910 - RNA, 22 nt, Human
gugcucugccuggggucauggc

SEQ ID NO: 680911 - RNA, 19 nt, Human
caguuuguccagaggggac

SEQ ID NO: 680912 - RNA, 22 nt, Human
gccuggagcccaguguggggcu

SEQ ID NO: 680913 - RNA, 17 nt, Human
gguguauggggagggaa

SEQ ID NO: 680914 - RNA, 22 nt, Human
ucagguuuuucucaaaucaggu

SEQ ID NO: 680915 - RNA, 21 nt, Human
uugcaccaugauaaauucaga

SEQ ID NO: 680916 - RNA, 22 nt, Human
uaaagacacugguuuuaaucau

SEQ ID NO: 680917 - RNA, 22 nt, Human
ugacgucaacugcaaaggccuu

SEQ ID NO: 680918 - RNA, 22 nt, Human
aggcuguguuuaagugguaaug

SEQ ID NO: 680919 - RNA, 22 nt, Human
aacucuuaauuuucaugaaaug

SEQ ID NO: 680920 - RNA, 22 nt, Human
auggcuguuuugugacuucuca

SEQ ID NO: 680921 - RNA, 22 nt, Human
acugggaauggagccugggccu

SEQ ID NO: 680922 - RNA, 22 nt, Human
cagcgcugggguaggagcaccu

SEQ ID NO: 680923 - RNA, 21 nt, Human
accaggcuugugggagggagc

SEQ ID NO: 680924 - RNA, 22 nt, Human
uuaaauuccagccucauaauag

SEQ ID NO: 680925 - RNA, 23 nt, Human
uguuccagauacgccuuuuccuc

SEQ ID NO: 680926 - RNA, 22 nt, Human
ccucacagcaaggauuucagug

SEQ ID NO: 680927 - RNA, 22 nt, Human
cccuagggcuaagcaggacugc

SEQ ID NO: 680928 - RNA, 22 nt, Human
uggagagucucaaggcaggaaa

SEQ ID NO: 680929 - RNA, 22 nt, Human
gccaggaaaagaagcuggugcu

SEQ ID NO: 680930 - RNA, 22 nt, Human
ccaguguuccagagagcugaug

SEQ ID NO: 680931 - RNA, 22 nt, Human
uugcagcugcaguaaauguuca

SEQ ID NO: 680932 - RNA, 22 nt, Human
aagaguuuuuggagugugaguu

SEQ ID NO: 680933 - RNA, 22 nt, Human
ccacagaauucugucuccagga

SEQ ID NO: 680934 - RNA, 19 nt, Human
uuuacaaguucuuuguaug

SEQ ID NO: 680935 - RNA, 22 nt, Human
gaauuguauugauuuuucagag

SEQ ID NO: 680936 - RNA, 22 nt, Human
gccucugggugacgaaagguga

SEQ ID NO: 680937 - RNA, 22 nt, Human
uaucuauaauguuuuacuuccu

SEQ ID NO: 680938 - RNA, 22 nt, Human
ccagugugggcccggccuccuc

SEQ ID NO: 680939 - RNA, 22 nt, Human
cuuuccaggaauccucacagcc

SEQ ID NO: 680940 - RNA, 21 nt, Human
gaaucuuugauuuacauggga

SEQ ID NO: 680941 - RNA, 22 nt, Human
cuucaacuucccuagaugucau

SEQ ID NO: 680942 - RNA, 22 nt, Human
cugccaggccuccgcugucccc

SEQ ID NO: 680943 - RNA, 22 nt, Human
cucccagagaccaagcugagaa

SEQ ID NO: 680944 - RNA, 22 nt, Human
gcugccacgaucucugcuguag

SEQ ID NO: 680945 - RNA, 22 nt, Human
gcagaugcugagauuuauuucu

SEQ ID NO: 680946 - RNA, 23 nt, Human
gcaggugguucgaacagaaguuu

SEQ ID NO: 680947 - RNA, 22 nt, Human
uuugggcugguuugccaugccc

SEQ ID NO: 680948 - RNA, 22 nt, Human
guaaucuguaguaaagcaccau

SEQ ID NO: 680949 - RNA, 21 nt, Human
uccuccuggccaggcggcccc

SEQ ID NO: 680950 - RNA, 22 nt, Human
ucuuugcaguucugauuaaaua

SEQ ID NO: 680951 - RNA, 20 nt, Human
cuuugccuauucucugccug

SEQ ID NO: 680952 - RNA, 22 nt, Human
ucagccagcugugugcuucugc

SEQ ID NO: 680953 - RNA, 22 nt, Human
gaguaauucugguaaaucauug

SEQ ID NO: 680954 - RNA, 22 nt, Human
accugcccagacucagauccua

SEQ ID NO: 680955 - RNA, 22 nt, Human
gaagguuugauccuuauuuaua

SEQ ID NO: 680956 - RNA, 22 nt, Human
gcuucuguggauuggcuggcuu

SEQ ID NO: 680957 - RNA, 22 nt, Human
uguguggcguugcguggcuagg

SEQ ID NO: 680958 - RNA, 22 nt, Human
ggcuggcuugccaagcucaggg

SEQ ID NO: 680959 - RNA, 22 nt, Human
auauguauuuuaacguguaagg

SEQ ID NO: 680960 - RNA, 22 nt, Human
ugcagggaggccccgcagcccu

SEQ ID NO: 680961 - RNA, 22 nt, Human
gucccaggcaggccacuggcag

SEQ ID NO: 680962 - RNA, 22 nt, Human
ucaguugcuaaaugguguagug

SEQ ID NO: 680963 - RNA, 22 nt, Human
gugcagauccugauugcaguuc

SEQ ID NO: 680964 - RNA, 22 nt, Human
ucugaauauguuuaucaucucu

SEQ ID NO: 680965 - RNA, 22 nt, Human
aaaugcagguucuugagccaag

SEQ ID NO: 680966 - RNA, 22 nt, Human
aaaaagucauauucuuguuccu

SEQ ID NO: 680967 - RNA, 22 nt, Human
auucugggugacuacgugauca

SEQ ID NO: 680968 - RNA, 22 nt, Human
ccucagcucuucccugugcaca

SEQ ID NO: 680969 - RNA, 22 nt, Human
uaaaggcuuuuacaggagugca

SEQ ID NO: 680970 - RNA, 22 nt, Human
auccacuccuggaggugcccca

SEQ ID NO: 680971 - RNA, 22 nt, Human
uuucucuugcgauaugcuacac

SEQ ID NO: 680972 - RNA, 22 nt, Human
aauuuauucccgucucugggcu

SEQ ID NO: 680973 - RNA, 22 nt, Human
aucagagacaaaaccagcacuu

SEQ ID NO: 680974 - RNA, 23 nt, Human
augaaaugcuggcucagggaggu

SEQ ID NO: 680975 - RNA, 22 nt, Human
auguccagaguguccuggaaag

SEQ ID NO: 680976 - RNA, 22 nt, Human
caguuaauguccuauacaauag

SEQ ID NO: 680977 - RNA, 22 nt, Human
ugagccagaguggagugugccu

SEQ ID NO: 680978 - RNA, 22 nt, Human
agacauuggcuaaaaguagugu

SEQ ID NO: 680979 - RNA, 22 nt, Human
ucaauaauggcaggauaaauuu

SEQ ID NO: 680980 - RNA, 18 nt, Human
gucugccaacaacuauca

SEQ ID NO: 680981 - RNA, 22 nt, Human
aggaauuccugggaaggcacag

SEQ ID NO: 680982 - RNA, 22 nt, Human
aaacuuauuuuaucacaguuca

SEQ ID NO: 680983 - RNA, 22 nt, Human
gcgaggaggggugcugggcccc

SEQ ID NO: 680984 - RNA, 22 nt, Human
uuucaggaaggugaggcacaug

SEQ ID NO: 680985 - RNA, 22 nt, Human
gaggagccaggaggucucccug

SEQ ID NO: 680986 - RNA, 22 nt, Human
guuuccugacuguggaauuaua

SEQ ID NO: 680987 - RNA, 22 nt, Human
gcacacugugaauuugcauaug

SEQ ID NO: 680988 - RNA, 22 nt, Human
agggaggaguccucaaagucau

SEQ ID NO: 680989 - RNA, 19 nt, Human
cccucuugcacaaagcaaa

SEQ ID NO: 680990 - RNA, 22 nt, Human
acuggggagagucaugccagca

SEQ ID NO: 680991 - RNA, 22 nt, Human
agcauucaaguaauucacuugg

SEQ ID NO: 680992 - RNA, 22 nt, Human
aaugaaugaaccacauauaaca

SEQ ID NO: 680993 - RNA, 21 nt, Human
uucagaaguugagggcagguu

SEQ ID NO: 680994 - RNA, 22 nt, Human
agggccuggaacuggagaccac

SEQ ID NO: 680995 - RNA, 22 nt, Human
ugaggcagcccacuuuccuuag

SEQ ID NO: 680996 - RNA, 22 nt, Human
uuugcauuuguucaaguauuga

SEQ ID NO: 680997 - RNA, 22 nt, Human
uagagaaaagcagggaucagga

SEQ ID NO: 680998 - RNA, 22 nt, Human
uuccugggcaggacgagagucu

SEQ ID NO: 680999 - RNA, 22 nt, Human
ucagggaagagagaucuccuag

SEQ ID NO: 681000 - RNA, 21 nt, Human
aagugccacccacagaugcau

SEQ ID NO: 681001 - RNA, 22 nt, Human
augugucugaccacuguauugg

SEQ ID NO: 681002 - RNA, 22 nt, Human
ucugcuggucaaggcugggucc

SEQ ID NO: 681003 - RNA, 22 nt, Human
cuggaggaauaauggcaucuug

SEQ ID NO: 681004 - RNA, 22 nt, Human
cacucuaagaacacaaaggccc

SEQ ID NO: 681005 - RNA, 22 nt, Human
gugaauaauuuuuuaguauaag

SEQ ID NO: 681006 - RNA, 22 nt, Human
uuuuccugggcuuucuguguaa

SEQ ID NO: 681007 - RNA, 22 nt, Human
uuaaauauuuucagcaggguca

SEQ ID NO: 681008 - RNA, 22 nt, Human
ucacaguacaugauucaguggu

SEQ ID NO: 681009 - RNA, 22 nt, Human
ugaguaauucacaaaacagaug

SEQ ID NO: 681010 - RNA, 22 nt, Human
cugccaccaugccccagcagag

SEQ ID NO: 681011 - RNA, 22 nt, Human
aacaucuucagagaagcuaagu

SEQ ID NO: 681012 - RNA, 22 nt, Human
aggccuguuccuuccugggcac

SEQ ID NO: 681013 - RNA, 22 nt, Human
agccaagcugaucuccugcuga

SEQ ID NO: 681014 - RNA, 16 nt, Human
ccucucuuauuccucc

SEQ ID NO: 681015 - RNA, 22 nt, Human
ggcuucacauagcaaugugagc

SEQ ID NO: 681016 - RNA, 22 nt, Human
uggccaugggauagugcagggg

SEQ ID NO: 681017 - RNA, 22 nt, Human
uggcuggggagccccgacuccc

SEQ ID NO: 681018 - RNA, 22 nt, Human
ugaagcaggugaauggaugucg

SEQ ID NO: 681019 - RNA, 22 nt, Human
cagccuguggcagaggucuaau

SEQ ID NO: 681020 - RNA, 22 nt, Human
cuuauuugagagaaaagaaacu

SEQ ID NO: 681021 - RNA, 22 nt, Human
ggucaggguauaaucaagugag

SEQ ID NO: 681022 - RNA, 22 nt, Human
augagagguuucgucagaggaa

SEQ ID NO: 681023 - RNA, 22 nt, Human
ucacaugcacaucucuggaacc

SEQ ID NO: 681024 - RNA, 22 nt, Human
gcccuuucuucuucuggacugg

SEQ ID NO: 681025 - RNA, 22 nt, Human
gguccuggcagucuuugguugu

SEQ ID NO: 681026 - RNA, 16 nt, Human
gcugcugcuuccugcu

SEQ ID NO: 681027 - RNA, 22 nt, Human
aaauugauuaaaguccgugcuu

SEQ ID NO: 681028 - RNA, 22 nt, Human
uaaagaauaauacccauggagc

SEQ ID NO: 681029 - RNA, 22 nt, Human
aguguuuaaaaauggaaaugca

SEQ ID NO: 681030 - RNA, 18 nt, Human
agcaugagagaggcugug

SEQ ID NO: 681031 - RNA, 22 nt, Human
uacaugcaugucacagaaugaa

SEQ ID NO: 681032 - RNA, 22 nt, Human
gaacuuuaggauuuucacaggu

SEQ ID NO: 681033 - RNA, 22 nt, Human
cagcuuuauuaaugauugucuu

SEQ ID NO: 681034 - RNA, 22 nt, Human
ucaggugguccuaagugccauc

SEQ ID NO: 681035 - RNA, 19 nt, Human
acuggcacacaggggcugc

SEQ ID NO: 681036 - RNA, 22 nt, Human
ugggguaggagucagcgagaga

SEQ ID NO: 681037 - RNA, 22 nt, Human
ucuggcugggugagagcuucuc

SEQ ID NO: 681038 - RNA, 19 nt, Human
auggaaaaugccagacuga

SEQ ID NO: 681039 - RNA, 22 nt, Human
gaccauuugcuaguaaauugca

SEQ ID NO: 681040 - RNA, 22 nt, Human
agcacuagcuuuaagcauucug

SEQ ID NO: 681041 - RNA, 22 nt, Human
ggcaugcaaaugugggugaccu

SEQ ID NO: 681042 - RNA, 22 nt, Human
accagggcacauuccggccaga

SEQ ID NO: 681043 - RNA, 22 nt, Human
uuauuauuggugaguuaaggaa

SEQ ID NO: 681044 - RNA, 20 nt, Human
ucaguuuaaauccuggcuuu

SEQ ID NO: 681045 - RNA, 22 nt, Human
cagugccucaggccagccugca

SEQ ID NO: 681046 - RNA, 22 nt, Human
uugucaagaaaaauggaugaag

SEQ ID NO: 681047 - RNA, 22 nt, Human
ggcuucuccagguacugagcau

SEQ ID NO: 681048 - RNA, 22 nt, Human
uuucuuuccauacauauugcua

SEQ ID NO: 681049 - RNA, 19 nt, Human
gaauguuucugucucuucu

SEQ ID NO: 681050 - RNA, 22 nt, Human
ggaagaaagcacacaaacuuga

SEQ ID NO: 681051 - RNA, 22 nt, Human
gggcuggagagucccacguggg

SEQ ID NO: 681052 - RNA, 19 nt, Human
ucucugcuucucuuggcau

SEQ ID NO: 681053 - RNA, 22 nt, Human
aaaacacugcaaagcugauugg

SEQ ID NO: 681054 - RNA, 22 nt, Human
guggauggcuaguugagaaggg

SEQ ID NO: 681055 - RNA, 22 nt, Human
uaguggaggguguagcugcugg

SEQ ID NO: 681056 - RNA, 22 nt, Human
caaccugaugugcaugccacgg

SEQ ID NO: 681057 - RNA, 22 nt, Human
cccaggcugaugggaugggcca

SEQ ID NO: 681058 - RNA, 22 nt, Human
aaaguucaugguguuauagaaa

SEQ ID NO: 681059 - RNA, 22 nt, Human
uguguaaauggacugugaauua

SEQ ID NO: 681060 - RNA, 22 nt, Human
cauuuaguuuugcaguagcagg

SEQ ID NO: 681061 - RNA, 22 nt, Human
gccuggaguucagccaaguccc

SEQ ID NO: 681062 - RNA, 20 nt, Human
aguaggcaaaggaaagaucu

SEQ ID NO: 681063 - RNA, 22 nt, Human
cugccuugguucccagccagca

SEQ ID NO: 681064 - RNA, 22 nt, Human
ccaaacauuucaaauuuagaga

SEQ ID NO: 681065 - RNA, 22 nt, Human
aggcugccuggcugugagugaa

SEQ ID NO: 681066 - RNA, 22 nt, Human
caggaaauaaaugguaaugcau

SEQ ID NO: 681067 - RNA, 22 nt, Human
cauuucccccucauguugcagc

SEQ ID NO: 681068 - RNA, 22 nt, Human
ucacugaagucuucaaguagga

SEQ ID NO: 681069 - RNA, 19 nt, Human
uugaacacuuucuucaagg

SEQ ID NO: 681070 - RNA, 22 nt, Human
ccagcuugaagaugugcugguu

SEQ ID NO: 681071 - RNA, 22 nt, Human
gccucugcccauccaccaucag

SEQ ID NO: 681072 - RNA, 22 nt, Human
uuucauucauuauacaguagag

SEQ ID NO: 681073 - RNA, 23 nt, Human
acaguuauagcugugaauaacau

SEQ ID NO: 681074 - RNA, 22 nt, Human
caggacagacagaaugccuaac

SEQ ID NO: 681075 - RNA, 22 nt, Human
cagaggucagguuggacauuau

SEQ ID NO: 681076 - RNA, 22 nt, Human
acuguagaggccuggauugagg

SEQ ID NO: 681077 - RNA, 22 nt, Human
agcaggagcugugggaagaugg

SEQ ID NO: 681078 - RNA, 22 nt, Human
cccaggagagaggggauaaagc

SEQ ID NO: 681079 - RNA, 23 nt, Human
uguaacuuugggcauguugcuuc

SEQ ID NO: 681080 - RNA, 22 nt, Human
gcucagagaaagauuagucccu

SEQ ID NO: 681081 - RNA, 21 nt, Human
uccugggggguaggugaguuu

SEQ ID NO: 681082 - RNA, 20 nt, Human
gcagagugugagagggugaa

SEQ ID NO: 681083 - RNA, 22 nt, Human
cuaaaauuaucaagauaauucc

SEQ ID NO: 681084 - RNA, 21 nt, Human
uuucucaccaugguauggaaa

SEQ ID NO: 681085 - RNA, 22 nt, Human
uucguguggagauguuucugca

SEQ ID NO: 681086 - RNA, 22 nt, Human
acacagauuuuacauguuaugc

SEQ ID NO: 681087 - RNA, 22 nt, Human
uuacuuugcuuucucauuacag

SEQ ID NO: 681088 - RNA, 22 nt, Human
gaaagccaucuggcugcuggga

SEQ ID NO: 681089 - RNA, 22 nt, Human
cccaggcugcaugaguccaugg

SEQ ID NO: 681090 - RNA, 22 nt, Human
ugagcaggugagucuagggcag

SEQ ID NO: 681091 - RNA, 22 nt, Human
auguuuccagguucuuccuaug

SEQ ID NO: 681092 - RNA, 22 nt, Human
ucagaacaugaagguuaauuug

SEQ ID NO: 681093 - RNA, 22 nt, Human
caggggcucccugggugccagu

SEQ ID NO: 681094 - RNA, 20 nt, Human
ugacaaagaguaagaggagg

SEQ ID NO: 681095 - RNA, 21 nt, Human
gcucucagcugccugcugguu

SEQ ID NO: 681096 - RNA, 22 nt, Human
uaagagcagaacagcaacauau

SEQ ID NO: 681097 - RNA, 22 nt, Human
acagcucuuaggcagaaccaac

SEQ ID NO: 681098 - RNA, 22 nt, Human
agcucaggcucugcagggacua

SEQ ID NO: 681099 - RNA, 19 nt, Human
guuuuucccagacgaggca

SEQ ID NO: 681100 - RNA, 22 nt, Human
ucuugaagucuuaugguuuaaa

SEQ ID NO: 681101 - RNA, 22 nt, Human
ccucagaggugaacaucagugc

SEQ ID NO: 681102 - RNA, 22 nt, Human
cagagcagaaaccugggugauu

SEQ ID NO: 681103 - RNA, 22 nt, Human
gcuuaaaucccaaugcuagacc

SEQ ID NO: 681104 - RNA, 22 nt, Human
uggacaggugagugacucaggg

SEQ ID NO: 681105 - RNA, 22 nt, Human
uacagagaugugaaaagcucua

SEQ ID NO: 681106 - RNA, 22 nt, Human
gaagcaucagcaauggcuggaa

SEQ ID NO: 681107 - RNA, 22 nt, Human
aggcaggcucaaugcccagucu

SEQ ID NO: 681108 - RNA, 22 nt, Human
uauuugcugacagugcuggagc

SEQ ID NO: 681109 - RNA, 21 nt, Human
cagcuucuucugugaccuggu

SEQ ID NO: 681110 - RNA, 22 nt, Human
uguucuuuggcuucacagcucu

SEQ ID NO: 681111 - RNA, 23 nt, Human
ucagugugcaagaauggagaagc

SEQ ID NO: 681112 - RNA, 23 nt, Human
aggagccaggaaccagcuucccc

SEQ ID NO: 681113 - RNA, 22 nt, Human
acaugaagcaagaaagaugcua

SEQ ID NO: 681114 - RNA, 22 nt, Human
aucuguuauuuacccaucucug

SEQ ID NO: 681115 - RNA, 19 nt, Human
aagagcagggaaagaauug

SEQ ID NO: 681116 - RNA, 22 nt, Human
gaagaggaugacaggagccggu

SEQ ID NO: 681117 - RNA, 22 nt, Human
ucagugugaguaccaugcucag

SEQ ID NO: 681118 - RNA, 22 nt, Human
guguguggaaugcucauuuauu

SEQ ID NO: 681119 - RNA, 22 nt, Human
uauguacaucguugaauucaaa

SEQ ID NO: 681120 - RNA, 22 nt, Human
cugcacagagcagggcagacac

SEQ ID NO: 681121 - RNA, 22 nt, Human
agggagcaugggugaagcaggc

SEQ ID NO: 681122 - RNA, 22 nt, Human
agagccaguuacaacuguggag

SEQ ID NO: 681123 - RNA, 22 nt, Human
ccaucuccaguuuauucuuccu

SEQ ID NO: 681124 - RNA, 23 nt, Human
agcuugcuuuucccaguacugca

SEQ ID NO: 681125 - RNA, 22 nt, Human
gcccagccuccaagcuccaagg

SEQ ID NO: 681126 - RNA, 22 nt, Human
ggucacaaggcagauaauaagg

SEQ ID NO: 681127 - RNA, 22 nt, Human
uuucagaguuaguagagcaugu

SEQ ID NO: 681128 - RNA, 22 nt, Human
aggagcuggccacuaggaugca

SEQ ID NO: 681129 - RNA, 22 nt, Human
gaggagucuaguuuauggcuuc

SEQ ID NO: 681130 - RNA, 22 nt, Human
agcagcauacacaucauguuga

SEQ ID NO: 681131 - RNA, 18 nt, Human
uuuuccuuccaccuugaa

SEQ ID NO: 681132 - RNA, 22 nt, Human
aaugcaguuucauuuguagaau

SEQ ID NO: 681133 - RNA, 22 nt, Human
cacuucaaauauggcuucauga

SEQ ID NO: 681134 - RNA, 22 nt, Human
uuuaugagccucaaaucugagu

SEQ ID NO: 681135 - RNA, 22 nt, Human
ucaaaggagacacaaggagaaa

SEQ ID NO: 681136 - RNA, 22 nt, Human
caggaaccuaaugaaggcucac

SEQ ID NO: 681137 - RNA, 22 nt, Human
aggaaagcuuggcaaacuaaau

SEQ ID NO: 681138 - RNA, 22 nt, Human
cuggcacacagcaggcucucag

SEQ ID NO: 681139 - RNA, 22 nt, Human
ugggccaccugcuuuuuugcau

SEQ ID NO: 681140 - RNA, 22 nt, Human
gugucugcauauucaaacuugu

SEQ ID NO: 681141 - RNA, 22 nt, Human
cccagaggugcuucagaggugc

SEQ ID NO: 681142 - RNA, 22 nt, Human
cuuucugauguaaggaacuagg

SEQ ID NO: 681143 - RNA, 22 nt, Human
ggauugagagcacugguagcug

SEQ ID NO: 681144 - RNA, 22 nt, Human
gcugagaacagagcucugagcu

SEQ ID NO: 681145 - RNA, 22 nt, Human
aaggccaaaguuuucaggcuaa

SEQ ID NO: 681146 - RNA, 21 nt, Human
cauuucaaagagcuggaaauc

SEQ ID NO: 681147 - RNA, 22 nt, Human
aacaaaguacuuuucagugcuu

SEQ ID NO: 681148 - RNA, 22 nt, Human
uugugaaauguuucaaaauagu

SEQ ID NO: 681149 - RNA, 22 nt, Human
uagccaggucacacuguguguu

SEQ ID NO: 681150 - RNA, 22 nt, Human
ccagccccuauccucgcuccac

SEQ ID NO: 681151 - RNA, 22 nt, Human
uuugugaacuuaggcaauuagg

SEQ ID NO: 681152 - RNA, 22 nt, Human
gauaccaaaaucaucuuauagg

SEQ ID NO: 681153 - RNA, 22 nt, Human
auaucaaaauaaacagcaugca

SEQ ID NO: 681154 - RNA, 22 nt, Human
cagagugaaaacugagcucaaa

SEQ ID NO: 681155 - RNA, 22 nt, Human
ugacagggcuagaggcaaugca

SEQ ID NO: 681156 - RNA, 22 nt, Human
gucccugcaucaccacgggacu

SEQ ID NO: 681157 - RNA, 22 nt, Human
gugagagaugcuuucuuaacgc

SEQ ID NO: 681158 - RNA, 22 nt, Human
gggggcggagcacgugaccacg

SEQ ID NO: 681159 - RNA, 22 nt, Human
gaaggccuagggaugcucugcg

SEQ ID NO: 681160 - RNA, 18 nt, Human
aaugcauuuauggagaug

SEQ ID NO: 681161 - RNA, 22 nt, Human
ccugggaacaguggguuggcuc

SEQ ID NO: 681162 - RNA, 22 nt, Human
agccugcuggaccaagcucaug

SEQ ID NO: 681163 - RNA, 16 nt, Human
ccccucaggaaguaca

SEQ ID NO: 681164 - RNA, 22 nt, Human
cuuaacucuacacugcacuuua

SEQ ID NO: 681165 - RNA, 22 nt, Human
ugaagccaaggaugccuuucuc

SEQ ID NO: 681166 - RNA, 22 nt, Human
uucacauuggugauauguuucu

SEQ ID NO: 681167 - RNA, 22 nt, Human
cugugccucaguguccucgagu

SEQ ID NO: 681168 - RNA, 22 nt, Human
ccuccugggacucauuagcacc

SEQ ID NO: 681169 - RNA, 23 nt, Human
cuucacaaucaaaaucaguucug

SEQ ID NO: 681170 - RNA, 20 nt, Human
aucuccugcuaccacccauu

SEQ ID NO: 681171 - RNA, 22 nt, Human
uggaaggggccaggcgcggagu

SEQ ID NO: 681172 - RNA, 22 nt, Human
aaggccaggcagggagcuguga

SEQ ID NO: 681173 - RNA, 22 nt, Human
aucaggauucaguaucuccagc

SEQ ID NO: 681174 - RNA, 22 nt, Human
acuagaaaauuccuagaaacua

SEQ ID NO: 681175 - RNA, 22 nt, Human
uuacaaugagaaaugguuggca

SEQ ID NO: 681176 - RNA, 22 nt, Human
ugcagggaugcuagagguaaga

SEQ ID NO: 681177 - RNA, 20 nt, Human
acucaaaucaccugccucaa

SEQ ID NO: 681178 - RNA, 22 nt, Human
agcauagaauaagcugaaguca

SEQ ID NO: 681179 - RNA, 22 nt, Human
gcagugccuugcuucucugucu

SEQ ID NO: 681180 - RNA, 22 nt, Human
aacauuuauauggguucaugaa

SEQ ID NO: 681181 - RNA, 22 nt, Human
acuugggucaaguagcucacag

SEQ ID NO: 681182 - RNA, 22 nt, Human
ucugaggcccugcaggcagugu

SEQ ID NO: 681183 - RNA, 21 nt, Human
auuuucugugauagcugucuc

SEQ ID NO: 681184 - RNA, 22 nt, Human
aaugauggauuuagacaagcug

SEQ ID NO: 681185 - RNA, 22 nt, Human
agugggagauaacuuaacagcu

SEQ ID NO: 681186 - RNA, 22 nt, Human
gcuuccaucuaugucuucauca

SEQ ID NO: 681187 - RNA, 22 nt, Human
ugcugguccuggagcuggguuc

SEQ ID NO: 681188 - RNA, 22 nt, Human
aaguuacaggagaaagagauca

SEQ ID NO: 681189 - RNA, 22 nt, Human
ucacugugaauguuaucaucuu

SEQ ID NO: 681190 - RNA, 22 nt, Human
ugucccaguuuaucugggacug

SEQ ID NO: 681191 - RNA, 22 nt, Human
augcaggaguuggaaaaaauga

SEQ ID NO: 681192 - RNA, 22 nt, Human
ucaaugucugcggcuagcugga

SEQ ID NO: 681193 - RNA, 22 nt, Human
uuccuguccgcaauggccuggg

SEQ ID NO: 681194 - RNA, 18 nt, Human
acccaggcucaugguccu

SEQ ID NO: 681195 - RNA, 22 nt, Human
ugggagaacacugcucuggaug

SEQ ID NO: 681196 - RNA, 22 nt, Human
gcagaugauguagacagacagu

SEQ ID NO: 681197 - RNA, 22 nt, Human
aucagcugaaaaacaggcagca

SEQ ID NO: 681198 - RNA, 22 nt, Human
aaucagcaggcuucuaaauuuu

SEQ ID NO: 681199 - RNA, 22 nt, Human
guccagagaguaaaggggguaa

SEQ ID NO: 681200 - RNA, 22 nt, Human
cuuuacaggaaaagguggcugu

SEQ ID NO: 681201 - RNA, 23 nt, Human
aauauuccugccauuaaugacuc

SEQ ID NO: 681202 - RNA, 22 nt, Human
uucugccugccccagagaggcc

SEQ ID NO: 681203 - RNA, 23 nt, Human
uguaaacaucacccccuggaguu

SEQ ID NO: 681204 - RNA, 20 nt, Human
uuuagcacauuguacaaaac

SEQ ID NO: 681205 - RNA, 22 nt, Human
aggcagacuuccugcuuggauc

SEQ ID NO: 681206 - RNA, 22 nt, Human
guccagccacccuggaggcacg

SEQ ID NO: 681207 - RNA, 22 nt, Human
agugaccaucuaacgccuguga

SEQ ID NO: 681208 - RNA, 22 nt, Human
acguaguguguuguggaaagag

SEQ ID NO: 681209 - RNA, 22 nt, Human
acccuuugucaagcacagaaga

SEQ ID NO: 681210 - RNA, 22 nt, Human
uuuaauugauucacagucugua

SEQ ID NO: 681211 - RNA, 20 nt, Human
aaagauacuuuuuguaaugg

SEQ ID NO: 681212 - RNA, 22 nt, Human
uuuuucugucucuuacauugca

SEQ ID NO: 681213 - RNA, 22 nt, Human
gcugggcagccuggccgcugcc

SEQ ID NO: 681214 - RNA, 23 nt, Human
uuacuacacaaguaacgauuccc

SEQ ID NO: 681215 - RNA, 22 nt, Human
ucacauaaauuauacaauuuca

SEQ ID NO: 681216 - RNA, 22 nt, Human
uucacauuugaaaggaaagaua

SEQ ID NO: 681217 - RNA, 22 nt, Human
gcuggcaguuuccucaccgagg

SEQ ID NO: 681218 - RNA, 22 nt, Human
ccuggccaguuuccaggcccug

SEQ ID NO: 681219 - RNA, 22 nt, Human
ggcuucaggggucugucugcac

SEQ ID NO: 681220 - RNA, 22 nt, Human
ccugggcucaagugaugguccc

SEQ ID NO: 681221 - RNA, 22 nt, Human
cccccaccguguuccugcucgg

SEQ ID NO: 681222 - RNA, 22 nt, Human
uccuggccuugcuccugaugcc

SEQ ID NO: 681223 - RNA, 22 nt, Human
agaucuuguuaaaugcugccuc

SEQ ID NO: 681224 - RNA, 22 nt, Human
gacaggcuggcaaugcccugcu

SEQ ID NO: 681225 - RNA, 22 nt, Human
ccucaggggugcccacagcugc

SEQ ID NO: 681226 - RNA, 23 nt, Human
uguggcugagaaauugacaacuu

SEQ ID NO: 681227 - RNA, 22 nt, Human
uuaaaagucugaugauuuacau

SEQ ID NO: 681228 - RNA, 22 nt, Human
auucauuugcuauuguguaugg

SEQ ID NO: 681229 - RNA, 21 nt, Human
uuaagaccugcaucaucauua

SEQ ID NO: 681230 - RNA, 22 nt, Human
uguccauggauagagcugcucg

SEQ ID NO: 681231 - RNA, 22 nt, Human
uaaauuauguuccauguccuuu

SEQ ID NO: 681232 - RNA, 22 nt, Human
augaaggcuguguagauggaug

SEQ ID NO: 681233 - RNA, 22 nt, Human
cucagagagggcaccagggcca

SEQ ID NO: 681234 - RNA, 22 nt, Human
agcugagggcaggaugggguga

SEQ ID NO: 681235 - RNA, 22 nt, Human
cagguuggagaucugucuaugg

SEQ ID NO: 681236 - RNA, 22 nt, Human
ucugaggcugucucugggcucc

SEQ ID NO: 681237 - RNA, 22 nt, Human
guguaaacaacagugguuugaa

SEQ ID NO: 681238 - RNA, 21 nt, Human
ugccagcauuaaacagucauu

SEQ ID NO: 681239 - RNA, 22 nt, Human
ccugaguggccaggcagcugug

SEQ ID NO: 681240 - RNA, 22 nt, Human
uuuaugcacacuuagacauggc

SEQ ID NO: 681241 - RNA, 23 nt, Human
ucacuuugauguaauugaaaagc

SEQ ID NO: 681242 - RNA, 22 nt, Human
ucccaggaggugcuuccuagga

SEQ ID NO: 681243 - RNA, 22 nt, Human
gacaagacaccucucuccaucc

SEQ ID NO: 681244 - RNA, 22 nt, Human
gaacuacaguaagaauugaugu

SEQ ID NO: 681245 - RNA, 22 nt, Human
ucacaucuccauguguuguuca

SEQ ID NO: 681246 - RNA, 22 nt, Human
caguucuaucauuuuagagaug

SEQ ID NO: 681247 - RNA, 22 nt, Human
ggagcuguuggcagcuaucuug

SEQ ID NO: 681248 - RNA, 22 nt, Human
caguuuaccuauauguaaauuu

SEQ ID NO: 681249 - RNA, 22 nt, Human
aggggccaccaccaaggaaggu

SEQ ID NO: 681250 - RNA, 22 nt, Human
uucuggaacauagcaagaaguu

SEQ ID NO: 681251 - RNA, 22 nt, Human
ccuggcuguggcggugcucuca

SEQ ID NO: 681252 - RNA, 22 nt, Human
acagaauauuuggcaugcgucu

SEQ ID NO: 681253 - RNA, 20 nt, Human
ucuucagcacuccuuaggua

SEQ ID NO: 681254 - RNA, 22 nt, Human
aggacuguuuuuucuucuaggg

SEQ ID NO: 681255 - RNA, 22 nt, Human
cccuggaguccuggcaguugau

SEQ ID NO: 681256 - RNA, 22 nt, Human
ugggagagcagagaacccucuu

SEQ ID NO: 681257 - RNA, 23 nt, Human
ugcagcucaaagauggguaaaug

SEQ ID NO: 681258 - RNA, 22 nt, Human
uuaucguacgcuucagaaauuu

SEQ ID NO: 681259 - RNA, 22 nt, Human
uuggagaguuaauugacaguua

SEQ ID NO: 681260 - RNA, 22 nt, Human
aacagcagggaugacauggcca

SEQ ID NO: 681261 - RNA, 22 nt, Human
acagcuuuguuuucccugcuga

SEQ ID NO: 681262 - RNA, 22 nt, Human
gaaauauucuugucuuguuuuc

SEQ ID NO: 681263 - RNA, 22 nt, Human
aacacucucuguugguaaggcu

SEQ ID NO: 681264 - RNA, 22 nt, Human
ccaggcauccauugcuuccucu

SEQ ID NO: 681265 - RNA, 22 nt, Human
gcucucuuuuuccagugguggu

SEQ ID NO: 681266 - RNA, 22 nt, Human
gaaaaccaccucccaucaagca

SEQ ID NO: 681267 - RNA, 22 nt, Human
gcauccaggacuauaugaugau

SEQ ID NO: 681268 - RNA, 22 nt, Human
uugaaacuuuucuuggagaaac

SEQ ID NO: 681269 - RNA, 22 nt, Human
ugcaggaaaaauaaauaguguu

SEQ ID NO: 681270 - RNA, 22 nt, Human
cuucagugauauaggcuucucc

SEQ ID NO: 681271 - RNA, 22 nt, Human
guggucccuucuggcccugguc

SEQ ID NO: 681272 - RNA, 22 nt, Human
aauucauauggauaugcuagua

SEQ ID NO: 681273 - RNA, 22 nt, Human
augaucagcaguuuucaguguu

SEQ ID NO: 681274 - RNA, 22 nt, Human
caguccagcucaucaguggcac

SEQ ID NO: 681275 - RNA, 22 nt, Human
uacauaauaaggggcauggugu

SEQ ID NO: 681276 - RNA, 22 nt, Human
ugaagcuuuaggauggguucau

SEQ ID NO: 681277 - RNA, 22 nt, Human
cugugcccaggccccuggggau

SEQ ID NO: 681278 - RNA, 19 nt, Human
ucauugaacauaauuacuu

SEQ ID NO: 681279 - RNA, 22 nt, Human
ccuaagaauuaaugaauacacc

SEQ ID NO: 681280 - RNA, 22 nt, Human
ggccucuguucugcauuccucc

SEQ ID NO: 681281 - RNA, 22 nt, Human
cuggaggaauaaucuccuaccc

SEQ ID NO: 681282 - RNA, 22 nt, Human
cuugcuuuugcugaugauuaag

SEQ ID NO: 681283 - RNA, 22 nt, Human
caugcaguauucaggacaguuc

SEQ ID NO: 681284 - RNA, 22 nt, Human
ccacugcuaacuugcugcagcu

SEQ ID NO: 681285 - RNA, 22 nt, Human
auguacauucuaaguaugugua

SEQ ID NO: 681286 - RNA, 22 nt, Human
guggcuaguuggcagagaacag

SEQ ID NO: 681287 - RNA, 22 nt, Human
acugaauagugcugcauuguac

SEQ ID NO: 681288 - RNA, 22 nt, Human
acaucuguuugagaaaaagaag

SEQ ID NO: 681289 - RNA, 22 nt, Human
aauugcaacagguagacuuuuc

SEQ ID NO: 681290 - RNA, 22 nt, Human
ggcaauuucaugugguuuaaac

SEQ ID NO: 681291 - RNA, 22 nt, Human
cuucuguggauauguucucucu

SEQ ID NO: 681292 - RNA, 22 nt, Human
uagcaaguguuggugaagaugu

SEQ ID NO: 681293 - RNA, 22 nt, Human
cagaggccuauccaguguccau

SEQ ID NO: 681294 - RNA, 22 nt, Human
agguggagugugcagggagagc

SEQ ID NO: 681295 - RNA, 22 nt, Human
ucucagaaggcaagggcugggg

SEQ ID NO: 681296 - RNA, 22 nt, Human
auuugauuuguagauaguguag

SEQ ID NO: 681297 - RNA, 22 nt, Human
agcugcuuguacaugaccacau

SEQ ID NO: 681298 - RNA, 22 nt, Human
auguggcaaugguuagcacugu

SEQ ID NO: 681299 - RNA, 22 nt, Human
aaucagaacgcucgaucuucgg

SEQ ID NO: 681300 - RNA, 22 nt, Human
aggcuccaggcaaaauuucgga

SEQ ID NO: 681301 - RNA, 22 nt, Human
gccagguguccucacagugagg

SEQ ID NO: 681302 - RNA, 22 nt, Human
uggcagcuacagacagagguga

SEQ ID NO: 681303 - RNA, 22 nt, Human
cagauuacuuuguagcagucag

SEQ ID NO: 681304 - RNA, 22 nt, Human
uggagaaggacagccugagaaa

SEQ ID NO: 681305 - RNA, 22 nt, Human
augugcaggauccaggcuccua

SEQ ID NO: 681306 - RNA, 22 nt, Human
uuagagauugguugacagauuu

SEQ ID NO: 681307 - RNA, 22 nt, Human
cagcccugugcggagggcccug

SEQ ID NO: 681308 - RNA, 22 nt, Human
uuaaacagacaguaaaugaaac

SEQ ID NO: 681309 - RNA, 22 nt, Human
ugaaaugagagcacagaauaaa

SEQ ID NO: 681310 - RNA, 22 nt, Human
uggguaggaccagaaaugcacu

SEQ ID NO: 681311 - RNA, 22 nt, Human
gggcaggaugcaguuucagaga

SEQ ID NO: 681312 - RNA, 22 nt, Human
aauggcuuucagcaaggauaga

SEQ ID NO: 681313 - RNA, 22 nt, Human
acaucugaggagaccagccucu

SEQ ID NO: 681314 - RNA, 22 nt, Human
uucacagacauugcagacugaa

SEQ ID NO: 681315 - RNA, 20 nt, Human
gcugagguuucuuccuauau

SEQ ID NO: 681316 - RNA, 22 nt, Human
uuuuacaguuccaugcaaagcg

SEQ ID NO: 681317 - RNA, 22 nt, Human
uccuugaauccuagcauccuau

SEQ ID NO: 681318 - RNA, 22 nt, Human
aggccugucccagcugaggacg

SEQ ID NO: 681319 - RNA, 22 nt, Human
acaguuaagcaguaugaucaca

SEQ ID NO: 681320 - RNA, 21 nt, Human
agcauucaaaagaugccauaa

SEQ ID NO: 681321 - RNA, 22 nt, Human
gcagcuccuuuaggcugcaaag

SEQ ID NO: 681322 - RNA, 22 nt, Human
ugggaggcuuccagaccuugcu

SEQ ID NO: 681323 - RNA, 21 nt, Human
ucaggguucaaaggaacugau

SEQ ID NO: 681324 - RNA, 22 nt, Human
uauguucuaaccuugucuuucc

SEQ ID NO: 681325 - RNA, 22 nt, Human
uagggcugccuauggcuagaua

SEQ ID NO: 681326 - RNA, 22 nt, Human
ggagcauguggggugagcaggg

SEQ ID NO: 681327 - RNA, 22 nt, Human
acacagcuucaaagucuaauuc

SEQ ID NO: 681328 - RNA, 22 nt, Human
uagagagguuugaauuggcugc

SEQ ID NO: 681329 - RNA, 23 nt, Human
aacauacuguuuaauauucacag

SEQ ID NO: 681330 - RNA, 22 nt, Human
cuuaauuacccaaugugguagg

SEQ ID NO: 681331 - RNA, 21 nt, Human
gcagacugcccugcugucccc

SEQ ID NO: 681332 - RNA, 22 nt, Human
aaaucuaggcucauccuggucc

SEQ ID NO: 681333 - RNA, 22 nt, Human
auggccagcaagguagggcaau

SEQ ID NO: 681334 - RNA, 22 nt, Human
gaaggccaguuuugagauaggu

SEQ ID NO: 681335 - RNA, 22 nt, Human
ccagugcgagccugugcuggcc

SEQ ID NO: 681336 - RNA, 22 nt, Human
ugauuauauucuaacuucauaa

SEQ ID NO: 681337 - RNA, 22 nt, Human
ccaggcuccccaggaggcccuu

SEQ ID NO: 681338 - RNA, 22 nt, Human
ucugucaccauucagcuugaau

SEQ ID NO: 681339 - RNA, 22 nt, Human
ccagcugcuugggaaaaugucu

SEQ ID NO: 681340 - RNA, 22 nt, Human
uauggcuuaugcugaacaccug

SEQ ID NO: 681341 - RNA, 21 nt, Human
acugaccacuucugccugucu

SEQ ID NO: 681342 - RNA, 22 nt, Human
agugcagagaccuggucaggca

SEQ ID NO: 681343 - RNA, 18 nt, Human
ugaggccagagugggcau

SEQ ID NO: 681344 - RNA, 22 nt, Human
ccucugugggccgggccugcug

SEQ ID NO: 681345 - RNA, 22 nt, Human
auuccaaacuuaccccagagga

SEQ ID NO: 681346 - RNA, 22 nt, Human
ugagaagcugcuugugcuguau

SEQ ID NO: 681347 - RNA, 21 nt, Human
aggcauggaaauggcacacug

SEQ ID NO: 681348 - RNA, 22 nt, Human
uuggcccuagaugauuaaguug

SEQ ID NO: 681349 - RNA, 21 nt, Human
uggcacagcaagugggcucau

SEQ ID NO: 681350 - RNA, 22 nt, Human
ucaauuaugccauugcaauauu

SEQ ID NO: 681351 - RNA, 22 nt, Human
ccugccugucuuuauccccugu

SEQ ID NO: 681352 - RNA, 22 nt, Human
cuucaaagggucacuauuuauc

SEQ ID NO: 681353 - RNA, 22 nt, Human
aagguacaaaguauuauuuaaa

SEQ ID NO: 681354 - RNA, 22 nt, Human
ggcaccuguguaagaucuggaa

SEQ ID NO: 681355 - RNA, 22 nt, Human
ucauuucagaugcauuuagaau

SEQ ID NO: 681356 - RNA, 22 nt, Human
gaccugaaauuugugguagaac

SEQ ID NO: 681357 - RNA, 18 nt, Human
uucauguuggcuuaggga

SEQ ID NO: 681358 - RNA, 23 nt, Human
agcagugaguaaacagauaggau

SEQ ID NO: 681359 - RNA, 22 nt, Human
uugugugcauaaauucugaugu

SEQ ID NO: 681360 - RNA, 22 nt, Human
cucuagggaagaaugagagccc

SEQ ID NO: 681361 - RNA, 22 nt, Human
gaaaugucaagauauguuugga

SEQ ID NO: 681362 - RNA, 22 nt, Human
gugagccauucuacuccuaacc

SEQ ID NO: 681363 - RNA, 22 nt, Human
gaggccuggagccgccuaggcg

SEQ ID NO: 681364 - RNA, 22 nt, Human
ugacuauuuuuuauagauucca

SEQ ID NO: 681365 - RNA, 22 nt, Human
ccugaguucuuauuuccaguca

SEQ ID NO: 681366 - RNA, 22 nt, Human
ccaggcucaccuggagccccug

SEQ ID NO: 681367 - RNA, 22 nt, Human
gcgggggcggcgcagaccucag

SEQ ID NO: 681368 - RNA, 22 nt, Human
uuaacacugauuguagagacac

SEQ ID NO: 681369 - RNA, 22 nt, Human
aagagggagggcaaaggcacug

SEQ ID NO: 681370 - RNA, 22 nt, Human
acuuugcacuucaauauaacuu

SEQ ID NO: 681371 - RNA, 22 nt, Human
uuuaguuauuguuacaguauga

SEQ ID NO: 681372 - RNA, 22 nt, Human
aaaaaucacuuuuauaggcagc

SEQ ID NO: 681373 - RNA, 21 nt, Human
gagauuuagaaggaucaauuu

SEQ ID NO: 681374 - RNA, 22 nt, Human
acauaugucuauuucauguaaa

SEQ ID NO: 681375 - RNA, 22 nt, Human
ccucccguauauguccugggcu

SEQ ID NO: 681376 - RNA, 22 nt, Human
ugguccuugcuauagagugaua

SEQ ID NO: 681377 - RNA, 22 nt, Human
cuggccucuguguucaccauag

SEQ ID NO: 681378 - RNA, 22 nt, Human
aauguacaaggguuccaguuuu

SEQ ID NO: 681379 - RNA, 22 nt, Human
cagguuccaguugcagggacuu

SEQ ID NO: 681380 - RNA, 22 nt, Human
cugcccugcagcuccacggacu

SEQ ID NO: 681381 - RNA, 19 nt, Human
ucucuauauuuguuucuga

SEQ ID NO: 681382 - RNA, 22 nt, Human
aggccuuuguggagcucauggc

SEQ ID NO: 681383 - RNA, 22 nt, Human
agccagaggaagccuggcccuc

SEQ ID NO: 681384 - RNA, 22 nt, Human
agcccagcuuugaaccauauca

SEQ ID NO: 681385 - RNA, 22 nt, Human
gaaacauaguugagacacugcu

SEQ ID NO: 681386 - RNA, 20 nt, Human
uuuucugugccaagaaaacu

SEQ ID NO: 681387 - RNA, 22 nt, Human
uacaagcugacccugaagauga

SEQ ID NO: 681388 - RNA, 21 nt, Human
auggcucaggccaucaaugga

SEQ ID NO: 681389 - RNA, 22 nt, Human
auuuauguaucuguguagauca

SEQ ID NO: 681390 - RNA, 22 nt, Human
ucgcugaggcugcacggcugcc

SEQ ID NO: 681391 - RNA, 22 nt, Human
guuucauuuacaucuguaggua

SEQ ID NO: 681392 - RNA, 22 nt, Human
gcuuuuuugggaugccugccuu

SEQ ID NO: 681393 - RNA, 22 nt, Human
ugcuauacauguacauauuagu

SEQ ID NO: 681394 - RNA, 22 nt, Human
uugcauugaaaauauauuuuaa

SEQ ID NO: 681395 - RNA, 22 nt, Human
cuucacuggaaucuguaauagu

SEQ ID NO: 681396 - RNA, 22 nt, Human
gggcugcacagaucuucaaggg

SEQ ID NO: 681397 - RNA, 22 nt, Human
ucuaagccaggacugagagacg

SEQ ID NO: 681398 - RNA, 22 nt, Human
gugcucuccagccccacgugga

SEQ ID NO: 681399 - RNA, 22 nt, Human
uacuaaauaguuuaauuccuca

SEQ ID NO: 681400 - RNA, 23 nt, Human
cagaugagguuggcagcaugguc

SEQ ID NO: 681401 - RNA, 18 nt, Human
uaagcaaugacauugcaa

SEQ ID NO: 681402 - RNA, 22 nt, Human
aaaagcaauugcaguucuugcc

SEQ ID NO: 681403 - RNA, 22 nt, Human
cuuuacugccaugcauuuauaa

SEQ ID NO: 681404 - RNA, 19 nt, Human
agaaguuagacauugcaau

SEQ ID NO: 681405 - RNA, 22 nt, Human
ggcugugcccucacauggggca

SEQ ID NO: 681406 - RNA, 22 nt, Human
uagggcugcugcagaugacagg

SEQ ID NO: 681407 - RNA, 22 nt, Human
caagagcuagaaauugguuaga

SEQ ID NO: 681408 - RNA, 22 nt, Human
cuccucucuggaguuaugcaga

SEQ ID NO: 681409 - RNA, 22 nt, Human
ugaggcuugucucagauggggg

SEQ ID NO: 681410 - RNA, 22 nt, Human
aaugagaauguaagugaagaga

SEQ ID NO: 681411 - RNA, 22 nt, Human
ccuggcaguucaucaaauggca

SEQ ID NO: 681412 - RNA, 22 nt, Human
agcuggaaaauccaagaccuug

SEQ ID NO: 681413 - RNA, 22 nt, Human
ugagggcugcuuccagagcuag

SEQ ID NO: 681414 - RNA, 22 nt, Human
gcacugagcuuuggaggagcag

SEQ ID NO: 681415 - RNA, 22 nt, Human
uaucuugagagacaacacagca

SEQ ID NO: 681416 - RNA, 21 nt, Human
agcagaggggacauguuugau

SEQ ID NO: 681417 - RNA, 22 nt, Human
cguguggucccggcaaggcaag

SEQ ID NO: 681418 - RNA, 22 nt, Human
agggucaccaguucauaggcac

SEQ ID NO: 681419 - RNA, 22 nt, Human
cuguuacuaaucuuuucugcua

SEQ ID NO: 681420 - RNA, 22 nt, Human
aguauauugcucuuaaucauag

SEQ ID NO: 681421 - RNA, 22 nt, Human
aaauguucccaauaugaagcug

SEQ ID NO: 681422 - RNA, 22 nt, Human
gacugagggacagggcagugga

SEQ ID NO: 681423 - RNA, 22 nt, Human
gaugcaggauagcuucacccag

SEQ ID NO: 681424 - RNA, 22 nt, Human
agccagugaugaagacucugga

SEQ ID NO: 681425 - RNA, 22 nt, Human
uguuuacuagccaacauggaga

SEQ ID NO: 681426 - RNA, 22 nt, Human
ggcuucaccaggugcaugcaug

SEQ ID NO: 681427 - RNA, 23 nt, Human
acagacaacacugaugagagaaa

SEQ ID NO: 681428 - RNA, 22 nt, Human
aagugccugaccuagccuggag

SEQ ID NO: 681429 - RNA, 22 nt, Human
uugcagcuucuugcaucagaaa

SEQ ID NO: 681430 - RNA, 22 nt, Human
ugcaugcagcauaugaggccuc

SEQ ID NO: 681431 - RNA, 22 nt, Human
acacugacugggacagaagacc

SEQ ID NO: 681432 - RNA, 22 nt, Human
caaguauauuugaacauguaaa

SEQ ID NO: 681433 - RNA, 22 nt, Human
ucucuguagaccugaccagcac

SEQ ID NO: 681434 - RNA, 22 nt, Human
gggcccugcguccggaagucug

SEQ ID NO: 681435 - RNA, 22 nt, Human
gauuucagggugcagaugauga

SEQ ID NO: 681436 - RNA, 22 nt, Human
cccuuccucccaggcuucugug

SEQ ID NO: 681437 - RNA, 19 nt, Human
agcaggccacagggccagc

SEQ ID NO: 681438 - RNA, 22 nt, Human
aaagugauuuaaguaccucagg

SEQ ID NO: 681439 - RNA, 22 nt, Human
cagggccaguucucgcagcagu

SEQ ID NO: 681440 - RNA, 22 nt, Human
acguauauugaaauaucaugag

SEQ ID NO: 681441 - RNA, 22 nt, Human
gaugugugcuuuucgcaguguc

SEQ ID NO: 681442 - RNA, 22 nt, Human
gcagcagcggggccccugcgcg

SEQ ID NO: 681443 - RNA, 22 nt, Human
aggguucagugagguguacucc

SEQ ID NO: 681444 - RNA, 22 nt, Human
caguacaauguugaaaaggagu

SEQ ID NO: 681445 - RNA, 22 nt, Human
cagggucaggaggaucuggcuu

SEQ ID NO: 681446 - RNA, 23 nt, Human
uggcagcuguguaagagaaagca

SEQ ID NO: 681447 - RNA, 22 nt, Human
uauuagaggaaccaagguggag

SEQ ID NO: 681448 - RNA, 22 nt, Human
uggaaauggaucugaugagucu

SEQ ID NO: 681449 - RNA, 22 nt, Human
gagacguggccuuugccugagc

SEQ ID NO: 681450 - RNA, 19 nt, Human
agggagaauuccaagagga

SEQ ID NO: 681451 - RNA, 21 nt, Human
cccugguuccacugucaccgc

SEQ ID NO: 681452 - RNA, 22 nt, Human
gcagcuggugcaaaugucacuc

SEQ ID NO: 681453 - RNA, 18 nt, Human
uccgaggcaccauaaaaa

SEQ ID NO: 681454 - RNA, 22 nt, Human
cuccauggcuuucgcaucugca

SEQ ID NO: 681455 - RNA, 19 nt, Human
uuauucugucagagcacac

SEQ ID NO: 681456 - RNA, 22 nt, Human
gccuguguggaugcgccggugc

SEQ ID NO: 681457 - RNA, 22 nt, Human
aaaguguuuacauugcuauaag

SEQ ID NO: 681458 - RNA, 22 nt, Human
ucccuguggauaucugcagcug

SEQ ID NO: 681459 - RNA, 22 nt, Human
agcccucucuauggcccucuug

SEQ ID NO: 681460 - RNA, 22 nt, Human
uacauuccugggcuccacccua

SEQ ID NO: 681461 - RNA, 22 nt, Human
cacaaaugugcagaaaugugag

SEQ ID NO: 681462 - RNA, 22 nt, Human
cacgcauguggaucagaugaag

SEQ ID NO: 681463 - RNA, 19 nt, Human
uuagggacaugaauucuag

SEQ ID NO: 681464 - RNA, 22 nt, Human
aucaccugcacaaauguguucc

SEQ ID NO: 681465 - RNA, 21 nt, Human
aucccagcacccaggagugca

SEQ ID NO: 681466 - RNA, 22 nt, Human
ucauggaugauagcuucauugc

SEQ ID NO: 681467 - RNA, 22 nt, Human
aggccuuaccauagcuguagca

SEQ ID NO: 681468 - RNA, 22 nt, Human
guggcccugugaacagcgcagu

SEQ ID NO: 681469 - RNA, 22 nt, Human
ccagguccuguuuucaccacag

SEQ ID NO: 681470 - RNA, 22 nt, Human
ggagucugcggcagacacugua

SEQ ID NO: 681471 - RNA, 22 nt, Human
cugaggccagcugcagagcucu

SEQ ID NO: 681472 - RNA, 18 nt, Human
uccagagcuggugcuucu

SEQ ID NO: 681473 - RNA, 22 nt, Human
agcagcucggccagucaccagg

SEQ ID NO: 681474 - RNA, 22 nt, Human
cugucguguucacuguggccua

SEQ ID NO: 681475 - RNA, 22 nt, Human
ugucuagugguuuauaaaauca

SEQ ID NO: 681476 - RNA, 22 nt, Human
uccucggcugggccccaggcuu

SEQ ID NO: 681477 - RNA, 22 nt, Human
ucagacuucaguuuuuaguugu

SEQ ID NO: 681478 - RNA, 22 nt, Human
uuuauugcuagcccuuggucca

SEQ ID NO: 681479 - RNA, 19 nt, Human
ggcuccuggggcucagccc

SEQ ID NO: 681480 - RNA, 22 nt, Human
ucuagagauacauuggucauuu

SEQ ID NO: 681481 - RNA, 22 nt, Human
caauguuuucaacugacaagua

SEQ ID NO: 681482 - RNA, 22 nt, Human
uuucuaaguguguuucauagga

SEQ ID NO: 681483 - RNA, 22 nt, Human
agaaaacagaaagucauuggug

SEQ ID NO: 681484 - RNA, 22 nt, Human
cagugucuacaguggcuggagg

SEQ ID NO: 681485 - RNA, 22 nt, Human
aguguaucaugguuggcagaca

SEQ ID NO: 681486 - RNA, 22 nt, Human
cacgacuuguggaggagcgcgg

SEQ ID NO: 681487 - RNA, 22 nt, Human
agcuggcaaggcaauuuggauu

SEQ ID NO: 681488 - RNA, 22 nt, Human
gugcccugguccccagcauaua

SEQ ID NO: 681489 - RNA, 22 nt, Human
aucuuuuugacauggugauggu

SEQ ID NO: 681490 - RNA, 22 nt, Human
guuucccaaauuguucacaggg

SEQ ID NO: 681491 - RNA, 22 nt, Human
uaaaggcaaauguguguuugug

SEQ ID NO: 681492 - RNA, 22 nt, Human
cacccaggagguugggaagggc

SEQ ID NO: 681493 - RNA, 22 nt, Human
aagauucucccugagauauuua

SEQ ID NO: 681494 - RNA, 22 nt, Human
gccagagagagucccugggccu

SEQ ID NO: 681495 - RNA, 22 nt, Human
gaaucaauugugaagacuauga

SEQ ID NO: 681496 - RNA, 22 nt, Human
auggauaacccaguucauuucu

SEQ ID NO: 681497 - RNA, 20 nt, Human
agaguaacuggcacauaggg

SEQ ID NO: 681498 - RNA, 22 nt, Human
ucugucuccugccagugccucu

SEQ ID NO: 681499 - RNA, 22 nt, Human
cucuggcugucccgaugagcag

SEQ ID NO: 681500 - RNA, 22 nt, Human
ggugaacauugaugugguuaca

SEQ ID NO: 681501 - RNA, 22 nt, Human
gggcacuggccgcccaucccug

SEQ ID NO: 681502 - RNA, 22 nt, Human
ucucaggacuuugggaagcuca

SEQ ID NO: 681503 - RNA, 22 nt, Human
gcccucagcuugauguuguucu

SEQ ID NO: 681504 - RNA, 23 nt, Human
uugcacaguguauacacauauuu

SEQ ID NO: 681505 - RNA, 22 nt, Human
accaucagucauugucaguggg

SEQ ID NO: 681506 - RNA, 22 nt, Human
ugaauacuauuucauaaugugg

SEQ ID NO: 681507 - RNA, 22 nt, Human
ccucucggcagcccaucuuguc

SEQ ID NO: 681508 - RNA, 22 nt, Human
gacaggguuugcaaggacuucg

SEQ ID NO: 681509 - RNA, 22 nt, Human
ugacccugcuucuuggugcagg

SEQ ID NO: 681510 - RNA, 22 nt, Human
acagaggccucggccugcccag

SEQ ID NO: 681511 - RNA, 22 nt, Human
uuuugggugaauuugccaguua

SEQ ID NO: 681512 - RNA, 19 nt, Human
ggccuugcucuguggcagc

SEQ ID NO: 681513 - RNA, 22 nt, Human
cagugcagaggugcaagcaugu

SEQ ID NO: 681514 - RNA, 22 nt, Human
gugcagggcagguguccuucca

SEQ ID NO: 681515 - RNA, 22 nt, Human
auacagaauacuaauuccugag

SEQ ID NO: 681516 - RNA, 22 nt, Human
ggcccagcugggcggggacacg

SEQ ID NO: 681517 - RNA, 23 nt, Human
agggagaugccacaaagaugccc

SEQ ID NO: 681518 - RNA, 22 nt, Human
cucaggccuugaagucuuuucu

SEQ ID NO: 681519 - RNA, 22 nt, Human
aauguguaaaugaggagucuug

SEQ ID NO: 681520 - RNA, 22 nt, Human
gacauucagccaauuacuuucu

SEQ ID NO: 681521 - RNA, 22 nt, Human
uaaaacuagugguugggacuaa

SEQ ID NO: 681522 - RNA, 20 nt, Human
gcccaggaucucugaggcau

SEQ ID NO: 681523 - RNA, 22 nt, Human
aucacaguguagaccuuuuaaa

SEQ ID NO: 681524 - RNA, 22 nt, Human
uggaggaaucagggcuuaggcu

SEQ ID NO: 681525 - RNA, 22 nt, Human
auaacuugauguuauuugucca

SEQ ID NO: 681526 - RNA, 22 nt, Human
uuuuggcacugcgucuacaugg

SEQ ID NO: 681527 - RNA, 23 nt, Human
gggagccauggguggucauggag

SEQ ID NO: 681528 - RNA, 22 nt, Human
aggcccugcggaaaugaucauu

SEQ ID NO: 681529 - RNA, 19 nt, Human
gucaggcacgugagagcau

SEQ ID NO: 681530 - RNA, 22 nt, Human
uggcucugagacacaggcucuc

SEQ ID NO: 681531 - RNA, 22 nt, Human
aggaggcugaacuagggucugg

SEQ ID NO: 681532 - RNA, 22 nt, Human
agauggcugggagcucuguuug

SEQ ID NO: 681533 - RNA, 22 nt, Human
uaugucuuguguuugcuaaucu

SEQ ID NO: 681534 - RNA, 22 nt, Human
uucaguuucaaauccugugaag

SEQ ID NO: 681535 - RNA, 18 nt, Human
ggaaggugaugugaaaag

SEQ ID NO: 681536 - RNA, 22 nt, Human
aaggccugaacaugaggagaug

SEQ ID NO: 681537 - RNA, 22 nt, Human
uuucucauuuagaguggcaggg

SEQ ID NO: 681538 - RNA, 22 nt, Human
aaaugugcuaaaguauuaacau

SEQ ID NO: 681539 - RNA, 22 nt, Human
gcucuggguucugauuuaugag

SEQ ID NO: 681540 - RNA, 22 nt, Human
uuacacaguauccaagguucuu

SEQ ID NO: 681541 - RNA, 22 nt, Human
ugcugccugcuacgagggaaga

SEQ ID NO: 681542 - RNA, 22 nt, Human
ucagggcucagugggauagguc

SEQ ID NO: 681543 - RNA, 22 nt, Human
ucaaucaaagccagauguccuu

SEQ ID NO: 681544 - RNA, 22 nt, Human
gcugggcucuuaucaccuguac

SEQ ID NO: 681545 - RNA, 22 nt, Human
cagacaggcuagccagacucac

SEQ ID NO: 681546 - RNA, 22 nt, Human
uacuuucuagcucuccccaguu

SEQ ID NO: 681547 - RNA, 22 nt, Human
agccagggaaggauaacaagaa

SEQ ID NO: 681548 - RNA, 22 nt, Human
gcacaauaacagccaagguuau

SEQ ID NO: 681549 - RNA, 21 nt, Human
ucaggaagagcuucucccacu

SEQ ID NO: 681550 - RNA, 22 nt, Human
uucuggaaauguugcugaggcc

SEQ ID NO: 681551 - RNA, 22 nt, Human
gggcauggugaugugcaccugu

SEQ ID NO: 681552 - RNA, 22 nt, Human
ucuguacauuuggggaccccag

SEQ ID NO: 681553 - RNA, 22 nt, Human
ggcacagcugaugcagacacac

SEQ ID NO: 681554 - RNA, 20 nt, Human
uacaaaccuccacacuggug

SEQ ID NO: 681555 - RNA, 22 nt, Human
uauacaguaucuuuugaaggca

SEQ ID NO: 681556 - RNA, 20 nt, Human
gcugccuguuucuguaagua

SEQ ID NO: 681557 - RNA, 20 nt, Human
uagagagaggauauuaaagu

SEQ ID NO: 681558 - RNA, 22 nt, Human
gagacagagaucuugcugaguc

SEQ ID NO: 681559 - RNA, 22 nt, Human
ccugagccucuugcacgcucag

SEQ ID NO: 681560 - RNA, 22 nt, Human
cugggcugcagcgggagcgacg

SEQ ID NO: 681561 - RNA, 22 nt, Human
gcugcugugugggagacaggcg

SEQ ID NO: 681562 - RNA, 22 nt, Human
uacuuuggaagaguucauacag

SEQ ID NO: 681563 - RNA, 22 nt, Human
uuccaggauagcuuucaggaau

SEQ ID NO: 681564 - RNA, 22 nt, Human
acagcucuguugccagaucugc

SEQ ID NO: 681565 - RNA, 22 nt, Human
gcuuccagcaccagcagagggg

SEQ ID NO: 681566 - RNA, 22 nt, Human
uccuuugguuguagacaggaau

SEQ ID NO: 681567 - RNA, 22 nt, Human
gggcagcaaaucugagucuggu

SEQ ID NO: 681568 - RNA, 22 nt, Human
ucagcauuccugaagacaagca

SEQ ID NO: 681569 - RNA, 20 nt, Human
cucagaaaagcuaaggagaa

SEQ ID NO: 681570 - RNA, 22 nt, Human
aucuacaggauuuuacagaguu

SEQ ID NO: 681571 - RNA, 22 nt, Human
agauaauuauuuacuucaaagu

SEQ ID NO: 681572 - RNA, 22 nt, Human
ccaguucuaaacauaaagcuaa

SEQ ID NO: 681573 - RNA, 22 nt, Human
cugcugugugaccauggacagg

SEQ ID NO: 681574 - RNA, 22 nt, Human
uuuacaagucuguugaucccaa

SEQ ID NO: 681575 - RNA, 22 nt, Human
uggagaagauuggucaccauuc

SEQ ID NO: 681576 - RNA, 22 nt, Human
cagccucugacaccacagucgu

SEQ ID NO: 681577 - RNA, 22 nt, Human
aaaguuguucaguaagaaacuc

SEQ ID NO: 681578 - RNA, 22 nt, Human
gcagcccaagccugagcauccu

SEQ ID NO: 681579 - RNA, 22 nt, Human
uccucagucucuaaggccucag

SEQ ID NO: 681580 - RNA, 22 nt, Human
cagggccucauccucagagauu

SEQ ID NO: 681581 - RNA, 22 nt, Human
ccucugggccagccuggacccu

SEQ ID NO: 681582 - RNA, 22 nt, Human
uuuaaugugacaucuuuuagag

SEQ ID NO: 681583 - RNA, 22 nt, Human
aaaugcuuguauauuucuuggu

SEQ ID NO: 681584 - RNA, 22 nt, Human
ugcuggagcggaggugagccag

SEQ ID NO: 681585 - RNA, 22 nt, Human
auaguauuuccagaaauagucu

SEQ ID NO: 681586 - RNA, 22 nt, Human
cagcuggcguggagugauugca

SEQ ID NO: 681587 - RNA, 22 nt, Human
cuuaagaagcaagucucagcaa

SEQ ID NO: 681588 - RNA, 22 nt, Human
gcauggcuccugucuuacuccc

SEQ ID NO: 681589 - RNA, 22 nt, Human
ugcuccuggcuccuucccuaac

SEQ ID NO: 681590 - RNA, 22 nt, Human
aggugggguucagucucagccg

SEQ ID NO: 681591 - RNA, 22 nt, Human
aaacugcaauuacuuuugcacc

SEQ ID NO: 681592 - RNA, 22 nt, Human
ucuggcagugagcaacuugaca

SEQ ID NO: 681593 - RNA, 22 nt, Human
aaagcauuacuagacuggauuu

SEQ ID NO: 681594 - RNA, 22 nt, Human
ccuccaggcugguuaucagcug

SEQ ID NO: 681595 - RNA, 22 nt, Human
uguaguaagugcgcaauaaaua

SEQ ID NO: 681596 - RNA, 22 nt, Human
auucauaacggcaaaugucacc

SEQ ID NO: 681597 - RNA, 22 nt, Human
aagaugguguggucaaggacca

SEQ ID NO: 681598 - RNA, 22 nt, Human
guacauguugguuguuuccagu

SEQ ID NO: 681599 - RNA, 22 nt, Human
uuugcuuugacugucagcaagu

SEQ ID NO: 681600 - RNA, 22 nt, Human
aagcaugggaaucccacagggu

SEQ ID NO: 681601 - RNA, 22 nt, Human
uaaaguauaagcauuggaguau

SEQ ID NO: 681602 - RNA, 22 nt, Human
uuacaagauaugugagaacuag

SEQ ID NO: 681603 - RNA, 22 nt, Human
uggcucugucaaacugcacaca

SEQ ID NO: 681604 - RNA, 21 nt, Human
ucagggcagugggagguuccu

SEQ ID NO: 681605 - RNA, 22 nt, Human
uccuuaaaugugaucuagauuu

SEQ ID NO: 681606 - RNA, 22 nt, Human
ucuggaaucagaccuaauccca

SEQ ID NO: 681607 - RNA, 22 nt, Human
uguacaccugucuuuacacaua

SEQ ID NO: 681608 - RNA, 22 nt, Human
gauggcuucucucuagcuuggu

SEQ ID NO: 681609 - RNA, 22 nt, Human
ggaaaucaugggagaguuggaa

SEQ ID NO: 681610 - RNA, 18 nt, Human
gaaagaugaacuuuuuuc

SEQ ID NO: 681611 - RNA, 22 nt, Human
ucugguaaccuuuaucccuccu

SEQ ID NO: 681612 - RNA, 22 nt, Human
auguuuuauguuccacucaagg

SEQ ID NO: 681613 - RNA, 21 nt, Human
guguuuccuguuuauggcuug

SEQ ID NO: 681614 - RNA, 17 nt, Human
uagcagcaguaauugug

SEQ ID NO: 681615 - RNA, 22 nt, Human
uauuucauucuuuaucaggagc

SEQ ID NO: 681616 - RNA, 22 nt, Human
ugcagggagggcccagcaaucu

SEQ ID NO: 681617 - RNA, 22 nt, Human
ucugugcugcccaacuucucaa

SEQ ID NO: 681618 - RNA, 22 nt, Human
uagacauuauguauuaaguucu

SEQ ID NO: 681619 - RNA, 22 nt, Human
cuuuucuucucacggcugucag

SEQ ID NO: 681620 - RNA, 22 nt, Human
cuggcccugucagcacagaauc

SEQ ID NO: 681621 - RNA, 22 nt, Human
cacaugaauucacauguauuuu

SEQ ID NO: 681622 - RNA, 22 nt, Human
auuacaguucuacacauccuuu

SEQ ID NO: 681623 - RNA, 22 nt, Human
gugugagggacagagaaagggg

SEQ ID NO: 681624 - RNA, 22 nt, Human
agcaguguuggugggagcaucu

SEQ ID NO: 681625 - RNA, 22 nt, Human
aacuacagcaucuauacaaaua

SEQ ID NO: 681626 - RNA, 19 nt, Human
ucagaacucagaaugugua

SEQ ID NO: 681627 - RNA, 22 nt, Human
aggagcuucagagagaaccugg

SEQ ID NO: 681628 - RNA, 22 nt, Human
uaauacagauacaaaggaggac

SEQ ID NO: 681629 - RNA, 22 nt, Human
cagaaagcuugguacaauaugc

SEQ ID NO: 681630 - RNA, 22 nt, Human
ugaauggauauaacaacagugu

SEQ ID NO: 681631 - RNA, 22 nt, Human
ugggagaaagaacccugaguga

SEQ ID NO: 681632 - RNA, 22 nt, Human
cgcuaggauuaggauuaauccu

SEQ ID NO: 681633 - RNA, 22 nt, Human
cccuggaguccggagcucaccu

SEQ ID NO: 681634 - RNA, 22 nt, Human
cagacagaggcuguaugagggc

SEQ ID NO: 681635 - RNA, 22 nt, Human
ggguuaaaacaggaagaucagc

SEQ ID NO: 681636 - RNA, 20 nt, Human
acacuguucuucacacauuu

SEQ ID NO: 681637 - RNA, 22 nt, Human
uucuuagugguagucaucuuug

SEQ ID NO: 681638 - RNA, 22 nt, Human
cccuugggcuuccacccagccc

SEQ ID NO: 681639 - RNA, 22 nt, Human
aaagauguuaugaaauaacuau

SEQ ID NO: 681640 - RNA, 22 nt, Human
ugucuccugagagcuggacaga

SEQ ID NO: 681641 - RNA, 22 nt, Human
guuuuauaguucgggaccuguu

SEQ ID NO: 681642 - RNA, 23 nt, Human
uggaggcaggaugcuaaggaguc

SEQ ID NO: 681643 - RNA, 22 nt, Human
gaagguccagcguggccaaguc

SEQ ID NO: 681644 - RNA, 22 nt, Human
ccagcccuugagauggaaggga

SEQ ID NO: 681645 - RNA, 22 nt, Human
uaguugaagagaugaaugacca

SEQ ID NO: 681646 - RNA, 22 nt, Human
ucugcugacauuuaugaauaga

SEQ ID NO: 681647 - RNA, 22 nt, Human
ccucuacuuaccacucagccag

SEQ ID NO: 681648 - RNA, 22 nt, Human
auuguaaguagaaauguuaugg

SEQ ID NO: 681649 - RNA, 22 nt, Human
aucauuuuuaagagacucuucu

SEQ ID NO: 681650 - RNA, 22 nt, Human
uaugaaugcuccaguaacuuuc

SEQ ID NO: 681651 - RNA, 22 nt, Human
uaugauaugcacuuuaucagaa

SEQ ID NO: 681652 - RNA, 21 nt, Human
ugacauuuaguagcauuguca

SEQ ID NO: 681653 - RNA, 22 nt, Human
accuagcugaggagugugagug

SEQ ID NO: 681654 - RNA, 22 nt, Human
auaauuuaauuuucacaguggu

SEQ ID NO: 681655 - RNA, 22 nt, Human
aagcaaaggaaagcugacuuuu

SEQ ID NO: 681656 - RNA, 22 nt, Human
ugugguuuacuguggcgcugcu

SEQ ID NO: 681657 - RNA, 22 nt, Human
guaaacaucagccacucuauuu

SEQ ID NO: 681658 - RNA, 22 nt, Human
ccugaggcuuaaucugucccaa

SEQ ID NO: 681659 - RNA, 22 nt, Human
guggucagaauggagcccagga

SEQ ID NO: 681660 - RNA, 22 nt, Human
uuuacaaggcaguuauuuuccu

SEQ ID NO: 681661 - RNA, 22 nt, Human
acuuagcagaguugaauguacu

SEQ ID NO: 681662 - RNA, 22 nt, Human
gagaaagauguaggcugggagg

SEQ ID NO: 681663 - RNA, 20 nt, Human
gaagcagcuucauguagaca

SEQ ID NO: 681664 - RNA, 22 nt, Human
auuugcagauucugucagguuu

SEQ ID NO: 681665 - RNA, 19 nt, Human
ugucuccucaugcaagugu

SEQ ID NO: 681666 - RNA, 20 nt, Human
ugggagaagaacacuggaac

SEQ ID NO: 681667 - RNA, 22 nt, Human
uugauuuguaggaauggagacc

SEQ ID NO: 681668 - RNA, 21 nt, Human
ucacaucuauguuaagcaaac

SEQ ID NO: 681669 - RNA, 22 nt, Human
ucucccaagugaccaggaaaga

SEQ ID NO: 681670 - RNA, 22 nt, Human
uccagcugccaaccgggccccg

SEQ ID NO: 681671 - RNA, 22 nt, Human
cccagaggggucgucugagggg

SEQ ID NO: 681672 - RNA, 22 nt, Human
uguuuacuuuuaauuaccuguc

SEQ ID NO: 681673 - RNA, 22 nt, Human
ucucagccucaccucuauggag

SEQ ID NO: 681674 - RNA, 22 nt, Human
agcccuggcagagccagguagu

SEQ ID NO: 681675 - RNA, 22 nt, Human
ucuuaacuaucauuugaacacc

SEQ ID NO: 681676 - RNA, 22 nt, Human
gcucucucccuaggcaagugag

SEQ ID NO: 681677 - RNA, 22 nt, Human
auugauaaauugcaauggggcu

SEQ ID NO: 681678 - RNA, 22 nt, Human
aucacaaaggguuuucucugag

SEQ ID NO: 681679 - RNA, 22 nt, Human
gggagggaucugcuaggcaaug

SEQ ID NO: 681680 - RNA, 22 nt, Human
uuuccuugccuccuguccuucu

SEQ ID NO: 681681 - RNA, 22 nt, Human
uagaggugucacuuugggaagu

SEQ ID NO: 681682 - RNA, 22 nt, Human
cacacugucuuuaugagcugua

SEQ ID NO: 681683 - RNA, 21 nt, Human
uucauaaaccauucucaugca

SEQ ID NO: 681684 - RNA, 22 nt, Human
aaggccuucuaccaaggcuggg

SEQ ID NO: 681685 - RNA, 22 nt, Human
gaaagcacauacuauaaaucac

SEQ ID NO: 681686 - RNA, 22 nt, Human
uagcugggacuacuggcccugc

SEQ ID NO: 681687 - RNA, 22 nt, Human
gugucuguuauacagaggagac

SEQ ID NO: 681688 - RNA, 23 nt, Human
gaaguucuuucuucucaugcugu

SEQ ID NO: 681689 - RNA, 22 nt, Human
uugcugaaaacaguggguauug

SEQ ID NO: 681690 - RNA, 22 nt, Human
uugaggucuucaggaucaggcu

SEQ ID NO: 681691 - RNA, 22 nt, Human
aguccuggcauggaauuguccc

SEQ ID NO: 681692 - RNA, 22 nt, Human
aggcucugggcucuagauuuug

SEQ ID NO: 681693 - RNA, 22 nt, Human
ucccaagagcucugggauaagg

SEQ ID NO: 681694 - RNA, 22 nt, Human
guggcagagccuugcggcuuug

SEQ ID NO: 681695 - RNA, 22 nt, Human
ucugcugcugaccaacacugug

SEQ ID NO: 681696 - RNA, 22 nt, Human
aaagccauugaacuguacuuua

SEQ ID NO: 681697 - RNA, 22 nt, Human
ucaaaggcugcuugucuucugg

SEQ ID NO: 681698 - RNA, 22 nt, Human
ugcccaagauccuacauccuga

SEQ ID NO: 681699 - RNA, 22 nt, Human
aaauuucaagcaaaguagcuau

SEQ ID NO: 681700 - RNA, 22 nt, Human
cugcagggagaggggacagccu

SEQ ID NO: 681701 - RNA, 17 nt, Human
gcuucuggagcuucugu

SEQ ID NO: 681702 - RNA, 22 nt, Human
cuauuuggauguuagccucagu

SEQ ID NO: 681703 - RNA, 22 nt, Human
uaaaggccagggccugagugcu

SEQ ID NO: 681704 - RNA, 22 nt, Human
cggggcuuggaccagccacccc

SEQ ID NO: 681705 - RNA, 22 nt, Human
uuucuuauacuauauugucauc

SEQ ID NO: 681706 - RNA, 22 nt, Human
uguuaucagagagaggugcugu

SEQ ID NO: 681707 - RNA, 22 nt, Human
uuucuucagagagagcuuuccc

SEQ ID NO: 681708 - RNA, 22 nt, Human
gggguccucggagccugggucu

SEQ ID NO: 681709 - RNA, 22 nt, Human
uguaaugagaaagagagugaau

SEQ ID NO: 681710 - RNA, 21 nt, Human
agcuggcagauauggugucug

SEQ ID NO: 681711 - RNA, 20 nt, Human
ucccucagcacuucuaccuc

SEQ ID NO: 681712 - RNA, 22 nt, Human
acacuggguaacauaucuguua

SEQ ID NO: 681713 - RNA, 22 nt, Human
auucuuaauuccaaagacugag

SEQ ID NO: 681714 - RNA, 22 nt, Human
aacaggcaacaguugacucuga

SEQ ID NO: 681715 - RNA, 22 nt, Human
gcuccuggcuccaggcagccaa

SEQ ID NO: 681716 - RNA, 22 nt, Human
ugagaauuuuuggcagaaacaa

SEQ ID NO: 681717 - RNA, 22 nt, Human
gaagauuugaaacacauagaca

SEQ ID NO: 681718 - RNA, 22 nt, Human
aggucaugauccauuggugagu

SEQ ID NO: 681719 - RNA, 22 nt, Human
gcagugcugaucccauggcaga

SEQ ID NO: 681720 - RNA, 22 nt, Human
cauugcuuauuucagcuaaagu

SEQ ID NO: 681721 - RNA, 22 nt, Human
acauugaauuucacuuuuguac

SEQ ID NO: 681722 - RNA, 22 nt, Human
ggagaaggcgaagucauucuuu

SEQ ID NO: 681723 - RNA, 22 nt, Human
uauucuugucuuuuccagaaau

SEQ ID NO: 681724 - RNA, 20 nt, Human
gcccaagguccagaaggggg

SEQ ID NO: 681725 - RNA, 22 nt, Human
ggccagguaagagugcagccgc

SEQ ID NO: 681726 - RNA, 22 nt, Human
uggacagcuugcagagccaccc

SEQ ID NO: 681727 - RNA, 22 nt, Human
agaagcauuggaccaggggccc

SEQ ID NO: 681728 - RNA, 22 nt, Human
gcuggcugaguucugucgucug

SEQ ID NO: 681729 - RNA, 22 nt, Human
augucuuucgcaucaguagcua

SEQ ID NO: 681730 - RNA, 22 nt, Human
ucaggugggaccugcuaggaca

SEQ ID NO: 681731 - RNA, 22 nt, Human
gcauggaugggaguggacagau

SEQ ID NO: 681732 - RNA, 20 nt, Human
ccagguggugccuggagagg

SEQ ID NO: 681733 - RNA, 22 nt, Human
agugacaugcucucaggcauaa

SEQ ID NO: 681734 - RNA, 22 nt, Human
uagaagcaccacucaucacgug

SEQ ID NO: 681735 - RNA, 22 nt, Human
gucaaacaaauuaacauaucca

SEQ ID NO: 681736 - RNA, 22 nt, Human
gacaguuuaagcaccuaauauu

SEQ ID NO: 681737 - RNA, 22 nt, Human
guuucuuaccacuuggaccucu

SEQ ID NO: 681738 - RNA, 22 nt, Human
ugugugugugcgcgcacgcaua

SEQ ID NO: 681739 - RNA, 22 nt, Human
ggcuuuuguuucagcucugcua

SEQ ID NO: 681740 - RNA, 22 nt, Human
cccucccaagcacucugacaua

SEQ ID NO: 681741 - RNA, 20 nt, Human
cacaggccccaagaccugua

SEQ ID NO: 681742 - RNA, 22 nt, Human
uguuuagacucaaaauugaaag

SEQ ID NO: 681743 - RNA, 22 nt, Human
guucuccauucagcuuccugug

SEQ ID NO: 681744 - RNA, 22 nt, Human
gcagacuggucuucagccuugg

SEQ ID NO: 681745 - RNA, 22 nt, Human
gagucagacagggucacccaga

SEQ ID NO: 681746 - RNA, 22 nt, Human
ggcacugagaacaggcugacuu

SEQ ID NO: 681747 - RNA, 22 nt, Human
gccuggcuggucacugccuggc

SEQ ID NO: 681748 - RNA, 22 nt, Human
ucccugcuuucuugugagggga

SEQ ID NO: 681749 - RNA, 22 nt, Human
agcuccugauucucagagauag

SEQ ID NO: 681750 - RNA, 19 nt, Human
ccaggaccuuuccaggguc

SEQ ID NO: 681751 - RNA, 22 nt, Human
ucaacauacauacauggucagg

SEQ ID NO: 681752 - RNA, 22 nt, Human
ugggacaggaggccucuggaga

SEQ ID NO: 681753 - RNA, 22 nt, Human
ugcauuaugcuacccagaagcu

SEQ ID NO: 681754 - RNA, 22 nt, Human
agcaacagcccugagguucaug

SEQ ID NO: 681755 - RNA, 22 nt, Human
uuggagggucuuccacagccau

SEQ ID NO: 681756 - RNA, 22 nt, Human
gggaggagugaagauucaccug

SEQ ID NO: 681757 - RNA, 18 nt, Human
ugucugcuucuccaacuc

SEQ ID NO: 681758 - RNA, 22 nt, Human
cacuucuguugccuugugcaau

SEQ ID NO: 681759 - RNA, 22 nt, Human
cugucucucuaggacacugggg

SEQ ID NO: 681760 - RNA, 22 nt, Human
gugaggauacuuaagagaacac

SEQ ID NO: 681761 - RNA, 22 nt, Human
cagggcuugaaucaaggaaguc

SEQ ID NO: 681762 - RNA, 21 nt, Human
cuggaucugucaucgaguuuu

SEQ ID NO: 681763 - RNA, 22 nt, Human
uuugucuuggccucaguuuucu

SEQ ID NO: 681764 - RNA, 22 nt, Human
caguccagagcccaccagagga

SEQ ID NO: 681765 - RNA, 22 nt, Human
uagaucauuagcgggggugaga

SEQ ID NO: 681766 - RNA, 22 nt, Human
gcugccuguguggccacucacu

SEQ ID NO: 681767 - RNA, 22 nt, Human
gggcuagaaauucugcagugga

SEQ ID NO: 681768 - RNA, 22 nt, Human
uguccagaucaaugcccacaug

SEQ ID NO: 681769 - RNA, 23 nt, Human
cauguuuuucuaucucagcgugu

SEQ ID NO: 681770 - RNA, 22 nt, Human
acauugaaagcauauuaucucc

SEQ ID NO: 681771 - RNA, 22 nt, Human
aaggcagccuuuugaguugauu

SEQ ID NO: 681772 - RNA, 22 nt, Human
agccuucuaggaugucaucugc

SEQ ID NO: 681773 - RNA, 22 nt, Human
gcucucuuuaaacugcauggcu

SEQ ID NO: 681774 - RNA, 22 nt, Human
caaauguaaauucuuuugaagc

SEQ ID NO: 681775 - RNA, 22 nt, Human
cucuucuugcuagacugagugc

SEQ ID NO: 681776 - RNA, 22 nt, Human
acagaugaggcccaucagucug

SEQ ID NO: 681777 - RNA, 22 nt, Human
ccaggucuaucaaguugggcuc

SEQ ID NO: 681778 - RNA, 20 nt, Human
ugugugcaucuguauguauu

SEQ ID NO: 681779 - RNA, 22 nt, Human
uggggagaggaauuugaaugau

SEQ ID NO: 681780 - RNA, 21 nt, Human
acaaugcauggaacucauggc

SEQ ID NO: 681781 - RNA, 22 nt, Human
guacaauagucccuguuuggau

SEQ ID NO: 681782 - RNA, 18 nt, Human
gguggcggggauggaggu

SEQ ID NO: 681783 - RNA, 22 nt, Human
aucuggaguagaaaaaucgcuu

SEQ ID NO: 681784 - RNA, 22 nt, Human
cugucugcaggauaguacccuc

SEQ ID NO: 681785 - RNA, 22 nt, Human
uccccaggaaauucugauucuu

SEQ ID NO: 681786 - RNA, 22 nt, Human
ggcuccaggguaccccuggaug

SEQ ID NO: 681787 - RNA, 22 nt, Human
ucagaaaagagaaaaucuuaua

SEQ ID NO: 681788 - RNA, 22 nt, Human
aagaguuucugauucaguaggu

SEQ ID NO: 681789 - RNA, 22 nt, Human
agguauuuuauagauaaguaaa

SEQ ID NO: 681790 - RNA, 22 nt, Human
ggcagggcuugucucugugaug

SEQ ID NO: 681791 - RNA, 22 nt, Human
ggggcagagucuggacuguugu

SEQ ID NO: 681792 - RNA, 22 nt, Human
aaugaacaacacugaaggaaga

SEQ ID NO: 681793 - RNA, 22 nt, Human
gcaucuaauccaguccagcauc

SEQ ID NO: 681794 - RNA, 20 nt, Human
cacaagagaauacacacugg

SEQ ID NO: 681795 - RNA, 22 nt, Human
ucuguccauucagaauggcccu

SEQ ID NO: 681796 - RNA, 22 nt, Human
agggacuugaugucagggagau

SEQ ID NO: 681797 - RNA, 17 nt, Human
gugaagagucauugaau

SEQ ID NO: 681798 - RNA, 21 nt, Human
ccacugcucuucccuagggcc

SEQ ID NO: 681799 - RNA, 22 nt, Human
uucauugaaauacagucuugac

SEQ ID NO: 681800 - RNA, 22 nt, Human
uucauuuuuaccgcgugucaaa

SEQ ID NO: 681801 - RNA, 22 nt, Human
uuuccuaagguagugauaauuu

SEQ ID NO: 681802 - RNA, 23 nt, Human
acagggcuuaucugucacucauc

SEQ ID NO: 681803 - RNA, 22 nt, Human
ggagugucagaaacaguguccu

SEQ ID NO: 681804 - RNA, 22 nt, Human
uuccuacauuuguacaauaaga

SEQ ID NO: 681805 - RNA, 22 nt, Human
auagagauggguuuaguuauaa

SEQ ID NO: 681806 - RNA, 22 nt, Human
acugggccuugugugucucauc

SEQ ID NO: 681807 - RNA, 22 nt, Human
cugggaagaagugggcuacauu

SEQ ID NO: 681808 - RNA, 22 nt, Human
cugugggaacacugaggacuuc

SEQ ID NO: 681809 - RNA, 22 nt, Human
cucagaaaggugccauuuaugu

SEQ ID NO: 681810 - RNA, 20 nt, Human
gagcugugcucucaggagcc

SEQ ID NO: 681811 - RNA, 22 nt, Human
uagcagcaaagcaggaucugcu

SEQ ID NO: 681812 - RNA, 20 nt, Human
guacacauauauguaugugu

SEQ ID NO: 681813 - RNA, 22 nt, Human
aggcaguggcugagaccagggg

SEQ ID NO: 681814 - RNA, 22 nt, Human
ugaauccuaauucuaucacuua

SEQ ID NO: 681815 - RNA, 18 nt, Human
gccugggaggaggaaaug

SEQ ID NO: 681816 - RNA, 22 nt, Human
cucauucuuucacagucugugg

SEQ ID NO: 681817 - RNA, 22 nt, Human
ucugagagcuguagaagccuau

SEQ ID NO: 681818 - RNA, 22 nt, Human
gacagcagcauguuuacaggcc

SEQ ID NO: 681819 - RNA, 22 nt, Human
ccucugggcggagaucugcugc

SEQ ID NO: 681820 - RNA, 22 nt, Human
uacaagucauuggaugaggaau

SEQ ID NO: 681821 - RNA, 21 nt, Human
uccagcucuuauguucaugaa

SEQ ID NO: 681822 - RNA, 22 nt, Human
gugaagguggggagccucaguu

SEQ ID NO: 681823 - RNA, 22 nt, Human
cuguauucaagcuucugcccaa

SEQ ID NO: 681824 - RNA, 22 nt, Human
aguggccaauaugucaugcucu

SEQ ID NO: 681825 - RNA, 23 nt, Human
ucucuggccuuugaucagguuga

SEQ ID NO: 681826 - RNA, 22 nt, Human
gaggcuaagcacuggcauuucu

SEQ ID NO: 681827 - RNA, 22 nt, Human
uccagcuggccuaacuucaggg

SEQ ID NO: 681828 - RNA, 22 nt, Human
ccccucucccucacuuaucaau

SEQ ID NO: 681829 - RNA, 22 nt, Human
augaggucacaguguuuggcau

SEQ ID NO: 681830 - RNA, 22 nt, Human
aaaugaccagaauacaggcuuc

SEQ ID NO: 681831 - RNA, 22 nt, Human
uucacagccucugccccaggca

SEQ ID NO: 681832 - RNA, 22 nt, Human
agggucugacuccucuggcaag

SEQ ID NO: 681833 - RNA, 22 nt, Human
cacuggggugggccugguagag

SEQ ID NO: 681834 - RNA, 22 nt, Human
gggcuggcaggaccugggcuga

SEQ ID NO: 681835 - RNA, 22 nt, Human
augagacuaccuguaauguggc

SEQ ID NO: 681836 - RNA, 22 nt, Human
ugccaggcuguccugggccugg

SEQ ID NO: 681837 - RNA, 22 nt, Human
ucugaaagaaagauuuuguuuc

SEQ ID NO: 681838 - RNA, 22 nt, Human
auuucuuaucugaggucuacau

SEQ ID NO: 681839 - RNA, 22 nt, Human
ugauggaaauguucuguaucug

SEQ ID NO: 681840 - RNA, 22 nt, Human
ccagaggaucaguacuggcugg

SEQ ID NO: 681841 - RNA, 22 nt, Human
gcuuccaggggcugugggcuga

SEQ ID NO: 681842 - RNA, 22 nt, Human
ccuuuggcccugagagaugauu

SEQ ID NO: 681843 - RNA, 22 nt, Human
gacacagagcucacagucuccu

SEQ ID NO: 681844 - RNA, 22 nt, Human
gaguaagagcuggcuuuggugu

SEQ ID NO: 681845 - RNA, 22 nt, Human
ucagggagccuggacuucaagg

SEQ ID NO: 681846 - RNA, 22 nt, Human
aauucaaagccgcuugggaauc

SEQ ID NO: 681847 - RNA, 22 nt, Human
cuuggccugcccagccagaagg

SEQ ID NO: 681848 - RNA, 22 nt, Human
agagauguucauucagcauguu

SEQ ID NO: 681849 - RNA, 22 nt, Human
uaugcacgucuauuuaugaaga

SEQ ID NO: 681850 - RNA, 22 nt, Human
gcugcugugaauuuuuuaaaug

SEQ ID NO: 681851 - RNA, 19 nt, Human
ccagcagaagccacuccug

SEQ ID NO: 681852 - RNA, 17 nt, Human
ugcaggcuguuauagcc

SEQ ID NO: 681853 - RNA, 22 nt, Human
uggaggccaaggcaggcggauc

SEQ ID NO: 681854 - RNA, 22 nt, Human
gccuggcucccucugcagcucc

SEQ ID NO: 681855 - RNA, 22 nt, Human
auaaugcagcuuuucaauggcc

SEQ ID NO: 681856 - RNA, 22 nt, Human
cgcaccacugaauuccagccug

SEQ ID NO: 681857 - RNA, 22 nt, Human
ccaguggacaauuucugaggaa

SEQ ID NO: 681858 - RNA, 22 nt, Human
uguaucaaaccaaauuaauucu

SEQ ID NO: 681859 - RNA, 19 nt, Human
caggaaugagguaauggcu

SEQ ID NO: 681860 - RNA, 23 nt, Human
uuuuauugauauguagcuguugu

SEQ ID NO: 681861 - RNA, 22 nt, Human
gaauugcuagcgcaccaauucu

SEQ ID NO: 681862 - RNA, 22 nt, Human
auguuuauuguuuuaagcugcu

SEQ ID NO: 681863 - RNA, 17 nt, Human
auuucccagcagugcua

SEQ ID NO: 681864 - RNA, 22 nt, Human
ggcuggaacuucuucuggcauu

SEQ ID NO: 681865 - RNA, 22 nt, Human
cacagguccuuccugcccuggg

SEQ ID NO: 681866 - RNA, 22 nt, Human
uacucagagucauugcccuucu

SEQ ID NO: 681867 - RNA, 22 nt, Human
cugcugacucauuuucaacacu

SEQ ID NO: 681868 - RNA, 22 nt, Human
cugagaaauacccaagucuggu

SEQ ID NO: 681869 - RNA, 19 nt, Human
uuugauaucugaauuaugc

SEQ ID NO: 681870 - RNA, 22 nt, Human
uggcucaggggucuggcucugu

SEQ ID NO: 681871 - RNA, 22 nt, Human
agcaggcagcugggggaguuga

SEQ ID NO: 681872 - RNA, 23 nt, Human
aauaucaaggugauguucccaga

SEQ ID NO: 681873 - RNA, 22 nt, Human
cuuggccagacagggagcucca

SEQ ID NO: 681874 - RNA, 22 nt, Human
ucagccuccuaauuuccuguga

SEQ ID NO: 681875 - RNA, 22 nt, Human
gcucugagaggugcagcaguaa

SEQ ID NO: 681876 - RNA, 22 nt, Human
ccaugaguagcgauuucauuuu

SEQ ID NO: 681877 - RNA, 22 nt, Human
ccagugcacagccaggcaggug

SEQ ID NO: 681878 - RNA, 22 nt, Human
gaagaucaagugucauucugug

SEQ ID NO: 681879 - RNA, 22 nt, Human
gcagcccaggagcaggcgaccc

SEQ ID NO: 681880 - RNA, 22 nt, Human
ucaguguucagggaccaggucc

SEQ ID NO: 681881 - RNA, 22 nt, Human
uggcucagagccuugagagcug

SEQ ID NO: 681882 - RNA, 22 nt, Human
gagcuuuaggagaaggagguca

SEQ ID NO: 681883 - RNA, 22 nt, Human
uuuaucugauauucagcgauuu

SEQ ID NO: 681884 - RNA, 22 nt, Human
uuccuucccucaguggcugaag

SEQ ID NO: 681885 - RNA, 22 nt, Human
cagaggcugaugugggaugggc

SEQ ID NO: 681886 - RNA, 22 nt, Human
cagagcucagagcugccaggca

SEQ ID NO: 681887 - RNA, 22 nt, Human
agacaacuagaaaacuagacag

SEQ ID NO: 681888 - RNA, 22 nt, Human
ucuacaguagaaagaucccagu

SEQ ID NO: 681889 - RNA, 22 nt, Human
uccaggcuaauuuugcauuguu

SEQ ID NO: 681890 - RNA, 22 nt, Human
acccaggguagagugcaguggc

SEQ ID NO: 681891 - RNA, 22 nt, Human
cuugcugucccuugguaugaac

SEQ ID NO: 681892 - RNA, 22 nt, Human
auaagaugagaucagcuuucug

SEQ ID NO: 681893 - RNA, 22 nt, Human
aagguagcuugcuuccugagua

SEQ ID NO: 681894 - RNA, 22 nt, Human
uuuauuaauuagugacccaaug

SEQ ID NO: 681895 - RNA, 22 nt, Human
aaagcagcagcaccugcauuuc

SEQ ID NO: 681896 - RNA, 22 nt, Human
ucaggaaguauaaucagauuca

SEQ ID NO: 681897 - RNA, 22 nt, Human
agaggcaaggcaggauucuucu

SEQ ID NO: 681898 - RNA, 22 nt, Human
agacaaagaaaccguagaagca

SEQ ID NO: 681899 - RNA, 22 nt, Human
cuccucugucuggcccugagcc

SEQ ID NO: 681900 - RNA, 22 nt, Human
uuuuuagaguguuaccaguaua

SEQ ID NO: 681901 - RNA, 19 nt, Human
caucuggaugauucuccug

SEQ ID NO: 681902 - RNA, 22 nt, Human
uaugcauucagagguugggugu

SEQ ID NO: 681903 - RNA, 22 nt, Human
uggcuggcaaggcuggagucag

SEQ ID NO: 681904 - RNA, 22 nt, Human
uauguucuaggaaugguugaug

SEQ ID NO: 681905 - RNA, 22 nt, Human
aguuugaaaguauugacagaag

SEQ ID NO: 681906 - RNA, 22 nt, Human
ugggaauugaggugauugugag

SEQ ID NO: 681907 - RNA, 22 nt, Human
ugugaacuuacuguccccacag

SEQ ID NO: 681908 - RNA, 17 nt, Human
uaaagaucagccaugua

SEQ ID NO: 681909 - RNA, 22 nt, Human
gucuccugaggcauccauugaa

SEQ ID NO: 681910 - RNA, 22 nt, Human
cucugugguaaaauagcaguau

SEQ ID NO: 681911 - RNA, 22 nt, Human
ugcugccacauuuaaagagggg

SEQ ID NO: 681912 - RNA, 23 nt, Human
ugccuccaccgagggccaggcau

SEQ ID NO: 681913 - RNA, 23 nt, Human
agagggugcaacauggggaucua

SEQ ID NO: 681914 - RNA, 22 nt, Human
uguuuucaagucaaggccaaau

SEQ ID NO: 681915 - RNA, 22 nt, Human
gagcccuguaggaaucucucaa

SEQ ID NO: 681916 - RNA, 22 nt, Human
ccagucccagcucugccaugcu

SEQ ID NO: 681917 - RNA, 22 nt, Human
gagucacaaagccuuucuuauu

SEQ ID NO: 681918 - RNA, 22 nt, Human
cuucuucauguauugauagucu

SEQ ID NO: 681919 - RNA, 22 nt, Human
uuuuuccuuagggguuacucac

SEQ ID NO: 681920 - RNA, 22 nt, Human
auguguguguuuaauccucaaa

SEQ ID NO: 681921 - RNA, 23 nt, Human
aaccugaacuagggucuugcaua

SEQ ID NO: 681922 - RNA, 22 nt, Human
ugccauggccuagaccugugau

SEQ ID NO: 681923 - RNA, 22 nt, Human
uguccugugcacuguagcaugu

SEQ ID NO: 681924 - RNA, 22 nt, Human
caggaggccaacugugggacuu

SEQ ID NO: 681925 - RNA, 22 nt, Human
aggcuccacggucacuggcucu

SEQ ID NO: 681926 - RNA, 22 nt, Human
agaacagguucaggguauaaaa

SEQ ID NO: 681927 - RNA, 22 nt, Human
guucucuaucauuagugaauuu

SEQ ID NO: 681928 - RNA, 22 nt, Human
gcuuccuggagggagagagcug

SEQ ID NO: 681929 - RNA, 22 nt, Human
ccuguguucuaauccaucucag

SEQ ID NO: 681930 - RNA, 22 nt, Human
aggaggaggcuggaguacaccc

SEQ ID NO: 681931 - RNA, 22 nt, Human
aguguuuauuuacagaugguuu

SEQ ID NO: 681932 - RNA, 22 nt, Human
uacugaaauggcagauauauaa

SEQ ID NO: 681933 - RNA, 22 nt, Human
cauuccagcucucauacucugg

SEQ ID NO: 681934 - RNA, 22 nt, Human
acuugguugaugucauaagguu

SEQ ID NO: 681935 - RNA, 22 nt, Human
uaagaagcuucugcuaaugccu

SEQ ID NO: 681936 - RNA, 22 nt, Human
cagguccaguaaaaagaguccu

SEQ ID NO: 681937 - RNA, 22 nt, Human
gugaggacuaguggguuugugc

SEQ ID NO: 681938 - RNA, 22 nt, Human
ugcagcuguaacagaggccuca

SEQ ID NO: 681939 - RNA, 22 nt, Human
gagguagcucuuacucucuccg

SEQ ID NO: 681940 - RNA, 22 nt, Human
uaacagaagagcaggcagcccu

SEQ ID NO: 681941 - RNA, 22 nt, Human
ggucgugaauugaaucaguggc

SEQ ID NO: 681942 - RNA, 22 nt, Human
accugugcaaagacuggucagg

SEQ ID NO: 681943 - RNA, 22 nt, Human
cggagaggugggggcagcaucu

SEQ ID NO: 681944 - RNA, 22 nt, Human
gcucccugaaaagaacaaaguc

SEQ ID NO: 681945 - RNA, 22 nt, Human
uguuauuucuuugccauaucuu

SEQ ID NO: 681946 - RNA, 22 nt, Human
ugaguggaguagugaaugcauu

SEQ ID NO: 681947 - RNA, 22 nt, Human
gugugccuuaagcucuauagac

SEQ ID NO: 681948 - RNA, 22 nt, Human
gaagagcauuugcccaggcugu

SEQ ID NO: 681949 - RNA, 22 nt, Human
aguccggggucuggacaccugg

SEQ ID NO: 681950 - RNA, 19 nt, Human
ucugucacuggggguauuc

SEQ ID NO: 681951 - RNA, 20 nt, Human
ugcaggaauuugcauuccuu

SEQ ID NO: 681952 - RNA, 22 nt, Human
ucccagaggcuccagucucuau

SEQ ID NO: 681953 - RNA, 23 nt, Human
uuuauagcagcaugauuuauaau

SEQ ID NO: 681954 - RNA, 22 nt, Human
ccucuauguacacauuuccagc

SEQ ID NO: 681955 - RNA, 22 nt, Human
aguuaacucauuuuauaaugcc

SEQ ID NO: 681956 - RNA, 22 nt, Human
gcuuugcuagcacugcgcuucc

SEQ ID NO: 681957 - RNA, 22 nt, Human
ccuucucuaccaugugaggaaa

SEQ ID NO: 681958 - RNA, 22 nt, Human
gaugugugugcccugggccugc

SEQ ID NO: 681959 - RNA, 22 nt, Human
uuauucaguuuguguagaggug

SEQ ID NO: 681960 - RNA, 22 nt, Human
guuuuagauaaagcuguccuug

SEQ ID NO: 681961 - RNA, 22 nt, Human
gccugagaaggacacagcaggu

SEQ ID NO: 681962 - RNA, 22 nt, Human
cggggugggaauagaccugucu

SEQ ID NO: 681963 - RNA, 22 nt, Human
ucuguggcuuccuauuucuugg

SEQ ID NO: 681964 - RNA, 22 nt, Human
uggccagugauuaaugacgcuu

SEQ ID NO: 681965 - RNA, 22 nt, Human
auagaauguauuauaguacaga

SEQ ID NO: 681966 - RNA, 20 nt, Human
aggcugucauuucuggcagg

SEQ ID NO: 681967 - RNA, 22 nt, Human
uggauuaguuucaaggcagcaa

SEQ ID NO: 681968 - RNA, 22 nt, Human
gacuuuaucuuguccuuccugc

SEQ ID NO: 681969 - RNA, 22 nt, Human
agugauggcaucggguccagca

SEQ ID NO: 681970 - RNA, 22 nt, Human
aacaucuuuuuguuugcugaaa

SEQ ID NO: 681971 - RNA, 20 nt, Human
ugacaacaaaaugguaauuu

SEQ ID NO: 681972 - RNA, 22 nt, Human
cagguggggcagcugugggagc

SEQ ID NO: 681973 - RNA, 22 nt, Human
cagguuuacaaaguaaagugug

SEQ ID NO: 681974 - RNA, 22 nt, Human
uuggaacaugccgggguccagg

SEQ ID NO: 681975 - RNA, 21 nt, Human
auauuuuuguuuggacuguca

SEQ ID NO: 681976 - RNA, 22 nt, Human
uguauacauacauaugugugug

SEQ ID NO: 681977 - RNA, 22 nt, Human
ggcccuguccuggcugucuccg

SEQ ID NO: 681978 - RNA, 22 nt, Human
aacuguaaggcuuagaacagca

SEQ ID NO: 681979 - RNA, 22 nt, Human
ucccuggguccugcuugcucuc

SEQ ID NO: 681980 - RNA, 22 nt, Human
aguggaauguagaaaaaagaug

SEQ ID NO: 681981 - RNA, 22 nt, Human
ccugguggaaggugagugaggc

SEQ ID NO: 681982 - RNA, 22 nt, Human
agggagcucaguuggaagcggu

SEQ ID NO: 681983 - RNA, 22 nt, Human
cgggcagugcccagcggggcag

SEQ ID NO: 681984 - RNA, 22 nt, Human
aagcauuucaauauaauauuca

SEQ ID NO: 681985 - RNA, 22 nt, Human
uuaaacagguuuuugaauggcc

SEQ ID NO: 681986 - RNA, 21 nt, Human
gaauggcucgcgcgccacacu

SEQ ID NO: 681987 - RNA, 22 nt, Human
aaguuuauguucuuugaaggca

SEQ ID NO: 681988 - RNA, 22 nt, Human
aaaaccugauugaauucuauuu

SEQ ID NO: 681989 - RNA, 22 nt, Human
cucagcccggugcucgugccac

SEQ ID NO: 681990 - RNA, 21 nt, Human
ugcccuggggcucuucccuca

SEQ ID NO: 681991 - RNA, 22 nt, Human
ugaaccaggaggcagccagcac

SEQ ID NO: 681992 - RNA, 22 nt, Human
ucucagagcuucaguuauuuuc

SEQ ID NO: 681993 - RNA, 22 nt, Human
agucucuuuaaucacagugucu

SEQ ID NO: 681994 - RNA, 22 nt, Human
cccaccaguacagaugguagau

SEQ ID NO: 681995 - RNA, 22 nt, Human
uggcucagaacuacuucuaguu

SEQ ID NO: 681996 - RNA, 22 nt, Human
uuaaaugucaauagauugcuug

SEQ ID NO: 681997 - RNA, 22 nt, Human
guuuuuccuugcugaggacccg

SEQ ID NO: 681998 - RNA, 22 nt, Human
aucuuucucugcacuauacaau

SEQ ID NO: 681999 - RNA, 19 nt, Human
ucucuggcuugucugccug

SEQ ID NO: 682000 - RNA, 22 nt, Human
uccucugcuccaucuuuacugu

SEQ ID NO: 682001 - RNA, 22 nt, Human
agagaaaugauuccugggcaga

SEQ ID NO: 682002 - RNA, 22 nt, Human
cauauaaauacaacauguguua

SEQ ID NO: 682003 - RNA, 22 nt, Human
guccagccacucaccuuccagc

SEQ ID NO: 682004 - RNA, 22 nt, Human
gggaaggagguggaccugcccc

SEQ ID NO: 682005 - RNA, 22 nt, Human
ugaagccacacuagcuuguccu

SEQ ID NO: 682006 - RNA, 22 nt, Human
agagugauggguugugcugacc

SEQ ID NO: 682007 - RNA, 22 nt, Human
guacauuuugagguuaaaacaa

SEQ ID NO: 682008 - RNA, 22 nt, Human
ucaugcauauuuguaguaguuc

SEQ ID NO: 682009 - RNA, 22 nt, Human
uccaggcugugcgcaccgugug

SEQ ID NO: 682010 - RNA, 22 nt, Human
ccugggagguggauguugcggu

SEQ ID NO: 682011 - RNA, 22 nt, Human
cagaauuucagugauguuuucu

SEQ ID NO: 682012 - RNA, 22 nt, Human
uagaaacucacguuaucauugc

SEQ ID NO: 682013 - RNA, 22 nt, Human
caaauuuaagugaggucuuugu

SEQ ID NO: 682014 - RNA, 22 nt, Human
uucugcuuagagggcauuugca

SEQ ID NO: 682015 - RNA, 22 nt, Human
uaacaucuuaacuggauacuuc

SEQ ID NO: 682016 - RNA, 22 nt, Human
aguggcagagaccccagccagc

SEQ ID NO: 682017 - RNA, 19 nt, Human
guguacagcucagugaauu

SEQ ID NO: 682018 - RNA, 22 nt, Human
gaauugcuucugguauguuacu

SEQ ID NO: 682019 - RNA, 23 nt, Human
uuuauacaagaaaccgcuggccu

SEQ ID NO: 682020 - RNA, 22 nt, Human
aauacuuuugaacugaaaggca

SEQ ID NO: 682021 - RNA, 22 nt, Human
ccagaaaguucagcugugaaug

SEQ ID NO: 682022 - RNA, 22 nt, Human
cuuacaguacuucuaauaugau

SEQ ID NO: 682023 - RNA, 22 nt, Human
ucagaaauguaagcugaugacu

SEQ ID NO: 682024 - RNA, 22 nt, Human
auccuugaaugacucugcccuc

SEQ ID NO: 682025 - RNA, 22 nt, Human
ugggagcacucuuugggaagca

SEQ ID NO: 682026 - RNA, 22 nt, Human
uaaggaaagugccaugauuucu

SEQ ID NO: 682027 - RNA, 22 nt, Human
uugaggcccggcaggccgagcg

SEQ ID NO: 682028 - RNA, 22 nt, Human
gaagggugcauggagggaaguc

SEQ ID NO: 682029 - RNA, 22 nt, Human
gcaggguccauggaggcagccc

SEQ ID NO: 682030 - RNA, 22 nt, Human
cuuuguauucaguugggcugug

SEQ ID NO: 682031 - RNA, 22 nt, Human
ugguaaggucuucacucagauu

SEQ ID NO: 682032 - RNA, 22 nt, Human
uagcacaggucuuguugccauu

SEQ ID NO: 682033 - RNA, 22 nt, Human
ccugggcagguguggcuucccc

SEQ ID NO: 682034 - RNA, 21 nt, Human
uacauugacuacaaauaaagc

SEQ ID NO: 682035 - RNA, 22 nt, Human
gcuuuacaacaaauugaauaug

SEQ ID NO: 682036 - RNA, 22 nt, Human
uuauuuccacaaugugguaggg

SEQ ID NO: 682037 - RNA, 22 nt, Human
gauuucuuuagguguaauagug

SEQ ID NO: 682038 - RNA, 22 nt, Human
gucuggaaauuuaagguaugag

SEQ ID NO: 682039 - RNA, 22 nt, Human
uuugcaaaauuauucccagcau

SEQ ID NO: 682040 - RNA, 18 nt, Human
aguuuuuaggaagaaaug

SEQ ID NO: 682041 - RNA, 20 nt, Human
gugcuuccucgcaaguugca

SEQ ID NO: 682042 - RNA, 18 nt, Human
acauuucuaugcuucugg

SEQ ID NO: 682043 - RNA, 22 nt, Human
cuucagaauuccucagccucag

SEQ ID NO: 682044 - RNA, 22 nt, Human
gaggcccagcagcgcaggucuu

SEQ ID NO: 682045 - RNA, 22 nt, Human
ucucuucuaacacuagaaauuc

SEQ ID NO: 682046 - RNA, 21 nt, Human
aucaccagcagaagcugcaga

SEQ ID NO: 682047 - RNA, 22 nt, Human
aguguuguaugggaugacugcu

SEQ ID NO: 682048 - RNA, 22 nt, Human
caggcacaauuauuucccuuuc

SEQ ID NO: 682049 - RNA, 22 nt, Human
cucagaauuacaucccauuuua

SEQ ID NO: 682050 - RNA, 22 nt, Human
cacuguacagcauuaacaaggc

SEQ ID NO: 682051 - RNA, 20 nt, Human
gucagaggacccuagagcga

SEQ ID NO: 682052 - RNA, 22 nt, Human
ccugagcaaaggaaggaugacu

SEQ ID NO: 682053 - RNA, 22 nt, Human
ccaugcugacccugugcaggca

SEQ ID NO: 682054 - RNA, 22 nt, Human
gauuuuucaguauaaaauauau

SEQ ID NO: 682055 - RNA, 22 nt, Human
ucccaagacgaugugcuuggcc

SEQ ID NO: 682056 - RNA, 22 nt, Human
augggcagaguggggacaggaa

SEQ ID NO: 682057 - RNA, 22 nt, Human
ugccugcuuguguaccugguga

SEQ ID NO: 682058 - RNA, 22 nt, Human
cagagguacagccauugaagau

SEQ ID NO: 682059 - RNA, 22 nt, Human
auuauuuagaaaucgauugaaa

SEQ ID NO: 682060 - RNA, 22 nt, Human
ugggcuucauaauugguccuag

SEQ ID NO: 682061 - RNA, 22 nt, Human
ggcagcagcaagguuggagcug

SEQ ID NO: 682062 - RNA, 22 nt, Human
acagagcugggugcccccugga

SEQ ID NO: 682063 - RNA, 19 nt, Human
cagaaauagcgaaguguaa

SEQ ID NO: 682064 - RNA, 22 nt, Human
uagauucuugaaccagugccuc

SEQ ID NO: 682065 - RNA, 22 nt, Human
cccagggguauccauggagaag

SEQ ID NO: 682066 - RNA, 22 nt, Human
agccaggaucacccggggcugu

SEQ ID NO: 682067 - RNA, 22 nt, Human
aaagccaguuugucucuuuaaa

SEQ ID NO: 682068 - RNA, 22 nt, Human
cagggggcagcguagaaaauga

SEQ ID NO: 682069 - RNA, 22 nt, Human
agauacauugcacgaugcagau

SEQ ID NO: 682070 - RNA, 22 nt, Human
uguucagaacaaagguaaauga

SEQ ID NO: 682071 - RNA, 22 nt, Human
guccugggcaugcagggcuuuc

SEQ ID NO: 682072 - RNA, 18 nt, Human
aaaaagugcucaggccua

SEQ ID NO: 682073 - RNA, 22 nt, Human
ccuuccuuucagggcuaugccu

SEQ ID NO: 682074 - RNA, 22 nt, Human
ucccugggacggccuuuuggag

SEQ ID NO: 682075 - RNA, 22 nt, Human
auggccagcaaguucagaauuu

SEQ ID NO: 682076 - RNA, 22 nt, Human
gacauaaaguucuugcuugaau

SEQ ID NO: 682077 - RNA, 22 nt, Human
uggagguguggagucaaaggga

SEQ ID NO: 682078 - RNA, 22 nt, Human
aggcugagcugguagugaguac

SEQ ID NO: 682079 - RNA, 22 nt, Human
ggcagcugggucacaccgaucu

SEQ ID NO: 682080 - RNA, 15 nt, Human
uaacuuuuuugggcu

SEQ ID NO: 682081 - RNA, 18 nt, Human
aucucccauuggccaagg

SEQ ID NO: 682082 - RNA, 18 nt, Human
uuguagcaaauggcagug

SEQ ID NO: 682083 - RNA, 22 nt, Human
ggcaggaauaaauuauggacuu

SEQ ID NO: 682084 - RNA, 22 nt, Human
ucaggcagaaaaaucacuaauu

SEQ ID NO: 682085 - RNA, 22 nt, Human
gaggagcugggcugagaggguc

SEQ ID NO: 682086 - RNA, 19 nt, Human
ggcuggaguggccaucugu

SEQ ID NO: 682087 - RNA, 22 nt, Human
auucuggguuuuugucuucugu

SEQ ID NO: 682088 - RNA, 22 nt, Human
uuuacacugugaaacagguauc

SEQ ID NO: 682089 - RNA, 22 nt, Human
gcaaggcagcgcggaguagcua

SEQ ID NO: 682090 - RNA, 22 nt, Human
agacaaggcuggaguuuaggca

SEQ ID NO: 682091 - RNA, 22 nt, Human
agggacuggcucucugagcagg

SEQ ID NO: 682092 - RNA, 23 nt, Human
uauuacaauuggucuuauuaaga

SEQ ID NO: 682093 - RNA, 17 nt, Human
ugggccaguagaaggga

SEQ ID NO: 682094 - RNA, 22 nt, Human
guuacagugagaagauagccua

SEQ ID NO: 682095 - RNA, 22 nt, Human
gccagcugagaaaucauugaua

SEQ ID NO: 682096 - RNA, 22 nt, Human
ccuuucuacagaugccucuugc

SEQ ID NO: 682097 - RNA, 22 nt, Human
gaggcugccccuuccucagcug

SEQ ID NO: 682098 - RNA, 22 nt, Human
uauuaaagggaaguuaugcaug

SEQ ID NO: 682099 - RNA, 22 nt, Human
augucacaugagagcgcagcac

SEQ ID NO: 682100 - RNA, 22 nt, Human
auggaaauggagugugcuugcu

SEQ ID NO: 682101 - RNA, 22 nt, Human
agcugcugguuuaagggauggg

SEQ ID NO: 682102 - RNA, 22 nt, Human
ccuggcagcccagagcgccgcu

SEQ ID NO: 682103 - RNA, 22 nt, Human
ucucacagugcaggucugucuc

SEQ ID NO: 682104 - RNA, 22 nt, Human
uuugacauggaauaacucauuu

SEQ ID NO: 682105 - RNA, 22 nt, Human
uuuaucuggacugugauauaaa

SEQ ID NO: 682106 - RNA, 21 nt, Human
ugcuuugcagguggauuuagu

SEQ ID NO: 682107 - RNA, 22 nt, Human
cagggccaaguuggugccuuuu

SEQ ID NO: 682108 - RNA, 22 nt, Human
auccugucuuuguuuuaaauau

SEQ ID NO: 682109 - RNA, 19 nt, Human
caggauuguuuaaagcuuu

SEQ ID NO: 682110 - RNA, 22 nt, Human
gugcccugacacaccuggugug

SEQ ID NO: 682111 - RNA, 21 nt, Human
ccuggagacaaagacagggug

SEQ ID NO: 682112 - RNA, 22 nt, Human
ucaaaggaaacgugguccuggc

SEQ ID NO: 682113 - RNA, 22 nt, Human
agagcggggauaguuaauauuc

SEQ ID NO: 682114 - RNA, 22 nt, Human
aaugucuuuuaaccucuggacu

SEQ ID NO: 682115 - RNA, 21 nt, Human
cagagguggccugaccucuga

SEQ ID NO: 682116 - RNA, 22 nt, Human
cagagaaacucagauagcugau

SEQ ID NO: 682117 - RNA, 22 nt, Human
aacauggaggcagacagacgug

SEQ ID NO: 682118 - RNA, 22 nt, Human
uucccauuugugguagugaauu

SEQ ID NO: 682119 - RNA, 22 nt, Human
uggcacugagcagccgcggcag

SEQ ID NO: 682120 - RNA, 22 nt, Human
acccaggcuagagugcaguggu

SEQ ID NO: 682121 - RNA, 17 nt, Human
uccagcccugcccgacg

SEQ ID NO: 682122 - RNA, 22 nt, Human
guccuucagcuuuaucugaaca

SEQ ID NO: 682123 - RNA, 22 nt, Human
ugugcacaggaagcuauucucu

SEQ ID NO: 682124 - RNA, 22 nt, Human
agggacacgagguccugcuggg

SEQ ID NO: 682125 - RNA, 21 nt, Human
gcucaggcucagguucagguu

SEQ ID NO: 682126 - RNA, 22 nt, Human
aagcacuuagaagagugccugc

SEQ ID NO: 682127 - RNA, 22 nt, Human
ucaggggcugugcauuucccag

SEQ ID NO: 682128 - RNA, 21 nt, Human
ugaaaucugaugggacaaaug

SEQ ID NO: 682129 - RNA, 22 nt, Human
uuucuucuaggacuaauaagag

SEQ ID NO: 682130 - RNA, 23 nt, Human
ugcgugugugcugaggggcgucc

SEQ ID NO: 682131 - RNA, 22 nt, Human
cuggcccuaugagccuccugau

SEQ ID NO: 682132 - RNA, 22 nt, Human
gcccccucuuuggagccagcca

SEQ ID NO: 682133 - RNA, 22 nt, Human
gggacaggcaaagguaugcuuc

SEQ ID NO: 682134 - RNA, 23 nt, Human
agggccugauggcucccgcuggc

SEQ ID NO: 682135 - RNA, 22 nt, Human
acauagcauaaagaaugacucu

SEQ ID NO: 682136 - RNA, 19 nt, Human
uaccagccuccugccugau

SEQ ID NO: 682137 - RNA, 22 nt, Human
aaagaguuuggagacaagauca

SEQ ID NO: 682138 - RNA, 22 nt, Human
uuuagagacccucugcuauuuu

SEQ ID NO: 682139 - RNA, 21 nt, Human
agcuauuucagauuugagagc

SEQ ID NO: 682140 - RNA, 22 nt, Human
cugcagggagcagauggcgugu

SEQ ID NO: 682141 - RNA, 22 nt, Human
caguucuggaggcuccacaucu

SEQ ID NO: 682142 - RNA, 22 nt, Human
cccuuuaauuccaacacaggaa

SEQ ID NO: 682143 - RNA, 22 nt, Human
aggcucucucugccccugggac

SEQ ID NO: 682144 - RNA, 20 nt, Human
ucauaaagaggaaauaaaua

SEQ ID NO: 682145 - RNA, 22 nt, Human
gccugugcuuaacugacgugag

SEQ ID NO: 682146 - RNA, 22 nt, Human
gagcuuuaagggauaaaaugau

SEQ ID NO: 682147 - RNA, 22 nt, Human
aggggucuuuaggaacgucggg

SEQ ID NO: 682148 - RNA, 22 nt, Human
agagucaguuagcgaauacuua

SEQ ID NO: 682149 - RNA, 22 nt, Human
uguuuacaaggagaauuugagg

SEQ ID NO: 682150 - RNA, 22 nt, Human
uggguaaacaauguuugccuaa

SEQ ID NO: 682151 - RNA, 22 nt, Human
cuggggaggcagggcugccccu

SEQ ID NO: 682152 - RNA, 22 nt, Human
gcaggcugaguugggaaaccaa

SEQ ID NO: 682153 - RNA, 21 nt, Human
ccuggcuccagaacuuccggu

SEQ ID NO: 682154 - RNA, 22 nt, Human
uuucccaguucccugcucuaua

SEQ ID NO: 682155 - RNA, 20 nt, Human
guuuagcauggcagugaaag

SEQ ID NO: 682156 - RNA, 22 nt, Human
ucuggcaggucaaucauucuuu

SEQ ID NO: 682157 - RNA, 22 nt, Human
acacugaauaauugagaguuga

SEQ ID NO: 682158 - RNA, 22 nt, Human
uauuaaguaucuugaugacaaa

SEQ ID NO: 682159 - RNA, 22 nt, Human
ucagugcuuuugagaagcuccu

SEQ ID NO: 682160 - RNA, 22 nt, Human
acauuucagugagcuauugaag

SEQ ID NO: 682161 - RNA, 22 nt, Human
gaagaagcauucugcuguuuug

SEQ ID NO: 682162 - RNA, 20 nt, Human
acauagaucagugauugaca

SEQ ID NO: 682163 - RNA, 22 nt, Human
ugagcuguuucucugguggcuu

SEQ ID NO: 682164 - RNA, 22 nt, Human
ugcugcauagcagcuccugaaa

SEQ ID NO: 682165 - RNA, 22 nt, Human
caggcccucaggcaagggcucu

SEQ ID NO: 682166 - RNA, 20 nt, Human
ccagauggucccugugaaaa

SEQ ID NO: 682167 - RNA, 22 nt, Human
uuagagaugucccaaaaugaag

SEQ ID NO: 682168 - RNA, 22 nt, Human
aguauuucuucauaugauuacu

SEQ ID NO: 682169 - RNA, 22 nt, Human
auacacauuacuuucugucuga

SEQ ID NO: 682170 - RNA, 22 nt, Human
aaggccauguaggaggcaugcg

SEQ ID NO: 682171 - RNA, 22 nt, Human
aguuuucugcuaaaccagcuaa

SEQ ID NO: 682172 - RNA, 22 nt, Human
acagaguuguaaacauuuacca

SEQ ID NO: 682173 - RNA, 21 nt, Human
cuggaggguagaguugggcug

SEQ ID NO: 682174 - RNA, 22 nt, Human
agaugguuaucuaagugaaaaa

SEQ ID NO: 682175 - RNA, 22 nt, Human
guuucucuuugaagccuggcug

SEQ ID NO: 682176 - RNA, 22 nt, Human
gcuagccugcaguggcuauggu

SEQ ID NO: 682177 - RNA, 22 nt, Human
cccaagggaugcuugaguaguu

SEQ ID NO: 682178 - RNA, 22 nt, Human
ugaugcuucacgcugaauaugc

SEQ ID NO: 682179 - RNA, 22 nt, Human
cugggaggauacacaagaucag

SEQ ID NO: 682180 - RNA, 22 nt, Human
ugcagggccccucugcaugagu

SEQ ID NO: 682181 - RNA, 22 nt, Human
uuauugcaaaggaagagcuuga

SEQ ID NO: 682182 - RNA, 22 nt, Human
ucagcuuuuuacaugugaaaua

SEQ ID NO: 682183 - RNA, 22 nt, Human
cauaacugggagauccaagggu

SEQ ID NO: 682184 - RNA, 22 nt, Human
gcagggacgcagcacucuccgu

SEQ ID NO: 682185 - RNA, 22 nt, Human
cagcccugucuaugacugauga

SEQ ID NO: 682186 - RNA, 22 nt, Human
guacugcuguaaauauucuuca

SEQ ID NO: 682187 - RNA, 22 nt, Human
ugcugaugcuguucuguuagga

SEQ ID NO: 682188 - RNA, 22 nt, Human
ugcuuucagauaucuguuucaa

SEQ ID NO: 682189 - RNA, 22 nt, Human
cugccuggccacaacccagggu

SEQ ID NO: 682190 - RNA, 22 nt, Human
uguccauggagaagcucagggc

SEQ ID NO: 682191 - RNA, 22 nt, Human
cucugaggcuccaugcaggcuu

SEQ ID NO: 682192 - RNA, 22 nt, Human
aauugugcauuuuuaaaucacg

SEQ ID NO: 682193 - RNA, 22 nt, Human
gcucccaguucccaaagugacc

SEQ ID NO: 682194 - RNA, 22 nt, Human
cagcagcaacaacggaagccuu

SEQ ID NO: 682195 - RNA, 22 nt, Human
cauuucaauacuaucugagaau

SEQ ID NO: 682196 - RNA, 22 nt, Human
uagcagcucacagccucccauu

SEQ ID NO: 682197 - RNA, 22 nt, Human
uucagaauauuuguuuuacaug

SEQ ID NO: 682198 - RNA, 22 nt, Human
ccagaggagaugccuccucugu

SEQ ID NO: 682199 - RNA, 22 nt, Human
ggaguuggugagcaccaggcuu

SEQ ID NO: 682200 - RNA, 22 nt, Human
ggaguaaggcucagaggaaaug

SEQ ID NO: 682201 - RNA, 22 nt, Human
agcccagcggagcgggcccggg

SEQ ID NO: 682202 - RNA, 22 nt, Human
aguuuucacacucaccaaaagg

SEQ ID NO: 682203 - RNA, 22 nt, Human
uuuucauuuacauuagggaaga

SEQ ID NO: 682204 - RNA, 22 nt, Human
aaauuauuauaggcagagcuga

SEQ ID NO: 682205 - RNA, 22 nt, Human
aacuucagggggcacauucaag

SEQ ID NO: 682206 - RNA, 22 nt, Human
ggucagaacaaggguaaauaaa

SEQ ID NO: 682207 - RNA, 22 nt, Human
ugccagccagguucugaggcua

SEQ ID NO: 682208 - RNA, 19 nt, Human
gcuucccaccagccagccc

SEQ ID NO: 682209 - RNA, 22 nt, Human
uaggcagaauuguugaaugaag

SEQ ID NO: 682210 - RNA, 22 nt, Human
uccuggcacauugcaggggcuc

SEQ ID NO: 682211 - RNA, 20 nt, Human
ugcccuguggaggggaaagg

SEQ ID NO: 682212 - RNA, 22 nt, Human
aaauugcugaccaaguauauuc

SEQ ID NO: 682213 - RNA, 22 nt, Human
caagaaauguuuacugagcauc

SEQ ID NO: 682214 - RNA, 23 nt, Human
uuucaacuccugccauuauuucu

SEQ ID NO: 682215 - RNA, 22 nt, Human
aggcugagccacggggcuggcu

SEQ ID NO: 682216 - RNA, 22 nt, Human
uucuuuggcuuacgucuggccu

SEQ ID NO: 682217 - RNA, 21 nt, Human
acaugcauagagagauuucug

SEQ ID NO: 682218 - RNA, 22 nt, Human
ugcaguccuggugaggggacau

SEQ ID NO: 682219 - RNA, 22 nt, Human
ccugagugaccugaggucuagu

SEQ ID NO: 682220 - RNA, 22 nt, Human
cacaggaacuuacuggccacuu

SEQ ID NO: 682221 - RNA, 19 nt, Human
gauuucuacaaaugucaga

SEQ ID NO: 682222 - RNA, 22 nt, Human
aagggcuccaagagguagcugg

SEQ ID NO: 682223 - RNA, 22 nt, Human
gcagugauuggaucagagaugg

SEQ ID NO: 682224 - RNA, 22 nt, Human
gccucuggucccucaugcugug

SEQ ID NO: 682225 - RNA, 22 nt, Human
cuuucacauaauugaccuugaa

SEQ ID NO: 682226 - RNA, 22 nt, Human
ggaggagacaguaaaaagcacg

SEQ ID NO: 682227 - RNA, 22 nt, Human
ccagugcuuccaggaauacggu

SEQ ID NO: 682228 - RNA, 22 nt, Human
ggcucucuccuuggcuuucaga

SEQ ID NO: 682229 - RNA, 22 nt, Human
ucacaugccacagaugaggcaa

SEQ ID NO: 682230 - RNA, 22 nt, Human
ucacagaagagcauuaagauga

SEQ ID NO: 682231 - RNA, 22 nt, Human
cagugcagaggccagggaggau

SEQ ID NO: 682232 - RNA, 21 nt, Human
uaucagaagagaaagaaugau

SEQ ID NO: 682233 - RNA, 22 nt, Human
uugcuauaaaugguuucauauu

SEQ ID NO: 682234 - RNA, 21 nt, Human
acagcaagccuuccuuucagg

SEQ ID NO: 682235 - RNA, 22 nt, Human
uccccaggagcaaugauucagu

SEQ ID NO: 682236 - RNA, 22 nt, Human
ucauguuucucuuacagcagcu

SEQ ID NO: 682237 - RNA, 20 nt, Human
cagggacagcaguggguuuu

SEQ ID NO: 682238 - RNA, 22 nt, Human
auauuaguguagguagcuaaua

SEQ ID NO: 682239 - RNA, 22 nt, Human
ugucaacagauacuagagagcu

SEQ ID NO: 682240 - RNA, 22 nt, Human
ugggccacaguucaccaauccc

SEQ ID NO: 682241 - RNA, 22 nt, Human
agacucugggauuuugaaagca

SEQ ID NO: 682242 - RNA, 22 nt, Human
aguggcuguaggcuaugagaga

SEQ ID NO: 682243 - RNA, 23 nt, Human
ugcuggagacaagugugagaagg

SEQ ID NO: 682244 - RNA, 23 nt, Human
ucagcccacaucuagucauuagc

SEQ ID NO: 682245 - RNA, 22 nt, Human
ugccacaguuguuugugcucua

SEQ ID NO: 682246 - RNA, 22 nt, Human
auaauuaucucagacacuuguu

SEQ ID NO: 682247 - RNA, 22 nt, Human
uggcuucuaaaguuucuuuuag

SEQ ID NO: 682248 - RNA, 22 nt, Human
uugcuucuuagauauuccucuc

SEQ ID NO: 682249 - RNA, 22 nt, Human
augcaaugguauauggucaccu

SEQ ID NO: 682250 - RNA, 22 nt, Human
uuacagaacugcccuaguuggc

SEQ ID NO: 682251 - RNA, 22 nt, Human
caagaagccgagcuacaggcuc

SEQ ID NO: 682252 - RNA, 22 nt, Human
aacugaaaguuucaccugaggu

SEQ ID NO: 682253 - RNA, 22 nt, Human
agacaugugguauaaucagggg

SEQ ID NO: 682254 - RNA, 22 nt, Human
acugucuucaaaugaauauauu

SEQ ID NO: 682255 - RNA, 20 nt, Human
uggguccugcacauucucca

SEQ ID NO: 682256 - RNA, 22 nt, Human
cugggagcuuguuaggaaugca

SEQ ID NO: 682257 - RNA, 22 nt, Human
caucucugagaccucagcuggg

SEQ ID NO: 682258 - RNA, 22 nt, Human
ucagaacauuacauuuugagcu

SEQ ID NO: 682259 - RNA, 23 nt, Human
cuucuggcucuauaucagaauuc

SEQ ID NO: 682260 - RNA, 22 nt, Human
caggucagcuggugccccaggu

SEQ ID NO: 682261 - RNA, 22 nt, Human
ccucugcucugguccaugugcu

SEQ ID NO: 682262 - RNA, 22 nt, Human
cacaggaaaauaaaagaucuaa

SEQ ID NO: 682263 - RNA, 22 nt, Human
uggcucagaggggaagugguuu

SEQ ID NO: 682264 - RNA, 22 nt, Human
gucuuauaguacaauuugaagu

SEQ ID NO: 682265 - RNA, 22 nt, Human
uguguguguaaaagcauuuaua

SEQ ID NO: 682266 - RNA, 22 nt, Human
ccagagacuggcugagagaucu

SEQ ID NO: 682267 - RNA, 22 nt, Human
cuguccuggccgcccuugugag

SEQ ID NO: 682268 - RNA, 22 nt, Human
aaugacaauggcagagguagaa

SEQ ID NO: 682269 - RNA, 22 nt, Human
cagaggccccagaacuagcucu

SEQ ID NO: 682270 - RNA, 22 nt, Human
acaguccuuguuucggucagau

SEQ ID NO: 682271 - RNA, 21 nt, Human
aaauguguuccauaaugcuuu

SEQ ID NO: 682272 - RNA, 22 nt, Human
gauuucaccugaucuugucauc

SEQ ID NO: 682273 - RNA, 22 nt, Human
ugcuggaagggucggcgugggc

SEQ ID NO: 682274 - RNA, 22 nt, Human
uacacagaaauuguguagggau

SEQ ID NO: 682275 - RNA, 22 nt, Human
gcagcagagaccccaggaagga

SEQ ID NO: 682276 - RNA, 22 nt, Human
ccagcaucagucagauuuugcu

SEQ ID NO: 682277 - RNA, 22 nt, Human
gcuguuuccagacaaugucuuu

SEQ ID NO: 682278 - RNA, 22 nt, Human
aggcucaguucacgucaacuuu

SEQ ID NO: 682279 - RNA, 22 nt, Human
uugauuuuuccagcuucuagag

SEQ ID NO: 682280 - RNA, 22 nt, Human
cuucccugguguuagcccaaug

SEQ ID NO: 682281 - RNA, 22 nt, Human
acagggcagagggcaguuggua

SEQ ID NO: 682282 - RNA, 23 nt, Human
ccuggcuggauucucugcauuca

SEQ ID NO: 682283 - RNA, 22 nt, Human
cacagaggcucaaagccaggug

SEQ ID NO: 682284 - RNA, 22 nt, Human
auucugaauucugagccuuuca

SEQ ID NO: 682285 - RNA, 22 nt, Human
ggucuggauaauuccaguaccu

SEQ ID NO: 682286 - RNA, 22 nt, Human
aguuagaaaguaaaucauuuga

SEQ ID NO: 682287 - RNA, 22 nt, Human
uuccucucgcucuccggggccc

SEQ ID NO: 682288 - RNA, 18 nt, Human
caugggugacagguggau

SEQ ID NO: 682289 - RNA, 22 nt, Human
uguuuacaagccacuuguuaag

SEQ ID NO: 682290 - RNA, 22 nt, Human
uagcaggguaaauguagaugga

SEQ ID NO: 682291 - RNA, 22 nt, Human
ucugccuggccuggagggcaca

SEQ ID NO: 682292 - RNA, 22 nt, Human
cuggagggacuuucucacggau

SEQ ID NO: 682293 - RNA, 22 nt, Human
gggugggugguccgcagacaua

SEQ ID NO: 682294 - RNA, 22 nt, Human
agucugggcauuuaggauguug

SEQ ID NO: 682295 - RNA, 22 nt, Human
gcucccagcauugcugcugaau

SEQ ID NO: 682296 - RNA, 22 nt, Human
uuucuuuugaauaguguguggu

SEQ ID NO: 682297 - RNA, 22 nt, Human
acagagucucaaaccuacaaag

SEQ ID NO: 682298 - RNA, 22 nt, Human
caguuuauauucuagugcuguu

SEQ ID NO: 682299 - RNA, 22 nt, Human
ggcaaagccuuacucuaacuga

SEQ ID NO: 682300 - RNA, 22 nt, Human
aaggaaauacaacauguauuca

SEQ ID NO: 682301 - RNA, 22 nt, Human
ugggccuguugccugaguccau

SEQ ID NO: 682302 - RNA, 22 nt, Human
uugucugaaucuggagcucucu

SEQ ID NO: 682303 - RNA, 20 nt, Human
aggguucccuuguucagcag

SEQ ID NO: 682304 - RNA, 22 nt, Human
cagcuccagcccaggcagcucc

SEQ ID NO: 682305 - RNA, 22 nt, Human
cagccagagaaagggcacugcc

SEQ ID NO: 682306 - RNA, 22 nt, Human
uugggcagugauuaguucauga

SEQ ID NO: 682307 - RNA, 22 nt, Human
aaggucugaguuuugccaggcc

SEQ ID NO: 682308 - RNA, 22 nt, Human
ucucagcucuuuuuucacagaa

SEQ ID NO: 682309 - RNA, 22 nt, Human
ugugaaaggggucacagggaaa

SEQ ID NO: 682310 - RNA, 22 nt, Human
uuucacacugcagcaucagaga

SEQ ID NO: 682311 - RNA, 22 nt, Human
ucugccuguaccucuuuuuugc

SEQ ID NO: 682312 - RNA, 19 nt, Human
ucugacacuuacacacccc

SEQ ID NO: 682313 - RNA, 22 nt, Human
uugucgggcuuacgcagggcca

SEQ ID NO: 682314 - RNA, 22 nt, Human
uauugucaagaaguuuauagug

SEQ ID NO: 682315 - RNA, 22 nt, Human
uccuccagcccucuaggaaaau

SEQ ID NO: 682316 - RNA, 22 nt, Human
aagcaggcuugguguggccgcu

SEQ ID NO: 682317 - RNA, 18 nt, Human
ggugaggcggcggccagc

SEQ ID NO: 682318 - RNA, 22 nt, Human
cccagccuacucugccauagca

SEQ ID NO: 682319 - RNA, 22 nt, Human
acggcaggcucagagcuggaau

SEQ ID NO: 682320 - RNA, 22 nt, Human
aaauugcuugagauuagucucc

SEQ ID NO: 682321 - RNA, 17 nt, Human
ggcagcugccacuuuuu

SEQ ID NO: 682322 - RNA, 22 nt, Human
ggugucugaugguggcuucuca

SEQ ID NO: 682323 - RNA, 22 nt, Human
auguauuugcgagguuaggaaa

SEQ ID NO: 682324 - RNA, 22 nt, Human
uagaauugaguuucacuguucc

SEQ ID NO: 682325 - RNA, 22 nt, Human
guggcagagugcgguucugacc

SEQ ID NO: 682326 - RNA, 22 nt, Human
agagaugaaaaguggagacugg

SEQ ID NO: 682327 - RNA, 22 nt, Human
agagaaaugggguaaucuuuca

SEQ ID NO: 682328 - RNA, 22 nt, Human
aaaauugucgaacaguaguaac

SEQ ID NO: 682329 - RNA, 22 nt, Human
ucugcacaucccccaaaguauu

SEQ ID NO: 682330 - RNA, 22 nt, Human
ugcauuccacagaagggaaaac

SEQ ID NO: 682331 - RNA, 22 nt, Human
auuugccuuacugaagaaggag

SEQ ID NO: 682332 - RNA, 22 nt, Human
uauguguauguucauucaugca

SEQ ID NO: 682333 - RNA, 22 nt, Human
aguuaacaaguuggcaaucaac

SEQ ID NO: 682334 - RNA, 22 nt, Human
uagaucauauuuguggagaaaa

SEQ ID NO: 682335 - RNA, 22 nt, Human
auggcugcaucauccugguuga

SEQ ID NO: 682336 - RNA, 22 nt, Human
augcagggucuccgugugacga

SEQ ID NO: 682337 - RNA, 22 nt, Human
guuaaccaaggcaccaagugua

SEQ ID NO: 682338 - RNA, 22 nt, Human
uagcauaacagguaagagugag

SEQ ID NO: 682339 - RNA, 22 nt, Human
uuucuaaggugagguagaaaau

SEQ ID NO: 682340 - RNA, 22 nt, Human
cuggagcugccagacgggcaca

SEQ ID NO: 682341 - RNA, 22 nt, Human
agguccugucuuaucucuguaa

SEQ ID NO: 682342 - RNA, 22 nt, Human
ccuggcucuucagagguuccua

SEQ ID NO: 682343 - RNA, 22 nt, Human
agcagggcaugaauaaggguuu

SEQ ID NO: 682344 - RNA, 22 nt, Human
auguguuaaugagcaaugaccu

SEQ ID NO: 682345 - RNA, 22 nt, Human
uucuaugccauguucagcuacu

SEQ ID NO: 682346 - RNA, 22 nt, Human
cugcccugacugaccuuuugaa

SEQ ID NO: 682347 - RNA, 22 nt, Human
agagacagaucugagggaccuc

SEQ ID NO: 682348 - RNA, 22 nt, Human
auacagguggacuucaguuagu

SEQ ID NO: 682349 - RNA, 22 nt, Human
gcugugcugcgggaggauuccg

SEQ ID NO: 682350 - RNA, 22 nt, Human
ucacagucggugacuucuugcu

SEQ ID NO: 682351 - RNA, 22 nt, Human
caggcaggagaggaggauuucu

SEQ ID NO: 682352 - RNA, 22 nt, Human
aaauaguaaagugguagccauc

SEQ ID NO: 682353 - RNA, 22 nt, Human
cucugggcugccuuuuagcucu

SEQ ID NO: 682354 - RNA, 22 nt, Human
agcauucuguggucuucuaugg

SEQ ID NO: 682355 - RNA, 22 nt, Human
ugaucaguguugguucuaucua

SEQ ID NO: 682356 - RNA, 22 nt, Human
agccaggcuacuccuugcugac

SEQ ID NO: 682357 - RNA, 22 nt, Human
auuaguaaaacauuguauaugu

SEQ ID NO: 682358 - RNA, 20 nt, Human
ggaagccagggugcagggga

SEQ ID NO: 682359 - RNA, 21 nt, Human
agcagcagggaagccucaucc

SEQ ID NO: 682360 - RNA, 22 nt, Human
gcaaagcaaucaggaguagcau

SEQ ID NO: 682361 - RNA, 22 nt, Human
aaacuuuaaauuuguaccucug

SEQ ID NO: 682362 - RNA, 22 nt, Human
uuucagacucaucucaagcuuu

SEQ ID NO: 682363 - RNA, 22 nt, Human
aauuaguauugcgauucauuag

SEQ ID NO: 682364 - RNA, 22 nt, Human
uucugaggcacuggcucuccca

SEQ ID NO: 682365 - RNA, 23 nt, Human
uugcuuccacuguaaguggagaa

SEQ ID NO: 682366 - RNA, 22 nt, Human
ggcaggaagaggagggugaacu

SEQ ID NO: 682367 - RNA, 22 nt, Human
ucugccccugcugggcacagag

SEQ ID NO: 682368 - RNA, 22 nt, Human
ucugcuucacuuccccaagcuu

SEQ ID NO: 682369 - RNA, 22 nt, Human
ucaggggagguugaaucgucuc

SEQ ID NO: 682370 - RNA, 22 nt, Human
gaaccuguuuauguuaccugcg

SEQ ID NO: 682371 - RNA, 22 nt, Human
ucucaguguuaucuaucugccu

SEQ ID NO: 682372 - RNA, 22 nt, Human
ccaggguggcguagaugcuggg

SEQ ID NO: 682373 - RNA, 22 nt, Human
cagcaacuuaggcagaacaucu

SEQ ID NO: 682374 - RNA, 22 nt, Human
ugcucuagcucauaggacucau

SEQ ID NO: 682375 - RNA, 22 nt, Human
gaauacacgaauagagcauggu

SEQ ID NO: 682376 - RNA, 22 nt, Human
uacaguuuguauggucaggaau

SEQ ID NO: 682377 - RNA, 22 nt, Human
aggcuggagguuuguugcggcu

SEQ ID NO: 682378 - RNA, 22 nt, Human
uuagcuuuggauugcauuuagu

SEQ ID NO: 682379 - RNA, 22 nt, Human
acucugggcuguuaggagcugu

SEQ ID NO: 682380 - RNA, 22 nt, Human
uaaaacaccuguagugucugcc

SEQ ID NO: 682381 - RNA, 22 nt, Human
caugagagauccuucaugagag

SEQ ID NO: 682382 - RNA, 20 nt, Human
agcaccuguguagaagcauc

SEQ ID NO: 682383 - RNA, 20 nt, Human
cuaucuccuggcgugccuuc

SEQ ID NO: 682384 - RNA, 22 nt, Human
caagccagucagcucaguagau

SEQ ID NO: 682385 - RNA, 22 nt, Human
ucauaugucacucaugggcaua

SEQ ID NO: 682386 - RNA, 22 nt, Human
uuuugcaaugagaugcuuguca

SEQ ID NO: 682387 - RNA, 20 nt, Human
cguguguggcuauuuugggu

SEQ ID NO: 682388 - RNA, 22 nt, Human
aaggaaucacuucuuuaaauga

SEQ ID NO: 682389 - RNA, 20 nt, Human
auucuacaagaauaagcaug

SEQ ID NO: 682390 - RNA, 22 nt, Human
ugggcagccaucccagccucuc

SEQ ID NO: 682391 - RNA, 22 nt, Human
aagcagaggaccgacggaggga

SEQ ID NO: 682392 - RNA, 22 nt, Human
augacauuuauacagugagcuu

SEQ ID NO: 682393 - RNA, 22 nt, Human
uugcagcaaggucaugaaaugu

SEQ ID NO: 682394 - RNA, 22 nt, Human
caggacagugcagguccauccu

SEQ ID NO: 682395 - RNA, 22 nt, Human
ucaggagaacuuccuucuaccc

SEQ ID NO: 682396 - RNA, 22 nt, Human
uuugcaguuucauugcugaaau

SEQ ID NO: 682397 - RNA, 22 nt, Human
ucagagaaauaauugcugaguu

SEQ ID NO: 682398 - RNA, 22 nt, Human
uggccguguuagauguuuggcu

SEQ ID NO: 682399 - RNA, 22 nt, Human
caggcuuuacuuucucucugaa

SEQ ID NO: 682400 - RNA, 22 nt, Human
gaaguauuauagcauauuagcc

SEQ ID NO: 682401 - RNA, 20 nt, Human
aaggcacuaugucugcuagc

SEQ ID NO: 682402 - RNA, 22 nt, Human
acaguucaagacaucaguauga

SEQ ID NO: 682403 - RNA, 22 nt, Human
acauagaacuucccagugagca

SEQ ID NO: 682404 - RNA, 22 nt, Human
auauuuguugaguucuuaugau

SEQ ID NO: 682405 - RNA, 22 nt, Human
aguuaaacucuaguagauacaa

SEQ ID NO: 682406 - RNA, 22 nt, Human
cagcuguguaaacacaugugua

SEQ ID NO: 682407 - RNA, 22 nt, Human
ugugugagacaauuggcugugg

SEQ ID NO: 682408 - RNA, 22 nt, Human
cuggggaugggaccuggcauaa

SEQ ID NO: 682409 - RNA, 21 nt, Human
ccagcucugccuccaguuggu

SEQ ID NO: 682410 - RNA, 22 nt, Human
ucaguugcaccugcaugguacu

SEQ ID NO: 682411 - RNA, 22 nt, Human
cugggcugucaguuuuguuuua

SEQ ID NO: 682412 - RNA, 22 nt, Human
ucccagggacaccaagcuguuu

SEQ ID NO: 682413 - RNA, 22 nt, Human
agauacaucauuuauaccuuca

SEQ ID NO: 682414 - RNA, 22 nt, Human
auguguaaugugguauuuuaau

SEQ ID NO: 682415 - RNA, 23 nt, Human
gugcucuucaguuuuagggucau

SEQ ID NO: 682416 - RNA, 22 nt, Human
ucacagagcacguaucaugccu

SEQ ID NO: 682417 - RNA, 22 nt, Human
gugcugaaauggaccucaggaa

SEQ ID NO: 682418 - RNA, 22 nt, Human
caggagcucacagucuuugggu

SEQ ID NO: 682419 - RNA, 22 nt, Human
ugaacaugcuguugauggccug

SEQ ID NO: 682420 - RNA, 22 nt, Human
gggauauguuuagguguuggag

SEQ ID NO: 682421 - RNA, 19 nt, Human
uccugcagaccagaccugu

SEQ ID NO: 682422 - RNA, 22 nt, Human
gcuggccuuugaggaagcugcg

SEQ ID NO: 682423 - RNA, 22 nt, Human
auucagaaagauaugccugguu

SEQ ID NO: 682424 - RNA, 22 nt, Human
guuucagauuugguuucagaag

SEQ ID NO: 682425 - RNA, 22 nt, Human
gaggagggagaauuaggcuuaa

SEQ ID NO: 682426 - RNA, 20 nt, Human
ucacaugcauauucguuucu

SEQ ID NO: 682427 - RNA, 22 nt, Human
ucucacacaacauguuacuuug

SEQ ID NO: 682428 - RNA, 22 nt, Human
cagcuugggaguuugguuuuau

SEQ ID NO: 682429 - RNA, 22 nt, Human
uaggcauuuaagauggauaagg

SEQ ID NO: 682430 - RNA, 22 nt, Human
cuuucuggacaagacagaggga

SEQ ID NO: 682431 - RNA, 22 nt, Human
cacuccaggucccaguuccugg

SEQ ID NO: 682432 - RNA, 22 nt, Human
aguccaugcugucuacagaauc

SEQ ID NO: 682433 - RNA, 22 nt, Human
gaggccauaagaaguucuuggg

SEQ ID NO: 682434 - RNA, 21 nt, Human
gccuucacucccagaguuugu

SEQ ID NO: 682435 - RNA, 22 nt, Human
ugugauuauuugauuaacaugu

SEQ ID NO: 682436 - RNA, 22 nt, Human
uucauugagcuguacacuuagg

SEQ ID NO: 682437 - RNA, 22 nt, Human
ggaccaggccagccucccugcg

SEQ ID NO: 682438 - RNA, 22 nt, Human
ucaguguguaauucuuuguuuc

SEQ ID NO: 682439 - RNA, 22 nt, Human
gaggccacauuacuuggugggu

SEQ ID NO: 682440 - RNA, 22 nt, Human
cugggccagaagacauuuagga

SEQ ID NO: 682441 - RNA, 22 nt, Human
gcauguaaucacucuaggaagg

SEQ ID NO: 682442 - RNA, 22 nt, Human
aaguacaugcuguaaugauugg

SEQ ID NO: 682443 - RNA, 22 nt, Human
gcucugcugaagccccuugcau

SEQ ID NO: 682444 - RNA, 22 nt, Human
cuggggacugaaggauguugcu

SEQ ID NO: 682445 - RNA, 22 nt, Human
cugugggcauuugagugugggu

SEQ ID NO: 682446 - RNA, 23 nt, Human
aggcccaacucugugagggcugc

SEQ ID NO: 682447 - RNA, 22 nt, Human
ucaaggaagggauauucuugaa

SEQ ID NO: 682448 - RNA, 22 nt, Human
ucagggaaaccuaaggaagcca

SEQ ID NO: 682449 - RNA, 21 nt, Human
gcagagaaugaacuuuggcuu

SEQ ID NO: 682450 - RNA, 22 nt, Human
gaauggcuaucggauuauuagg

SEQ ID NO: 682451 - RNA, 22 nt, Human
uguacaaaacaagaugggggua

SEQ ID NO: 682452 - RNA, 22 nt, Human
ucugggcugguugugcuugcuu

SEQ ID NO: 682453 - RNA, 22 nt, Human
uauaauuuuucuguggccaguu

SEQ ID NO: 682454 - RNA, 22 nt, Human
cuacuguaauagaugaauuuga

SEQ ID NO: 682455 - RNA, 22 nt, Human
aaauuguaggaucacaugaccu

SEQ ID NO: 682456 - RNA, 22 nt, Human
cagcuggcgccuggggaccaga

SEQ ID NO: 682457 - RNA, 22 nt, Human
gggggaagaaagaacauggcau

SEQ ID NO: 682458 - RNA, 22 nt, Human
uugucacuagugaagaaucagg

SEQ ID NO: 682459 - RNA, 22 nt, Human
ucccugggguuccuccagccac

SEQ ID NO: 682460 - RNA, 22 nt, Human
uguuugaacugaauaacauagu

SEQ ID NO: 682461 - RNA, 22 nt, Human
uugcuuuaucuaagcauggcca

SEQ ID NO: 682462 - RNA, 22 nt, Human
uuugaaaucuaaucaaggaaca

SEQ ID NO: 682463 - RNA, 22 nt, Human
uuagaucauuuuagcuaaaugg

SEQ ID NO: 682464 - RNA, 22 nt, Human
ucucacugggucacagcagagg

SEQ ID NO: 682465 - RNA, 19 nt, Human
gaggcccaugagggugcuc

SEQ ID NO: 682466 - RNA, 22 nt, Human
ucagagucauugcaaguagaag

SEQ ID NO: 682467 - RNA, 22 nt, Human
aauuauacaugaaggcauuaua

SEQ ID NO: 682468 - RNA, 23 nt, Human
uucuggauguucuagucugagag

SEQ ID NO: 682469 - RNA, 22 nt, Human
ccaaucuuguuuucuacaucca

SEQ ID NO: 682470 - RNA, 22 nt, Human
uuucuucuugauuuaaacaggg

SEQ ID NO: 682471 - RNA, 22 nt, Human
uuucucccuccacuacaggcuc

SEQ ID NO: 682472 - RNA, 22 nt, Human
gacugaggugaccuaggacuac

SEQ ID NO: 682473 - RNA, 22 nt, Human
cugugccuggggggcagagcug

SEQ ID NO: 682474 - RNA, 17 nt, Human
augcucuauagucagug

SEQ ID NO: 682475 - RNA, 22 nt, Human
aacaggcaauuuaggacucuuu

SEQ ID NO: 682476 - RNA, 22 nt, Human
ugcccucagaauugcucccugc

SEQ ID NO: 682477 - RNA, 22 nt, Human
agccucugucaagcuuuucaaa

SEQ ID NO: 682478 - RNA, 22 nt, Human
ucauuucaaugauacuacuaag

SEQ ID NO: 682479 - RNA, 22 nt, Human
caucaaagggccuguggugcag

SEQ ID NO: 682480 - RNA, 22 nt, Human
gcccagaacagugucacauguc

SEQ ID NO: 682481 - RNA, 22 nt, Human
ucagacuuuuaaagacugaaug

SEQ ID NO: 682482 - RNA, 22 nt, Human
agccagcuaagggaagcaugau

SEQ ID NO: 682483 - RNA, 22 nt, Human
cugaggaguuuggguuguucaa

SEQ ID NO: 682484 - RNA, 22 nt, Human
ugguggcagagcaagagcugga

SEQ ID NO: 682485 - RNA, 22 nt, Human
cagcaucuggauuuccuccacu

SEQ ID NO: 682486 - RNA, 22 nt, Human
aagacauuguggagauguugcu

SEQ ID NO: 682487 - RNA, 21 nt, Human
gccugggaaaucugggaagcc

SEQ ID NO: 682488 - RNA, 22 nt, Human
agucuuacaugagaaagaaccu

SEQ ID NO: 682489 - RNA, 22 nt, Human
gagcugggaagauagcuugagc

SEQ ID NO: 682490 - RNA, 22 nt, Human
aaaggccaauaaagacaagcug

SEQ ID NO: 682491 - RNA, 22 nt, Human
aacagcaauagcacuauucauu

SEQ ID NO: 682492 - RNA, 22 nt, Human
gaugagaauguuuaucaaaugc

SEQ ID NO: 682493 - RNA, 22 nt, Human
aggaagcccaagucucaucuuc

SEQ ID NO: 682494 - RNA, 22 nt, Human
cugcauccuaaccuccaugcag

SEQ ID NO: 682495 - RNA, 22 nt, Human
ucucuggcuuagguugagugca

SEQ ID NO: 682496 - RNA, 20 nt, Human
ggauggccggaccagagccu

SEQ ID NO: 682497 - RNA, 21 nt, Human
aaggcuggagaugcaggucug

SEQ ID NO: 682498 - RNA, 22 nt, Human
ugcauguguuugccacagugag

SEQ ID NO: 682499 - RNA, 19 nt, Human
agcugucugcugcuuuugu

SEQ ID NO: 682500 - RNA, 22 nt, Human
uaugcucuccucccagucccag

SEQ ID NO: 682501 - RNA, 22 nt, Human
agaagaaacugucggggauauu

SEQ ID NO: 682502 - RNA, 22 nt, Human
uuuccauauuuaaucaaaauaa

SEQ ID NO: 682503 - RNA, 22 nt, Human
gcagggcagccacaggcccccu

SEQ ID NO: 682504 - RNA, 23 nt, Human
gggggcgugucauggagggccac

SEQ ID NO: 682505 - RNA, 23 nt, Human
ccuccccuucccacagcugggug

SEQ ID NO: 682506 - RNA, 22 nt, Human
caguaugauugccaguucuauc

SEQ ID NO: 682507 - RNA, 18 nt, Human
uaaaccagaugacaguug

SEQ ID NO: 682508 - RNA, 22 nt, Human
aggccuccugcagggaugagug

SEQ ID NO: 682509 - RNA, 22 nt, Human
gcaauacaguugaagagauuga

SEQ ID NO: 682510 - RNA, 22 nt, Human
aaguuucauuguucauguaaca

SEQ ID NO: 682511 - RNA, 22 nt, Human
aggugcuggaguagaagaaaaa

SEQ ID NO: 682512 - RNA, 17 nt, Human
uccagcuccucauuguu

SEQ ID NO: 682513 - RNA, 22 nt, Human
ucacaucucccuggaggacaca

SEQ ID NO: 682514 - RNA, 22 nt, Human
aaaaauacuucacuucugggug

SEQ ID NO: 682515 - RNA, 22 nt, Human
auccccagggagugagcugucu

SEQ ID NO: 682516 - RNA, 21 nt, Human
aguacaucucaaauguaaauc

SEQ ID NO: 682517 - RNA, 22 nt, Human
ucuuuuaucuguuguguaacaa

SEQ ID NO: 682518 - RNA, 22 nt, Human
aaaucuuucccuuuacuaucca

SEQ ID NO: 682519 - RNA, 22 nt, Human
uuuuagaaauacugauuuagug

SEQ ID NO: 682520 - RNA, 22 nt, Human
caagggcagcagccucaagcgg

SEQ ID NO: 682521 - RNA, 22 nt, Human
aucauugaguaaaaugaauaca

SEQ ID NO: 682522 - RNA, 22 nt, Human
uccuugaagaaugauucuugga

SEQ ID NO: 682523 - RNA, 22 nt, Human
acagacauuuucuguauugccu

SEQ ID NO: 682524 - RNA, 22 nt, Human
ucacuaaugagcuaaggaaaag

SEQ ID NO: 682525 - RNA, 23 nt, Human
ugcacaggacggccuuauaagua

SEQ ID NO: 682526 - RNA, 22 nt, Human
ugcaagggcuuagggggcugug

SEQ ID NO: 682527 - RNA, 22 nt, Human
auaacuuaaugggucaugcucu

SEQ ID NO: 682528 - RNA, 22 nt, Human
uacagcuuaaaaaagccaacuu

SEQ ID NO: 682529 - RNA, 22 nt, Human
cacaugcuuagauuucagugga

SEQ ID NO: 682530 - RNA, 22 nt, Human
uacagccucaucacgggagcug

SEQ ID NO: 682531 - RNA, 22 nt, Human
cugcccauucaaccagcuacag

SEQ ID NO: 682532 - RNA, 22 nt, Human
agcagggcagcuuuuuucagaa

SEQ ID NO: 682533 - RNA, 22 nt, Human
uggggcuggcacagucucuauu

SEQ ID NO: 682534 - RNA, 22 nt, Human
uggcuggggccugaauccugca

SEQ ID NO: 682535 - RNA, 22 nt, Human
gucuucuguucugugaggcuuc

SEQ ID NO: 682536 - RNA, 22 nt, Human
agcacaauauggguuuuauagu

SEQ ID NO: 682537 - RNA, 22 nt, Human
agggcagagcacugaauuggga

SEQ ID NO: 682538 - RNA, 19 nt, Human
caugagcugcucacuuccc

SEQ ID NO: 682539 - RNA, 22 nt, Human
aggacacaccagguccagcugu

SEQ ID NO: 682540 - RNA, 22 nt, Human
gcuguucccauguggggcucag

SEQ ID NO: 682541 - RNA, 20 nt, Human
auucacaggcacaaaacccu

SEQ ID NO: 682542 - RNA, 19 nt, Human
ugaagcaggcagagaagau

SEQ ID NO: 682543 - RNA, 22 nt, Human
ugcauugagauuuuaaaauuca

SEQ ID NO: 682544 - RNA, 22 nt, Human
uugcuucauuaaguucucacag

SEQ ID NO: 682545 - RNA, 22 nt, Human
uguggcauacacaugagguggu

SEQ ID NO: 682546 - RNA, 22 nt, Human
ggcagaggaggggugaauuugc

SEQ ID NO: 682547 - RNA, 22 nt, Human
agugcaaagcagccuguacacc

SEQ ID NO: 682548 - RNA, 22 nt, Human
acauugaucagccucccaugca

SEQ ID NO: 682549 - RNA, 22 nt, Human
cccaggcagccugcagggaagg

SEQ ID NO: 682550 - RNA, 22 nt, Human
cugucagcuucuccuggccaga

SEQ ID NO: 682551 - RNA, 22 nt, Human
gggcuggggcucaauaauuugu

SEQ ID NO: 682552 - RNA, 22 nt, Human
uucaaagauaauguagcauuuu

SEQ ID NO: 682553 - RNA, 19 nt, Human
aggaaaggaucaaaauagc

SEQ ID NO: 682554 - RNA, 18 nt, Human
auauucaagaagacagag

SEQ ID NO: 682555 - RNA, 22 nt, Human
cucagugugagugagaagugca

SEQ ID NO: 682556 - RNA, 22 nt, Human
uuucaauaacaaagcucauuuu

SEQ ID NO: 682557 - RNA, 22 nt, Human
ccuaugccugucacucugcgcu

SEQ ID NO: 682558 - RNA, 22 nt, Human
uugcugugucauuuguuuaauc

SEQ ID NO: 682559 - RNA, 22 nt, Human
auucuacugcaaauccugacca

SEQ ID NO: 682560 - RNA, 22 nt, Human
gacauugaguauuucuuuucuc

SEQ ID NO: 682561 - RNA, 22 nt, Human
ugcugaggaaaaaugugacucu

SEQ ID NO: 682562 - RNA, 22 nt, Human
uacagaguauuuuuaauauggu

SEQ ID NO: 682563 - RNA, 23 nt, Human
uggcuccaugaaaauuacgagga

SEQ ID NO: 682564 - RNA, 20 nt, Human
caggcagaggaugcugacca

SEQ ID NO: 682565 - RNA, 21 nt, Human
uacauugaagaaugggaauga

SEQ ID NO: 682566 - RNA, 22 nt, Human
aaucuguuuaguucugcguaug

SEQ ID NO: 682567 - RNA, 22 nt, Human
uuggccaaauaaucuugcagau

SEQ ID NO: 682568 - RNA, 22 nt, Human
gaauggcauagcuuucuuuaca

SEQ ID NO: 682569 - RNA, 22 nt, Human
uuuauauagagauuugugcaug

SEQ ID NO: 682570 - RNA, 22 nt, Human
cccagcaucuccaggcauggcc

SEQ ID NO: 682571 - RNA, 22 nt, Human
gaggaaugucagcacaggccuc

SEQ ID NO: 682572 - RNA, 22 nt, Human
gagggggcgaacagaagcaagg

SEQ ID NO: 682573 - RNA, 22 nt, Human
cauaauuaggcaguugaucauu

SEQ ID NO: 682574 - RNA, 22 nt, Human
augaaaacagccuccugugaua

SEQ ID NO: 682575 - RNA, 22 nt, Human
uguuaugaacuucuagaaaaca

SEQ ID NO: 682576 - RNA, 22 nt, Human
aagauuauggcagauaacaauu

SEQ ID NO: 682577 - RNA, 22 nt, Human
cuguccuccggccaccuacagu

SEQ ID NO: 682578 - RNA, 22 nt, Human
ucuaccacucaugcuacuuacu

SEQ ID NO: 682579 - RNA, 22 nt, Human
aucuggagcaagauuaagagau

SEQ ID NO: 682580 - RNA, 22 nt, Human
aguucuuauugaauagaaauca

SEQ ID NO: 682581 - RNA, 22 nt, Human
uggcuucuuuguagaaauugaa

SEQ ID NO: 682582 - RNA, 22 nt, Human
caguuucuucuauuuugaacua

SEQ ID NO: 682583 - RNA, 21 nt, Human
ucugccugagacuuugcuggu

SEQ ID NO: 682584 - RNA, 22 nt, Human
uuagcuuuucucuauguuggcu

SEQ ID NO: 682585 - RNA, 22 nt, Human
aaaugcacaaaguaaguguaau

SEQ ID NO: 682586 - RNA, 22 nt, Human
ggugugucugccaggaacugca

SEQ ID NO: 682587 - RNA, 22 nt, Human
ggagaaugauauauagcucagu

SEQ ID NO: 682588 - RNA, 22 nt, Human
guggaaauaguuugguuauaga

SEQ ID NO: 682589 - RNA, 22 nt, Human
augcuguguggucaaguuaauu

SEQ ID NO: 682590 - RNA, 22 nt, Human
agacagcacuuuuguauggggg

SEQ ID NO: 682591 - RNA, 22 nt, Human
ucagaagccuugauuaucuaga

SEQ ID NO: 682592 - RNA, 22 nt, Human
aagagcauggaauggagaucca

SEQ ID NO: 682593 - RNA, 22 nt, Human
acaucucaugaaugauaaauca

SEQ ID NO: 682594 - RNA, 22 nt, Human
ccagggagcggggcugggucuc

SEQ ID NO: 682595 - RNA, 23 nt, Human
uaggggaaaaaucuucugcaauu

SEQ ID NO: 682596 - RNA, 22 nt, Human
uauuuaaaaagaggccagcugg

SEQ ID NO: 682597 - RNA, 22 nt, Human
ggcacagcacagagcacaugua

SEQ ID NO: 682598 - RNA, 22 nt, Human
gaggcuuucacaagguuaguuc

SEQ ID NO: 682599 - RNA, 23 nt, Human
aacagccaacuuuagcggguggc

SEQ ID NO: 682600 - RNA, 22 nt, Human
gaaauugucagugauaugauac

SEQ ID NO: 682601 - RNA, 22 nt, Human
aggcuauuuccacucuucucau

SEQ ID NO: 682602 - RNA, 22 nt, Human
uuaucucucacuuuuaaggaca

SEQ ID NO: 682603 - RNA, 22 nt, Human
cuucuucaauagcaagcgcaua

SEQ ID NO: 682604 - RNA, 22 nt, Human
guuuuauaauugcuucauaaga

SEQ ID NO: 682605 - RNA, 22 nt, Human
uggcugugaauggcaaauaauc

SEQ ID NO: 682606 - RNA, 22 nt, Human
uuauugacugaaaugagaguga

SEQ ID NO: 682607 - RNA, 22 nt, Human
ccugggcucgcgcacuucaccc

SEQ ID NO: 682608 - RNA, 22 nt, Human
ugaggggccagaccccaccuag

SEQ ID NO: 682609 - RNA, 22 nt, Human
acaugucuguaauuauuuuagg

SEQ ID NO: 682610 - RNA, 19 nt, Human
ugcuuaccaucugugcugg

SEQ ID NO: 682611 - RNA, 22 nt, Human
uacagucaacauugaugaugau

SEQ ID NO: 682612 - RNA, 22 nt, Human
aagguccaugacucggcauagu

SEQ ID NO: 682613 - RNA, 20 nt, Human
aacucagagaugaaaaagac

SEQ ID NO: 682614 - RNA, 22 nt, Human
cucaguuuccucuucuguugaa

SEQ ID NO: 682615 - RNA, 22 nt, Human
gucggccacgcaggugcgguag

SEQ ID NO: 682616 - RNA, 22 nt, Human
gagacugggggcuuggccuuuu

SEQ ID NO: 682617 - RNA, 22 nt, Human
aaugauccuacacauggaauuc

SEQ ID NO: 682618 - RNA, 22 nt, Human
cagggggcuguggcuguccagu

SEQ ID NO: 682619 - RNA, 22 nt, Human
agaaagugccucccuugggagc

SEQ ID NO: 682620 - RNA, 21 nt, Human
gagagcuaacagugacagcuc

SEQ ID NO: 682621 - RNA, 22 nt, Human
uuaacaaggugacugcauuaaa

SEQ ID NO: 682622 - RNA, 22 nt, Human
aauauagcucacuauaccaugg

SEQ ID NO: 682623 - RNA, 22 nt, Human
uuaaauauuauguugucugcaa

SEQ ID NO: 682624 - RNA, 19 nt, Human
gacuuuggaaaugcuguuu

SEQ ID NO: 682625 - RNA, 22 nt, Human
auuccuugcacaucagauaguu

SEQ ID NO: 682626 - RNA, 22 nt, Human
aggggauggagcuggaaggcag

SEQ ID NO: 682627 - RNA, 22 nt, Human
ugauuacaaaagauuguuugaa

SEQ ID NO: 682628 - RNA, 19 nt, Human
ggcucucccuugagagagc

SEQ ID NO: 682629 - RNA, 18 nt, Human
cuugagcuaagggacccc

SEQ ID NO: 682630 - RNA, 21 nt, Human
ugagccaggcugacggcugug

SEQ ID NO: 682631 - RNA, 22 nt, Human
agguaagguuuggaggcagugg

SEQ ID NO: 682632 - RNA, 21 nt, Human
agacagacugccugacccacg

SEQ ID NO: 682633 - RNA, 22 nt, Human
acagggcuuagaacuuggccuc

SEQ ID NO: 682634 - RNA, 22 nt, Human
cucugggcuuguugaccugcac

SEQ ID NO: 682635 - RNA, 22 nt, Human
aguuccauccuuccacugcccu

SEQ ID NO: 682636 - RNA, 22 nt, Human
cuucuucaucuguaaaacuugg

SEQ ID NO: 682637 - RNA, 19 nt, Human
caggaugaucccaugacac

SEQ ID NO: 682638 - RNA, 22 nt, Human
uuugaagaagcugaccuauuuu

SEQ ID NO: 682639 - RNA, 22 nt, Human
cuucaggaguaguuaccuagca

SEQ ID NO: 682640 - RNA, 22 nt, Human
aggcaggagugacccugacagg

SEQ ID NO: 682641 - RNA, 22 nt, Human
aagcacaucucaaacuucaucu

SEQ ID NO: 682642 - RNA, 22 nt, Human
aggaaacuaaggcucagugaag

SEQ ID NO: 682643 - RNA, 22 nt, Human
aucugcuuuugagaauuuacuu

SEQ ID NO: 682644 - RNA, 23 nt, Human
ugcugcccugccuucagcucucc

SEQ ID NO: 682645 - RNA, 22 nt, Human
ccaaaggcggaacugagucucu

SEQ ID NO: 682646 - RNA, 22 nt, Human
cuggcuuugaaaugcauuucag

SEQ ID NO: 682647 - RNA, 22 nt, Human
accaugaugcauccuuaaggaa

SEQ ID NO: 682648 - RNA, 22 nt, Human
uucuguaucucuguguuucuug

SEQ ID NO: 682649 - RNA, 22 nt, Human
uauagauagacugacgauacag

SEQ ID NO: 682650 - RNA, 22 nt, Human
aguuuguacugaauucaauuua

SEQ ID NO: 682651 - RNA, 22 nt, Human
acaugauuucagggaauucuca

SEQ ID NO: 682652 - RNA, 22 nt, Human
uacauacauauucauacaggug

SEQ ID NO: 682653 - RNA, 20 nt, Human
agcaggaaaagugccagucu

SEQ ID NO: 682654 - RNA, 22 nt, Human
uaccugaaccaagcccagcucu

SEQ ID NO: 682655 - RNA, 18 nt, Human
guuaacaauuacuaacgc

SEQ ID NO: 682656 - RNA, 22 nt, Human
agagccccucgguggagggguc

SEQ ID NO: 682657 - RNA, 21 nt, Human
cagaggcugagagggcaaucu

SEQ ID NO: 682658 - RNA, 22 nt, Human
uuauuagggugguuuauguucu

SEQ ID NO: 682659 - RNA, 22 nt, Human
cauggcuucaaagccuuuggca

SEQ ID NO: 682660 - RNA, 22 nt, Human
aagccagggauuccugagggag

SEQ ID NO: 682661 - RNA, 22 nt, Human
ggggcagauggaacagagcaca

SEQ ID NO: 682662 - RNA, 22 nt, Human
aaggguccagcaccucggcucc

SEQ ID NO: 682663 - RNA, 22 nt, Human
gccucccuccaccacugcaggu

SEQ ID NO: 682664 - RNA, 22 nt, Human
acaaacugaauggguuuucugu

SEQ ID NO: 682665 - RNA, 22 nt, Human
aauagaggagcuuuggacuccc

SEQ ID NO: 682666 - RNA, 20 nt, Human
ucagcucuuagaggucgcuu

SEQ ID NO: 682667 - RNA, 22 nt, Human
aacaagaagggaaggcaugauu

SEQ ID NO: 682668 - RNA, 18 nt, Human
gcagugccagccucuccu

SEQ ID NO: 682669 - RNA, 22 nt, Human
uuaauggaugcggcugcgugac

SEQ ID NO: 682670 - RNA, 18 nt, Human
gcuucucauuucuaagca

SEQ ID NO: 682671 - RNA, 22 nt, Human
caauguaucaagaagcaucagu

SEQ ID NO: 682672 - RNA, 18 nt, Human
ugcagcauguucccauaa

SEQ ID NO: 682673 - RNA, 22 nt, Human
acaaucauuccguucacaacag

SEQ ID NO: 682674 - RNA, 22 nt, Human
uguucccauggauaucugcaua

SEQ ID NO: 682675 - RNA, 22 nt, Human
agcagugggugacagagcugag

SEQ ID NO: 682676 - RNA, 22 nt, Human
caguccagccaguagggugugg

SEQ ID NO: 682677 - RNA, 22 nt, Human
auauaguuggguuucauucuac

SEQ ID NO: 682678 - RNA, 22 nt, Human
acugccugagcuauuggaaaag

SEQ ID NO: 682679 - RNA, 22 nt, Human
cuggccccaucuggagucugag

SEQ ID NO: 682680 - RNA, 18 nt, Human
uggccccuuaucaguccu

SEQ ID NO: 682681 - RNA, 22 nt, Human
gugccugggacacgagauuuuc

SEQ ID NO: 682682 - RNA, 22 nt, Human
uugauucugcugaucucggacg

SEQ ID NO: 682683 - RNA, 22 nt, Human
cagcugccacaccucuuucucu

SEQ ID NO: 682684 - RNA, 22 nt, Human
ucugucugaggaguuuuugacc

SEQ ID NO: 682685 - RNA, 22 nt, Human
acacuuuacagcuuccuuugca

SEQ ID NO: 682686 - RNA, 20 nt, Human
uuucagagugucuuuccauu

SEQ ID NO: 682687 - RNA, 23 nt, Human
ggaggucagugccugagggugag

SEQ ID NO: 682688 - RNA, 22 nt, Human
acauugaauucaaaauuacuga

SEQ ID NO: 682689 - RNA, 22 nt, Human
acucuggguucuuucacuugac

SEQ ID NO: 682690 - RNA, 22 nt, Human
ggcuggaaacucagguaggguu

SEQ ID NO: 682691 - RNA, 22 nt, Human
cacacaugguuccgcaggaugc

SEQ ID NO: 682692 - RNA, 22 nt, Human
acacuuuacagaauguuuugau

SEQ ID NO: 682693 - RNA, 22 nt, Human
ggcuucucagcacacuguccac

SEQ ID NO: 682694 - RNA, 22 nt, Human
ugagccccggaguuucaggcug

SEQ ID NO: 682695 - RNA, 22 nt, Human
cuggccacugcgggccucugcc

SEQ ID NO: 682696 - RNA, 22 nt, Human
agcaugaaaacaugaaacagca

SEQ ID NO: 682697 - RNA, 22 nt, Human
uauauucugauuccaucugugu

SEQ ID NO: 682698 - RNA, 22 nt, Human
cugcauaugauagaugccuugc

SEQ ID NO: 682699 - RNA, 22 nt, Human
aacacauggcaagagcaggaaa

SEQ ID NO: 682700 - RNA, 22 nt, Human
uugcugccugaggagcaacacu

SEQ ID NO: 682701 - RNA, 23 nt, Human
ccuucuguuaaccaucugggggg

SEQ ID NO: 682702 - RNA, 20 nt, Human
gaggagccaccuugagcugg

SEQ ID NO: 682703 - RNA, 22 nt, Human
auggccagcuagcacuugcauu

SEQ ID NO: 682704 - RNA, 22 nt, Human
cagagcugauuggauccagaga

SEQ ID NO: 682705 - RNA, 22 nt, Human
agcccagcaaagggguuugaga

SEQ ID NO: 682706 - RNA, 22 nt, Human
acaaaguuauucuuucagagga

SEQ ID NO: 682707 - RNA, 22 nt, Human
uucuccaggccgcgcagggggc

SEQ ID NO: 682708 - RNA, 22 nt, Human
cagcaagggauaaacaaggacg

SEQ ID NO: 682709 - RNA, 22 nt, Human
gagagaaaagggggaauugauu

SEQ ID NO: 682710 - RNA, 19 nt, Human
augagcuggcauuucaggu

SEQ ID NO: 682711 - RNA, 22 nt, Human
ugcaucagaguuugcugcugcu

SEQ ID NO: 682712 - RNA, 22 nt, Human
ucucugugacauuucugagccu

SEQ ID NO: 682713 - RNA, 22 nt, Human
aagggaugcaggaaagaagguu

SEQ ID NO: 682714 - RNA, 22 nt, Human
ggggacaguuaaagaccaagac

SEQ ID NO: 682715 - RNA, 21 nt, Human
gggcagcagcagcaacaaggg

SEQ ID NO: 682716 - RNA, 22 nt, Human
aggucauuuuugccuucuauuu

SEQ ID NO: 682717 - RNA, 22 nt, Human
ucucagaguaauucuuuaaggu

SEQ ID NO: 682718 - RNA, 22 nt, Human
ccagucaguucugauuaugugg

SEQ ID NO: 682719 - RNA, 22 nt, Human
cccaggucccggggccagcugc

SEQ ID NO: 682720 - RNA, 22 nt, Human
gaguccuuaauacacuggugga

SEQ ID NO: 682721 - RNA, 22 nt, Human
ccaggcagagugcuccagaaag

SEQ ID NO: 682722 - RNA, 22 nt, Human
aaauauacuagaugaugaccca

SEQ ID NO: 682723 - RNA, 22 nt, Human
aggcuggaucucuguugccuuc

SEQ ID NO: 682724 - RNA, 22 nt, Human
cugccacuuucacccagugcuc

SEQ ID NO: 682725 - RNA, 22 nt, Human
ccagguaccagucaaaucugua

SEQ ID NO: 682726 - RNA, 22 nt, Human
uguagaaggcuauagacuagga

SEQ ID NO: 682727 - RNA, 22 nt, Human
gcugaagagcaaggcugggucu

SEQ ID NO: 682728 - RNA, 22 nt, Human
ggcuucaauguauucacauuca

SEQ ID NO: 682729 - RNA, 22 nt, Human
uccagucaucucccuucacauu

SEQ ID NO: 682730 - RNA, 22 nt, Human
gcuucuaucccuccacugcacu

SEQ ID NO: 682731 - RNA, 22 nt, Human
cccaggcugugcaaacuucaaa

SEQ ID NO: 682732 - RNA, 22 nt, Human
gcuguuccugcuuagaggucgg

SEQ ID NO: 682733 - RNA, 22 nt, Human
acaucugagcaacagaacacua

SEQ ID NO: 682734 - RNA, 22 nt, Human
acagaugagagacaaugugcua

SEQ ID NO: 682735 - RNA, 22 nt, Human
acucuacagaaugaauaccugu

SEQ ID NO: 682736 - RNA, 22 nt, Human
cugcagucagcuuuuaagaucu

SEQ ID NO: 682737 - RNA, 22 nt, Human
aacacauauuuauauaugcaca

SEQ ID NO: 682738 - RNA, 22 nt, Human
uugcauuucccauugaguaaug

SEQ ID NO: 682739 - RNA, 22 nt, Human
ugggauaucugucagcagcuuc

SEQ ID NO: 682740 - RNA, 22 nt, Human
uuagagccaguuacaaggucaa

SEQ ID NO: 682741 - RNA, 22 nt, Human
uuccaccauucaugcuaauauu

SEQ ID NO: 682742 - RNA, 22 nt, Human
guuucuguugcucagauaaugc

SEQ ID NO: 682743 - RNA, 22 nt, Human
uagagguauaccaaaaaggcau

SEQ ID NO: 682744 - RNA, 22 nt, Human
ggcgguggcgugaagguggcug

SEQ ID NO: 682745 - RNA, 22 nt, Human
ucacaguaaaagcauggaagag

SEQ ID NO: 682746 - RNA, 22 nt, Human
ucugucacaauuugcuuacucu

SEQ ID NO: 682747 - RNA, 23 nt, Human
guggagagauuaguaauucaccc

SEQ ID NO: 682748 - RNA, 22 nt, Human
acaucuguccucugcagagcuc

SEQ ID NO: 682749 - RNA, 18 nt, Human
gcaaggcucaggccaggc

SEQ ID NO: 682750 - RNA, 22 nt, Human
cuggagaaacaucaggcauagg

SEQ ID NO: 682751 - RNA, 22 nt, Human
agcagcaggcuagggaacugcu

SEQ ID NO: 682752 - RNA, 22 nt, Human
ggccuucugccuuucagcaaug

SEQ ID NO: 682753 - RNA, 22 nt, Human
cuuccuagcuucagagucuguu

SEQ ID NO: 682754 - RNA, 22 nt, Human
guggcccuuuguuuugauaccu

SEQ ID NO: 682755 - RNA, 22 nt, Human
ugagagcugccacgugaccaug

SEQ ID NO: 682756 - RNA, 22 nt, Human
ucacaggcuccagggccuggau

SEQ ID NO: 682757 - RNA, 22 nt, Human
uccaagcucucuaugccaugau

SEQ ID NO: 682758 - RNA, 19 nt, Human
gggacuggaggauguggag

SEQ ID NO: 682759 - RNA, 22 nt, Human
uauuugaaaguguacaaaaacu

SEQ ID NO: 682760 - RNA, 22 nt, Human
aggcugcucugcgaagucagcu

SEQ ID NO: 682761 - RNA, 19 nt, Human
ucagggcaguccggucccc

SEQ ID NO: 682762 - RNA, 22 nt, Human
ugccugaggagucagggcaggu

SEQ ID NO: 682763 - RNA, 22 nt, Human
gaacugucauuggggacaucag

SEQ ID NO: 682764 - RNA, 22 nt, Human
caggauugaaugcuucucccug

SEQ ID NO: 682765 - RNA, 22 nt, Human
agcaucagcagacucucagcua

SEQ ID NO: 682766 - RNA, 22 nt, Human
ucuucagcagggccucucugag

SEQ ID NO: 682767 - RNA, 22 nt, Human
uuucaaauggagucgugaaaug

SEQ ID NO: 682768 - RNA, 22 nt, Human
uggcaaagaugaagcauuucgu

SEQ ID NO: 682769 - RNA, 22 nt, Human
ucugcugcacaaauucaucucu

SEQ ID NO: 682770 - RNA, 22 nt, Human
uuagaaaggaaucuucauuuca

SEQ ID NO: 682771 - RNA, 22 nt, Human
ucaaccucuggagaaaucagga

SEQ ID NO: 682772 - RNA, 22 nt, Human
cuuauuucuccauccagaguca

SEQ ID NO: 682773 - RNA, 22 nt, Human
ggcagugaaugaaacagaggcu

SEQ ID NO: 682774 - RNA, 22 nt, Human
acacuucucccaucuccuguug

SEQ ID NO: 682775 - RNA, 23 nt, Human
uaccugaaguaagcauucaucca

SEQ ID NO: 682776 - RNA, 22 nt, Human
ugcaagagcuguggcaaaagca

SEQ ID NO: 682777 - RNA, 22 nt, Human
uccuuuaaagaacugugcuuuu

SEQ ID NO: 682778 - RNA, 22 nt, Human
gaaugaauagguguccagaugg

SEQ ID NO: 682779 - RNA, 22 nt, Human
auuaaaguugaaauugaacuga

SEQ ID NO: 682780 - RNA, 19 nt, Human
auuuccaagaauuggagag

SEQ ID NO: 682781 - RNA, 22 nt, Human
ggggaggaagcuggaacacggg

SEQ ID NO: 682782 - RNA, 20 nt, Human
aguguacagacacuagaaau

SEQ ID NO: 682783 - RNA, 22 nt, Human
augagcagaugcuccugccucu

SEQ ID NO: 682784 - RNA, 22 nt, Human
ccauuuggaggucauuaggaca

SEQ ID NO: 682785 - RNA, 23 nt, Human
uccuccugagugagagugccagc

SEQ ID NO: 682786 - RNA, 22 nt, Human
ugcauuguugaccaguugugca

SEQ ID NO: 682787 - RNA, 22 nt, Human
uugauacaggcucuauuucauc

SEQ ID NO: 682788 - RNA, 22 nt, Human
ugcccugucuaagcugucagua

SEQ ID NO: 682789 - RNA, 22 nt, Human
cucagagggaggacugggcugg

SEQ ID NO: 682790 - RNA, 22 nt, Human
guuuauaugugugccacucuua

SEQ ID NO: 682791 - RNA, 21 nt, Human
ccuucucuugcuucagcuuca

SEQ ID NO: 682792 - RNA, 22 nt, Human
acagccuguuugaucuggugcu

SEQ ID NO: 682793 - RNA, 22 nt, Human
ucacuugaccucuugaacuccu

SEQ ID NO: 682794 - RNA, 22 nt, Human
caacagcucagacacgggaccu

SEQ ID NO: 682795 - RNA, 20 nt, Human
cauuuguuagcuuucuacug

SEQ ID NO: 682796 - RNA, 22 nt, Human
ucucucagaggccaggguccug

SEQ ID NO: 682797 - RNA, 22 nt, Human
augucugcuuuccuuuuaauca

SEQ ID NO: 682798 - RNA, 22 nt, Human
auccuugagccuuaucuuuugu

SEQ ID NO: 682799 - RNA, 23 nt, Human
aggaugugcauaugaccuaauca

SEQ ID NO: 682800 - RNA, 22 nt, Human
gcaggguauaauacuuagguga

SEQ ID NO: 682801 - RNA, 22 nt, Human
ucagcaaaggcaauucauuauu

SEQ ID NO: 682802 - RNA, 18 nt, Human
ggcucagcaggcucucuc

SEQ ID NO: 682803 - RNA, 22 nt, Human
ugaucuuuucaaagacaagcuu

SEQ ID NO: 682804 - RNA, 22 nt, Human
gauuuaaaguagaccuuuguuu

SEQ ID NO: 682805 - RNA, 22 nt, Human
cuacaacauuaugcuuucuguc

SEQ ID NO: 682806 - RNA, 23 nt, Human
aaacuugcuauggcugaaaucau

SEQ ID NO: 682807 - RNA, 22 nt, Human
ccugggaaagugaggucauuau

SEQ ID NO: 682808 - RNA, 22 nt, Human
accuccccucaccaaucugguu

SEQ ID NO: 682809 - RNA, 22 nt, Human
uucauggaguugagaaggcuaa

SEQ ID NO: 682810 - RNA, 22 nt, Human
uggggagauuguuaaauuuaga

SEQ ID NO: 682811 - RNA, 22 nt, Human
guucuucacauuucauugagga

SEQ ID NO: 682812 - RNA, 22 nt, Human
ucccagccauuccuuuaggugu

SEQ ID NO: 682813 - RNA, 22 nt, Human
gcugagagaaaagugagguucu

SEQ ID NO: 682814 - RNA, 22 nt, Human
cuguauauaauguaugcauggg

SEQ ID NO: 682815 - RNA, 21 nt, Human
caaagccaggcaacucucucc

SEQ ID NO: 682816 - RNA, 22 nt, Human
caguuccuaugggcaaaacaca

SEQ ID NO: 682817 - RNA, 23 nt, Human
gcccugcccuuagcacacucaca

SEQ ID NO: 682818 - RNA, 22 nt, Human
auauuugugguuuuuggcuccu

SEQ ID NO: 682819 - RNA, 22 nt, Human
aggugggcacaccucccuucuc

SEQ ID NO: 682820 - RNA, 22 nt, Human
ugagaauuugcauuucuaacaa

SEQ ID NO: 682821 - RNA, 22 nt, Human
ccuaggaacccccaggcuucug

SEQ ID NO: 682822 - RNA, 22 nt, Human
agcuucuagcccauccagcagg

SEQ ID NO: 682823 - RNA, 22 nt, Human
ggcagcuggccuccucgcccac

SEQ ID NO: 682824 - RNA, 22 nt, Human
gaacacuugcuguuaauaagug

SEQ ID NO: 682825 - RNA, 22 nt, Human
cuguccagucuuuagcaagcug

SEQ ID NO: 682826 - RNA, 22 nt, Human
uuugcacuagcauuuguccaug

SEQ ID NO: 682827 - RNA, 22 nt, Human
aacaaugaggaucuguucugag

SEQ ID NO: 682828 - RNA, 22 nt, Human
aaacucaaguuucuuaauguca

SEQ ID NO: 682829 - RNA, 22 nt, Human
aaccagcucugcaaaaugucau

SEQ ID NO: 682830 - RNA, 23 nt, Human
ucugccagugugugccaggagcc

SEQ ID NO: 682831 - RNA, 19 nt, Human
ugccagcauuaggcugaag

SEQ ID NO: 682832 - RNA, 22 nt, Human
ucuuccuugccuugcuucauca

SEQ ID NO: 682833 - RNA, 22 nt, Human
ccuggggcuuucuuuguaucau

SEQ ID NO: 682834 - RNA, 22 nt, Human
uggcagaaguacacaagcaugc

SEQ ID NO: 682835 - RNA, 17 nt, Human
cacugugggggcauuua

SEQ ID NO: 682836 - RNA, 22 nt, Human
ccacugccuauuugcagggccc

SEQ ID NO: 682837 - RNA, 22 nt, Human
ggccaccuggcugugggggcag

SEQ ID NO: 682838 - RNA, 22 nt, Human
cagcaccagcauauuccagggc

SEQ ID NO: 682839 - RNA, 22 nt, Human
agggacuauuuacccaucucac

SEQ ID NO: 682840 - RNA, 22 nt, Human
ucuuugcacugugcaagcagaa

SEQ ID NO: 682841 - RNA, 22 nt, Human
uguauguaaaguuuguaauaga

SEQ ID NO: 682842 - RNA, 16 nt, Human
gucucuucccugcuga

SEQ ID NO: 682843 - RNA, 18 nt, Human
ugugccucugcaggacgu

SEQ ID NO: 682844 - RNA, 22 nt, Human
uuuaacagaugcuaugucuacc

SEQ ID NO: 682845 - RNA, 22 nt, Human
acacacugagugccauaggacc

SEQ ID NO: 682846 - RNA, 22 nt, Human
gcccaggaaauaaaagugggcu

SEQ ID NO: 682847 - RNA, 22 nt, Human
gucccucugcucuagagagcca

SEQ ID NO: 682848 - RNA, 22 nt, Human
agaacaguuuguuggagacugu

SEQ ID NO: 682849 - RNA, 22 nt, Human
uucaaugagcccggggccauag

SEQ ID NO: 682850 - RNA, 22 nt, Human
gggggagcuacaggucccuugg

SEQ ID NO: 682851 - RNA, 22 nt, Human
uguucuagcaacacaguuuugg

SEQ ID NO: 682852 - RNA, 22 nt, Human
aagaacagauucagccugaacu

SEQ ID NO: 682853 - RNA, 22 nt, Human
gcaagcagaucuccggagggaa

SEQ ID NO: 682854 - RNA, 22 nt, Human
uggcaguguauagguggcuccu

SEQ ID NO: 682855 - RNA, 22 nt, Human
caucuggguucucagauggaua

SEQ ID NO: 682856 - RNA, 22 nt, Human
uuccaagucacccuuaggguca

SEQ ID NO: 682857 - RNA, 21 nt, Human
ugagcaaaauuuagagugaug

SEQ ID NO: 682858 - RNA, 22 nt, Human
auuuguucagcauugaauuugg

SEQ ID NO: 682859 - RNA, 22 nt, Human
cuuucacuuuaaucugacaccu

SEQ ID NO: 682860 - RNA, 22 nt, Human
acucccuuuucuacuucuaccc

SEQ ID NO: 682861 - RNA, 22 nt, Human
gacagccaugcacuucugcugu

SEQ ID NO: 682862 - RNA, 22 nt, Human
gaaucucaggaagaucucugca

SEQ ID NO: 682863 - RNA, 22 nt, Human
guguaugauuucaaauggcuag

SEQ ID NO: 682864 - RNA, 22 nt, Human
cuuucccagaguaguugaugcu

SEQ ID NO: 682865 - RNA, 22 nt, Human
uggccuggcugcccugucugga

SEQ ID NO: 682866 - RNA, 21 nt, Human
uuuauguacuucauagaguag

SEQ ID NO: 682867 - RNA, 22 nt, Human
gcauucuuuuuaggagguuccu

SEQ ID NO: 682868 - RNA, 22 nt, Human
gagcuguuugugacaggcugug

SEQ ID NO: 682869 - RNA, 22 nt, Human
accagugggaaguggaaaauga

SEQ ID NO: 682870 - RNA, 22 nt, Human
ucuuuucuggacucugcaugga

SEQ ID NO: 682871 - RNA, 17 nt, Human
ggucugugucuagggaa

SEQ ID NO: 682872 - RNA, 22 nt, Human
aggagccaugagugacaucaca

SEQ ID NO: 682873 - RNA, 22 nt, Human
agcaggcaccagggcucguccu

SEQ ID NO: 682874 - RNA, 22 nt, Human
ucugccuggcucauggcaguga

SEQ ID NO: 682875 - RNA, 22 nt, Human
uaggaaggaggccaucuuggcg

SEQ ID NO: 682876 - RNA, 22 nt, Human
gccugcuucucagucagcuugg

SEQ ID NO: 682877 - RNA, 22 nt, Human
gcuccugggcccugggcuaacu

SEQ ID NO: 682878 - RNA, 22 nt, Human
aauacuuugccaaguucgaaga

SEQ ID NO: 682879 - RNA, 18 nt, Human
acucugggaccuguuauu

SEQ ID NO: 682880 - RNA, 21 nt, Human
ugggagagggcucagcuaccc

SEQ ID NO: 682881 - RNA, 22 nt, Human
auuaguguuguaagaagcugcc

SEQ ID NO: 682882 - RNA, 22 nt, Human
gcugcagcagaaguucucagag

SEQ ID NO: 682883 - RNA, 22 nt, Human
aauauagaaucacuuuccuuca

SEQ ID NO: 682884 - RNA, 23 nt, Human
gcuugccugguguguggcugacc

SEQ ID NO: 682885 - RNA, 22 nt, Human
aguguuucuggcaaaugaaagu

SEQ ID NO: 682886 - RNA, 22 nt, Human
ucccagugggugacuggaggcu

SEQ ID NO: 682887 - RNA, 23 nt, Human
aagcccugaagguuucaggcccu

SEQ ID NO: 682888 - RNA, 22 nt, Human
guguccugaucaauugagcugg

SEQ ID NO: 682889 - RNA, 22 nt, Human
uguauauucugccuaaaagcuu

SEQ ID NO: 682890 - RNA, 22 nt, Human
uccuucaaaaguugagagagcc

SEQ ID NO: 682891 - RNA, 22 nt, Human
cagagacagggcagggagugug

SEQ ID NO: 682892 - RNA, 22 nt, Human
uaucgguaagauggaaaucagg

SEQ ID NO: 682893 - RNA, 22 nt, Human
uaguacagaaaaccucaggguc

SEQ ID NO: 682894 - RNA, 22 nt, Human
ggccccugcggacugccuagag

SEQ ID NO: 682895 - RNA, 22 nt, Human
ugauuucccucaucauaacaga

SEQ ID NO: 682896 - RNA, 22 nt, Human
cauuaugugggaaaauguucuu

SEQ ID NO: 682897 - RNA, 22 nt, Human
gcugugagggcuucugaggcau

SEQ ID NO: 682898 - RNA, 22 nt, Human
agggcacagccuaaagccuaug

SEQ ID NO: 682899 - RNA, 22 nt, Human
cccagagauguccugagugaua

SEQ ID NO: 682900 - RNA, 22 nt, Human
ucucuucacaugcuugcuccaa

SEQ ID NO: 682901 - RNA, 22 nt, Human
cgcugcagaagcguguucagga

SEQ ID NO: 682902 - RNA, 22 nt, Human
agugucugcggcggggaggcgg

SEQ ID NO: 682903 - RNA, 22 nt, Human
aagauguugucguuagugauga

SEQ ID NO: 682904 - RNA, 22 nt, Human
guuauacuuaugugcaaaaaua

SEQ ID NO: 682905 - RNA, 22 nt, Human
gugcauuacauguaauaaaaua

SEQ ID NO: 682906 - RNA, 22 nt, Human
cagggugcauacccaugcauac

SEQ ID NO: 682907 - RNA, 22 nt, Human
gugcaugcaaauuacuguaaag

SEQ ID NO: 682908 - RNA, 22 nt, Human
ucuguuucuccaacauugugag

SEQ ID NO: 682909 - RNA, 22 nt, Human
ucuucuaguaggccaagaagcu

SEQ ID NO: 682910 - RNA, 22 nt, Human
uuugaauguuggauugacuuag

SEQ ID NO: 682911 - RNA, 20 nt, Human
gaauguuucacuugcuccau

SEQ ID NO: 682912 - RNA, 22 nt, Human
ucccuuuggauccaagcuuaug

SEQ ID NO: 682913 - RNA, 22 nt, Human
gagcaacacauugaaugaggau

SEQ ID NO: 682914 - RNA, 22 nt, Human
uggcuaugacuucguacugucu

SEQ ID NO: 682915 - RNA, 22 nt, Human
gacaaagagaaguaacaguacc

SEQ ID NO: 682916 - RNA, 22 nt, Human
gagugugguaugcucugaggcu

SEQ ID NO: 682917 - RNA, 18 nt, Human
guccauggccuccaccca

SEQ ID NO: 682918 - RNA, 22 nt, Human
ugcuuugggucucucuaguuuc

SEQ ID NO: 682919 - RNA, 22 nt, Human
acauuauagcuuugaguuugga

SEQ ID NO: 682920 - RNA, 22 nt, Human
agguaacuagcauuagcuucug

SEQ ID NO: 682921 - RNA, 22 nt, Human
ugagucacagccuugccuuggu

SEQ ID NO: 682922 - RNA, 22 nt, Human
uuuuaaguuggauugcuaagua

SEQ ID NO: 682923 - RNA, 22 nt, Human
uacagugacuggacuuugucau

SEQ ID NO: 682924 - RNA, 22 nt, Human
cagggagaucuuggcuccuggu

SEQ ID NO: 682925 - RNA, 22 nt, Human
ccaggaaggaagcagggguuuc

SEQ ID NO: 682926 - RNA, 22 nt, Human
uaccaggucugugcagguguca

SEQ ID NO: 682927 - RNA, 22 nt, Human
uaacagcaaccacagugcuggu

SEQ ID NO: 682928 - RNA, 22 nt, Human
cugggccacagacucaaggcag

SEQ ID NO: 682929 - RNA, 22 nt, Human
ucccugagcugagcucaacagc

SEQ ID NO: 682930 - RNA, 22 nt, Human
cugcauguuuacauuuuugaga

SEQ ID NO: 682931 - RNA, 22 nt, Human
ucacugaaaguaauucuaguga

SEQ ID NO: 682932 - RNA, 22 nt, Human
acaagauaaggugucagugugu

SEQ ID NO: 682933 - RNA, 22 nt, Human
uggcagguggagacagcagagc

SEQ ID NO: 682934 - RNA, 22 nt, Human
uuaagcauggaagugaaauaau

SEQ ID NO: 682935 - RNA, 22 nt, Human
agucacaauaccgugugucagu

SEQ ID NO: 682936 - RNA, 22 nt, Human
gggugggcccagcccagagaag

SEQ ID NO: 682937 - RNA, 21 nt, Human
ucauuuuuauugcuaccuugc

SEQ ID NO: 682938 - RNA, 22 nt, Human
uaagacaccucucugcccuuca

SEQ ID NO: 682939 - RNA, 22 nt, Human
aaggccauuauucugauauauu

SEQ ID NO: 682940 - RNA, 22 nt, Human
uuuccuguucuaguuguugcca

SEQ ID NO: 682941 - RNA, 22 nt, Human
augucuguucauuauuaacugc

SEQ ID NO: 682942 - RNA, 22 nt, Human
gcaggcugugaggcucagaugg

SEQ ID NO: 682943 - RNA, 22 nt, Human
gacagggccgcagauggagacu

SEQ ID NO: 682944 - RNA, 22 nt, Human
guucuucagcauuagaagucau

SEQ ID NO: 682945 - RNA, 22 nt, Human
aaggccagacaggaccacaucu

SEQ ID NO: 682946 - RNA, 22 nt, Human
cuagaucagcuaacuuuccagu

SEQ ID NO: 682947 - RNA, 22 nt, Human
uugauucaucuucuaauaccca

SEQ ID NO: 682948 - RNA, 20 nt, Human
gcugaggagcagugugguug

SEQ ID NO: 682949 - RNA, 22 nt, Human
aguccagaccccggcagcuggu

SEQ ID NO: 682950 - RNA, 22 nt, Human
uucaagugaggcugucuuuaga

SEQ ID NO: 682951 - RNA, 22 nt, Human
uuugcagucuggccugcuuugg

SEQ ID NO: 682952 - RNA, 22 nt, Human
caguauauuuuagagaaguccc

SEQ ID NO: 682953 - RNA, 19 nt, Human
uucccaggaaaggggugca

SEQ ID NO: 682954 - RNA, 22 nt, Human
ugggauguggccaugguucucu

SEQ ID NO: 682955 - RNA, 22 nt, Human
caguguuuguggaauucaggug

SEQ ID NO: 682956 - RNA, 22 nt, Human
aggcugaggcagguggaucacu

SEQ ID NO: 682957 - RNA, 22 nt, Human
uggggguguccuggugcacaca

SEQ ID NO: 682958 - RNA, 17 nt, Human
ugauucaacuagaaacu

SEQ ID NO: 682959 - RNA, 22 nt, Human
acaggccauaaaggcaggcccu

SEQ ID NO: 682960 - RNA, 22 nt, Human
augauacaagcaaaacuaauca

SEQ ID NO: 682961 - RNA, 22 nt, Human
caugcuguguguuuuagcucca

SEQ ID NO: 682962 - RNA, 22 nt, Human
gauauucaaguggaauuauucu

SEQ ID NO: 682963 - RNA, 22 nt, Human
caagacuuagagcaucuugaaa

SEQ ID NO: 682964 - RNA, 18 nt, Human
gggcuuuacagaguggag

SEQ ID NO: 682965 - RNA, 22 nt, Human
uugauuuucaauucauugacaa

SEQ ID NO: 682966 - RNA, 22 nt, Human
acugcuucacugcgucuuaucu

SEQ ID NO: 682967 - RNA, 22 nt, Human
ccccacaguccgugaggagcca

SEQ ID NO: 682968 - RNA, 22 nt, Human
guagcagaaucagugcuacaga

SEQ ID NO: 682969 - RNA, 22 nt, Human
cucccucacacccuugcccaga

SEQ ID NO: 682970 - RNA, 22 nt, Human
ggagcagccacgucucagggca

SEQ ID NO: 682971 - RNA, 22 nt, Human
cagcaggggugucauuguaguu

SEQ ID NO: 682972 - RNA, 22 nt, Human
auggcuuucagauggugaaaga

SEQ ID NO: 682973 - RNA, 22 nt, Human
cugcuucaaggaaaugaaucgg

SEQ ID NO: 682974 - RNA, 22 nt, Human
gcauacagagaggauguggcau

SEQ ID NO: 682975 - RNA, 22 nt, Human
cuguggcuucugggucaguuca

SEQ ID NO: 682976 - RNA, 19 nt, Human
agcaaccugucagagaugc

SEQ ID NO: 682977 - RNA, 22 nt, Human
gcucccugacucaguuccugag

SEQ ID NO: 682978 - RNA, 22 nt, Human
gagcugguccacaaucugcagg

SEQ ID NO: 682979 - RNA, 22 nt, Human
ccacugagcaguagcugcgucg

SEQ ID NO: 682980 - RNA, 22 nt, Human
ucuuggccccaacccucuauuu

SEQ ID NO: 682981 - RNA, 22 nt, Human
caguggagugggacuggucuga

SEQ ID NO: 682982 - RNA, 22 nt, Human
uguggcagcugcugcaggagcu

SEQ ID NO: 682983 - RNA, 22 nt, Human
acucuuacucccucaggcacug

SEQ ID NO: 682984 - RNA, 22 nt, Human
ccacuguuggcccgaagggguc

SEQ ID NO: 682985 - RNA, 22 nt, Human
cagcacaguuucccccaugagc

SEQ ID NO: 682986 - RNA, 22 nt, Human
cagggagcuuucccaggacccu

SEQ ID NO: 682987 - RNA, 22 nt, Human
uguggacugugcugccacagug

SEQ ID NO: 682988 - RNA, 21 nt, Human
uccagggcgggcgcacggaga

SEQ ID NO: 682989 - RNA, 22 nt, Human
uuccuuacauucauauggcuuc

SEQ ID NO: 682990 - RNA, 22 nt, Human
uuucaaacuuaaauaccuuucc

SEQ ID NO: 682991 - RNA, 22 nt, Human
aucuuccuucacuuucucccac

SEQ ID NO: 682992 - RNA, 22 nt, Human
gagggcugugaaggagcggguu

SEQ ID NO: 682993 - RNA, 22 nt, Human
aaguggagucccuacaaccagc

SEQ ID NO: 682994 - RNA, 17 nt, Human
cuaggcuuggcagcucg

SEQ ID NO: 682995 - RNA, 22 nt, Human
uuucuaggucuuccauacugcc

SEQ ID NO: 682996 - RNA, 22 nt, Human
gaaugcaaauauauggaucagu

SEQ ID NO: 682997 - RNA, 22 nt, Human
cuuuggaugacuggugcagguu

SEQ ID NO: 682998 - RNA, 22 nt, Human
acagcagagugugagauagcca

SEQ ID NO: 682999 - RNA, 22 nt, Human
cugcuuggaguccuccagcacc

SEQ ID NO: 683000 - RNA, 22 nt, Human
uccugaagaggcuacacugcuu

SEQ ID NO: 683001 - RNA, 22 nt, Human
acucuucauacagucaucuaau

SEQ ID NO: 683002 - RNA, 22 nt, Human
uaugcauacaaugagauauucc

SEQ ID NO: 683003 - RNA, 18 nt, Human
cccacacagcaguagcuc

SEQ ID NO: 683004 - RNA, 22 nt, Human
agaaaguucugugaguuguuca

SEQ ID NO: 683005 - RNA, 22 nt, Human
ccagagccucaacacagguccu

SEQ ID NO: 683006 - RNA, 18 nt, Human
uauaaacacacuuagguu

SEQ ID NO: 683007 - RNA, 22 nt, Human
ccuaagaucugguaugugacag

SEQ ID NO: 683008 - RNA, 22 nt, Human
aggaagcucauuuugacauauc

SEQ ID NO: 683009 - RNA, 22 nt, Human
uuugagaaaggggauuuaauuc

SEQ ID NO: 683010 - RNA, 22 nt, Human
uaccagcucacacaaucuuugu

SEQ ID NO: 683011 - RNA, 22 nt, Human
ugggagaacccagggucaggcu

SEQ ID NO: 683012 - RNA, 22 nt, Human
auuuagcaccuccaucucaaca

SEQ ID NO: 683013 - RNA, 22 nt, Human
accuggauuuugcuuagacaug

SEQ ID NO: 683014 - RNA, 22 nt, Human
caggcccagcccagcccuucga

SEQ ID NO: 683015 - RNA, 21 nt, Human
uucaaaguuugccuaaagauu

SEQ ID NO: 683016 - RNA, 22 nt, Human
cauuauauuacagcacuguuaa

SEQ ID NO: 683017 - RNA, 22 nt, Human
cuggggcuguaggaggacuuau

SEQ ID NO: 683018 - RNA, 18 nt, Human
ggguggugugcucuucgc

SEQ ID NO: 683019 - RNA, 22 nt, Human
ugcugcuagcuguauugcaaga

SEQ ID NO: 683020 - RNA, 22 nt, Human
ugaggggagaagcagcagccug

SEQ ID NO: 683021 - RNA, 22 nt, Human
agucaguugcaaacaucaggca

SEQ ID NO: 683022 - RNA, 18 nt, Human
uauuucccaauggaaaca

SEQ ID NO: 683023 - RNA, 22 nt, Human
agcccccaggagucuccacgcc

SEQ ID NO: 683024 - RNA, 22 nt, Human
uccuucccaggugucgccgccu

SEQ ID NO: 683025 - RNA, 22 nt, Human
cucacuguccaacaggcuuuac

SEQ ID NO: 683026 - RNA, 18 nt, Human
cccaggcuuugugggucu

SEQ ID NO: 683027 - RNA, 22 nt, Human
uccuggugcugacacccauagc

SEQ ID NO: 683028 - RNA, 22 nt, Human
uuauaggaaaaguucuagaaaa

SEQ ID NO: 683029 - RNA, 22 nt, Human
acuauaaccuguuagaauagau

SEQ ID NO: 683030 - RNA, 22 nt, Human
uguaguguggccuaucuuugcc

SEQ ID NO: 683031 - RNA, 22 nt, Human
cuucagcaccucagcuggagag

SEQ ID NO: 683032 - RNA, 22 nt, Human
agugcagcaugaagcacaugug

SEQ ID NO: 683033 - RNA, 22 nt, Human
ucaggcucaggaauguguuuau

SEQ ID NO: 683034 - RNA, 22 nt, Human
cugggcuggagugcaauggcgc

SEQ ID NO: 683035 - RNA, 22 nt, Human
agggagcuucuggccucagccu

SEQ ID NO: 683036 - RNA, 22 nt, Human
cccacuccuggagcuagggcuc

SEQ ID NO: 683037 - RNA, 22 nt, Human
cgcuuuggauuucgcuuuccaa

SEQ ID NO: 683038 - RNA, 22 nt, Human
gauacauuucaaggaggacugg

SEQ ID NO: 683039 - RNA, 22 nt, Human
aagaaacaaccacugcucuccu

SEQ ID NO: 683040 - RNA, 21 nt, Human
gggugcuguggucaugcagga

SEQ ID NO: 683041 - RNA, 22 nt, Human
guguguggcauguccuauuuug

SEQ ID NO: 683042 - RNA, 22 nt, Human
acagauuuguucuuuugggcua

SEQ ID NO: 683043 - RNA, 22 nt, Human
cuacacuugcaugagucuugaa

SEQ ID NO: 683044 - RNA, 22 nt, Human
uccauuuuguagguaugcuaca

SEQ ID NO: 683045 - RNA, 22 nt, Human
ggagccaggcaaucuguacuuu

SEQ ID NO: 683046 - RNA, 22 nt, Human
aggacaaucucuccuuuaucag

SEQ ID NO: 683047 - RNA, 22 nt, Human
ugugccuggcauucugggcuuc

SEQ ID NO: 683048 - RNA, 22 nt, Human
agaccaugaccugccacuaagc

SEQ ID NO: 683049 - RNA, 22 nt, Human
augcuuuuccaggagaaauaua

SEQ ID NO: 683050 - RNA, 22 nt, Human
guucaucucacagauaggcagu

SEQ ID NO: 683051 - RNA, 22 nt, Human
agauggggcagaauggagccau

SEQ ID NO: 683052 - RNA, 19 nt, Human
uccuucacuucuuaccagg

SEQ ID NO: 683053 - RNA, 22 nt, Human
uaggaacacacauguguagcug

SEQ ID NO: 683054 - RNA, 22 nt, Human
gauggugcaauuaucgugcaug

SEQ ID NO: 683055 - RNA, 22 nt, Human
ugcucugguaacucacuuccau

SEQ ID NO: 683056 - RNA, 22 nt, Human
acucauugggaaagugcucucu

SEQ ID NO: 683057 - RNA, 22 nt, Human
uaauacauuaccuaaccucucu

SEQ ID NO: 683058 - RNA, 22 nt, Human
auuucuacaguacacaugcauu

SEQ ID NO: 683059 - RNA, 22 nt, Human
agcuucuccaucugcccagaga

SEQ ID NO: 683060 - RNA, 22 nt, Human
cagucuuuguucccauuacuga

SEQ ID NO: 683061 - RNA, 22 nt, Human
cuggcccugccagagaucaaca

SEQ ID NO: 683062 - RNA, 22 nt, Human
gagaagucauuugaccaccuag

SEQ ID NO: 683063 - RNA, 20 nt, Human
ugagccagucaagcuacauu

SEQ ID NO: 683064 - RNA, 22 nt, Human
ccaggaucugauauugggcucc

SEQ ID NO: 683065 - RNA, 22 nt, Human
agagggcauuaacucugucuug

SEQ ID NO: 683066 - RNA, 19 nt, Human
gcauuucauuuaaccauca

SEQ ID NO: 683067 - RNA, 22 nt, Human
cugugcacuaaccacacccacg

SEQ ID NO: 683068 - RNA, 20 nt, Human
guccagaguaaugugcugac

SEQ ID NO: 683069 - RNA, 22 nt, Human
aagaggagggcagauucaaggc

SEQ ID NO: 683070 - RNA, 22 nt, Human
uggggccacacugaucucccag

SEQ ID NO: 683071 - RNA, 22 nt, Human
ccugugugguagccagcggugc

SEQ ID NO: 683072 - RNA, 22 nt, Human
cuggaaggcagagguugcagug

SEQ ID NO: 683073 - RNA, 22 nt, Human
aagcuguuguucauccugaauu

SEQ ID NO: 683074 - RNA, 22 nt, Human
acacugaaggcuacaagguuga

SEQ ID NO: 683075 - RNA, 22 nt, Human
gaaguugauagaguacaugauu

SEQ ID NO: 683076 - RNA, 22 nt, Human
uuucacaacguuguggugagag

SEQ ID NO: 683077 - RNA, 22 nt, Human
ucuggagaagcccagggagcug

SEQ ID NO: 683078 - RNA, 22 nt, Human
uucuuaaagaggcaaaacacag

SEQ ID NO: 683079 - RNA, 21 nt, Human
ucugggcugcugcugcccauc

SEQ ID NO: 683080 - RNA, 22 nt, Human
uucaacaucaagaaugcaugga

SEQ ID NO: 683081 - RNA, 22 nt, Human
cagcagccuggagggggccacg

SEQ ID NO: 683082 - RNA, 22 nt, Human
ucucugugaauggcgucaccug

SEQ ID NO: 683083 - RNA, 22 nt, Human
aguugcagacgcagagauguug

SEQ ID NO: 683084 - RNA, 22 nt, Human
ggcuggcaccugcccuccgcug

SEQ ID NO: 683085 - RNA, 22 nt, Human
cagcugagcugccagacuacug

SEQ ID NO: 683086 - RNA, 22 nt, Human
aucaggaagccagucuaaugga

SEQ ID NO: 683087 - RNA, 22 nt, Human
ggcagcuguuggcucucuagga

SEQ ID NO: 683088 - RNA, 22 nt, Human
caugcggcucuuuccaaaccgg

SEQ ID NO: 683089 - RNA, 22 nt, Human
uauguagagauaaaauccaaau

SEQ ID NO: 683090 - RNA, 22 nt, Human
ggcuggaauguguggaugugau

SEQ ID NO: 683091 - RNA, 22 nt, Human
cuucuguguuaaaugagucuuu

SEQ ID NO: 683092 - RNA, 19 nt, Human
cagcucaguuugauucucu

SEQ ID NO: 683093 - RNA, 22 nt, Human
uccugcagagacagaggccuca

SEQ ID NO: 683094 - RNA, 22 nt, Human
ucacugugauucuguauggauu

SEQ ID NO: 683095 - RNA, 23 nt, Human
uuauuuggauuuuaguggaaaga

SEQ ID NO: 683096 - RNA, 22 nt, Human
gcuggcugggacagauuccauu

SEQ ID NO: 683097 - RNA, 20 nt, Human
aacuccuagccucaagugau

SEQ ID NO: 683098 - RNA, 22 nt, Human
uccagacucacucaugugacua

SEQ ID NO: 683099 - RNA, 22 nt, Human
ggagaagcaggugcuuuggguc

SEQ ID NO: 683100 - RNA, 22 nt, Human
gguggccuuucaguggaucagg

SEQ ID NO: 683101 - RNA, 22 nt, Human
aucguuuacccugagugauugc

SEQ ID NO: 683102 - RNA, 22 nt, Human
agucagugaaugguguaugcua

SEQ ID NO: 683103 - RNA, 22 nt, Human
uuuauauauggcuggucuggau

SEQ ID NO: 683104 - RNA, 22 nt, Human
uaguggagaaguggagucugug

SEQ ID NO: 683105 - RNA, 22 nt, Human
ucugaggucauuccaaggacau

SEQ ID NO: 683106 - RNA, 22 nt, Human
gaggucagucagaccaggguuu

SEQ ID NO: 683107 - RNA, 22 nt, Human
ccucggagcgggucagagaggg

SEQ ID NO: 683108 - RNA, 22 nt, Human
gauauacaauccacaguugauu

SEQ ID NO: 683109 - RNA, 22 nt, Human
aacauuguuuucccuauaucca

SEQ ID NO: 683110 - RNA, 22 nt, Human
uauucuggguaccaaacuucaa

SEQ ID NO: 683111 - RNA, 22 nt, Human
accacuguacagcagauauagu

SEQ ID NO: 683112 - RNA, 22 nt, Human
gggcuaaguggaucagucagga

SEQ ID NO: 683113 - RNA, 22 nt, Human
ucccucagagggcaagcgcaga

SEQ ID NO: 683114 - RNA, 22 nt, Human
aguccaagaucaaggugucaac

SEQ ID NO: 683115 - RNA, 22 nt, Human
acacagccaggguaguaaggcu

SEQ ID NO: 683116 - RNA, 22 nt, Human
ucaucccuaaggacagcucugc

SEQ ID NO: 683117 - RNA, 22 nt, Human
ucucucccaaaucugcagauag

SEQ ID NO: 683118 - RNA, 22 nt, Human
auuguucaaagugcuuugcaug

SEQ ID NO: 683119 - RNA, 22 nt, Human
acagcagggggagcuguuggac

SEQ ID NO: 683120 - RNA, 22 nt, Human
gcucuggcagcugauauuagga

SEQ ID NO: 683121 - RNA, 22 nt, Human
caaagcaggcuugucaaauugc

SEQ ID NO: 683122 - RNA, 22 nt, Human
aucagcaaggcaaucacugcag

SEQ ID NO: 683123 - RNA, 22 nt, Human
aggacagcagugcuggcacuug

SEQ ID NO: 683124 - RNA, 22 nt, Human
ccucuuccacugggccccaucc

SEQ ID NO: 683125 - RNA, 22 nt, Human
aauaauguugacgauagucuua

SEQ ID NO: 683126 - RNA, 22 nt, Human
aaauguguuucgaaaacuggug

SEQ ID NO: 683127 - RNA, 22 nt, Human
cuguuuuaugaagggaaugaga

SEQ ID NO: 683128 - RNA, 22 nt, Human
uaaggcaccauaauauauuuaa

SEQ ID NO: 683129 - RNA, 22 nt, Human
ugcuuaccucuggcuguuuucc

SEQ ID NO: 683130 - RNA, 22 nt, Human
auuguucauguaugaauaaaua

SEQ ID NO: 683131 - RNA, 22 nt, Human
aauagcauccuguaucucuucc

SEQ ID NO: 683132 - RNA, 22 nt, Human
agguucuugacucuaccuucca

SEQ ID NO: 683133 - RNA, 22 nt, Human
uaaaacagcagggcagagaagu

SEQ ID NO: 683134 - RNA, 22 nt, Human
gcacccagggcaggaagugagg

SEQ ID NO: 683135 - RNA, 20 nt, Human
accagagacuggggacaagu

SEQ ID NO: 683136 - RNA, 22 nt, Human
ucacagacuguguugcuacuca

SEQ ID NO: 683137 - RNA, 18 nt, Human
agacuuugaguuagaggg

SEQ ID NO: 683138 - RNA, 22 nt, Human
ccccagcacaggcuccucagau

SEQ ID NO: 683139 - RNA, 22 nt, Human
gagucuguaugucuuccaugca

SEQ ID NO: 683140 - RNA, 22 nt, Human
cagagacaggagugcucccagu

SEQ ID NO: 683141 - RNA, 22 nt, Human
aaguccagcucuaaauaucuga

SEQ ID NO: 683142 - RNA, 22 nt, Human
agggucccgaaggagacagcaa

SEQ ID NO: 683143 - RNA, 19 nt, Human
ccugaggugggguggaagg

SEQ ID NO: 683144 - RNA, 22 nt, Human
ugccaggcauguaguagacuug

SEQ ID NO: 683145 - RNA, 22 nt, Human
agguuuucacaggaaguauguu

SEQ ID NO: 683146 - RNA, 22 nt, Human
aauuaauauuuguggaauuaau

SEQ ID NO: 683147 - RNA, 22 nt, Human
cuguggcacauguggcaaggcc

SEQ ID NO: 683148 - RNA, 22 nt, Human
cucagcuagggaagguuagcuu

SEQ ID NO: 683149 - RNA, 22 nt, Human
ucaggauccauagacucccaaa

SEQ ID NO: 683150 - RNA, 22 nt, Human
ccacagaaugaugacacuucag

SEQ ID NO: 683151 - RNA, 23 nt, Human
gaggaaagaauauagaugcaauc

SEQ ID NO: 683152 - RNA, 22 nt, Human
aggccacagguggaagccagag

SEQ ID NO: 683153 - RNA, 22 nt, Human
gaacacagucaagggcugcugu

SEQ ID NO: 683154 - RNA, 22 nt, Human
aggucagcugugugugcaugag

SEQ ID NO: 683155 - RNA, 22 nt, Human
acagccagucaucucagcaggg

SEQ ID NO: 683156 - RNA, 22 nt, Human
cucugcccgcggaugccacguc

SEQ ID NO: 683157 - RNA, 22 nt, Human
ggcuggaaguccaagaucaagg

SEQ ID NO: 683158 - RNA, 21 nt, Human
ccauaaucuuaggaucaaaau

SEQ ID NO: 683159 - RNA, 22 nt, Human
uaacuacauuucacugcaauua

SEQ ID NO: 683160 - RNA, 22 nt, Human
uucagcaaggcaugugcaggag

SEQ ID NO: 683161 - RNA, 22 nt, Human
acagauacagggacuugguauu

SEQ ID NO: 683162 - RNA, 22 nt, Human
gccugggaaaugguggggucag

SEQ ID NO: 683163 - RNA, 22 nt, Human
cagagacaccccagaaaauaag

SEQ ID NO: 683164 - RNA, 22 nt, Human
ugggcuucugauguugagugcu

SEQ ID NO: 683165 - RNA, 22 nt, Human
agaaauguccagggcuaggauc

SEQ ID NO: 683166 - RNA, 22 nt, Human
uuggcagggcaucagacacgug

SEQ ID NO: 683167 - RNA, 22 nt, Human
gagucacauuaauuuaauuuua

SEQ ID NO: 683168 - RNA, 22 nt, Human
cagcaacaugugguaguguagg

SEQ ID NO: 683169 - RNA, 23 nt, Human
ccagggagugcuacuaucaagcc

SEQ ID NO: 683170 - RNA, 22 nt, Human
agcaggaaggcuuuggggguuc

SEQ ID NO: 683171 - RNA, 22 nt, Human
cugugucuuccucugcccaggc

SEQ ID NO: 683172 - RNA, 22 nt, Human
uggcuucugagcauugaaacgu

SEQ ID NO: 683173 - RNA, 20 nt, Human
uuuccacuguaauguaugau

SEQ ID NO: 683174 - RNA, 22 nt, Human
cacagaaauuauuaggaugcuu

SEQ ID NO: 683175 - RNA, 22 nt, Human
cuaaggaaauaugucacuugcu

SEQ ID NO: 683176 - RNA, 22 nt, Human
ccccagcacucugacucuuacc

SEQ ID NO: 683177 - RNA, 22 nt, Human
ugggcuuccuggagccugugcu

SEQ ID NO: 683178 - RNA, 22 nt, Human
agccuagguuuccgauucucuu

SEQ ID NO: 683179 - RNA, 22 nt, Human
agcacuuuccuggcaaaugugg

SEQ ID NO: 683180 - RNA, 22 nt, Human
ugggggcuagaacccagggauu

SEQ ID NO: 683181 - RNA, 22 nt, Human
cuuugauuccaggcacauguuu

SEQ ID NO: 683182 - RNA, 22 nt, Human
caguuuuacccaagcuuauuuu

SEQ ID NO: 683183 - RNA, 21 nt, Human
aaaggccauaaucacggagca

SEQ ID NO: 683184 - RNA, 22 nt, Human
gcugucccgaaccccugguaau

SEQ ID NO: 683185 - RNA, 17 nt, Human
augcacauguaagagga

SEQ ID NO: 683186 - RNA, 22 nt, Human
aguggcugagugacugugacuc

SEQ ID NO: 683187 - RNA, 22 nt, Human
cagugagagagaacgcauucau

SEQ ID NO: 683188 - RNA, 22 nt, Human
aagggcagaauagagaagaugg

SEQ ID NO: 683189 - RNA, 22 nt, Human
auuugucuagugguauucacgu

SEQ ID NO: 683190 - RNA, 22 nt, Human
ggacacaggcagcugggugggu

SEQ ID NO: 683191 - RNA, 22 nt, Human
cagcaggcccagaguuucaugg

SEQ ID NO: 683192 - RNA, 22 nt, Human
augaacagaggaauagaauucu

SEQ ID NO: 683193 - RNA, 22 nt, Human
gcugggccagagcagcagcacu

SEQ ID NO: 683194 - RNA, 22 nt, Human
uuaaagccugacuguggacuac

SEQ ID NO: 683195 - RNA, 22 nt, Human
caauuucaucuugugcuucaau

SEQ ID NO: 683196 - RNA, 21 nt, Human
uuguaaagguuuagaagaaug

SEQ ID NO: 683197 - RNA, 22 nt, Human
cacacagugggaaaaccugaag

SEQ ID NO: 683198 - RNA, 22 nt, Human
uaucuuagggaauuaacuaaaa

SEQ ID NO: 683199 - RNA, 22 nt, Human
uggaacaaaauauuuauguuug

SEQ ID NO: 683200 - RNA, 22 nt, Human
ccauuccaugugcuacacauaa

SEQ ID NO: 683201 - RNA, 22 nt, Human
ucucuuaaaagauuuuaaugac

SEQ ID NO: 683202 - RNA, 22 nt, Human
uggcaugaguauaggcuucuca

SEQ ID NO: 683203 - RNA, 22 nt, Human
aaagccaaaugaaagaugguuc

SEQ ID NO: 683204 - RNA, 20 nt, Human
gggaguggugguagccugug

SEQ ID NO: 683205 - RNA, 22 nt, Human
cuagaaauacaggcacgugcca

SEQ ID NO: 683206 - RNA, 22 nt, Human
auuuagacacaaaagugccaug

SEQ ID NO: 683207 - RNA, 22 nt, Human
guguaacuuuuauucaugcucu

SEQ ID NO: 683208 - RNA, 22 nt, Human
gcagugguggagcuuacauauc

SEQ ID NO: 683209 - RNA, 22 nt, Human
ugccuggguccaggccaagccu

SEQ ID NO: 683210 - RNA, 22 nt, Human
uuacacagugaauuuacucaag

SEQ ID NO: 683211 - RNA, 18 nt, Human
guaggucaguaccaagca

SEQ ID NO: 683212 - RNA, 22 nt, Human
aagauaauguucuagcugucag

SEQ ID NO: 683213 - RNA, 21 nt, Human
accaucuuccaugcauuauau

SEQ ID NO: 683214 - RNA, 22 nt, Human
ugcauuaauuuuugccagguuc

SEQ ID NO: 683215 - RNA, 22 nt, Human
gggcccuggauuuaagcaugga

SEQ ID NO: 683216 - RNA, 22 nt, Human
ccuguguggccaggcuggaguc

SEQ ID NO: 683217 - RNA, 22 nt, Human
uauauuauaagcccuuucagaa

SEQ ID NO: 683218 - RNA, 22 nt, Human
uuucucaaggugucauguauuu

SEQ ID NO: 683219 - RNA, 22 nt, Human
uuguggggaggauuugaugaga

SEQ ID NO: 683220 - RNA, 22 nt, Human
ugucaugaugugcacaccacag

SEQ ID NO: 683221 - RNA, 18 nt, Human
gaaagccaugcagcagug

SEQ ID NO: 683222 - RNA, 22 nt, Human
uaugcacaccuggguccuuguc

SEQ ID NO: 683223 - RNA, 22 nt, Human
uagauacauacauuuuaaaaug

SEQ ID NO: 683224 - RNA, 22 nt, Human
aagcagcuggaagaguaagaug

SEQ ID NO: 683225 - RNA, 22 nt, Human
ccuggcaggcuggggacagugc

SEQ ID NO: 683226 - RNA, 22 nt, Human
ucauuuucacacauaaauagca

SEQ ID NO: 683227 - RNA, 17 nt, Human
ccagagaugccucaggc

SEQ ID NO: 683228 - RNA, 22 nt, Human
uuugacaauuagguagaaaaag

SEQ ID NO: 683229 - RNA, 22 nt, Human
aguaacaaagugggagaaugau

SEQ ID NO: 683230 - RNA, 22 nt, Human
uaacuugaacauggagaguaag

SEQ ID NO: 683231 - RNA, 22 nt, Human
acaugucuuuuaaagucuaaua

SEQ ID NO: 683232 - RNA, 22 nt, Human
aggacacaugcacacccugcgu

SEQ ID NO: 683233 - RNA, 22 nt, Human
auuucaacagaguuugaaggca

SEQ ID NO: 683234 - RNA, 22 nt, Human
ucucugugucucauguuccuau

SEQ ID NO: 683235 - RNA, 22 nt, Human
uccaggcuacuuggauuccugg

SEQ ID NO: 683236 - RNA, 22 nt, Human
ccagcuuucucagaggcuucua

SEQ ID NO: 683237 - RNA, 22 nt, Human
acucaggaaaugagaggcucuc

SEQ ID NO: 683238 - RNA, 22 nt, Human
aacauuaagauggcggaacagu

SEQ ID NO: 683239 - RNA, 22 nt, Human
uaugguagaaaaacugaguccc

SEQ ID NO: 683240 - RNA, 22 nt, Human
agacccugguaaacacuccagg

SEQ ID NO: 683241 - RNA, 22 nt, Human
aucaggauucaccccagagcug

SEQ ID NO: 683242 - RNA, 22 nt, Human
aaauccuuuucuauacagcaua

SEQ ID NO: 683243 - RNA, 20 nt, Human
gaugucuuggucacaguggc

SEQ ID NO: 683244 - RNA, 22 nt, Human
ggcagcucugcuccacaugagu

SEQ ID NO: 683245 - RNA, 22 nt, Human
gaggccuggcucugcccuccug

SEQ ID NO: 683246 - RNA, 22 nt, Human
uuucuaaucuuuaguuacaaaa

SEQ ID NO: 683247 - RNA, 21 nt, Human
uggaaugaggcugagcagugc

SEQ ID NO: 683248 - RNA, 22 nt, Human
cgcuggaaauugccguuggcuu

SEQ ID NO: 683249 - RNA, 23 nt, Human
uccagucuccugaaaggcagcgu

SEQ ID NO: 683250 - RNA, 22 nt, Human
aguccuggugacacuccucuuc

SEQ ID NO: 683251 - RNA, 22 nt, Human
cagcaugcccagacugagcuaa

SEQ ID NO: 683252 - RNA, 22 nt, Human
uaggcagaaaggaaggcaaguu

SEQ ID NO: 683253 - RNA, 22 nt, Human
guuugugucaaugacuucugca

SEQ ID NO: 683254 - RNA, 19 nt, Human
ugggccucacaaugcuccc

SEQ ID NO: 683255 - RNA, 22 nt, Human
aauacagaugagcuucugccuc

SEQ ID NO: 683256 - RNA, 22 nt, Human
caugcuuccuccaaacuacccu

SEQ ID NO: 683257 - RNA, 22 nt, Human
ugguggagggaacuauuuccag

SEQ ID NO: 683258 - RNA, 22 nt, Human
auacagaagccuguauuucugg

SEQ ID NO: 683259 - RNA, 17 nt, Human
gcucccugaggacagcu

SEQ ID NO: 683260 - RNA, 20 nt, Human
gcuccaggucagagaggacg

SEQ ID NO: 683261 - RNA, 22 nt, Human
uugcugccuugucucagggucu

SEQ ID NO: 683262 - RNA, 22 nt, Human
cugagcucagucccagcucuac

SEQ ID NO: 683263 - RNA, 22 nt, Human
uugaggucccaaacccacugag

SEQ ID NO: 683264 - RNA, 23 nt, Human
aaaugugagggaaaaucuuucug

SEQ ID NO: 683265 - RNA, 22 nt, Human
aaggugugaagagaugggaaga

SEQ ID NO: 683266 - RNA, 22 nt, Human
ugaagcuuguauuuaaauaagu

SEQ ID NO: 683267 - RNA, 22 nt, Human
cagagacaggaaucagcugcag

SEQ ID NO: 683268 - RNA, 22 nt, Human
uucuggagccgggccugggcag

SEQ ID NO: 683269 - RNA, 22 nt, Human
ccuuccuugagaagcaauuccu

SEQ ID NO: 683270 - RNA, 22 nt, Human
agacuggauagcuuuggacuug

SEQ ID NO: 683271 - RNA, 22 nt, Human
cuuugaauugccguuucaucug

SEQ ID NO: 683272 - RNA, 22 nt, Human
uugcuuuuaauuaaucauugcu

SEQ ID NO: 683273 - RNA, 22 nt, Human
uuccauccuaauaaaagaaguu

SEQ ID NO: 683274 - RNA, 22 nt, Human
gcucaaggcaggcagacaugag

SEQ ID NO: 683275 - RNA, 22 nt, Human
cuuggagaauccugguuauuca

SEQ ID NO: 683276 - RNA, 22 nt, Human
gccacagacagagagucuagug

SEQ ID NO: 683277 - RNA, 23 nt, Human
agccuucaggcaaugucaguaga

SEQ ID NO: 683278 - RNA, 22 nt, Human
gucuggaggcacuuucucauga

SEQ ID NO: 683279 - RNA, 22 nt, Human
acagugcaaauaggacugucuu

SEQ ID NO: 683280 - RNA, 21 nt, Human
uagggcaggcauuggaagaga

SEQ ID NO: 683281 - RNA, 22 nt, Human
ccuggagaggcgcugcagagga

SEQ ID NO: 683282 - RNA, 22 nt, Human
augcaacaggucagccaggaag

SEQ ID NO: 683283 - RNA, 22 nt, Human
cuguuuuccuggguuccaugag

SEQ ID NO: 683284 - RNA, 22 nt, Human
ucuucccaaugcaaaguaggac

SEQ ID NO: 683285 - RNA, 19 nt, Human
cugauguuccagagaagcu

SEQ ID NO: 683286 - RNA, 22 nt, Human
gucuccuggaaauaugcccaua

SEQ ID NO: 683287 - RNA, 23 nt, Human
aggggcagcaaguuuugguguua

SEQ ID NO: 683288 - RNA, 22 nt, Human
uuuuuuccagcuucuagaggcc

SEQ ID NO: 683289 - RNA, 22 nt, Human
ugucaugggucuaaacauugau

SEQ ID NO: 683290 - RNA, 22 nt, Human
auugaaagaguuuucugcugca

SEQ ID NO: 683291 - RNA, 22 nt, Human
uuggacucugggauucuggauu

SEQ ID NO: 683292 - RNA, 22 nt, Human
gugucagaaacaggaaggggaa

SEQ ID NO: 683293 - RNA, 22 nt, Human
uucaguuugaauucuguagaac

SEQ ID NO: 683294 - RNA, 21 nt, Human
uucauuuguuauagacaaagu

SEQ ID NO: 683295 - RNA, 22 nt, Human
cagacugggagucaggaagaag

SEQ ID NO: 683296 - RNA, 22 nt, Human
caggacagcucaacaccuccuc

SEQ ID NO: 683297 - RNA, 22 nt, Human
cagccacagcugggugccugac

SEQ ID NO: 683298 - RNA, 22 nt, Human
ucagaagaagguauauuuauac

SEQ ID NO: 683299 - RNA, 22 nt, Human
uggcaggcagugugggagcugg

SEQ ID NO: 683300 - RNA, 22 nt, Human
ucugaggccuugggacagaagu

SEQ ID NO: 683301 - RNA, 22 nt, Human
uggguuaacaguuuauaccaga

SEQ ID NO: 683302 - RNA, 22 nt, Human
uacaaugagcuguacaucucca

SEQ ID NO: 683303 - RNA, 22 nt, Human
agacaucucccaugcauuuuua

SEQ ID NO: 683304 - RNA, 22 nt, Human
aaguuuuauuggcuauagcacu

SEQ ID NO: 683305 - RNA, 22 nt, Human
uguacagacuuugcagugugca

SEQ ID NO: 683306 - RNA, 22 nt, Human
aauguuuuauagcucaagcaau

SEQ ID NO: 683307 - RNA, 22 nt, Human
uuccaaauggagaagaugaguu

SEQ ID NO: 683308 - RNA, 22 nt, Human
uuaaacuauagcuugaugugaa

SEQ ID NO: 683309 - RNA, 22 nt, Human
uuacaacauauuuagcuugauu

SEQ ID NO: 683310 - RNA, 22 nt, Human
gguggcagagaggagguaguuu

SEQ ID NO: 683311 - RNA, 22 nt, Human
gauaaaauaacuauggaauacu

SEQ ID NO: 683312 - RNA, 22 nt, Human
uaugagaaauugcugauauuug

SEQ ID NO: 683313 - RNA, 22 nt, Human
cucucugcaaguuuugaaauag

SEQ ID NO: 683314 - RNA, 22 nt, Human
aaggcugauuagacugauagcu

SEQ ID NO: 683315 - RNA, 22 nt, Human
gcaguccucucauuggccuccu

SEQ ID NO: 683316 - RNA, 20 nt, Human
cacaugcuguguguuucucu

SEQ ID NO: 683317 - RNA, 22 nt, Human
augucuguuuucauaucagaua

SEQ ID NO: 683318 - RNA, 17 nt, Human
ugaaggccaugaccacg

SEQ ID NO: 683319 - RNA, 22 nt, Human
gaggccugguagccgagcccca

SEQ ID NO: 683320 - RNA, 22 nt, Human
ccagucugcagccccuggggac

SEQ ID NO: 683321 - RNA, 22 nt, Human
agguggcuguauucagcuguaa

SEQ ID NO: 683322 - RNA, 18 nt, Human
auccuugaugagaggucu

SEQ ID NO: 683323 - RNA, 22 nt, Human
ucccugagagcacuggggagcc

SEQ ID NO: 683324 - RNA, 22 nt, Human
uaaagccauacugaaagccacu

SEQ ID NO: 683325 - RNA, 22 nt, Human
acuggaaaauucaaaugggguc

SEQ ID NO: 683326 - RNA, 22 nt, Human
aaguccagaacuccugugauag

SEQ ID NO: 683327 - RNA, 22 nt, Human
ugaguccaucgcagggaagugg

SEQ ID NO: 683328 - RNA, 22 nt, Human
uccuucaaagcuccuagugagc

SEQ ID NO: 683329 - RNA, 20 nt, Human
ccagagcugauggcugcccg

SEQ ID NO: 683330 - RNA, 20 nt, Human
agugugcauuuagagucugc

SEQ ID NO: 683331 - RNA, 22 nt, Human
acaguguucaaaccacuaggcu

SEQ ID NO: 683332 - RNA, 22 nt, Human
agacuguuaauuucaauuaaaa

SEQ ID NO: 683333 - RNA, 22 nt, Human
gugaauaugaucuuauuuggaa

SEQ ID NO: 683334 - RNA, 22 nt, Human
uucugcagcaugaggcuggagc

SEQ ID NO: 683335 - RNA, 22 nt, Human
aaacuguaagugccucaagguc

SEQ ID NO: 683336 - RNA, 22 nt, Human
cgagugucccuaccauuuccua

SEQ ID NO: 683337 - RNA, 22 nt, Human
gaauguuucauguguauguuag

SEQ ID NO: 683338 - RNA, 22 nt, Human
gcucagccgaacuucagagcag

SEQ ID NO: 683339 - RNA, 19 nt, Human
gacuucugauguccagaug

SEQ ID NO: 683340 - RNA, 22 nt, Human
uuuaaaugcuuuaagcaagggu

SEQ ID NO: 683341 - RNA, 22 nt, Human
uauguccugcuacucucucaug

SEQ ID NO: 683342 - RNA, 22 nt, Human
uucuugaaucacuuuagagaua

SEQ ID NO: 683343 - RNA, 22 nt, Human
gugcaaauuccacuggaaagcu

SEQ ID NO: 683344 - RNA, 22 nt, Human
cuggcucaccuccgcuccagca

SEQ ID NO: 683345 - RNA, 22 nt, Human
gggcacugugcugggugcuuua

SEQ ID NO: 683346 - RNA, 18 nt, Human
cuuucagauggauaugcu

SEQ ID NO: 683347 - RNA, 23 nt, Human
agcuccagcugacgugggcagcc

SEQ ID NO: 683348 - RNA, 22 nt, Human
ggaagccaggccaaugagaaca

SEQ ID NO: 683349 - RNA, 22 nt, Human
cugagggccgggacccaguuuc

SEQ ID NO: 683350 - RNA, 22 nt, Human
uccagagccccagucuaguggg

SEQ ID NO: 683351 - RNA, 22 nt, Human
caguagccuuauuuggaucauu

SEQ ID NO: 683352 - RNA, 22 nt, Human
aguggcaguggaaagcacacgg

SEQ ID NO: 683353 - RNA, 22 nt, Human
guacuuuaagacuccaguagca

SEQ ID NO: 683354 - RNA, 22 nt, Human
agaagugccauacuguggucca

SEQ ID NO: 683355 - RNA, 22 nt, Human
aagguacaggguauuagauuau

SEQ ID NO: 683356 - RNA, 22 nt, Human
ccuccacugcuucccagcuuug

SEQ ID NO: 683357 - RNA, 22 nt, Human
cagagcugcagauugaaggcau

SEQ ID NO: 683358 - RNA, 22 nt, Human
agaugcagauuuggauucagga

SEQ ID NO: 683359 - RNA, 22 nt, Human
uuuugaaagggugauuuggcuu

SEQ ID NO: 683360 - RNA, 22 nt, Human
guggccuuuucaaguaggguau

SEQ ID NO: 683361 - RNA, 22 nt, Human
ugcccagcacccagcaugaugc

SEQ ID NO: 683362 - RNA, 23 nt, Human
uccagggcaguggcugggucugc

SEQ ID NO: 683363 - RNA, 22 nt, Human
agcaucuggccugguuacuuuu

SEQ ID NO: 683364 - RNA, 22 nt, Human
uggagagcagggcuggaguuca

SEQ ID NO: 683365 - RNA, 22 nt, Human
aaauguucuaaauuacauguga

SEQ ID NO: 683366 - RNA, 22 nt, Human
cuuggcuguaaaaucagaggcu

SEQ ID NO: 683367 - RNA, 22 nt, Human
gcaauaaacauguuugaugcgc

SEQ ID NO: 683368 - RNA, 22 nt, Human
agguuucuaugcuguuuaucuu

SEQ ID NO: 683369 - RNA, 22 nt, Human
ucaccaaggcauuuucacagca

SEQ ID NO: 683370 - RNA, 22 nt, Human
ucauacaucuguccuggagcuc

SEQ ID NO: 683371 - RNA, 22 nt, Human
ugaguaaaagugaaucuuaugu

SEQ ID NO: 683372 - RNA, 22 nt, Human
ccucccuuccccaguagucaag

SEQ ID NO: 683373 - RNA, 22 nt, Human
ugggcugcccaagguggccaug

SEQ ID NO: 683374 - RNA, 22 nt, Human
ucauggggugacagaagggagg

SEQ ID NO: 683375 - RNA, 22 nt, Human
cccagugugguugugaauucug

SEQ ID NO: 683376 - RNA, 20 nt, Human
uuugaauguaaagcauguca

SEQ ID NO: 683377 - RNA, 22 nt, Human
ucugauuccagugacccuagga

SEQ ID NO: 683378 - RNA, 22 nt, Human
cuaauguaucauggcucucagc

SEQ ID NO: 683379 - RNA, 22 nt, Human
agccaggacagggcagcucgcu

SEQ ID NO: 683380 - RNA, 22 nt, Human
gaggcucugugaugugccaggc

SEQ ID NO: 683381 - RNA, 22 nt, Human
gaggagggcaguuccucuuuua

SEQ ID NO: 683382 - RNA, 22 nt, Human
uuuaagcagagaaaugauguau

SEQ ID NO: 683383 - RNA, 22 nt, Human
uaacuucagcgaguucucuuaa

SEQ ID NO: 683384 - RNA, 22 nt, Human
ggcucugggucuguggggagcg

SEQ ID NO: 683385 - RNA, 22 nt, Human
agcagaaagcuuauuuugacug

SEQ ID NO: 683386 - RNA, 20 nt, Human
cuugaacugauucuauuucc

SEQ ID NO: 683387 - RNA, 22 nt, Human
uucaccagagguuagaauauuu

SEQ ID NO: 683388 - RNA, 22 nt, Human
ugcuuuauuggaaccucauccu

SEQ ID NO: 683389 - RNA, 23 nt, Human
uuguccuucugaaauauaucugg

SEQ ID NO: 683390 - RNA, 21 nt, Human
agaauuaaauuggauuugugu

SEQ ID NO: 683391 - RNA, 22 nt, Human
guacaaauugauacagguuuuc

SEQ ID NO: 683392 - RNA, 22 nt, Human
aggcaguucucguguguguccc

SEQ ID NO: 683393 - RNA, 22 nt, Human
ugaaagaacuagcaucuucaag

SEQ ID NO: 683394 - RNA, 22 nt, Human
aauagcaucuucugagacaaag

SEQ ID NO: 683395 - RNA, 22 nt, Human
gacccugguguccagguccugc

SEQ ID NO: 683396 - RNA, 22 nt, Human
aacagcuuugagcaguucugua

SEQ ID NO: 683397 - RNA, 22 nt, Human
uauuuuaaagacugccagccua

SEQ ID NO: 683398 - RNA, 22 nt, Human
auaaaaucagaguuggauugga

SEQ ID NO: 683399 - RNA, 22 nt, Human
aaaggccaccaacaugaagcau

SEQ ID NO: 683400 - RNA, 22 nt, Human
augguggacgggagacaggacu

SEQ ID NO: 683401 - RNA, 22 nt, Human
guuaaugucuuccuauucuaca

SEQ ID NO: 683402 - RNA, 22 nt, Human
cuacagcuggccuuggaaaacu

SEQ ID NO: 683403 - RNA, 22 nt, Human
caguauuuauggcuugaguauu

SEQ ID NO: 683404 - RNA, 22 nt, Human
cugcagcuuauuugcuguguga

SEQ ID NO: 683405 - RNA, 22 nt, Human
ugcugcugauggcaccuaggca

SEQ ID NO: 683406 - RNA, 22 nt, Human
cugaagagacuggagggggcau

SEQ ID NO: 683407 - RNA, 22 nt, Human
uuguccuuaccucaaucuggaa

SEQ ID NO: 683408 - RNA, 22 nt, Human
cuuaacagagagaaguguugcu

SEQ ID NO: 683409 - RNA, 22 nt, Human
uacuguuucaagcccucacaga

SEQ ID NO: 683410 - RNA, 22 nt, Human
ugccacuggcucaauggugcag

SEQ ID NO: 683411 - RNA, 22 nt, Human
uauaggaaaggaguggucacaa

SEQ ID NO: 683412 - RNA, 22 nt, Human
uggcccuucaaauucccuaguc

SEQ ID NO: 683413 - RNA, 22 nt, Human
gccuggcugagguggggaggca

SEQ ID NO: 683414 - RNA, 22 nt, Human
agcaguugagugggaaucaggc

SEQ ID NO: 683415 - RNA, 20 nt, Human
uacauucaaaacaaacucug

SEQ ID NO: 683416 - RNA, 22 nt, Human
gagaggaacucccagugccugg

SEQ ID NO: 683417 - RNA, 22 nt, Human
gaguccuuccagcaggcauuua

SEQ ID NO: 683418 - RNA, 22 nt, Human
gcuuauuuucaccuucucucag

SEQ ID NO: 683419 - RNA, 22 nt, Human
gcugccuuuugcuccucccacc

SEQ ID NO: 683420 - RNA, 22 nt, Human
aggccaccacccuaucuccugg

SEQ ID NO: 683421 - RNA, 22 nt, Human
ccuucaaggcaaggagggcugg

SEQ ID NO: 683422 - RNA, 22 nt, Human
agaagcugccuacaugaccagc

SEQ ID NO: 683423 - RNA, 22 nt, Human
uacaugcucaguaacuuucagu

SEQ ID NO: 683424 - RNA, 22 nt, Human
agcaggcuacuccuguguucgu

SEQ ID NO: 683425 - RNA, 22 nt, Human
agacaggcaugaggcuggauug

SEQ ID NO: 683426 - RNA, 22 nt, Human
agaguaaauaggagaugacagc

SEQ ID NO: 683427 - RNA, 22 nt, Human
uuaaugacaucauaggugaagu

SEQ ID NO: 683428 - RNA, 22 nt, Human
caggcucacuuucucagucaca

SEQ ID NO: 683429 - RNA, 23 nt, Human
ccagucucuuuccaaaaucacau

SEQ ID NO: 683430 - RNA, 22 nt, Human
ugagugugcuaggugucucggu

SEQ ID NO: 683431 - RNA, 22 nt, Human
uuucauagccuucuaaugaguu

SEQ ID NO: 683432 - RNA, 22 nt, Human
uacaccauucccagguggauuu

SEQ ID NO: 683433 - RNA, 22 nt, Human
gcucuuccauuucucuugaacu

SEQ ID NO: 683434 - RNA, 22 nt, Human
auguggcuuaguuaggugcccc

SEQ ID NO: 683435 - RNA, 22 nt, Human
cucuguaccuggcauagcaacc

SEQ ID NO: 683436 - RNA, 22 nt, Human
aggucccugcagcagacugcca

SEQ ID NO: 683437 - RNA, 19 nt, Human
uagcugccuguuaccucca

SEQ ID NO: 683438 - RNA, 23 nt, Human
uccagagcucaugcucucaacca

SEQ ID NO: 683439 - RNA, 22 nt, Human
caauuucucgaacucuaaucca

SEQ ID NO: 683440 - RNA, 22 nt, Human
aggcugugaaauguggcaagga

SEQ ID NO: 683441 - RNA, 22 nt, Human
cucaaauccccguuccucauuc

SEQ ID NO: 683442 - RNA, 22 nt, Human
cacagagauggucuggcaggug

SEQ ID NO: 683443 - RNA, 22 nt, Human
uaguuucuggguuggcuucuac

SEQ ID NO: 683444 - RNA, 18 nt, Human
cagaggagagacauucag

SEQ ID NO: 683445 - RNA, 22 nt, Human
acagauauuaugguuucuccuu

SEQ ID NO: 683446 - RNA, 22 nt, Human
gucugaggucauuagcucucuu

SEQ ID NO: 683447 - RNA, 22 nt, Human
caguucucugugccucgcuggg

SEQ ID NO: 683448 - RNA, 20 nt, Human
aggaaagccugugugagucu

SEQ ID NO: 683449 - RNA, 22 nt, Human
aauguuuucugacugcuaacuu

SEQ ID NO: 683450 - RNA, 22 nt, Human
ucccucagaugagcuccuagca

SEQ ID NO: 683451 - RNA, 23 nt, Human
uguaacaauuucauauacaugca

SEQ ID NO: 683452 - RNA, 23 nt, Human
ucuuuccuaaugaaacagugaaa

SEQ ID NO: 683453 - RNA, 22 nt, Human
ggguaggaugguagaagggacc

SEQ ID NO: 683454 - RNA, 22 nt, Human
uacauucugguggagaaaguaa

SEQ ID NO: 683455 - RNA, 22 nt, Human
cuguggcucuuuaguugagcac

SEQ ID NO: 683456 - RNA, 22 nt, Human
gcugccugauuuacauagugaa

SEQ ID NO: 683457 - RNA, 22 nt, Human
uggugcaggaguuggcagggac

SEQ ID NO: 683458 - RNA, 21 nt, Human
uacuacagucucuuuaucagu

SEQ ID NO: 683459 - RNA, 22 nt, Human
ggcaggagcucuccaguuugcc

SEQ ID NO: 683460 - RNA, 22 nt, Human
gcuuuacacagaugaauauuuc

SEQ ID NO: 683461 - RNA, 22 nt, Human
guaugucaugagccuugugcgu

SEQ ID NO: 683462 - RNA, 22 nt, Human
uuugcauaggauggacauuuua

SEQ ID NO: 683463 - RNA, 22 nt, Human
acaaugcuguugagacauucuu

SEQ ID NO: 683464 - RNA, 22 nt, Human
caggccagcuuccugacauccu

SEQ ID NO: 683465 - RNA, 22 nt, Human
ugugucuggaccggggaggagc

SEQ ID NO: 683466 - RNA, 22 nt, Human
auacugaaggcauucagauaac

SEQ ID NO: 683467 - RNA, 22 nt, Human
augcauguauuaucuagaugag

SEQ ID NO: 683468 - RNA, 22 nt, Human
cuggaagggaaaucucuuggca

SEQ ID NO: 683469 - RNA, 20 nt, Human
gucugaggagcagugggaaa

SEQ ID NO: 683470 - RNA, 22 nt, Human
aacuuuuucugggauggagggu

SEQ ID NO: 683471 - RNA, 22 nt, Human
aggcuccagucugaaccuuggg

SEQ ID NO: 683472 - RNA, 22 nt, Human
agugggagaaugaauaagggcc

SEQ ID NO: 683473 - RNA, 22 nt, Human
agcccagcaguaagauuagaga

SEQ ID NO: 683474 - RNA, 22 nt, Human
ccaggaggggucucugucuccc

SEQ ID NO: 683475 - RNA, 22 nt, Human
uaugaacuuuaagcucuguguc

SEQ ID NO: 683476 - RNA, 22 nt, Human
gggcuuaaggccagugugcuuu

SEQ ID NO: 683477 - RNA, 22 nt, Human
auguccagcucaugauacuauc

SEQ ID NO: 683478 - RNA, 22 nt, Human
uucugccugauguagucauacc

SEQ ID NO: 683479 - RNA, 22 nt, Human
ccaguucuuucugugugcaaca

SEQ ID NO: 683480 - RNA, 22 nt, Human
aaugcacauauauguguauaca

SEQ ID NO: 683481 - RNA, 22 nt, Human
uugaaguuguaguucagugaag

SEQ ID NO: 683482 - RNA, 18 nt, Human
acacugcagcagucugcu

SEQ ID NO: 683483 - RNA, 22 nt, Human
ucagaggaccuuacugagaacc

SEQ ID NO: 683484 - RNA, 22 nt, Human
agccugcuugagaguccuggcu

SEQ ID NO: 683485 - RNA, 22 nt, Human
uuugauuuucagcaauaguggc

SEQ ID NO: 683486 - RNA, 22 nt, Human
ggcuuccaagguccucuccacc

SEQ ID NO: 683487 - RNA, 22 nt, Human
cagugcagacguggagggggca

SEQ ID NO: 683488 - RNA, 22 nt, Human
gugggugcggggagccgaggcg

SEQ ID NO: 683489 - RNA, 22 nt, Human
ugcauuuaugucucccaccagc

SEQ ID NO: 683490 - RNA, 22 nt, Human
cugccuugucuuguuuucaggg

SEQ ID NO: 683491 - RNA, 22 nt, Human
uucugaauuucuguguaucuua

SEQ ID NO: 683492 - RNA, 22 nt, Human
ugucuacaaacguguacacauu

SEQ ID NO: 683493 - RNA, 22 nt, Human
gcagcccaggacccuggacaga

SEQ ID NO: 683494 - RNA, 22 nt, Human
ggcugccccaugggcugggcug

SEQ ID NO: 683495 - RNA, 22 nt, Human
ucucucagaacugcagcugcag

SEQ ID NO: 683496 - RNA, 20 nt, Human
agauggugaaggccagggag

SEQ ID NO: 683497 - RNA, 22 nt, Human
uagaaacacagaucugguguca

SEQ ID NO: 683498 - RNA, 22 nt, Human
gugugccacugccugaggaccc

SEQ ID NO: 683499 - RNA, 22 nt, Human
uuguauucuuuaugacuucccu

SEQ ID NO: 683500 - RNA, 22 nt, Human
uccuuggaggucaacgggacgg

SEQ ID NO: 683501 - RNA, 22 nt, Human
ucagugugcacaugguagcagu

SEQ ID NO: 683502 - RNA, 22 nt, Human
caggguggaauggaaugcuggc

SEQ ID NO: 683503 - RNA, 22 nt, Human
aaucacuuguaaggaauucaau

SEQ ID NO: 683504 - RNA, 22 nt, Human
acaugcuuugcacuuacaucau

SEQ ID NO: 683505 - RNA, 22 nt, Human
gcuuugugaauuauuacucaca

SEQ ID NO: 683506 - RNA, 22 nt, Human
ccagguggugaaagugggcccu

SEQ ID NO: 683507 - RNA, 20 nt, Human
ucauuacagugcuaagaugu

SEQ ID NO: 683508 - RNA, 22 nt, Human
guggcaugaaagcaucugugau

SEQ ID NO: 683509 - RNA, 22 nt, Human
auaagacacgccccacucacuc

SEQ ID NO: 683510 - RNA, 22 nt, Human
uaaucucuuuaugagaagaagg

SEQ ID NO: 683511 - RNA, 18 nt, Human
uuaaguuuuacugcuuua

SEQ ID NO: 683512 - RNA, 22 nt, Human
agauauuaggaggauucauaau

SEQ ID NO: 683513 - RNA, 22 nt, Human
gcacucugugaucugcagagcc

SEQ ID NO: 683514 - RNA, 22 nt, Human
cuggcucuucuggguucugugu

SEQ ID NO: 683515 - RNA, 22 nt, Human
uauggcuugucuuuauaccagg

SEQ ID NO: 683516 - RNA, 22 nt, Human
agcaggugccagguguacccgc

SEQ ID NO: 683517 - RNA, 22 nt, Human
uucucagaaaauguagagaaaa

SEQ ID NO: 683518 - RNA, 22 nt, Human
agccacaccuguccugccagcu

SEQ ID NO: 683519 - RNA, 22 nt, Human
gugcacaaucuucauauggcgu

SEQ ID NO: 683520 - RNA, 22 nt, Human
ugcuguguucaccaauaugugu

SEQ ID NO: 683521 - RNA, 22 nt, Human
ugggccuggguuccuccugggc

SEQ ID NO: 683522 - RNA, 22 nt, Human
gggaggagcugagugugugugc

SEQ ID NO: 683523 - RNA, 22 nt, Human
agugacuucuccuaaugucaua

SEQ ID NO: 683524 - RNA, 22 nt, Human
gucaccagugcuaagaggugga

SEQ ID NO: 683525 - RNA, 22 nt, Human
uauguuuauacuuugauguacu

SEQ ID NO: 683526 - RNA, 22 nt, Human
aaagugcugggauuacaggugu

SEQ ID NO: 683527 - RNA, 15 nt, Human
ugggcagaucacuug

SEQ ID NO: 683528 - RNA, 22 nt, Human
uggggagucgcugcagagcgau

SEQ ID NO: 683529 - RNA, 22 nt, Human
cagcaaggacugggcaugugaa

SEQ ID NO: 683530 - RNA, 22 nt, Human
cuuugcagauuuguuuagugcu

SEQ ID NO: 683531 - RNA, 22 nt, Human
acugcagagcuuuucaguugag

SEQ ID NO: 683532 - RNA, 22 nt, Human
agacagugcuaucccaucugug

SEQ ID NO: 683533 - RNA, 22 nt, Human
gugaauaauauuguuuauaaaa

SEQ ID NO: 683534 - RNA, 22 nt, Human
augcuucuguguauguuucagg

SEQ ID NO: 683535 - RNA, 22 nt, Human
aaucacacaaaggcaacuuuug

SEQ ID NO: 683536 - RNA, 22 nt, Human
cugggacauauugcuaguguug

SEQ ID NO: 683537 - RNA, 22 nt, Human
gauggcuuaagaguaaaaggca

SEQ ID NO: 683538 - RNA, 22 nt, Human
uauaggaaguauucaaagacug

SEQ ID NO: 683539 - RNA, 22 nt, Human
aggcuugggucagaaggcuugu

SEQ ID NO: 683540 - RNA, 23 nt, Human
ucacagagcauacugcauuuugc

SEQ ID NO: 683541 - RNA, 22 nt, Human
caaaugcagauucaggaguucu

SEQ ID NO: 683542 - RNA, 22 nt, Human
ugagcagagucgcuccagagug

SEQ ID NO: 683543 - RNA, 22 nt, Human
uacaauagggcuuuuguuuaug

SEQ ID NO: 683544 - RNA, 22 nt, Human
ugagaacugaggauuugaauuc

SEQ ID NO: 683545 - RNA, 22 nt, Human
aagcugaggucaaguagcuagu

SEQ ID NO: 683546 - RNA, 22 nt, Human
ugacaucuuugaucucauuuag

SEQ ID NO: 683547 - RNA, 22 nt, Human
uccuagaaucuuuguaagauug

SEQ ID NO: 683548 - RNA, 22 nt, Human
gauucacucauauuuuacguuu

SEQ ID NO: 683549 - RNA, 22 nt, Human
aaagcaaugcuuguggaaugua

SEQ ID NO: 683550 - RNA, 22 nt, Human
aaauugcauuuuaaagguagau

SEQ ID NO: 683551 - RNA, 22 nt, Human
gacucagauuuagaggguaaga

SEQ ID NO: 683552 - RNA, 22 nt, Human
augugcaguugguggccaggag

SEQ ID NO: 683553 - RNA, 22 nt, Human
ucucugaguauccugaacugcc

SEQ ID NO: 683554 - RNA, 22 nt, Human
cuauuuguaaagugccuggugu

SEQ ID NO: 683555 - RNA, 20 nt, Human
uuuuagcacuuguuauggug

SEQ ID NO: 683556 - RNA, 22 nt, Human
uucucacaguaccuaacaugua

SEQ ID NO: 683557 - RNA, 22 nt, Human
uacacuuuucugguuacucuug

SEQ ID NO: 683558 - RNA, 22 nt, Human
acuauauacacauuaucuuguu

SEQ ID NO: 683559 - RNA, 22 nt, Human
caagauggguguugugaugguu

SEQ ID NO: 683560 - RNA, 22 nt, Human
acuguacaugcaucuugucuau

SEQ ID NO: 683561 - RNA, 22 nt, Human
uauuuuacaugauccagaguug

SEQ ID NO: 683562 - RNA, 16 nt, Human
gcccaggacgggaggc

SEQ ID NO: 683563 - RNA, 22 nt, Human
uagacuuuucaaaaucuagacc

SEQ ID NO: 683564 - RNA, 22 nt, Human
uuuucacacaaggugauaaguu

SEQ ID NO: 683565 - RNA, 22 nt, Human
uucuacagacuauaacugugau

SEQ ID NO: 683566 - RNA, 22 nt, Human
gaggagaaagcagugauuugug

SEQ ID NO: 683567 - RNA, 22 nt, Human
ugaggcuaaaggugaccagauu

SEQ ID NO: 683568 - RNA, 22 nt, Human
cugcugcccuagacccaguccu

SEQ ID NO: 683569 - RNA, 22 nt, Human
auggacucacuaauuccuccac

SEQ ID NO: 683570 - RNA, 22 nt, Human
cuuccucacggugcaacaggaa

SEQ ID NO: 683571 - RNA, 22 nt, Human
auuucucacccuaccucacucc

SEQ ID NO: 683572 - RNA, 22 nt, Human
cacguuuuaugacagaagaagc

SEQ ID NO: 683573 - RNA, 22 nt, Human
gggauggggucaacauguaccu

SEQ ID NO: 683574 - RNA, 22 nt, Human
aagauguuaggaaaguuagggu

SEQ ID NO: 683575 - RNA, 22 nt, Human
augcauauaauggccagaacaa

SEQ ID NO: 683576 - RNA, 22 nt, Human
ccccacagccgccagcagggag

SEQ ID NO: 683577 - RNA, 22 nt, Human
gcacaugacuuugaggaaacca

SEQ ID NO: 683578 - RNA, 22 nt, Human
ggucccugcugaagccuuggug

SEQ ID NO: 683579 - RNA, 22 nt, Human
uacagcuuuucauauuuguguu

SEQ ID NO: 683580 - RNA, 22 nt, Human
uuuacuguuuuauauuguccag

SEQ ID NO: 683581 - RNA, 22 nt, Human
aaauacaguggcagcagauaau

SEQ ID NO: 683582 - RNA, 22 nt, Human
cauucccuuggggaguucaugc

SEQ ID NO: 683583 - RNA, 22 nt, Human
ucccugucucccuugagacuag

SEQ ID NO: 683584 - RNA, 22 nt, Human
aucggggaaaagggaggcugug

SEQ ID NO: 683585 - RNA, 20 nt, Human
caaaagcaaugaaguuauga

SEQ ID NO: 683586 - RNA, 22 nt, Human
uaaaauagccagugccccucug

SEQ ID NO: 683587 - RNA, 22 nt, Human
caaauuuaaguuagaaagcaau

SEQ ID NO: 683588 - RNA, 22 nt, Human
acuagacaucgagcuacagagu

SEQ ID NO: 683589 - RNA, 22 nt, Human
cacuggaggucaguggagcacu

SEQ ID NO: 683590 - RNA, 22 nt, Human
ggaggacaggggcugcagcaca

SEQ ID NO: 683591 - RNA, 21 nt, Human
ugaaaugagaaugcugagcac

SEQ ID NO: 683592 - RNA, 22 nt, Human
uugaacaaucaaaagaauucau

SEQ ID NO: 683593 - RNA, 22 nt, Human
cagagacccuaggcaggugaca

SEQ ID NO: 683594 - RNA, 22 nt, Human
gggcuggagaugcuuauggaga

SEQ ID NO: 683595 - RNA, 22 nt, Human
uaaauuagggacuuuaguuaau

SEQ ID NO: 683596 - RNA, 22 nt, Human
uugcugugaaaccaugggaagu

SEQ ID NO: 683597 - RNA, 23 nt, Human
ggcuuugcucuggguucuagggu

SEQ ID NO: 683598 - RNA, 22 nt, Human
cuggcuguuuucaauguugaug

SEQ ID NO: 683599 - RNA, 22 nt, Human
uggaggaaaauuacuggggucu

SEQ ID NO: 683600 - RNA, 22 nt, Human
uccugccucuugccuucuucac

SEQ ID NO: 683601 - RNA, 22 nt, Human
aggcaguguggagggcuguugc

SEQ ID NO: 683602 - RNA, 22 nt, Human
caggauagaaaggccauggagu

SEQ ID NO: 683603 - RNA, 22 nt, Human
ugcauacuuguauguguuacau

SEQ ID NO: 683604 - RNA, 22 nt, Human
agcuguccuggcucaggcugug

SEQ ID NO: 683605 - RNA, 18 nt, Human
caggucugucugccuccc

SEQ ID NO: 683606 - RNA, 22 nt, Human
cagugggugaugaguccugggg

SEQ ID NO: 683607 - RNA, 22 nt, Human
gauuuacagguuagguccugua

SEQ ID NO: 683608 - RNA, 22 nt, Human
uauuaugcaaauauuccuaccu

SEQ ID NO: 683609 - RNA, 22 nt, Human
cuuacgugauaacuucucaaaa

SEQ ID NO: 683610 - RNA, 22 nt, Human
uguguuaauuccacaaacauuc

SEQ ID NO: 683611 - RNA, 22 nt, Human
gcugccuuuuaaagccucgcuu

SEQ ID NO: 683612 - RNA, 22 nt, Human
cugaggaaaguauugccuggug

SEQ ID NO: 683613 - RNA, 17 nt, Human
auuuacauugucaccga

SEQ ID NO: 683614 - RNA, 22 nt, Human
caagauggacauaaggagagaa

SEQ ID NO: 683615 - RNA, 17 nt, Human
gagauuuucguccugaa

SEQ ID NO: 683616 - RNA, 22 nt, Human
ggccuugguaaugggggacugu

SEQ ID NO: 683617 - RNA, 22 nt, Human
cucugaaagacaagcucucauu

SEQ ID NO: 683618 - RNA, 22 nt, Human
uuuagacagcaucuggugacuu

SEQ ID NO: 683619 - RNA, 22 nt, Human
ugauucaguugguuuuguucag

SEQ ID NO: 683620 - RNA, 22 nt, Human
caugagauaauuuuucuccagu

SEQ ID NO: 683621 - RNA, 22 nt, Human
uggcuucuugacuucuuggcug

SEQ ID NO: 683622 - RNA, 22 nt, Human
gcacacaggggaguucucagaa

SEQ ID NO: 683623 - RNA, 22 nt, Human
accuggcacauucuaccacagu

SEQ ID NO: 683624 - RNA, 22 nt, Human
aggcucugccaauuccuuccuc

SEQ ID NO: 683625 - RNA, 22 nt, Human
gugugggaaggcuaggaugcug

SEQ ID NO: 683626 - RNA, 22 nt, Human
uagugucuucaggagauaugag

SEQ ID NO: 683627 - RNA, 22 nt, Human
ugucccugccugcccacucugu

SEQ ID NO: 683628 - RNA, 22 nt, Human
aaauucacucuguuccucaugg

SEQ ID NO: 683629 - RNA, 17 nt, Human
gggugggcacugcuggc

SEQ ID NO: 683630 - RNA, 22 nt, Human
gagcuagggguagucaggagac

SEQ ID NO: 683631 - RNA, 22 nt, Human
uauuuggaauagcuugcuaaug

SEQ ID NO: 683632 - RNA, 22 nt, Human
ucaaagcacacuuagugguaga

SEQ ID NO: 683633 - RNA, 22 nt, Human
ggaccaucucuagccagagcuu

SEQ ID NO: 683634 - RNA, 22 nt, Human
gcccuuacaggguggucagcca

SEQ ID NO: 683635 - RNA, 22 nt, Human
gugcuuuaaagacaguuaugcu

SEQ ID NO: 683636 - RNA, 22 nt, Human
augaaauucaucugagaaugcu

SEQ ID NO: 683637 - RNA, 23 nt, Human
ucacugcuacucagccugagauu

SEQ ID NO: 683638 - RNA, 22 nt, Human
uuugacaguaauaaagcacaag

SEQ ID NO: 683639 - RNA, 22 nt, Human
uuacauguuuacggauacacuu

SEQ ID NO: 683640 - RNA, 22 nt, Human
guacacaggcagcccagugcug

SEQ ID NO: 683641 - RNA, 22 nt, Human
guugugaauagugccgcaauaa

SEQ ID NO: 683642 - RNA, 22 nt, Human
cucauuaaaggaaaucaccugc

SEQ ID NO: 683643 - RNA, 22 nt, Human
gccuggcugaggccucugcuaa

SEQ ID NO: 683644 - RNA, 22 nt, Human
ggagccuggcccggcccuuggc

SEQ ID NO: 683645 - RNA, 22 nt, Human
agucagacauaauucuaacauu

SEQ ID NO: 683646 - RNA, 22 nt, Human
uucucuguggauugggugagag

SEQ ID NO: 683647 - RNA, 22 nt, Human
auaaagcaauagauuguguaau

SEQ ID NO: 683648 - RNA, 21 nt, Human
aacauugguucaaauaaaacu

SEQ ID NO: 683649 - RNA, 20 nt, Human
aggcucaggguguuuaggaa

SEQ ID NO: 683650 - RNA, 22 nt, Human
auuuuacuuaguguaaugucca

SEQ ID NO: 683651 - RNA, 22 nt, Human
uccagagcaugcagaucaucaa

SEQ ID NO: 683652 - RNA, 22 nt, Human
ucaguugccaguauuuuauaua

SEQ ID NO: 683653 - RNA, 22 nt, Human
cagcuggcugcggugaggggac

SEQ ID NO: 683654 - RNA, 22 nt, Human
auguuucaucaguaagguuuug

SEQ ID NO: 683655 - RNA, 19 nt, Human
uucacauuuugcucugagg

SEQ ID NO: 683656 - RNA, 22 nt, Human
gccugcuuugugccugaucuuu

SEQ ID NO: 683657 - RNA, 22 nt, Human
auacagggacauccaguuuuuc

SEQ ID NO: 683658 - RNA, 19 nt, Human
aaaguugagaaacaaugga

SEQ ID NO: 683659 - RNA, 22 nt, Human
acauaugaguacuauacagugc

SEQ ID NO: 683660 - RNA, 22 nt, Human
ggcccagcacagugcuuggggg

SEQ ID NO: 683661 - RNA, 22 nt, Human
caguguuuaaucauugugaauu

SEQ ID NO: 683662 - RNA, 22 nt, Human
gggcuccaaccccagugaacuc

SEQ ID NO: 683663 - RNA, 22 nt, Human
ccugugggcccuggacagagac

SEQ ID NO: 683664 - RNA, 22 nt, Human
gccaggagaaaaggcgaaugau

SEQ ID NO: 683665 - RNA, 22 nt, Human
ccucugugcuuuguccagccuc

SEQ ID NO: 683666 - RNA, 22 nt, Human
gaugcaaaccuuacauggaccu

SEQ ID NO: 683667 - RNA, 22 nt, Human
gcacagggcugccaggcggcuu

SEQ ID NO: 683668 - RNA, 22 nt, Human
gggucagagccguaacaggacu

SEQ ID NO: 683669 - RNA, 22 nt, Human
gaggcuggaauauuagaaaugu

SEQ ID NO: 683670 - RNA, 17 nt, Human
gggagaugaagggauau

SEQ ID NO: 683671 - RNA, 22 nt, Human
cuagggagacucgcaggacuca

SEQ ID NO: 683672 - RNA, 22 nt, Human
aacaaugcaguuaaugggaaga

SEQ ID NO: 683673 - RNA, 22 nt, Human
agaaaguuguuuuagccaaacc

SEQ ID NO: 683674 - RNA, 22 nt, Human
cagcuacacaccagaacuauua

SEQ ID NO: 683675 - RNA, 22 nt, Human
uuucacaggaugcuguuuuaua

SEQ ID NO: 683676 - RNA, 22 nt, Human
gcugggaguuacugucuccuuu

SEQ ID NO: 683677 - RNA, 22 nt, Human
auggaauugaagacagcauagg

SEQ ID NO: 683678 - RNA, 22 nt, Human
ucugaggccuuggcagcuaagg

SEQ ID NO: 683679 - RNA, 22 nt, Human
uuggaaaggagauucuauugug

SEQ ID NO: 683680 - RNA, 22 nt, Human
uuguuaaaaauagauuuccagg

SEQ ID NO: 683681 - RNA, 22 nt, Human
cauuaucucuucuauaugcuag

SEQ ID NO: 683682 - RNA, 22 nt, Human
ccacccacaaccagcuggcugu

SEQ ID NO: 683683 - RNA, 22 nt, Human
gcuggccuccugcuagauggaa

SEQ ID NO: 683684 - RNA, 22 nt, Human
agggagccagaguugggagcuc

SEQ ID NO: 683685 - RNA, 23 nt, Human
uccuaacucaauucagggguguc

SEQ ID NO: 683686 - RNA, 22 nt, Human
cccuggagaggacucaccccug

SEQ ID NO: 683687 - RNA, 22 nt, Human
caggcacuggggaugcugggau

SEQ ID NO: 683688 - RNA, 22 nt, Human
aucaucuggguuaaugugcuca

SEQ ID NO: 683689 - RNA, 22 nt, Human
uaugacagcaaauauccaugag

SEQ ID NO: 683690 - RNA, 22 nt, Human
ugcacuacugugauacacagcc

SEQ ID NO: 683691 - RNA, 22 nt, Human
cagccacucucagacaguccca

SEQ ID NO: 683692 - RNA, 22 nt, Human
ucuccuugacaggcaggcagac

SEQ ID NO: 683693 - RNA, 22 nt, Human
ugucucuuuggguuccucuugg

SEQ ID NO: 683694 - RNA, 22 nt, Human
uuagcaguucauugauuaucgu

SEQ ID NO: 683695 - RNA, 22 nt, Human
acugaggacagugaggagggcu

SEQ ID NO: 683696 - RNA, 21 nt, Human
gcaggguccuuuccauuccua

SEQ ID NO: 683697 - RNA, 22 nt, Human
agaaacuguguuacuagaaugu

SEQ ID NO: 683698 - RNA, 22 nt, Human
acacagugccaaauugcaguua

SEQ ID NO: 683699 - RNA, 22 nt, Human
uguagcuuuauauuguguuggg

SEQ ID NO: 683700 - RNA, 22 nt, Human
auucagacuaugaacacgucag

SEQ ID NO: 683701 - RNA, 22 nt, Human
auauggaaauagcaauaugguu

SEQ ID NO: 683702 - RNA, 22 nt, Human
ggguaggccagaagggccugga

SEQ ID NO: 683703 - RNA, 22 nt, Human
aggcaaauuauuguaugcaguu

SEQ ID NO: 683704 - RNA, 21 nt, Human
ggccugaguauaggacaggcc

SEQ ID NO: 683705 - RNA, 22 nt, Human
accugaggccuccccagcagac

SEQ ID NO: 683706 - RNA, 22 nt, Human
ugucaauguguacaggagcuca

SEQ ID NO: 683707 - RNA, 21 nt, Human
agcuuccugcagugggagguc

SEQ ID NO: 683708 - RNA, 22 nt, Human
acugcccucccaucuauugcaa

SEQ ID NO: 683709 - RNA, 22 nt, Human
ugaauauguauuucuuauuuac

SEQ ID NO: 683710 - RNA, 22 nt, Human
ugucugcugcccuggagccugg

SEQ ID NO: 683711 - RNA, 22 nt, Human
cugggcucaaauccuggcccug

SEQ ID NO: 683712 - RNA, 22 nt, Human
uacagaauguguaucauuacca

SEQ ID NO: 683713 - RNA, 22 nt, Human
ucuggcugcugcgugagugcuu

SEQ ID NO: 683714 - RNA, 22 nt, Human
cuucccaguucugcuugagggg

SEQ ID NO: 683715 - RNA, 22 nt, Human
ugccugccaggcaaccugggag

SEQ ID NO: 683716 - RNA, 22 nt, Human
ggccucagggucacucuguaga

SEQ ID NO: 683717 - RNA, 22 nt, Human
caggaaauuuauguucuacuua

SEQ ID NO: 683718 - RNA, 22 nt, Human
uaggaagguguuuuuaaggagc

SEQ ID NO: 683719 - RNA, 22 nt, Human
agucauauggcuauuuaguggg

SEQ ID NO: 683720 - RNA, 22 nt, Human
uggaaacuaacaacagagcaga

SEQ ID NO: 683721 - RNA, 22 nt, Human
uuccucagccaaggcugggauc

SEQ ID NO: 683722 - RNA, 22 nt, Human
ugagcaagacccggccucugcc

SEQ ID NO: 683723 - RNA, 22 nt, Human
ugaguuauaaugaauauuugaa

SEQ ID NO: 683724 - RNA, 22 nt, Human
guucuuaagaccacaauaaaaa

SEQ ID NO: 683725 - RNA, 22 nt, Human
cugagcaggauauucacagcag

SEQ ID NO: 683726 - RNA, 22 nt, Human
gaggcugaauggccagaagcca

SEQ ID NO: 683727 - RNA, 20 nt, Human
acaugaacagggcuacagca

SEQ ID NO: 683728 - RNA, 22 nt, Human
ucugggagguaaccaugcugau

SEQ ID NO: 683729 - RNA, 22 nt, Human
aaucgcuugguaauuuuaaaag

SEQ ID NO: 683730 - RNA, 22 nt, Human
cauugcacaucugagaagagau

SEQ ID NO: 683731 - RNA, 22 nt, Human
aauacaguaauuuugaugaguu

SEQ ID NO: 683732 - RNA, 22 nt, Human
acuaguauucuuggucuuguau

SEQ ID NO: 683733 - RNA, 22 nt, Human
cuggcucugagcccaccuccag

SEQ ID NO: 683734 - RNA, 22 nt, Human
auggcucugcugggcaaagcaa

SEQ ID NO: 683735 - RNA, 22 nt, Human
cugagggccugaggaccuagau

SEQ ID NO: 683736 - RNA, 22 nt, Human
acaccuggucuuugcaugagca

SEQ ID NO: 683737 - RNA, 22 nt, Human
gcccugugagucaugcggcaga

SEQ ID NO: 683738 - RNA, 22 nt, Human
gagguuucacuguguuguccag

SEQ ID NO: 683739 - RNA, 22 nt, Human
uagaggccugaaagaaugauca

SEQ ID NO: 683740 - RNA, 22 nt, Human
gaaauguguuguucauuucuaa

SEQ ID NO: 683741 - RNA, 22 nt, Human
gguguugggagagcugguuuug

SEQ ID NO: 683742 - RNA, 22 nt, Human
gcacacaguagggauucaauga

SEQ ID NO: 683743 - RNA, 19 nt, Human
gccugccuggguuucugag

SEQ ID NO: 683744 - RNA, 22 nt, Human
uguucacaagaugucuguggcu

SEQ ID NO: 683745 - RNA, 22 nt, Human
gaggagcuucagaggaaucuua

SEQ ID NO: 683746 - RNA, 22 nt, Human
ccuuuauucaauuaguccuaau

SEQ ID NO: 683747 - RNA, 22 nt, Human
ggcugcucacgcagcccucccu

SEQ ID NO: 683748 - RNA, 21 nt, Human
cucuuugggaucuuuggaaag

SEQ ID NO: 683749 - RNA, 22 nt, Human
agaguguggaaauguucagagu

SEQ ID NO: 683750 - RNA, 22 nt, Human
gagcuaaggcacaggcaggcuu

SEQ ID NO: 683751 - RNA, 22 nt, Human
gcagagaugagcuaucaggaca

SEQ ID NO: 683752 - RNA, 22 nt, Human
gugagacucgccuuuguguagc

SEQ ID NO: 683753 - RNA, 22 nt, Human
ggcugcugugaccucaggugau

SEQ ID NO: 683754 - RNA, 22 nt, Human
agccuggaauuaaggaaaugca

SEQ ID NO: 683755 - RNA, 22 nt, Human
gggacaggccccucgcuagcuu

SEQ ID NO: 683756 - RNA, 19 nt, Human
ggacagggggagcuuuuau

SEQ ID NO: 683757 - RNA, 22 nt, Human
ggcuugagacccgggagccaga

SEQ ID NO: 683758 - RNA, 19 nt, Human
uucuguguuaauuccuuua

SEQ ID NO: 683759 - RNA, 22 nt, Human
ucaggugggcguuccggugcgg

SEQ ID NO: 683760 - RNA, 22 nt, Human
uuuuucaugagacuagaaguca

SEQ ID NO: 683761 - RNA, 22 nt, Human
gccugggagggcagcagugugg

SEQ ID NO: 683762 - RNA, 22 nt, Human
gccaggcaugggcuucugggcg

SEQ ID NO: 683763 - RNA, 22 nt, Human
auguacacuuuggaagagucac

SEQ ID NO: 683764 - RNA, 22 nt, Human
auaaauaucacuguugucccuc

SEQ ID NO: 683765 - RNA, 22 nt, Human
caauaacugcuaaauucccugu

SEQ ID NO: 683766 - RNA, 22 nt, Human
cauucaucuaucaaaugguacc

SEQ ID NO: 683767 - RNA, 18 nt, Human
ugccagccgacuggccug

SEQ ID NO: 683768 - RNA, 22 nt, Human
ugaggcauuaaagggaggucaa

SEQ ID NO: 683769 - RNA, 21 nt, Human
agcagccauuucacagagacu

SEQ ID NO: 683770 - RNA, 22 nt, Human
uuuaaucuauucccuaaacacc

SEQ ID NO: 683771 - RNA, 22 nt, Human
caguccuugcuaugacccugag

SEQ ID NO: 683772 - RNA, 22 nt, Human
aagguauuuucuaauguauacu

SEQ ID NO: 683773 - RNA, 22 nt, Human
cuggcaucuagugcguugaggu

SEQ ID NO: 683774 - RNA, 22 nt, Human
ucuuuuuauauugacaaaaggu

SEQ ID NO: 683775 - RNA, 22 nt, Human
ccucacaguuuggcuaacugug

SEQ ID NO: 683776 - RNA, 22 nt, Human
cuacaguaugaaaccuuuacuc

SEQ ID NO: 683777 - RNA, 22 nt, Human
aauauuugaacagucacugagu

SEQ ID NO: 683778 - RNA, 22 nt, Human
cagagguguacagagggaggcc

SEQ ID NO: 683779 - RNA, 22 nt, Human
uggaggaugccauccaggauac

SEQ ID NO: 683780 - RNA, 22 nt, Human
cuaacuuuagcuuagauuauca

SEQ ID NO: 683781 - RNA, 22 nt, Human
ucugccugcuaacuccugcacc

SEQ ID NO: 683782 - RNA, 22 nt, Human
aaaugcagaaugauuucaucua

SEQ ID NO: 683783 - RNA, 22 nt, Human
cugggugaauuugaaggaaagg

SEQ ID NO: 683784 - RNA, 22 nt, Human
cugcucuaauaucagauagacu

SEQ ID NO: 683785 - RNA, 21 nt, Human
aaggggcaaacccaggacacc

SEQ ID NO: 683786 - RNA, 22 nt, Human
uguacaauggcuauaauacccu

SEQ ID NO: 683787 - RNA, 22 nt, Human
agaguggccuggccuggggcau

SEQ ID NO: 683788 - RNA, 22 nt, Human
caucugcugacuugacaaguac

SEQ ID NO: 683789 - RNA, 22 nt, Human
gggaggguguucucccaagaac

SEQ ID NO: 683790 - RNA, 22 nt, Human
ugugugugacucauacuagaac

SEQ ID NO: 683791 - RNA, 22 nt, Human
uucacaaacuucaugauggcac

SEQ ID NO: 683792 - RNA, 22 nt, Human
uaguauuuaaucacuuuugucu

SEQ ID NO: 683793 - RNA, 21 nt, Human
gcucugccacuuaccagauuu

SEQ ID NO: 683794 - RNA, 21 nt, Human
aggcugugacuuacacuaucu

SEQ ID NO: 683795 - RNA, 22 nt, Human
uggagguggggcucaggaaucu

SEQ ID NO: 683796 - RNA, 22 nt, Human
aacauuuguuuggcuucaauua

SEQ ID NO: 683797 - RNA, 22 nt, Human
ucucugagcgcauuccuccggc

SEQ ID NO: 683798 - RNA, 19 nt, Human
ucucagaggaaaaauugcu

SEQ ID NO: 683799 - RNA, 22 nt, Human
agggcagaggcggacacggaag

SEQ ID NO: 683800 - RNA, 22 nt, Human
cagggcuggauuucauuucuag

SEQ ID NO: 683801 - RNA, 22 nt, Human
agccccagccccucucucacaa

SEQ ID NO: 683802 - RNA, 22 nt, Human
cagaggcaaaagagguggaggu

SEQ ID NO: 683803 - RNA, 22 nt, Human
uggcugccaauggcuuggaaag

SEQ ID NO: 683804 - RNA, 21 nt, Human
ucacaggucaaugugugaagg

SEQ ID NO: 683805 - RNA, 22 nt, Human
auaugaaguuacagguaagaaa

SEQ ID NO: 683806 - RNA, 22 nt, Human
auucuuauuuaaauagagucug

SEQ ID NO: 683807 - RNA, 22 nt, Human
aaugcaaccugcugaucugaca

SEQ ID NO: 683808 - RNA, 22 nt, Human
caaugauugcuauuuacauaaa

SEQ ID NO: 683809 - RNA, 22 nt, Human
ccuggcacaugauagaugcuca

SEQ ID NO: 683810 - RNA, 22 nt, Human
uauuucugauugcucaugaggc

SEQ ID NO: 683811 - RNA, 22 nt, Human
gauaaugugccgauaauuucua

SEQ ID NO: 683812 - RNA, 22 nt, Human
aaucucuucccaguaaaaaugg

SEQ ID NO: 683813 - RNA, 22 nt, Human
cccaggcagaauuaguguuuca

SEQ ID NO: 683814 - RNA, 22 nt, Human
aggaaaauggaccagaguuguu

SEQ ID NO: 683815 - RNA, 22 nt, Human
agggcugccugacuccagagcc

SEQ ID NO: 683816 - RNA, 22 nt, Human
agaaagcagucccuuccgaccg

SEQ ID NO: 683817 - RNA, 22 nt, Human
aaagccagguugugugcaggaa

SEQ ID NO: 683818 - RNA, 22 nt, Human
cacaggaggcaaugguaagauu

SEQ ID NO: 683819 - RNA, 22 nt, Human
ugaaggcauuugaguuggugag

SEQ ID NO: 683820 - RNA, 22 nt, Human
ugcacaguaaacaugacuggag

SEQ ID NO: 683821 - RNA, 22 nt, Human
aagcauuuugccacuugaaguu

SEQ ID NO: 683822 - RNA, 21 nt, Human
agcucccuguuuccucacucu

SEQ ID NO: 683823 - RNA, 22 nt, Human
agggcagaaguacagacacuua

SEQ ID NO: 683824 - RNA, 22 nt, Human
gggagggaaggaccuuaugaau

SEQ ID NO: 683825 - RNA, 22 nt, Human
gggcugagugucccaggccgaa

SEQ ID NO: 683826 - RNA, 22 nt, Human
aguuauaugugaaaacacguau

SEQ ID NO: 683827 - RNA, 22 nt, Human
cuuucuagacuguccagaugau

SEQ ID NO: 683828 - RNA, 22 nt, Human
cuuugguucuguccuucccaga

SEQ ID NO: 683829 - RNA, 22 nt, Human
uucuggaaggcagggagaaccc

SEQ ID NO: 683830 - RNA, 23 nt, Human
gccuucagcucgggaaggcuccc

SEQ ID NO: 683831 - RNA, 18 nt, Human
acccucuggcuucugagc

SEQ ID NO: 683832 - RNA, 22 nt, Human
augggaggcaggcucagaaccg

SEQ ID NO: 683833 - RNA, 22 nt, Human
gugccugugccaggggugugcu

SEQ ID NO: 683834 - RNA, 22 nt, Human
acacuucauuuacauuauaggc

SEQ ID NO: 683835 - RNA, 23 nt, Human
aggagccaugaguuggauauguu

SEQ ID NO: 683836 - RNA, 22 nt, Human
cuuccagucuuuucaguggagu

SEQ ID NO: 683837 - RNA, 22 nt, Human
ugccucugggugaccaaggagc

SEQ ID NO: 683838 - RNA, 22 nt, Human
uuucagccagugaugcugaaga

SEQ ID NO: 683839 - RNA, 22 nt, Human
gcagcccaagagacucuguuga

SEQ ID NO: 683840 - RNA, 22 nt, Human
caucuggcagacccugccuccg

SEQ ID NO: 683841 - RNA, 22 nt, Human
agguaucaacagcagagucuga

SEQ ID NO: 683842 - RNA, 22 nt, Human
ucacaagagcuggacugucuuu

SEQ ID NO: 683843 - RNA, 22 nt, Human
ucuggaauugcugugugaguuc

SEQ ID NO: 683844 - RNA, 22 nt, Human
uagacacaucuucauccacaau

SEQ ID NO: 683845 - RNA, 22 nt, Human
uggcugagaccaucagggugua

SEQ ID NO: 683846 - RNA, 22 nt, Human
gcccucuggugggugagccccg

SEQ ID NO: 683847 - RNA, 22 nt, Human
ugaagggcaaccccaggcccag

SEQ ID NO: 683848 - RNA, 22 nt, Human
gcagcagcucaguucugggagg

SEQ ID NO: 683849 - RNA, 22 nt, Human
ucuagguggaugaggaacauag

SEQ ID NO: 683850 - RNA, 22 nt, Human
cugaauaauauuccauuaugag

SEQ ID NO: 683851 - RNA, 22 nt, Human
uggccagcccucuucccacacu

SEQ ID NO: 683852 - RNA, 22 nt, Human
uuacuaguauaugucaagcaac

SEQ ID NO: 683853 - RNA, 22 nt, Human
agacagcaugagccugcugaug

SEQ ID NO: 683854 - RNA, 22 nt, Human
uccuggccacccgacagaaguc

SEQ ID NO: 683855 - RNA, 22 nt, Human
uuggggagguugccacauucca

SEQ ID NO: 683856 - RNA, 22 nt, Human
agugcugagugauugcaaagga

SEQ ID NO: 683857 - RNA, 22 nt, Human
ucuuugaauuucugacugucuu

SEQ ID NO: 683858 - RNA, 22 nt, Human
uauuuguuccagagauaaaaau

SEQ ID NO: 683859 - RNA, 22 nt, Human
ggagagcuagugccugccagua

SEQ ID NO: 683860 - RNA, 22 nt, Human
auacaaucaucauuauauuccc

SEQ ID NO: 683861 - RNA, 22 nt, Human
cacaggcuuuuuuggcugaugu

SEQ ID NO: 683862 - RNA, 22 nt, Human
ucucccaaccucuggugggugc

SEQ ID NO: 683863 - RNA, 22 nt, Human
ucagauuucagcuaaagggaug

SEQ ID NO: 683864 - RNA, 22 nt, Human
cuuuccuagaaauauauacuua

SEQ ID NO: 683865 - RNA, 22 nt, Human
cagccacucggccauaaaggcu

SEQ ID NO: 683866 - RNA, 21 nt, Human
aggcccagcuuuccucuugcu

SEQ ID NO: 683867 - RNA, 22 nt, Human
agaaggcugagacugggaugaa

SEQ ID NO: 683868 - RNA, 22 nt, Human
uuugaugaugaugauaaaguuu

SEQ ID NO: 683869 - RNA, 22 nt, Human
gaaagcaaguugacugcagaau

SEQ ID NO: 683870 - RNA, 22 nt, Human
agaaaguuaucacaaaauugag

SEQ ID NO: 683871 - RNA, 20 nt, Human
acccuccacuguucacugug

SEQ ID NO: 683872 - RNA, 22 nt, Human
cagcuuucuuuccauaagguuu

SEQ ID NO: 683873 - RNA, 22 nt, Human
cucuguggcuugccuuucuguc

SEQ ID NO: 683874 - RNA, 21 nt, Human
caagacauaugaguacucugg

SEQ ID NO: 683875 - RNA, 22 nt, Human
ccucaggccucugccucauugg

SEQ ID NO: 683876 - RNA, 22 nt, Human
guccuuggcuguggcuguaaug

SEQ ID NO: 683877 - RNA, 22 nt, Human
aaaaugagccaugaaccaacca

SEQ ID NO: 683878 - RNA, 22 nt, Human
ccagggucucugcugccugaga

SEQ ID NO: 683879 - RNA, 22 nt, Human
ugccugucagggggagugggaa

SEQ ID NO: 683880 - RNA, 22 nt, Human
uguguggauucaucucaaagag

SEQ ID NO: 683881 - RNA, 22 nt, Human
uuuuaguuguacugucaacagu

SEQ ID NO: 683882 - RNA, 22 nt, Human
auuagauauuugcuguuggauu

SEQ ID NO: 683883 - RNA, 22 nt, Human
ucugaggucacagauuucaaga

SEQ ID NO: 683884 - RNA, 22 nt, Human
acagugauuauuaguugguggu

SEQ ID NO: 683885 - RNA, 22 nt, Human
uucugcuucugugugucccagg

SEQ ID NO: 683886 - RNA, 22 nt, Human
ucaggacagguucgggugggua

SEQ ID NO: 683887 - RNA, 22 nt, Human
guuuguuuuaagauaggaugga

SEQ ID NO: 683888 - RNA, 22 nt, Human
caggacaucgucaucaugggga

SEQ ID NO: 683889 - RNA, 19 nt, Human
uccagcagugcuugaaauc

SEQ ID NO: 683890 - RNA, 22 nt, Human
cugcaaauaggggugugaauaa

SEQ ID NO: 683891 - RNA, 22 nt, Human
agugggaauuucagugcuaaaa

SEQ ID NO: 683892 - RNA, 22 nt, Human
caggccucuuccaugcagcagc

SEQ ID NO: 683893 - RNA, 22 nt, Human
agagaagacuuacagccacagu

SEQ ID NO: 683894 - RNA, 22 nt, Human
ucucugagaucagccacugacu

SEQ ID NO: 683895 - RNA, 22 nt, Human
cgccucagccguggucaucuuc

SEQ ID NO: 683896 - RNA, 22 nt, Human
ugaggcucagaagugccaagug

SEQ ID NO: 683897 - RNA, 22 nt, Human
agugauuuugcuuugaagugac

SEQ ID NO: 683898 - RNA, 22 nt, Human
cucagaggggaugcuuggagaa

SEQ ID NO: 683899 - RNA, 22 nt, Human
guggaaggaauuaacagacuag

SEQ ID NO: 683900 - RNA, 22 nt, Human
aauaacugcacuuguugaaugc

SEQ ID NO: 683901 - RNA, 20 nt, Human
cgugcugugaccuugagcau

SEQ ID NO: 683902 - RNA, 22 nt, Human
aggcccagacucagcggggcgg

SEQ ID NO: 683903 - RNA, 22 nt, Human
cagagucagagcuccauggagu

SEQ ID NO: 683904 - RNA, 22 nt, Human
uguggcuguguccaccugcugc

SEQ ID NO: 683905 - RNA, 22 nt, Human
aagguccuguagccacagagcc

SEQ ID NO: 683906 - RNA, 21 nt, Human
ggaaaacuuuccuugucugaa

SEQ ID NO: 683907 - RNA, 22 nt, Human
ucaggcucugagcugaugcuaa

SEQ ID NO: 683908 - RNA, 22 nt, Human
agcucccagaaggcccugcgcc

SEQ ID NO: 683909 - RNA, 22 nt, Human
ccuggccucagacagagggugg

SEQ ID NO: 683910 - RNA, 22 nt, Human
gcuugccuggcauuucuggggc

SEQ ID NO: 683911 - RNA, 21 nt, Human
gccuccagccagauggccucc

SEQ ID NO: 683912 - RNA, 22 nt, Human
cuguacagaguucugaguguac

SEQ ID NO: 683913 - RNA, 20 nt, Human
gccaccucucuagcaguaga

SEQ ID NO: 683914 - RNA, 22 nt, Human
gugggcuggagcaaugauuuca

SEQ ID NO: 683915 - RNA, 22 nt, Human
ucaggcugcaguggcaaaagac

SEQ ID NO: 683916 - RNA, 19 nt, Human
gaggagcuaucggagacag

SEQ ID NO: 683917 - RNA, 22 nt, Human
uguagauuuuggagucuacaag

SEQ ID NO: 683918 - RNA, 22 nt, Human
gugcccaggcccaaggcaccac

SEQ ID NO: 683919 - RNA, 22 nt, Human
aagcccuguuaggcacugggga

SEQ ID NO: 683920 - RNA, 22 nt, Human
cagaguggugcaagggcagugu

SEQ ID NO: 683921 - RNA, 22 nt, Human
auggcugcagccggcccugcgc

SEQ ID NO: 683922 - RNA, 22 nt, Human
augagguuauauuuaauucacu

SEQ ID NO: 683923 - RNA, 22 nt, Human
cccugcagagggaugggggcag

SEQ ID NO: 683924 - RNA, 22 nt, Human
uaucacacucggaaaucuagga

SEQ ID NO: 683925 - RNA, 19 nt, Human
acccagggguuuaugugug

SEQ ID NO: 683926 - RNA, 15 nt, Human
ccaggcucugcacuc

SEQ ID NO: 683927 - RNA, 18 nt, Human
cugaggcccagagagggc

SEQ ID NO: 683928 - RNA, 22 nt, Human
aagugucugacacaaaauaugu

SEQ ID NO: 683929 - RNA, 22 nt, Human
auguuaccucuauuagaauauu

SEQ ID NO: 683930 - RNA, 21 nt, Human
gugugaguagcaugugucuca

SEQ ID NO: 683931 - RNA, 22 nt, Human
acuuccuguguuggucuugcug

SEQ ID NO: 683932 - RNA, 22 nt, Human
agaaaacuugcucgagccuguu

SEQ ID NO: 683933 - RNA, 22 nt, Human
cuguuauuccccuugcuguggu

SEQ ID NO: 683934 - RNA, 22 nt, Human
caaacauuuugagugguuucug

SEQ ID NO: 683935 - RNA, 22 nt, Human
auugcuuuuaagcaccaccuaa

SEQ ID NO: 683936 - RNA, 22 nt, Human
cuagaaaaauacuuuauuguga

SEQ ID NO: 683937 - RNA, 22 nt, Human
uuccugguuugccuggaaucca

SEQ ID NO: 683938 - RNA, 22 nt, Human
ccucuucagcaaaguucggccc

SEQ ID NO: 683939 - RNA, 21 nt, Human
ugacagcacaugcaaucggag

SEQ ID NO: 683940 - RNA, 22 nt, Human
ccaauacuuagauuaaaauagu

SEQ ID NO: 683941 - RNA, 22 nt, Human
ucucaccauggugcuugcuuau

SEQ ID NO: 683942 - RNA, 22 nt, Human
caaauaagcaauuccauucuuc

SEQ ID NO: 683943 - RNA, 22 nt, Human
aggagacagccaggggccugag

SEQ ID NO: 683944 - RNA, 22 nt, Human
uaaaauuugucccugaguguug

SEQ ID NO: 683945 - RNA, 22 nt, Human
ccaggcuuuaagagguggaaac

SEQ ID NO: 683946 - RNA, 22 nt, Human
acagggcuugugacaacuuuaa

SEQ ID NO: 683947 - RNA, 22 nt, Human
uagucucugcuuugcccuuggc

SEQ ID NO: 683948 - RNA, 18 nt, Human
auguggcuagugcuacug

SEQ ID NO: 683949 - RNA, 22 nt, Human
ccacugucugcaggccucagca

SEQ ID NO: 683950 - RNA, 22 nt, Human
ucagacaguuugcagugugccu

SEQ ID NO: 683951 - RNA, 22 nt, Human
uagcauuuauggucaugugucc

SEQ ID NO: 683952 - RNA, 17 nt, Human
uuacaacgucaucucug

SEQ ID NO: 683953 - RNA, 22 nt, Human
ucugucauccaggcuggaauau

SEQ ID NO: 683954 - RNA, 22 nt, Human
ggcacagcaagaagggaaauga

SEQ ID NO: 683955 - RNA, 22 nt, Human
cuccuugguguaguacugagca

SEQ ID NO: 683956 - RNA, 22 nt, Human
gaggcucagagggagcaugguc

SEQ ID NO: 683957 - RNA, 22 nt, Human
accagccagccacaguggcucc

SEQ ID NO: 683958 - RNA, 22 nt, Human
aaacucucauuuuagugcacug

SEQ ID NO: 683959 - RNA, 22 nt, Human
ggccaccugggaucucauccug

SEQ ID NO: 683960 - RNA, 18 nt, Human
auccugggagcagacagc

SEQ ID NO: 683961 - RNA, 22 nt, Human
agcuauguauaaauaggccacu

SEQ ID NO: 683962 - RNA, 22 nt, Human
augucaccuucgguggcacggu

SEQ ID NO: 683963 - RNA, 22 nt, Human
gcugccugaagugucuacacug

SEQ ID NO: 683964 - RNA, 19 nt, Human
acagagggcaacugagaaa

SEQ ID NO: 683965 - RNA, 22 nt, Human
cuggucugggaugagggaugua

SEQ ID NO: 683966 - RNA, 22 nt, Human
uuugcaaagugacuauuauaug

SEQ ID NO: 683967 - RNA, 22 nt, Human
uauucucagugcuauaaguaga

SEQ ID NO: 683968 - RNA, 22 nt, Human
cuggcugaauccuagucucaua

SEQ ID NO: 683969 - RNA, 22 nt, Human
uugaaugaagggaugaccgaag

SEQ ID NO: 683970 - RNA, 21 nt, Human
ucccaagcugcuggcucagcu

SEQ ID NO: 683971 - RNA, 20 nt, Human
guggagaggcuggcgggacu

SEQ ID NO: 683972 - RNA, 22 nt, Human
aagugaauggggcagacuucag

SEQ ID NO: 683973 - RNA, 22 nt, Human
gucuuguccauuccaugcugcu

SEQ ID NO: 683974 - RNA, 22 nt, Human
gcaggcugaguauuacccuagu

SEQ ID NO: 683975 - RNA, 22 nt, Human
uguccaggcggccuugccuguu

SEQ ID NO: 683976 - RNA, 21 nt, Human
cugccuugaaugguacuggga

SEQ ID NO: 683977 - RNA, 22 nt, Human
uauuaaauuauggauuuaggag

SEQ ID NO: 683978 - RNA, 22 nt, Human
aggaagccuggcauuaaaaagc

SEQ ID NO: 683979 - RNA, 22 nt, Human
ggagcuguugcgcaugcgcucg

SEQ ID NO: 683980 - RNA, 22 nt, Human
cagagccccuggguugggagcu

SEQ ID NO: 683981 - RNA, 22 nt, Human
aaauuauucaaaaagcuguguu

SEQ ID NO: 683982 - RNA, 22 nt, Human
cagggcacggagaagucacccc

SEQ ID NO: 683983 - RNA, 22 nt, Human
gccagccagggaagggagagac

SEQ ID NO: 683984 - RNA, 22 nt, Human
auuuucacccugaauauauuga

SEQ ID NO: 683985 - RNA, 22 nt, Human
cacuucagguucuggcagggcg

SEQ ID NO: 683986 - RNA, 22 nt, Human
aaguuuagcgcucucucaagga

SEQ ID NO: 683987 - RNA, 22 nt, Human
aaggccugggaggccucucuuc

SEQ ID NO: 683988 - RNA, 22 nt, Human
gcauucaggguucacggucaac

SEQ ID NO: 683989 - RNA, 22 nt, Human
cuucuucuuuugugggugguaa

SEQ ID NO: 683990 - RNA, 22 nt, Human
uggcuucaggguugucuucagc

SEQ ID NO: 683991 - RNA, 22 nt, Human
guauuuuauggcaugcaguggc

SEQ ID NO: 683992 - RNA, 22 nt, Human
agcaauagauaaaacauuuacc

SEQ ID NO: 683993 - RNA, 22 nt, Human
agcauuauguccaugcuaaauu

SEQ ID NO: 683994 - RNA, 22 nt, Human
uagauuucaggagacaaaaugg

SEQ ID NO: 683995 - RNA, 22 nt, Human
caggagugagaugcgaucacuu

SEQ ID NO: 683996 - RNA, 21 nt, Human
gcagggacaaagcuucaggag

SEQ ID NO: 683997 - RNA, 22 nt, Human
uccaggccccugccugggccug

SEQ ID NO: 683998 - RNA, 22 nt, Human
agacagaacagaauaauuguug

SEQ ID NO: 683999 - RNA, 22 nt, Human
aaacaggcuugcaacauguuuu

SEQ ID NO: 684000 - RNA, 17 nt, Human
aguguggcccugguuaa

SEQ ID NO: 684001 - RNA, 23 nt, Human
ucucccucaugccuaggccuggg

SEQ ID NO: 684002 - RNA, 20 nt, Human
aggaagcugagauguagagg

SEQ ID NO: 684003 - RNA, 22 nt, Human
augacagcauucaagacauaga

SEQ ID NO: 684004 - RNA, 22 nt, Human
caccugagugucaguauucuca

SEQ ID NO: 684005 - RNA, 22 nt, Human
agcacagacuggucccaggucu

SEQ ID NO: 684006 - RNA, 22 nt, Human
agugucugcaaaaugaaagagc

SEQ ID NO: 684007 - RNA, 23 nt, Human
aaauugucguaagguggagaugu

SEQ ID NO: 684008 - RNA, 22 nt, Human
cuggaagguucuuugugugccu

SEQ ID NO: 684009 - RNA, 22 nt, Human
auuuacaggacagcuuggcauu

SEQ ID NO: 684010 - RNA, 22 nt, Human
ccccucagguacccgugcagca

SEQ ID NO: 684011 - RNA, 22 nt, Human
augcaaauuaacauauaguaga

SEQ ID NO: 684012 - RNA, 22 nt, Human
uuucaggauuaguuuaagcagg

SEQ ID NO: 684013 - RNA, 22 nt, Human
uggcuguagaacaguggauauu

SEQ ID NO: 684014 - RNA, 22 nt, Human
uugccuguuugagagcuguguu

SEQ ID NO: 684015 - RNA, 22 nt, Human
gcuggcagaauuucuucuugcu

SEQ ID NO: 684016 - RNA, 22 nt, Human
cccucuccuggcugcauggagc

SEQ ID NO: 684017 - RNA, 22 nt, Human
uggcuucaguuucccagucugg

SEQ ID NO: 684018 - RNA, 22 nt, Human
uugaaaggcacaggcaccuggg

SEQ ID NO: 684019 - RNA, 21 nt, Human
ugggcgcuugaccucugcacu

SEQ ID NO: 684020 - RNA, 22 nt, Human
uguugaagauaaaguucucauu

SEQ ID NO: 684021 - RNA, 22 nt, Human
aggucaaaaugcuuuucagguc

SEQ ID NO: 684022 - RNA, 22 nt, Human
cugcuuuaauuuagacaaggca

SEQ ID NO: 684023 - RNA, 22 nt, Human
ccuggcugagggaccucgggua

SEQ ID NO: 684024 - RNA, 22 nt, Human
ugggagcaaaugacugggagau

SEQ ID NO: 684025 - RNA, 18 nt, Human
uggcuucagaguaaaaug

SEQ ID NO: 684026 - RNA, 22 nt, Human
gcagcccaauggacugagacag

SEQ ID NO: 684027 - RNA, 22 nt, Human
aggcaggugggagugauuccuu

SEQ ID NO: 684028 - RNA, 22 nt, Human
aaaugguaagacaacacauuau

SEQ ID NO: 684029 - RNA, 22 nt, Human
aggaagcucggagagggcaaau

SEQ ID NO: 684030 - RNA, 22 nt, Human
agucaguuaaacuuuguaaagu

SEQ ID NO: 684031 - RNA, 22 nt, Human
ugcauguguuucccagcaagcu

SEQ ID NO: 684032 - RNA, 22 nt, Human
augucccuugucugugaugucu

SEQ ID NO: 684033 - RNA, 22 nt, Human
uggccagcuuugacuguaaacc

SEQ ID NO: 684034 - RNA, 22 nt, Human
uuucauuacguguuugacuugu

SEQ ID NO: 684035 - RNA, 23 nt, Human
ccuccucauaucuuugacuagug

SEQ ID NO: 684036 - RNA, 22 nt, Human
acuuuucuuaucagaaaggcca

SEQ ID NO: 684037 - RNA, 22 nt, Human
agcugcuccaauuuuuaccauu

SEQ ID NO: 684038 - RNA, 22 nt, Human
ucacaugcuguguguggagauc

SEQ ID NO: 684039 - RNA, 22 nt, Human
uguuuacaaggaguuuauauug

SEQ ID NO: 684040 - RNA, 22 nt, Human
agcuaagauuuauuaaaggccc

SEQ ID NO: 684041 - RNA, 22 nt, Human
aauuucuccaagaaugcuuaga

SEQ ID NO: 684042 - RNA, 22 nt, Human
ggugagagaaaagaaacacugu

SEQ ID NO: 684043 - RNA, 22 nt, Human
aacuggcauaugaacuuguucu

SEQ ID NO: 684044 - RNA, 22 nt, Human
cauugcuuugugcauauuuaaa

SEQ ID NO: 684045 - RNA, 22 nt, Human
gcacaggaugauggguugaggg

SEQ ID NO: 684046 - RNA, 22 nt, Human
uagggcaguuauaacauuagug

SEQ ID NO: 684047 - RNA, 22 nt, Human
aaucauugcuccuuucucuggu

SEQ ID NO: 684048 - RNA, 22 nt, Human
agcagcagugacagccgaaagc

SEQ ID NO: 684049 - RNA, 22 nt, Human
uagaggcuacuagaggcaccug

SEQ ID NO: 684050 - RNA, 22 nt, Human
gcaaagcacacccucagaguuu

SEQ ID NO: 684051 - RNA, 22 nt, Human
ucaggcagguggcuggcuaugg

SEQ ID NO: 684052 - RNA, 22 nt, Human
uggaauaugcaauugcauuuca

SEQ ID NO: 684053 - RNA, 17 nt, Human
ugccugccagcauugga

SEQ ID NO: 684054 - RNA, 22 nt, Human
gggugcagugguucacgccugu

SEQ ID NO: 684055 - RNA, 19 nt, Human
agaaauagccuuccuuguc

SEQ ID NO: 684056 - RNA, 22 nt, Human
uuugcagugucagcuucugugu

SEQ ID NO: 684057 - RNA, 21 nt, Human
ccauccacugagugguucccu

SEQ ID NO: 684058 - RNA, 22 nt, Human
ugcaggugugugcaagggaggg

SEQ ID NO: 684059 - RNA, 20 nt, Human
ugcagcagaagcccaugcuc

SEQ ID NO: 684060 - RNA, 19 nt, Human
aggguuacccgcugccacc

SEQ ID NO: 684061 - RNA, 22 nt, Human
cagaaaacaaaccuauccugag

SEQ ID NO: 684062 - RNA, 22 nt, Human
aaauaggagcuuaagcacuucu

SEQ ID NO: 684063 - RNA, 22 nt, Human
aagugcuuggagcauaccuguu

SEQ ID NO: 684064 - RNA, 22 nt, Human
agcaaugacuggcuauaugauu

SEQ ID NO: 684065 - RNA, 22 nt, Human
ccacaggggucucuguagcuga

SEQ ID NO: 684066 - RNA, 22 nt, Human
uacaaaacagugcucugguccu

SEQ ID NO: 684067 - RNA, 22 nt, Human
gaggggaagacuucuggacagu

SEQ ID NO: 684068 - RNA, 22 nt, Human
gagcccagauuggaauuuccca

SEQ ID NO: 684069 - RNA, 22 nt, Human
caaggcagcguuccuuucugga

SEQ ID NO: 684070 - RNA, 22 nt, Human
cuggcacaaaagaaaacugcca

SEQ ID NO: 684071 - RNA, 22 nt, Human
cagcaucuguuggauggauaag

SEQ ID NO: 684072 - RNA, 22 nt, Human
gugaggacugguaaggacugca

SEQ ID NO: 684073 - RNA, 22 nt, Human
uccccaggggcaucucucugcu

SEQ ID NO: 684074 - RNA, 22 nt, Human
ucaggaaauacaagugacauca

SEQ ID NO: 684075 - RNA, 21 nt, Human
acaggcucacgauccauuucu

SEQ ID NO: 684076 - RNA, 22 nt, Human
ucuggcucaggagcuguguuca

SEQ ID NO: 684077 - RNA, 21 nt, Human
ggcuccugcuuugugaggggc

SEQ ID NO: 684078 - RNA, 22 nt, Human
ugugauuucaucugaggccagg

SEQ ID NO: 684079 - RNA, 22 nt, Human
uuucuagcuguaggaagcugag

SEQ ID NO: 684080 - RNA, 22 nt, Human
gaggcacaauacaugucucaag

SEQ ID NO: 684081 - RNA, 22 nt, Human
caggaaaugaacaggaaugaac

SEQ ID NO: 684082 - RNA, 22 nt, Human
uucagacuuuguggggcccucc

SEQ ID NO: 684083 - RNA, 22 nt, Human
ggagaggcgaugagucacagcc

SEQ ID NO: 684084 - RNA, 22 nt, Human
gcucgaccgccagaaacuuccu

SEQ ID NO: 684085 - RNA, 22 nt, Human
uugauucagagaagauuggccc

SEQ ID NO: 684086 - RNA, 22 nt, Human
gccuggcuaauuuugguauuuu

SEQ ID NO: 684087 - RNA, 22 nt, Human
aaagucugagcagaauuucuca

SEQ ID NO: 684088 - RNA, 22 nt, Human
uaggggugggauccaggaauua

SEQ ID NO: 684089 - RNA, 22 nt, Human
gaacaguaacugucugcugugu

SEQ ID NO: 684090 - RNA, 22 nt, Human
uacagcuucagugugccccagu

SEQ ID NO: 684091 - RNA, 22 nt, Human
auaugcaagcacauagaauacu

SEQ ID NO: 684092 - RNA, 22 nt, Human
guaagaggagugggaagccuca

SEQ ID NO: 684093 - RNA, 22 nt, Human
ucagaggccuaugucuacaacu

SEQ ID NO: 684094 - RNA, 22 nt, Human
agaaaugcaguuucaagacaaa

SEQ ID NO: 684095 - RNA, 22 nt, Human
cccucugccugcgcccuggugu

SEQ ID NO: 684096 - RNA, 22 nt, Human
ucuaccacuaagugugcuuuga

SEQ ID NO: 684097 - RNA, 22 nt, Human
ggagcagagcugggcuuggcug

SEQ ID NO: 684098 - RNA, 22 nt, Human
ucacagcacauggaccgagucc

SEQ ID NO: 684099 - RNA, 22 nt, Human
ugcaugguaaccaggaugucua

SEQ ID NO: 684100 - RNA, 22 nt, Human
uucuggaauacuaaguuccuuu

SEQ ID NO: 684101 - RNA, 17 nt, Human
ucccaggaacagggaau

SEQ ID NO: 684102 - RNA, 22 nt, Human
ugaggcagcaauugauuauuca

SEQ ID NO: 684103 - RNA, 22 nt, Human
caaggcugucuccagcuuccaa

SEQ ID NO: 684104 - RNA, 22 nt, Human
acagugacguuuauuugagacg

SEQ ID NO: 684105 - RNA, 22 nt, Human
ugcuggggguagcucugcguag

SEQ ID NO: 684106 - RNA, 18 nt, Human
acaggccucaguccugca

SEQ ID NO: 684107 - RNA, 22 nt, Human
uggcccugaggacccagugugg

SEQ ID NO: 684108 - RNA, 22 nt, Human
agggcuuugagaauaguggaac

SEQ ID NO: 684109 - RNA, 22 nt, Human
aaguucaagagugacauauuag

SEQ ID NO: 684110 - RNA, 22 nt, Human
ucucucugagcccugcuuuuuc

SEQ ID NO: 684111 - RNA, 22 nt, Human
uggcuucuugucuaauuuguua

SEQ ID NO: 684112 - RNA, 22 nt, Human
acauacuugaagcaagugauca

SEQ ID NO: 684113 - RNA, 17 nt, Human
ucuguucaugcauaccu

SEQ ID NO: 684114 - RNA, 22 nt, Human
uguauguauacacugaucauca

SEQ ID NO: 684115 - RNA, 22 nt, Human
ucugacagggccaaacaugaca

SEQ ID NO: 684116 - RNA, 22 nt, Human
uagcaaggcuuccaaugaacag

SEQ ID NO: 684117 - RNA, 22 nt, Human
gcucccuguucucagccaugau

SEQ ID NO: 684118 - RNA, 22 nt, Human
ccaggagcaacuugaaggcaag

SEQ ID NO: 684119 - RNA, 22 nt, Human
uuacuuuggcaaacuccugccc

SEQ ID NO: 684120 - RNA, 22 nt, Human
uauggcuuccaggcuggccagg

SEQ ID NO: 684121 - RNA, 22 nt, Human
caggaagccuuccuugucugcu

SEQ ID NO: 684122 - RNA, 22 nt, Human
guuacaauguucuucaguucug

SEQ ID NO: 684123 - RNA, 22 nt, Human
uacagcuuauccagcuugauag

SEQ ID NO: 684124 - RNA, 22 nt, Human
ccuuccagaggcgugacacccu

SEQ ID NO: 684125 - RNA, 22 nt, Human
auuuuuccaauuaggauaaaga

SEQ ID NO: 684126 - RNA, 22 nt, Human
cugggcugcaguuccugguccu

SEQ ID NO: 684127 - RNA, 22 nt, Human
uagagcugaguugacuccauuu

SEQ ID NO: 684128 - RNA, 22 nt, Human
ucucagagaucuuucugcaugu

SEQ ID NO: 684129 - RNA, 22 nt, Human
ccucaugguacuuacuguagcu

SEQ ID NO: 684130 - RNA, 22 nt, Human
uggaagacaguugaugggaguu

SEQ ID NO: 684131 - RNA, 22 nt, Human
ugcacaggccuugaagggagag

SEQ ID NO: 684132 - RNA, 20 nt, Human
ucacaucuggcagcugauga

SEQ ID NO: 684133 - RNA, 22 nt, Human
uaauguuuccagucuaugaugg

SEQ ID NO: 684134 - RNA, 22 nt, Human
gcaggagcugcucuccugacga

SEQ ID NO: 684135 - RNA, 22 nt, Human
cagagggcuucagguucaggau

SEQ ID NO: 684136 - RNA, 22 nt, Human
ugcaggagcugugcggugaggg

SEQ ID NO: 684137 - RNA, 22 nt, Human
uuaaagcaaccaucaauuugga

SEQ ID NO: 684138 - RNA, 22 nt, Human
uauguacauguuaaagggcaaa

SEQ ID NO: 684139 - RNA, 22 nt, Human
agcagggguggaagguagcuuu

SEQ ID NO: 684140 - RNA, 22 nt, Human
gagacacacauucuggagagaa

SEQ ID NO: 684141 - RNA, 22 nt, Human
ggaugcugcuaucaggcuucga

SEQ ID NO: 684142 - RNA, 23 nt, Human
agcugcaagacucccugucugag

SEQ ID NO: 684143 - RNA, 22 nt, Human
aguacaaagugcuccugguucu

SEQ ID NO: 684144 - RNA, 22 nt, Human
uccuggccucgcuguccaccuu

SEQ ID NO: 684145 - RNA, 22 nt, Human
gugccugguuuggggaauguuc

SEQ ID NO: 684146 - RNA, 22 nt, Human
uggcacagacagaucaggaguc

SEQ ID NO: 684147 - RNA, 21 nt, Human
acucccugcauaagugauuua

SEQ ID NO: 684148 - RNA, 22 nt, Human
uuacaacugaagcuaaugugcu

SEQ ID NO: 684149 - RNA, 22 nt, Human
gucugccuuuaucaucuccuua

SEQ ID NO: 684150 - RNA, 22 nt, Human
uaacagaauagcagaaacagaa

SEQ ID NO: 684151 - RNA, 22 nt, Human
agagucagucacuggcacuuug

SEQ ID NO: 684152 - RNA, 22 nt, Human
ucacaugcccuguauuuaccag

SEQ ID NO: 684153 - RNA, 22 nt, Human
auauauaucgaguucaugucuc

SEQ ID NO: 684154 - RNA, 19 nt, Human
cuucauucuucagcuuuug

SEQ ID NO: 684155 - RNA, 18 nt, Human
acauuucuaggugaaagc

SEQ ID NO: 684156 - RNA, 22 nt, Human
aaaagccaagguccucuucaga

SEQ ID NO: 684157 - RNA, 22 nt, Human
uauguacaugauuucauuugcu

SEQ ID NO: 684158 - RNA, 22 nt, Human
agugucuuacaugaauugauuu

SEQ ID NO: 684159 - RNA, 22 nt, Human
uacacccuucuccugagugugu

SEQ ID NO: 684160 - RNA, 22 nt, Human
uacauauucaacguucaguauu

SEQ ID NO: 684161 - RNA, 22 nt, Human
ucuguagagacgaauguguuau

SEQ ID NO: 684162 - RNA, 22 nt, Human
gcaggguaggugacagguaguc

SEQ ID NO: 684163 - RNA, 22 nt, Human
aaagguuuucaucacagcaaga

SEQ ID NO: 684164 - RNA, 22 nt, Human
agaguuuggugaagcaauuuga

SEQ ID NO: 684165 - RNA, 22 nt, Human
gcugaggccaguuuaaugagga

SEQ ID NO: 684166 - RNA, 22 nt, Human
ucaaggagcccacagucuaaug

SEQ ID NO: 684167 - RNA, 22 nt, Human
acuguacuuuucuuggcuagau

SEQ ID NO: 684168 - RNA, 22 nt, Human
uguagaaguaggagucaucuca

SEQ ID NO: 684169 - RNA, 22 nt, Human
aucagaagaaauggaugugacu

SEQ ID NO: 684170 - RNA, 22 nt, Human
ugcacagagcuggacuccgcgg

SEQ ID NO: 684171 - RNA, 22 nt, Human
ucuuggaacccuaugugauuuc

SEQ ID NO: 684172 - RNA, 22 nt, Human
gaggcuccgguaguagccuuga

SEQ ID NO: 684173 - RNA, 22 nt, Human
cccugugucuucuugccuuugu

SEQ ID NO: 684174 - RNA, 22 nt, Human
gaagcgcggcgucggcgugggu

SEQ ID NO: 684175 - RNA, 22 nt, Human
aauuuauauguaauuaggcaca

SEQ ID NO: 684176 - RNA, 21 nt, Human
ugcaggagucugugagucagg

SEQ ID NO: 684177 - RNA, 22 nt, Human
aucccucagccaccuuugagga

SEQ ID NO: 684178 - RNA, 22 nt, Human
gaguuauuggguggaaagguag

SEQ ID NO: 684179 - RNA, 22 nt, Human
ucaauucuagagccuuacauug

SEQ ID NO: 684180 - RNA, 22 nt, Human
uucucugccucacaggucuaag

SEQ ID NO: 684181 - RNA, 22 nt, Human
gagaacuucaggauuauucaag

SEQ ID NO: 684182 - RNA, 22 nt, Human
gggcuucuauucuggcacaaga

SEQ ID NO: 684183 - RNA, 22 nt, Human
gcuggauuggagcaauagaguc

SEQ ID NO: 684184 - RNA, 21 nt, Human
guagggacagagaguugguga

SEQ ID NO: 684185 - RNA, 22 nt, Human
gauacagaaaggcugcauugag

SEQ ID NO: 684186 - RNA, 22 nt, Human
cucuuuggucgcaucauccauu

SEQ ID NO: 684187 - RNA, 22 nt, Human
auucagcauuggcaccauggau

SEQ ID NO: 684188 - RNA, 22 nt, Human
uuccuugaaaguuugaacugac

SEQ ID NO: 684189 - RNA, 22 nt, Human
agagucaguaacauauauggua

SEQ ID NO: 684190 - RNA, 22 nt, Human
cucuguguuccggguugcugcu

SEQ ID NO: 684191 - RNA, 22 nt, Human
uucauucuuuuacaugugaaua

SEQ ID NO: 684192 - RNA, 22 nt, Human
cagcuggguggcucuucugcuc

SEQ ID NO: 684193 - RNA, 22 nt, Human
uggaaggcaacggagugagcug

SEQ ID NO: 684194 - RNA, 22 nt, Human
uggugaagucagcggagcccgg

SEQ ID NO: 684195 - RNA, 20 nt, Human
caggaugauuggacacgaug

SEQ ID NO: 684196 - RNA, 22 nt, Human
aaugugaaaccgcacagaauaa

SEQ ID NO: 684197 - RNA, 19 nt, Human
acaagggcaggcaagguga

SEQ ID NO: 684198 - RNA, 22 nt, Human
cagcaguucaauccagugcacg

SEQ ID NO: 684199 - RNA, 22 nt, Human
cagucugggacugagcuccacc

SEQ ID NO: 684200 - RNA, 22 nt, Human
ucugcguugcucacgcugggag

SEQ ID NO: 684201 - RNA, 22 nt, Human
cuccaaguauguuaaaaucuaa

SEQ ID NO: 684202 - RNA, 22 nt, Human
aggaaacuguccccucauccua

SEQ ID NO: 684203 - RNA, 22 nt, Human
ugcugcagggauuucagagaca

SEQ ID NO: 684204 - RNA, 22 nt, Human
ucugaguuuaggaccaggcuga

SEQ ID NO: 684205 - RNA, 22 nt, Human
uccccaggggccugggcacagu

SEQ ID NO: 684206 - RNA, 22 nt, Human
caggugagaggcgguccugcau

SEQ ID NO: 684207 - RNA, 22 nt, Human
cagggacauaagaggaacaugg

SEQ ID NO: 684208 - RNA, 22 nt, Human
gggcugacauauuuggugcucu

SEQ ID NO: 684209 - RNA, 22 nt, Human
aagaugguuucuguagguuuau

SEQ ID NO: 684210 - RNA, 22 nt, Human
ugcaacaaggccucauuucuug

SEQ ID NO: 684211 - RNA, 22 nt, Human
acccagggccacagcccgcagu

SEQ ID NO: 684212 - RNA, 23 nt, Human
aguucacugagguugaccacugg

SEQ ID NO: 684213 - RNA, 22 nt, Human
ucuuugaacuuggcugaucucu

SEQ ID NO: 684214 - RNA, 22 nt, Human
cagggcugugcccaucuucccc

SEQ ID NO: 684215 - RNA, 22 nt, Human
guguucugcagaccagcaucau

SEQ ID NO: 684216 - RNA, 22 nt, Human
guggugcaugcaugcauaugua

SEQ ID NO: 684217 - RNA, 22 nt, Human
uuacaaagagaaguuguagaau

SEQ ID NO: 684218 - RNA, 22 nt, Human
aaggaugcagggacccaaggcu

SEQ ID NO: 684219 - RNA, 22 nt, Human
ucucaguggaucucagaauuuu

SEQ ID NO: 684220 - RNA, 22 nt, Human
uacaguaguaucuucauuuguu

SEQ ID NO: 684221 - RNA, 22 nt, Human
uggugcagucauuggcccaggg

SEQ ID NO: 684222 - RNA, 22 nt, Human
ggaagccaugagggacaguucu

SEQ ID NO: 684223 - RNA, 22 nt, Human
cagauggcaacagcucugugac

SEQ ID NO: 684224 - RNA, 22 nt, Human
augaucucauucuuucaaaggg

SEQ ID NO: 684225 - RNA, 22 nt, Human
ccuggcucuucugugucagccc

SEQ ID NO: 684226 - RNA, 22 nt, Human
acagaaguggcuucaaagagca

SEQ ID NO: 684227 - RNA, 22 nt, Human
ggcucugcgcgguaaagugacu

SEQ ID NO: 684228 - RNA, 22 nt, Human
gggcagguggagggcccagcca

SEQ ID NO: 684229 - RNA, 23 nt, Human
aucccuucuccaguguggugagg

SEQ ID NO: 684230 - RNA, 22 nt, Human
cucaggcacgggucagugagcg

SEQ ID NO: 684231 - RNA, 22 nt, Human
uuauucugccaggagcgucagu

SEQ ID NO: 684232 - RNA, 22 nt, Human
ugcuuaauccaaccuggcugac

SEQ ID NO: 684233 - RNA, 22 nt, Human
gaacuggguccuugagucuaga

SEQ ID NO: 684234 - RNA, 22 nt, Human
cuaggcagggugcugugccaug

SEQ ID NO: 684235 - RNA, 22 nt, Human
uaaugcucacccugcaucaggc

SEQ ID NO: 684236 - RNA, 22 nt, Human
agggggcuggagacaccuccuc

SEQ ID NO: 684237 - RNA, 22 nt, Human
caguccagaguaccccaagaag

SEQ ID NO: 684238 - RNA, 21 nt, Human
uauuuaguuuuacaaaugugg

SEQ ID NO: 684239 - RNA, 22 nt, Human
uucuauguguugacaagccuga

SEQ ID NO: 684240 - RNA, 22 nt, Human
gaccugagauuuugaggcucau

SEQ ID NO: 684241 - RNA, 22 nt, Human
ggcugagaaggagugggugagg

SEQ ID NO: 684242 - RNA, 22 nt, Human
uagaaacucaggauacucuucc

SEQ ID NO: 684243 - RNA, 22 nt, Human
ucauugaaaacucagcaucuac

SEQ ID NO: 684244 - RNA, 23 nt, Human
cugaaauaccagaaaaucagugu

SEQ ID NO: 684245 - RNA, 22 nt, Human
guggcugcagcggcuguggaga

SEQ ID NO: 684246 - RNA, 22 nt, Human
caggcuugggagcagagccacu

SEQ ID NO: 684247 - RNA, 22 nt, Human
uucuggaaaagaaaguuaagau

SEQ ID NO: 684248 - RNA, 22 nt, Human
gccucucucuacccaguaugau

SEQ ID NO: 684249 - RNA, 22 nt, Human
cuugugaaaugccagauaaucu

SEQ ID NO: 684250 - RNA, 22 nt, Human
ccugaagaauucaaauccagau

SEQ ID NO: 684251 - RNA, 22 nt, Human
ggcuggguucugagaaagagua

SEQ ID NO: 684252 - RNA, 22 nt, Human
cugaugcuauaagccacagugg

SEQ ID NO: 684253 - RNA, 22 nt, Human
aguccugggucuggagaaugga

SEQ ID NO: 684254 - RNA, 22 nt, Human
aauaugcauuaacuguguacau

SEQ ID NO: 684255 - RNA, 22 nt, Human
gucuuauuagguuaacccugcu

SEQ ID NO: 684256 - RNA, 22 nt, Human
agugaggcuaauaggcaauggu

SEQ ID NO: 684257 - RNA, 22 nt, Human
gcuuccuguaggcagguccaag

SEQ ID NO: 684258 - RNA, 22 nt, Human
cagcuacagaggccacauggcu

SEQ ID NO: 684259 - RNA, 22 nt, Human
uuuccaauaaggucaccuuccu

SEQ ID NO: 684260 - RNA, 22 nt, Human
gacccagccugguuuuuauagg

SEQ ID NO: 684261 - RNA, 22 nt, Human
cugaugcucuggauguagucaa

SEQ ID NO: 684262 - RNA, 22 nt, Human
agugaguuuagggugcaggugu

SEQ ID NO: 684263 - RNA, 22 nt, Human
uagaaaguagccacuuacagag

SEQ ID NO: 684264 - RNA, 22 nt, Human
augcagaugguggauggagaaa

SEQ ID NO: 684265 - RNA, 22 nt, Human
acucugcuugggccauaucugg

SEQ ID NO: 684266 - RNA, 22 nt, Human
aauauuucuguagcuauguucu

SEQ ID NO: 684267 - RNA, 19 nt, Human
uucacauuuuuguggcacu

SEQ ID NO: 684268 - RNA, 22 nt, Human
uggugggcacagugcccaggcu

SEQ ID NO: 684269 - RNA, 22 nt, Human
gcuggugguaaggaggaaaaag

SEQ ID NO: 684270 - RNA, 22 nt, Human
gaagggugugauuugccugaga

SEQ ID NO: 684271 - RNA, 22 nt, Human
uagugcauaccuaacauuuuug

SEQ ID NO: 684272 - RNA, 22 nt, Human
agcugggagcagagccacagcc

SEQ ID NO: 684273 - RNA, 22 nt, Human
aagcagcaacaaacuggauaaa

SEQ ID NO: 684274 - RNA, 22 nt, Human
uguacaaagguacuuugauguu

SEQ ID NO: 684275 - RNA, 22 nt, Human
gcuuuagaaauguaggagauac

SEQ ID NO: 684276 - RNA, 22 nt, Human
uacauguacaugcauagguaga

SEQ ID NO: 684277 - RNA, 22 nt, Human
auuguggugucaguuauaggca

SEQ ID NO: 684278 - RNA, 22 nt, Human
agcagccaguucucugugguag

SEQ ID NO: 684279 - RNA, 22 nt, Human
acaggacagucuaguaacagua

SEQ ID NO: 684280 - RNA, 22 nt, Human
gucuggaaauucaauuuaaugc

SEQ ID NO: 684281 - RNA, 22 nt, Human
cuugaaucuucugaguauuugc

SEQ ID NO: 684282 - RNA, 22 nt, Human
ccugagagggggcccuagaaau

SEQ ID NO: 684283 - RNA, 22 nt, Human
uaacuuugagaacuuucuggug

SEQ ID NO: 684284 - RNA, 22 nt, Human
aacacugauggaaaguauguuu

SEQ ID NO: 684285 - RNA, 22 nt, Human
cugugccaggcccgggugggug

SEQ ID NO: 684286 - RNA, 23 nt, Human
cagcccugaaaucgaggugacac

SEQ ID NO: 684287 - RNA, 22 nt, Human
ucccccacucuaaaggagccuu

SEQ ID NO: 684288 - RNA, 22 nt, Human
uaucaaaguuguccugugaagu

SEQ ID NO: 684289 - RNA, 22 nt, Human
gggaggucagggugccugcugg

SEQ ID NO: 684290 - RNA, 22 nt, Human
uaaaugauuuauguaugugaaa

SEQ ID NO: 684291 - RNA, 20 nt, Human
cuaggcagcgagugacugag

SEQ ID NO: 684292 - RNA, 22 nt, Human
gggacacagguaucucaaauga

SEQ ID NO: 684293 - RNA, 22 nt, Human
caccacuggaggucuuggcuuu

SEQ ID NO: 684294 - RNA, 22 nt, Human
uggaauaacucaccaaggucau

SEQ ID NO: 684295 - RNA, 22 nt, Human
aaaaccacaauuacuuuugcac

SEQ ID NO: 684296 - RNA, 22 nt, Human
auaauuuaaauuaguaugugau

SEQ ID NO: 684297 - RNA, 22 nt, Human
aaaaguguccagauuaugaaga

SEQ ID NO: 684298 - RNA, 22 nt, Human
aaagccaggguccaggccugcc

SEQ ID NO: 684299 - RNA, 22 nt, Human
augcugggaagacaagguggag

SEQ ID NO: 684300 - RNA, 19 nt, Human
ucucaauguucagaaagcu

SEQ ID NO: 684301 - RNA, 22 nt, Human
caagggccuccaccuugcucgu

SEQ ID NO: 684302 - RNA, 22 nt, Human
uagcuggucuuuaagcauguaa

SEQ ID NO: 684303 - RNA, 22 nt, Human
guauuuccucgcuugugggauu

SEQ ID NO: 684304 - RNA, 22 nt, Human
uucagagagaccaaguggcgug

SEQ ID NO: 684305 - RNA, 19 nt, Human
uggaaaauggauugaauca

SEQ ID NO: 684306 - RNA, 22 nt, Human
gaagcugcguguagccauacuu

SEQ ID NO: 684307 - RNA, 22 nt, Human
gaauggaaacugggagauggcc

SEQ ID NO: 684308 - RNA, 22 nt, Human
cagggccuuguucaggagugaa

SEQ ID NO: 684309 - RNA, 22 nt, Human
auugcuguggaaauauaagaug

SEQ ID NO: 684310 - RNA, 22 nt, Human
uggaaggagcuaaggaccuggg

SEQ ID NO: 684311 - RNA, 22 nt, Human
cugggcugagcuguggaaacuc

SEQ ID NO: 684312 - RNA, 21 nt, Human
ugucagaaauaagcaugugau

SEQ ID NO: 684313 - RNA, 22 nt, Human
ccacugauucugccaggucucu

SEQ ID NO: 684314 - RNA, 21 nt, Human
uggcggggacuuguggcugcc

SEQ ID NO: 684315 - RNA, 22 nt, Human
aggccucugagcagcacucaug

SEQ ID NO: 684316 - RNA, 22 nt, Human
gggcaggugccagcucccuguc

SEQ ID NO: 684317 - RNA, 22 nt, Human
uuuagaaugugacuguauuuga

SEQ ID NO: 684318 - RNA, 22 nt, Human
uucauugauuuaacaaacaagu

SEQ ID NO: 684319 - RNA, 22 nt, Human
uaggccaacguggaagggucca

SEQ ID NO: 684320 - RNA, 22 nt, Human
acaaaauuuuuagacaaggcuu

SEQ ID NO: 684321 - RNA, 22 nt, Human
cuagagaaaaagcuuagguacg

SEQ ID NO: 684322 - RNA, 22 nt, Human
gcuggccucuacaggccggcca

SEQ ID NO: 684323 - RNA, 22 nt, Human
gugcuaggauuacaggcauggg

SEQ ID NO: 684324 - RNA, 22 nt, Human
cagaccccgaguuugcagaguu

SEQ ID NO: 684325 - RNA, 22 nt, Human
agagcaaauagagaagccagcu

SEQ ID NO: 684326 - RNA, 21 nt, Human
ucauuugugaucugauuucca

SEQ ID NO: 684327 - RNA, 22 nt, Human
gcuguucuuugcaucucuggug

SEQ ID NO: 684328 - RNA, 22 nt, Human
ugggagcaggcugaugauaggu

SEQ ID NO: 684329 - RNA, 23 nt, Human
uccaggcaugagcucuggaugga

SEQ ID NO: 684330 - RNA, 22 nt, Human
uggcacagcccagagcucuuga

SEQ ID NO: 684331 - RNA, 22 nt, Human
gccuggaaucaugcagggguua

SEQ ID NO: 684332 - RNA, 22 nt, Human
cugcugugccucuuuucacgug

SEQ ID NO: 684333 - RNA, 22 nt, Human
uuucucaaccucaacacuauuu

SEQ ID NO: 684334 - RNA, 23 nt, Human
gcagaaauucucacacugaggcc

SEQ ID NO: 684335 - RNA, 22 nt, Human
gaggcagccagagguucucauu

SEQ ID NO: 684336 - RNA, 22 nt, Human
cagcuucccagcucacucauaa

SEQ ID NO: 684337 - RNA, 22 nt, Human
cucaguccagggaccggccucc

SEQ ID NO: 684338 - RNA, 22 nt, Human
ugaacuuuguaguaauggagau

SEQ ID NO: 684339 - RNA, 22 nt, Human
cuccugagaauuuucaguugga

SEQ ID NO: 684340 - RNA, 22 nt, Human
uccuggcucggcuuggggacuu

SEQ ID NO: 684341 - RNA, 22 nt, Human
acugagagaacgggcugcuccc

SEQ ID NO: 684342 - RNA, 22 nt, Human
agcacaaugugaaaagagcucu

SEQ ID NO: 684343 - RNA, 22 nt, Human
aggcagccugguuugaauggaa

SEQ ID NO: 684344 - RNA, 22 nt, Human
aagggacccuggaucaaaugga

SEQ ID NO: 684345 - RNA, 22 nt, Human
uuggucccucauggacacauga

SEQ ID NO: 684346 - RNA, 21 nt, Human
aaucauacaaaacaugucagg

SEQ ID NO: 684347 - RNA, 22 nt, Human
auaaagcauacuuuguaugacu

SEQ ID NO: 684348 - RNA, 22 nt, Human
acaaggcugugggagaaccucu

SEQ ID NO: 684349 - RNA, 22 nt, Human
uguugguaggauuugcuucagc

SEQ ID NO: 684350 - RNA, 22 nt, Human
augcuauguaacuggcagauag

SEQ ID NO: 684351 - RNA, 22 nt, Human
caggcaggagccagggauucca

SEQ ID NO: 684352 - RNA, 22 nt, Human
cugcaggaggauccugagagug

SEQ ID NO: 684353 - RNA, 22 nt, Human
auauuauaaguuauuucaaguu

SEQ ID NO: 684354 - RNA, 22 nt, Human
gagcacagcagggcucugggug

SEQ ID NO: 684355 - RNA, 22 nt, Human
cagggccugcuuccuucuuguu

SEQ ID NO: 684356 - RNA, 22 nt, Human
uagcuguuacccauaaaagcca

SEQ ID NO: 684357 - RNA, 22 nt, Human
uggaaccuaaaaaugucauugc

SEQ ID NO: 684358 - RNA, 22 nt, Human
ggauaaagucuuuagguggaca

SEQ ID NO: 684359 - RNA, 22 nt, Human
ccauagugaauugucucagacg

SEQ ID NO: 684360 - RNA, 22 nt, Human
ccucccugucuaccuguugugg

SEQ ID NO: 684361 - RNA, 19 nt, Human
auguacccagugucaaucc

SEQ ID NO: 684362 - RNA, 22 nt, Human
agucccaguucgguucuuccuc

SEQ ID NO: 684363 - RNA, 22 nt, Human
ugcuucuggaguaacaggguga

SEQ ID NO: 684364 - RNA, 22 nt, Human
gcuccagaugaaugcacuuguu

SEQ ID NO: 684365 - RNA, 20 nt, Human
uaugaaguguucuucuggua

SEQ ID NO: 684366 - RNA, 22 nt, Human
cugcccaucgucauuuaauaaa

SEQ ID NO: 684367 - RNA, 21 nt, Human
gcucuguuauuuucuaugcag

SEQ ID NO: 684368 - RNA, 23 nt, Human
ucccuggaggcagguccagggcc

SEQ ID NO: 684369 - RNA, 22 nt, Human
ugagagugaaaugucacauguc

SEQ ID NO: 684370 - RNA, 22 nt, Human
aguguuuacauauaaggcccuu

SEQ ID NO: 684371 - RNA, 22 nt, Human
auucaacuguaaacuuguucac

SEQ ID NO: 684372 - RNA, 22 nt, Human
ccucuaggauguggcuggagga

SEQ ID NO: 684373 - RNA, 22 nt, Human
agcauaaguugguacagccacu

SEQ ID NO: 684374 - RNA, 22 nt, Human
ugugcccaacgugcagguuugu

SEQ ID NO: 684375 - RNA, 22 nt, Human
caucacauuuaaggggaaggac

SEQ ID NO: 684376 - RNA, 22 nt, Human
gagucccaggauaugugcuguu

SEQ ID NO: 684377 - RNA, 22 nt, Human
ucagcauaucuugagcuucaug

SEQ ID NO: 684378 - RNA, 22 nt, Human
cagccaggccuggugaccaaag

SEQ ID NO: 684379 - RNA, 22 nt, Human
gcuggcuugauaguuucugcuu

SEQ ID NO: 684380 - RNA, 22 nt, Human
uccuggggcucaugggauuugu

SEQ ID NO: 684381 - RNA, 22 nt, Human
cagcugugagcagccaguugcc

SEQ ID NO: 684382 - RNA, 22 nt, Human
ugcauuuauggaguuaccucau

SEQ ID NO: 684383 - RNA, 16 nt, Human
ggguggucuuggagac

SEQ ID NO: 684384 - RNA, 22 nt, Human
aggaaauguaguccucaucucc

SEQ ID NO: 684385 - RNA, 22 nt, Human
auaaaagaaguuuugguacuug

SEQ ID NO: 684386 - RNA, 22 nt, Human
acugcaauuauuuguucaccaa

SEQ ID NO: 684387 - RNA, 22 nt, Human
uuuaucugaggaaagcagacaa

SEQ ID NO: 684388 - RNA, 20 nt, Human
gaaggaagggggcaagguga

SEQ ID NO: 684389 - RNA, 22 nt, Human
gucauagguucaaaaggcagau

SEQ ID NO: 684390 - RNA, 22 nt, Human
gggggcugaggcuguucugagg

SEQ ID NO: 684391 - RNA, 17 nt, Human
gcacagugauauuauuu

SEQ ID NO: 684392 - RNA, 20 nt, Human
cacauuaaggaaaacaacug

SEQ ID NO: 684393 - RNA, 22 nt, Human
cacuaaauguuucaauguggga

SEQ ID NO: 684394 - RNA, 22 nt, Human
uugugggcuugccuggcucuug

SEQ ID NO: 684395 - RNA, 22 nt, Human
ucaaaaauuuucugaggaugag

SEQ ID NO: 684396 - RNA, 22 nt, Human
aggcugugaguuuugucucaga

SEQ ID NO: 684397 - RNA, 22 nt, Human
acuuggcuuuaguaguaacuga

SEQ ID NO: 684398 - RNA, 22 nt, Human
gaaguggaagccaucggcaguc

SEQ ID NO: 684399 - RNA, 22 nt, Human
gagcccagggcaggcaaggcag

SEQ ID NO: 684400 - RNA, 22 nt, Human
ucugccuuccccauaaucugau

SEQ ID NO: 684401 - RNA, 20 nt, Human
aaagcauuuacuugugauug

SEQ ID NO: 684402 - RNA, 20 nt, Human
uccugccacaccucaguugc

SEQ ID NO: 684403 - RNA, 22 nt, Human
aagagcaguguuuuacucagcu

SEQ ID NO: 684404 - RNA, 22 nt, Human
guggacacaggagagagaacug

SEQ ID NO: 684405 - RNA, 22 nt, Human
gcuucucuucgccuagguccuu

SEQ ID NO: 684406 - RNA, 22 nt, Human
uugcaucagaaaauaugggaag

SEQ ID NO: 684407 - RNA, 22 nt, Human
cagggccagccauccugcuggg

SEQ ID NO: 684408 - RNA, 22 nt, Human
cccaggcugauguucagcgggu

SEQ ID NO: 684409 - RNA, 22 nt, Human
ggcagcugcaaaucugcucugu

SEQ ID NO: 684410 - RNA, 22 nt, Human
aagcaacucccuccucauuuuu

SEQ ID NO: 684411 - RNA, 22 nt, Human
uauggcuuuuaaggagaucuga

SEQ ID NO: 684412 - RNA, 22 nt, Human
ccagcccaugcccuuauagcau

SEQ ID NO: 684413 - RNA, 22 nt, Human
cuggggugucucgucugccauu

SEQ ID NO: 684414 - RNA, 22 nt, Human
aaagucaagguuuagacuagag

SEQ ID NO: 684415 - RNA, 22 nt, Human
gccuagggugcucagggacgag

SEQ ID NO: 684416 - RNA, 22 nt, Human
ugugucugaacaugcuuuguaa

SEQ ID NO: 684417 - RNA, 18 nt, Human
cgugaguggaggcugcgg

SEQ ID NO: 684418 - RNA, 22 nt, Human
uacagauacagaucuagauaca

SEQ ID NO: 684419 - RNA, 22 nt, Human
guuguacagcauccagugcaga

SEQ ID NO: 684420 - RNA, 22 nt, Human
ugcagcuggaacuuagaggaga

SEQ ID NO: 684421 - RNA, 22 nt, Human
ugucccucugaggcuucccugg

SEQ ID NO: 684422 - RNA, 22 nt, Human
aggagccaaauuuuagacucug

SEQ ID NO: 684423 - RNA, 22 nt, Human
aggcagcaugcucugcuucuac

SEQ ID NO: 684424 - RNA, 22 nt, Human
agagaaauucucaguggaagau

SEQ ID NO: 684425 - RNA, 22 nt, Human
ccagcugucugguuccagagcc

SEQ ID NO: 684426 - RNA, 22 nt, Human
gaauacaugauacaugaacugc

SEQ ID NO: 684427 - RNA, 22 nt, Human
uauaaguaguuguugaagacuu

SEQ ID NO: 684428 - RNA, 22 nt, Human
gcagcacaaaguccccagggac

SEQ ID NO: 684429 - RNA, 22 nt, Human
cauguguaaggcucacaggcag

SEQ ID NO: 684430 - RNA, 19 nt, Human
ugucacugucauggcccag

SEQ ID NO: 684431 - RNA, 18 nt, Human
uaagaagguggcuccagc

SEQ ID NO: 684432 - RNA, 22 nt, Human
uuccacucuacucuggccaguc

SEQ ID NO: 684433 - RNA, 22 nt, Human
uggaggccagagguacugggac

SEQ ID NO: 684434 - RNA, 22 nt, Human
gaaggacccucuggggucucag

SEQ ID NO: 684435 - RNA, 22 nt, Human
gccucacugcagccccaggaag

SEQ ID NO: 684436 - RNA, 22 nt, Human
cuguggcucugcagucccaaca

SEQ ID NO: 684437 - RNA, 22 nt, Human
agagcacugagugagcaaggcc

SEQ ID NO: 684438 - RNA, 22 nt, Human
uuguuuuaacgacucagcuugu

SEQ ID NO: 684439 - RNA, 22 nt, Human
gagcaguaggagaacccugagc

SEQ ID NO: 684440 - RNA, 22 nt, Human
aauuuucacagugcugugagau

SEQ ID NO: 684441 - RNA, 22 nt, Human
aacaucugggcccugauuuugg

SEQ ID NO: 684442 - RNA, 21 nt, Human
guuauugaccuccaggcuggc

SEQ ID NO: 684443 - RNA, 22 nt, Human
ccaguguucugguguucauuuc

SEQ ID NO: 684444 - RNA, 22 nt, Human
auccagugagugcagcuguugu

SEQ ID NO: 684445 - RNA, 21 nt, Human
agcaacucugacuagaugagg

SEQ ID NO: 684446 - RNA, 22 nt, Human
cagcacagcuggcucuggaagc

SEQ ID NO: 684447 - RNA, 22 nt, Human
aagcugugaagagcaagugagg

SEQ ID NO: 684448 - RNA, 22 nt, Human
agaaauguuuauggcugccuau

SEQ ID NO: 684449 - RNA, 20 nt, Human
caggugagcagaucugggug

SEQ ID NO: 684450 - RNA, 22 nt, Human
cugucuguucagauucauuacu

SEQ ID NO: 684451 - RNA, 22 nt, Human
cugucuuuuacuaucauuuacu

SEQ ID NO: 684452 - RNA, 22 nt, Human
cuguuuauggagguaaggcauc

SEQ ID NO: 684453 - RNA, 22 nt, Human
aggaauucaagaccagcugggc

SEQ ID NO: 684454 - RNA, 22 nt, Human
acacaaugcauauuuuuccaga

SEQ ID NO: 684455 - RNA, 22 nt, Human
gaagguuuacugaagauuuaaa

SEQ ID NO: 684456 - RNA, 22 nt, Human
uauuugucaccuauggcugucc

SEQ ID NO: 684457 - RNA, 22 nt, Human
gagcacccuaccugccacugag

SEQ ID NO: 684458 - RNA, 22 nt, Human
aggggacauuuagcaaugacua

SEQ ID NO: 684459 - RNA, 22 nt, Human
aagcgccacgagaagcuggacc

SEQ ID NO: 684460 - RNA, 22 nt, Human
gguagcaagcgcuugcccugcg

SEQ ID NO: 684461 - RNA, 19 nt, Human
uaauauacagacccaucug

SEQ ID NO: 684462 - RNA, 22 nt, Human
caacacugacaauggacugauu

SEQ ID NO: 684463 - RNA, 22 nt, Human
uggggugaggcagccacauuua

SEQ ID NO: 684464 - RNA, 22 nt, Human
gaacaucuuauccauuuccucu

SEQ ID NO: 684465 - RNA, 22 nt, Human
uaaggcauuagagugaaagcaa

SEQ ID NO: 684466 - RNA, 22 nt, Human
augucagaaucuacauucuacu

SEQ ID NO: 684467 - RNA, 22 nt, Human
gguaaaaaucacaaauacuuua

SEQ ID NO: 684468 - RNA, 22 nt, Human
uugugaauagugccgcaauaaa

SEQ ID NO: 684469 - RNA, 22 nt, Human
ggguuccuccaguuccuagagc

SEQ ID NO: 684470 - RNA, 22 nt, Human
aacuguggacuugagacugaug

SEQ ID NO: 684471 - RNA, 22 nt, Human
gucauauacacugcauguaauc

SEQ ID NO: 684472 - RNA, 22 nt, Human
ggucaaagggugagauggcagg

SEQ ID NO: 684473 - RNA, 22 nt, Human
cuagucacuguaauaaucugcu

SEQ ID NO: 684474 - RNA, 22 nt, Human
acaaugucaccucucauguuuu

SEQ ID NO: 684475 - RNA, 22 nt, Human
uaagaguaucuauuaaguacuu

SEQ ID NO: 684476 - RNA, 22 nt, Human
aaaggcuuugagaaguccugca

SEQ ID NO: 684477 - RNA, 22 nt, Human
ccugaguggugcuaagcagaua

SEQ ID NO: 684478 - RNA, 23 nt, Human
agacaaaagccucagucuuaggc

SEQ ID NO: 684479 - RNA, 18 nt, Human
uacaaacuccuugaaggc

SEQ ID NO: 684480 - RNA, 22 nt, Human
auguuauuucaaaauucccuug

SEQ ID NO: 684481 - RNA, 22 nt, Human
gcugggcagugagugaguccuu

SEQ ID NO: 684482 - RNA, 22 nt, Human
augugaaacugaagcauccaua

SEQ ID NO: 684483 - RNA, 22 nt, Human
cugggcagagcuaacaccugag

SEQ ID NO: 684484 - RNA, 22 nt, Human
ucuucaugaccucuguguuuua

SEQ ID NO: 684485 - RNA, 22 nt, Human
ggcaggcaaggcagccugguga

SEQ ID NO: 684486 - RNA, 22 nt, Human
uuauuuugagagaaugugugcu

SEQ ID NO: 684487 - RNA, 22 nt, Human
aacucaaagaugcaugacgcuu

SEQ ID NO: 684488 - RNA, 22 nt, Human
agcagagcccuuccauggccuu

SEQ ID NO: 684489 - RNA, 22 nt, Human
gcucaggccucacuccauuugg

SEQ ID NO: 684490 - RNA, 22 nt, Human
auaaguuugucuuuguaaagau

SEQ ID NO: 684491 - RNA, 21 nt, Human
cagcccagagcaguggggcca

SEQ ID NO: 684492 - RNA, 22 nt, Human
auaagaggaauuacagaagagg

SEQ ID NO: 684493 - RNA, 21 nt, Human
aggagcugugugcuuccuuuc

SEQ ID NO: 684494 - RNA, 22 nt, Human
auguucauuugacaaguaguga

SEQ ID NO: 684495 - RNA, 22 nt, Human
agcagggcuggauuuggcaaga

SEQ ID NO: 684496 - RNA, 22 nt, Human
auucaagauuaauucuauguca

SEQ ID NO: 684497 - RNA, 22 nt, Human
aaauaauuauagcgagucuauc

SEQ ID NO: 684498 - RNA, 22 nt, Human
guuuuucuuugugugaagacaa

SEQ ID NO: 684499 - RNA, 22 nt, Human
gacagagugcagggcuagaaga

SEQ ID NO: 684500 - RNA, 22 nt, Human
uguggaaugggagugagaagac

SEQ ID NO: 684501 - RNA, 18 nt, Human
guuuggcauaacugaugc

SEQ ID NO: 684502 - RNA, 22 nt, Human
agucacugagauggugaggcua

SEQ ID NO: 684503 - RNA, 22 nt, Human
uggagcagcugaacagaguuga

SEQ ID NO: 684504 - RNA, 22 nt, Human
aagagcaacuuggaaacacuca

SEQ ID NO: 684505 - RNA, 22 nt, Human
ugccaggcuuuggucaaaggcu

SEQ ID NO: 684506 - RNA, 22 nt, Human
uuuccuggcucuguggccuugu

SEQ ID NO: 684507 - RNA, 22 nt, Human
uacaggcacugaaaugcuuauu

SEQ ID NO: 684508 - RNA, 22 nt, Human
gaaucucaguggaagcaggaag

SEQ ID NO: 684509 - RNA, 22 nt, Human
gucugccauguggagaaagcca

SEQ ID NO: 684510 - RNA, 22 nt, Human
gaaagcacuaaaagagaauccu

SEQ ID NO: 684511 - RNA, 22 nt, Human
uggcccugugugcaggcugcac

SEQ ID NO: 684512 - RNA, 23 nt, Human
ugagcaucacaggagaaccaggc

SEQ ID NO: 684513 - RNA, 19 nt, Human
aguuauugaucuauucagg

SEQ ID NO: 684514 - RNA, 22 nt, Human
aggcacugcagauuacaggcgc

SEQ ID NO: 684515 - RNA, 22 nt, Human
ucaaagcaucagucaauuuagg

SEQ ID NO: 684516 - RNA, 22 nt, Human
acagacauucagcuaagucuau

SEQ ID NO: 684517 - RNA, 22 nt, Human
gcacggcaagacggggccuccu

SEQ ID NO: 684518 - RNA, 22 nt, Human
cggcugugucuucacaggagcc

SEQ ID NO: 684519 - RNA, 22 nt, Human
uaaagugcagauugugauucag

SEQ ID NO: 684520 - RNA, 22 nt, Human
cgccgccugcugcagcagcugu

SEQ ID NO: 684521 - RNA, 22 nt, Human
agcugccuguccuaggccauca

SEQ ID NO: 684522 - RNA, 19 nt, Human
agccuggagggcuggucac

SEQ ID NO: 684523 - RNA, 22 nt, Human
uuguuggugaauaggguggaau

SEQ ID NO: 684524 - RNA, 22 nt, Human
cuggccuuuagccccagugucu

SEQ ID NO: 684525 - RNA, 22 nt, Human
agcuacagucggaaggacagac

SEQ ID NO: 684526 - RNA, 22 nt, Human
ccacagaaaguugucuagagua

SEQ ID NO: 684527 - RNA, 22 nt, Human
gggguagggugauugugaagua

SEQ ID NO: 684528 - RNA, 22 nt, Human
ugcccagcacugugccagucac

SEQ ID NO: 684529 - RNA, 22 nt, Human
gcccucagcauccucagggcca

SEQ ID NO: 684530 - RNA, 22 nt, Human
cccaggagaugcacuccauugg

SEQ ID NO: 684531 - RNA, 22 nt, Human
uaauuuuaugacaguguauuuu

SEQ ID NO: 684532 - RNA, 22 nt, Human
uugggccacuuuaguuuccuua

SEQ ID NO: 684533 - RNA, 22 nt, Human
cuuauuagugucugucugaguu

SEQ ID NO: 684534 - RNA, 22 nt, Human
uuuaaccugucaauuugcaugc

SEQ ID NO: 684535 - RNA, 22 nt, Human
uggcucagcgcggccuggucuu

SEQ ID NO: 684536 - RNA, 21 nt, Human
uccuuccuugagguccuuucc

SEQ ID NO: 684537 - RNA, 23 nt, Human
uucaaagcuuaagcucuuuccac

SEQ ID NO: 684538 - RNA, 22 nt, Human
uuccaauccaaacuucaccuuu

SEQ ID NO: 684539 - RNA, 22 nt, Human
augaauauguacacaucuguca

SEQ ID NO: 684540 - RNA, 23 nt, Human
ggcagccucugacucugcuuugc

SEQ ID NO: 684541 - RNA, 22 nt, Human
gcuuccaguaaguugcugccau

SEQ ID NO: 684542 - RNA, 22 nt, Human
ugugcuucaucacuucucaguu

SEQ ID NO: 684543 - RNA, 20 nt, Human
uggcuuuaaguuuuuugcua

SEQ ID NO: 684544 - RNA, 22 nt, Human
acacaugaggaugaggggauca

SEQ ID NO: 684545 - RNA, 22 nt, Human
agagcugagaauguggcuuccu

SEQ ID NO: 684546 - RNA, 22 nt, Human
gacagcaaccucaugagaaacu

SEQ ID NO: 684547 - RNA, 22 nt, Human
uuacaggggacauuggggacau

SEQ ID NO: 684548 - RNA, 22 nt, Human
gaggcccaggucaagcagccac

SEQ ID NO: 684549 - RNA, 22 nt, Human
uuucucuccccaaguggaauug

SEQ ID NO: 684550 - RNA, 22 nt, Human
agcucuccacacauaggacuag

SEQ ID NO: 684551 - RNA, 22 nt, Human
aauaauuuugagagccuggaaa

SEQ ID NO: 684552 - RNA, 22 nt, Human
cagagucucugggaggcugggu

SEQ ID NO: 684553 - RNA, 21 nt, Human
ucugccagcugaagaggugga

SEQ ID NO: 684554 - RNA, 22 nt, Human
aucuuuagauuagaaacucuaa

SEQ ID NO: 684555 - RNA, 22 nt, Human
ugguccuuguaggcauuugagc

SEQ ID NO: 684556 - RNA, 22 nt, Human
cacagcuuguuuagugacucac

SEQ ID NO: 684557 - RNA, 22 nt, Human
agcaacuagccaggaugcagag

SEQ ID NO: 684558 - RNA, 22 nt, Human
ugccaggcugcccuccagucug

SEQ ID NO: 684559 - RNA, 22 nt, Human
agggccaggaucacagccaaga

SEQ ID NO: 684560 - RNA, 22 nt, Human
cacaugugugcugaggacugug

SEQ ID NO: 684561 - RNA, 22 nt, Human
aaguacagccagcacccagacu

SEQ ID NO: 684562 - RNA, 19 nt, Human
ccaccagugugaucuaaga

SEQ ID NO: 684563 - RNA, 22 nt, Human
aauguguuuauuuagugauuua

SEQ ID NO: 684564 - RNA, 19 nt, Human
uucccagagccaugaguga

SEQ ID NO: 684565 - RNA, 22 nt, Human
ggggauggugggaaggcaaucu

SEQ ID NO: 684566 - RNA, 22 nt, Human
uggugaucagucaacugucuuc

SEQ ID NO: 684567 - RNA, 22 nt, Human
uuacagcagugggaaggaguca

SEQ ID NO: 684568 - RNA, 22 nt, Human
augcauugucaggcaauuucau

SEQ ID NO: 684569 - RNA, 22 nt, Human
ugaugagguggauucaaagcag

SEQ ID NO: 684570 - RNA, 22 nt, Human
cucaucugcucuuauuaucuua

SEQ ID NO: 684571 - RNA, 22 nt, Human
uaaugaacaauauaucaauagc

SEQ ID NO: 684572 - RNA, 22 nt, Human
cucaucaccacauauaacaaag

SEQ ID NO: 684573 - RNA, 22 nt, Human
guggccaugugcuugcagggua

SEQ ID NO: 684574 - RNA, 20 nt, Human
gagcagcuguuugcauugca

SEQ ID NO: 684575 - RNA, 22 nt, Human
guggcccacuuacgucaugugu

SEQ ID NO: 684576 - RNA, 22 nt, Human
gacaggcaauuaccagcgccca

SEQ ID NO: 684577 - RNA, 22 nt, Human
gggcagguguuuccaaggugag

SEQ ID NO: 684578 - RNA, 22 nt, Human
gaagagcugucagaaaagcuaa

SEQ ID NO: 684579 - RNA, 22 nt, Human
agagguagaaaauaauggagag

SEQ ID NO: 684580 - RNA, 22 nt, Human
gccggggcuggggagagacaug

SEQ ID NO: 684581 - RNA, 22 nt, Human
caccagcugcaacaccaucucc

SEQ ID NO: 684582 - RNA, 20 nt, Human
augugagggguugaaguggg

SEQ ID NO: 684583 - RNA, 22 nt, Human
ucuuuagaguuaacaauaauga

SEQ ID NO: 684584 - RNA, 22 nt, Human
gagaggcagaggccugaaaccg

SEQ ID NO: 684585 - RNA, 21 nt, Human
ugcaggcugugcgcuccugcc

SEQ ID NO: 684586 - RNA, 22 nt, Human
aagauacaccaagagccuagua

SEQ ID NO: 684587 - RNA, 22 nt, Human
ugcuuaaacauacuauuuauau

SEQ ID NO: 684588 - RNA, 22 nt, Human
gaggucugggauggggccugaa

SEQ ID NO: 684589 - RNA, 22 nt, Human
aaauuaagggugagaagaguug

SEQ ID NO: 684590 - RNA, 16 nt, Human
gggggugagagagagu

SEQ ID NO: 684591 - RNA, 22 nt, Human
caggccugucugcacaugaggc

SEQ ID NO: 684592 - RNA, 22 nt, Human
ugagccaggcuccaugccaccu

SEQ ID NO: 684593 - RNA, 23 nt, Human
aauagcugguaaugauagcacaa

SEQ ID NO: 684594 - RNA, 20 nt, Human
gcaaggcacagugaggaggg

SEQ ID NO: 684595 - RNA, 22 nt, Human
aaaggcuccuucucccaugacc

SEQ ID NO: 684596 - RNA, 22 nt, Human
ugaagcagcaaaugaugggaga

SEQ ID NO: 684597 - RNA, 22 nt, Human
ggaggggagguccagcugaucu

SEQ ID NO: 684598 - RNA, 22 nt, Human
acaguacaagcaaugcauuuuu

SEQ ID NO: 684599 - RNA, 22 nt, Human
uaagacuuaggucgaguuuggc

SEQ ID NO: 684600 - RNA, 22 nt, Human
uccuggaguggagucuguuguu

SEQ ID NO: 684601 - RNA, 22 nt, Human
ccuugguuuccaggaugaggcu

SEQ ID NO: 684602 - RNA, 22 nt, Human
caggguggggcuggcuaucaaa

SEQ ID NO: 684603 - RNA, 22 nt, Human
aagggcugggucugguuaaccc

SEQ ID NO: 684604 - RNA, 22 nt, Human
cauugucauucuaugcuauuca

SEQ ID NO: 684605 - RNA, 22 nt, Human
ucccaggacuuccaguuggagg

SEQ ID NO: 684606 - RNA, 22 nt, Human
ccagcaggagacuagcaacaua

SEQ ID NO: 684607 - RNA, 22 nt, Human
ccugccagggccuuggaagaaa

SEQ ID NO: 684608 - RNA, 22 nt, Human
agugcuggagggaggcagguuc

SEQ ID NO: 684609 - RNA, 20 nt, Human
aggcuccuccaggaugugug

SEQ ID NO: 684610 - RNA, 19 nt, Human
uggggccuccugucccugg

SEQ ID NO: 684611 - RNA, 22 nt, Human
augucuggaggucaucugguua

SEQ ID NO: 684612 - RNA, 22 nt, Human
aaacaauguugucuccaagagg

SEQ ID NO: 684613 - RNA, 22 nt, Human
gcccacucuggagccuguuccc

SEQ ID NO: 684614 - RNA, 22 nt, Human
gagggugguggcuuaaggugcu

SEQ ID NO: 684615 - RNA, 22 nt, Human
cagcacaugcucaucagggaag

SEQ ID NO: 684616 - RNA, 22 nt, Human
uggagucugugaugcucugggu

SEQ ID NO: 684617 - RNA, 22 nt, Human
auuuuagcaaaugcaagaugga

SEQ ID NO: 684618 - RNA, 22 nt, Human
cagggcuuuccugagaagugau

SEQ ID NO: 684619 - RNA, 22 nt, Human
guggcaggagugggccuugaag

SEQ ID NO: 684620 - RNA, 21 nt, Human
aggucagcccagcucuggaag

SEQ ID NO: 684621 - RNA, 22 nt, Human
accauacauuaaaugacuuuca

SEQ ID NO: 684622 - RNA, 22 nt, Human
uuggcuucccagagcuuacgcu

SEQ ID NO: 684623 - RNA, 22 nt, Human
uuucuagaucaaacuuuuauau

SEQ ID NO: 684624 - RNA, 22 nt, Human
agcagugugcuucguuucauga

SEQ ID NO: 684625 - RNA, 22 nt, Human
uuccugagcaccagacacugca

SEQ ID NO: 684626 - RNA, 22 nt, Human
ggcuguggacacugagcucaga

SEQ ID NO: 684627 - RNA, 22 nt, Human
aagacagcauugcugagggcuu

SEQ ID NO: 684628 - RNA, 22 nt, Human
cagagccaucccagccuguggu

SEQ ID NO: 684629 - RNA, 22 nt, Human
aaaaggcuaauccagagcaacu

SEQ ID NO: 684630 - RNA, 22 nt, Human
ugugcuuacuuugaauuauaua

SEQ ID NO: 684631 - RNA, 22 nt, Human
ugguuccaguuuucaauagagc

SEQ ID NO: 684632 - RNA, 22 nt, Human
agcugguuagcaaucuaaguga

SEQ ID NO: 684633 - RNA, 21 nt, Human
agucuggggaagggaucccag

SEQ ID NO: 684634 - RNA, 17 nt, Human
ccagcugcucccucaga

SEQ ID NO: 684635 - RNA, 22 nt, Human
guggagccaggaucuccgcaca

SEQ ID NO: 684636 - RNA, 22 nt, Human
uuuacaaggcagaacugauuaa

SEQ ID NO: 684637 - RNA, 22 nt, Human
cauucacaaagcugauugaugg

SEQ ID NO: 684638 - RNA, 22 nt, Human
ggcugugcugagggggaagccc

SEQ ID NO: 684639 - RNA, 22 nt, Human
ggagccagcagggugacacuga

SEQ ID NO: 684640 - RNA, 22 nt, Human
cugcaggauucucccaguugga

SEQ ID NO: 684641 - RNA, 21 nt, Human
gauuucacuuaccuucauuua

SEQ ID NO: 684642 - RNA, 22 nt, Human
cuggcugugugucuucauucag

SEQ ID NO: 684643 - RNA, 17 nt, Human
cucacggaggaugaauc

SEQ ID NO: 684644 - RNA, 22 nt, Human
gcacccugucaaaauggaccaa

SEQ ID NO: 684645 - RNA, 22 nt, Human
uggcuucaucugcagcacugcc

SEQ ID NO: 684646 - RNA, 22 nt, Human
gaugcuggccuggccaucuggg

SEQ ID NO: 684647 - RNA, 22 nt, Human
cagugcuauaauccagugucgu

SEQ ID NO: 684648 - RNA, 22 nt, Human
cuuccugaaucuuccauguaua

SEQ ID NO: 684649 - RNA, 22 nt, Human
gaagcuguguugauggcaugga

SEQ ID NO: 684650 - RNA, 22 nt, Human
ucuucccuaaucaccaucuuca

SEQ ID NO: 684651 - RNA, 22 nt, Human
uccucuccaugucucacgccac

SEQ ID NO: 684652 - RNA, 22 nt, Human
augguuuguaacccaauacucc

SEQ ID NO: 684653 - RNA, 22 nt, Human
cacauacauucauguuacucua

SEQ ID NO: 684654 - RNA, 22 nt, Human
uugauacauuuuuaggauaaac

SEQ ID NO: 684655 - RNA, 22 nt, Human
cugagguggccucugccgggga

SEQ ID NO: 684656 - RNA, 23 nt, Human
ucucugaguuguacuuucccuug

SEQ ID NO: 684657 - RNA, 20 nt, Human
ucuguaggcaaguuagcagg

SEQ ID NO: 684658 - RNA, 22 nt, Human
agcacuguuaugggaugacuua

SEQ ID NO: 684659 - RNA, 22 nt, Human
gugggcagugugucaguaucuu

SEQ ID NO: 684660 - RNA, 22 nt, Human
gucagaaaaagcaaggcugggc

SEQ ID NO: 684661 - RNA, 21 nt, Human
ugucugccccuguuuaccaga

SEQ ID NO: 684662 - RNA, 18 nt, Human
gcucuggcucaccuccag

SEQ ID NO: 684663 - RNA, 22 nt, Human
ucugugugaccauaagccagcu

SEQ ID NO: 684664 - RNA, 20 nt, Human
uagauccgcaguaaaacuuu

SEQ ID NO: 684665 - RNA, 22 nt, Human
cuuccugaacaaugccaucaau

SEQ ID NO: 684666 - RNA, 22 nt, Human
gaucgauucagugugccuaccc

SEQ ID NO: 684667 - RNA, 22 nt, Human
gcuggccugggcucaagaccag

SEQ ID NO: 684668 - RNA, 22 nt, Human
acagaacugggggcacagauag

SEQ ID NO: 684669 - RNA, 22 nt, Human
augcuacgaaugagagcauaua

SEQ ID NO: 684670 - RNA, 22 nt, Human
auuauaggcuugagccaccgug

SEQ ID NO: 684671 - RNA, 23 nt, Human
agugcucccaggaccuggggcag

SEQ ID NO: 684672 - RNA, 22 nt, Human
ugugccaagaucaaacuuuucu

SEQ ID NO: 684673 - RNA, 22 nt, Human
ucucuccuguguucugauguuu

SEQ ID NO: 684674 - RNA, 22 nt, Human
gggcacagccuaacuauggaga

SEQ ID NO: 684675 - RNA, 22 nt, Human
ggccacagaacagcuacaggac

SEQ ID NO: 684676 - RNA, 22 nt, Human
agcagguuuaaacucuaaugca

SEQ ID NO: 684677 - RNA, 22 nt, Human
cagugcuggagauggguggaac

SEQ ID NO: 684678 - RNA, 21 nt, Human
cagugguuuauaaacaacaga

SEQ ID NO: 684679 - RNA, 22 nt, Human
cucuggagcauuucaccuacau

SEQ ID NO: 684680 - RNA, 22 nt, Human
aaauacagaguuauggaccuca

SEQ ID NO: 684681 - RNA, 22 nt, Human
agggcuccuaugccccauggac

SEQ ID NO: 684682 - RNA, 22 nt, Human
ugugucaggagauagcaaaggg

SEQ ID NO: 684683 - RNA, 22 nt, Human
uaacuucuggaaaugcaucugc

SEQ ID NO: 684684 - RNA, 22 nt, Human
aauguuuucucugugaacacau

SEQ ID NO: 684685 - RNA, 22 nt, Human
cagacaugauguaagcagaggc

SEQ ID NO: 684686 - RNA, 23 nt, Human
uagagcauugcugaggccucccu

SEQ ID NO: 684687 - RNA, 22 nt, Human
ucuuagcaaauuuucuuugccu

SEQ ID NO: 684688 - RNA, 19 nt, Human
ucauuuacgguuuugauga

SEQ ID NO: 684689 - RNA, 22 nt, Human
ggagcuggagaguacagaguuu

SEQ ID NO: 684690 - RNA, 22 nt, Human
ugggagcuccuggagggcagga

SEQ ID NO: 684691 - RNA, 22 nt, Human
ggccuuggguauagguggguau

SEQ ID NO: 684692 - RNA, 22 nt, Human
aaacugagaccgaaagggguag

SEQ ID NO: 684693 - RNA, 22 nt, Human
uggcaucuuugucccagaagcu

SEQ ID NO: 684694 - RNA, 22 nt, Human
cagcuacacuucuggguguguc

SEQ ID NO: 684695 - RNA, 22 nt, Human
uucugaauucaugagauuuggg

SEQ ID NO: 684696 - RNA, 22 nt, Human
uuauuuacuggauggccuuggg

SEQ ID NO: 684697 - RNA, 22 nt, Human
ugaacacacaccuauguacaaa

SEQ ID NO: 684698 - RNA, 22 nt, Human
gcuguacauuuguguacacuug

SEQ ID NO: 684699 - RNA, 22 nt, Human
aggggcacuucucaggcugugg

SEQ ID NO: 684700 - RNA, 22 nt, Human
cuggcagcugcccgagaugccc

SEQ ID NO: 684701 - RNA, 21 nt, Human
gcagaggcacggcaccaaggg

SEQ ID NO: 684702 - RNA, 22 nt, Human
uguuguagcuugacagcagcca

SEQ ID NO: 684703 - RNA, 22 nt, Human
gaggcagaaguugcagugagca

SEQ ID NO: 684704 - RNA, 22 nt, Human
guaucuuucccaccaaucacaa

SEQ ID NO: 684705 - RNA, 22 nt, Human
uguccuggagugcuugggggaa

SEQ ID NO: 684706 - RNA, 22 nt, Human
gggaccuggucuagcacugagc

SEQ ID NO: 684707 - RNA, 22 nt, Human
acagagcuguacuacuuacuga

SEQ ID NO: 684708 - RNA, 22 nt, Human
gagagagaagugggugucaccu

SEQ ID NO: 684709 - RNA, 22 nt, Human
gcugagccccccugcguggguc

SEQ ID NO: 684710 - RNA, 22 nt, Human
uggcagauuguaggcaguuagg

SEQ ID NO: 684711 - RNA, 22 nt, Human
gcagggaccagggccagaucca

SEQ ID NO: 684712 - RNA, 21 nt, Human
uguuuacucccugcaagcacg

SEQ ID NO: 684713 - RNA, 20 nt, Human
accucugcaucaauccuuug

SEQ ID NO: 684714 - RNA, 22 nt, Human
acacauuuagcaccagguuuau

SEQ ID NO: 684715 - RNA, 22 nt, Human
ggcccagagucugcaauggagu

SEQ ID NO: 684716 - RNA, 16 nt, Human
ggugggaggugaggug

SEQ ID NO: 684717 - RNA, 22 nt, Human
gaggccaggggccuggagauga

SEQ ID NO: 684718 - RNA, 22 nt, Human
uagaggagggcuguucuucagu

SEQ ID NO: 684719 - RNA, 22 nt, Human
gauacuuuguggaauccuggau

SEQ ID NO: 684720 - RNA, 23 nt, Human
agugucugagugcaggcugugca

SEQ ID NO: 684721 - RNA, 22 nt, Human
auguaacacccacuuuuauagc

SEQ ID NO: 684722 - RNA, 22 nt, Human
ugcagagauuuggcucuuaaag

SEQ ID NO: 684723 - RNA, 22 nt, Human
uccauaagcagguucuuccuga

SEQ ID NO: 684724 - RNA, 22 nt, Human
gcuggcuggcgggugcguccuc

SEQ ID NO: 684725 - RNA, 22 nt, Human
acucagagaaacagcagggugu

SEQ ID NO: 684726 - RNA, 22 nt, Human
agcuguggccagaugugagcgg

SEQ ID NO: 684727 - RNA, 22 nt, Human
caggugguugagagcuguaggc

SEQ ID NO: 684728 - RNA, 22 nt, Human
acccaggacuuggcaaccucau

SEQ ID NO: 684729 - RNA, 22 nt, Human
gcaagcagacugggccccugug

SEQ ID NO: 684730 - RNA, 22 nt, Human
cagugcagucaaggaagaacca

SEQ ID NO: 684731 - RNA, 22 nt, Human
auuugauuagcuguguaauuuu

SEQ ID NO: 684732 - RNA, 22 nt, Human
auacaaguggccacuugaauuc

SEQ ID NO: 684733 - RNA, 22 nt, Human
gacucugcuacaggccgagguu

SEQ ID NO: 684734 - RNA, 22 nt, Human
uacugccugggggagacagcug

SEQ ID NO: 684735 - RNA, 22 nt, Human
cuggccugggagcugcuagcgu

SEQ ID NO: 684736 - RNA, 22 nt, Human
uuuccaagcugucuuggcccac

SEQ ID NO: 684737 - RNA, 22 nt, Human
ccauccuggccuugcuguccac

SEQ ID NO: 684738 - RNA, 22 nt, Human
uauuaaagagagaaucaucauc

SEQ ID NO: 684739 - RNA, 22 nt, Human
ucaaugacugguccaagguggc

SEQ ID NO: 684740 - RNA, 22 nt, Human
uccuggcccucugcaaacgcca

SEQ ID NO: 684741 - RNA, 22 nt, Human
gggaucaguuaaggagaguuuu

SEQ ID NO: 684742 - RNA, 22 nt, Human
ugaaggugagcauuugcugauu

SEQ ID NO: 684743 - RNA, 22 nt, Human
ugcagcuggauuuaucuuuucc

SEQ ID NO: 684744 - RNA, 17 nt, Human
ccaggcuccaucacugu

SEQ ID NO: 684745 - RNA, 22 nt, Human
uauuuuacuauuuggcaaaguc

SEQ ID NO: 684746 - RNA, 19 nt, Human
uuacaugacauaugaagga

SEQ ID NO: 684747 - RNA, 22 nt, Human
aggcaguuguugcugagcagcu

SEQ ID NO: 684748 - RNA, 20 nt, Human
uccagggcaacuagagugug

SEQ ID NO: 684749 - RNA, 22 nt, Human
acuuagaauuaaauauuuuugg

SEQ ID NO: 684750 - RNA, 22 nt, Human
uuacaguagauuuugaaugugg

SEQ ID NO: 684751 - RNA, 22 nt, Human
accaggcccgcugcuauggugg

SEQ ID NO: 684752 - RNA, 22 nt, Human
aagucaaagcuuucagaggaaa

SEQ ID NO: 684753 - RNA, 21 nt, Human
uccuucaguucugcacuuucu

SEQ ID NO: 684754 - RNA, 22 nt, Human
ugggagagcacugcagccccgg

SEQ ID NO: 684755 - RNA, 22 nt, Human
uacuuugaauuaaauauuucag

SEQ ID NO: 684756 - RNA, 22 nt, Human
uggagguacauaaugagagggu

SEQ ID NO: 684757 - RNA, 22 nt, Human
auugucuucugucuuaggugau

SEQ ID NO: 684758 - RNA, 22 nt, Human
acauucuuccagcuggcuguug

SEQ ID NO: 684759 - RNA, 22 nt, Human
gaugucuuucuaauacuggcuu

SEQ ID NO: 684760 - RNA, 22 nt, Human
ugaggaagaacaagaauuuaga

SEQ ID NO: 684761 - RNA, 22 nt, Human
ggcuuuugaauuccaaggcauu

SEQ ID NO: 684762 - RNA, 22 nt, Human
uaacguuugauaacuucuguuc

SEQ ID NO: 684763 - RNA, 23 nt, Human
auggucagaauuuuccagcugag

SEQ ID NO: 684764 - RNA, 22 nt, Human
cacacauuucagaugcuacaau

SEQ ID NO: 684765 - RNA, 22 nt, Human
acaccauacucauguugguucc

SEQ ID NO: 684766 - RNA, 22 nt, Human
uagugauuaaaggcagaauguu

SEQ ID NO: 684767 - RNA, 22 nt, Human
gucccuuggcucacaaacagcu

SEQ ID NO: 684768 - RNA, 22 nt, Human
uuugcauuccugccugcauuca

SEQ ID NO: 684769 - RNA, 22 nt, Human
acuuuacuccccaacauaaaug

SEQ ID NO: 684770 - RNA, 22 nt, Human
agagugagggggcacugagacg

SEQ ID NO: 684771 - RNA, 22 nt, Human
gaguauauaauuaauuggucug

SEQ ID NO: 684772 - RNA, 22 nt, Human
cccugcagccggccagcucauu

SEQ ID NO: 684773 - RNA, 22 nt, Human
aucugggcauggaggaaagaga

SEQ ID NO: 684774 - RNA, 22 nt, Human
gugugcaggccacaggccaggg

SEQ ID NO: 684775 - RNA, 22 nt, Human
aagguauuauugucuauguacu

SEQ ID NO: 684776 - RNA, 20 nt, Human
aagcuggguaggagaggagc

SEQ ID NO: 684777 - RNA, 22 nt, Human
ggaggguccccagcagcaugaa

SEQ ID NO: 684778 - RNA, 22 nt, Human
cucagccaugucaugccuaccu

SEQ ID NO: 684779 - RNA, 22 nt, Human
gcaggcucuucuuucugcccag

SEQ ID NO: 684780 - RNA, 22 nt, Human
ggugggagccaacacccuucug

SEQ ID NO: 684781 - RNA, 20 nt, Human
gguagcagcugcugucaucc

SEQ ID NO: 684782 - RNA, 22 nt, Human
ucugaaguucuuaaauuaguuu

SEQ ID NO: 684783 - RNA, 22 nt, Human
cacuguggcaaccugugcccaa

SEQ ID NO: 684784 - RNA, 22 nt, Human
uuuugcuuaaucuagauuuugc

SEQ ID NO: 684785 - RNA, 22 nt, Human
gugaacucagucucucuugcua

SEQ ID NO: 684786 - RNA, 18 nt, Human
ggcagccuggacaugcuc

SEQ ID NO: 684787 - RNA, 22 nt, Human
acaaggcaauuccuggugaauu

SEQ ID NO: 684788 - RNA, 22 nt, Human
aagggcuguaagccaaguaaag

SEQ ID NO: 684789 - RNA, 22 nt, Human
auguuucaugacugagcaaaau

SEQ ID NO: 684790 - RNA, 22 nt, Human
uucauacuguuuaaguucuguu

SEQ ID NO: 684791 - RNA, 22 nt, Human
gcauacaaagguuuacaacuga

SEQ ID NO: 684792 - RNA, 22 nt, Human
gaaauagaagcugccaauuucu

SEQ ID NO: 684793 - RNA, 22 nt, Human
cuggcccucagacucaugggca

SEQ ID NO: 684794 - RNA, 23 nt, Human
ugggagcucaagggaggcugccc

SEQ ID NO: 684795 - RNA, 22 nt, Human
uccaucagauucccuccugaga

SEQ ID NO: 684796 - RNA, 22 nt, Human
agggucaggagacacuggcaac

SEQ ID NO: 684797 - RNA, 22 nt, Human
ccucuguccuggggaguggagc

SEQ ID NO: 684798 - RNA, 22 nt, Human
aaacucaugccauuaauccuuu

SEQ ID NO: 684799 - RNA, 22 nt, Human
gaaggcacugaacuccuucugg

SEQ ID NO: 684800 - RNA, 22 nt, Human
cagggcagugaagaacacacgu

SEQ ID NO: 684801 - RNA, 19 nt, Human
ccuugccugucccugcagc

SEQ ID NO: 684802 - RNA, 22 nt, Human
acagaacugcagacagugccaa

SEQ ID NO: 684803 - RNA, 17 nt, Human
uuuucucucuuggauuc

SEQ ID NO: 684804 - RNA, 22 nt, Human
uuuccaagauaauacacagaaa

SEQ ID NO: 684805 - RNA, 22 nt, Human
acagaggccucguagguacaac

SEQ ID NO: 684806 - RNA, 22 nt, Human
gcaggauugggcagagggugaa

SEQ ID NO: 684807 - RNA, 22 nt, Human
cuggguauaggaaacaguuaag

SEQ ID NO: 684808 - RNA, 22 nt, Human
cugguccaguggaugcugaggg

SEQ ID NO: 684809 - RNA, 22 nt, Human
gugugcacagagcuccaguguu

SEQ ID NO: 684810 - RNA, 22 nt, Human
cagcuuuggcccagucgggagg

SEQ ID NO: 684811 - RNA, 22 nt, Human
cagcuccuaugaguaugauucc

SEQ ID NO: 684812 - RNA, 22 nt, Human
gcucgguggccagccugaggcc

SEQ ID NO: 684813 - RNA, 22 nt, Human
cugcaguacaagaagcaucucu

SEQ ID NO: 684814 - RNA, 22 nt, Human
uggguagggacuuagcuggcug

SEQ ID NO: 684815 - RNA, 22 nt, Human
acugagguuguaguaggaauuc

SEQ ID NO: 684816 - RNA, 17 nt, Human
cucuuuauaaagaguua

SEQ ID NO: 684817 - RNA, 22 nt, Human
cuuauugaaagccccugugccu

SEQ ID NO: 684818 - RNA, 22 nt, Human
cauugaaagagauaaagccuuu

SEQ ID NO: 684819 - RNA, 22 nt, Human
aagucccugugggguggaggcu

SEQ ID NO: 684820 - RNA, 23 nt, Human
cugccugcuggggagacagaucu

SEQ ID NO: 684821 - RNA, 22 nt, Human
gggggacuaacuggauccugga

SEQ ID NO: 684822 - RNA, 22 nt, Human
agauggggcugaaaguuccaau

SEQ ID NO: 684823 - RNA, 22 nt, Human
uggccucuuaggacauccucua

SEQ ID NO: 684824 - RNA, 22 nt, Human
uggccccugaggagcgucagcc

SEQ ID NO: 684825 - RNA, 22 nt, Human
uguggcagauuuuauaaauugc

SEQ ID NO: 684826 - RNA, 23 nt, Human
aggcccugccugucccucuuuuu

SEQ ID NO: 684827 - RNA, 22 nt, Human
caguuuaggagagacgcguucu

SEQ ID NO: 684828 - RNA, 22 nt, Human
gggagccagcagggcauggagc

SEQ ID NO: 684829 - RNA, 22 nt, Human
aaaagaguguuucaacuuuggc

SEQ ID NO: 684830 - RNA, 21 nt, Human
ucuguggcagcaugaugaggu

SEQ ID NO: 684831 - RNA, 22 nt, Human
auggaguucugccagcgcugcu

SEQ ID NO: 684832 - RNA, 22 nt, Human
uggcagagaauaaaucuugacu

SEQ ID NO: 684833 - RNA, 22 nt, Human
ugucucagaauggcucauaaua

SEQ ID NO: 684834 - RNA, 17 nt, Human
gacagcugggcgcacgc

SEQ ID NO: 684835 - RNA, 22 nt, Human
cugcugugcacccaggaaggcu

SEQ ID NO: 684836 - RNA, 22 nt, Human
gggcucagucggcaagccccuu

SEQ ID NO: 684837 - RNA, 22 nt, Human
uuccagagugacugugccacuu

SEQ ID NO: 684838 - RNA, 22 nt, Human
aggaaguuaguaaauuaugugc

SEQ ID NO: 684839 - RNA, 22 nt, Human
gacuggccuggagaugcagcug

SEQ ID NO: 684840 - RNA, 22 nt, Human
uuugcuuguucaagauuucugu

SEQ ID NO: 684841 - RNA, 22 nt, Human
ggcuagggacuccuccucaggg

SEQ ID NO: 684842 - RNA, 22 nt, Human
aaagaaucguguguaguuugaa

SEQ ID NO: 684843 - RNA, 22 nt, Human
ggacagcguggcugguggaggg

SEQ ID NO: 684844 - RNA, 22 nt, Human
cauuuaaugccuuugccaucca

SEQ ID NO: 684845 - RNA, 18 nt, Human
acucugcggaggccccag

SEQ ID NO: 684846 - RNA, 22 nt, Human
gaggcucagggaaacagcgcag

SEQ ID NO: 684847 - RNA, 22 nt, Human
uuguuaaaggcaaaacaagcac

SEQ ID NO: 684848 - RNA, 22 nt, Human
ugcaggaguuaagugcucuccu

SEQ ID NO: 684849 - RNA, 22 nt, Human
uggccuguggcuuaaggucugu

SEQ ID NO: 684850 - RNA, 22 nt, Human
uggcaggcaaguucagcuccac

SEQ ID NO: 684851 - RNA, 22 nt, Human
cagcucucacacccuccuccca

SEQ ID NO: 684852 - RNA, 22 nt, Human
cauuuauucaugaucuguagcu

SEQ ID NO: 684853 - RNA, 22 nt, Human
ucaugguauauuucacucuuua

SEQ ID NO: 684854 - RNA, 22 nt, Human
gagucacauacuauguaauaga

SEQ ID NO: 684855 - RNA, 22 nt, Human
auuacaaaagaagggagaaggu

SEQ ID NO: 684856 - RNA, 22 nt, Human
gcuccaggugaauccucucacc

SEQ ID NO: 684857 - RNA, 22 nt, Human
agggaucagcagaggguguggu

SEQ ID NO: 684858 - RNA, 22 nt, Human
cuauuuauguccaaguguuuua

SEQ ID NO: 684859 - RNA, 22 nt, Human
acauuugucuggcuagaaaguu

SEQ ID NO: 684860 - RNA, 22 nt, Human
ucucccagaggaucccagugga

SEQ ID NO: 684861 - RNA, 22 nt, Human
cuuuaugaaaaccagauugggg

SEQ ID NO: 684862 - RNA, 22 nt, Human
aggaagugaaagggaaggaguu

SEQ ID NO: 684863 - RNA, 22 nt, Human
guggccucuguuggcuccuagg

SEQ ID NO: 684864 - RNA, 22 nt, Human
acucacuagagguagaucccug

SEQ ID NO: 684865 - RNA, 22 nt, Human
cugcuuuaagaaugaguguaag

SEQ ID NO: 684866 - RNA, 20 nt, Human
ucuggggaugaggucuagga

SEQ ID NO: 684867 - RNA, 21 nt, Human
ugcagagauaucugaagcaga

SEQ ID NO: 684868 - RNA, 22 nt, Human
ucugggaggggcugccauugcu

SEQ ID NO: 684869 - RNA, 23 nt, Human
ucuggaauccucccccuugguuc

SEQ ID NO: 684870 - RNA, 22 nt, Human
uaagaacagugucugucucaca

SEQ ID NO: 684871 - RNA, 22 nt, Human
guaacauuauucaugagauaca

SEQ ID NO: 684872 - RNA, 22 nt, Human
aauuuuacauaggggauauggg

SEQ ID NO: 684873 - RNA, 22 nt, Human
uagaaaucagguuuuuagaaag

SEQ ID NO: 684874 - RNA, 22 nt, Human
agcaacauugagacugcaguug

SEQ ID NO: 684875 - RNA, 22 nt, Human
uuaacauuuaguguaccccugu

SEQ ID NO: 684876 - RNA, 22 nt, Human
cugcagcagaauaaucugcuca

SEQ ID NO: 684877 - RNA, 22 nt, Human
uuagaaaaaacgucuucuagug

SEQ ID NO: 684878 - RNA, 22 nt, Human
ucucagaacuuuauauguauca

SEQ ID NO: 684879 - RNA, 21 nt, Human
agugacagaggaaggugcaua

SEQ ID NO: 684880 - RNA, 22 nt, Human
cuugcucacaguaccuggcuug

SEQ ID NO: 684881 - RNA, 22 nt, Human
auuauggauggaggcauuaguc

SEQ ID NO: 684882 - RNA, 22 nt, Human
gucugaggcgaggccugagaac

SEQ ID NO: 684883 - RNA, 22 nt, Human
uuccagcccgcgacuuguucag

SEQ ID NO: 684884 - RNA, 22 nt, Human
ucucaggcuccugacauauaug

SEQ ID NO: 684885 - RNA, 22 nt, Human
ucagcccagggacagaggcccc

SEQ ID NO: 684886 - RNA, 19 nt, Human
ucauuuguuaguagaaguu

SEQ ID NO: 684887 - RNA, 22 nt, Human
agauuucugucaccuucuaugc

SEQ ID NO: 684888 - RNA, 22 nt, Human
auguaaggcugccuaugacacu

SEQ ID NO: 684889 - RNA, 23 nt, Human
uuuguacauugaggaggcagaau

SEQ ID NO: 684890 - RNA, 22 nt, Human
ucugagaggauuccugucccga

SEQ ID NO: 684891 - RNA, 22 nt, Human
ggugaggguaaauauaggcaaa

SEQ ID NO: 684892 - RNA, 22 nt, Human
aauaagauugacacaaguaccu

SEQ ID NO: 684893 - RNA, 22 nt, Human
cuuucacagcugugcuuaugau

SEQ ID NO: 684894 - RNA, 19 nt, Human
ccugccugagcugucccuc

SEQ ID NO: 684895 - RNA, 22 nt, Human
cucucugucuuggcauuugguc

SEQ ID NO: 684896 - RNA, 22 nt, Human
caggcacugcacuaccacuuuu

SEQ ID NO: 684897 - RNA, 22 nt, Human
cugugagugacccuggucagca

SEQ ID NO: 684898 - RNA, 22 nt, Human
agaaauguacgauguuaugcag

SEQ ID NO: 684899 - RNA, 22 nt, Human
uuaaagcugcugaauccuauuu

SEQ ID NO: 684900 - RNA, 22 nt, Human
gacccuggggaccaucuagccc

SEQ ID NO: 684901 - RNA, 20 nt, Human
uucaaaguguaugauaugca

SEQ ID NO: 684902 - RNA, 22 nt, Human
aggugggcuuggugccaacaug

SEQ ID NO: 684903 - RNA, 22 nt, Human
caaccucauagaaagaaaaugu

SEQ ID NO: 684904 - RNA, 22 nt, Human
auaaccugagauugagcugccu

SEQ ID NO: 684905 - RNA, 22 nt, Human
auauuguugacuauaagaguaa

SEQ ID NO: 684906 - RNA, 22 nt, Human
cuggucccugcagugugcuggg

SEQ ID NO: 684907 - RNA, 19 nt, Human
ugcuauuugaagaagugua

SEQ ID NO: 684908 - RNA, 22 nt, Human
uuagucaauagugaauauagag

SEQ ID NO: 684909 - RNA, 22 nt, Human
cugccugcaggacaccucgcua

SEQ ID NO: 684910 - RNA, 22 nt, Human
gcagggcuccacuguggccaag

SEQ ID NO: 684911 - RNA, 22 nt, Human
ucuauaaauuaugcagucucag

SEQ ID NO: 684912 - RNA, 22 nt, Human
gcucucuggaggccauggacag

SEQ ID NO: 684913 - RNA, 22 nt, Human
gcugggcuucucaaugcugccu

SEQ ID NO: 684914 - RNA, 22 nt, Human
agggcagcugugagccacugug

SEQ ID NO: 684915 - RNA, 22 nt, Human
ucagaacauuaaggauuugaag

SEQ ID NO: 684916 - RNA, 22 nt, Human
uaacacauuuuccucauacgga

SEQ ID NO: 684917 - RNA, 22 nt, Human
augugugcaaugcuauuuuggc

SEQ ID NO: 684918 - RNA, 22 nt, Human
ucucccucucagauuuauucac

SEQ ID NO: 684919 - RNA, 22 nt, Human
auggcucauuuaucuugcagcc

SEQ ID NO: 684920 - RNA, 22 nt, Human
auacaaagcuaaauaugguuuc

SEQ ID NO: 684921 - RNA, 22 nt, Human
cuggaacaaguggccuugcaag

SEQ ID NO: 684922 - RNA, 22 nt, Human
ugugugcaggcacugugccaga

SEQ ID NO: 684923 - RNA, 17 nt, Human
uccagagaggcuucccu

SEQ ID NO: 684924 - RNA, 22 nt, Human
ucuguuccuggucucuggagcu

SEQ ID NO: 684925 - RNA, 22 nt, Human
ugugucuguccucgguugaugc

SEQ ID NO: 684926 - RNA, 22 nt, Human
caggaaagggaugggcugccac

SEQ ID NO: 684927 - RNA, 22 nt, Human
ugauggaaauauguaaucuggu

SEQ ID NO: 684928 - RNA, 22 nt, Human
aaaauaaguugguccuguccuu

SEQ ID NO: 684929 - RNA, 22 nt, Human
gcacuugagccaaugcuaguag

SEQ ID NO: 684930 - RNA, 22 nt, Human
agugaaaugauaguguaaauac

SEQ ID NO: 684931 - RNA, 22 nt, Human
aaguucccgaggaccacaguug

SEQ ID NO: 684932 - RNA, 22 nt, Human
gaacuaaauuugacagacaaca

SEQ ID NO: 684933 - RNA, 22 nt, Human
cugcagcuuucgcuccaucagc

SEQ ID NO: 684934 - RNA, 23 nt, Human
ugcaggguguuccugccuuugcu

SEQ ID NO: 684935 - RNA, 22 nt, Human
cugagcugacaucuuccucuuu

SEQ ID NO: 684936 - RNA, 22 nt, Human
caggugaaucacuugaguccag

SEQ ID NO: 684937 - RNA, 22 nt, Human
gccacagcagggcccucucagg

SEQ ID NO: 684938 - RNA, 22 nt, Human
aggaagugcuaagagaacauca

SEQ ID NO: 684939 - RNA, 18 nt, Human
uguuccaaggaaggaauc

SEQ ID NO: 684940 - RNA, 22 nt, Human
gcuuugaagacuuuuccagggu

SEQ ID NO: 684941 - RNA, 22 nt, Human
acagggcuccuagguggugugc

SEQ ID NO: 684942 - RNA, 22 nt, Human
gucugagcacccuggccuguca

SEQ ID NO: 684943 - RNA, 22 nt, Human
ucauugcaagcucauuuaucug

SEQ ID NO: 684944 - RNA, 22 nt, Human
aaguauuauuuaacaaauuugu

SEQ ID NO: 684945 - RNA, 22 nt, Human
ccuugcuguuagccuacauuau

SEQ ID NO: 684946 - RNA, 22 nt, Human
uacacagauaugugaucaauca

SEQ ID NO: 684947 - RNA, 22 nt, Human
aauguguaugaggaagagagaa

SEQ ID NO: 684948 - RNA, 22 nt, Human
ggagcagagcauuucacagccu

SEQ ID NO: 684949 - RNA, 22 nt, Human
ugggagagaauaaucaauaggu

SEQ ID NO: 684950 - RNA, 22 nt, Human
uccaagaguauaguuuauuggc

SEQ ID NO: 684951 - RNA, 22 nt, Human
cucaggacggccgggggagccu

SEQ ID NO: 684952 - RNA, 22 nt, Human
aagaaugugcuaaugaaaacuu

SEQ ID NO: 684953 - RNA, 22 nt, Human
ccauucaauaccuuagagaaaa

SEQ ID NO: 684954 - RNA, 22 nt, Human
aggcuccagcagccagaggaag

SEQ ID NO: 684955 - RNA, 22 nt, Human
accuacauggcuuuaaguaagu

SEQ ID NO: 684956 - RNA, 22 nt, Human
uuccuuugggaaaucacuaagg

SEQ ID NO: 684957 - RNA, 22 nt, Human
gugcaaaaguaauugcuguuuu

SEQ ID NO: 684958 - RNA, 22 nt, Human
uuauuauuccccaagucauuau

SEQ ID NO: 684959 - RNA, 22 nt, Human
ucugggugucacuccugccugc

SEQ ID NO: 684960 - RNA, 22 nt, Human
caaaugcauagaaagaugaaac

SEQ ID NO: 684961 - RNA, 22 nt, Human
ucuaagcagaacugaagcucug

SEQ ID NO: 684962 - RNA, 22 nt, Human
ggccuuccagggaagacagggc

SEQ ID NO: 684963 - RNA, 22 nt, Human
cauuugugcuuuuauaaaauag

SEQ ID NO: 684964 - RNA, 22 nt, Human
aaaccacacuuagcaguuucgu

SEQ ID NO: 684965 - RNA, 22 nt, Human
acacaggggcucggcugggugc

SEQ ID NO: 684966 - RNA, 23 nt, Human
auuugaaacuuucuuguuuccag

SEQ ID NO: 684967 - RNA, 23 nt, Human
agggaaaguaguaauggccuuug

SEQ ID NO: 684968 - RNA, 22 nt, Human
gccuggcagggcccggacggca

SEQ ID NO: 684969 - RNA, 22 nt, Human
caguuucuguggucucuuuuca

SEQ ID NO: 684970 - RNA, 22 nt, Human
gggaagccaugcucagagguac

SEQ ID NO: 684971 - RNA, 22 nt, Human
cacaugggcguaauguccaugg

SEQ ID NO: 684972 - RNA, 22 nt, Human
aaugacagagcacugaacuugg

SEQ ID NO: 684973 - RNA, 22 nt, Human
ugcaggcuguaaucugaggcua

SEQ ID NO: 684974 - RNA, 22 nt, Human
agagucauaguuuaacuuuugu

SEQ ID NO: 684975 - RNA, 22 nt, Human
auguggcugaucgcagagcucu

SEQ ID NO: 684976 - RNA, 22 nt, Human
cuggagcugguauagggacaaa

SEQ ID NO: 684977 - RNA, 22 nt, Human
uccagauggauuuaagaccuaa

SEQ ID NO: 684978 - RNA, 21 nt, Human
uccagcugcacaagcaugggg

SEQ ID NO: 684979 - RNA, 22 nt, Human
uucauuuguccaaauacuaugu

SEQ ID NO: 684980 - RNA, 22 nt, Human
ugacaccuugcuaaauggcacc

SEQ ID NO: 684981 - RNA, 22 nt, Human
ucagugcacccaauucucucca

SEQ ID NO: 684982 - RNA, 20 nt, Human
ggcagggagggauacugagg

SEQ ID NO: 684983 - RNA, 22 nt, Human
cucucuaacgacauucccauuc

SEQ ID NO: 684984 - RNA, 22 nt, Human
auuggcaaugucccggcugcug

SEQ ID NO: 684985 - RNA, 22 nt, Human
cagaugagaguggccaggguuc

SEQ ID NO: 684986 - RNA, 22 nt, Human
cagcaaucgggugauaugcaau

SEQ ID NO: 684987 - RNA, 22 nt, Human
gagucagaaaguagugugccua

SEQ ID NO: 684988 - RNA, 22 nt, Human
ugggccucuguuuccucaucug

SEQ ID NO: 684989 - RNA, 22 nt, Human
acuuccuuuugggaaacuguuu

SEQ ID NO: 684990 - RNA, 22 nt, Human
ggucugaaucacugugccuauc

SEQ ID NO: 684991 - RNA, 19 nt, Human
cugugcaggccgggcugag

SEQ ID NO: 684992 - RNA, 22 nt, Human
ucacaucucuguuuucuaaauc

SEQ ID NO: 684993 - RNA, 18 nt, Human
caaagcucacguuccauc

SEQ ID NO: 684994 - RNA, 22 nt, Human
aggccagaaaaagacagcucca

SEQ ID NO: 684995 - RNA, 22 nt, Human
gaguuuagguucaugaacgagu

SEQ ID NO: 684996 - RNA, 22 nt, Human
uggccucaccacuagcugggug

SEQ ID NO: 684997 - RNA, 22 nt, Human
ugcuuuauuuuaaauaugccau

SEQ ID NO: 684998 - RNA, 21 nt, Human
augacagaugcugcagaucgu

SEQ ID NO: 684999 - RNA, 22 nt, Human
acuaguauuagacuaaaaguca

SEQ ID NO: 685000 - RNA, 22 nt, Human
uccucagucacgguagcacauu

SEQ ID NO: 685001 - RNA, 22 nt, Human
cggcuucaguaauuccaugucc

SEQ ID NO: 685002 - RNA, 22 nt, Human
acuucacacagcaaauuuaucu

SEQ ID NO: 685003 - RNA, 22 nt, Human
cuggcugcauuggcaagucaau

SEQ ID NO: 685004 - RNA, 19 nt, Human
cccacaggaggacauaugg

SEQ ID NO: 685005 - RNA, 18 nt, Human
acuucccagaugagggga

SEQ ID NO: 685006 - RNA, 22 nt, Human
aaagguuuuauucugagcucug

SEQ ID NO: 685007 - RNA, 22 nt, Human
agcucucaagauaagaaagaac

SEQ ID NO: 685008 - RNA, 22 nt, Human
guucuucagcccucagguccua

SEQ ID NO: 685009 - RNA, 22 nt, Human
ccucuugccaaucagcuacaga

SEQ ID NO: 685010 - RNA, 22 nt, Human
agcagcagugugguuuggggaa

SEQ ID NO: 685011 - RNA, 22 nt, Human
cuguguguccucggacgaguuu

SEQ ID NO: 685012 - RNA, 22 nt, Human
gaagccacagagauuguggggg

SEQ ID NO: 685013 - RNA, 22 nt, Human
aaguguuucaauaauuuggacc

SEQ ID NO: 685014 - RNA, 22 nt, Human
gcugcccaguucugcugcugcc

SEQ ID NO: 685015 - RNA, 22 nt, Human
ugauuuaggaaacagcuacagg

SEQ ID NO: 685016 - RNA, 22 nt, Human
ggcuuccagcugggccuuggag

SEQ ID NO: 685017 - RNA, 22 nt, Human
ggcuuugcuuaacgugcuucua

SEQ ID NO: 685018 - RNA, 22 nt, Human
acaugaaaugcagccuguaacc

SEQ ID NO: 685019 - RNA, 22 nt, Human
ucugacagguugggauauggaa

SEQ ID NO: 685020 - RNA, 22 nt, Human
ccugcagcuguaggagaaggcg

SEQ ID NO: 685021 - RNA, 22 nt, Human
aaaaguauaggguuuggaguca

SEQ ID NO: 685022 - RNA, 22 nt, Human
aucccugagguuccuccugagc

SEQ ID NO: 685023 - RNA, 19 nt, Human
cugcuucaggcgccuugcc

SEQ ID NO: 685024 - RNA, 22 nt, Human
auggcccuguuuaugguaaggc

SEQ ID NO: 685025 - RNA, 22 nt, Human
caguguuuagcacagugcuugg

SEQ ID NO: 685026 - RNA, 22 nt, Human
ucauaaagcauuucagcuuuug

SEQ ID NO: 685027 - RNA, 19 nt, Human
gcuuuuauugcucaggugc

SEQ ID NO: 685028 - RNA, 22 nt, Human
cuucaguguucccaucuguaaa

SEQ ID NO: 685029 - RNA, 19 nt, Human
cuucuucuuggcagccaag

SEQ ID NO: 685030 - RNA, 19 nt, Human
ggcugggcccuguuucucc

SEQ ID NO: 685031 - RNA, 22 nt, Human
uguuuucaugguuaugugucua

SEQ ID NO: 685032 - RNA, 22 nt, Human
cucauaaagugagaauaugacc

SEQ ID NO: 685033 - RNA, 23 nt, Human
auauuuccagguuagugagguaa

SEQ ID NO: 685034 - RNA, 22 nt, Human
ugcagggccuucuagaccaugg

SEQ ID NO: 685035 - RNA, 23 nt, Human
uccuccagaggcccuccuuggcc

SEQ ID NO: 685036 - RNA, 22 nt, Human
ucuagaaacagguuucuagaaa

SEQ ID NO: 685037 - RNA, 22 nt, Human
acagagagcugugauugaguua

SEQ ID NO: 685038 - RNA, 22 nt, Human
ugaaccagagucuccagugguu

SEQ ID NO: 685039 - RNA, 22 nt, Human
cagaaauauuuauugagugaca

SEQ ID NO: 685040 - RNA, 22 nt, Human
uggcuucagagucugaguucuu

SEQ ID NO: 685041 - RNA, 22 nt, Human
aacccagccguguagcugccgc

SEQ ID NO: 685042 - RNA, 22 nt, Human
ugacaucugggcccucagcuaa

SEQ ID NO: 685043 - RNA, 21 nt, Human
cugggcuggcaggcauuaccu

SEQ ID NO: 685044 - RNA, 22 nt, Human
cuggccaguuguccuggcuugg

SEQ ID NO: 685045 - RNA, 22 nt, Human
gcuggcagaagagcugguucaa

SEQ ID NO: 685046 - RNA, 22 nt, Human
aaugaccagcgccugcagaggg

SEQ ID NO: 685047 - RNA, 21 nt, Human
cucagaccacagcucacaccc

SEQ ID NO: 685048 - RNA, 22 nt, Human
gcuuccugauauucauacuguu

SEQ ID NO: 685049 - RNA, 22 nt, Human
gucaccuugaacaggcuacuca

SEQ ID NO: 685050 - RNA, 22 nt, Human
agauauacacccauaucacaua

SEQ ID NO: 685051 - RNA, 22 nt, Human
acacagcuagugaguggcagag

SEQ ID NO: 685052 - RNA, 20 nt, Human
uucucuagccuuccccuggg

SEQ ID NO: 685053 - RNA, 22 nt, Human
auuguuaaaguaauaaccaugg

SEQ ID NO: 685054 - RNA, 22 nt, Human
uauugcugaugcugaagggaag

SEQ ID NO: 685055 - RNA, 22 nt, Human
agagaauacaaagaagauaugu

SEQ ID NO: 685056 - RNA, 22 nt, Human
uucaaaucccugcuccacuauu

SEQ ID NO: 685057 - RNA, 22 nt, Human
uuuauuuggcauccagggagaa

SEQ ID NO: 685058 - RNA, 22 nt, Human
ucuaccuauuucuucuauuggu

SEQ ID NO: 685059 - RNA, 22 nt, Human
gugagucuguggaccgggcacu

SEQ ID NO: 685060 - RNA, 22 nt, Human
cagaggauuauuucagaaucua

SEQ ID NO: 685061 - RNA, 22 nt, Human
ugcauacuuuuaaugacuguuu

SEQ ID NO: 685062 - RNA, 22 nt, Human
uacagcuuuugcagcuguuuug

SEQ ID NO: 685063 - RNA, 22 nt, Human
caugaaaucugaguauguuucc

SEQ ID NO: 685064 - RNA, 22 nt, Human
gccagguggcugagugacugag

SEQ ID NO: 685065 - RNA, 22 nt, Human
cugcaggacugaaagaugaggu

SEQ ID NO: 685066 - RNA, 22 nt, Human
uggcccaaagcagcccagcagg

SEQ ID NO: 685067 - RNA, 22 nt, Human
ggcugugggugugacaggccuc

SEQ ID NO: 685068 - RNA, 22 nt, Human
ugaggcccagccgcccugagag

SEQ ID NO: 685069 - RNA, 23 nt, Human
uccucccaaauuucagccucauu

SEQ ID NO: 685070 - RNA, 22 nt, Human
ggcacuuggaucuuaguugggg

SEQ ID NO: 685071 - RNA, 22 nt, Human
aaagacuugggagcaguaugcu

SEQ ID NO: 685072 - RNA, 22 nt, Human
ggcucccucaccaccaucacau

SEQ ID NO: 685073 - RNA, 22 nt, Human
guacauuucauuuaaaugaugu

SEQ ID NO: 685074 - RNA, 22 nt, Human
gauggauacuauaggaggcaca

SEQ ID NO: 685075 - RNA, 22 nt, Human
gccaggcagcugggagggugcc

SEQ ID NO: 685076 - RNA, 22 nt, Human
ggcucucuggaggagcucaccc

SEQ ID NO: 685077 - RNA, 22 nt, Human
uauguacaguccuuaacuuaaa

SEQ ID NO: 685078 - RNA, 22 nt, Human
uccuccagugucuggggccuug

SEQ ID NO: 685079 - RNA, 22 nt, Human
aaagguuugaggugggaagagg

SEQ ID NO: 685080 - RNA, 22 nt, Human
gcuucucucaggagcaucagcc

SEQ ID NO: 685081 - RNA, 22 nt, Human
cacuugaaauauuaggggugau

SEQ ID NO: 685082 - RNA, 22 nt, Human
caacuuuucugugaauuuaagu

SEQ ID NO: 685083 - RNA, 22 nt, Human
uuuagggaaauugaggguuaag

SEQ ID NO: 685084 - RNA, 22 nt, Human
ugagaucauuuauuuaccuuuc

SEQ ID NO: 685085 - RNA, 21 nt, Human
uugcuuauggcacugcuuugc

SEQ ID NO: 685086 - RNA, 22 nt, Human
uucagaauauccguuuaaguuu

SEQ ID NO: 685087 - RNA, 22 nt, Human
agcagcucagaggcaccagggc

SEQ ID NO: 685088 - RNA, 22 nt, Human
aacauguaucgcuuuuuaauau

SEQ ID NO: 685089 - RNA, 20 nt, Human
agauuauuccuaagauuucu

SEQ ID NO: 685090 - RNA, 22 nt, Human
ucuauccugcuuagaaguaugu

SEQ ID NO: 685091 - RNA, 23 nt, Human
ugcagggcaaguuagagacccca

SEQ ID NO: 685092 - RNA, 22 nt, Human
acaucuuugcucuuauagagcu

SEQ ID NO: 685093 - RNA, 20 nt, Human
uccuggccucccuggggcuc

SEQ ID NO: 685094 - RNA, 22 nt, Human
uuuccagauuaagauaccacuu

SEQ ID NO: 685095 - RNA, 22 nt, Human
uucagagcuggugucuacagcu

SEQ ID NO: 685096 - RNA, 22 nt, Human
cgugagcaaaauggacacuccc

SEQ ID NO: 685097 - RNA, 22 nt, Human
uuacagaagagaaagaauucag

SEQ ID NO: 685098 - RNA, 22 nt, Human
auguccugguccuccaccaugg

SEQ ID NO: 685099 - RNA, 23 nt, Human
agaauuucuaacucuagcucugu

SEQ ID NO: 685100 - RNA, 22 nt, Human
gcuucagauuccucuucuguaa

SEQ ID NO: 685101 - RNA, 22 nt, Human
aggacagugguguucuggagug

SEQ ID NO: 685102 - RNA, 22 nt, Human
cacacaugguagcagguacaag

SEQ ID NO: 685103 - RNA, 22 nt, Human
uacacauuacauaauacuaucu

SEQ ID NO: 685104 - RNA, 22 nt, Human
acucagagauauggugguugau

SEQ ID NO: 685105 - RNA, 22 nt, Human
aagccacucacaauaacugucc

SEQ ID NO: 685106 - RNA, 22 nt, Human
aagcugaugucccaguuugaag

SEQ ID NO: 685107 - RNA, 22 nt, Human
guccucuccaggaggcucugau

SEQ ID NO: 685108 - RNA, 22 nt, Human
uacacagaagccagaaggccug

SEQ ID NO: 685109 - RNA, 22 nt, Human
uucccuggggaaggugaccuuu

SEQ ID NO: 685110 - RNA, 21 nt, Human
ucauuguugcaugguaggggg

SEQ ID NO: 685111 - RNA, 22 nt, Human
agagcugauuugauuacagugc

SEQ ID NO: 685112 - RNA, 21 nt, Human
ggccagcagcguccacugugg

SEQ ID NO: 685113 - RNA, 22 nt, Human
uaccugagguaaggaugaugag

SEQ ID NO: 685114 - RNA, 22 nt, Human
uuuuagaaguucacuuggguuu

SEQ ID NO: 685115 - RNA, 16 nt, Human
gcuccugggcccucga

SEQ ID NO: 685116 - RNA, 22 nt, Human
ugcagugggccggaggccaggg

SEQ ID NO: 685117 - RNA, 19 nt, Human
cucagagaggggcagugcc

SEQ ID NO: 685118 - RNA, 21 nt, Human
ucucuggaauuagaccauguu

SEQ ID NO: 685119 - RNA, 22 nt, Human
aguccuggccccaaggaaggau

SEQ ID NO: 685120 - RNA, 17 nt, Human
aauugucagcaguagcu

SEQ ID NO: 685121 - RNA, 22 nt, Human
agaguucugcucuucucaguga

SEQ ID NO: 685122 - RNA, 22 nt, Human
gcugucagcgcccaaggagcuc

SEQ ID NO: 685123 - RNA, 22 nt, Human
aaugcaaugcagcaccuccuug

SEQ ID NO: 685124 - RNA, 22 nt, Human
uaaugaauaaacuugagaguca

SEQ ID NO: 685125 - RNA, 22 nt, Human
ugagaacauacaaacagagaaa

SEQ ID NO: 685126 - RNA, 22 nt, Human
aauggcaaaguguuuucauacc

SEQ ID NO: 685127 - RNA, 22 nt, Human
caggggaagaugccaagggaga

SEQ ID NO: 685128 - RNA, 22 nt, Human
gcagccugaugaucuggguugu

SEQ ID NO: 685129 - RNA, 22 nt, Human
ugggaaugggccuagaaggcug

SEQ ID NO: 685130 - RNA, 22 nt, Human
augaggccauggcugucacuaa

SEQ ID NO: 685131 - RNA, 22 nt, Human
uacacacuuacuggagaugaag

SEQ ID NO: 685132 - RNA, 22 nt, Human
ucaguaauuaccuaugacucga

SEQ ID NO: 685133 - RNA, 22 nt, Human
aagggcuguagacaagauugcu

SEQ ID NO: 685134 - RNA, 18 nt, Human
ggccucuggacuggcagc

SEQ ID NO: 685135 - RNA, 22 nt, Human
uuucucugcugccugugucgau

SEQ ID NO: 685136 - RNA, 22 nt, Human
caggcugacaacugagcauuuu

SEQ ID NO: 685137 - RNA, 22 nt, Human
caacagcuggaggcuuggcccg

SEQ ID NO: 685138 - RNA, 21 nt, Human
augucuguucuuucuggcagg

SEQ ID NO: 685139 - RNA, 22 nt, Human
uuucuacaugucaauccaaacc

SEQ ID NO: 685140 - RNA, 22 nt, Human
uaaccaaagggccuaaggaaug

SEQ ID NO: 685141 - RNA, 22 nt, Human
cagagggcugcccugaguucgu

SEQ ID NO: 685142 - RNA, 22 nt, Human
cugggaugucuauagaacacuu

SEQ ID NO: 685143 - RNA, 22 nt, Human
gcccugagauucuuggauucug

SEQ ID NO: 685144 - RNA, 17 nt, Human
gaaagguccuagaaauc

SEQ ID NO: 685145 - RNA, 22 nt, Human
cauguuaaguguuugauaacca

SEQ ID NO: 685146 - RNA, 22 nt, Human
cugaaggacacgugaggagcca

SEQ ID NO: 685147 - RNA, 22 nt, Human
auacaugugugagcgaagaugu

SEQ ID NO: 685148 - RNA, 22 nt, Human
uccugaauugaacucaguuaau

SEQ ID NO: 685149 - RNA, 22 nt, Human
agcagcauuaugauauaucuua

SEQ ID NO: 685150 - RNA, 22 nt, Human
cuuuugauugagcaguuucaaa

SEQ ID NO: 685151 - RNA, 22 nt, Human
guggccaguggugggcgcccug

SEQ ID NO: 685152 - RNA, 22 nt, Human
uucagggcagacagaagagaug

SEQ ID NO: 685153 - RNA, 22 nt, Human
gggaaggagguggcuugaagug

SEQ ID NO: 685154 - RNA, 22 nt, Human
uagcaucuugauuucagaccag

SEQ ID NO: 685155 - RNA, 22 nt, Human
cacugccugcuggcugucacuu

SEQ ID NO: 685156 - RNA, 22 nt, Human
uggcagauuuaacauuggaacu

SEQ ID NO: 685157 - RNA, 22 nt, Human
ucaguuuccucaucuacaaaag

SEQ ID NO: 685158 - RNA, 22 nt, Human
uuauguaugaauauaguagaag

SEQ ID NO: 685159 - RNA, 22 nt, Human
ucccugggacucagacauggaa

SEQ ID NO: 685160 - RNA, 22 nt, Human
ucauuguauucagaacugaaga

SEQ ID NO: 685161 - RNA, 17 nt, Human
ucauuucaguaaaucca

SEQ ID NO: 685162 - RNA, 22 nt, Human
caggagccagaggcggauggag

SEQ ID NO: 685163 - RNA, 22 nt, Human
cagagggaccagaacauacugu

SEQ ID NO: 685164 - RNA, 22 nt, Human
gagaagggauauggcuucuuga

SEQ ID NO: 685165 - RNA, 21 nt, Human
caugggguugcuauagcaaaa

SEQ ID NO: 685166 - RNA, 22 nt, Human
aucauugaauugcuuuguucuu

SEQ ID NO: 685167 - RNA, 22 nt, Human
gcagcauuaccaagacauggca

SEQ ID NO: 685168 - RNA, 22 nt, Human
acagguguagcaggagcaucaa

SEQ ID NO: 685169 - RNA, 22 nt, Human
aggcugcccugccgccaguggg

SEQ ID NO: 685170 - RNA, 22 nt, Human
auacaguagggaccaugucuga

SEQ ID NO: 685171 - RNA, 22 nt, Human
cugagcugggagccuggcacca

SEQ ID NO: 685172 - RNA, 22 nt, Human
uuucagacaggcucagagccgu

SEQ ID NO: 685173 - RNA, 22 nt, Human
ggacagugcgagacacaguaac

SEQ ID NO: 685174 - RNA, 22 nt, Human
ccaggcccaccuuggccacuua

SEQ ID NO: 685175 - RNA, 21 nt, Human
uuauaggcugggguuugcuuu

SEQ ID NO: 685176 - RNA, 22 nt, Human
caaggcagcccgcugaaccaca

SEQ ID NO: 685177 - RNA, 22 nt, Human
cugggaagaagggacaacagcg

SEQ ID NO: 685178 - RNA, 22 nt, Human
cuuuuacaguggaccugccauu

SEQ ID NO: 685179 - RNA, 22 nt, Human
cuggacucauccauagagguga

SEQ ID NO: 685180 - RNA, 22 nt, Human
ucucgacagccuggcacagugg

SEQ ID NO: 685181 - RNA, 22 nt, Human
ggugggugagcccugggagcug

SEQ ID NO: 685182 - RNA, 22 nt, Human
acgaugaugaaagagaacauuc

SEQ ID NO: 685183 - RNA, 22 nt, Human
cuuggaggaugugcggcugccc

SEQ ID NO: 685184 - RNA, 20 nt, Human
caacaugagcaagugaacug

SEQ ID NO: 685185 - RNA, 22 nt, Human
ugagagacacacugugcaugua

SEQ ID NO: 685186 - RNA, 22 nt, Human
gcuggccccgagugcuacgcuc

SEQ ID NO: 685187 - RNA, 22 nt, Human
ugcacaggugagacucaggaag

SEQ ID NO: 685188 - RNA, 22 nt, Human
ucagacagggcuucucaaacuu

SEQ ID NO: 685189 - RNA, 22 nt, Human
ggcugcaggaacgacggagggg

SEQ ID NO: 685190 - RNA, 22 nt, Human
agaaggccuaacuugggggcaa

SEQ ID NO: 685191 - RNA, 22 nt, Human
uguccugcaacugaaggagaag

SEQ ID NO: 685192 - RNA, 22 nt, Human
gugugggaauggcggucgugca

SEQ ID NO: 685193 - RNA, 22 nt, Human
ggccaaggcucuugagggcuga

SEQ ID NO: 685194 - RNA, 22 nt, Human
gagcagagaauccagcuaagug

SEQ ID NO: 685195 - RNA, 22 nt, Human
agacaucuugcacacauauacu

SEQ ID NO: 685196 - RNA, 22 nt, Human
caugaggauccaggugacaggc

SEQ ID NO: 685197 - RNA, 22 nt, Human
ucuaacucugccaggacacaga

SEQ ID NO: 685198 - RNA, 19 nt, Human
uguguucauucaucagagg

SEQ ID NO: 685199 - RNA, 22 nt, Human
aagauguaucaguuaagucuuc

SEQ ID NO: 685200 - RNA, 22 nt, Human
uucaguguuuguagagauaacu

SEQ ID NO: 685201 - RNA, 22 nt, Human
acuuuuugcuggucucuuccau

SEQ ID NO: 685202 - RNA, 23 nt, Human
ggcuugagcuggaacagcuuggu

SEQ ID NO: 685203 - RNA, 22 nt, Human
gucagcagugucagcucugggg

SEQ ID NO: 685204 - RNA, 22 nt, Human
gcugaaggaggcucugguacua

SEQ ID NO: 685205 - RNA, 22 nt, Human
uauuacagcuuugauuaucugg

SEQ ID NO: 685206 - RNA, 22 nt, Human
ugucuccaugugauaguggccu

SEQ ID NO: 685207 - RNA, 22 nt, Human
agccuguccagaggacagggcu

SEQ ID NO: 685208 - RNA, 22 nt, Human
ucagagaauuguuuaauggaau

SEQ ID NO: 685209 - RNA, 22 nt, Human
aaaaccacaaugacuuuugcag

SEQ ID NO: 685210 - RNA, 22 nt, Human
uuccccaguagugacaaucaaa

SEQ ID NO: 685211 - RNA, 22 nt, Human
cuuugauauaaguauacauagu

SEQ ID NO: 685212 - RNA, 22 nt, Human
caggcagcauuuacucugauga

SEQ ID NO: 685213 - RNA, 22 nt, Human
agcuccagaaagguacacacag

SEQ ID NO: 685214 - RNA, 22 nt, Human
augugucuugcggcaguuggua

SEQ ID NO: 685215 - RNA, 22 nt, Human
ggcucccuguucuauucccugg

SEQ ID NO: 685216 - RNA, 22 nt, Human
cuguauuucccacauucucuau

SEQ ID NO: 685217 - RNA, 22 nt, Human
augcaagagcaauaugguaugc

SEQ ID NO: 685218 - RNA, 22 nt, Human
gcuaggaaucggacccaggaag

SEQ ID NO: 685219 - RNA, 22 nt, Human
caaagauaugacauggaaaaug

SEQ ID NO: 685220 - RNA, 22 nt, Human
aacaauaacuagacaugccaug

SEQ ID NO: 685221 - RNA, 22 nt, Human
aauugucuugaaagcaacacuu

SEQ ID NO: 685222 - RNA, 20 nt, Human
cuuccaccagggccgcugau

SEQ ID NO: 685223 - RNA, 22 nt, Human
uggagccagagcgcagccuggg

SEQ ID NO: 685224 - RNA, 22 nt, Human
uccuuuaugugaguuguuuccc

SEQ ID NO: 685225 - RNA, 23 nt, Human
ucugugccaguuuccaugucugu

SEQ ID NO: 685226 - RNA, 22 nt, Human
gccuccccaaagugcugacagc

SEQ ID NO: 685227 - RNA, 22 nt, Human
cugcaguaaccacuguaggugu

SEQ ID NO: 685228 - RNA, 22 nt, Human
cauggcuucugaucaaggaacu

SEQ ID NO: 685229 - RNA, 21 nt, Human
aauucccagaaacagcacaag

SEQ ID NO: 685230 - RNA, 22 nt, Human
cuguaacuuaaugagaggcaga

SEQ ID NO: 685231 - RNA, 22 nt, Human
cucuuuuaugugacguguguga

SEQ ID NO: 685232 - RNA, 19 nt, Human
gggcaaagugaucguccug

SEQ ID NO: 685233 - RNA, 22 nt, Human
cagcuauugguccacagguaug

SEQ ID NO: 685234 - RNA, 22 nt, Human
ccucucaguauugaacuuuaua

SEQ ID NO: 685235 - RNA, 22 nt, Human
cucugcauuuuaacagaugauu

SEQ ID NO: 685236 - RNA, 22 nt, Human
aagacaaugcauuacuaagaag

SEQ ID NO: 685237 - RNA, 22 nt, Human
cuggagucacucauguagcugc

SEQ ID NO: 685238 - RNA, 22 nt, Human
uuuguuauaacaauaaaaaguc

SEQ ID NO: 685239 - RNA, 22 nt, Human
ugucugcagaagauggcauggg

SEQ ID NO: 685240 - RNA, 22 nt, Human
gcugucugggaggccuccacuu

SEQ ID NO: 685241 - RNA, 17 nt, Human
uggaaggcuucaauauu

SEQ ID NO: 685242 - RNA, 22 nt, Human
agaggccaaagaaucuacaaga

SEQ ID NO: 685243 - RNA, 22 nt, Human
ugugugacccccagugaagccu

SEQ ID NO: 685244 - RNA, 22 nt, Human
aacaaugccugaugaccuccug

SEQ ID NO: 685245 - RNA, 22 nt, Human
ugaggaugagaugagauaacac

SEQ ID NO: 685246 - RNA, 22 nt, Human
uuaggaaacgcugcuauugacu

SEQ ID NO: 685247 - RNA, 22 nt, Human
aaggcugaaagaccuugaaccu

SEQ ID NO: 685248 - RNA, 22 nt, Human
agaugugguuauucucuuccuu

SEQ ID NO: 685249 - RNA, 22 nt, Human
aggagcuaauucauaagccacu

SEQ ID NO: 685250 - RNA, 22 nt, Human
uguggggugugguccaggcauc

SEQ ID NO: 685251 - RNA, 18 nt, Human
ggagcccagaggacagga

SEQ ID NO: 685252 - RNA, 20 nt, Human
ugugggcccuuggcuggcaa

SEQ ID NO: 685253 - RNA, 18 nt, Human
uagagggggccugggcau

SEQ ID NO: 685254 - RNA, 22 nt, Human
accaccccaaaugaaccucugu

SEQ ID NO: 685255 - RNA, 22 nt, Human
auaugaguuucccacuucugga

SEQ ID NO: 685256 - RNA, 22 nt, Human
ucaggcucucagaccaacagca

SEQ ID NO: 685257 - RNA, 22 nt, Human
cucagagccaguuagcaggugc

SEQ ID NO: 685258 - RNA, 22 nt, Human
ugucucugcuuuccuugcaggg

SEQ ID NO: 685259 - RNA, 18 nt, Human
aaguuccacaagagaucu

SEQ ID NO: 685260 - RNA, 19 nt, Human
ggacuguugccaggccucu

SEQ ID NO: 685261 - RNA, 22 nt, Human
auguuucccuucugauuuggga

SEQ ID NO: 685262 - RNA, 22 nt, Human
uccaggcuuuuucaugcugucu

SEQ ID NO: 685263 - RNA, 22 nt, Human
cugucagagauggggagucaga

SEQ ID NO: 685264 - RNA, 22 nt, Human
ccagcccuguaaggaugaggca

SEQ ID NO: 685265 - RNA, 22 nt, Human
auagcaauuaagcuccagaauu

SEQ ID NO: 685266 - RNA, 22 nt, Human
guuucuaaauguucugaguuuu

SEQ ID NO: 685267 - RNA, 22 nt, Human
acugugagcagcgaccugagga

SEQ ID NO: 685268 - RNA, 22 nt, Human
agguggagacccagagaaggcg

SEQ ID NO: 685269 - RNA, 22 nt, Human
auguauaugaagcuaguauuuu

SEQ ID NO: 685270 - RNA, 22 nt, Human
acaugcacugcucaggguuccg

SEQ ID NO: 685271 - RNA, 22 nt, Human
agucacucugcuacaugacagc

SEQ ID NO: 685272 - RNA, 22 nt, Human
aaacucuaguaaaauguauuca

SEQ ID NO: 685273 - RNA, 22 nt, Human
guuuugaauacuacuagaacuu

SEQ ID NO: 685274 - RNA, 22 nt, Human
uccaggcaucccccaggacaga

SEQ ID NO: 685275 - RNA, 22 nt, Human
gcuggggccucugugagguuaa

SEQ ID NO: 685276 - RNA, 22 nt, Human
acuuuauuuccuauugcaucca

SEQ ID NO: 685277 - RNA, 18 nt, Human
aaugaaauguacaccuuu

SEQ ID NO: 685278 - RNA, 22 nt, Human
uaugugugcauguauacauuaa

SEQ ID NO: 685279 - RNA, 22 nt, Human
uggagcugaggggaaugcugag

SEQ ID NO: 685280 - RNA, 22 nt, Human
ugcagcuguuacggacccuguc

SEQ ID NO: 685281 - RNA, 22 nt, Human
uggcucagcuuuccccaucugg

SEQ ID NO: 685282 - RNA, 22 nt, Human
ucuuaauucugugucuucacua

SEQ ID NO: 685283 - RNA, 22 nt, Human
gagccucguggcggccacugcg

SEQ ID NO: 685284 - RNA, 22 nt, Human
ccagaauccaaaacguuuugag

SEQ ID NO: 685285 - RNA, 22 nt, Human
gcuuccaggcuuccuaccuuug

SEQ ID NO: 685286 - RNA, 18 nt, Human
ggacccagggccucaccc

SEQ ID NO: 685287 - RNA, 22 nt, Human
uugcugagcaguguuuaauugu

SEQ ID NO: 685288 - RNA, 19 nt, Human
agaagcugugaaaugaagg

SEQ ID NO: 685289 - RNA, 22 nt, Human
ucccagggucaguggugaggcc

SEQ ID NO: 685290 - RNA, 22 nt, Human
caggcccaugagggcagccaca

SEQ ID NO: 685291 - RNA, 22 nt, Human
agcuguuuaaaugacuuacuuu

SEQ ID NO: 685292 - RNA, 22 nt, Human
cagaaauggagcccaggaaucu

SEQ ID NO: 685293 - RNA, 22 nt, Human
cacugugcuccuuccuuagcac

SEQ ID NO: 685294 - RNA, 22 nt, Human
ucugugauagguggcauaguga

SEQ ID NO: 685295 - RNA, 22 nt, Human
aaauuccagaaacucaguauau

SEQ ID NO: 685296 - RNA, 22 nt, Human
ugagcuaggugugcagauauga

SEQ ID NO: 685297 - RNA, 22 nt, Human
cugugaccuccaggaaggggug

SEQ ID NO: 685298 - RNA, 22 nt, Human
gcacacaguacuauaugcuaca

SEQ ID NO: 685299 - RNA, 22 nt, Human
auggaugaguccuugagacaca

SEQ ID NO: 685300 - RNA, 22 nt, Human
gagagagaaaaugacuccggac

SEQ ID NO: 685301 - RNA, 21 nt, Human
cagagcugaaggguguagugu

SEQ ID NO: 685302 - RNA, 22 nt, Human
cccugcagaaccacagacaaac

SEQ ID NO: 685303 - RNA, 22 nt, Human
cccuccauuaaaacagaccuau

SEQ ID NO: 685304 - RNA, 22 nt, Human
gcaguacuuuaagggaugaagc

SEQ ID NO: 685305 - RNA, 22 nt, Human
auggaacugagcuugccaaacu

SEQ ID NO: 685306 - RNA, 17 nt, Human
agccugggaaggaguga

SEQ ID NO: 685307 - RNA, 22 nt, Human
uacagugauagagaguagcuau

SEQ ID NO: 685308 - RNA, 22 nt, Human
ggcagcuggguuggccagaaac

SEQ ID NO: 685309 - RNA, 22 nt, Human
agggcucagcaucucauucugu

SEQ ID NO: 685310 - RNA, 22 nt, Human
uuauugagcaccuacuaugugu

SEQ ID NO: 685311 - RNA, 22 nt, Human
ugcaccugagaggucucugagg

SEQ ID NO: 685312 - RNA, 22 nt, Human
augugcuuuaaagaagccagcu

SEQ ID NO: 685313 - RNA, 22 nt, Human
uacauccaaaugaauuagaauu

SEQ ID NO: 685314 - RNA, 22 nt, Human
aggcugcucaguagauggagcu

SEQ ID NO: 685315 - RNA, 22 nt, Human
uuuagguuuuuucacguggcua

SEQ ID NO: 685316 - RNA, 22 nt, Human
ucagacugaucaucuaucagau

SEQ ID NO: 685317 - RNA, 22 nt, Human
cacagguaauagccuaggcuau

SEQ ID NO: 685318 - RNA, 22 nt, Human
gaggccagaguuccccgaguca

SEQ ID NO: 685319 - RNA, 22 nt, Human
caguggggaggccaggauagaa

SEQ ID NO: 685320 - RNA, 22 nt, Human
ucaagaugaaagauguagccau

SEQ ID NO: 685321 - RNA, 22 nt, Human
aaacucuucauauacauaugcu

SEQ ID NO: 685322 - RNA, 22 nt, Human
aauaauauuugaagcuucaaag

SEQ ID NO: 685323 - RNA, 22 nt, Human
uauaguuaguuucauaaucaug

SEQ ID NO: 685324 - RNA, 22 nt, Human
gccagagggauuccuggugugu

SEQ ID NO: 685325 - RNA, 22 nt, Human
cagggacaauggcagagccuga

SEQ ID NO: 685326 - RNA, 22 nt, Human
aggagucagauuguuugaaugu

SEQ ID NO: 685327 - RNA, 23 nt, Human
uggagaugccccacucccugucu

SEQ ID NO: 685328 - RNA, 22 nt, Human
cugcugccugacaauuuagguu

SEQ ID NO: 685329 - RNA, 22 nt, Human
ugugaaaucacaggcuauuuag

SEQ ID NO: 685330 - RNA, 22 nt, Human
uuacaacugggcuugucagcuu

SEQ ID NO: 685331 - RNA, 22 nt, Human
ugguccauguccuccaucucuc

SEQ ID NO: 685332 - RNA, 22 nt, Human
accuguggaucagauucuugua

SEQ ID NO: 685333 - RNA, 22 nt, Human
agcaaagcugauuaagagcaca

SEQ ID NO: 685334 - RNA, 22 nt, Human
uccagagcugggucugugcuca

SEQ ID NO: 685335 - RNA, 22 nt, Human
gugcaaaaguaauugcgguuuu

SEQ ID NO: 685336 - RNA, 22 nt, Human
cagcugggcuaagaguagaggc

SEQ ID NO: 685337 - RNA, 22 nt, Human
guaaacaaacucucaggccagu

SEQ ID NO: 685338 - RNA, 19 nt, Human
acccucugccacaagccuc

SEQ ID NO: 685339 - RNA, 22 nt, Human
guguggcugugggagauguuca

SEQ ID NO: 685340 - RNA, 22 nt, Human
gaauguccuccuggaucacucc

SEQ ID NO: 685341 - RNA, 22 nt, Human
gaggaggaggaaguggaaccca

SEQ ID NO: 685342 - RNA, 22 nt, Human
aaacacagggauauauauucca

SEQ ID NO: 685343 - RNA, 22 nt, Human
auaggaaugugauuuauaaaug

SEQ ID NO: 685344 - RNA, 22 nt, Human
gucauucuuaacaacucaguag

SEQ ID NO: 685345 - RNA, 19 nt, Human
gacucacaccuuccgcugu

SEQ ID NO: 685346 - RNA, 22 nt, Human
aaggucugcuuguuuucuugag

SEQ ID NO: 685347 - RNA, 22 nt, Human
acuguaacacaaugguaucugu

SEQ ID NO: 685348 - RNA, 22 nt, Human
ugacucucccaaguuugaggga

SEQ ID NO: 685349 - RNA, 22 nt, Human
cuguggcuggccuuauugcugc

SEQ ID NO: 685350 - RNA, 22 nt, Human
cugguccuaaagcccuacucca

SEQ ID NO: 685351 - RNA, 22 nt, Human
aguccuggguccagcagguccu

SEQ ID NO: 685352 - RNA, 22 nt, Human
acacauuuucuaacagggauca

SEQ ID NO: 685353 - RNA, 22 nt, Human
ggccaccuuaaguuaaggauau

SEQ ID NO: 685354 - RNA, 22 nt, Human
aaugaugguauugaugagcuaa

SEQ ID NO: 685355 - RNA, 22 nt, Human
aaguggaggccgaguucacgca

SEQ ID NO: 685356 - RNA, 22 nt, Human
uacaaugcauucguugucucgg

SEQ ID NO: 685357 - RNA, 22 nt, Human
uaaauguguaaaccuccauuac

SEQ ID NO: 685358 - RNA, 22 nt, Human
cccugccuuguuggagccuaug

SEQ ID NO: 685359 - RNA, 22 nt, Human
cacagugaagcaugcagacauc

SEQ ID NO: 685360 - RNA, 22 nt, Human
gucaccagcaccaaugccacau

SEQ ID NO: 685361 - RNA, 22 nt, Human
uuuguugacaucccuguacuuu

SEQ ID NO: 685362 - RNA, 22 nt, Human
aaggucuguggccaccucuggg

SEQ ID NO: 685363 - RNA, 21 nt, Human
agugucugagcgcugcuucug

SEQ ID NO: 685364 - RNA, 22 nt, Human
agggagcugagcugugagcagc

SEQ ID NO: 685365 - RNA, 22 nt, Human
aaagcucuuaaugagauuaucc

SEQ ID NO: 685366 - RNA, 22 nt, Human
aaguggcaguucaggaagcaga

SEQ ID NO: 685367 - RNA, 22 nt, Human
cugggaagcuucgagcaggaaa

SEQ ID NO: 685368 - RNA, 22 nt, Human
guaggagcucauggggccagga

SEQ ID NO: 685369 - RNA, 22 nt, Human
gguguccucacuauagcaaguc

SEQ ID NO: 685370 - RNA, 22 nt, Human
uaggcagauguuaacaggaaaa

SEQ ID NO: 685371 - RNA, 22 nt, Human
cagcaucucugccugccugcaa

SEQ ID NO: 685372 - RNA, 23 nt, Human
acucacaaagcaggaucauguug

SEQ ID NO: 685373 - RNA, 22 nt, Human
cagcuuuaccaauauuuggaaa

SEQ ID NO: 685374 - RNA, 20 nt, Human
cucaguaaaagcacaggguc

SEQ ID NO: 685375 - RNA, 22 nt, Human
gcagccaggcuacagcgggcuu

SEQ ID NO: 685376 - RNA, 22 nt, Human
guccucagcaccagaacuaggg

SEQ ID NO: 685377 - RNA, 22 nt, Human
aguuuagaaaaucuguuucuuc

SEQ ID NO: 685378 - RNA, 22 nt, Human
aggcaguguguagcuggaagag

SEQ ID NO: 685379 - RNA, 22 nt, Human
cugggcccacgagggcucuggg

SEQ ID NO: 685380 - RNA, 22 nt, Human
uuuagggaugucagaacaggga

SEQ ID NO: 685381 - RNA, 18 nt, Human
uggagccauugccaccau

SEQ ID NO: 685382 - RNA, 22 nt, Human
ugaggacauuggucaggacaug

SEQ ID NO: 685383 - RNA, 22 nt, Human
uaucaucugcaaagcacaucua

SEQ ID NO: 685384 - RNA, 22 nt, Human
cccucaggugaaaggaaaaauu

SEQ ID NO: 685385 - RNA, 22 nt, Human
auaaacugaagggaacacugag

SEQ ID NO: 685386 - RNA, 22 nt, Human
ugcugaggagggcacccggggg

SEQ ID NO: 685387 - RNA, 19 nt, Human
agggccaggauucuggaac

SEQ ID NO: 685388 - RNA, 22 nt, Human
cuggaucuguccccuuuuuguu

SEQ ID NO: 685389 - RNA, 22 nt, Human
acucaucaacuguuacaaaugu

SEQ ID NO: 685390 - RNA, 22 nt, Human
uuggacugaaucuuucucacac

SEQ ID NO: 685391 - RNA, 22 nt, Human
uucuggagacccagcaacaggg

SEQ ID NO: 685392 - RNA, 21 nt, Human
gcuggcuggcugaccggccuu

SEQ ID NO: 685393 - RNA, 22 nt, Human
aggaccagugagucuggcaagu

SEQ ID NO: 685394 - RNA, 22 nt, Human
gcucugagagagcaaagucacc

SEQ ID NO: 685395 - RNA, 22 nt, Human
ucagaaauuuaggcuggacuug

SEQ ID NO: 685396 - RNA, 22 nt, Human
ucaagaaggagacuccacugug

SEQ ID NO: 685397 - RNA, 22 nt, Human
ucagcuccagaguugcacagug

SEQ ID NO: 685398 - RNA, 22 nt, Human
gcucgcgccgcaccgguccacc

SEQ ID NO: 685399 - RNA, 22 nt, Human
cgcucuggagaauaguagcuuu

SEQ ID NO: 685400 - RNA, 22 nt, Human
acagguacauacuugggaucca

SEQ ID NO: 685401 - RNA, 18 nt, Human
guuuugaauugucuuaca

SEQ ID NO: 685402 - RNA, 22 nt, Human
gggacuucauagcuaggcacuu

SEQ ID NO: 685403 - RNA, 22 nt, Human
cugugugcugaaaugcagugag

SEQ ID NO: 685404 - RNA, 22 nt, Human
aauuacacagggaucacuuuuu

SEQ ID NO: 685405 - RNA, 22 nt, Human
agaggcagccguauuucaaagg

SEQ ID NO: 685406 - RNA, 22 nt, Human
ggcugcuggauuguguaucugu

SEQ ID NO: 685407 - RNA, 22 nt, Human
uucacaguggcuuaggcuaugg

SEQ ID NO: 685408 - RNA, 22 nt, Human
gcaauacaguagguuuauuggu

SEQ ID NO: 685409 - RNA, 22 nt, Human
aggaaucaggagaugagcacgg

SEQ ID NO: 685410 - RNA, 22 nt, Human
ggucagagggugggcugccugu

SEQ ID NO: 685411 - RNA, 22 nt, Human
guaugaaguaagauauuguuca

SEQ ID NO: 685412 - RNA, 22 nt, Human
cggccaggcacaguggcccacg

SEQ ID NO: 685413 - RNA, 22 nt, Human
cugcugucgccgagcugcaugc

SEQ ID NO: 685414 - RNA, 22 nt, Human
guggguggaucaugaggucagg

SEQ ID NO: 685415 - RNA, 22 nt, Human
auguaauuuauguuauccauaa

SEQ ID NO: 685416 - RNA, 22 nt, Human
aauaugugagguauguucagug

SEQ ID NO: 685417 - RNA, 22 nt, Human
acagggcagagugaaaugcuau

SEQ ID NO: 685418 - RNA, 22 nt, Human
ggucagaacaagcaaauaauag

SEQ ID NO: 685419 - RNA, 23 nt, Human
aagagcuauacauucaccuggua

SEQ ID NO: 685420 - RNA, 22 nt, Human
gggcagugucgaggucuggucc

SEQ ID NO: 685421 - RNA, 22 nt, Human
uggacagcgaaagugccuggga

SEQ ID NO: 685422 - RNA, 22 nt, Human
caaugggagcagaaauuguuug

SEQ ID NO: 685423 - RNA, 22 nt, Human
cauuucaaacaguuacagcugc

SEQ ID NO: 685424 - RNA, 18 nt, Human
acagcagguuucauucuu

SEQ ID NO: 685425 - RNA, 22 nt, Human
ucauuauucucuuuaauguucu

SEQ ID NO: 685426 - RNA, 22 nt, Human
aagaacauugauauugucuaug

SEQ ID NO: 685427 - RNA, 23 nt, Human
cucccuggcccuugggagaccug

SEQ ID NO: 685428 - RNA, 22 nt, Human
ucuguagcauucaccagcccug

SEQ ID NO: 685429 - RNA, 22 nt, Human
aagcagaugcguuggagcaguu

SEQ ID NO: 685430 - RNA, 22 nt, Human
ugcuuccacuaaugagcugugu

SEQ ID NO: 685431 - RNA, 22 nt, Human
gagaaguuguaggagaauuuug

SEQ ID NO: 685432 - RNA, 23 nt, Human
aacuuugccaggagacagcacag

SEQ ID NO: 685433 - RNA, 22 nt, Human
acuguggauaagucagagaugu

SEQ ID NO: 685434 - RNA, 22 nt, Human
gcuggcuuugcacugggugcau

SEQ ID NO: 685435 - RNA, 22 nt, Human
cacuugaaugagaauuuccugg

SEQ ID NO: 685436 - RNA, 22 nt, Human
agacaaugucaaggugaucauc

SEQ ID NO: 685437 - RNA, 19 nt, Human
uacauuuguguacacuugu

SEQ ID NO: 685438 - RNA, 23 nt, Human
auuuacagguuaaaugaaaucag

SEQ ID NO: 685439 - RNA, 22 nt, Human
cugagaauuacucugaugagua

SEQ ID NO: 685440 - RNA, 22 nt, Human
ugaaguauccaucuuguucuag

SEQ ID NO: 685441 - RNA, 22 nt, Human
uaaugucuaugggccagauaau

SEQ ID NO: 685442 - RNA, 22 nt, Human
ugagaugguugaccagagagca

SEQ ID NO: 685443 - RNA, 22 nt, Human
gccagagcuucccccgagugug

SEQ ID NO: 685444 - RNA, 22 nt, Human
cugaccugcuaagccccugucc

SEQ ID NO: 685445 - RNA, 18 nt, Human
cagaagcaggcagugcag

SEQ ID NO: 685446 - RNA, 22 nt, Human
ucagaagcaagcuucuacuucu

SEQ ID NO: 685447 - RNA, 23 nt, Human
ucuucaugcccaggccuuggugc

SEQ ID NO: 685448 - RNA, 22 nt, Human
gacccucauugucaccgugagc

SEQ ID NO: 685449 - RNA, 22 nt, Human
agagaaaagccaucccagccaa

SEQ ID NO: 685450 - RNA, 22 nt, Human
uucuaaauggggauccuuucug

SEQ ID NO: 685451 - RNA, 22 nt, Human
gcacacaggcaguuuccagcca

SEQ ID NO: 685452 - RNA, 22 nt, Human
aggaggccgauuucagaggucg

SEQ ID NO: 685453 - RNA, 22 nt, Human
ugggcuuuaucaugggucuggu

SEQ ID NO: 685454 - RNA, 22 nt, Human
agcaauagacacaagauggaua

SEQ ID NO: 685455 - RNA, 22 nt, Human
cugugucccaguaccuugggua

SEQ ID NO: 685456 - RNA, 22 nt, Human
acuucaaaugugacaaugugaa

SEQ ID NO: 685457 - RNA, 22 nt, Human
gggaggcuggcucuggccacag

SEQ ID NO: 685458 - RNA, 23 nt, Human
uugaaggagaaagcuuucuuggu

SEQ ID NO: 685459 - RNA, 22 nt, Human
cgaguccaggguuaggaguccg

SEQ ID NO: 685460 - RNA, 22 nt, Human
caguggaaacuaugcugcugga

SEQ ID NO: 685461 - RNA, 22 nt, Human
ugugauucaagaaaguaaaaug

SEQ ID NO: 685462 - RNA, 22 nt, Human
agcagccucuguagaggucucc

SEQ ID NO: 685463 - RNA, 22 nt, Human
cuggagaacuaguuaaacacgu

SEQ ID NO: 685464 - RNA, 22 nt, Human
acagccagggcauugucgccga

SEQ ID NO: 685465 - RNA, 22 nt, Human
ugcuuugaaagauaauacuguc

SEQ ID NO: 685466 - RNA, 22 nt, Human
ugucauuuccugaaugcugagu

SEQ ID NO: 685467 - RNA, 22 nt, Human
cugcaggcauuuauucaugcaa

SEQ ID NO: 685468 - RNA, 22 nt, Human
ggcugccuucccugagccccgg

SEQ ID NO: 685469 - RNA, 22 nt, Human
gcccagggcagggcaagaguga

SEQ ID NO: 685470 - RNA, 22 nt, Human
ccucuggucccagcucugcugc

SEQ ID NO: 685471 - RNA, 22 nt, Human
augggaugcauggcuguggcca

SEQ ID NO: 685472 - RNA, 22 nt, Human
gcuuucugccugggcuccauuu

SEQ ID NO: 685473 - RNA, 22 nt, Human
gcaggcaauuuuggaaggucag

SEQ ID NO: 685474 - RNA, 22 nt, Human
aauaucuucuaaggauagaacu

SEQ ID NO: 685475 - RNA, 22 nt, Human
ucugucugacuaccaugaggca

SEQ ID NO: 685476 - RNA, 23 nt, Human
ggacacugcuauaaaggaucugc

SEQ ID NO: 685477 - RNA, 22 nt, Human
ucaaaccugcugucuuguucau

SEQ ID NO: 685478 - RNA, 22 nt, Human
gcugugauguggagggugcuga

SEQ ID NO: 685479 - RNA, 22 nt, Human
ccaggaggcaauaucaagucca

SEQ ID NO: 685480 - RNA, 22 nt, Human
agcuaaugaaauauuuucugau

SEQ ID NO: 685481 - RNA, 22 nt, Human
auuccuugggcugccuuauuau

SEQ ID NO: 685482 - RNA, 22 nt, Human
aggcacaggaaugucauccagu

SEQ ID NO: 685483 - RNA, 22 nt, Human
cuuccuucugaagcauagaagc

SEQ ID NO: 685484 - RNA, 22 nt, Human
uggcuucauguaguuugaguug

SEQ ID NO: 685485 - RNA, 22 nt, Human
gccacagguacuaugggagaga

SEQ ID NO: 685486 - RNA, 22 nt, Human
cacaggugcuccucggggagcu

SEQ ID NO: 685487 - RNA, 22 nt, Human
cuggggacgucgggcaguguuc

SEQ ID NO: 685488 - RNA, 20 nt, Human
cgcauaguuuccaucauucc

SEQ ID NO: 685489 - RNA, 22 nt, Human
ugacacaguugucgacucuaca

SEQ ID NO: 685490 - RNA, 22 nt, Human
aggccucugcuggaaagaguug

SEQ ID NO: 685491 - RNA, 22 nt, Human
ugcccuccacaguggcuccacc

SEQ ID NO: 685492 - RNA, 19 nt, Human
guuuucugaucuugccccc

SEQ ID NO: 685493 - RNA, 22 nt, Human
auccccagaaaauaggugccua

SEQ ID NO: 685494 - RNA, 22 nt, Human
gcaugagacuagcucaugagca

SEQ ID NO: 685495 - RNA, 22 nt, Human
ggcuagaaacucaggcaagaaa

SEQ ID NO: 685496 - RNA, 22 nt, Human
ugcaggcuggaggagggacuaa

SEQ ID NO: 685497 - RNA, 22 nt, Human
cucucuggguccucuuuuauag

SEQ ID NO: 685498 - RNA, 22 nt, Human
ucccugggucauucucuggcac

SEQ ID NO: 685499 - RNA, 22 nt, Human
cugccagucuaugcugcucggc

SEQ ID NO: 685500 - RNA, 23 nt, Human
ucugagggagugggcaguggcac

SEQ ID NO: 685501 - RNA, 22 nt, Human
acucagaguuugcguuccauac

SEQ ID NO: 685502 - RNA, 22 nt, Human
caggcccugccuugagggaccu

SEQ ID NO: 685503 - RNA, 22 nt, Human
aagacuuucucccaaauccuca

SEQ ID NO: 685504 - RNA, 22 nt, Human
uauuucuguuuauuuguacauc

SEQ ID NO: 685505 - RNA, 22 nt, Human
gcugccuuuagggggugcucag

SEQ ID NO: 685506 - RNA, 22 nt, Human
gccugcagggugaugggcugcc

SEQ ID NO: 685507 - RNA, 22 nt, Human
ugcuggggagugauugaccauc

SEQ ID NO: 685508 - RNA, 22 nt, Human
gcaguaaguuaauagugcuggu

SEQ ID NO: 685509 - RNA, 22 nt, Human
cagcuuuccccgugccucagcc

SEQ ID NO: 685510 - RNA, 22 nt, Human
cagaauuugaaguaauauucca

SEQ ID NO: 685511 - RNA, 20 nt, Human
uuucuugucggcuguugcug

SEQ ID NO: 685512 - RNA, 22 nt, Human
uacauguuauuucacuauuggu

SEQ ID NO: 685513 - RNA, 22 nt, Human
ugaguccauugauggauaguga

SEQ ID NO: 685514 - RNA, 22 nt, Human
ucagauuuuccacagacuggaa

SEQ ID NO: 685515 - RNA, 17 nt, Human
uccuggcaguccccugg

SEQ ID NO: 685516 - RNA, 22 nt, Human
caggcuugauuauucagacaau

SEQ ID NO: 685517 - RNA, 22 nt, Human
uucuggcaucugggggaggccu

SEQ ID NO: 685518 - RNA, 22 nt, Human
gggcucuggacccaggcaagag

SEQ ID NO: 685519 - RNA, 22 nt, Human
ugcuccuauccuccugcugaca

SEQ ID NO: 685520 - RNA, 22 nt, Human
aaagcaaugggucuaagguaaa

SEQ ID NO: 685521 - RNA, 22 nt, Human
cuuugccauguugccugcagaa

SEQ ID NO: 685522 - RNA, 22 nt, Human
cauagcaacagcaucaagucaa

SEQ ID NO: 685523 - RNA, 22 nt, Human
acaguuuauguaaagcugccaa

SEQ ID NO: 685524 - RNA, 22 nt, Human
cucagggacuuggauccuggcc

SEQ ID NO: 685525 - RNA, 22 nt, Human
acaugcaugugaauauggacac

SEQ ID NO: 685526 - RNA, 22 nt, Human
ugggaccuguuacauugaguua

SEQ ID NO: 685527 - RNA, 22 nt, Human
aagauguuacucaaccaggaua

SEQ ID NO: 685528 - RNA, 21 nt, Human
cagugccccagcuacaaaagg

SEQ ID NO: 685529 - RNA, 22 nt, Human
aaacagcaauuacuuuugcacc

SEQ ID NO: 685530 - RNA, 22 nt, Human
gaggugcuuccuuugggcucug

SEQ ID NO: 685531 - RNA, 22 nt, Human
cauuuacagcagacugaugaaa

SEQ ID NO: 685532 - RNA, 22 nt, Human
ugcuugugugagggccugggag

SEQ ID NO: 685533 - RNA, 22 nt, Human
uuuguacauuucacuccauugu

SEQ ID NO: 685534 - RNA, 22 nt, Human
uacaugaaauaggauucuggag

SEQ ID NO: 685535 - RNA, 22 nt, Human
uggcuucauucagcaugacagu

SEQ ID NO: 685536 - RNA, 22 nt, Human
acauguguauagccuguauaga

SEQ ID NO: 685537 - RNA, 22 nt, Human
uggcuuucgcuauagagcacgg

SEQ ID NO: 685538 - RNA, 22 nt, Human
uucugcauuauacacaaccuaa

SEQ ID NO: 685539 - RNA, 22 nt, Human
cuccaggcccacgucgaggagg

SEQ ID NO: 685540 - RNA, 22 nt, Human
ugagcuuacuucuguacacaga

SEQ ID NO: 685541 - RNA, 22 nt, Human
uuucuauugaucuaauaaacau

SEQ ID NO: 685542 - RNA, 22 nt, Human
aagaggaauggguguguuuaug

SEQ ID NO: 685543 - RNA, 22 nt, Human
ucauacaagaucacuuuggcca

SEQ ID NO: 685544 - RNA, 23 nt, Human
uauuagggccaggacuggcaaau

SEQ ID NO: 685545 - RNA, 22 nt, Human
guugaaacuuaguugaaauuua

SEQ ID NO: 685546 - RNA, 22 nt, Human
caggaggcaggugcauuuugag

SEQ ID NO: 685547 - RNA, 22 nt, Human
cagguccagucacuggucugca

SEQ ID NO: 685548 - RNA, 22 nt, Human
augagauaggaacaaacuuaca

SEQ ID NO: 685549 - RNA, 18 nt, Human
cugcugcaggcacucagg

SEQ ID NO: 685550 - RNA, 22 nt, Human
augaugguaaauucaguauccg

SEQ ID NO: 685551 - RNA, 22 nt, Human
caaagaagagauuuacagagcu

SEQ ID NO: 685552 - RNA, 22 nt, Human
aaucuucacucauucagaguug

SEQ ID NO: 685553 - RNA, 22 nt, Human
ucagauauagucauuuaaauaa

SEQ ID NO: 685554 - RNA, 22 nt, Human
aggacccagaggcagaggacgu

SEQ ID NO: 685555 - RNA, 22 nt, Human
uuucuuaaauauuugcaggaca

SEQ ID NO: 685556 - RNA, 22 nt, Human
ggcugcaguuugucuuuugcuu

SEQ ID NO: 685557 - RNA, 23 nt, Human
aaaaucuucugccuaugaagaaa

SEQ ID NO: 685558 - RNA, 22 nt, Human
uccagggagauacuggcugcca

SEQ ID NO: 685559 - RNA, 17 nt, Human
agaacuguaguagcucc

SEQ ID NO: 685560 - RNA, 22 nt, Human
aacuguauacaauugucagaca

SEQ ID NO: 685561 - RNA, 18 nt, Human
cucauguguggucccagc

SEQ ID NO: 685562 - RNA, 22 nt, Human
gcagcuggcucugggaaaaacu

SEQ ID NO: 685563 - RNA, 22 nt, Human
auacacacaaucagguuuugua

SEQ ID NO: 685564 - RNA, 22 nt, Human
ggagcuguguuauccauuccca

SEQ ID NO: 685565 - RNA, 22 nt, Human
guagacagcaaccaaaccaggu

SEQ ID NO: 685566 - RNA, 22 nt, Human
cacugacuccaaaaauaaagaa

SEQ ID NO: 685567 - RNA, 21 nt, Human
ccagccucagaucagggagcu

SEQ ID NO: 685568 - RNA, 22 nt, Human
aggagcugcagauucugccuug

SEQ ID NO: 685569 - RNA, 22 nt, Human
ucagagaaggcugagucacggc

SEQ ID NO: 685570 - RNA, 23 nt, Human
gccuggccaccccagggcugcuu

SEQ ID NO: 685571 - RNA, 22 nt, Human
ucuucacaggagccugccugcc

SEQ ID NO: 685572 - RNA, 22 nt, Human
cagucucugugccagauccugg

SEQ ID NO: 685573 - RNA, 22 nt, Human
aucugcuuccugggcuccauga

SEQ ID NO: 685574 - RNA, 20 nt, Human
uucagggcuuuggggacacc

SEQ ID NO: 685575 - RNA, 22 nt, Human
uccugguggucugugcuucuuc

SEQ ID NO: 685576 - RNA, 22 nt, Human
gcucagugcaucauuccaggcu

SEQ ID NO: 685577 - RNA, 22 nt, Human
ucuggcucucauacucgccagu

SEQ ID NO: 685578 - RNA, 22 nt, Human
uguuuacuuaaauguuuucaua

SEQ ID NO: 685579 - RNA, 22 nt, Human
acaguuuaucgauucaccuacc

SEQ ID NO: 685580 - RNA, 22 nt, Human
gcuccagcucuguucuggggaa

SEQ ID NO: 685581 - RNA, 22 nt, Human
ugcagcugcuugauucaucuug

SEQ ID NO: 685582 - RNA, 22 nt, Human
guuugcauuucuugaacuauau

SEQ ID NO: 685583 - RNA, 22 nt, Human
cugccuggacagcucuuaccuu

SEQ ID NO: 685584 - RNA, 22 nt, Human
gcucccugugcucugagugaua

SEQ ID NO: 685585 - RNA, 22 nt, Human
ccauuggagaguuuuaagaagg

SEQ ID NO: 685586 - RNA, 22 nt, Human
cuaguugcucuccuuuaaaccu

SEQ ID NO: 685587 - RNA, 22 nt, Human
gcuggccauggccugcgccauc

SEQ ID NO: 685588 - RNA, 22 nt, Human
augucagaagcuggaugacagc

SEQ ID NO: 685589 - RNA, 22 nt, Human
aggcucaggugccucauucaca

SEQ ID NO: 685590 - RNA, 22 nt, Human
gcauugaaauggcaaaaagaga

SEQ ID NO: 685591 - RNA, 22 nt, Human
agcugaaauucacaaggaucca

SEQ ID NO: 685592 - RNA, 22 nt, Human
uucugggaugugaaugguuuaa

SEQ ID NO: 685593 - RNA, 22 nt, Human
uucaguuuucuuuagaauguag

SEQ ID NO: 685594 - RNA, 22 nt, Human
ucccacacuacacgguuguugg

SEQ ID NO: 685595 - RNA, 22 nt, Human
cagcuccugccugggcagcugu

SEQ ID NO: 685596 - RNA, 22 nt, Human
agagagcucugaugggagguga

SEQ ID NO: 685597 - RNA, 22 nt, Human
gacaugcauuaagacacacuga

SEQ ID NO: 685598 - RNA, 19 nt, Human
aggcaccuugauggcuucc

SEQ ID NO: 685599 - RNA, 22 nt, Human
cuucugcaauaaguuuuggucc

SEQ ID NO: 685600 - RNA, 22 nt, Human
ucacuguagugagcagaauaua

SEQ ID NO: 685601 - RNA, 17 nt, Human
uuguguguaguucugau

SEQ ID NO: 685602 - RNA, 22 nt, Human
cauacuuugggauaagagugga

SEQ ID NO: 685603 - RNA, 22 nt, Human
uccugggguuuagagggaagug

SEQ ID NO: 685604 - RNA, 22 nt, Human
gcucagagaauuuacugcugcc

SEQ ID NO: 685605 - RNA, 22 nt, Human
auggcugugaaaugguaggugg

SEQ ID NO: 685606 - RNA, 22 nt, Human
aucucuuaugucacauaaacca

SEQ ID NO: 685607 - RNA, 22 nt, Human
cacacuguugaggacgagaugu

SEQ ID NO: 685608 - RNA, 22 nt, Human
caaaaguaauugugguuuuugc

SEQ ID NO: 685609 - RNA, 22 nt, Human
aaagagcauggaaaguucagga

SEQ ID NO: 685610 - RNA, 22 nt, Human
aauuucagagguagagauucua

SEQ ID NO: 685611 - RNA, 22 nt, Human
ggggccaguaggagugauguac

SEQ ID NO: 685612 - RNA, 22 nt, Human
uggcccucguccgacagguggg

SEQ ID NO: 685613 - RNA, 18 nt, Human
cacccuccgcggcugccc

SEQ ID NO: 685614 - RNA, 22 nt, Human
guuccagguggucacagagcuc

SEQ ID NO: 685615 - RNA, 20 nt, Human
gcugcucgcugcagucacuc

SEQ ID NO: 685616 - RNA, 22 nt, Human
acauuuagaguucuuuacucca

SEQ ID NO: 685617 - RNA, 22 nt, Human
ucuuuguuuguacuguuagaau

SEQ ID NO: 685618 - RNA, 22 nt, Human
gcagggugacguugcccaccuc

SEQ ID NO: 685619 - RNA, 22 nt, Human
aagucacagaacccauuguaac

SEQ ID NO: 685620 - RNA, 23 nt, Human
caggaaauguucuugaagccuga

SEQ ID NO: 685621 - RNA, 22 nt, Human
agugggucagagagcuccagau

SEQ ID NO: 685622 - RNA, 19 nt, Human
ugcuccaggccuugccgca

SEQ ID NO: 685623 - RNA, 22 nt, Human
acuaagugggacauuuacuagg

SEQ ID NO: 685624 - RNA, 22 nt, Human
uguguuccuucgucuucccuuc

SEQ ID NO: 685625 - RNA, 22 nt, Human
ccaucugacugccacccaggcc

SEQ ID NO: 685626 - RNA, 22 nt, Human
ucucugagcucaggagcugcag

SEQ ID NO: 685627 - RNA, 22 nt, Human
ugagacaguaucgccccaaggc

SEQ ID NO: 685628 - RNA, 22 nt, Human
uucuggagccccaagaucugua

SEQ ID NO: 685629 - RNA, 22 nt, Human
cacuggcugagcuucucuaggg

SEQ ID NO: 685630 - RNA, 22 nt, Human
gacugugggaagacuguagguu

SEQ ID NO: 685631 - RNA, 22 nt, Human
aggcaguuuauccccagagccu

SEQ ID NO: 685632 - RNA, 22 nt, Human
ggcuccagguacguaugggagg

SEQ ID NO: 685633 - RNA, 22 nt, Human
ugcucaguccuccugcagugcc

SEQ ID NO: 685634 - RNA, 22 nt, Human
ucuugauuuugugaauaaguug

SEQ ID NO: 685635 - RNA, 22 nt, Human
ccagaggaauugggaaacaugu

SEQ ID NO: 685636 - RNA, 22 nt, Human
aagcuguguaaguugcuugguu

SEQ ID NO: 685637 - RNA, 23 nt, Human
gcagacagagcagacuaagacaa

SEQ ID NO: 685638 - RNA, 22 nt, Human
gcauggccuugugcuccuucuc

SEQ ID NO: 685639 - RNA, 22 nt, Human
gggagucagugaaggagucaga

SEQ ID NO: 685640 - RNA, 22 nt, Human
uuauucagcagggacuuccuuu

SEQ ID NO: 685641 - RNA, 22 nt, Human
uggccugucuuguugugcuaga

SEQ ID NO: 685642 - RNA, 22 nt, Human
gcaggcagccacgauucccuug

SEQ ID NO: 685643 - RNA, 22 nt, Human
gauuuuaucgucauccuucugg

SEQ ID NO: 685644 - RNA, 22 nt, Human
cuggcuuucugcacagaauugg

SEQ ID NO: 685645 - RNA, 22 nt, Human
accaggaguugggggugggacc

SEQ ID NO: 685646 - RNA, 18 nt, Human
gggcaagcggcugucacc

SEQ ID NO: 685647 - RNA, 22 nt, Human
agcuggcuucucugcagacauu

SEQ ID NO: 685648 - RNA, 22 nt, Human
uagcagcucacuaacucugcgu

SEQ ID NO: 685649 - RNA, 22 nt, Human
ugagcagaaaagaaugcugagc

SEQ ID NO: 685650 - RNA, 21 nt, Human
ucuaugcaagacccuaguccu

SEQ ID NO: 685651 - RNA, 22 nt, Human
cuucuuugugccuauuggugac

SEQ ID NO: 685652 - RNA, 22 nt, Human
ucuucagaagaucacaucagug

SEQ ID NO: 685653 - RNA, 22 nt, Human
acacagugucuuagguaguguc

SEQ ID NO: 685654 - RNA, 22 nt, Human
ucucugucucccguguguccgg

SEQ ID NO: 685655 - RNA, 22 nt, Human
gcuguggcuuucuguuucuguu

SEQ ID NO: 685656 - RNA, 22 nt, Human
augugucucuaaaauuuaguaa

SEQ ID NO: 685657 - RNA, 22 nt, Human
augugcuuuauuaaguaaaaau

SEQ ID NO: 685658 - RNA, 22 nt, Human
ugccaggauggccagggggcca

SEQ ID NO: 685659 - RNA, 22 nt, Human
uguaacugccauguagccuguc

SEQ ID NO: 685660 - RNA, 22 nt, Human
cacugaaauauuaauaucuuau

SEQ ID NO: 685661 - RNA, 22 nt, Human
uaaugcacagaauugacauggg

SEQ ID NO: 685662 - RNA, 22 nt, Human
uuuaucugucauuucccauauc

SEQ ID NO: 685663 - RNA, 18 nt, Human
agcuggcccuggcugccg

SEQ ID NO: 685664 - RNA, 22 nt, Human
ugcaggugugguuccucagcca

SEQ ID NO: 685665 - RNA, 22 nt, Human
uccgguccggguacuccucucu

SEQ ID NO: 685666 - RNA, 22 nt, Human
ggaggaagcccucggugcccca

SEQ ID NO: 685667 - RNA, 23 nt, Human
cuugggcuagagacuuagcagug

SEQ ID NO: 685668 - RNA, 22 nt, Human
uuacaagacacugcugacacag

SEQ ID NO: 685669 - RNA, 22 nt, Human
uuucagagcugagaugccacag

SEQ ID NO: 685670 - RNA, 22 nt, Human
cccuggacuguucagggccuga

SEQ ID NO: 685671 - RNA, 22 nt, Human
agaaguuuugggaaauacugau

SEQ ID NO: 685672 - RNA, 22 nt, Human
gaaacauacgauuuaggagaaa

SEQ ID NO: 685673 - RNA, 22 nt, Human
uagcaucaugaucagaacuguu

SEQ ID NO: 685674 - RNA, 22 nt, Human
uuugcugaauagauuguaaacu

SEQ ID NO: 685675 - RNA, 22 nt, Human
ggccagggaggagaggccccug

SEQ ID NO: 685676 - RNA, 22 nt, Human
ugaagauuuccaccaaaucaca

SEQ ID NO: 685677 - RNA, 22 nt, Human
ucccagaguuuccuguguccca

SEQ ID NO: 685678 - RNA, 22 nt, Human
cugagggaugggcugggccgcc

SEQ ID NO: 685679 - RNA, 19 nt, Human
gggaugggcccucacccuc

SEQ ID NO: 685680 - RNA, 22 nt, Human
aauuaagucacacaccuaaacc

SEQ ID NO: 685681 - RNA, 22 nt, Human
uggccaggcuggucuggaacgc

SEQ ID NO: 685682 - RNA, 22 nt, Human
agggacucgguugagugccccu

SEQ ID NO: 685683 - RNA, 22 nt, Human
cuggagagggagcccuggcagu

SEQ ID NO: 685684 - RNA, 22 nt, Human
agggcugggcugcuuguuguca

SEQ ID NO: 685685 - RNA, 23 nt, Human
aggauggguggcaauagaaagac

SEQ ID NO: 685686 - RNA, 23 nt, Human
ugcagagggacugaagccagcuu

SEQ ID NO: 685687 - RNA, 22 nt, Human
cuuccugaggugcugagcacag

SEQ ID NO: 685688 - RNA, 22 nt, Human
aguuacaaacacuaucaguucu

SEQ ID NO: 685689 - RNA, 22 nt, Human
cauauuaaggucuguaaggggu

SEQ ID NO: 685690 - RNA, 22 nt, Human
aaugauguauuaguacaacaca

SEQ ID NO: 685691 - RNA, 22 nt, Human
gaggcuguucaguguccagcuu

SEQ ID NO: 685692 - RNA, 22 nt, Human
gcaggggcugagcaccagcggg

SEQ ID NO: 685693 - RNA, 22 nt, Human
caucuguagcuccaugacaauu

SEQ ID NO: 685694 - RNA, 23 nt, Human
aagcaaugcugagccaguucuga

SEQ ID NO: 685695 - RNA, 22 nt, Human
gagccagcgccuugccucuggg

SEQ ID NO: 685696 - RNA, 22 nt, Human
aggcagcagccacaaggccuga

SEQ ID NO: 685697 - RNA, 22 nt, Human
ugcaugcacgugcuauguauga

SEQ ID NO: 685698 - RNA, 22 nt, Human
uagcagaaccagcagucaauuu

SEQ ID NO: 685699 - RNA, 22 nt, Human
uucucuaggaguucugggauca

SEQ ID NO: 685700 - RNA, 22 nt, Human
accugaaacucaacuuuaucuc

SEQ ID NO: 685701 - RNA, 22 nt, Human
uacauacaagauguguuuaaaa

SEQ ID NO: 685702 - RNA, 22 nt, Human
ugccuggguucccaccccaaag

SEQ ID NO: 685703 - RNA, 22 nt, Human
gacacaugaccauaaaugcuaa

SEQ ID NO: 685704 - RNA, 21 nt, Human
ccaggcuccugaggcugguca

SEQ ID NO: 685705 - RNA, 22 nt, Human
uaagacaugagacucagccagu

SEQ ID NO: 685706 - RNA, 22 nt, Human
acaguaaacaaugcagcaaauu

SEQ ID NO: 685707 - RNA, 22 nt, Human
uuaaagcacuaaaugaugaggg

SEQ ID NO: 685708 - RNA, 22 nt, Human
caccucaggcagcaaagucuca

SEQ ID NO: 685709 - RNA, 22 nt, Human
uggaggagaauuuauggucgaa

SEQ ID NO: 685710 - RNA, 23 nt, Human
caugccaguuugugcaggcagau

SEQ ID NO: 685711 - RNA, 23 nt, Human
gacacaggagcacccagcugagc

SEQ ID NO: 685712 - RNA, 22 nt, Human
cagugccaugaugcagagcaau

SEQ ID NO: 685713 - RNA, 22 nt, Human
ucagccaugucaggggaaugac

SEQ ID NO: 685714 - RNA, 22 nt, Human
aaacaacaauccaaugggagcu

SEQ ID NO: 685715 - RNA, 22 nt, Human
acucugccaucccaggugcugu

SEQ ID NO: 685716 - RNA, 22 nt, Human
cacuaagauuuaaaguauuagu

SEQ ID NO: 685717 - RNA, 22 nt, Human
augaaacaacagacuuggucaa

SEQ ID NO: 685718 - RNA, 22 nt, Human
aggaucauauaagcuccagcua

SEQ ID NO: 685719 - RNA, 22 nt, Human
uuucaaagaccauuaacuauca

SEQ ID NO: 685720 - RNA, 22 nt, Human
guuaguggguuacucucagccc

SEQ ID NO: 685721 - RNA, 22 nt, Human
cugcaguuugcuaagagacaaa

SEQ ID NO: 685722 - RNA, 22 nt, Human
aggucacaggguugaaguacuu

SEQ ID NO: 685723 - RNA, 19 nt, Human
acugccugaggcucacagg

SEQ ID NO: 685724 - RNA, 21 nt, Human
acacagcugccggagacggau

SEQ ID NO: 685725 - RNA, 22 nt, Human
guggcgaggggagguccuggcg

SEQ ID NO: 685726 - RNA, 22 nt, Human
cugugcuggagaugggccagag

SEQ ID NO: 685727 - RNA, 22 nt, Human
uucauacauuuuuacuaacagc

SEQ ID NO: 685728 - RNA, 22 nt, Human
acauuccugaggaaauacauuc

SEQ ID NO: 685729 - RNA, 22 nt, Human
uaugaguuuaaggcuaaaauag

SEQ ID NO: 685730 - RNA, 22 nt, Human
acaaaggcauagugaauguuuu

SEQ ID NO: 685731 - RNA, 22 nt, Human
acagcagagaacuuuagagggu

SEQ ID NO: 685732 - RNA, 22 nt, Human
accaaggaagaaucuauuugag

SEQ ID NO: 685733 - RNA, 22 nt, Human
agggccaaguccaggaccucgg

SEQ ID NO: 685734 - RNA, 23 nt, Human
agaugaaagcuucccaucacagu

SEQ ID NO: 685735 - RNA, 22 nt, Human
agcugccuggccggagccacug

SEQ ID NO: 685736 - RNA, 23 nt, Human
ugaugggaaggaacgacuaccac

SEQ ID NO: 685737 - RNA, 22 nt, Human
ugucaaauuuuuauugcaguau

SEQ ID NO: 685738 - RNA, 22 nt, Human
agucucuuaaugggcagaaagu

SEQ ID NO: 685739 - RNA, 22 nt, Human
aguguauucugcaugggagacu

SEQ ID NO: 685740 - RNA, 22 nt, Human
gggcugagagcuggaaucugag

SEQ ID NO: 685741 - RNA, 22 nt, Human
aggcuggcuggcaggggacaca

SEQ ID NO: 685742 - RNA, 22 nt, Human
ucuggcucaaaauacguacucu

SEQ ID NO: 685743 - RNA, 22 nt, Human
aauucaguugugucugaccucg

SEQ ID NO: 685744 - RNA, 22 nt, Human
aucuccgccaucgcgaacgccu

SEQ ID NO: 685745 - RNA, 22 nt, Human
ugagcagcuacuguguucaggg

SEQ ID NO: 685746 - RNA, 22 nt, Human
caggucucuuuugucacaccac

SEQ ID NO: 685747 - RNA, 21 nt, Human
guuuaugaaucuuguccugcu

SEQ ID NO: 685748 - RNA, 22 nt, Human
cagucagagucacaguaauuug

SEQ ID NO: 685749 - RNA, 22 nt, Human
gugcacaucgugcagguuuguu

SEQ ID NO: 685750 - RNA, 22 nt, Human
uuucauagcugaaaauguugaa

SEQ ID NO: 685751 - RNA, 22 nt, Human
cagcugguguccagggaagugg

SEQ ID NO: 685752 - RNA, 22 nt, Human
ucccagauuccugcucuuauau

SEQ ID NO: 685753 - RNA, 22 nt, Human
ugccuucaaucaggauggucuc

SEQ ID NO: 685754 - RNA, 22 nt, Human
caagaaacuuuauucugccaua

SEQ ID NO: 685755 - RNA, 22 nt, Human
gagcuaagaccugagggcaagu

SEQ ID NO: 685756 - RNA, 22 nt, Human
agcauauucaugccagacuacu

SEQ ID NO: 685757 - RNA, 18 nt, Human
aucuuuccauagcauguu

SEQ ID NO: 685758 - RNA, 22 nt, Human
cucagcccagcccaggaccagg

SEQ ID NO: 685759 - RNA, 22 nt, Human
cuggagaacagagcuguuuaga

SEQ ID NO: 685760 - RNA, 22 nt, Human
acaugaucugacuugcuuuuua

SEQ ID NO: 685761 - RNA, 19 nt, Human
ggaagagaggaaaggugga

SEQ ID NO: 685762 - RNA, 22 nt, Human
ugauggcuuauggagagagcaa

SEQ ID NO: 685763 - RNA, 22 nt, Human
uuucacaucaugggauggaagc

SEQ ID NO: 685764 - RNA, 22 nt, Human
aagauguugcauuagaauaccu

SEQ ID NO: 685765 - RNA, 22 nt, Human
cuguuguaucauuuguucacau

SEQ ID NO: 685766 - RNA, 22 nt, Human
ccagggaagucacauugucuag

SEQ ID NO: 685767 - RNA, 22 nt, Human
uuaggaagagcuuucaaucacu

SEQ ID NO: 685768 - RNA, 22 nt, Human
ucagggacagggugcugcugcg

SEQ ID NO: 685769 - RNA, 22 nt, Human
ucaugcaacggcucgcugagcc

SEQ ID NO: 685770 - RNA, 22 nt, Human
ucucagucuuugcaaggaugcu

SEQ ID NO: 685771 - RNA, 22 nt, Human
auguaucaacaaauuguacagu

SEQ ID NO: 685772 - RNA, 22 nt, Human
cguucucucaugaucuucccga

SEQ ID NO: 685773 - RNA, 22 nt, Human
agcaagcagaaaugccauggca

SEQ ID NO: 685774 - RNA, 22 nt, Human
ucagcucuguuuugaguggaac

SEQ ID NO: 685775 - RNA, 22 nt, Human
ggcuguggccagcggggcugag

SEQ ID NO: 685776 - RNA, 22 nt, Human
uggagcuggaagaauguagacg

SEQ ID NO: 685777 - RNA, 22 nt, Human
accuuagaaaaucaaaauuaga

SEQ ID NO: 685778 - RNA, 22 nt, Human
ucccaggaugugcgugccgccg

SEQ ID NO: 685779 - RNA, 22 nt, Human
aaacuugagucacuucucuucc

SEQ ID NO: 685780 - RNA, 22 nt, Human
gaacacugaggacacugagaau

SEQ ID NO: 685781 - RNA, 22 nt, Human
agggcccuagggaaugagacau

SEQ ID NO: 685782 - RNA, 22 nt, Human
uccagguaggccaagacagcua

SEQ ID NO: 685783 - RNA, 22 nt, Human
agaggcugcaggcuggaaauca

SEQ ID NO: 685784 - RNA, 22 nt, Human
ugcauaacuagaguaauuacag

SEQ ID NO: 685785 - RNA, 22 nt, Human
auaucuuuguaugguucagcag

SEQ ID NO: 685786 - RNA, 22 nt, Human
ccuguccuccaagagcacaucu

SEQ ID NO: 685787 - RNA, 22 nt, Human
gguccuugggucuccuguguuu

SEQ ID NO: 685788 - RNA, 22 nt, Human
cuccccaccuucgcggucccug

SEQ ID NO: 685789 - RNA, 22 nt, Human
ucucugggucucaguuuguaca

SEQ ID NO: 685790 - RNA, 22 nt, Human
aucaauuuugaggauacaagaa

SEQ ID NO: 685791 - RNA, 22 nt, Human
ggugucugugauggcauauaac

SEQ ID NO: 685792 - RNA, 21 nt, Human
aauugaagauguggagccauu

SEQ ID NO: 685793 - RNA, 22 nt, Human
gagcccaggcugggguucagag

SEQ ID NO: 685794 - RNA, 22 nt, Human
aauguuacaguuuuaauucuga

SEQ ID NO: 685795 - RNA, 22 nt, Human
cuaguccacuguccugccucca

SEQ ID NO: 685796 - RNA, 22 nt, Human
aagucagaaaucaucuagugua

SEQ ID NO: 685797 - RNA, 22 nt, Human
ucagagcagcauuuuacaggau

SEQ ID NO: 685798 - RNA, 22 nt, Human
aaauggugagggaauugaacag

SEQ ID NO: 685799 - RNA, 22 nt, Human
acauucuguuuccccaaagaga

SEQ ID NO: 685800 - RNA, 22 nt, Human
aaaguuacacgacuauuuaugu

SEQ ID NO: 685801 - RNA, 22 nt, Human
uuaugcaacaggugagcagaca

SEQ ID NO: 685802 - RNA, 22 nt, Human
uuauuuugguaaauguuugccu

SEQ ID NO: 685803 - RNA, 22 nt, Human
gagaggucaucucccaucagca

SEQ ID NO: 685804 - RNA, 22 nt, Human
uggucucugagccuuccugugg

SEQ ID NO: 685805 - RNA, 22 nt, Human
ccuagaugggauggcggccggg

SEQ ID NO: 685806 - RNA, 22 nt, Human
agaaaggaggaagaaugaccuc

SEQ ID NO: 685807 - RNA, 22 nt, Human
cuucucucggugcaucccucac

SEQ ID NO: 685808 - RNA, 22 nt, Human
uuuaagaaguuauguuauaaau

SEQ ID NO: 685809 - RNA, 22 nt, Human
uaauuuaauccaaguguuacau

SEQ ID NO: 685810 - RNA, 22 nt, Human
gcucccuuaguccuugccggga

SEQ ID NO: 685811 - RNA, 22 nt, Human
uugcaaauguuauacugccagu

SEQ ID NO: 685812 - RNA, 22 nt, Human
gagcugcuuccagaguugagug

SEQ ID NO: 685813 - RNA, 22 nt, Human
acccuccccaagaggucgugcc

SEQ ID NO: 685814 - RNA, 22 nt, Human
ucuggagauaagcagcaaugaa

SEQ ID NO: 685815 - RNA, 22 nt, Human
cagcuucuuacgagcugguacu

SEQ ID NO: 685816 - RNA, 22 nt, Human
uucauauuugaaacagaaguua

SEQ ID NO: 685817 - RNA, 22 nt, Human
caagacaugcaauugccacuuu

SEQ ID NO: 685818 - RNA, 22 nt, Human
gagggccaacuagcaccacuuu

SEQ ID NO: 685819 - RNA, 22 nt, Human
gccugcuguugagggaagagcu

SEQ ID NO: 685820 - RNA, 19 nt, Human
ugcagcugucucuauauua

SEQ ID NO: 685821 - RNA, 22 nt, Human
ggucucauguccuaugugcuua

SEQ ID NO: 685822 - RNA, 22 nt, Human
cagcaggaccauugaggcauca

SEQ ID NO: 685823 - RNA, 19 nt, Human
uuucuaagcuaaaugcuuc

SEQ ID NO: 685824 - RNA, 22 nt, Human
gagguggcugcuugcugggaaa

SEQ ID NO: 685825 - RNA, 22 nt, Human
aacuuuucauuccaaaggugcu

SEQ ID NO: 685826 - RNA, 22 nt, Human
ucagugaaaugcauauucuucg

SEQ ID NO: 685827 - RNA, 22 nt, Human
uugguuaaaaucaaauuaauca

SEQ ID NO: 685828 - RNA, 22 nt, Human
gguguagcucugugucccacug

SEQ ID NO: 685829 - RNA, 22 nt, Human
agaugcugugucuguucccuug

SEQ ID NO: 685830 - RNA, 19 nt, Human
cugggucuuauucugugaa

SEQ ID NO: 685831 - RNA, 22 nt, Human
aagcaaagugcuuugccuccag

SEQ ID NO: 685832 - RNA, 22 nt, Human
uggcugagggcacuaugaagcc

SEQ ID NO: 685833 - RNA, 22 nt, Human
aaggggugagcagaggcuucgc

SEQ ID NO: 685834 - RNA, 21 nt, Human
uucuacaggaugaaugaaaac

SEQ ID NO: 685835 - RNA, 22 nt, Human
ccagggcagugggagaaggugc

SEQ ID NO: 685836 - RNA, 22 nt, Human
uaacauuacggacaucugucag

SEQ ID NO: 685837 - RNA, 22 nt, Human
cagagacagccugggagggaca

SEQ ID NO: 685838 - RNA, 22 nt, Human
auuuaugagcugaaccaugaaa

SEQ ID NO: 685839 - RNA, 22 nt, Human
gcugcuccgucugagcucuggu

SEQ ID NO: 685840 - RNA, 22 nt, Human
gcuuuagaucugacuuucugug

SEQ ID NO: 685841 - RNA, 22 nt, Human
gcugcuuucuguuaggaauugg

SEQ ID NO: 685842 - RNA, 22 nt, Human
augagguggucuucaguagguc

SEQ ID NO: 685843 - RNA, 22 nt, Human
cauggaacaaggaagauguuug

SEQ ID NO: 685844 - RNA, 22 nt, Human
agggcugagugggagagaguug

SEQ ID NO: 685845 - RNA, 22 nt, Human
agugcguggaccccuggcugcu

SEQ ID NO: 685846 - RNA, 22 nt, Human
uuugaaauaugaggcauuauga

SEQ ID NO: 685847 - RNA, 22 nt, Human
uauagugcauuauuuacaguaa

SEQ ID NO: 685848 - RNA, 20 nt, Human
ggaagcuguggguccccagg

SEQ ID NO: 685849 - RNA, 22 nt, Human
auaacagugaccucucagcacc

SEQ ID NO: 685850 - RNA, 22 nt, Human
agacuaaauaguuacagguagg

SEQ ID NO: 685851 - RNA, 22 nt, Human
aucaggaagaauuggaugcuac

SEQ ID NO: 685852 - RNA, 22 nt, Human
ucucagaguuuacggggcugaa

SEQ ID NO: 685853 - RNA, 19 nt, Human
ugguggcaaugucagcuaa

SEQ ID NO: 685854 - RNA, 22 nt, Human
uacaguuucccagcagaugcaa

SEQ ID NO: 685855 - RNA, 22 nt, Human
cugccuguggguacaaguggaa

SEQ ID NO: 685856 - RNA, 22 nt, Human
cuaggcacuuguaaggccgcuc

SEQ ID NO: 685857 - RNA, 22 nt, Human
gagguggcgcgccaucccugcc

SEQ ID NO: 685858 - RNA, 22 nt, Human
agggggcucagcauggauggag

SEQ ID NO: 685859 - RNA, 22 nt, Human
ugccuggaucugaggacccauu

SEQ ID NO: 685860 - RNA, 22 nt, Human
augucaaacacaacaccagugg

SEQ ID NO: 685861 - RNA, 22 nt, Human
aaacucaagucuaugaacaagg

SEQ ID NO: 685862 - RNA, 22 nt, Human
aaauacugcugcuauuccuuuu

SEQ ID NO: 685863 - RNA, 22 nt, Human
ugucugaacugcacugaaagac

SEQ ID NO: 685864 - RNA, 22 nt, Human
uugccugcuacggucuucacug

SEQ ID NO: 685865 - RNA, 19 nt, Human
caggagagcaugcacuuug

SEQ ID NO: 685866 - RNA, 22 nt, Human
gcuuccuugggaaaauuagaug

SEQ ID NO: 685867 - RNA, 22 nt, Human
cugcccaggggagugcugucgg

SEQ ID NO: 685868 - RNA, 22 nt, Human
ggcuggccucuacagggaggca

SEQ ID NO: 685869 - RNA, 22 nt, Human
cagcucaggcacuggcgcggga

SEQ ID NO: 685870 - RNA, 22 nt, Human
gaccagcucucugaagaaagag

SEQ ID NO: 685871 - RNA, 22 nt, Human
cagugucucaguuucacuugaa

SEQ ID NO: 685872 - RNA, 18 nt, Human
accugccuguucuucucu

SEQ ID NO: 685873 - RNA, 22 nt, Human
cugcagaggccucgccuccucu

SEQ ID NO: 685874 - RNA, 22 nt, Human
ucaggaucggccuuuuuuuaag

SEQ ID NO: 685875 - RNA, 22 nt, Human
uagcagaaccagucagugagcc

SEQ ID NO: 685876 - RNA, 22 nt, Human
ucugaagacauaugauauggug

SEQ ID NO: 685877 - RNA, 22 nt, Human
aagcacaggggaaauaaguugu

SEQ ID NO: 685878 - RNA, 22 nt, Human
cuauauuuggugagggaugucu

SEQ ID NO: 685879 - RNA, 22 nt, Human
cugcacacauauggcuucucuc

SEQ ID NO: 685880 - RNA, 22 nt, Human
cagcuggcugcaugaugccaaa

SEQ ID NO: 685881 - RNA, 22 nt, Human
aguuuguaaacuugagcuagcc

SEQ ID NO: 685882 - RNA, 22 nt, Human
ucauuuacuguaggcaaaaauu

SEQ ID NO: 685883 - RNA, 22 nt, Human
cuguccugcaguugggggcagg

SEQ ID NO: 685884 - RNA, 22 nt, Human
cagcuccugaggacugcuggga

SEQ ID NO: 685885 - RNA, 22 nt, Human
ucucuggguugagaacuaggac

SEQ ID NO: 685886 - RNA, 22 nt, Human
ucuccaggugaaacuugcaggg

SEQ ID NO: 685887 - RNA, 22 nt, Human
gccagcuggaaaucugcuugaa

SEQ ID NO: 685888 - RNA, 22 nt, Human
gggccaagggugcguggcagga

SEQ ID NO: 685889 - RNA, 22 nt, Human
cugagcagccccaccagccauu

SEQ ID NO: 685890 - RNA, 22 nt, Human
uccaggcauguggccaguacuc

SEQ ID NO: 685891 - RNA, 18 nt, Human
uccaaaaucauguauuuu

SEQ ID NO: 685892 - RNA, 22 nt, Human
auguaauaggguaacauaacau

SEQ ID NO: 685893 - RNA, 22 nt, Human
ucugggcaauggaugcacucac

SEQ ID NO: 685894 - RNA, 22 nt, Human
ggccucugccccagccacaccu

SEQ ID NO: 685895 - RNA, 22 nt, Human
auuucucacucacaguccaugu

SEQ ID NO: 685896 - RNA, 22 nt, Human
uagcaggaaaccuguguugagg

SEQ ID NO: 685897 - RNA, 22 nt, Human
ggaagaaaugcucuucuaugcg

SEQ ID NO: 685898 - RNA, 21 nt, Human
ugucacauugucccugcugcu

SEQ ID NO: 685899 - RNA, 22 nt, Human
ugagguaggugguaagagauac

SEQ ID NO: 685900 - RNA, 22 nt, Human
auacaugcuuggguguagugcg

SEQ ID NO: 685901 - RNA, 22 nt, Human
uacauguuugguaaaugauggc

SEQ ID NO: 685902 - RNA, 22 nt, Human
aacacagcuaauuucugucaau

SEQ ID NO: 685903 - RNA, 21 nt, Human
agacaaugcuguaaaauucag

SEQ ID NO: 685904 - RNA, 22 nt, Human
aagaguuucuuuauuaaccuuu

SEQ ID NO: 685905 - RNA, 22 nt, Human
aauggcaagcugaacucagaag

SEQ ID NO: 685906 - RNA, 22 nt, Human
uuuguaugaacugguauguagg

SEQ ID NO: 685907 - RNA, 22 nt, Human
agcugccucugaacuuuaauuc

SEQ ID NO: 685908 - RNA, 22 nt, Human
aggcaagauuaggaccagaaga

SEQ ID NO: 685909 - RNA, 21 nt, Human
ggagucauuagucauuuccuu

SEQ ID NO: 685910 - RNA, 22 nt, Human
gauuuccaggacgggagguggg

SEQ ID NO: 685911 - RNA, 22 nt, Human
uucuucuugaaacuuuagguug

SEQ ID NO: 685912 - RNA, 22 nt, Human
ggagggacccacugcggugacc

SEQ ID NO: 685913 - RNA, 22 nt, Human
aggccagcucuacccuuggacu

SEQ ID NO: 685914 - RNA, 22 nt, Human
uagaagugaaagacuugauguc

SEQ ID NO: 685915 - RNA, 22 nt, Human
ugacacagauuagagacauacc

SEQ ID NO: 685916 - RNA, 22 nt, Human
uccggggcuuccccgcagugcc

SEQ ID NO: 685917 - RNA, 22 nt, Human
aguuacuuucugaucagugugu

SEQ ID NO: 685918 - RNA, 22 nt, Human
ucaguuuuuguuugccagauag

SEQ ID NO: 685919 - RNA, 22 nt, Human
guuccucaguuguaaaaaaugu

SEQ ID NO: 685920 - RNA, 22 nt, Human
uauugauucugucccaaguuga

SEQ ID NO: 685921 - RNA, 22 nt, Human
ugcagcagccucaucugguuuc

SEQ ID NO: 685922 - RNA, 22 nt, Human
cuauggucuggaccgagguccu

SEQ ID NO: 685923 - RNA, 22 nt, Human
agaauauugaaaguucuugaca

SEQ ID NO: 685924 - RNA, 22 nt, Human
acauuucuccuugcaggaguca

SEQ ID NO: 685925 - RNA, 22 nt, Human
agcagagcaugcuaagugacuc

SEQ ID NO: 685926 - RNA, 22 nt, Human
acaguccuguugucaaagcaau

SEQ ID NO: 685927 - RNA, 22 nt, Human
ucagaagucacuuaggaaaggg

SEQ ID NO: 685928 - RNA, 22 nt, Human
ccaggacccugcaaacccuguu

SEQ ID NO: 685929 - RNA, 22 nt, Human
gucuggcauucuuccuggagaa

SEQ ID NO: 685930 - RNA, 22 nt, Human
accucaguucaauucaguuaga

SEQ ID NO: 685931 - RNA, 22 nt, Human
ggccaggcugcugggaccccgc

SEQ ID NO: 685932 - RNA, 22 nt, Human
uaucaauugggccaaaugguac

SEQ ID NO: 685933 - RNA, 22 nt, Human
gggcagucacagugcuggagca

SEQ ID NO: 685934 - RNA, 22 nt, Human
uuucaacagaauaugaucagag

SEQ ID NO: 685935 - RNA, 22 nt, Human
aaggaacugaugcucaaagaau

SEQ ID NO: 685936 - RNA, 23 nt, Human
ugccucaguggaaugugagggug

SEQ ID NO: 685937 - RNA, 22 nt, Human
ugcuaggaauacacagagcaau

SEQ ID NO: 685938 - RNA, 22 nt, Human
gugucuuaggguugcacagagu

SEQ ID NO: 685939 - RNA, 22 nt, Human
uauuggauugagacauuuuaga

SEQ ID NO: 685940 - RNA, 22 nt, Human
agugucagccugggcaaggaac

SEQ ID NO: 685941 - RNA, 22 nt, Human
ggcagccaguagggccagccug

SEQ ID NO: 685942 - RNA, 22 nt, Human
gcacugaugcaaaaaucacuca

SEQ ID NO: 685943 - RNA, 22 nt, Human
accagggcacaggagucugaag

SEQ ID NO: 685944 - RNA, 22 nt, Human
aagaaacugaaaguggcuucau

SEQ ID NO: 685945 - RNA, 22 nt, Human
gggcucugggucgugucuccau

SEQ ID NO: 685946 - RNA, 22 nt, Human
agugguggagagaugaggacac

SEQ ID NO: 685947 - RNA, 22 nt, Human
ggcuggugaguucagagaaccc

SEQ ID NO: 685948 - RNA, 22 nt, Human
gaaaguauuuacauuaacaucu

SEQ ID NO: 685949 - RNA, 22 nt, Human
uaucagcgugcaaaucuuugga

SEQ ID NO: 685950 - RNA, 22 nt, Human
ugcauuccacacccauagagau

SEQ ID NO: 685951 - RNA, 20 nt, Human
ucaucagauagguuaguaca

SEQ ID NO: 685952 - RNA, 22 nt, Human
ugugaagauuuggcaugcagaa

SEQ ID NO: 685953 - RNA, 18 nt, Human
cauguguucuacaucagu

SEQ ID NO: 685954 - RNA, 22 nt, Human
uuucaaaggaggcugagaggau

SEQ ID NO: 685955 - RNA, 22 nt, Human
uuucacaggaguuguaccauuu

SEQ ID NO: 685956 - RNA, 22 nt, Human
gaauugcuaaccaauucaaaau

SEQ ID NO: 685957 - RNA, 22 nt, Human
gagagacuggaaugggcugugg

SEQ ID NO: 685958 - RNA, 22 nt, Human
ggcuguggucauuaggagguug

SEQ ID NO: 685959 - RNA, 22 nt, Human
agaggcugucucauauuuugua

SEQ ID NO: 685960 - RNA, 21 nt, Human
acuccaaacaaguuaagcugu

SEQ ID NO: 685961 - RNA, 22 nt, Human
ugucucugugcauuugugcuuc

SEQ ID NO: 685962 - RNA, 22 nt, Human
uaaugucuuuaagagcauuggg

SEQ ID NO: 685963 - RNA, 22 nt, Human
aaagauuauggcauugaaauac

SEQ ID NO: 685964 - RNA, 22 nt, Human
uugauuuugccugaucugagag

SEQ ID NO: 685965 - RNA, 22 nt, Human
ggccaagguggagaaggcacug

SEQ ID NO: 685966 - RNA, 22 nt, Human
acaacuucaauugggauucucc

SEQ ID NO: 685967 - RNA, 22 nt, Human
uugaaugaggaagagcacuggc

SEQ ID NO: 685968 - RNA, 23 nt, Human
uaugugcauauguguaagaauac

SEQ ID NO: 685969 - RNA, 22 nt, Human
agagcccugugguucugguaag

SEQ ID NO: 685970 - RNA, 22 nt, Human
uuuuaagaugcuaguauuucag

SEQ ID NO: 685971 - RNA, 22 nt, Human
guuccuuguaauuuguuaagga

SEQ ID NO: 685972 - RNA, 22 nt, Human
gcaggagugacauggaugugga

SEQ ID NO: 685973 - RNA, 23 nt, Human
augauguuuuugguagucaaaug

SEQ ID NO: 685974 - RNA, 22 nt, Human
auuuguacucaggaauucugcu

SEQ ID NO: 685975 - RNA, 18 nt, Human
agaguguucucagugaaa

SEQ ID NO: 685976 - RNA, 22 nt, Human
auugcuaaugugcgaaugugua

SEQ ID NO: 685977 - RNA, 22 nt, Human
aagccaggaauggagucuucgc

SEQ ID NO: 685978 - RNA, 22 nt, Human
ugagaggcgcucacucucaggu

SEQ ID NO: 685979 - RNA, 22 nt, Human
aauuauccaccuuugcaugauu

SEQ ID NO: 685980 - RNA, 22 nt, Human
ccuucucuacuccugaugcaug

SEQ ID NO: 685981 - RNA, 23 nt, Human
aggaggccugaaacugaggcuga

SEQ ID NO: 685982 - RNA, 22 nt, Human
uaaauuaaagauuggagaagga

SEQ ID NO: 685983 - RNA, 22 nt, Human
acaauguagaggcugaaagcaa

SEQ ID NO: 685984 - RNA, 22 nt, Human
ucccugcucagcucaccuggca

SEQ ID NO: 685985 - RNA, 22 nt, Human
aggaugugaguggacacagucc

SEQ ID NO: 685986 - RNA, 22 nt, Human
acacugguguaguuuucugcag

SEQ ID NO: 685987 - RNA, 22 nt, Human
guugaaaguggagaaccugguu

SEQ ID NO: 685988 - RNA, 22 nt, Human
uggugacagcauggaagaagug

SEQ ID NO: 685989 - RNA, 22 nt, Human
agagagaggggcgagcaaacac

SEQ ID NO: 685990 - RNA, 23 nt, Human
gcuaggugcuuccacacgugcug

SEQ ID NO: 685991 - RNA, 22 nt, Human
gcucucuguuauuaagaucuuu

SEQ ID NO: 685992 - RNA, 22 nt, Human
agcuggugugccaguuccaguu

SEQ ID NO: 685993 - RNA, 22 nt, Human
aagucacacugcugggaacucu

SEQ ID NO: 685994 - RNA, 22 nt, Human
uaaguuccuggaaggcaaggau

SEQ ID NO: 685995 - RNA, 22 nt, Human
auuauccaacacccaguuacau

SEQ ID NO: 685996 - RNA, 22 nt, Human
ugcagaacgggucuucuagcac

SEQ ID NO: 685997 - RNA, 22 nt, Human
ugagaguauuuuggcauuauca

SEQ ID NO: 685998 - RNA, 22 nt, Human
acucagagaauaucuagaagga

SEQ ID NO: 685999 - RNA, 22 nt, Human
cauggcagagaaggggaacugg

SEQ ID NO: 686000 - RNA, 18 nt, Human
cuuggagaacuaaugaua

SEQ ID NO: 686001 - RNA, 19 nt, Human
acaugcauauggacaguug

SEQ ID NO: 686002 - RNA, 22 nt, Human
caaugcacauggacaucaggcu

SEQ ID NO: 686003 - RNA, 22 nt, Human
aggcagugagugugacuucaca

SEQ ID NO: 686004 - RNA, 22 nt, Human
agcuuguuagaaauguagacuc

SEQ ID NO: 686005 - RNA, 21 nt, Human
aguuacauguauagauaaagu

SEQ ID NO: 686006 - RNA, 22 nt, Human
gacuuuaaguaagucaaggagc

SEQ ID NO: 686007 - RNA, 22 nt, Human
cccucgccgcagcugcuucccg

SEQ ID NO: 686008 - RNA, 19 nt, Human
aauguuuaagagaaaaagg

SEQ ID NO: 686009 - RNA, 22 nt, Human
accaugggucagccaccucagc

SEQ ID NO: 686010 - RNA, 22 nt, Human
uaaguuugugucucuguuacuu

SEQ ID NO: 686011 - RNA, 22 nt, Human
cgcauacauagaaacacacaga

SEQ ID NO: 686012 - RNA, 22 nt, Human
ccaggaggcagagguuguagug

SEQ ID NO: 686013 - RNA, 23 nt, Human
gcagugugaauccaguguuucag

SEQ ID NO: 686014 - RNA, 22 nt, Human
ugagcagacucugcagagccac

SEQ ID NO: 686015 - RNA, 22 nt, Human
uuccaagugcccauauuucauc

SEQ ID NO: 686016 - RNA, 22 nt, Human
cauaaaguagcagagcaugacu

SEQ ID NO: 686017 - RNA, 22 nt, Human
gccuucccaagacgccugaguu

SEQ ID NO: 686018 - RNA, 22 nt, Human
gaaagugcucucucuauacaca

SEQ ID NO: 686019 - RNA, 20 nt, Human
uuacagaaaugauguuauuu

SEQ ID NO: 686020 - RNA, 22 nt, Human
agaugaaaauacgugacuuuaa

SEQ ID NO: 686021 - RNA, 22 nt, Human
ugaggagaaaugcucagagcca

SEQ ID NO: 686022 - RNA, 22 nt, Human
gcagaaggucaaagcaagaugu

SEQ ID NO: 686023 - RNA, 22 nt, Human
gcccugugagauuagaacagca

SEQ ID NO: 686024 - RNA, 22 nt, Human
aagauucuacaaacucugguaa

SEQ ID NO: 686025 - RNA, 22 nt, Human
uuggcacagagcugcagccugg

SEQ ID NO: 686026 - RNA, 22 nt, Human
cugccucucaggucccugagau

SEQ ID NO: 686027 - RNA, 22 nt, Human
aaauaagaggacagauguuugg

SEQ ID NO: 686028 - RNA, 22 nt, Human
gaaugcaaagcucucuauguua

SEQ ID NO: 686029 - RNA, 22 nt, Human
aggcugaaaacgagauggcaau

SEQ ID NO: 686030 - RNA, 22 nt, Human
ggcagccaugcacgcugccugg

SEQ ID NO: 686031 - RNA, 22 nt, Human
aaucuuaaagaauauucuacca

SEQ ID NO: 686032 - RNA, 22 nt, Human
cguauuuagaaggcugcugaaa

SEQ ID NO: 686033 - RNA, 22 nt, Human
ucagcugaaguggagaagcaga

SEQ ID NO: 686034 - RNA, 22 nt, Human
ccucagugaccuauugcauuca

SEQ ID NO: 686035 - RNA, 22 nt, Human
aaacuuuuauaaagcugcagau

SEQ ID NO: 686036 - RNA, 22 nt, Human
cugcagcugugagugcuggaug

SEQ ID NO: 686037 - RNA, 22 nt, Human
aggcccaguguggcuuccugga

SEQ ID NO: 686038 - RNA, 22 nt, Human
gcugaguugaaagcagaggaua

SEQ ID NO: 686039 - RNA, 22 nt, Human
ggaugcugacuuuggagcaugg

SEQ ID NO: 686040 - RNA, 22 nt, Human
ucacagcaguaaagaaaacacu

SEQ ID NO: 686041 - RNA, 16 nt, Human
ugcuggggcgccgucc

SEQ ID NO: 686042 - RNA, 22 nt, Human
aaauucauauguugaaaugcua

SEQ ID NO: 686043 - RNA, 22 nt, Human
caguggaagacucagcucuccc

SEQ ID NO: 686044 - RNA, 22 nt, Human
uucuucugugaggugugugccu

SEQ ID NO: 686045 - RNA, 22 nt, Human
aacacuucucaucacugcaagc

SEQ ID NO: 686046 - RNA, 22 nt, Human
acugcugcagguccagccccuu

SEQ ID NO: 686047 - RNA, 22 nt, Human
aaauaguuuagcucucauuuca

SEQ ID NO: 686048 - RNA, 22 nt, Human
aaacuguaagagaauaaacuac

SEQ ID NO: 686049 - RNA, 22 nt, Human
aggaccagccuccaggucucuu

SEQ ID NO: 686050 - RNA, 22 nt, Human
uggcuucuuugugacagcucuu

SEQ ID NO: 686051 - RNA, 22 nt, Human
aacagauaaguauaucuaugua

SEQ ID NO: 686052 - RNA, 22 nt, Human
gaugaaauucagaauugagggg

SEQ ID NO: 686053 - RNA, 22 nt, Human
uaacuuuaugacaugucuugcu

SEQ ID NO: 686054 - RNA, 22 nt, Human
ccaagaggaccuugccagggca

SEQ ID NO: 686055 - RNA, 22 nt, Human
uaugacuauagggcuuaguguu

SEQ ID NO: 686056 - RNA, 22 nt, Human
aacucaguguguuucuuaguau

SEQ ID NO: 686057 - RNA, 23 nt, Human
uggcagugaucaaaagcuuacau

SEQ ID NO: 686058 - RNA, 22 nt, Human
uaagaacuucggacauguuauc

SEQ ID NO: 686059 - RNA, 20 nt, Human
aaaugcuguaauguuuggga

SEQ ID NO: 686060 - RNA, 22 nt, Human
aagaguuuaugauauaacaugu

SEQ ID NO: 686061 - RNA, 22 nt, Human
caguguucccugaacauauguu

SEQ ID NO: 686062 - RNA, 22 nt, Human
ccagagaggcaaaacuccuucc

SEQ ID NO: 686063 - RNA, 22 nt, Human
auaucuuucaaagccaaaagua

SEQ ID NO: 686064 - RNA, 22 nt, Human
auguggcucacauagcuggaaa

SEQ ID NO: 686065 - RNA, 22 nt, Human
aucugucuaugauauagucugu

SEQ ID NO: 686066 - RNA, 22 nt, Human
uaaaucagccuuugcuauuuua

SEQ ID NO: 686067 - RNA, 22 nt, Human
uuccaggaacaaacucaccuua

SEQ ID NO: 686068 - RNA, 22 nt, Human
uuccagaggcuucagggaagaa

SEQ ID NO: 686069 - RNA, 21 nt, Human
ugggacagugauggcuccucc

SEQ ID NO: 686070 - RNA, 22 nt, Human
gacuagggaaucauucuuggau

SEQ ID NO: 686071 - RNA, 18 nt, Human
uccauuguucuacuguga

SEQ ID NO: 686072 - RNA, 22 nt, Human
cccuggagugugacgaggcauu

SEQ ID NO: 686073 - RNA, 22 nt, Human
ucaaaaguuucacauagagaua

SEQ ID NO: 686074 - RNA, 22 nt, Human
caauguguguguuuuucucaac

SEQ ID NO: 686075 - RNA, 22 nt, Human
uuucuauaaaaagugcuaggau

SEQ ID NO: 686076 - RNA, 22 nt, Human
gggcuggcgggaaaggcaauuc

SEQ ID NO: 686077 - RNA, 22 nt, Human
auuuguaauuucuuaucugugu

SEQ ID NO: 686078 - RNA, 22 nt, Human
aaagcagagaucauggcuugua

SEQ ID NO: 686079 - RNA, 19 nt, Human
gccugcagaaaaggcaggg

SEQ ID NO: 686080 - RNA, 22 nt, Human
acaggcagguaauuuacauauu

SEQ ID NO: 686081 - RNA, 23 nt, Human
ugaggcugauugauuuuugcuca

SEQ ID NO: 686082 - RNA, 22 nt, Human
ccugugaggucuugcaugugaa

SEQ ID NO: 686083 - RNA, 22 nt, Human
ugugcccauuacacagaggcau

SEQ ID NO: 686084 - RNA, 22 nt, Human
gauuccugcuauucacagggcu

SEQ ID NO: 686085 - RNA, 22 nt, Human
uggacauguaaaggcucaaggu

SEQ ID NO: 686086 - RNA, 22 nt, Human
ugcagugguugagagcccagac

SEQ ID NO: 686087 - RNA, 22 nt, Human
agcugcuuagaguccucaggau

SEQ ID NO: 686088 - RNA, 22 nt, Human
gagcaccucaauuugcuauuug

SEQ ID NO: 686089 - RNA, 22 nt, Human
ugcagagauagaacuacuuucu

SEQ ID NO: 686090 - RNA, 22 nt, Human
acauaccauacauggugagaug

SEQ ID NO: 686091 - RNA, 22 nt, Human
gaaagggcaugggcaugacaac

SEQ ID NO: 686092 - RNA, 21 nt, Human
uauacagcaaagucuggagca

SEQ ID NO: 686093 - RNA, 22 nt, Human
auccucuguggauuacaccuag

SEQ ID NO: 686094 - RNA, 22 nt, Human
uagugucuuccaggacauggua

SEQ ID NO: 686095 - RNA, 22 nt, Human
uauaagaaauugccaaccuguu

SEQ ID NO: 686096 - RNA, 22 nt, Human
ggcagcaguccauggcccaagg

SEQ ID NO: 686097 - RNA, 22 nt, Human
auuucccagggcccucauaguu

SEQ ID NO: 686098 - RNA, 22 nt, Human
acauuuuucuaggaggcaaggu

SEQ ID NO: 686099 - RNA, 22 nt, Human
uccugugccuccaccugcuccg

SEQ ID NO: 686100 - RNA, 22 nt, Human
guauaucagacacucauaugua

SEQ ID NO: 686101 - RNA, 20 nt, Human
aucccucuuccuagaguccc

SEQ ID NO: 686102 - RNA, 22 nt, Human
ucagcuucaaauuuggugaagu

SEQ ID NO: 686103 - RNA, 22 nt, Human
uucucuuuugugaugugagaug

SEQ ID NO: 686104 - RNA, 22 nt, Human
ucaauucuaguggagagaguuu

SEQ ID NO: 686105 - RNA, 22 nt, Human
gaggcuccuccuuacauuuacc

SEQ ID NO: 686106 - RNA, 22 nt, Human
aguauguugaguuuugcuuuag

SEQ ID NO: 686107 - RNA, 17 nt, Human
aggggagagugggaaga

SEQ ID NO: 686108 - RNA, 22 nt, Human
cacaaugucugguaggccacuu

SEQ ID NO: 686109 - RNA, 22 nt, Human
ccucaggggucacugugaggag

SEQ ID NO: 686110 - RNA, 20 nt, Human
ggaccagguggggcgguggc

SEQ ID NO: 686111 - RNA, 22 nt, Human
cuccuggccacguucuugcugg

SEQ ID NO: 686112 - RNA, 22 nt, Human
ucagacaggcuucuuucucccu

SEQ ID NO: 686113 - RNA, 22 nt, Human
caaagggaaacgcagugucaag

SEQ ID NO: 686114 - RNA, 22 nt, Human
cuguuuauacucaaaagauaca

SEQ ID NO: 686115 - RNA, 22 nt, Human
acagucuuuagaguauuguccu

SEQ ID NO: 686116 - RNA, 22 nt, Human
gaccugcccacucugaggacau

SEQ ID NO: 686117 - RNA, 22 nt, Human
ugccuuuaggggccucucccuc

SEQ ID NO: 686118 - RNA, 22 nt, Human
augacaauacuucaauaagcug

SEQ ID NO: 686119 - RNA, 22 nt, Human
ugaagauugugcuuggccugua

SEQ ID NO: 686120 - RNA, 23 nt, Human
acaacaggaaaucagaccugaac

SEQ ID NO: 686121 - RNA, 22 nt, Human
ucagauuuccuugcaguuugga

SEQ ID NO: 686122 - RNA, 22 nt, Human
gauguagacacuuggaggcuua

SEQ ID NO: 686123 - RNA, 22 nt, Human
uggacucagugcugccauuccc

SEQ ID NO: 686124 - RNA, 22 nt, Human
gauauguauugaaugaucauuu

SEQ ID NO: 686125 - RNA, 22 nt, Human
auaguguguuagugacauaggc

SEQ ID NO: 686126 - RNA, 22 nt, Human
uagcacugagucuagcuuugga

SEQ ID NO: 686127 - RNA, 22 nt, Human
caguccuuggcaaguucucagu

SEQ ID NO: 686128 - RNA, 22 nt, Human
gaguggggcguggauccagcgu

SEQ ID NO: 686129 - RNA, 21 nt, Human
ucugggcccaugcugccucac

SEQ ID NO: 686130 - RNA, 22 nt, Human
ccagaggggcugagcaggucac

SEQ ID NO: 686131 - RNA, 22 nt, Human
cauuauauuuuacugcauggga

SEQ ID NO: 686132 - RNA, 22 nt, Human
ugcaaaaacugcaauugcuuuu

SEQ ID NO: 686133 - RNA, 22 nt, Human
caggcaagcacggugaaccugg

SEQ ID NO: 686134 - RNA, 22 nt, Human
ggccaggcacugugugagauau

SEQ ID NO: 686135 - RNA, 22 nt, Human
aaagcugguuauucugaggcag

SEQ ID NO: 686136 - RNA, 22 nt, Human
agagguauauauucuccauauu

SEQ ID NO: 686137 - RNA, 22 nt, Human
cauacauuuugcauauuuacca

SEQ ID NO: 686138 - RNA, 22 nt, Human
cugacuguuugcugaaaggucu

SEQ ID NO: 686139 - RNA, 22 nt, Human
ucuucauucucgccuuugucgu

SEQ ID NO: 686140 - RNA, 19 nt, Human
augauggucccauucaccu

SEQ ID NO: 686141 - RNA, 22 nt, Human
aguuucuugaagacugauguuu

SEQ ID NO: 686142 - RNA, 22 nt, Human
acugaaauggggacaguccuua

SEQ ID NO: 686143 - RNA, 22 nt, Human
uuucuuuuacaguguggcuauu

SEQ ID NO: 686144 - RNA, 22 nt, Human
ggcaggagaaaggucucuucuu

SEQ ID NO: 686145 - RNA, 22 nt, Human
uguacagugccaugcaguuugc

SEQ ID NO: 686146 - RNA, 22 nt, Human
guacaauuccugucaagcuggc

SEQ ID NO: 686147 - RNA, 22 nt, Human
gggggcuagagagaugaaauau

SEQ ID NO: 686148 - RNA, 22 nt, Human
acaauagucaaugcacgucauu

SEQ ID NO: 686149 - RNA, 22 nt, Human
uggcauguggcaauguugggau

SEQ ID NO: 686150 - RNA, 22 nt, Human
auaagagucuuguuuucuuauu

SEQ ID NO: 686151 - RNA, 22 nt, Human
uauauugaccaguacaauuggu

SEQ ID NO: 686152 - RNA, 22 nt, Human
uaggguacaugugcacaacaug

SEQ ID NO: 686153 - RNA, 22 nt, Human
uugaaacauuaccuguauuucc

SEQ ID NO: 686154 - RNA, 22 nt, Human
aaugcacauauauuuccuuauu

SEQ ID NO: 686155 - RNA, 22 nt, Human
ugauuuuuagcuauucugaaga

SEQ ID NO: 686156 - RNA, 22 nt, Human
uguccuggggcgacuuggggcc

SEQ ID NO: 686157 - RNA, 22 nt, Human
cagcuugggggcgcuggccuca

SEQ ID NO: 686158 - RNA, 22 nt, Human
uucaaagaauuuugagaccuga

SEQ ID NO: 686159 - RNA, 22 nt, Human
ugcauauccacaccuuaucucu

SEQ ID NO: 686160 - RNA, 22 nt, Human
auuuucucacaauccuaugggg

SEQ ID NO: 686161 - RNA, 22 nt, Human
caggagaggaggcuacuucuua

SEQ ID NO: 686162 - RNA, 17 nt, Human
aaccagcuguccccucc

SEQ ID NO: 686163 - RNA, 22 nt, Human
uuguauuucgaugcacguguag

SEQ ID NO: 686164 - RNA, 22 nt, Human
auuuacucgugcuucauugaau

SEQ ID NO: 686165 - RNA, 22 nt, Human
cuuguggagugccugcugcagu

SEQ ID NO: 686166 - RNA, 18 nt, Human
auauccaauaaugaacac

SEQ ID NO: 686167 - RNA, 22 nt, Human
agguccacaguucagcugccca

SEQ ID NO: 686168 - RNA, 22 nt, Human
gcacauauguaaauagcugccu

SEQ ID NO: 686169 - RNA, 22 nt, Human
aacucuugaauucccuugaaga

SEQ ID NO: 686170 - RNA, 22 nt, Human
gagggaaagguuaauacaugau

SEQ ID NO: 686171 - RNA, 22 nt, Human
agaaaagggcaggagggauaca

SEQ ID NO: 686172 - RNA, 22 nt, Human
ucagagcugugcuucaggaaag

SEQ ID NO: 686173 - RNA, 22 nt, Human
ggcggggucugagcgccgcgcc

SEQ ID NO: 686174 - RNA, 22 nt, Human
caaaugauagagccgauuauca

SEQ ID NO: 686175 - RNA, 22 nt, Human
ucccucagaaauucucucugaa

SEQ ID NO: 686176 - RNA, 20 nt, Human
uagauguuuccugucauaaa

SEQ ID NO: 686177 - RNA, 22 nt, Human
ucaguguugugcacauacaaaa

SEQ ID NO: 686178 - RNA, 22 nt, Human
cucucuuucauuggucgccuug

SEQ ID NO: 686179 - RNA, 19 nt, Human
agaguauugaauuugcccu

SEQ ID NO: 686180 - RNA, 23 nt, Human
gaguguucauagcaggcucuugc

SEQ ID NO: 686181 - RNA, 22 nt, Human
uucuaauuauucccuuguccca

SEQ ID NO: 686182 - RNA, 22 nt, Human
cagacuuucaaggagugaaggc

SEQ ID NO: 686183 - RNA, 22 nt, Human
uggcuucauuauuguuuuuccu

SEQ ID NO: 686184 - RNA, 22 nt, Human
uaguuaaagcccuaaauugaua

SEQ ID NO: 686185 - RNA, 22 nt, Human
cagagcccauccuauacucucc

SEQ ID NO: 686186 - RNA, 22 nt, Human
agggugccugcugcagguucag

SEQ ID NO: 686187 - RNA, 22 nt, Human
agaacuuuuggagacuuuuagu

SEQ ID NO: 686188 - RNA, 22 nt, Human
ugugugucagucuuguuuaggg

SEQ ID NO: 686189 - RNA, 22 nt, Human
auggggagagccucugucccca

SEQ ID NO: 686190 - RNA, 21 nt, Human
gcuggagagccaggcaggggc

SEQ ID NO: 686191 - RNA, 22 nt, Human
gcugaggcucaauccccuucug

SEQ ID NO: 686192 - RNA, 22 nt, Human
cugcugugcaacauugcaccua

SEQ ID NO: 686193 - RNA, 22 nt, Human
cacaguauuuguuuuucugagu

SEQ ID NO: 686194 - RNA, 22 nt, Human
cuguuuauaaauagaggggagu

SEQ ID NO: 686195 - RNA, 22 nt, Human
uauuaugaggcuuagggaugac

SEQ ID NO: 686196 - RNA, 22 nt, Human
aguggguacugggcaggcagag

SEQ ID NO: 686197 - RNA, 22 nt, Human
cagagucccagaugccccuccu

SEQ ID NO: 686198 - RNA, 21 nt, Human
aaugucauugaauggugagac

SEQ ID NO: 686199 - RNA, 22 nt, Human
ucuccuuucuuuuaaaauguca

SEQ ID NO: 686200 - RNA, 22 nt, Human
uucuucaauuauuggaaagaaa

SEQ ID NO: 686201 - RNA, 22 nt, Human
cuggccuggcaggggaccucua

SEQ ID NO: 686202 - RNA, 22 nt, Human
cagcucugcugguggugccagg

SEQ ID NO: 686203 - RNA, 22 nt, Human
aagucacuugauuguugacaga

SEQ ID NO: 686204 - RNA, 22 nt, Human
uucuguguucugugcaaugagc

SEQ ID NO: 686205 - RNA, 22 nt, Human
gaauuugugcucaggaagauua

SEQ ID NO: 686206 - RNA, 22 nt, Human
ccacagugaguuagauugacca

SEQ ID NO: 686207 - RNA, 22 nt, Human
uuccuuuagugucauauacuuu

SEQ ID NO: 686208 - RNA, 22 nt, Human
gggcugagaaguugaucccaag

SEQ ID NO: 686209 - RNA, 22 nt, Human
uuucaucuucccagagaccuug

SEQ ID NO: 686210 - RNA, 22 nt, Human
acauucuacaguuaaccauuag

SEQ ID NO: 686211 - RNA, 22 nt, Human
uucugaaaugagauauaaggua

SEQ ID NO: 686212 - RNA, 22 nt, Human
ugcugcuccccagcacacagca

SEQ ID NO: 686213 - RNA, 21 nt, Human
ugcuugucugccuagaggcuu

SEQ ID NO: 686214 - RNA, 22 nt, Human
uguuugaauuuugcuaacgugu

SEQ ID NO: 686215 - RNA, 22 nt, Human
uacaugcuucuauaugugaagu

SEQ ID NO: 686216 - RNA, 22 nt, Human
gucugggcaagggagauggcgc

SEQ ID NO: 686217 - RNA, 22 nt, Human
cugcaucucaggagacgggucu

SEQ ID NO: 686218 - RNA, 23 nt, Human
ucugaagaugcuguuuccaguga

SEQ ID NO: 686219 - RNA, 22 nt, Human
ccuuuaaguccucuuuuauauu

SEQ ID NO: 686220 - RNA, 22 nt, Human
uugacuuuauguguauguuuac

SEQ ID NO: 686221 - RNA, 22 nt, Human
gcccaggaguucaagucuagug

SEQ ID NO: 686222 - RNA, 22 nt, Human
caggguugcaugcaucuguggg

SEQ ID NO: 686223 - RNA, 22 nt, Human
cccuuuaaguccuggaacaaag

SEQ ID NO: 686224 - RNA, 22 nt, Human
acugccugugucccuucagugc

SEQ ID NO: 686225 - RNA, 22 nt, Human
cauggaaugguugaaugacgaa

SEQ ID NO: 686226 - RNA, 22 nt, Human
ucaaagcacuggggaaagccug

SEQ ID NO: 686227 - RNA, 22 nt, Human
auuagcauugcuacucucaaga

SEQ ID NO: 686228 - RNA, 22 nt, Human
ucagcaucacgugguccgagaa

SEQ ID NO: 686229 - RNA, 22 nt, Human
uagcucuucauuucaucugauu

SEQ ID NO: 686230 - RNA, 22 nt, Human
uucuguggucucccaugucugu

SEQ ID NO: 686231 - RNA, 22 nt, Human
agucuggauuuagaggugggcc

SEQ ID NO: 686232 - RNA, 22 nt, Human
guagggacccacagucuauauu

SEQ ID NO: 686233 - RNA, 17 nt, Human
gcuguaguuugauaaga

SEQ ID NO: 686234 - RNA, 22 nt, Human
cagaugaauaaaugaugaggua

SEQ ID NO: 686235 - RNA, 22 nt, Human
uuaggaaaggaacauugaaacg

SEQ ID NO: 686236 - RNA, 18 nt, Human
gcccguguggagaccaug

SEQ ID NO: 686237 - RNA, 22 nt, Human
gcagggcucagccgcucccacc

SEQ ID NO: 686238 - RNA, 22 nt, Human
gcaggaagaggcucgaagcccc

SEQ ID NO: 686239 - RNA, 21 nt, Human
ugacauuuccaauauaaagcc

SEQ ID NO: 686240 - RNA, 22 nt, Human
aaagccagcaaggugaguuuca

SEQ ID NO: 686241 - RNA, 22 nt, Human
auaaggaaaauuggagaaauug

SEQ ID NO: 686242 - RNA, 22 nt, Human
agcuggguguagggcuggacaa

SEQ ID NO: 686243 - RNA, 22 nt, Human
gguggcggccacuucagcccug

SEQ ID NO: 686244 - RNA, 22 nt, Human
uuuggcuuuagugccuucugau

SEQ ID NO: 686245 - RNA, 22 nt, Human
gccuauuuuauuaugcauguaa

SEQ ID NO: 686246 - RNA, 21 nt, Human
agaggaagugauuggucuggc

SEQ ID NO: 686247 - RNA, 19 nt, Human
cuugaaaugagacugaagg

SEQ ID NO: 686248 - RNA, 22 nt, Human
agcaccugucaaguccaggcug

SEQ ID NO: 686249 - RNA, 23 nt, Human
ccaggccucucagagggugugcc

SEQ ID NO: 686250 - RNA, 22 nt, Human
agggcgggcucaucacaugcuc

SEQ ID NO: 686251 - RNA, 23 nt, Human
aagauguauuuuuaccaaauguc

SEQ ID NO: 686252 - RNA, 22 nt, Human
cuggaaagugucuccauccugg

SEQ ID NO: 686253 - RNA, 22 nt, Human
aaaguuuccugcuaagugcuau

SEQ ID NO: 686254 - RNA, 22 nt, Human
gugcugagaguuuauuaugaua

SEQ ID NO: 686255 - RNA, 22 nt, Human
ucauugaagcauuuuguguauu

SEQ ID NO: 686256 - RNA, 22 nt, Human
guauauauuggauaaaccagag

SEQ ID NO: 686257 - RNA, 22 nt, Human
gcuuccuaaaugcacagggcag

SEQ ID NO: 686258 - RNA, 22 nt, Human
uguguacaggacagaaaggagg

SEQ ID NO: 686259 - RNA, 23 nt, Human
agaguuuguuucuaaugagugag

SEQ ID NO: 686260 - RNA, 22 nt, Human
caggccagguggcaggcaaaac

SEQ ID NO: 686261 - RNA, 22 nt, Human
caucugaauuugccuuaguuuc

SEQ ID NO: 686262 - RNA, 22 nt, Human
gugggggacccaggugcugucc

SEQ ID NO: 686263 - RNA, 22 nt, Human
cagccuguagaauacaguaaau

SEQ ID NO: 686264 - RNA, 22 nt, Human
gacuugggcuugggcguggguu

SEQ ID NO: 686265 - RNA, 18 nt, Human
ggguccugugggagacag

SEQ ID NO: 686266 - RNA, 22 nt, Human
ugguccagaagauauucaacca

SEQ ID NO: 686267 - RNA, 22 nt, Human
ggauguugauugaauggccauu

SEQ ID NO: 686268 - RNA, 22 nt, Human
aauaucugucucuaaugcauau

SEQ ID NO: 686269 - RNA, 22 nt, Human
auggcugugagacaaagagcug

SEQ ID NO: 686270 - RNA, 20 nt, Human
gagggcucguggauggauaa

SEQ ID NO: 686271 - RNA, 22 nt, Human
gcugaaaugccuuguaaauauu

SEQ ID NO: 686272 - RNA, 22 nt, Human
uggcucaggagggaucuuugcu

SEQ ID NO: 686273 - RNA, 22 nt, Human
ucacaauuuggauacagcuaug

SEQ ID NO: 686274 - RNA, 22 nt, Human
aacaaugccaacagcaugcugg

SEQ ID NO: 686275 - RNA, 22 nt, Human
uaaguuucuccaaagcacagaa

SEQ ID NO: 686276 - RNA, 22 nt, Human
ucuacagggucagaguuucaug

SEQ ID NO: 686277 - RNA, 18 nt, Human
cuccuuggagaagaggcc

SEQ ID NO: 686278 - RNA, 21 nt, Human
agacacugguuuagcauucau

SEQ ID NO: 686279 - RNA, 23 nt, Human
auccucucuccaucccacugugc

SEQ ID NO: 686280 - RNA, 22 nt, Human
aguagaaucagccucuugaugg

SEQ ID NO: 686281 - RNA, 23 nt, Human
uugaaagguagcuggcagcuaga

SEQ ID NO: 686282 - RNA, 22 nt, Human
guggcugcuguccucucugguu

SEQ ID NO: 686283 - RNA, 21 nt, Human
acagauauuucauugaacauu

SEQ ID NO: 686284 - RNA, 22 nt, Human
ugcagcauauagcuuagugaug

SEQ ID NO: 686285 - RNA, 22 nt, Human
uacccugcuagcuagcaucucu

SEQ ID NO: 686286 - RNA, 22 nt, Human
uccuccagaccacuucugugcg

SEQ ID NO: 686287 - RNA, 22 nt, Human
aauaaugagcuugucuaauugu

SEQ ID NO: 686288 - RNA, 22 nt, Human
gcugaagcccacguggcuugua

SEQ ID NO: 686289 - RNA, 22 nt, Human
uggcccuuugggugcaggggca

SEQ ID NO: 686290 - RNA, 22 nt, Human
aaucacauuacagcauaucugu

SEQ ID NO: 686291 - RNA, 22 nt, Human
uucaguuucuucccugugaaau

SEQ ID NO: 686292 - RNA, 22 nt, Human
cccaguggagauaggagugugg

SEQ ID NO: 686293 - RNA, 22 nt, Human
cucugggaaagauugugcaggc

SEQ ID NO: 686294 - RNA, 23 nt, Human
aaggaucucugagaucauggcuu

SEQ ID NO: 686295 - RNA, 22 nt, Human
gagcugggcuggcuuccucccu

SEQ ID NO: 686296 - RNA, 18 nt, Human
gaggccugagaaccaggu

SEQ ID NO: 686297 - RNA, 22 nt, Human
gcagaagguuguuugggaaagg

SEQ ID NO: 686298 - RNA, 22 nt, Human
aucuucccaggcuggggagagg

SEQ ID NO: 686299 - RNA, 22 nt, Human
augccagggucauccccugggu

SEQ ID NO: 686300 - RNA, 22 nt, Human
auuucuuuucaagagggugcuu

SEQ ID NO: 686301 - RNA, 19 nt, Human
cuuugccacugauaggagu

SEQ ID NO: 686302 - RNA, 20 nt, Human
auguccuguugcugccccag

SEQ ID NO: 686303 - RNA, 22 nt, Human
aaaggaaugagcuucuguuagg

SEQ ID NO: 686304 - RNA, 22 nt, Human
cucugauuuccuuauucuguca

SEQ ID NO: 686305 - RNA, 22 nt, Human
acuggggugaaauuggaguguc

SEQ ID NO: 686306 - RNA, 22 nt, Human
uccagcuggggacaugggcuuc

SEQ ID NO: 686307 - RNA, 22 nt, Human
caggaaaugggucguuuuauaa

SEQ ID NO: 686308 - RNA, 22 nt, Human
cuccauauguucaguuaugcag

SEQ ID NO: 686309 - RNA, 22 nt, Human
caguugcagaggcagagugcua

SEQ ID NO: 686310 - RNA, 22 nt, Human
uagugauugcugauauuccauu

SEQ ID NO: 686311 - RNA, 22 nt, Human
uuuaguuuuaacugaaagcuau

SEQ ID NO: 686312 - RNA, 22 nt, Human
auggaauuuggagauuaggcau

SEQ ID NO: 686313 - RNA, 22 nt, Human
ucuuccuuguaagggcuuuaga

SEQ ID NO: 686314 - RNA, 22 nt, Human
ugggccacuugaaaguggaugu

SEQ ID NO: 686315 - RNA, 22 nt, Human
uucuuacauauuuucauauggu

SEQ ID NO: 686316 - RNA, 22 nt, Human
gcaggccuuuaucccugccuca

SEQ ID NO: 686317 - RNA, 22 nt, Human
cauagauuuuagguuagaucga

SEQ ID NO: 686318 - RNA, 22 nt, Human
auucuugauauagauaguuaau

SEQ ID NO: 686319 - RNA, 20 nt, Human
ccuuucuggagugcuguuca

SEQ ID NO: 686320 - RNA, 23 nt, Human
ugcagcaaccuuggaagcauuuc

SEQ ID NO: 686321 - RNA, 22 nt, Human
aucucugcuagccuucuucagg

SEQ ID NO: 686322 - RNA, 19 nt, Human
caucaaguggaguaucucg

SEQ ID NO: 686323 - RNA, 20 nt, Human
ggaggucaaaugaugagaag

SEQ ID NO: 686324 - RNA, 22 nt, Human
acugucacuccaacugagucgu

SEQ ID NO: 686325 - RNA, 21 nt, Human
aagagacauuucucaucagca

SEQ ID NO: 686326 - RNA, 19 nt, Human
uggaacacucaaacugggu

SEQ ID NO: 686327 - RNA, 22 nt, Human
auacacauauguguguauaugu

SEQ ID NO: 686328 - RNA, 22 nt, Human
cuaagguuggcaguggaauugg

SEQ ID NO: 686329 - RNA, 22 nt, Human
cugcuccaguagccccaugugg

SEQ ID NO: 686330 - RNA, 23 nt, Human
agugcuggagaagcuucuggcuu

SEQ ID NO: 686331 - RNA, 17 nt, Human
ugacuuaacagcaaggc

SEQ ID NO: 686332 - RNA, 22 nt, Human
ugcuccuggaugagguacucca

SEQ ID NO: 686333 - RNA, 17 nt, Human
gagaguguauuggaugc

SEQ ID NO: 686334 - RNA, 22 nt, Human
agaggcaggaagagcugauuuu

SEQ ID NO: 686335 - RNA, 23 nt, Human
aacacauugcuaauuacauucaa

SEQ ID NO: 686336 - RNA, 22 nt, Human
cagcccugaguuagcccacgga

SEQ ID NO: 686337 - RNA, 22 nt, Human
uagaugauggaaaaaagcaaua

SEQ ID NO: 686338 - RNA, 22 nt, Human
guaauugaaauugccuuggguu

SEQ ID NO: 686339 - RNA, 22 nt, Human
uacaugcauguguguaaauaua

SEQ ID NO: 686340 - RNA, 22 nt, Human
guuauucuaccacuauguacag

SEQ ID NO: 686341 - RNA, 22 nt, Human
guuuuucucugaaauaguugac

SEQ ID NO: 686342 - RNA, 22 nt, Human
gaguccugaauccuguggcaac

SEQ ID NO: 686343 - RNA, 22 nt, Human
uggcugagguuaugcugguugu

SEQ ID NO: 686344 - RNA, 22 nt, Human
guuucuaagcacaugugagugu

SEQ ID NO: 686345 - RNA, 22 nt, Human
uuccugcuuccuggccucacaa

SEQ ID NO: 686346 - RNA, 22 nt, Human
cccugaggggaguggugaggug

SEQ ID NO: 686347 - RNA, 22 nt, Human
uccugaagccugagugaugacu

SEQ ID NO: 686348 - RNA, 22 nt, Human
gcugagguuucaggaguggcag

SEQ ID NO: 686349 - RNA, 19 nt, Human
cagcuggaaucaucugagg

SEQ ID NO: 686350 - RNA, 19 nt, Human
ugcagcucagggcaggggc

SEQ ID NO: 686351 - RNA, 22 nt, Human
cauaucccauuggccaggacau

SEQ ID NO: 686352 - RNA, 22 nt, Human
cacaugcauaccuauguguaua

SEQ ID NO: 686353 - RNA, 22 nt, Human
augccaauaaauguuaauaucu

SEQ ID NO: 686354 - RNA, 22 nt, Human
agggcccuaaggaaggcacaca

SEQ ID NO: 686355 - RNA, 22 nt, Human
gggcacagaagucuaagacauc

SEQ ID NO: 686356 - RNA, 22 nt, Human
gcucaaauuucagacucaugaa

SEQ ID NO: 686357 - RNA, 22 nt, Human
gcaggagccagggauuccagga

SEQ ID NO: 686358 - RNA, 22 nt, Human
uuaggucuguuuauaaaacagu

SEQ ID NO: 686359 - RNA, 19 nt, Human
ccugauggagcuggugcaa

SEQ ID NO: 686360 - RNA, 23 nt, Human
uucuaagguaugguuuauaccug

SEQ ID NO: 686361 - RNA, 22 nt, Human
uguguauucugagguagguaua

SEQ ID NO: 686362 - RNA, 22 nt, Human
acuguccuuuuaaugcagccgu

SEQ ID NO: 686363 - RNA, 22 nt, Human
acuuccagaauuagaauuuaag

SEQ ID NO: 686364 - RNA, 22 nt, Human
guggcuauauuugaggauacgu

SEQ ID NO: 686365 - RNA, 22 nt, Human
uuauuaggaacucaggauuuuu

SEQ ID NO: 686366 - RNA, 18 nt, Human
gggcuguguucaugccca

SEQ ID NO: 686367 - RNA, 22 nt, Human
aacuccagggucaccauucaca

SEQ ID NO: 686368 - RNA, 22 nt, Human
caggccaaagaucccauugaca

SEQ ID NO: 686369 - RNA, 22 nt, Human
cuucacauguuggaguccuuug

SEQ ID NO: 686370 - RNA, 22 nt, Human
gcaccaugacagugaggagaac

SEQ ID NO: 686371 - RNA, 22 nt, Human
ucuuggcuauccaaguuaucca

SEQ ID NO: 686372 - RNA, 22 nt, Human
cauuucaccuuagagaauuauu

SEQ ID NO: 686373 - RNA, 22 nt, Human
ucugcagcgugcaggcuggugc

SEQ ID NO: 686374 - RNA, 22 nt, Human
agggcuuuguggcagucacuau

SEQ ID NO: 686375 - RNA, 22 nt, Human
uggccaguggacuaaguucuga

SEQ ID NO: 686376 - RNA, 22 nt, Human
cacaguggcuuugcuggucucg

SEQ ID NO: 686377 - RNA, 22 nt, Human
uccaagaaguuuauguuguuuc

SEQ ID NO: 686378 - RNA, 22 nt, Human
aauguuacacagguauaaucag

SEQ ID NO: 686379 - RNA, 22 nt, Human
aagagagaccaugggggacagg

SEQ ID NO: 686380 - RNA, 22 nt, Human
aggagcagauugguaagaucau

SEQ ID NO: 686381 - RNA, 22 nt, Human
caaagggcggcugucggagggu

SEQ ID NO: 686382 - RNA, 23 nt, Human
aaacugcaucucugagccucagc

SEQ ID NO: 686383 - RNA, 23 nt, Human
acaggaggggacagguggccgug

SEQ ID NO: 686384 - RNA, 22 nt, Human
ugcccagccaauuuguuauguu

SEQ ID NO: 686385 - RNA, 22 nt, Human
cgugucuguaugucaaucagcu

SEQ ID NO: 686386 - RNA, 22 nt, Human
aggacuccauguguccuggaga

SEQ ID NO: 686387 - RNA, 22 nt, Human
gcacaccuuagaggggagcugc

SEQ ID NO: 686388 - RNA, 22 nt, Human
cacagaugaaguaaacaacucu

SEQ ID NO: 686389 - RNA, 22 nt, Human
acacagaguauuuagaaggggu

SEQ ID NO: 686390 - RNA, 22 nt, Human
cuccaggcgcuuaccaagcgcu

SEQ ID NO: 686391 - RNA, 22 nt, Human
acugggcuguuccuuauuucua

SEQ ID NO: 686392 - RNA, 19 nt, Human
ugaaacaaacuuaaaagga

SEQ ID NO: 686393 - RNA, 19 nt, Human
ggccugcccaaugucugcu

SEQ ID NO: 686394 - RNA, 22 nt, Human
aucagcaggugcugguggagac

SEQ ID NO: 686395 - RNA, 22 nt, Human
ucuguugguucuguuucucuga

SEQ ID NO: 686396 - RNA, 22 nt, Human
aaggcagcagugcacgacugau

SEQ ID NO: 686397 - RNA, 22 nt, Human
ucauggagacuuugagccuguu

SEQ ID NO: 686398 - RNA, 22 nt, Human
gacuuuauuuuaacggagauuc

SEQ ID NO: 686399 - RNA, 22 nt, Human
cuuucaacuacauacaggcgau

SEQ ID NO: 686400 - RNA, 22 nt, Human
cagggcagaaggcacucuacuc

SEQ ID NO: 686401 - RNA, 22 nt, Human
ucauugcagcuucagguguuca

SEQ ID NO: 686402 - RNA, 22 nt, Human
aggcaagcauugggaacagggc

SEQ ID NO: 686403 - RNA, 22 nt, Human
cuguggggaaaggguccugcuc

SEQ ID NO: 686404 - RNA, 22 nt, Human
cuccacggcccauugggcagga

SEQ ID NO: 686405 - RNA, 22 nt, Human
gcugcccugcaucugugccuuc

SEQ ID NO: 686406 - RNA, 22 nt, Human
ccacugucuuuuccaggcugaa

SEQ ID NO: 686407 - RNA, 22 nt, Human
gaacauuuaugaugcaauaccu

SEQ ID NO: 686408 - RNA, 22 nt, Human
ccuggcugggguagaagugagg

SEQ ID NO: 686409 - RNA, 22 nt, Human
cagucucucugaaguauuaaga

SEQ ID NO: 686410 - RNA, 22 nt, Human
agcgggcucaaguggccagcag

SEQ ID NO: 686411 - RNA, 22 nt, Human
gcuccaggagagggaagcagau

SEQ ID NO: 686412 - RNA, 22 nt, Human
guugcugcaaaggaguguaggu

SEQ ID NO: 686413 - RNA, 22 nt, Human
acaaugaaaaaauuuacugugg

SEQ ID NO: 686414 - RNA, 22 nt, Human
ugggcugaacuucaucugauga

SEQ ID NO: 686415 - RNA, 23 nt, Human
ccuucagaagaaguaacaggggc

SEQ ID NO: 686416 - RNA, 19 nt, Human
cauaaauguacaagauaca

SEQ ID NO: 686417 - RNA, 22 nt, Human
uaagucauaagucaugauguua

SEQ ID NO: 686418 - RNA, 22 nt, Human
gauguucuagaagugugguguu

SEQ ID NO: 686419 - RNA, 22 nt, Human
aaagccaagcugggaaggcagg

SEQ ID NO: 686420 - RNA, 22 nt, Human
acaugaaacuguugcauuagaa

SEQ ID NO: 686421 - RNA, 22 nt, Human
uugugcagaguugccuuuauuu

SEQ ID NO: 686422 - RNA, 22 nt, Human
ugugcucuugucugugacuaac

SEQ ID NO: 686423 - RNA, 22 nt, Human
acacauauaccacuguaaauga

SEQ ID NO: 686424 - RNA, 22 nt, Human
acaagugugugcaguuuguaaa

SEQ ID NO: 686425 - RNA, 22 nt, Human
uuccuuguuuguagcucuggga

SEQ ID NO: 686426 - RNA, 22 nt, Human
agcugggcugaugacucauguu

SEQ ID NO: 686427 - RNA, 22 nt, Human
uucaacuaauguuuauuuuaug

SEQ ID NO: 686428 - RNA, 22 nt, Human
gcaugcauuucacuagguaugu

SEQ ID NO: 686429 - RNA, 22 nt, Human
gaaggccacuuuguguugagaa

SEQ ID NO: 686430 - RNA, 22 nt, Human
ccugucuguccuuugcauucuu

SEQ ID NO: 686431 - RNA, 22 nt, Human
ucucucagauggggcacuagua

SEQ ID NO: 686432 - RNA, 22 nt, Human
uucagggcaugagggacacauc

SEQ ID NO: 686433 - RNA, 22 nt, Human
ggaugcaggggcagcagagccu

SEQ ID NO: 686434 - RNA, 22 nt, Human
gccaggaauggagagguggccu

SEQ ID NO: 686435 - RNA, 21 nt, Human
ugcuccaggagggggcagucc

SEQ ID NO: 686436 - RNA, 22 nt, Human
uucuuuguaaagccacaguccu

SEQ ID NO: 686437 - RNA, 22 nt, Human
aggaaauugucuuuuuccuugu

SEQ ID NO: 686438 - RNA, 22 nt, Human
gcaugagguucuuggccagcau

SEQ ID NO: 686439 - RNA, 22 nt, Human
ugaaauucauuguuuuaugugu

SEQ ID NO: 686440 - RNA, 22 nt, Human
ugaaacaaguuuaagggaucua

SEQ ID NO: 686441 - RNA, 22 nt, Human
uggggugugcucagagcagggg

SEQ ID NO: 686442 - RNA, 22 nt, Human
uggggccagagcugcagggagc

SEQ ID NO: 686443 - RNA, 22 nt, Human
cuccaggccauggcugcggagg

SEQ ID NO: 686444 - RNA, 22 nt, Human
ugcaaggaagggacagcugaga

SEQ ID NO: 686445 - RNA, 23 nt, Human
uagaaugucauucaaugauaugg

SEQ ID NO: 686446 - RNA, 22 nt, Human
auugcuuuguacaugccuagca

SEQ ID NO: 686447 - RNA, 22 nt, Human
aagggagcggggagacccuaug

SEQ ID NO: 686448 - RNA, 22 nt, Human
gcuacagguauauagaugaaac

SEQ ID NO: 686449 - RNA, 22 nt, Human
gguccugaggggagcugaaggu

SEQ ID NO: 686450 - RNA, 22 nt, Human
augguguagcaugugauaugac

SEQ ID NO: 686451 - RNA, 22 nt, Human
ggccuuggugccauggccaguu

SEQ ID NO: 686452 - RNA, 22 nt, Human
gggagcagccugccucccaccu

SEQ ID NO: 686453 - RNA, 22 nt, Human
uggggccuggucagagcugcac

SEQ ID NO: 686454 - RNA, 22 nt, Human
aggcggcugguguccugcaggu

SEQ ID NO: 686455 - RNA, 22 nt, Human
acugcauuaucaccaagaugua

SEQ ID NO: 686456 - RNA, 22 nt, Human
acucaaguagauauuaacaaaa

SEQ ID NO: 686457 - RNA, 22 nt, Human
aauacuuuccuauauaaggugc

SEQ ID NO: 686458 - RNA, 22 nt, Human
aucuaagauuuugcuaagauca

SEQ ID NO: 686459 - RNA, 22 nt, Human
gauggguggguucugugagagg

SEQ ID NO: 686460 - RNA, 21 nt, Human
ugucacuuuaagcuagcucua

SEQ ID NO: 686461 - RNA, 22 nt, Human
cagagcugagucuucaagguug

SEQ ID NO: 686462 - RNA, 18 nt, Human
gcucugugaccuugagca

SEQ ID NO: 686463 - RNA, 22 nt, Human
uggcuucagacuucugcuacgu

SEQ ID NO: 686464 - RNA, 22 nt, Human
acccuccacuuuaucugucuuu

SEQ ID NO: 686465 - RNA, 22 nt, Human
uauuccaacugucauagucaua

SEQ ID NO: 686466 - RNA, 22 nt, Human
agucuggguggcugagcuacag

SEQ ID NO: 686467 - RNA, 22 nt, Human
guccagggccccgagcaccagg

SEQ ID NO: 686468 - RNA, 22 nt, Human
ugauuaacugucuauuaaucau

SEQ ID NO: 686469 - RNA, 22 nt, Human
ggagcccuucuauuccauggag

SEQ ID NO: 686470 - RNA, 22 nt, Human
uggagagcaaugaggggcaggc

SEQ ID NO: 686471 - RNA, 22 nt, Human
uccuggaguugugcagugcaca

SEQ ID NO: 686472 - RNA, 22 nt, Human
gugcuuggaccaggucaucuuc

SEQ ID NO: 686473 - RNA, 22 nt, Human
uuucaacaucaccuagcaguuc

SEQ ID NO: 686474 - RNA, 22 nt, Human
auggcaggauacccaguccggc

SEQ ID NO: 686475 - RNA, 22 nt, Human
acuucaaaaugaguuuccuggu

SEQ ID NO: 686476 - RNA, 22 nt, Human
uacacuuauaacucugugugug

SEQ ID NO: 686477 - RNA, 23 nt, Human
uaaauuaccuuuccagugcaggg

SEQ ID NO: 686478 - RNA, 22 nt, Human
ucugcccacugcucugcugccc

SEQ ID NO: 686479 - RNA, 22 nt, Human
aaaucucaggccucuauuuacu

SEQ ID NO: 686480 - RNA, 22 nt, Human
gcuucuguggugcaucuuugcu

SEQ ID NO: 686481 - RNA, 23 nt, Human
ccagggagguugauugguuaccc

SEQ ID NO: 686482 - RNA, 22 nt, Human
cuccagugcgucuuaguaaacc

SEQ ID NO: 686483 - RNA, 22 nt, Human
gagcuuggugaugccuccuggu

SEQ ID NO: 686484 - RNA, 22 nt, Human
ccauuugucaccucugcacucc

SEQ ID NO: 686485 - RNA, 22 nt, Human
ggucugaguggggccugagauu

SEQ ID NO: 686486 - RNA, 21 nt, Human
aguacaaaaauuccuuucuca

SEQ ID NO: 686487 - RNA, 19 nt, Human
uucuccagggacuuaggga

SEQ ID NO: 686488 - RNA, 22 nt, Human
ugccaggcgauugcuaucagca

SEQ ID NO: 686489 - RNA, 22 nt, Human
uacccagcuucaagucaggacu

SEQ ID NO: 686490 - RNA, 22 nt, Human
cauccugacuguaacuaagaga

SEQ ID NO: 686491 - RNA, 22 nt, Human
uacagggcaugugcagacacau

SEQ ID NO: 686492 - RNA, 22 nt, Human
gccaggcaggugucggagcccu

SEQ ID NO: 686493 - RNA, 22 nt, Human
agacccagagggcugcugggag

SEQ ID NO: 686494 - RNA, 22 nt, Human
ggcugcugggaauaugccagcu

SEQ ID NO: 686495 - RNA, 22 nt, Human
agaauguagucuuggagauuua

SEQ ID NO: 686496 - RNA, 22 nt, Human
aguauauggggaauugcauaau

SEQ ID NO: 686497 - RNA, 22 nt, Human
ugcccagccccuaucccuggga

SEQ ID NO: 686498 - RNA, 22 nt, Human
uaugugcauaugcauacacaca

SEQ ID NO: 686499 - RNA, 22 nt, Human
ugcugugguucccagaguggau

SEQ ID NO: 686500 - RNA, 22 nt, Human
aaggagaauuuggcuugugaug

SEQ ID NO: 686501 - RNA, 22 nt, Human
uuaucuuagaggugauuguauu

SEQ ID NO: 686502 - RNA, 22 nt, Human
guuccgcuucauauuuggaguc

SEQ ID NO: 686503 - RNA, 22 nt, Human
uccaggugacagagacaggaua

SEQ ID NO: 686504 - RNA, 22 nt, Human
agucugccaagccagaucaugu

SEQ ID NO: 686505 - RNA, 22 nt, Human
gcccagugguaaaagcaggccu

SEQ ID NO: 686506 - RNA, 23 nt, Human
agcugggcaaggauccgggcucc

SEQ ID NO: 686507 - RNA, 22 nt, Human
auauagguuaucauauuugccc

SEQ ID NO: 686508 - RNA, 22 nt, Human
gagguggcuccaggagcaaugc

SEQ ID NO: 686509 - RNA, 22 nt, Human
acacaucagaaauaugaaugag

SEQ ID NO: 686510 - RNA, 22 nt, Human
acagaauuaucaggaaauguua

SEQ ID NO: 686511 - RNA, 22 nt, Human
uaaugagaauucuuuuugggua

SEQ ID NO: 686512 - RNA, 22 nt, Human
gucagggcacagugacagcucc

SEQ ID NO: 686513 - RNA, 22 nt, Human
uagauucugacccucuuuuuac

SEQ ID NO: 686514 - RNA, 22 nt, Human
uuuacagucucuauagucaaaa

SEQ ID NO: 686515 - RNA, 22 nt, Human
gauuauuuugugcaauaaucgg

SEQ ID NO: 686516 - RNA, 22 nt, Human
uuuaguguagccuaagcagaau

SEQ ID NO: 686517 - RNA, 22 nt, Human
uucccucucuccagggcugccu

SEQ ID NO: 686518 - RNA, 22 nt, Human
uucagaacaaccaugguuagau

SEQ ID NO: 686519 - RNA, 22 nt, Human
gauucuuaugagugaacuuuac

SEQ ID NO: 686520 - RNA, 22 nt, Human
uaacaacaugcaauuuaaccuu

SEQ ID NO: 686521 - RNA, 22 nt, Human
agaacagugcugauaaaucaua

SEQ ID NO: 686522 - RNA, 22 nt, Human
uggaccccagacaagccagggu

SEQ ID NO: 686523 - RNA, 22 nt, Human
auuacacuuguucaucaucacc

SEQ ID NO: 686524 - RNA, 22 nt, Human
aaguuuuugguagagaaaagua

SEQ ID NO: 686525 - RNA, 22 nt, Human
uuguuacacauaauaacauuuu

SEQ ID NO: 686526 - RNA, 22 nt, Human
acacauauucauauguacuuac

SEQ ID NO: 686527 - RNA, 22 nt, Human
acccaggagcaggcugggcagu

SEQ ID NO: 686528 - RNA, 22 nt, Human
ucacugugcucucuagauaggc

SEQ ID NO: 686529 - RNA, 22 nt, Human
gggcccugggauucagagcaag

SEQ ID NO: 686530 - RNA, 22 nt, Human
acugggccuugccauggcagcc

SEQ ID NO: 686531 - RNA, 22 nt, Human
agcaggugaucgcgugugcucc

SEQ ID NO: 686532 - RNA, 22 nt, Human
aaugaacauauaaagagaucuu

SEQ ID NO: 686533 - RNA, 22 nt, Human
aguggcugccaagauauaauuc

SEQ ID NO: 686534 - RNA, 22 nt, Human
cuguggggccaaauucuccucu

SEQ ID NO: 686535 - RNA, 20 nt, Human
cuggggaggaggauguguuc

SEQ ID NO: 686536 - RNA, 22 nt, Human
augcacaucuuacagaugcaga

SEQ ID NO: 686537 - RNA, 22 nt, Human
uggucaaaaaggccuagacaca

SEQ ID NO: 686538 - RNA, 17 nt, Human
aggaaagucugcugucc

SEQ ID NO: 686539 - RNA, 22 nt, Human
uagaagauaagacaagugcugc

SEQ ID NO: 686540 - RNA, 22 nt, Human
caggagcuggauaggaccacaa

SEQ ID NO: 686541 - RNA, 22 nt, Human
agcagucaggccucagagccgu

SEQ ID NO: 686542 - RNA, 22 nt, Human
aauauacuauacuacuuucugg

SEQ ID NO: 686543 - RNA, 22 nt, Human
auuaaagacagcagauggaugg

SEQ ID NO: 686544 - RNA, 22 nt, Human
auuucagaguagaucguuauuu

SEQ ID NO: 686545 - RNA, 23 nt, Human
gcccugacugcggccucccacuc

SEQ ID NO: 686546 - RNA, 22 nt, Human
aggugggcccagugggcuccag

SEQ ID NO: 686547 - RNA, 22 nt, Human
augugcaauggugucaccacau

SEQ ID NO: 686548 - RNA, 22 nt, Human
guacuuccagccaagugagaca

SEQ ID NO: 686549 - RNA, 22 nt, Human
caagcaggaugaagcccaggga

SEQ ID NO: 686550 - RNA, 18 nt, Human
gcugggguugagcucucc

SEQ ID NO: 686551 - RNA, 22 nt, Human
aguaacacuuggaaugauagca

SEQ ID NO: 686552 - RNA, 22 nt, Human
uucaaaucacuuuggagcuuaa

SEQ ID NO: 686553 - RNA, 22 nt, Human
aagguuuccagugauauugugg

SEQ ID NO: 686554 - RNA, 20 nt, Human
auucagaauaggcauguaaa

SEQ ID NO: 686555 - RNA, 22 nt, Human
uucauuuaauuuguguauuaac

SEQ ID NO: 686556 - RNA, 22 nt, Human
ggaagcugaggcccagugaagg

SEQ ID NO: 686557 - RNA, 22 nt, Human
aaaauggucucagcuggcacca

SEQ ID NO: 686558 - RNA, 22 nt, Human
acccucagcuucuuggauuaau

SEQ ID NO: 686559 - RNA, 22 nt, Human
cucagggacaaggggagacccc

SEQ ID NO: 686560 - RNA, 22 nt, Human
cugaagcugaaaacuuccagca

SEQ ID NO: 686561 - RNA, 22 nt, Human
auguggaaugaacaaaggaggc

SEQ ID NO: 686562 - RNA, 22 nt, Human
auugacuagagucacaguugca

SEQ ID NO: 686563 - RNA, 23 nt, Human
acagaaaucauuuguaagguacc

SEQ ID NO: 686564 - RNA, 22 nt, Human
aagccacuuucagcugucucag

SEQ ID NO: 686565 - RNA, 22 nt, Human
cauuuccuuccugcugcuccuc

SEQ ID NO: 686566 - RNA, 22 nt, Human
cuggccagagguuccucugccc

SEQ ID NO: 686567 - RNA, 22 nt, Human
gcagauggcugagccugcagau

SEQ ID NO: 686568 - RNA, 21 nt, Human
caucuuagguuguacauauau

SEQ ID NO: 686569 - RNA, 22 nt, Human
auacacugguuuaugauauugu

SEQ ID NO: 686570 - RNA, 18 nt, Human
ccagugccaagaguggca

SEQ ID NO: 686571 - RNA, 22 nt, Human
agcuguuggaguaaagcacuua

SEQ ID NO: 686572 - RNA, 22 nt, Human
gaaguuuagaagugacagguuu

SEQ ID NO: 686573 - RNA, 22 nt, Human
uucuaaugaaaguggaccaugg

SEQ ID NO: 686574 - RNA, 22 nt, Human
uucaggagugucaggagugccu

SEQ ID NO: 686575 - RNA, 20 nt, Human
ccuguggagcugccuccucc

SEQ ID NO: 686576 - RNA, 22 nt, Human
uugaaaacagcguagauucaca

SEQ ID NO: 686577 - RNA, 22 nt, Human
guacuuuaaaucaauguagauu

SEQ ID NO: 686578 - RNA, 22 nt, Human
aggcagaaccagcugggacuuu

SEQ ID NO: 686579 - RNA, 22 nt, Human
cagaucugcuccucuguccaug

SEQ ID NO: 686580 - RNA, 22 nt, Human
ucucuuaauuuuggaauagugu

SEQ ID NO: 686581 - RNA, 22 nt, Human
cacugcagcaccaugcagggcu

SEQ ID NO: 686582 - RNA, 22 nt, Human
gaacugaagacuuuuacuguac

SEQ ID NO: 686583 - RNA, 22 nt, Human
guguuauuagagcauuaauuuu

SEQ ID NO: 686584 - RNA, 22 nt, Human
ccuggcugucguuuugugaaau

SEQ ID NO: 686585 - RNA, 22 nt, Human
cuucuguggauguuggaugcau

SEQ ID NO: 686586 - RNA, 22 nt, Human
cagcugagaaggucugaucagg

SEQ ID NO: 686587 - RNA, 22 nt, Human
accagagagccuaggcugggca

SEQ ID NO: 686588 - RNA, 23 nt, Human
ugaauuuggaacucagagaauua

SEQ ID NO: 686589 - RNA, 22 nt, Human
aaacagcuuucagaaucucuca

SEQ ID NO: 686590 - RNA, 22 nt, Human
cuuaggaacgcucugccuagug

SEQ ID NO: 686591 - RNA, 19 nt, Human
aggcuuggcuagauuuacu

SEQ ID NO: 686592 - RNA, 22 nt, Human
agaguggcuugcucagcuagca

SEQ ID NO: 686593 - RNA, 22 nt, Human
uuaucacuuaugagcuuuuugc

SEQ ID NO: 686594 - RNA, 22 nt, Human
ugcauuuguaacauucaagaau

SEQ ID NO: 686595 - RNA, 22 nt, Human
cagaaaauagaguuucucugag

SEQ ID NO: 686596 - RNA, 21 nt, Human
auuucauggugcuuuuaagaa

SEQ ID NO: 686597 - RNA, 22 nt, Human
auucugggcaagccuucuuaua

SEQ ID NO: 686598 - RNA, 22 nt, Human
aaggcucugcaaaaccuccaag

SEQ ID NO: 686599 - RNA, 22 nt, Human
aagaugcaugcugaagcuggcu

SEQ ID NO: 686600 - RNA, 22 nt, Human
ugcagggcauaggguccaguuu

SEQ ID NO: 686601 - RNA, 22 nt, Human
ggccucagagaaggcugugcgg

SEQ ID NO: 686602 - RNA, 22 nt, Human
cucuccuugcagauggcugccu

SEQ ID NO: 686603 - RNA, 22 nt, Human
uuugaaguucccccauaucaga

SEQ ID NO: 686604 - RNA, 22 nt, Human
aaagcagguuaugaccauggcc

SEQ ID NO: 686605 - RNA, 22 nt, Human
uuguaagagagaauugcaaauu

SEQ ID NO: 686606 - RNA, 22 nt, Human
gccagaggggcucgaaggcgcg

SEQ ID NO: 686607 - RNA, 22 nt, Human
ggcaggagcucagguugguucc

SEQ ID NO: 686608 - RNA, 22 nt, Human
uugaaggacauccuauuucuag

SEQ ID NO: 686609 - RNA, 22 nt, Human
cuuucuugcauaauuugaaacc

SEQ ID NO: 686610 - RNA, 22 nt, Human
aucccagauggaggcuggucac

SEQ ID NO: 686611 - RNA, 22 nt, Human
aaaugcacaggagaaccaauuc

SEQ ID NO: 686612 - RNA, 17 nt, Human
uuuuguucaucuucaaa

SEQ ID NO: 686613 - RNA, 22 nt, Human
gacauuuguaucuuaggggaaa

SEQ ID NO: 686614 - RNA, 22 nt, Human
gagggcaccagaagagccagau

SEQ ID NO: 686615 - RNA, 22 nt, Human
uccagcuccugaguucacugcu

SEQ ID NO: 686616 - RNA, 22 nt, Human
cuuucucaaugccggaaggcac

SEQ ID NO: 686617 - RNA, 22 nt, Human
auugcugaacuuauaaaugaau

SEQ ID NO: 686618 - RNA, 22 nt, Human
cagcccuguccaaugucugcuc

SEQ ID NO: 686619 - RNA, 22 nt, Human
uguugagacugagggagucagc

SEQ ID NO: 686620 - RNA, 22 nt, Human
auaugacauaaaaucauuuuug

SEQ ID NO: 686621 - RNA, 23 nt, Human
cagagcugauuaaacuuaaucuc

SEQ ID NO: 686622 - RNA, 22 nt, Human
gaagcuccguacuaugacuuuu

SEQ ID NO: 686623 - RNA, 22 nt, Human
cuuucucuugagcaagagcugu

SEQ ID NO: 686624 - RNA, 22 nt, Human
cacccugcuacaaagccuccug

SEQ ID NO: 686625 - RNA, 22 nt, Human
cagaguaaaccugucaucaaga

SEQ ID NO: 686626 - RNA, 22 nt, Human
augcccugcucucgggaaggga

SEQ ID NO: 686627 - RNA, 22 nt, Human
gagcuaagaacugugccaggug

SEQ ID NO: 686628 - RNA, 22 nt, Human
gagccaagggcgugcuggagag

SEQ ID NO: 686629 - RNA, 22 nt, Human
uguccugugucuaggggucuuc

SEQ ID NO: 686630 - RNA, 22 nt, Human
ggaagaaaucugguuaagagau

SEQ ID NO: 686631 - RNA, 22 nt, Human
ugcuucgcccccuggugcagcu

SEQ ID NO: 686632 - RNA, 22 nt, Human
uauuaauucuugccaauucucc

SEQ ID NO: 686633 - RNA, 22 nt, Human
uguacaguguagucaugagguu

SEQ ID NO: 686634 - RNA, 22 nt, Human
cagucccagacauaguaaggga

SEQ ID NO: 686635 - RNA, 22 nt, Human
ucaggccagcaccaucccuauc

SEQ ID NO: 686636 - RNA, 22 nt, Human
ucuggcuuucauuuguuuaaag

SEQ ID NO: 686637 - RNA, 22 nt, Human
uuggugaguauggacacagaga

SEQ ID NO: 686638 - RNA, 22 nt, Human
ugcucuggaaauaaaugauuua

SEQ ID NO: 686639 - RNA, 22 nt, Human
ugcaugauguuaaacaucaggu

SEQ ID NO: 686640 - RNA, 22 nt, Human
cugaaggaagcagaagcgaggu

SEQ ID NO: 686641 - RNA, 22 nt, Human
ugccaggcuccggaacgacagu

SEQ ID NO: 686642 - RNA, 22 nt, Human
aguccugaugcucuggcaggag

SEQ ID NO: 686643 - RNA, 19 nt, Human
ugggaugaugcagaaggua

SEQ ID NO: 686644 - RNA, 22 nt, Human
uauuucagucacuucuucucug

SEQ ID NO: 686645 - RNA, 22 nt, Human
cuuggggauuuuaaagaccucu

SEQ ID NO: 686646 - RNA, 22 nt, Human
uuuuuguucccagagaauuugu

SEQ ID NO: 686647 - RNA, 22 nt, Human
aggucagcugcugauaggcagc

SEQ ID NO: 686648 - RNA, 22 nt, Human
ugcccaggcuccucgcagccuu

SEQ ID NO: 686649 - RNA, 20 nt, Human
uuucaaaggcaccuaugaag

SEQ ID NO: 686650 - RNA, 22 nt, Human
ugaaaaacugaauaguugagua

SEQ ID NO: 686651 - RNA, 22 nt, Human
cuaccugaaaagguugugguga

SEQ ID NO: 686652 - RNA, 22 nt, Human
aaucaggagugugcacuuugau

SEQ ID NO: 686653 - RNA, 22 nt, Human
uggguggcggccugguucugag

SEQ ID NO: 686654 - RNA, 22 nt, Human
uggagucacagugaccugaguc

SEQ ID NO: 686655 - RNA, 22 nt, Human
aguuuaaaucauguuuuguaac

SEQ ID NO: 686656 - RNA, 22 nt, Human
gugggcagugccugacggauga

SEQ ID NO: 686657 - RNA, 22 nt, Human
gagagcuguguucauucuacca

SEQ ID NO: 686658 - RNA, 22 nt, Human
gggucaggccucaaggugggcu

SEQ ID NO: 686659 - RNA, 22 nt, Human
aaguggagagcccuggaggucu

SEQ ID NO: 686660 - RNA, 22 nt, Human
gugcaaaagcaauugcaguuuu

SEQ ID NO: 686661 - RNA, 22 nt, Human
uggacauguccggccagacaau

SEQ ID NO: 686662 - RNA, 22 nt, Human
uagaauguggagguaacagacu

SEQ ID NO: 686663 - RNA, 23 nt, Human
ugggaauugcaggggguucugcc

SEQ ID NO: 686664 - RNA, 22 nt, Human
uaucuaagagagucaauauuua

SEQ ID NO: 686665 - RNA, 21 nt, Human
acaaacugaaaugaguuuccu

SEQ ID NO: 686666 - RNA, 22 nt, Human
cagaggcauacucccagucuug

SEQ ID NO: 686667 - RNA, 22 nt, Human
cagaggugcuggagugaguccu

SEQ ID NO: 686668 - RNA, 22 nt, Human
aggcaggcccugggccaucccg

SEQ ID NO: 686669 - RNA, 22 nt, Human
uucuagcuuuuugcaccaaggu

SEQ ID NO: 686670 - RNA, 22 nt, Human
uagguucagcuuucauccugaa

SEQ ID NO: 686671 - RNA, 22 nt, Human
aagauaaguaacgagccucagu

SEQ ID NO: 686672 - RNA, 22 nt, Human
aagucaauuaguaaacuuggaa

SEQ ID NO: 686673 - RNA, 22 nt, Human
guuugcauauuugcacaggaau

SEQ ID NO: 686674 - RNA, 22 nt, Human
agaaccucuggauacaguuuaa

SEQ ID NO: 686675 - RNA, 22 nt, Human
ugcuucugacugggucaguuga

SEQ ID NO: 686676 - RNA, 19 nt, Human
gcaggaaaugagugauugc

SEQ ID NO: 686677 - RNA, 19 nt, Human
aggugcuggugaggguguu

SEQ ID NO: 686678 - RNA, 22 nt, Human
uccauuggucucugugcccagg

SEQ ID NO: 686679 - RNA, 22 nt, Human
gaaaaugugccuuuggguauug

SEQ ID NO: 686680 - RNA, 22 nt, Human
uuauagaugccuugaguaaaug

SEQ ID NO: 686681 - RNA, 22 nt, Human
uuaugacagaaaugaaaagcug

SEQ ID NO: 686682 - RNA, 22 nt, Human
uugagcccaggaggccugggug

SEQ ID NO: 686683 - RNA, 22 nt, Human
gccacagucaggacggggagag

SEQ ID NO: 686684 - RNA, 22 nt, Human
aauaucagcucugucacuuacu

SEQ ID NO: 686685 - RNA, 22 nt, Human
gggcacagagggucuugaagaa

SEQ ID NO: 686686 - RNA, 22 nt, Human
ucugccaccaacugucacuaca

SEQ ID NO: 686687 - RNA, 22 nt, Human
uucacccuggaccagaaauugg

SEQ ID NO: 686688 - RNA, 22 nt, Human
uugacacaguuuucucauuaag

SEQ ID NO: 686689 - RNA, 22 nt, Human
cagaaaggacagagugagggug

SEQ ID NO: 686690 - RNA, 22 nt, Human
ugucaaaaugacuuuacuacag

SEQ ID NO: 686691 - RNA, 22 nt, Human
ggacaggugcaaagggcacaug

SEQ ID NO: 686692 - RNA, 22 nt, Human
uaaugcuucaauuuccuugauu

SEQ ID NO: 686693 - RNA, 22 nt, Human
cuuucucuuacccaaggaucug

SEQ ID NO: 686694 - RNA, 22 nt, Human
gaggcagcuuggggcugugggu

SEQ ID NO: 686695 - RNA, 22 nt, Human
cugucucugauaagcucgaggg

SEQ ID NO: 686696 - RNA, 22 nt, Human
gaggccugcagcguggucccug

SEQ ID NO: 686697 - RNA, 20 nt, Human
uucuaauuugauggaguagc

SEQ ID NO: 686698 - RNA, 22 nt, Human
ucacauguuaggucgggcaagg

SEQ ID NO: 686699 - RNA, 22 nt, Human
cauuucugggagacaugcuaga

SEQ ID NO: 686700 - RNA, 22 nt, Human
cugggagaucuguugggacugg

SEQ ID NO: 686701 - RNA, 22 nt, Human
gaggccaggaggaucucucuaa

SEQ ID NO: 686702 - RNA, 22 nt, Human
ucuguggcacgauugcacugca

SEQ ID NO: 686703 - RNA, 17 nt, Human
ugaacuuuagguggagc

SEQ ID NO: 686704 - RNA, 22 nt, Human
ccucuggcucacagcaccaacu

SEQ ID NO: 686705 - RNA, 22 nt, Human
gugacagagugagacccugucu

SEQ ID NO: 686706 - RNA, 23 nt, Human
uuguuuuuagagguggcaugaga

SEQ ID NO: 686707 - RNA, 22 nt, Human
uacacccacauugagcauggga

SEQ ID NO: 686708 - RNA, 22 nt, Human
cacagcuaccugcaugccugcu

SEQ ID NO: 686709 - RNA, 21 nt, Human
gggaagacugucaggauuccu

SEQ ID NO: 686710 - RNA, 22 nt, Human
gugcaugcacacaugugugagg

SEQ ID NO: 686711 - RNA, 22 nt, Human
ucugccugccgagaacaccuac

SEQ ID NO: 686712 - RNA, 22 nt, Human
aagagcuggauugugcugcaga

SEQ ID NO: 686713 - RNA, 22 nt, Human
gcuggccucaucacugacuucu

SEQ ID NO: 686714 - RNA, 22 nt, Human
cagacugagggcaucacauacg

SEQ ID NO: 686715 - RNA, 22 nt, Human
cucccagccuucgccagucuga

SEQ ID NO: 686716 - RNA, 22 nt, Human
uuggaauuugcuucagcuaaua

SEQ ID NO: 686717 - RNA, 22 nt, Human
uggggacacagagccaaacuau

SEQ ID NO: 686718 - RNA, 22 nt, Human
gaggcagaggaagguggucucu

SEQ ID NO: 686719 - RNA, 22 nt, Human
gugcagcucaguugaaaugcag

SEQ ID NO: 686720 - RNA, 22 nt, Human
agacccagaaagcagcugcauu

SEQ ID NO: 686721 - RNA, 22 nt, Human
auuaagggccaauccuccagcc

SEQ ID NO: 686722 - RNA, 22 nt, Human
acaaacuaccuacagauguuca

SEQ ID NO: 686723 - RNA, 22 nt, Human
gcagcuuucuugcccuaaucuu

SEQ ID NO: 686724 - RNA, 22 nt, Human
ggcugcccucugcugacugcaa

SEQ ID NO: 686725 - RNA, 22 nt, Human
ucacaguuuccauaggucagca

SEQ ID NO: 686726 - RNA, 22 nt, Human
gcaggccuuggcaaugagccug

SEQ ID NO: 686727 - RNA, 22 nt, Human
aggggcuuguggaguugcuggu

SEQ ID NO: 686728 - RNA, 22 nt, Human
cuucuuuaauguauacaaaaga

SEQ ID NO: 686729 - RNA, 22 nt, Human
cucagacaaaugauuaagguua

SEQ ID NO: 686730 - RNA, 22 nt, Human
agagggaaaaacucaugucauu

SEQ ID NO: 686731 - RNA, 22 nt, Human
uucagaaacaucaguggaugga

SEQ ID NO: 686732 - RNA, 22 nt, Human
gucagaaaacuucccuuugagu

SEQ ID NO: 686733 - RNA, 22 nt, Human
accugccuucucaaggacauga

SEQ ID NO: 686734 - RNA, 22 nt, Human
auggaucacagugccgugggug

SEQ ID NO: 686735 - RNA, 22 nt, Human
uuugaaaguguuuacuugggaa

SEQ ID NO: 686736 - RNA, 23 nt, Human
cugggccuauggucugaauccaa

SEQ ID NO: 686737 - RNA, 22 nt, Human
cugagaggcagccagagaaaau

SEQ ID NO: 686738 - RNA, 22 nt, Human
uucagugcuaaaaagucucaag

SEQ ID NO: 686739 - RNA, 22 nt, Human
gaaugucuucuguucccagcug

SEQ ID NO: 686740 - RNA, 22 nt, Human
acuuuagauauuccucuguaca

SEQ ID NO: 686741 - RNA, 22 nt, Human
uccaaaaaacguuugaauaguu

SEQ ID NO: 686742 - RNA, 22 nt, Human
uacagggguaacaguggggaau

SEQ ID NO: 686743 - RNA, 19 nt, Human
gaauguuuguauucagcgc

SEQ ID NO: 686744 - RNA, 22 nt, Human
gaggcaguaauugugggcaaua

SEQ ID NO: 686745 - RNA, 23 nt, Human
aggcugccagaaauuggguaagg

SEQ ID NO: 686746 - RNA, 22 nt, Human
uucuaagcucugaaauaaaucu

SEQ ID NO: 686747 - RNA, 22 nt, Human
ggacaggccuggcacaguacug

SEQ ID NO: 686748 - RNA, 22 nt, Human
ccaggagcgcgugaacaggcug

SEQ ID NO: 686749 - RNA, 22 nt, Human
ucugucacucuagagauggcag

SEQ ID NO: 686750 - RNA, 22 nt, Human
ucauacaggcucaagcuauacg

SEQ ID NO: 686751 - RNA, 22 nt, Human
gcuggcugcuguugagacuugu

SEQ ID NO: 686752 - RNA, 18 nt, Human
uggagggcuugcugcagc

SEQ ID NO: 686753 - RNA, 22 nt, Human
agcagguguagggcucuuugua

SEQ ID NO: 686754 - RNA, 22 nt, Human
caugaauuuauauuauuaguga

SEQ ID NO: 686755 - RNA, 22 nt, Human
cccaggcucccaggugggacaa

SEQ ID NO: 686756 - RNA, 22 nt, Human
uuuggucuuuuguaaguuaucu

SEQ ID NO: 686757 - RNA, 22 nt, Human
gcugggcuggccgccgagaucg

SEQ ID NO: 686758 - RNA, 21 nt, Human
uuagcaguuguugauuuccag

SEQ ID NO: 686759 - RNA, 22 nt, Human
cagacagaccugcaagggcaca

SEQ ID NO: 686760 - RNA, 22 nt, Human
ugaaagcucugucaucauuccu

SEQ ID NO: 686761 - RNA, 22 nt, Human
auggauaauggugauaguugca

SEQ ID NO: 686762 - RNA, 19 nt, Human
ucguggggaggugggcagc

SEQ ID NO: 686763 - RNA, 22 nt, Human
uuccugguccuauuauauacac

SEQ ID NO: 686764 - RNA, 22 nt, Human
aagcauuuggcaugaaacucuu

SEQ ID NO: 686765 - RNA, 23 nt, Human
aggcuggcuucaggagccucucc

SEQ ID NO: 686766 - RNA, 22 nt, Human
augggcuguccuaguccagccc

SEQ ID NO: 686767 - RNA, 22 nt, Human
ugucugaacaaacucugccucc

SEQ ID NO: 686768 - RNA, 22 nt, Human
cuuauucauauauucucgguag

SEQ ID NO: 686769 - RNA, 22 nt, Human
ugcuuaaaguaguggauuguua

SEQ ID NO: 686770 - RNA, 22 nt, Human
cagcuguuccuggaaggagacc

SEQ ID NO: 686771 - RNA, 22 nt, Human
gacugggggcagccgcaccagu

SEQ ID NO: 686772 - RNA, 22 nt, Human
ucccuguaguucguggucuuug

SEQ ID NO: 686773 - RNA, 22 nt, Human
acuguuggcuucugguagugac

SEQ ID NO: 686774 - RNA, 22 nt, Human
uggcuucacccguccuccccac

SEQ ID NO: 686775 - RNA, 22 nt, Human
uccaucugguggcuuccuuuug

SEQ ID NO: 686776 - RNA, 22 nt, Human
aauguauguguauaucaaauca

SEQ ID NO: 686777 - RNA, 22 nt, Human
gcucugugguggggcagaguuu

SEQ ID NO: 686778 - RNA, 22 nt, Human
gcuuugggggcugcagugcgug

SEQ ID NO: 686779 - RNA, 22 nt, Human
aggcucuggaguuagccaggca

SEQ ID NO: 686780 - RNA, 22 nt, Human
acugggcaccaucaugagauag

SEQ ID NO: 686781 - RNA, 22 nt, Human
guggaaaacugagaaaauugcu

SEQ ID NO: 686782 - RNA, 22 nt, Human
uccugaaguauggguauggagu

SEQ ID NO: 686783 - RNA, 22 nt, Human
auaaagucaaggcauuuuauga

SEQ ID NO: 686784 - RNA, 22 nt, Human
ccuggcaguggugaagaagagg

SEQ ID NO: 686785 - RNA, 22 nt, Human
cuugggaaugcuaacagaugac

SEQ ID NO: 686786 - RNA, 22 nt, Human
caagauuugacuucgugguuug

SEQ ID NO: 686787 - RNA, 21 nt, Human
ccuggcacuggccugcugagc

SEQ ID NO: 686788 - RNA, 18 nt, Human
uccagcaggucugaggug

SEQ ID NO: 686789 - RNA, 22 nt, Human
uaugcuuugcaauuggaaaagg

SEQ ID NO: 686790 - RNA, 22 nt, Human
ugugaagaucaggguccuagag

SEQ ID NO: 686791 - RNA, 22 nt, Human
ccuggcucaguguugaaggggu

SEQ ID NO: 686792 - RNA, 22 nt, Human
uaggacuuggugacucucaaug

SEQ ID NO: 686793 - RNA, 22 nt, Human
gggagagcgcgcuagggccgag

SEQ ID NO: 686794 - RNA, 22 nt, Human
gccaccuguaagccauuaggcc

SEQ ID NO: 686795 - RNA, 22 nt, Human
augcacauuguagccacacaau

SEQ ID NO: 686796 - RNA, 22 nt, Human
agagcuggaaucagaccucagg

SEQ ID NO: 686797 - RNA, 22 nt, Human
acucacagucccuguaggagug

SEQ ID NO: 686798 - RNA, 22 nt, Human
acuucauguuucuauuagcuca

SEQ ID NO: 686799 - RNA, 22 nt, Human
agauggagucucacucuuguug

SEQ ID NO: 686800 - RNA, 22 nt, Human
aagauucucagaaaaaggcuau

SEQ ID NO: 686801 - RNA, 22 nt, Human
accuugggcaaccugcuccugc

SEQ ID NO: 686802 - RNA, 22 nt, Human
ucuguaucuaauuuuacaguag

SEQ ID NO: 686803 - RNA, 22 nt, Human
uuuagguuaaucaacaaacauu

SEQ ID NO: 686804 - RNA, 22 nt, Human
aauaaucucccuuuuuguaugu

SEQ ID NO: 686805 - RNA, 22 nt, Human
aauaauaagauacuaagggagu

SEQ ID NO: 686806 - RNA, 22 nt, Human
uaucuuugcaaauaucucuaag

SEQ ID NO: 686807 - RNA, 22 nt, Human
auucacacauacucauguguga

SEQ ID NO: 686808 - RNA, 22 nt, Human
uaugaacuuuugaugugacaug

SEQ ID NO: 686809 - RNA, 22 nt, Human
cacaggaauaagucaaacuuca

SEQ ID NO: 686810 - RNA, 23 nt, Human
ucuguggcuccuucaggcugcug

SEQ ID NO: 686811 - RNA, 22 nt, Human
uaaagugcagacucccggaaac

SEQ ID NO: 686812 - RNA, 22 nt, Human
aaaucccacucagaaacugcca

SEQ ID NO: 686813 - RNA, 22 nt, Human
uguacacugcaggaugcauugc

SEQ ID NO: 686814 - RNA, 22 nt, Human
gggcuccagccaggugucccca

SEQ ID NO: 686815 - RNA, 19 nt, Human
agacaaguuuccagaagcc

SEQ ID NO: 686816 - RNA, 22 nt, Human
agggacagucuacuguucacug

SEQ ID NO: 686817 - RNA, 22 nt, Human
aaguccugaaacuucuuucuga

SEQ ID NO: 686818 - RNA, 22 nt, Human
cagagacaguuucacagggucu

SEQ ID NO: 686819 - RNA, 22 nt, Human
cagggcuuugaacaggcaucaa

SEQ ID NO: 686820 - RNA, 22 nt, Human
auuuuacuacuccaauuaauga

SEQ ID NO: 686821 - RNA, 22 nt, Human
ugcagggccuugggucuuucuu

SEQ ID NO: 686822 - RNA, 20 nt, Human
aaugaaguuauuaaugaugu

SEQ ID NO: 686823 - RNA, 22 nt, Human
cauguacauucuguagauggag

SEQ ID NO: 686824 - RNA, 22 nt, Human
gaagcacauggcugugagcaac

SEQ ID NO: 686825 - RNA, 22 nt, Human
ugauauggcuaaagaaaguuuc

SEQ ID NO: 686826 - RNA, 21 nt, Human
ucuuuccugcccaguugcccu

SEQ ID NO: 686827 - RNA, 22 nt, Human
uuggagugacagaugaggaaac

SEQ ID NO: 686828 - RNA, 22 nt, Human
acccugggagggagaaaucaga

SEQ ID NO: 686829 - RNA, 22 nt, Human
ugugucucuccuggaagcacgu

SEQ ID NO: 686830 - RNA, 22 nt, Human
gugcauauaugugcagcaucaa

SEQ ID NO: 686831 - RNA, 22 nt, Human
acaugauauuaaugucuuauuu

SEQ ID NO: 686832 - RNA, 22 nt, Human
ccacuuucugagggaacagcag

SEQ ID NO: 686833 - RNA, 19 nt, Human
aagagucacaggcagcccu

SEQ ID NO: 686834 - RNA, 22 nt, Human
cuccccacauuucucccugucu

SEQ ID NO: 686835 - RNA, 22 nt, Human
auggcaccuuccccagagcuca

SEQ ID NO: 686836 - RNA, 22 nt, Human
cuuuuguuaggagaaaacauca

SEQ ID NO: 686837 - RNA, 22 nt, Human
aguguacauguuuacagcaucu

SEQ ID NO: 686838 - RNA, 22 nt, Human
agcagggcuccauuucacugcc

SEQ ID NO: 686839 - RNA, 22 nt, Human
ugauuacacuauuugggaauag

SEQ ID NO: 686840 - RNA, 22 nt, Human
uccagggacagcgcuggagcua

SEQ ID NO: 686841 - RNA, 22 nt, Human
acaucuucacugguuucuggaa

SEQ ID NO: 686842 - RNA, 22 nt, Human
acuuuacaaacuccucacuguu

SEQ ID NO: 686843 - RNA, 22 nt, Human
aacucuugggcugcaugcuguu

SEQ ID NO: 686844 - RNA, 22 nt, Human
uguuccuaaauaugaauggaga

SEQ ID NO: 686845 - RNA, 22 nt, Human
cagcuggcuccaccucugggcu

SEQ ID NO: 686846 - RNA, 23 nt, Human
uuuuccagaaucgacucuguaga

SEQ ID NO: 686847 - RNA, 22 nt, Human
augaccccuaaaauuuacuguc

SEQ ID NO: 686848 - RNA, 22 nt, Human
uaagaugacuacuuaccacuga

SEQ ID NO: 686849 - RNA, 22 nt, Human
gcuggcugagcacugguuuaua

SEQ ID NO: 686850 - RNA, 22 nt, Human
aggaaauguacaaaugaagaug

SEQ ID NO: 686851 - RNA, 22 nt, Human
ucaguaaaugagcaaaaauuuc

SEQ ID NO: 686852 - RNA, 22 nt, Human
ugaacuuuuauuugaugacagg

SEQ ID NO: 686853 - RNA, 22 nt, Human
aggucaaagaaccuagcuauag

SEQ ID NO: 686854 - RNA, 21 nt, Human
aacugagaccagcuaaagugg

SEQ ID NO: 686855 - RNA, 22 nt, Human
auaaaaguuuccaaucaugccu

SEQ ID NO: 686856 - RNA, 22 nt, Human
gagguuggugaggggacacggu

SEQ ID NO: 686857 - RNA, 22 nt, Human
caagaacauugugaucacuuca

SEQ ID NO: 686858 - RNA, 18 nt, Human
ggccugaggauuucagca

SEQ ID NO: 686859 - RNA, 22 nt, Human
caagggcucuuuugaggaaugu

SEQ ID NO: 686860 - RNA, 22 nt, Human
cauauucaagggguaaggcaaa

SEQ ID NO: 686861 - RNA, 22 nt, Human
aguuucacagaauaugaagguu

SEQ ID NO: 686862 - RNA, 22 nt, Human
ucacuggggccaugugagggac

SEQ ID NO: 686863 - RNA, 22 nt, Human
ggucccugaagaggccuggggu

SEQ ID NO: 686864 - RNA, 22 nt, Human
ggcugccuacuuucccagaguu

SEQ ID NO: 686865 - RNA, 22 nt, Human
ggcagcauugccaauccagaca

SEQ ID NO: 686866 - RNA, 22 nt, Human
caugucaauaaauauaacugca

SEQ ID NO: 686867 - RNA, 22 nt, Human
gauccuugcacuugacuuggca

SEQ ID NO: 686868 - RNA, 22 nt, Human
agggccagccgacuuccagccu

SEQ ID NO: 686869 - RNA, 22 nt, Human
gcagaugguggaggcaagaggc

SEQ ID NO: 686870 - RNA, 22 nt, Human
ugcugggcuaggguggagcucu

SEQ ID NO: 686871 - RNA, 22 nt, Human
agaaggcaucagaaguguguag

SEQ ID NO: 686872 - RNA, 22 nt, Human
aagcacagauugcugcauccau

SEQ ID NO: 686873 - RNA, 22 nt, Human
aggaaugguuauggggauagua

SEQ ID NO: 686874 - RNA, 22 nt, Human
aauguuuaauguuagugguaau

SEQ ID NO: 686875 - RNA, 20 nt, Human
agaaacagcacaauucuguu

SEQ ID NO: 686876 - RNA, 22 nt, Human
gcaguaggagggacaacuaccu

SEQ ID NO: 686877 - RNA, 21 nt, Human
ucaggaguggagagaauuggu

SEQ ID NO: 686878 - RNA, 22 nt, Human
gagggaauggugugcaagaggu

SEQ ID NO: 686879 - RNA, 22 nt, Human
ugaggaagugguuguaugguuu

SEQ ID NO: 686880 - RNA, 22 nt, Human
uccugccaggagugcuggcccu

SEQ ID NO: 686881 - RNA, 23 nt, Human
uggauaaagcugugcugcauagg

SEQ ID NO: 686882 - RNA, 22 nt, Human
acuucauguaguccaucagguu

SEQ ID NO: 686883 - RNA, 22 nt, Human
accagaaggaccagaggcaagg

SEQ ID NO: 686884 - RNA, 22 nt, Human
gcaaagcagucuucugugccua

SEQ ID NO: 686885 - RNA, 20 nt, Human
cugagcccccagccugcagg

SEQ ID NO: 686886 - RNA, 22 nt, Human
acaauuugaggcuacucaauug

SEQ ID NO: 686887 - RNA, 22 nt, Human
cuucuuuguucuguugucucac

SEQ ID NO: 686888 - RNA, 22 nt, Human
uucauuuguggugaaugaagug

SEQ ID NO: 686889 - RNA, 19 nt, Human
agugaguggggaaggcccu

SEQ ID NO: 686890 - RNA, 22 nt, Human
uuccagaauuuuguucugcuug

SEQ ID NO: 686891 - RNA, 22 nt, Human
ugaaacaaaauuaagauucucg

SEQ ID NO: 686892 - RNA, 22 nt, Human
aauauuuuugaggcccuguuau

SEQ ID NO: 686893 - RNA, 22 nt, Human
ugggccucaucuucaaugaguc

SEQ ID NO: 686894 - RNA, 22 nt, Human
gcacauacugcaaagauuacua

SEQ ID NO: 686895 - RNA, 22 nt, Human
ucccugaaccacuagugaugag

SEQ ID NO: 686896 - RNA, 22 nt, Human
agcugucuggaaguuccucaug

SEQ ID NO: 686897 - RNA, 22 nt, Human
gggcuuggcucauaaguggaug

SEQ ID NO: 686898 - RNA, 22 nt, Human
uugacaaaguuuaguaauaauc

SEQ ID NO: 686899 - RNA, 22 nt, Human
ugguuuuaaaagauguuugaga

SEQ ID NO: 686900 - RNA, 22 nt, Human
aggccucugggucuccucugac

SEQ ID NO: 686901 - RNA, 22 nt, Human
cgggcacugccuuuguugauuu

SEQ ID NO: 686902 - RNA, 22 nt, Human
ggagcagcacugccacacagag

SEQ ID NO: 686903 - RNA, 22 nt, Human
gcccugagaagaagucggaggg

SEQ ID NO: 686904 - RNA, 22 nt, Human
uuuaagagcauuugcaauuuau

SEQ ID NO: 686905 - RNA, 22 nt, Human
ucucaguccaaaugagagguug

SEQ ID NO: 686906 - RNA, 22 nt, Human
gcagaagucagaccaucugaau

SEQ ID NO: 686907 - RNA, 22 nt, Human
ugcccaaggucaccuaguuagu

SEQ ID NO: 686908 - RNA, 22 nt, Human
ugaaagcuguccacuaggcugu

SEQ ID NO: 686909 - RNA, 22 nt, Human
augcaugagcuuugugauccug

SEQ ID NO: 686910 - RNA, 22 nt, Human
ugcccuggcacacacacagcug

SEQ ID NO: 686911 - RNA, 22 nt, Human
caggugagcucuaucuagggag

SEQ ID NO: 686912 - RNA, 18 nt, Human
uggcagccagcugcuccu

SEQ ID NO: 686913 - RNA, 21 nt, Human
gcugcagggcccagggcaccc

SEQ ID NO: 686914 - RNA, 22 nt, Human
cucugugaaccccuccuuucuu

SEQ ID NO: 686915 - RNA, 18 nt, Human
uccugcagcuucuaugua

SEQ ID NO: 686916 - RNA, 22 nt, Human
uauuacaauuuacauugcacuu

SEQ ID NO: 686917 - RNA, 23 nt, Human
ugucuuuguuaggacuguguuua

SEQ ID NO: 686918 - RNA, 22 nt, Human
gcugggcucauuugugugucug

SEQ ID NO: 686919 - RNA, 22 nt, Human
gaugaagccccaguguaaguaa

SEQ ID NO: 686920 - RNA, 22 nt, Human
ucccuccuuaauaagaggucug

SEQ ID NO: 686921 - RNA, 18 nt, Human
cauuguuuccagaagacc

SEQ ID NO: 686922 - RNA, 22 nt, Human
agaagccauucucaguuccuga

SEQ ID NO: 686923 - RNA, 22 nt, Human
ucugggcugaaaugaaggccuu

SEQ ID NO: 686924 - RNA, 22 nt, Human
uaggacaguagcuggugcacag

SEQ ID NO: 686925 - RNA, 22 nt, Human
aguucucagcuuaguaugcugu

SEQ ID NO: 686926 - RNA, 22 nt, Human
agaggcaacauggggaacagau

SEQ ID NO: 686927 - RNA, 22 nt, Human
cucuuuuagagaugaaaauugg

SEQ ID NO: 686928 - RNA, 22 nt, Human
aacauaucauaggaugucauug

SEQ ID NO: 686929 - RNA, 21 nt, Human
gcugggccuguacuugcccug

SEQ ID NO: 686930 - RNA, 22 nt, Human
uucauugaaauguuucuagcug

SEQ ID NO: 686931 - RNA, 22 nt, Human
gggcuaggcuuggccagcacug

SEQ ID NO: 686932 - RNA, 22 nt, Human
cguccccucguucccacuuugg

SEQ ID NO: 686933 - RNA, 22 nt, Human
acauugagugcuccauaaauca

SEQ ID NO: 686934 - RNA, 22 nt, Human
uaauaguuucauaaugugcuuc

SEQ ID NO: 686935 - RNA, 22 nt, Human
agccacuguaaggggaauugcc

SEQ ID NO: 686936 - RNA, 22 nt, Human
aaggaugauugguaaugacacu

SEQ ID NO: 686937 - RNA, 22 nt, Human
cccagaaugauucagcgacagu

SEQ ID NO: 686938 - RNA, 18 nt, Human
ggcacuggugaugcagag

SEQ ID NO: 686939 - RNA, 22 nt, Human
gggugaggccuugcugccauca

SEQ ID NO: 686940 - RNA, 22 nt, Human
ucuauuaaugauucaauagugu

SEQ ID NO: 686941 - RNA, 22 nt, Human
aggcuggaguguagcagugcag

SEQ ID NO: 686942 - RNA, 22 nt, Human
ccaggagagcauugcacagagg

SEQ ID NO: 686943 - RNA, 22 nt, Human
auacaucuugucagauucaugu

SEQ ID NO: 686944 - RNA, 22 nt, Human
augcugaauaguucacucuucu

SEQ ID NO: 686945 - RNA, 22 nt, Human
aucccccucuuggauggcggca

SEQ ID NO: 686946 - RNA, 22 nt, Human
cagccaugagucuaagcaguuu

SEQ ID NO: 686947 - RNA, 22 nt, Human
gucccuggguagcucaguggcu

SEQ ID NO: 686948 - RNA, 18 nt, Human
uacugguccuuuuaugau

SEQ ID NO: 686949 - RNA, 22 nt, Human
ugagaauuacaaaugagucaca

SEQ ID NO: 686950 - RNA, 22 nt, Human
aagcaugguuucugacgucaug

SEQ ID NO: 686951 - RNA, 22 nt, Human
aggcaggcucaggcccaugcuu

SEQ ID NO: 686952 - RNA, 22 nt, Human
gaaaguuucucacacaugcaga

SEQ ID NO: 686953 - RNA, 22 nt, Human
uggccugcagcucucagggaag

SEQ ID NO: 686954 - RNA, 22 nt, Human
acaggcagcaaaaucagccuca

SEQ ID NO: 686955 - RNA, 22 nt, Human
uuaugagacuguuuuacacacu

SEQ ID NO: 686956 - RNA, 22 nt, Human
uucuuccucagcagggcugccu

SEQ ID NO: 686957 - RNA, 22 nt, Human
acagucuacuaaacaucaucag

SEQ ID NO: 686958 - RNA, 22 nt, Human
aguuauuuuggaaaaugaguca

SEQ ID NO: 686959 - RNA, 22 nt, Human
acccccaagaggggccuucagc

SEQ ID NO: 686960 - RNA, 22 nt, Human
ucugggugcccuuugcucuguu

SEQ ID NO: 686961 - RNA, 22 nt, Human
cccuuccuugugacuggugggg

SEQ ID NO: 686962 - RNA, 22 nt, Human
ucugagcucaagugacaguuag

SEQ ID NO: 686963 - RNA, 22 nt, Human
cccaggaggcagagcuugcagu

SEQ ID NO: 686964 - RNA, 22 nt, Human
ccacaggaccagaggagaucac

SEQ ID NO: 686965 - RNA, 22 nt, Human
caguccugcuggccuucccugg

SEQ ID NO: 686966 - RNA, 22 nt, Human
aaauacuggcaagugcuaauuc

SEQ ID NO: 686967 - RNA, 22 nt, Human
uguaugcaaauuuauuagcaca

SEQ ID NO: 686968 - RNA, 22 nt, Human
agcacacugaccugaagccuug

SEQ ID NO: 686969 - RNA, 22 nt, Human
gcucagaggguuuuggccaagu

SEQ ID NO: 686970 - RNA, 22 nt, Human
aaagugcugggauuacaagugu

SEQ ID NO: 686971 - RNA, 22 nt, Human
cagagagagugggguguggauu

SEQ ID NO: 686972 - RNA, 22 nt, Human
gcccucaggcagggagucuuuc

SEQ ID NO: 686973 - RNA, 22 nt, Human
auucccaccaacaauguacagg

SEQ ID NO: 686974 - RNA, 22 nt, Human
ucaagagauugaauaauaacug

SEQ ID NO: 686975 - RNA, 22 nt, Human
ccuuucugauggccucccagcc

SEQ ID NO: 686976 - RNA, 22 nt, Human
ggcaggcauggggucugccauu

SEQ ID NO: 686977 - RNA, 22 nt, Human
ugugugaauggauuauucuauu

SEQ ID NO: 686978 - RNA, 22 nt, Human
acccuggccugguucaugugau

SEQ ID NO: 686979 - RNA, 22 nt, Human
acuuuuaaggggccuugauuua

SEQ ID NO: 686980 - RNA, 22 nt, Human
ggcugccagcacugguguagag

SEQ ID NO: 686981 - RNA, 22 nt, Human
aggcugaggagggauguugcuu

SEQ ID NO: 686982 - RNA, 22 nt, Human
agugcuuauaccaaagacucuu

SEQ ID NO: 686983 - RNA, 22 nt, Human
uauuuugaaagucuguuuugaa

SEQ ID NO: 686984 - RNA, 22 nt, Human
ggcaggugcaccugagccaucu

SEQ ID NO: 686985 - RNA, 22 nt, Human
ugcagaagcagagaguugccaa

SEQ ID NO: 686986 - RNA, 22 nt, Human
cuacuucugugaugaaacuaca

SEQ ID NO: 686987 - RNA, 22 nt, Human
agcaaggauuauccugggaagg

SEQ ID NO: 686988 - RNA, 22 nt, Human
cccuccucucccuaagagucac

SEQ ID NO: 686989 - RNA, 22 nt, Human
uaacaaagguugccaaacuaag

SEQ ID NO: 686990 - RNA, 22 nt, Human
aaagacuaagaagaguauuauu

SEQ ID NO: 686991 - RNA, 22 nt, Human
cugacuguugcuguugaugagg

SEQ ID NO: 686992 - RNA, 22 nt, Human
gagcuggggcggauacucagcu

SEQ ID NO: 686993 - RNA, 22 nt, Human
uuucuguuaggcaucauuuuaa

SEQ ID NO: 686994 - RNA, 22 nt, Human
acaugaaugcagccauaacacu

SEQ ID NO: 686995 - RNA, 22 nt, Human
ggcucucugaggaaacccuucc

SEQ ID NO: 686996 - RNA, 22 nt, Human
gugccugcugcagagucgcugu

SEQ ID NO: 686997 - RNA, 22 nt, Human
gacuguccagaauuccuaggug

SEQ ID NO: 686998 - RNA, 22 nt, Human
gcugugugcucacguaguggaa

SEQ ID NO: 686999 - RNA, 22 nt, Human
caaggccaguuucuccuaguca

SEQ ID NO: 687000 - RNA, 22 nt, Human
ucugaauaguucuauuuuaaag

SEQ ID NO: 687001 - RNA, 22 nt, Human
guguccugagugaggccuggcc

SEQ ID NO: 687002 - RNA, 22 nt, Human
agcuccuggacgaacagggagu

SEQ ID NO: 687003 - RNA, 22 nt, Human
ccagcagaagcucccgcugggu

SEQ ID NO: 687004 - RNA, 22 nt, Human
uuguuuaaagaacuucugacuu

SEQ ID NO: 687005 - RNA, 22 nt, Human
gggcucugggaugcucuuagag

SEQ ID NO: 687006 - RNA, 22 nt, Human
aaucaagaggcgauggauggaa

SEQ ID NO: 687007 - RNA, 22 nt, Human
acagugaucaguuacugucugu

SEQ ID NO: 687008 - RNA, 21 nt, Human
gugucaugguugacuuuggca

SEQ ID NO: 687009 - RNA, 22 nt, Human
auuuuaugacacgauucuucca

SEQ ID NO: 687010 - RNA, 22 nt, Human
caucucuguguccccagagcuu

SEQ ID NO: 687011 - RNA, 22 nt, Human
gcagcugccccgacugugaguc

SEQ ID NO: 687012 - RNA, 22 nt, Human
ggcugcuggggacgugggagag

SEQ ID NO: 687013 - RNA, 22 nt, Human
cagagggucaccaggaagugca

SEQ ID NO: 687014 - RNA, 22 nt, Human
ccagaucccuguuugccucugg

SEQ ID NO: 687015 - RNA, 22 nt, Human
uaugcauuuuauagugcaaagc

SEQ ID NO: 687016 - RNA, 22 nt, Human
uuugugaauggaauccacagac

SEQ ID NO: 687017 - RNA, 22 nt, Human
aggccaagugcugggacaggug

SEQ ID NO: 687018 - RNA, 22 nt, Human
uacaaagaguuuggucucuaga

SEQ ID NO: 687019 - RNA, 22 nt, Human
gcaauagacuguuuuuauuguu

SEQ ID NO: 687020 - RNA, 22 nt, Human
cccaggaccauccuucugugcc

SEQ ID NO: 687021 - RNA, 22 nt, Human
ugagugagcuggggagccggug

SEQ ID NO: 687022 - RNA, 22 nt, Human
agugucugccugggaggagcau

SEQ ID NO: 687023 - RNA, 22 nt, Human
cgaggcagaggcugaaacggcu

SEQ ID NO: 687024 - RNA, 22 nt, Human
uaguuuaggauccaaucuaaga

SEQ ID NO: 687025 - RNA, 22 nt, Human
gaggaugugucuggucugggca

SEQ ID NO: 687026 - RNA, 19 nt, Human
augaggaacugaggcucag

SEQ ID NO: 687027 - RNA, 22 nt, Human
caggaaugccaaccagugcaug

SEQ ID NO: 687028 - RNA, 22 nt, Human
cagcucuuccuagccaugccac

SEQ ID NO: 687029 - RNA, 22 nt, Human
ugauugaagaggugaggaaguu

SEQ ID NO: 687030 - RNA, 21 nt, Human
ucugggugcuaguguuugcuu

SEQ ID NO: 687031 - RNA, 21 nt, Human
gggcagaggggccuccugggu

SEQ ID NO: 687032 - RNA, 22 nt, Human
caaggccagggaauuuuucugg

SEQ ID NO: 687033 - RNA, 22 nt, Human
ccaaaguccuuucuccaccugc

SEQ ID NO: 687034 - RNA, 22 nt, Human
caguaugcaguugaaaauaagc

SEQ ID NO: 687035 - RNA, 22 nt, Human
uaggaacaacugcagguacaag

SEQ ID NO: 687036 - RNA, 22 nt, Human
uuucagacaucacauggguuug

SEQ ID NO: 687037 - RNA, 22 nt, Human
aagugugggacuagggcuccag

SEQ ID NO: 687038 - RNA, 22 nt, Human
gaagaggcuuuccuagggcaag

SEQ ID NO: 687039 - RNA, 22 nt, Human
aggcccuggacacucaagccgg

SEQ ID NO: 687040 - RNA, 22 nt, Human
cuucugugaagagcagaaccau

SEQ ID NO: 687041 - RNA, 22 nt, Human
auuuagucuguaacaguacagu

SEQ ID NO: 687042 - RNA, 20 nt, Human
aucuugggacagggcacaug

SEQ ID NO: 687043 - RNA, 20 nt, Human
uggagcuguaaucuugucug

SEQ ID NO: 687044 - RNA, 22 nt, Human
ugcauuucuuuugaguauaugc

SEQ ID NO: 687045 - RNA, 22 nt, Human
aggcucccaagcacugacccca

SEQ ID NO: 687046 - RNA, 20 nt, Human
cucuucaaauauuuuauucu

SEQ ID NO: 687047 - RNA, 22 nt, Human
uagggcuauaagagaauaagac

SEQ ID NO: 687048 - RNA, 22 nt, Human
acauuuagaugguguuauagua

SEQ ID NO: 687049 - RNA, 22 nt, Human
gacaauuucucaauauagaaac

SEQ ID NO: 687050 - RNA, 22 nt, Human
ggggauggaggcgugugguccu

SEQ ID NO: 687051 - RNA, 22 nt, Human
uuaggaauauuuucugaguagu

SEQ ID NO: 687052 - RNA, 22 nt, Human
cucuuaaugaccuuaauucaag

SEQ ID NO: 687053 - RNA, 22 nt, Human
aacaccuucuccuugcaggcca

SEQ ID NO: 687054 - RNA, 18 nt, Human
ggaagaaaaggaacucag

SEQ ID NO: 687055 - RNA, 22 nt, Human
cauuuuauccucugggaagcua

SEQ ID NO: 687056 - RNA, 20 nt, Human
auuuuggugaacacagcuuc

SEQ ID NO: 687057 - RNA, 22 nt, Human
gccacuguccugugccugugcu

SEQ ID NO: 687058 - RNA, 22 nt, Human
cugguuccaggauggaucuuuc

SEQ ID NO: 687059 - RNA, 22 nt, Human
aacuucauuccuuuuuaugacu

SEQ ID NO: 687060 - RNA, 22 nt, Human
acauucugucaacagugagcag

SEQ ID NO: 687061 - RNA, 22 nt, Human
ccaugcacaccagcaggcagac

SEQ ID NO: 687062 - RNA, 22 nt, Human
cccagaggaggcaaagcucugu

SEQ ID NO: 687063 - RNA, 23 nt, Human
auuuccuacuauaaaagagguaa

SEQ ID NO: 687064 - RNA, 22 nt, Human
gccccuccauccaucaccgggg

SEQ ID NO: 687065 - RNA, 22 nt, Human
ggcccucuuuuauccaucauaa

SEQ ID NO: 687066 - RNA, 22 nt, Human
acauuacacugugguccuguuc

SEQ ID NO: 687067 - RNA, 19 nt, Human
cuauacagccucugaggaa

SEQ ID NO: 687068 - RNA, 22 nt, Human
aggaauauuacuuugcuuuuau

SEQ ID NO: 687069 - RNA, 23 nt, Human
ccacucucccaccauaucuguau

SEQ ID NO: 687070 - RNA, 22 nt, Human
uuuaacagguaaaguaaaugug

SEQ ID NO: 687071 - RNA, 22 nt, Human
uauggguauuauugguaagaau

SEQ ID NO: 687072 - RNA, 22 nt, Human
cugcugugaguuuggaggucua

SEQ ID NO: 687073 - RNA, 22 nt, Human
uguucauucgcuauugucuaug

SEQ ID NO: 687074 - RNA, 22 nt, Human
ucagaguuggccuuucuguauu

SEQ ID NO: 687075 - RNA, 22 nt, Human
agcagaggacaguucuuaggaa

SEQ ID NO: 687076 - RNA, 22 nt, Human
ucuuccuauggggcugcaggaa

SEQ ID NO: 687077 - RNA, 22 nt, Human
aagcugccaaugguaagcugcu

SEQ ID NO: 687078 - RNA, 22 nt, Human
ccaguacaucgcauggugacca

SEQ ID NO: 687079 - RNA, 23 nt, Human
aagugguuuugaacccggacccu

SEQ ID NO: 687080 - RNA, 22 nt, Human
uugccaggagacaaagugggcc

SEQ ID NO: 687081 - RNA, 22 nt, Human
augagaaggacauaaauuauag

SEQ ID NO: 687082 - RNA, 22 nt, Human
uuaaaggcaugguuagacaugg

SEQ ID NO: 687083 - RNA, 21 nt, Human
gcucccuggcugugugaccug

SEQ ID NO: 687084 - RNA, 22 nt, Human
guacaguaguaaaagugaauga

SEQ ID NO: 687085 - RNA, 22 nt, Human
aacugaggucuccagugcagaa

SEQ ID NO: 687086 - RNA, 22 nt, Human
uaauuggauguucucuggaagc

SEQ ID NO: 687087 - RNA, 20 nt, Human
accaggcccggugucuccuc

SEQ ID NO: 687088 - RNA, 20 nt, Human
acacacagagacaugcgcau

SEQ ID NO: 687089 - RNA, 22 nt, Human
aaagaauacuccuuuugccuug

SEQ ID NO: 687090 - RNA, 22 nt, Human
agguuuauaggaaauuuguucc

SEQ ID NO: 687091 - RNA, 22 nt, Human
cugaauauuagucaugucugau

SEQ ID NO: 687092 - RNA, 22 nt, Human
gaagccagccuugucugccucu

SEQ ID NO: 687093 - RNA, 22 nt, Human
auuuccuauacaguuguccaua

SEQ ID NO: 687094 - RNA, 22 nt, Human
ucucuggaauuuugagagugac

SEQ ID NO: 687095 - RNA, 22 nt, Human
ccugaggacacacgcugcagga

SEQ ID NO: 687096 - RNA, 22 nt, Human
gugagagauugauuguagcggc

SEQ ID NO: 687097 - RNA, 22 nt, Human
ucagagaguuuucacuagggug

SEQ ID NO: 687098 - RNA, 18 nt, Human
gcugugugcaccugauaa

SEQ ID NO: 687099 - RNA, 22 nt, Human
ccuccaaguuugacucaggaca

SEQ ID NO: 687100 - RNA, 22 nt, Human
gaacaaaucccuuccugucucc

SEQ ID NO: 687101 - RNA, 22 nt, Human
uaaagcuagaauuguuccagca

SEQ ID NO: 687102 - RNA, 22 nt, Human
ucacaucugaaaaaauauugag

SEQ ID NO: 687103 - RNA, 22 nt, Human
aacacuuuccguagguuuagua

SEQ ID NO: 687104 - RNA, 22 nt, Human
auuuacaguuuagcauuucaag

SEQ ID NO: 687105 - RNA, 19 nt, Human
acagagcucucugcuucug

SEQ ID NO: 687106 - RNA, 22 nt, Human
ugcuggcuuugcgagaugcauu

SEQ ID NO: 687107 - RNA, 21 nt, Human
guuuacaaggcuuugcuccug

SEQ ID NO: 687108 - RNA, 22 nt, Human
gaucagaauuuacuuauaauug

SEQ ID NO: 687109 - RNA, 20 nt, Human
uuccuuuucgccucucuccc

SEQ ID NO: 687110 - RNA, 19 nt, Human
agggucaggacaaggacuu

SEQ ID NO: 687111 - RNA, 22 nt, Human
ugcuggaaagagaguuucaaug

SEQ ID NO: 687112 - RNA, 22 nt, Human
uccaugugccaaggggcagagg

SEQ ID NO: 687113 - RNA, 21 nt, Human
aggcagcaggauccagggaca

SEQ ID NO: 687114 - RNA, 22 nt, Human
agggucaacacuuuaaacauau

SEQ ID NO: 687115 - RNA, 22 nt, Human
auggaauuaaaagucaaguaau

SEQ ID NO: 687116 - RNA, 22 nt, Human
gauggcacacagacauccccgc

SEQ ID NO: 687117 - RNA, 22 nt, Human
ccuggccuggcacucccucugc

SEQ ID NO: 687118 - RNA, 22 nt, Human
auucuucaccugagucagucua

SEQ ID NO: 687119 - RNA, 22 nt, Human
caccagaguuguccaaaugauu

SEQ ID NO: 687120 - RNA, 22 nt, Human
gcacacagauuaggaaacagaa

SEQ ID NO: 687121 - RNA, 22 nt, Human
cacugugcuccuaacuagcugu

SEQ ID NO: 687122 - RNA, 22 nt, Human
uucugacacauuacuacaugga

SEQ ID NO: 687123 - RNA, 22 nt, Human
uggcaggcggagguugcaguga

SEQ ID NO: 687124 - RNA, 22 nt, Human
gcaggaguguauuugcauguaa

SEQ ID NO: 687125 - RNA, 22 nt, Human
uccagggacacagaguccuucu

SEQ ID NO: 687126 - RNA, 22 nt, Human
ucucugugugugugacagcauu

SEQ ID NO: 687127 - RNA, 22 nt, Human
caccacuucauaggcuuuaagg

SEQ ID NO: 687128 - RNA, 22 nt, Human
uguggcucucaugcacucccag

SEQ ID NO: 687129 - RNA, 22 nt, Human
aaggagcuaugcauaacugauc

SEQ ID NO: 687130 - RNA, 22 nt, Human
cuggcccugcuccgcgccgcgg

SEQ ID NO: 687131 - RNA, 22 nt, Human
gcaguccauugacagaggucuu

SEQ ID NO: 687132 - RNA, 22 nt, Human
agccaguagaucgggaggaugu

SEQ ID NO: 687133 - RNA, 22 nt, Human
aggagccaggaaaccugcucug

SEQ ID NO: 687134 - RNA, 21 nt, Human
gacaaugcagucuuuuuugga

SEQ ID NO: 687135 - RNA, 22 nt, Human
gggcagagagcuggaacuccuu

SEQ ID NO: 687136 - RNA, 22 nt, Human
ccugugucaccggaacggagga

SEQ ID NO: 687137 - RNA, 22 nt, Human
uucacagagaguaugcagagaa

SEQ ID NO: 687138 - RNA, 22 nt, Human
cuuucuuugcagugagccagag

SEQ ID NO: 687139 - RNA, 22 nt, Human
aaaugugugcacaaagacagcu

SEQ ID NO: 687140 - RNA, 21 nt, Human
cacuugaaugguguuuuacaa

SEQ ID NO: 687141 - RNA, 22 nt, Human
cugggcucugcggugucgcucu

SEQ ID NO: 687142 - RNA, 22 nt, Human
uaaucuguguaccuucaucgga

SEQ ID NO: 687143 - RNA, 22 nt, Human
agguucagaugacuuuuaugcu

SEQ ID NO: 687144 - RNA, 22 nt, Human
ugauagaaaaugcugucaagcu

SEQ ID NO: 687145 - RNA, 22 nt, Human
aagaggcgccggguacguggcg

SEQ ID NO: 687146 - RNA, 22 nt, Human
aaauccuaaaaguuugacuuaa

SEQ ID NO: 687147 - RNA, 22 nt, Human
aaaaaccuuucccauacuaaga

SEQ ID NO: 687148 - RNA, 22 nt, Human
agcuggagccagugugaggcuu

SEQ ID NO: 687149 - RNA, 22 nt, Human
ggcugccugugcccaggcacac

SEQ ID NO: 687150 - RNA, 22 nt, Human
cacaauuauagaagaaagcaua

SEQ ID NO: 687151 - RNA, 22 nt, Human
gucuggaguggggccugagaau

SEQ ID NO: 687152 - RNA, 22 nt, Human
cccaggauggggcugcaguuau

SEQ ID NO: 687153 - RNA, 17 nt, Human
uggaagcuucauguugg

SEQ ID NO: 687154 - RNA, 22 nt, Human
aauucagaagcacaaaaccuag

SEQ ID NO: 687155 - RNA, 22 nt, Human
ugcucuggggagcuccucugcg

SEQ ID NO: 687156 - RNA, 22 nt, Human
gggucagcgauuucaggggcag

SEQ ID NO: 687157 - RNA, 22 nt, Human
ggcuuuauuaacucauccguaa

SEQ ID NO: 687158 - RNA, 22 nt, Human
gaaguucugguguaugugauaa

SEQ ID NO: 687159 - RNA, 22 nt, Human
agacagacacaugguaacagau

SEQ ID NO: 687160 - RNA, 22 nt, Human
guuguuuugcaggauccuuaca

SEQ ID NO: 687161 - RNA, 23 nt, Human
uuggcagcgggucaggcuguggg

SEQ ID NO: 687162 - RNA, 22 nt, Human
caggagcaggcccaaggacaca

SEQ ID NO: 687163 - RNA, 22 nt, Human
ucuuggcugucuuugaaguuag

SEQ ID NO: 687164 - RNA, 22 nt, Human
uaaauucacuccugguagaccu

SEQ ID NO: 687165 - RNA, 22 nt, Human
gagucugaugucccccaggcca

SEQ ID NO: 687166 - RNA, 22 nt, Human
aucagugcauccugccacaaag

SEQ ID NO: 687167 - RNA, 22 nt, Human
gcacagcagccgaaaugcccuu

SEQ ID NO: 687168 - RNA, 22 nt, Human
gcacaguugugacaaccaucgc

SEQ ID NO: 687169 - RNA, 22 nt, Human
aaagugcaaucaguuagaccau

SEQ ID NO: 687170 - RNA, 22 nt, Human
uggguagagcaggcuggggcuu

SEQ ID NO: 687171 - RNA, 22 nt, Human
acguuuucagccuuaauguaga

SEQ ID NO: 687172 - RNA, 22 nt, Human
ugguuauaaaaguccucucauu

SEQ ID NO: 687173 - RNA, 22 nt, Human
gaagcuucuggcauuucucaaa

SEQ ID NO: 687174 - RNA, 20 nt, Human
ccuguguggccagcugaggc

SEQ ID NO: 687175 - RNA, 22 nt, Human
ugacaccacaacuagccauuga

SEQ ID NO: 687176 - RNA, 22 nt, Human
acacaggagauauguaauggcu

SEQ ID NO: 687177 - RNA, 22 nt, Human
agaaugauaaugccaugaugga

SEQ ID NO: 687178 - RNA, 22 nt, Human
auuuccauacacccauuucuga

SEQ ID NO: 687179 - RNA, 22 nt, Human
ucaguguucgcucagggacucc

SEQ ID NO: 687180 - RNA, 22 nt, Human
agcacuauuccaaugauccaau

SEQ ID NO: 687181 - RNA, 22 nt, Human
aagauuucucuccuggaaagca

SEQ ID NO: 687182 - RNA, 22 nt, Human
uucaggaugaaagugugcaaca

SEQ ID NO: 687183 - RNA, 22 nt, Human
gggcucagcugggcgugcuggu

SEQ ID NO: 687184 - RNA, 22 nt, Human
ccugccagccagaucacucgcc

SEQ ID NO: 687185 - RNA, 22 nt, Human
cugggccucucagcucccgcgg

SEQ ID NO: 687186 - RNA, 22 nt, Human
gggccugaaaccuucagggcuu

SEQ ID NO: 687187 - RNA, 22 nt, Human
caggaacaauguaagucucauu

SEQ ID NO: 687188 - RNA, 22 nt, Human
acaauucuggguauuuauauag

SEQ ID NO: 687189 - RNA, 23 nt, Human
aucuguguguggguagggaugau

SEQ ID NO: 687190 - RNA, 22 nt, Human
gugaauaacuuucuauguuaau

SEQ ID NO: 687191 - RNA, 22 nt, Human
gagaacaggcucuggagucaga

SEQ ID NO: 687192 - RNA, 22 nt, Human
uucaagcagggauuggugaugg

SEQ ID NO: 687193 - RNA, 22 nt, Human
gggcacaguacuccaaucaacu

SEQ ID NO: 687194 - RNA, 22 nt, Human
cuggggcuucaaugcuucggug

SEQ ID NO: 687195 - RNA, 22 nt, Human
uauuuucaucuuguccuuggau

SEQ ID NO: 687196 - RNA, 22 nt, Human
acuuucugugguuaccagggag

SEQ ID NO: 687197 - RNA, 22 nt, Human
uuaucuuggguaacuuugugca

SEQ ID NO: 687198 - RNA, 22 nt, Human
aaagcaugcuacuuuauauagg

SEQ ID NO: 687199 - RNA, 22 nt, Human
uggacaggcaagcaagacauac

SEQ ID NO: 687200 - RNA, 22 nt, Human
aucugucaagauagacucugca

SEQ ID NO: 687201 - RNA, 22 nt, Human
aggcaggcagggcucacugucu

SEQ ID NO: 687202 - RNA, 22 nt, Human
acaguguuuuaugagaauuguu

SEQ ID NO: 687203 - RNA, 22 nt, Human
ucauaaagugaaggaugauggg

SEQ ID NO: 687204 - RNA, 22 nt, Human
ccagcugguuaaaauagagaaa

SEQ ID NO: 687205 - RNA, 22 nt, Human
caguuuccugaagagaaagaau

SEQ ID NO: 687206 - RNA, 18 nt, Human
uauauucugugcccuggu

SEQ ID NO: 687207 - RNA, 22 nt, Human
uucauagugcuuaauuugauaa

SEQ ID NO: 687208 - RNA, 22 nt, Human
uggaaggcuaggugcuaggccc

SEQ ID NO: 687209 - RNA, 22 nt, Human
gauguacaagauuguaggaaug

SEQ ID NO: 687210 - RNA, 22 nt, Human
cacaaugcagcauguaaaugca

SEQ ID NO: 687211 - RNA, 21 nt, Human
ccugaaauucucacuagcuua

SEQ ID NO: 687212 - RNA, 20 nt, Human
gaugagacccaugcaugaga

SEQ ID NO: 687213 - RNA, 22 nt, Human
caccagggcagcagccuagucu

SEQ ID NO: 687214 - RNA, 22 nt, Human
acagaucacuugacuaaaauga

SEQ ID NO: 687215 - RNA, 20 nt, Human
gggguuggcuggcacaggga

SEQ ID NO: 687216 - RNA, 22 nt, Human
cacagugcacuaagcuccgggg

SEQ ID NO: 687217 - RNA, 22 nt, Human
cucuccaguuauagcugauuug

SEQ ID NO: 687218 - RNA, 22 nt, Human
ggcagugagaggucuccugguc

SEQ ID NO: 687219 - RNA, 22 nt, Human
uuuaauuauguuaagccacuga

SEQ ID NO: 687220 - RNA, 22 nt, Human
guguuaauuauuggugaauaga

SEQ ID NO: 687221 - RNA, 18 nt, Human
uggcagcaggaagccauu

SEQ ID NO: 687222 - RNA, 22 nt, Human
agcaucaguacuaaucuggcca

SEQ ID NO: 687223 - RNA, 20 nt, Human
aaccugaggcaguguuccag

SEQ ID NO: 687224 - RNA, 22 nt, Human
acuuuucucccuccugccuuca

SEQ ID NO: 687225 - RNA, 20 nt, Human
aggacagcagcugccacuug

SEQ ID NO: 687226 - RNA, 22 nt, Human
ccccgcccugcgcggggauaac

SEQ ID NO: 687227 - RNA, 22 nt, Human
cccugagcauucaugugagcuu

SEQ ID NO: 687228 - RNA, 22 nt, Human
ggcaggagauaaaauauuaguu

SEQ ID NO: 687229 - RNA, 22 nt, Human
uuaaauuagucaagcuucucug

SEQ ID NO: 687230 - RNA, 22 nt, Human
cccacacucugagaaaugcuga

SEQ ID NO: 687231 - RNA, 22 nt, Human
ccuaggcuggcugucuucaggu

SEQ ID NO: 687232 - RNA, 22 nt, Human
ucuucuuuuauuucaagggugu

SEQ ID NO: 687233 - RNA, 22 nt, Human
uggcuuccaaauuaucccuaga

SEQ ID NO: 687234 - RNA, 22 nt, Human
gccauccucugagcacuaggca

SEQ ID NO: 687235 - RNA, 22 nt, Human
gugcagugacccuggagagcug

SEQ ID NO: 687236 - RNA, 22 nt, Human
cucugcaggggaggcaugcacu

SEQ ID NO: 687237 - RNA, 22 nt, Human
uugccaccgucauggccauuau

SEQ ID NO: 687238 - RNA, 22 nt, Human
cugcccugagucaugccagaug

SEQ ID NO: 687239 - RNA, 22 nt, Human
agauuucucuuucccuggcuga

SEQ ID NO: 687240 - RNA, 22 nt, Human
ugcugcacaauuggaaaguauc

SEQ ID NO: 687241 - RNA, 22 nt, Human
uggcugcagugcuugagauguc

SEQ ID NO: 687242 - RNA, 22 nt, Human
ucugaggucuaugacuuugcuu

SEQ ID NO: 687243 - RNA, 22 nt, Human
acagauguuacaguaugaucuc

SEQ ID NO: 687244 - RNA, 22 nt, Human
acagggugacuuugugacagau

SEQ ID NO: 687245 - RNA, 22 nt, Human
acgcuucugguucuggcuuuag

SEQ ID NO: 687246 - RNA, 22 nt, Human
cuggagccccagacagggagag

SEQ ID NO: 687247 - RNA, 22 nt, Human
cacaggcagccuuguagaagaa

SEQ ID NO: 687248 - RNA, 22 nt, Human
cugcaggcaucuaacugugggc

SEQ ID NO: 687249 - RNA, 22 nt, Human
gcagguggaucaccacgucagg

SEQ ID NO: 687250 - RNA, 17 nt, Human
uuugaaaggaugucagu

SEQ ID NO: 687251 - RNA, 22 nt, Human
cuguuauuugagaguguugaau

SEQ ID NO: 687252 - RNA, 22 nt, Human
uugaagcaggaaaauuucuauu

SEQ ID NO: 687253 - RNA, 22 nt, Human
aggagccaaggaaaacaguauu

SEQ ID NO: 687254 - RNA, 22 nt, Human
aggcagcagugauaagauagga

SEQ ID NO: 687255 - RNA, 22 nt, Human
aaaggcauggauagugaauuca

SEQ ID NO: 687256 - RNA, 22 nt, Human
agcagguuguuuuguggccagg

SEQ ID NO: 687257 - RNA, 20 nt, Human
ugugccuggcuuuguccuga

SEQ ID NO: 687258 - RNA, 22 nt, Human
gcucucuugacagcuugcuguu

SEQ ID NO: 687259 - RNA, 22 nt, Human
aauguuauuguccuuuccaaaa

SEQ ID NO: 687260 - RNA, 22 nt, Human
ggugaagguggaacgcagagca

SEQ ID NO: 687261 - RNA, 22 nt, Human
cuauuaaauacucuucaaauug

SEQ ID NO: 687262 - RNA, 20 nt, Human
ucacaggagggaaggcaggu

SEQ ID NO: 687263 - RNA, 22 nt, Human
aaacagagggccacugaggcuc

SEQ ID NO: 687264 - RNA, 22 nt, Human
uauuuuguaauuggucauagcu

SEQ ID NO: 687265 - RNA, 22 nt, Human
uggauucaaauuucagcucugu

SEQ ID NO: 687266 - RNA, 22 nt, Human
ucaggcugcuggccagcaggcu

SEQ ID NO: 687267 - RNA, 22 nt, Human
uccuggcuccugaucugucacu

SEQ ID NO: 687268 - RNA, 22 nt, Human
agaucacagucaauugcaaguu

SEQ ID NO: 687269 - RNA, 22 nt, Human
gugcagguggauuugggcucaa

SEQ ID NO: 687270 - RNA, 22 nt, Human
guacaaaugcagguuuguuaca

SEQ ID NO: 687271 - RNA, 22 nt, Human
ggcugggcugcggcuguaccug

SEQ ID NO: 687272 - RNA, 22 nt, Human
ccagagugacgugaagugugaa

SEQ ID NO: 687273 - RNA, 22 nt, Human
cugcuuuagacggcuuucgcug

SEQ ID NO: 687274 - RNA, 19 nt, Human
agcuagugcucagcuguca

SEQ ID NO: 687275 - RNA, 19 nt, Human
ugcccaggccagguugggc

SEQ ID NO: 687276 - RNA, 21 nt, Human
agccagcaacacagcaucucc

SEQ ID NO: 687277 - RNA, 22 nt, Human
ucuaaagagaguggguacaugu

SEQ ID NO: 687278 - RNA, 22 nt, Human
uaauacacacucucauuccuaa

SEQ ID NO: 687279 - RNA, 22 nt, Human
gcuguguaggauccuguuguau

SEQ ID NO: 687280 - RNA, 22 nt, Human
gugcaaacaucauagaguguac

SEQ ID NO: 687281 - RNA, 22 nt, Human
augaacaaugacuacauauuga

SEQ ID NO: 687282 - RNA, 22 nt, Human
ucaagacagauggguaacuugg

SEQ ID NO: 687283 - RNA, 22 nt, Human
ugcuuuauucccuucugaugug

SEQ ID NO: 687284 - RNA, 22 nt, Human
uggcucugggaaugggaagaug

SEQ ID NO: 687285 - RNA, 21 nt, Human
uucccuucugguuuugagaga

SEQ ID NO: 687286 - RNA, 20 nt, Human
agcugccuucauuuucuaga

SEQ ID NO: 687287 - RNA, 23 nt, Human
uggcagagacccagaaucuacau

SEQ ID NO: 687288 - RNA, 22 nt, Human
agaguggguuauaggcagacuu

SEQ ID NO: 687289 - RNA, 22 nt, Human
uacaugcaauuaagagggugaa

SEQ ID NO: 687290 - RNA, 22 nt, Human
uuggaacucguguuacuuguau

SEQ ID NO: 687291 - RNA, 22 nt, Human
gucaggaaguggcauuggagaa

SEQ ID NO: 687292 - RNA, 22 nt, Human
gugacucuccacuaguaugaaa

SEQ ID NO: 687293 - RNA, 22 nt, Human
caggcacacugucuacacugag

SEQ ID NO: 687294 - RNA, 22 nt, Human
agacaauggcuaaguaaccugu

SEQ ID NO: 687295 - RNA, 22 nt, Human
uaguuaauucuuuaagaacaag

SEQ ID NO: 687296 - RNA, 22 nt, Human
gucccugacacccggguggagg

SEQ ID NO: 687297 - RNA, 22 nt, Human
acaguuaccacuuagcaguuac

SEQ ID NO: 687298 - RNA, 22 nt, Human
gaaaggccagcucacagaugag

SEQ ID NO: 687299 - RNA, 22 nt, Human
ugcucugcacaucccucacaaa

SEQ ID NO: 687300 - RNA, 22 nt, Human
gagcaucugugguccaucagaa

SEQ ID NO: 687301 - RNA, 22 nt, Human
ucaggagcuauggacugucaaa

SEQ ID NO: 687302 - RNA, 16 nt, Human
agguggagaaguucac

SEQ ID NO: 687303 - RNA, 22 nt, Human
ccucaaauuggcauuaauuaag

SEQ ID NO: 687304 - RNA, 22 nt, Human
gaucacaucuuuaugaguauuu

SEQ ID NO: 687305 - RNA, 22 nt, Human
gcuuaaauuguuuguggauagu

SEQ ID NO: 687306 - RNA, 22 nt, Human
ggcuucccaaggagccaggaug

SEQ ID NO: 687307 - RNA, 22 nt, Human
uggcuucuaguuugaggaaaaa

SEQ ID NO: 687308 - RNA, 22 nt, Human
gaugaggaaaccaaggcucagg

SEQ ID NO: 687309 - RNA, 22 nt, Human
ugcugaggaauuugguuuaugu

SEQ ID NO: 687310 - RNA, 22 nt, Human
gaggccacgguuuuccuugggg

SEQ ID NO: 687311 - RNA, 22 nt, Human
acaggagcaacagacuaagaca

SEQ ID NO: 687312 - RNA, 22 nt, Human
cugcaaaauuguucuuugcucc

SEQ ID NO: 687313 - RNA, 21 nt, Human
ugcuuucagacucuuacagaa

SEQ ID NO: 687314 - RNA, 22 nt, Human
guggcauugacauguaaacagu

SEQ ID NO: 687315 - RNA, 22 nt, Human
aggaguguugaguuggguuuug

SEQ ID NO: 687316 - RNA, 22 nt, Human
gcuucauuucucucuguagacc

SEQ ID NO: 687317 - RNA, 22 nt, Human
uccaugaggaccaaauucguag

SEQ ID NO: 687318 - RNA, 22 nt, Human
uccugggcagaaugggauggcu

SEQ ID NO: 687319 - RNA, 22 nt, Human
ccuccagggcagacggggagca

SEQ ID NO: 687320 - RNA, 22 nt, Human
ugcuuuuuaguacugucuuauu

SEQ ID NO: 687321 - RNA, 22 nt, Human
cuucaccuccuccucugugggc

SEQ ID NO: 687322 - RNA, 22 nt, Human
gcagcagcugacagugggugcc

SEQ ID NO: 687323 - RNA, 22 nt, Human
cucuggaggccuaaggaagugg

SEQ ID NO: 687324 - RNA, 22 nt, Human
aguguuuaacuucguccugaag

SEQ ID NO: 687325 - RNA, 22 nt, Human
caaaccaguaggaagucuauua

SEQ ID NO: 687326 - RNA, 22 nt, Human
uuugacaagagggcaucuucag

SEQ ID NO: 687327 - RNA, 22 nt, Human
agaaguauaacuauuugcuuuc

SEQ ID NO: 687328 - RNA, 22 nt, Human
aagacacuaagcuuucaggaua

SEQ ID NO: 687329 - RNA, 22 nt, Human
agaggggcucauauccugucau

SEQ ID NO: 687330 - RNA, 22 nt, Human
cagaucuguuugccagaucagc

SEQ ID NO: 687331 - RNA, 22 nt, Human
cccagccucuguuugcuccucu

SEQ ID NO: 687332 - RNA, 22 nt, Human
cuagauaagguggcuuggaauu

SEQ ID NO: 687333 - RNA, 22 nt, Human
agaguuauauugguugagaauu

SEQ ID NO: 687334 - RNA, 22 nt, Human
ucuugcuucugcucaaggggag

SEQ ID NO: 687335 - RNA, 22 nt, Human
gcagccaggaagccuuucccuc

SEQ ID NO: 687336 - RNA, 22 nt, Human
uugcaucauuuccuggccgugu

SEQ ID NO: 687337 - RNA, 22 nt, Human
cuggcuuugaggauccccucuu

SEQ ID NO: 687338 - RNA, 22 nt, Human
ucagcaggggccguugggugga

SEQ ID NO: 687339 - RNA, 22 nt, Human
guccuggugagguagugggagg

SEQ ID NO: 687340 - RNA, 22 nt, Human
gagccaggguuugaaacuagac

SEQ ID NO: 687341 - RNA, 22 nt, Human
auuuccaugaauucccacucau

SEQ ID NO: 687342 - RNA, 22 nt, Human
cguuugaaagccuuuguacacu

SEQ ID NO: 687343 - RNA, 19 nt, Human
gugggacagacauuacaua

SEQ ID NO: 687344 - RNA, 22 nt, Human
cucuuugccuaacuguuuucaa

SEQ ID NO: 687345 - RNA, 22 nt, Human
ucucaggaauagaguggcagca

SEQ ID NO: 687346 - RNA, 22 nt, Human
gcagggggauggaguugaaaug

SEQ ID NO: 687347 - RNA, 22 nt, Human
ugaggcaggagaauggcgggaa

SEQ ID NO: 687348 - RNA, 18 nt, Human
ucagucuauuguauaaga

SEQ ID NO: 687349 - RNA, 22 nt, Human
augacaccauauuagccuagag

SEQ ID NO: 687350 - RNA, 22 nt, Human
guaauccaaaguaacauuaaac

SEQ ID NO: 687351 - RNA, 22 nt, Human
uucagacaguuuucagauucau

SEQ ID NO: 687352 - RNA, 22 nt, Human
gacuggggcucuagccaggccu

SEQ ID NO: 687353 - RNA, 22 nt, Human
cugaaggauuuaguucuuugcu

SEQ ID NO: 687354 - RNA, 22 nt, Human
agaguuugaauuuugaaaagau

SEQ ID NO: 687355 - RNA, 22 nt, Human
uguuauuauguuuccagagccu

SEQ ID NO: 687356 - RNA, 22 nt, Human
uagggcaguuucauguuaucuu

SEQ ID NO: 687357 - RNA, 22 nt, Human
ucagaauuagagcucuucuuga

SEQ ID NO: 687358 - RNA, 17 nt, Human
ucuggccuuccugaacu

SEQ ID NO: 687359 - RNA, 22 nt, Human
gcuggcagacugggggcagaac

SEQ ID NO: 687360 - RNA, 22 nt, Human
uccagcucaaagugcuccuguc

SEQ ID NO: 687361 - RNA, 22 nt, Human
auguggcucagcaggcucccgu

SEQ ID NO: 687362 - RNA, 18 nt, Human
ugcaggcugggguuccuc

SEQ ID NO: 687363 - RNA, 22 nt, Human
acuuuagaaaagcauccauaga

SEQ ID NO: 687364 - RNA, 22 nt, Human
augaaauguauucagauaugua

SEQ ID NO: 687365 - RNA, 22 nt, Human
acuuucuuaggcuguauaaaug

SEQ ID NO: 687366 - RNA, 22 nt, Human
uggcuucuggcuggugagaaau

SEQ ID NO: 687367 - RNA, 22 nt, Human
caucugugccggguguuuguca

SEQ ID NO: 687368 - RNA, 22 nt, Human
ucucugugggcuuuggacuuga

SEQ ID NO: 687369 - RNA, 22 nt, Human
ucugggccuauagaagucuacc

SEQ ID NO: 687370 - RNA, 21 nt, Human
uacugagaccucacagugugc

SEQ ID NO: 687371 - RNA, 21 nt, Human
ugcugccuguggguguuuacc

SEQ ID NO: 687372 - RNA, 20 nt, Human
ggggcagguuuuuauggcua

SEQ ID NO: 687373 - RNA, 22 nt, Human
ugagauaacucugauuuauguu

SEQ ID NO: 687374 - RNA, 19 nt, Human
gagcaacauauguaaacuc

SEQ ID NO: 687375 - RNA, 22 nt, Human
uaaaggccuaguaaguugagac

SEQ ID NO: 687376 - RNA, 22 nt, Human
aauaacuugaagaucucuucca

SEQ ID NO: 687377 - RNA, 22 nt, Human
gaugagaaggcucagauccaaa

SEQ ID NO: 687378 - RNA, 22 nt, Human
uuucuaucugagaagauaucua

SEQ ID NO: 687379 - RNA, 22 nt, Human
gcugagaaaugcagacaugcug

SEQ ID NO: 687380 - RNA, 20 nt, Human
agcugguccccaagccucuc

SEQ ID NO: 687381 - RNA, 18 nt, Human
ccagggagcuuauuagga

SEQ ID NO: 687382 - RNA, 19 nt, Human
ucaucucacagggccuggc

SEQ ID NO: 687383 - RNA, 22 nt, Human
gggaccuggcgagggucacaca

SEQ ID NO: 687384 - RNA, 22 nt, Human
aguggcuguuccaggugaggac

SEQ ID NO: 687385 - RNA, 20 nt, Human
auuaggauuuuaggucauca

SEQ ID NO: 687386 - RNA, 22 nt, Human
uuccaaauguuggacaacugua

SEQ ID NO: 687387 - RNA, 22 nt, Human
ucuggagaacuugcaagaggau

SEQ ID NO: 687388 - RNA, 22 nt, Human
cggaucaugugaccuuugagug

SEQ ID NO: 687389 - RNA, 22 nt, Human
uagcuccuccccauccagguuc

SEQ ID NO: 687390 - RNA, 22 nt, Human
aggcacugaauauccaguaaaa

SEQ ID NO: 687391 - RNA, 22 nt, Human
ugaagcaguuacuggguguuaa

SEQ ID NO: 687392 - RNA, 22 nt, Human
ccagcuccaaguuugggcauca

SEQ ID NO: 687393 - RNA, 22 nt, Human
cucagaggguacaggugaaccc

SEQ ID NO: 687394 - RNA, 22 nt, Human
ccaggagguggagauugcagug

SEQ ID NO: 687395 - RNA, 22 nt, Human
cccaggagguggaguucacagu

SEQ ID NO: 687396 - RNA, 22 nt, Human
uggcccuucugagcacagggcc

SEQ ID NO: 687397 - RNA, 22 nt, Human
gccaguggucagugggagggug

SEQ ID NO: 687398 - RNA, 22 nt, Human
gggaccagugucugugagaaaa

SEQ ID NO: 687399 - RNA, 22 nt, Human
agugucugcgggcagaggagcg

SEQ ID NO: 687400 - RNA, 22 nt, Human
aguacacagaguuauuuugugu

SEQ ID NO: 687401 - RNA, 22 nt, Human
uccucuccauauuuucugauuu

SEQ ID NO: 687402 - RNA, 23 nt, Human
acacuucacccauugugauagga

SEQ ID NO: 687403 - RNA, 22 nt, Human
caggugcagcuggauggaagcc

SEQ ID NO: 687404 - RNA, 22 nt, Human
auguaucagaaauagcauuggc

SEQ ID NO: 687405 - RNA, 22 nt, Human
aucaucuugcuuucuguuuacu

SEQ ID NO: 687406 - RNA, 22 nt, Human
augcuuaaugaggguauauaug

SEQ ID NO: 687407 - RNA, 22 nt, Human
gaauuugaaaagugaugggaau

SEQ ID NO: 687408 - RNA, 22 nt, Human
gcagagcaguacucucuugacu

SEQ ID NO: 687409 - RNA, 22 nt, Human
agucuucagagaaauuaacucu

SEQ ID NO: 687410 - RNA, 22 nt, Human
gaccacagaggugugggagaga

SEQ ID NO: 687411 - RNA, 22 nt, Human
acauguguggacaugaaucuac

SEQ ID NO: 687412 - RNA, 22 nt, Human
cuggggacuugcagacacaauu

SEQ ID NO: 687413 - RNA, 22 nt, Human
uuugggacuggagcuuggagag

SEQ ID NO: 687414 - RNA, 22 nt, Human
ugauggcuccuucauuaugggu

SEQ ID NO: 687415 - RNA, 22 nt, Human
agcuccugggccaagcccaugc

SEQ ID NO: 687416 - RNA, 22 nt, Human
caaauucaaauuucaucagugu

SEQ ID NO: 687417 - RNA, 22 nt, Human
uccugagagucaagaaugcagg

SEQ ID NO: 687418 - RNA, 22 nt, Human
ccuucuggaugugcuaaggaag

SEQ ID NO: 687419 - RNA, 18 nt, Human
ggagcccagaggugaguu

SEQ ID NO: 687420 - RNA, 22 nt, Human
gcccaggaagccaccgggaagu

SEQ ID NO: 687421 - RNA, 22 nt, Human
uucccagacuccacacugaggc

SEQ ID NO: 687422 - RNA, 22 nt, Human
uuauguugggaaaagucagauu

SEQ ID NO: 687423 - RNA, 22 nt, Human
acaauagaaauaauuaagcaca

SEQ ID NO: 687424 - RNA, 21 nt, Human
ucaguucucugccugugcuug

SEQ ID NO: 687425 - RNA, 22 nt, Human
auucacagggggagaaggguau

SEQ ID NO: 687426 - RNA, 22 nt, Human
uagaugaccuuguguuaggcaa

SEQ ID NO: 687427 - RNA, 22 nt, Human
ugcccagucuccgggccagccc

SEQ ID NO: 687428 - RNA, 22 nt, Human
gcuuaguggugugcaaaggggu

SEQ ID NO: 687429 - RNA, 22 nt, Human
ugccucagaguugucccuacca

SEQ ID NO: 687430 - RNA, 22 nt, Human
uggaaggcacugggagaagacu

SEQ ID NO: 687431 - RNA, 22 nt, Human
uuucuucucacccaggacagag

SEQ ID NO: 687432 - RNA, 22 nt, Human
gcucaggagcugacagccucaa

SEQ ID NO: 687433 - RNA, 23 nt, Human
uuuggacuugugacucuucuccu

SEQ ID NO: 687434 - RNA, 19 nt, Human
ggcagguagagggccaguc

SEQ ID NO: 687435 - RNA, 22 nt, Human
agcccagcugcuauguaccugg

SEQ ID NO: 687436 - RNA, 22 nt, Human
ugacagggacaguggagaugga

SEQ ID NO: 687437 - RNA, 22 nt, Human
auauggcuguugguagccaaca

SEQ ID NO: 687438 - RNA, 22 nt, Human
aagcagaacugggaaguagugg

SEQ ID NO: 687439 - RNA, 22 nt, Human
cauagaaacugagacaaggauu

SEQ ID NO: 687440 - RNA, 22 nt, Human
auugcauuguauuguaaauguu

SEQ ID NO: 687441 - RNA, 22 nt, Human
aaagggccaauggagagugugg

SEQ ID NO: 687442 - RNA, 21 nt, Human
gcaaggccuaucauggcagcu

SEQ ID NO: 687443 - RNA, 22 nt, Human
ugggccacggggguggagagcu

SEQ ID NO: 687444 - RNA, 22 nt, Human
acagcaggcacacaaggauaga

SEQ ID NO: 687445 - RNA, 22 nt, Human
auuugucaaaacacagagaaca

SEQ ID NO: 687446 - RNA, 22 nt, Human
augaaguuccaguauaugcagu

SEQ ID NO: 687447 - RNA, 22 nt, Human
gcucugaaucaaucagauaagg

SEQ ID NO: 687448 - RNA, 22 nt, Human
gauggguagccuuucaauagca

SEQ ID NO: 687449 - RNA, 22 nt, Human
auguuuaaggaacugguuugcu

SEQ ID NO: 687450 - RNA, 22 nt, Human
aaccaguacuuuacacagcucu

SEQ ID NO: 687451 - RNA, 21 nt, Human
ccugggccaaauucccuggac

SEQ ID NO: 687452 - RNA, 22 nt, Human
aggcucuauaccgcugggaguu

SEQ ID NO: 687453 - RNA, 22 nt, Human
caugcauggucaugcugggacu

SEQ ID NO: 687454 - RNA, 22 nt, Human
uucugagccagagucaguuaug

SEQ ID NO: 687455 - RNA, 22 nt, Human
aggcugguaguauuuagucaca

SEQ ID NO: 687456 - RNA, 22 nt, Human
acagugucuccugguacccagu

SEQ ID NO: 687457 - RNA, 22 nt, Human
ggagaccuuaaggugcuuccua

SEQ ID NO: 687458 - RNA, 22 nt, Human
ugucucugguauuaggugaaaa

SEQ ID NO: 687459 - RNA, 22 nt, Human
aacagcagcaugacagcugggu

SEQ ID NO: 687460 - RNA, 22 nt, Human
agcugguaaguggcagagauuc

SEQ ID NO: 687461 - RNA, 22 nt, Human
aucugggagucuuggcucugcu

SEQ ID NO: 687462 - RNA, 22 nt, Human
cuugagaagagauuuauauuug

SEQ ID NO: 687463 - RNA, 22 nt, Human
caucuuuaaaggggagacaccc

SEQ ID NO: 687464 - RNA, 22 nt, Human
cuuaaagucuauccuuucuaga

SEQ ID NO: 687465 - RNA, 22 nt, Human
uaauuacagagguuugccaguu

SEQ ID NO: 687466 - RNA, 22 nt, Human
ugugugcauucacaugcaugcc

SEQ ID NO: 687467 - RNA, 22 nt, Human
ggcugcuggccagccuaggagu

SEQ ID NO: 687468 - RNA, 22 nt, Human
aaaugccucauuuucucucacu

SEQ ID NO: 687469 - RNA, 18 nt, Human
uuaagagcugaaagggga

SEQ ID NO: 687470 - RNA, 22 nt, Human
uaauugcuauuuaaugugguga

SEQ ID NO: 687471 - RNA, 22 nt, Human
uuagcauucucauuugcauaaa

SEQ ID NO: 687472 - RNA, 22 nt, Human
ccuggcagguggagguugcagu

SEQ ID NO: 687473 - RNA, 22 nt, Human
acauuuauuacucagguuguug

SEQ ID NO: 687474 - RNA, 22 nt, Human
gaacauacaagaauuaaguaca

SEQ ID NO: 687475 - RNA, 22 nt, Human
ucuuggcuggucauuuaaaauc

SEQ ID NO: 687476 - RNA, 22 nt, Human
uuacuuuaucuccuagauucca

SEQ ID NO: 687477 - RNA, 22 nt, Human
ccugugcccucagccuggcucu

SEQ ID NO: 687478 - RNA, 23 nt, Human
uggcuucugccccauucucucca

SEQ ID NO: 687479 - RNA, 22 nt, Human
gcugugagugagcugccuaggc

SEQ ID NO: 687480 - RNA, 22 nt, Human
caaggucacauaacuugucaaa

SEQ ID NO: 687481 - RNA, 22 nt, Human
agggcagccauugagggauucu

SEQ ID NO: 687482 - RNA, 22 nt, Human
aaagaacuauuaacgaggaagc

SEQ ID NO: 687483 - RNA, 22 nt, Human
ccacccugagccgcaagagcag

SEQ ID NO: 687484 - RNA, 22 nt, Human
uuuguuaauucuuauguuagag

SEQ ID NO: 687485 - RNA, 22 nt, Human
uacacugagaugacuuugguuu

SEQ ID NO: 687486 - RNA, 17 nt, Human
ugacaaugacaagcacu

SEQ ID NO: 687487 - RNA, 22 nt, Human
acaugaucuuauguagaagauc

SEQ ID NO: 687488 - RNA, 22 nt, Human
agugaaauccuggucaacaggu

SEQ ID NO: 687489 - RNA, 22 nt, Human
auuucuugccccugcucccuga

SEQ ID NO: 687490 - RNA, 22 nt, Human
uucacaggugacuggggauaac

SEQ ID NO: 687491 - RNA, 22 nt, Human
auacaaguucucauguguaucu

SEQ ID NO: 687492 - RNA, 22 nt, Human
auuuguagugaagugaaaauaa

SEQ ID NO: 687493 - RNA, 23 nt, Human
ugggaguguugggaucucugcuc

SEQ ID NO: 687494 - RNA, 22 nt, Human
acagugcugucuaucucacuaa

SEQ ID NO: 687495 - RNA, 16 nt, Human
ucauccaugacagcuc

SEQ ID NO: 687496 - RNA, 22 nt, Human
cuggagaccucuccugagagug

SEQ ID NO: 687497 - RNA, 22 nt, Human
cccagggauguggcagauguua

SEQ ID NO: 687498 - RNA, 22 nt, Human
ccuuucuuuuauccaccagcca

SEQ ID NO: 687499 - RNA, 21 nt, Human
aagguagcauggguugcagcc

SEQ ID NO: 687500 - RNA, 22 nt, Human
caagaaauuucuuaagaacuaa

SEQ ID NO: 687501 - RNA, 22 nt, Human
gagucaggcacugcugcugcuc

SEQ ID NO: 687502 - RNA, 21 nt, Human
ucuggcccucacagucacacc

SEQ ID NO: 687503 - RNA, 22 nt, Human
ggcagccuugacuagugacuua

SEQ ID NO: 687504 - RNA, 22 nt, Human
cccacacaaaucauggggagaa

SEQ ID NO: 687505 - RNA, 22 nt, Human
agagcugugcuuugcaccacgu

SEQ ID NO: 687506 - RNA, 22 nt, Human
acgaauaaaucuauuucacaca

SEQ ID NO: 687507 - RNA, 22 nt, Human
uccugggaugacuuuugaaaug

SEQ ID NO: 687508 - RNA, 22 nt, Human
uauacauguuuuacauaaguga

SEQ ID NO: 687509 - RNA, 22 nt, Human
ggugcccaccugucuuccugga

SEQ ID NO: 687510 - RNA, 22 nt, Human
uacauuccuucguuuagagauu

SEQ ID NO: 687511 - RNA, 22 nt, Human
uagagcagauagugaaacagaa

SEQ ID NO: 687512 - RNA, 19 nt, Human
gaacaaacuuaaacuuuuc

SEQ ID NO: 687513 - RNA, 22 nt, Human
ugcuaugugacugcuucagauu

SEQ ID NO: 687514 - RNA, 16 nt, Human
aggaggggaauuagga

SEQ ID NO: 687515 - RNA, 22 nt, Human
cucuggcugccucucaggccug

SEQ ID NO: 687516 - RNA, 22 nt, Human
uaacagaagaaaacauauugga

SEQ ID NO: 687517 - RNA, 22 nt, Human
uaccuugggguuuuguugcucu

SEQ ID NO: 687518 - RNA, 22 nt, Human
cacuugaguucuuaauagucag

SEQ ID NO: 687519 - RNA, 22 nt, Human
guuuaacauuguaccaacaccu

SEQ ID NO: 687520 - RNA, 22 nt, Human
caaaugaagguggugggucauu

SEQ ID NO: 687521 - RNA, 22 nt, Human
caagcagagguuuauguauuag

SEQ ID NO: 687522 - RNA, 22 nt, Human
cauucuaucuuggacuggaucu

SEQ ID NO: 687523 - RNA, 22 nt, Human
ggggaaaggccauggcaagaac

SEQ ID NO: 687524 - RNA, 22 nt, Human
auucucuguggugaugcuggug

SEQ ID NO: 687525 - RNA, 22 nt, Human
gaggaggcuguuucucugcauu

SEQ ID NO: 687526 - RNA, 22 nt, Human
aagucucagaaaacuagugugg

SEQ ID NO: 687527 - RNA, 20 nt, Human
agaagcauucaaagaaaacu

SEQ ID NO: 687528 - RNA, 22 nt, Human
ggcaggcaccagcucagcaaua

SEQ ID NO: 687529 - RNA, 22 nt, Human
ucagauuucugaaagcccucuc

SEQ ID NO: 687530 - RNA, 22 nt, Human
gcucccaggaugaggagccagg

SEQ ID NO: 687531 - RNA, 22 nt, Human
gcugaggcaaaccaagaaugua

SEQ ID NO: 687532 - RNA, 22 nt, Human
gaaccagcagacuuugacaggu

SEQ ID NO: 687533 - RNA, 18 nt, Human
ugcugcccaacucucccc

SEQ ID NO: 687534 - RNA, 17 nt, Human
uggcucugaggcugaau

SEQ ID NO: 687535 - RNA, 21 nt, Human
uauugcuuguaggucauccug

SEQ ID NO: 687536 - RNA, 22 nt, Human
ccugggucccaucccagaguga

SEQ ID NO: 687537 - RNA, 22 nt, Human
ucaaaagaaacaccauguuccu

SEQ ID NO: 687538 - RNA, 22 nt, Human
aaaccuauuggcaagaauaaua

SEQ ID NO: 687539 - RNA, 22 nt, Human
uaaaugugucuauggacccgcc

SEQ ID NO: 687540 - RNA, 22 nt, Human
ucacagaaaucuguuuuuucua

SEQ ID NO: 687541 - RNA, 22 nt, Human
ccacaguaaauggauucagacc

SEQ ID NO: 687542 - RNA, 22 nt, Human
gcuuucuguggugauguaaagg

SEQ ID NO: 687543 - RNA, 23 nt, Human
uugcuuagagaccuccucaucag

SEQ ID NO: 687544 - RNA, 22 nt, Human
gauuuccaugauugggccagaa

SEQ ID NO: 687545 - RNA, 22 nt, Human
cugcuucacccugccugagaac

SEQ ID NO: 687546 - RNA, 21 nt, Human
ggauggauagggaagagauuu

SEQ ID NO: 687547 - RNA, 22 nt, Human
auuccuucuaaaacgcugcccu

SEQ ID NO: 687548 - RNA, 22 nt, Human
uuaaacaccugucuaguguagc

SEQ ID NO: 687549 - RNA, 22 nt, Human
aucugcauguaucucucugcau

SEQ ID NO: 687550 - RNA, 22 nt, Human
gugcgggccuggggguuucucu

SEQ ID NO: 687551 - RNA, 22 nt, Human
ggcaagauccaaggggcuagga

SEQ ID NO: 687552 - RNA, 22 nt, Human
ugagccugcugucgcuggaccc

SEQ ID NO: 687553 - RNA, 22 nt, Human
uuaauacagaagcaagacacug

SEQ ID NO: 687554 - RNA, 22 nt, Human
ugcagugugaccuguagcgagc

SEQ ID NO: 687555 - RNA, 22 nt, Human
ccucagggaaugggaggcuggg

SEQ ID NO: 687556 - RNA, 22 nt, Human
ucuuucuucagcccuguaagau

SEQ ID NO: 687557 - RNA, 22 nt, Human
ugaguucuucacauuaccuacg

SEQ ID NO: 687558 - RNA, 22 nt, Human
agggucagguuaagggagucau

SEQ ID NO: 687559 - RNA, 22 nt, Human
gagccagagauccaggauggcu

SEQ ID NO: 687560 - RNA, 22 nt, Human
augaggucaucuugaaguaggg

SEQ ID NO: 687561 - RNA, 22 nt, Human
ucagaacauucucauugacugc

SEQ ID NO: 687562 - RNA, 22 nt, Human
aggaaggguggauaguaacgug

SEQ ID NO: 687563 - RNA, 22 nt, Human
ccagggcugcugggggaguuga

SEQ ID NO: 687564 - RNA, 22 nt, Human
gugcuguugccuggcugcacgg

SEQ ID NO: 687565 - RNA, 22 nt, Human
uauuucaggggguacaagaaga

SEQ ID NO: 687566 - RNA, 22 nt, Human
gaaugaguagaguauaaacaaa

SEQ ID NO: 687567 - RNA, 20 nt, Human
ucaaagacaagcucucaucc

SEQ ID NO: 687568 - RNA, 22 nt, Human
auaaauucucugauguauagua

SEQ ID NO: 687569 - RNA, 18 nt, Human
ucacugugugucuugggu

SEQ ID NO: 687570 - RNA, 22 nt, Human
ucacaugucaaaaacuacauaa

SEQ ID NO: 687571 - RNA, 22 nt, Human
uguuggcagugcuacagucagu

SEQ ID NO: 687572 - RNA, 22 nt, Human
cuucacagucuuuauuuccucc

SEQ ID NO: 687573 - RNA, 22 nt, Human
ucucccaguggugcagaaagca

SEQ ID NO: 687574 - RNA, 22 nt, Human
agaauuguugggguaauaaaag

SEQ ID NO: 687575 - RNA, 22 nt, Human
ugcccacaggaagacaccagcg

SEQ ID NO: 687576 - RNA, 21 nt, Human
ccugcugugaucuuagugagu

SEQ ID NO: 687577 - RNA, 22 nt, Human
agaccucuggauagaugugagg

SEQ ID NO: 687578 - RNA, 21 nt, Human
aaucagaggcuuccuaguugg

SEQ ID NO: 687579 - RNA, 22 nt, Human
aaugucugugccuuaaaacuuc

SEQ ID NO: 687580 - RNA, 22 nt, Human
auuuagaacuuuguuugccaau

SEQ ID NO: 687581 - RNA, 22 nt, Human
ucccaggaauccguccucuaga

SEQ ID NO: 687582 - RNA, 22 nt, Human
aaaacuaaauacgcuuugccuc

SEQ ID NO: 687583 - RNA, 22 nt, Human
cucauauucagucacugaugca

SEQ ID NO: 687584 - RNA, 22 nt, Human
uuuguccuauaauccucuuaca

SEQ ID NO: 687585 - RNA, 22 nt, Human
uaacaucuuuagcagcucgaac

SEQ ID NO: 687586 - RNA, 22 nt, Human
aauuauacaauugucaaguucu

SEQ ID NO: 687587 - RNA, 22 nt, Human
uaaggccaaguucauauacaac

SEQ ID NO: 687588 - RNA, 22 nt, Human
uuauggaaaacuccagagagua

SEQ ID NO: 687589 - RNA, 22 nt, Human
ggcuucagaggagaagagggug

SEQ ID NO: 687590 - RNA, 22 nt, Human
auggggcugggauucuccucgg

SEQ ID NO: 687591 - RNA, 22 nt, Human
uuaaauaguaggucuauuuugg

SEQ ID NO: 687592 - RNA, 22 nt, Human
aaacuguugugguuuaucauua

SEQ ID NO: 687593 - RNA, 22 nt, Human
uuuauuuauaagccacuugcug

SEQ ID NO: 687594 - RNA, 22 nt, Human
guaaaacugcagaacuuggagg

SEQ ID NO: 687595 - RNA, 22 nt, Human
aaugggcuuuggccaguaggag

SEQ ID NO: 687596 - RNA, 22 nt, Human
cacuugaaguuugggggacucu

SEQ ID NO: 687597 - RNA, 22 nt, Human
auggcaguguuucaguuuuugg

SEQ ID NO: 687598 - RNA, 23 nt, Human
uguuacaagcaccacagguggcu

SEQ ID NO: 687599 - RNA, 23 nt, Human
gugcucugcggucugcuagucug

SEQ ID NO: 687600 - RNA, 22 nt, Human
ugacaagucacuguucuucaau

SEQ ID NO: 687601 - RNA, 22 nt, Human
ggccuguguccuccuugcccug

SEQ ID NO: 687602 - RNA, 22 nt, Human
gugcauuuaggucacaugaugu

SEQ ID NO: 687603 - RNA, 22 nt, Human
ccucuucuagguuucagccugc

SEQ ID NO: 687604 - RNA, 22 nt, Human
auguacaccaggugaagaugaa

SEQ ID NO: 687605 - RNA, 22 nt, Human
ccuggagcuuuuccauccugga

SEQ ID NO: 687606 - RNA, 22 nt, Human
augcaaaauuaccauucuguuc

SEQ ID NO: 687607 - RNA, 22 nt, Human
gagguggcagaggccuggaccu

SEQ ID NO: 687608 - RNA, 22 nt, Human
caggaaaugaaagcuagcuaau

SEQ ID NO: 687609 - RNA, 22 nt, Human
gagagacagcagaacgugcagc

SEQ ID NO: 687610 - RNA, 22 nt, Human
cacaguuucuauaggucagaau

SEQ ID NO: 687611 - RNA, 22 nt, Human
agcagggcagguaaggaucaga

SEQ ID NO: 687612 - RNA, 22 nt, Human
cucaggauauugggcuggagca

SEQ ID NO: 687613 - RNA, 22 nt, Human
uaaaugugagugaugcggugaa

SEQ ID NO: 687614 - RNA, 22 nt, Human
cugaagauuuuugguaaucaug

SEQ ID NO: 687615 - RNA, 22 nt, Human
ugcuuucaccuguuugcaccca

SEQ ID NO: 687616 - RNA, 22 nt, Human
ugaggacauuaggaagugaagg

SEQ ID NO: 687617 - RNA, 22 nt, Human
uagaaguuucaaaagacuucau

SEQ ID NO: 687618 - RNA, 22 nt, Human
gugggaugcaguggugaguggc

SEQ ID NO: 687619 - RNA, 22 nt, Human
ccaggagcuauguacacacuau

SEQ ID NO: 687620 - RNA, 22 nt, Human
cccaggcuggagugcaauggca

SEQ ID NO: 687621 - RNA, 22 nt, Human
ucauaacaggcugagaggauuu

SEQ ID NO: 687622 - RNA, 22 nt, Human
uuacaagauaaccugaugcugu

SEQ ID NO: 687623 - RNA, 22 nt, Human
auggccagccugguacuuggca

SEQ ID NO: 687624 - RNA, 22 nt, Human
uugggcugaucuguggaagaag

SEQ ID NO: 687625 - RNA, 22 nt, Human
ucugugcugagcucugagaugu

SEQ ID NO: 687626 - RNA, 22 nt, Human
acaguggcuuuugugucugcag

SEQ ID NO: 687627 - RNA, 22 nt, Human
cagcaguguggaagcugagggg

SEQ ID NO: 687628 - RNA, 22 nt, Human
uacagauaggaggaaucugaaa

SEQ ID NO: 687629 - RNA, 22 nt, Human
gaccagcugguccuguccuggg

SEQ ID NO: 687630 - RNA, 22 nt, Human
gugcuuuacuguguugccuuua

SEQ ID NO: 687631 - RNA, 22 nt, Human
ccacugggggcugcucccaggu

SEQ ID NO: 687632 - RNA, 22 nt, Human
ugagacuuggcacugaggaacu

SEQ ID NO: 687633 - RNA, 23 nt, Human
gagaacagccacagagagcugug

SEQ ID NO: 687634 - RNA, 22 nt, Human
acuuagcauuauguaauuacua

SEQ ID NO: 687635 - RNA, 23 nt, Human
gcucugccacuuaauagcugugu

SEQ ID NO: 687636 - RNA, 22 nt, Human
uguaaaaggaaaucaaagcacu

SEQ ID NO: 687637 - RNA, 22 nt, Human
cauucugagucacucuuuagca

SEQ ID NO: 687638 - RNA, 22 nt, Human
aaacugcaauuauuuuugcaau

SEQ ID NO: 687639 - RNA, 22 nt, Human
ccuggguccacccugugaagua

SEQ ID NO: 687640 - RNA, 22 nt, Human
ugauggaagagcuaacaauauc

SEQ ID NO: 687641 - RNA, 22 nt, Human
ugagugccugaacauagaguag

SEQ ID NO: 687642 - RNA, 21 nt, Human
agauuguauggaggugagagg

SEQ ID NO: 687643 - RNA, 22 nt, Human
cagaggcugcucuggguggcau

SEQ ID NO: 687644 - RNA, 22 nt, Human
uacacagggaaaggucucagag

SEQ ID NO: 687645 - RNA, 19 nt, Human
ggcagcuggacgcuguuca

SEQ ID NO: 687646 - RNA, 22 nt, Human
uagaagcacagguuaaaggcau

SEQ ID NO: 687647 - RNA, 22 nt, Human
aagggggcgaagacgugauuga

SEQ ID NO: 687648 - RNA, 22 nt, Human
cagggcaguuuuacuucucucu

SEQ ID NO: 687649 - RNA, 23 nt, Human
ugaguguguucccugugagauuu

SEQ ID NO: 687650 - RNA, 22 nt, Human
aagauauuuuagaacauucacu

SEQ ID NO: 687651 - RNA, 22 nt, Human
gagaaagggaacuuacagagug

SEQ ID NO: 687652 - RNA, 22 nt, Human
cagcuauauuguuuucuacugu

SEQ ID NO: 687653 - RNA, 22 nt, Human
uuuguugugaacagaauaauau

SEQ ID NO: 687654 - RNA, 19 nt, Human
ggaccagcuuucaggaggc

SEQ ID NO: 687655 - RNA, 22 nt, Human
uggcucagagcagggacucugg

SEQ ID NO: 687656 - RNA, 21 nt, Human
cccaggagaagaaaagaugca

SEQ ID NO: 687657 - RNA, 22 nt, Human
acucuuuuaugcauuccuucag

SEQ ID NO: 687658 - RNA, 22 nt, Human
ucagcccaggaaugagccuucu

SEQ ID NO: 687659 - RNA, 22 nt, Human
auggauaaauacuuggugguau

SEQ ID NO: 687660 - RNA, 22 nt, Human
ugaggaaguugaucucaucagu

SEQ ID NO: 687661 - RNA, 22 nt, Human
gggacgagccccaggcuggagg

SEQ ID NO: 687662 - RNA, 22 nt, Human
cacaguaucccucuuucucccc

SEQ ID NO: 687663 - RNA, 22 nt, Human
uugcagggaaauagaaauaaac

SEQ ID NO: 687664 - RNA, 18 nt, Human
ucaguccuccauagagcu

SEQ ID NO: 687665 - RNA, 22 nt, Human
caaugcuucaggcuccuuauag

SEQ ID NO: 687666 - RNA, 22 nt, Human
uugaacuaauagguaucuugua

SEQ ID NO: 687667 - RNA, 22 nt, Human
ugagacagucaccaggcaggcc

SEQ ID NO: 687668 - RNA, 22 nt, Human
cacauuuagagguuagcauggu

SEQ ID NO: 687669 - RNA, 22 nt, Human
gcuccucugucaaaugagagug

SEQ ID NO: 687670 - RNA, 22 nt, Human
aagcuucagugugagcauguaa

SEQ ID NO: 687671 - RNA, 22 nt, Human
gugcagguguuuuggcugccag

SEQ ID NO: 687672 - RNA, 22 nt, Human
ccuggcuccagcugccuguccu

SEQ ID NO: 687673 - RNA, 22 nt, Human
ugagugccuacggcacaggcgc

SEQ ID NO: 687674 - RNA, 22 nt, Human
uguuaauggcugaagacauccu

SEQ ID NO: 687675 - RNA, 22 nt, Human
cuuccagaggaacucugcagug

SEQ ID NO: 687676 - RNA, 22 nt, Human
auugcuuacuaaucaucuucag

SEQ ID NO: 687677 - RNA, 22 nt, Human
caaguuuucuggguucagagca

SEQ ID NO: 687678 - RNA, 22 nt, Human
aaauuauuacaagcuaguuggc

SEQ ID NO: 687679 - RNA, 22 nt, Human
uccaggcuggagugcaguggcg

SEQ ID NO: 687680 - RNA, 22 nt, Human
cccaggaggcagaaguugcagu

SEQ ID NO: 687681 - RNA, 22 nt, Human
uauucuuguauacuacaaucuu

SEQ ID NO: 687682 - RNA, 22 nt, Human
ugcagcugaaccuagagucugu

SEQ ID NO: 687683 - RNA, 22 nt, Human
ucugugccuucucccagacuua

SEQ ID NO: 687684 - RNA, 22 nt, Human
caucagcagucacaugaugcug

SEQ ID NO: 687685 - RNA, 22 nt, Human
uucauucccaagaguaaacaua

SEQ ID NO: 687686 - RNA, 22 nt, Human
cuauuacugacuucuguauuua

SEQ ID NO: 687687 - RNA, 22 nt, Human
agcuguugcagggaucagcacc

SEQ ID NO: 687688 - RNA, 22 nt, Human
ugaguccauguggaggggaggu

SEQ ID NO: 687689 - RNA, 22 nt, Human
ucugaacaugaugucaucugga

SEQ ID NO: 687690 - RNA, 22 nt, Human
cagcagagaugagauuccuaua

SEQ ID NO: 687691 - RNA, 22 nt, Human
uuucauggcuaggacuagagug

SEQ ID NO: 687692 - RNA, 22 nt, Human
ucuccugcuucaacugauggac

SEQ ID NO: 687693 - RNA, 22 nt, Human
augcuuggcguuucacuuccug

SEQ ID NO: 687694 - RNA, 22 nt, Human
agaacucucgcuggaucagacu

SEQ ID NO: 687695 - RNA, 22 nt, Human
uucaggaugacaccauguccag

SEQ ID NO: 687696 - RNA, 22 nt, Human
aagaaaugcugauguuggaugg

SEQ ID NO: 687697 - RNA, 19 nt, Human
ggucacagggguuacaagg

SEQ ID NO: 687698 - RNA, 22 nt, Human
ugucacaucaggugguggcugu

SEQ ID NO: 687699 - RNA, 21 nt, Human
agcagaggcagaauguaugca

SEQ ID NO: 687700 - RNA, 19 nt, Human
ugugucucuguguagccug

SEQ ID NO: 687701 - RNA, 22 nt, Human
uagcagaggcaaggaugugaau

SEQ ID NO: 687702 - RNA, 22 nt, Human
gcuggcucugccccaccuguuc

SEQ ID NO: 687703 - RNA, 22 nt, Human
uuauugugucuugguuuaucuu

SEQ ID NO: 687704 - RNA, 22 nt, Human
uacuaaaugauuaagcaggaau

SEQ ID NO: 687705 - RNA, 22 nt, Human
ccagcuuguuugaagcucguca

SEQ ID NO: 687706 - RNA, 22 nt, Human
ccucucuuggauguggaugggu

SEQ ID NO: 687707 - RNA, 19 nt, Human
aaggacacaacagagauag

SEQ ID NO: 687708 - RNA, 22 nt, Human
ucugagccaaaauaaacagcau

SEQ ID NO: 687709 - RNA, 22 nt, Human
gugcuggcugccaggaggcugc

SEQ ID NO: 687710 - RNA, 22 nt, Human
ccuggcugcuauagcagcaugu

SEQ ID NO: 687711 - RNA, 22 nt, Human
aagaguuuucucugauggcauu

SEQ ID NO: 687712 - RNA, 22 nt, Human
ggugccacauaaauggagagag

SEQ ID NO: 687713 - RNA, 22 nt, Human
gcugucugccgcaggcugccac

SEQ ID NO: 687714 - RNA, 22 nt, Human
ugggcaggggcccugcuuccgu

SEQ ID NO: 687715 - RNA, 22 nt, Human
auauugaacccuacagacugua

SEQ ID NO: 687716 - RNA, 22 nt, Human
ugaagacaagaaaacacugggg

SEQ ID NO: 687717 - RNA, 22 nt, Human
uccuccaggauaaaauguguug

SEQ ID NO: 687718 - RNA, 22 nt, Human
ugggggagcgacagacauaauu

SEQ ID NO: 687719 - RNA, 22 nt, Human
gccucaguuuauacaccuguaa

SEQ ID NO: 687720 - RNA, 22 nt, Human
ccaggacaaguguggccauggc

SEQ ID NO: 687721 - RNA, 20 nt, Human
gcccuggagccuuguccugg

SEQ ID NO: 687722 - RNA, 22 nt, Human
uuuauugcauacacaaauguca

SEQ ID NO: 687723 - RNA, 22 nt, Human
ccugggcuucugucuagauguu

SEQ ID NO: 687724 - RNA, 22 nt, Human
ggagucaccugggaggacuggg

SEQ ID NO: 687725 - RNA, 22 nt, Human
acacuuugaagauggaaacuug

SEQ ID NO: 687726 - RNA, 22 nt, Human
uccuagaauagugugucuggag

SEQ ID NO: 687727 - RNA, 22 nt, Human
uugaaauauuugggaguguuug

SEQ ID NO: 687728 - RNA, 22 nt, Human
aaaguguagagugccucaaaau

SEQ ID NO: 687729 - RNA, 22 nt, Human
agugaaauggaugcugcuacug

SEQ ID NO: 687730 - RNA, 20 nt, Human
gcagcagacagacaggggac

SEQ ID NO: 687731 - RNA, 22 nt, Human
aaggccagaguacuagaggcug

SEQ ID NO: 687732 - RNA, 22 nt, Human
guuaaauaaccucauguccguu

SEQ ID NO: 687733 - RNA, 22 nt, Human
ccaggcagggcucaaggaaccu

SEQ ID NO: 687734 - RNA, 22 nt, Human
ucucauugguauauacaugugu

SEQ ID NO: 687735 - RNA, 22 nt, Human
auacuaagcucauuacauuuug

SEQ ID NO: 687736 - RNA, 22 nt, Human
aggaaagugaauguuauuuugc

SEQ ID NO: 687737 - RNA, 22 nt, Human
aggagggagaugcccauccugg

SEQ ID NO: 687738 - RNA, 22 nt, Human
gcccaggaucugcucagaucau

SEQ ID NO: 687739 - RNA, 22 nt, Human
acccaggauaaucuguguaucu

SEQ ID NO: 687740 - RNA, 21 nt, Human
aggggaaguagaguuuugauu

SEQ ID NO: 687741 - RNA, 22 nt, Human
uuugacaaauccuucagcaaug

SEQ ID NO: 687742 - RNA, 22 nt, Human
uaguguggccccaagaggaucu

SEQ ID NO: 687743 - RNA, 22 nt, Human
uguuacugauuugauauacagu

SEQ ID NO: 687744 - RNA, 22 nt, Human
cugcuguggccagccaggucaa

SEQ ID NO: 687745 - RNA, 22 nt, Human
gggcugugugcccacuucccau

SEQ ID NO: 687746 - RNA, 22 nt, Human
cugugccucccuuuacuuugag

SEQ ID NO: 687747 - RNA, 22 nt, Human
auacacuguucacuagaucuuc

SEQ ID NO: 687748 - RNA, 22 nt, Human
auuuguuuaucgucgauuguag

SEQ ID NO: 687749 - RNA, 22 nt, Human
agggacacacuccaguguuauu

SEQ ID NO: 687750 - RNA, 21 nt, Human
ucugcauuuuagcaagaucuc

SEQ ID NO: 687751 - RNA, 22 nt, Human
uaagagcacugaagucuucuua

SEQ ID NO: 687752 - RNA, 22 nt, Human
cagagucaguauugaauugaaa

SEQ ID NO: 687753 - RNA, 22 nt, Human
uucaguaugcugaaugauuuuu

SEQ ID NO: 687754 - RNA, 22 nt, Human
aggaaugauaguaaaagagaau

SEQ ID NO: 687755 - RNA, 22 nt, Human
ggacauggagcuccauggaggc

SEQ ID NO: 687756 - RNA, 22 nt, Human
acguuuuauucccaugcagcau

SEQ ID NO: 687757 - RNA, 22 nt, Human
ccuggcucccccaucauagcug

SEQ ID NO: 687758 - RNA, 22 nt, Human
auauacuuuucacuaauggcua

SEQ ID NO: 687759 - RNA, 22 nt, Human
ucccugaguguauguggugaac

SEQ ID NO: 687760 - RNA, 22 nt, Human
aggcccaguuauccuacuuguu

SEQ ID NO: 687761 - RNA, 22 nt, Human
aucuuucuauuucuaaaaacua

SEQ ID NO: 687762 - RNA, 22 nt, Human
aggugggacccguggggugcga

SEQ ID NO: 687763 - RNA, 22 nt, Human
ugcuggagaacugcucuguguu

SEQ ID NO: 687764 - RNA, 22 nt, Human
gacacugaccccaagcuguccu

SEQ ID NO: 687765 - RNA, 21 nt, Human
ggucuuccaaauaaggagaaa

SEQ ID NO: 687766 - RNA, 18 nt, Human
uccauccucugcucuuca

SEQ ID NO: 687767 - RNA, 22 nt, Human
agaaggcuuaaaacauggaaua

SEQ ID NO: 687768 - RNA, 22 nt, Human
agaguuuguaguggugaaugua

SEQ ID NO: 687769 - RNA, 22 nt, Human
ccacgcucauccucucugagag

SEQ ID NO: 687770 - RNA, 22 nt, Human
ugaguacuuuauguuaguuauu

SEQ ID NO: 687771 - RNA, 22 nt, Human
aacugcaaucacuuuugcacca

SEQ ID NO: 687772 - RNA, 22 nt, Human
aauugaaagaagugggauugcc

SEQ ID NO: 687773 - RNA, 22 nt, Human
ugcaaaggaggaugggaaagaa

SEQ ID NO: 687774 - RNA, 22 nt, Human
aacacugugcuccccaggcugu

SEQ ID NO: 687775 - RNA, 22 nt, Human
guccuucauaucauggauuaua

SEQ ID NO: 687776 - RNA, 20 nt, Human
agugugucucggagguaagu

SEQ ID NO: 687777 - RNA, 17 nt, Human
gccuuccuuccuccaca

SEQ ID NO: 687778 - RNA, 22 nt, Human
augcaugagaauaucccaugcu

SEQ ID NO: 687779 - RNA, 20 nt, Human
cagaugggacguggaggagu

SEQ ID NO: 687780 - RNA, 22 nt, Human
ggaaggaaagcagcuuggcccu

SEQ ID NO: 687781 - RNA, 22 nt, Human
agcagcagaggucagaaaggua

SEQ ID NO: 687782 - RNA, 17 nt, Human
uaugcuuuucuucucca

SEQ ID NO: 687783 - RNA, 22 nt, Human
ucaggaguuucagguguaagug

SEQ ID NO: 687784 - RNA, 22 nt, Human
aaucaacauuguuuuaagucaa

SEQ ID NO: 687785 - RNA, 22 nt, Human
uuaguuaauugacuauguugca

SEQ ID NO: 687786 - RNA, 22 nt, Human
agguacauuugauaaaaauagc

SEQ ID NO: 687787 - RNA, 22 nt, Human
aggucagacagggugucuuucu

SEQ ID NO: 687788 - RNA, 23 nt, Human
acuuggaagcagugaacaacuuu

SEQ ID NO: 687789 - RNA, 22 nt, Human
aggcuccauucaugugaaggca

SEQ ID NO: 687790 - RNA, 22 nt, Human
aucaaaguuucccagaaguugu

SEQ ID NO: 687791 - RNA, 22 nt, Human
aaugcauuccacugagauuugu

SEQ ID NO: 687792 - RNA, 22 nt, Human
ugucuuaaacuugugggacuuc

SEQ ID NO: 687793 - RNA, 22 nt, Human
ucucaucuucauugucucccau

SEQ ID NO: 687794 - RNA, 20 nt, Human
aggcugaguucuaugcacuu

SEQ ID NO: 687795 - RNA, 22 nt, Human
gcugcagggggugggcgucucc

SEQ ID NO: 687796 - RNA, 22 nt, Human
cuauugaggacauaaggacucu

SEQ ID NO: 687797 - RNA, 22 nt, Human
uugucagccagcucgcacucuu

SEQ ID NO: 687798 - RNA, 22 nt, Human
auaucaguaucuauguauuugu

SEQ ID NO: 687799 - RNA, 22 nt, Human
ccugaggaugccagcaugggug

SEQ ID NO: 687800 - RNA, 22 nt, Human
cacaggguuguucugaggauuc

SEQ ID NO: 687801 - RNA, 22 nt, Human
agaaaggucacuuagccucagc

SEQ ID NO: 687802 - RNA, 22 nt, Human
uggggccugcacaggcugaaug

SEQ ID NO: 687803 - RNA, 20 nt, Human
auaaaauaacugccacaaga

SEQ ID NO: 687804 - RNA, 22 nt, Human
cuucaaggaagccacguuggga

SEQ ID NO: 687805 - RNA, 22 nt, Human
caaggccaguucaccaagggca

SEQ ID NO: 687806 - RNA, 22 nt, Human
gcauugaaccaucuagauuucu

SEQ ID NO: 687807 - RNA, 19 nt, Human
caguggagauuggaggagg

SEQ ID NO: 687808 - RNA, 22 nt, Human
uuucuggaaacuguaaagagga

SEQ ID NO: 687809 - RNA, 22 nt, Human
uucacacucucacucccugacc

SEQ ID NO: 687810 - RNA, 22 nt, Human
uccuucaccucaagcuuuugaa

SEQ ID NO: 687811 - RNA, 22 nt, Human
cuugaaagcuuugcgucuucua

SEQ ID NO: 687812 - RNA, 22 nt, Human
cugggcuccacucccacagugu

SEQ ID NO: 687813 - RNA, 22 nt, Human
gggcauggccaggugagggguc

SEQ ID NO: 687814 - RNA, 20 nt, Human
ucacuguaauugccuacauu

SEQ ID NO: 687815 - RNA, 22 nt, Human
guguagcauauagcaagagcau

SEQ ID NO: 687816 - RNA, 22 nt, Human
gggcuucauucaggcagaauuu

SEQ ID NO: 687817 - RNA, 22 nt, Human
aaauguuuaaguguaggagcaa

SEQ ID NO: 687818 - RNA, 22 nt, Human
auuacaagggucugacuggagg

SEQ ID NO: 687819 - RNA, 17 nt, Human
uggucuggaagaacuga

SEQ ID NO: 687820 - RNA, 23 nt, Human
uccuugggccugcccagaguggu

SEQ ID NO: 687821 - RNA, 22 nt, Human
ucccagggugaaaugcaguagg

SEQ ID NO: 687822 - RNA, 22 nt, Human
aaagguucucuuguucauuauu

SEQ ID NO: 687823 - RNA, 22 nt, Human
ggccagcauauagagugaagua

SEQ ID NO: 687824 - RNA, 22 nt, Human
cagaggggauaacagguguaga

SEQ ID NO: 687825 - RNA, 23 nt, Human
ucucaguuccagaggcuacaagu

SEQ ID NO: 687826 - RNA, 22 nt, Human
ggccucuggcaggcaggcccuc

SEQ ID NO: 687827 - RNA, 22 nt, Human
aucuuccaggugccggggguca

SEQ ID NO: 687828 - RNA, 22 nt, Human
aggcccuauucaauggggccca

SEQ ID NO: 687829 - RNA, 22 nt, Human
uggcagcaaguucuugggaggu

SEQ ID NO: 687830 - RNA, 22 nt, Human
aaauccuaauaaugcacuagug

SEQ ID NO: 687831 - RNA, 22 nt, Human
ccagcugcucucuucuccgcca

SEQ ID NO: 687832 - RNA, 22 nt, Human
ucagagaguuagugucuuagcu

SEQ ID NO: 687833 - RNA, 22 nt, Human
agcagggcuuugucucugugaa

SEQ ID NO: 687834 - RNA, 22 nt, Human
ucuccauaggcaguucauaaca

SEQ ID NO: 687835 - RNA, 22 nt, Human
ggacaggugugaggcuggcaca

SEQ ID NO: 687836 - RNA, 22 nt, Human
aagcuggcucugaugucagaau

SEQ ID NO: 687837 - RNA, 22 nt, Human
uagugucugaaugcaccuguuu

SEQ ID NO: 687838 - RNA, 22 nt, Human
cagcucugaagaaaggugucua

SEQ ID NO: 687839 - RNA, 22 nt, Human
aagggcucucugcauugaaauu

SEQ ID NO: 687840 - RNA, 21 nt, Human
uugagcagaaauguguaugcc

SEQ ID NO: 687841 - RNA, 22 nt, Human
gaggucugccuucaggagaguu

SEQ ID NO: 687842 - RNA, 22 nt, Human
aggucucacuuuguggaaguga

SEQ ID NO: 687843 - RNA, 22 nt, Human
gugugagcagaaaccaugagua

SEQ ID NO: 687844 - RNA, 22 nt, Human
auuccaauuguacuugcuuuua

SEQ ID NO: 687845 - RNA, 23 nt, Human
ccaagcuucuaaugcugcugagc

SEQ ID NO: 687846 - RNA, 22 nt, Human
gcuucuugccuguguagagaau

SEQ ID NO: 687847 - RNA, 22 nt, Human
cugcagagcagccaguccccca

SEQ ID NO: 687848 - RNA, 22 nt, Human
uggcuguguuaccacuucaugu

SEQ ID NO: 687849 - RNA, 22 nt, Human
cagcagauuugggaaacacugu

SEQ ID NO: 687850 - RNA, 22 nt, Human
aacaguguuuuucuucagcacu

SEQ ID NO: 687851 - RNA, 22 nt, Human
uuagggcaggcaugagagaacu

SEQ ID NO: 687852 - RNA, 22 nt, Human
ggaaacauuccaagaguugaaa

SEQ ID NO: 687853 - RNA, 22 nt, Human
gugccuggagcuaauguguaua

SEQ ID NO: 687854 - RNA, 22 nt, Human
uggcuggaguauaggaguagga

SEQ ID NO: 687855 - RNA, 20 nt, Human
ugccaggcacggagugcaug

SEQ ID NO: 687856 - RNA, 22 nt, Human
cuguugcaugacugugcaugcu

SEQ ID NO: 687857 - RNA, 22 nt, Human
cuggagauaagcagucccaggc

SEQ ID NO: 687858 - RNA, 22 nt, Human
gcagagauuggugcacugauga

SEQ ID NO: 687859 - RNA, 22 nt, Human
cucucccuagguuagcggucag

SEQ ID NO: 687860 - RNA, 22 nt, Human
uggcucucagcucccagcagcc

SEQ ID NO: 687861 - RNA, 22 nt, Human
accucugcaacccuggaauggg

SEQ ID NO: 687862 - RNA, 22 nt, Human
agggagcagcagccacaggaug

SEQ ID NO: 687863 - RNA, 22 nt, Human
uccagagcucugggcauagcug

SEQ ID NO: 687864 - RNA, 22 nt, Human
uggaggcaggggauacagguca

SEQ ID NO: 687865 - RNA, 22 nt, Human
gucuuuuucuacgauagcgccu

SEQ ID NO: 687866 - RNA, 22 nt, Human
ucaugguucaugaguguccuuu

SEQ ID NO: 687867 - RNA, 19 nt, Human
ggaaacaggggccagagga

SEQ ID NO: 687868 - RNA, 22 nt, Human
aaggccuugccugacagcacca

SEQ ID NO: 687869 - RNA, 21 nt, Human
aggcagaaagagcccaggcug

SEQ ID NO: 687870 - RNA, 22 nt, Human
ugcugcuuuggaacuccacagg

SEQ ID NO: 687871 - RNA, 22 nt, Human
ccucacacaguuaucucuucau

SEQ ID NO: 687872 - RNA, 22 nt, Human
ucaucagaggcaucuggcaagg

SEQ ID NO: 687873 - RNA, 22 nt, Human
cgcugggcagguccacuuguua

SEQ ID NO: 687874 - RNA, 22 nt, Human
aacaaauguguggcaguguggg

SEQ ID NO: 687875 - RNA, 22 nt, Human
auucuuggagcagucaaagaag

SEQ ID NO: 687876 - RNA, 21 nt, Human
gaagccaagacaggaucaagg

SEQ ID NO: 687877 - RNA, 22 nt, Human
uuuccauauuuggucuuuggga

SEQ ID NO: 687878 - RNA, 22 nt, Human
cacugcaguaacucuaggacug

SEQ ID NO: 687879 - RNA, 22 nt, Human
ucccugagacucuggaguguaa

SEQ ID NO: 687880 - RNA, 22 nt, Human
uacucugcaaguugaagguggc

SEQ ID NO: 687881 - RNA, 22 nt, Human
uuccuaacucuggcaccuaguc

SEQ ID NO: 687882 - RNA, 22 nt, Human
aaucuuucccuauuaaaugugg

SEQ ID NO: 687883 - RNA, 22 nt, Human
cugagggguauccaagggguaa

SEQ ID NO: 687884 - RNA, 16 nt, Human
uggcacagagcagaua

SEQ ID NO: 687885 - RNA, 22 nt, Human
gugagagaauuugaguuaaauu

SEQ ID NO: 687886 - RNA, 22 nt, Human
ugggcuuaggucggaggcggcc

SEQ ID NO: 687887 - RNA, 22 nt, Human
uugcuuugccaccagaagucua

SEQ ID NO: 687888 - RNA, 22 nt, Human
uuugcaaaccggagcucugcaa

SEQ ID NO: 687889 - RNA, 22 nt, Human
cucaggauucucgacacucaca

SEQ ID NO: 687890 - RNA, 22 nt, Human
cagccuucugaaugaacguacu

SEQ ID NO: 687891 - RNA, 22 nt, Human
cugagcugggcucucuugaggg

SEQ ID NO: 687892 - RNA, 22 nt, Human
ucaaaacaacacucagguguaa

SEQ ID NO: 687893 - RNA, 22 nt, Human
caguggucccugagguugcugg

SEQ ID NO: 687894 - RNA, 22 nt, Human
cuucugggugccugugaguguu

SEQ ID NO: 687895 - RNA, 22 nt, Human
auauguauugagugccaacugu

SEQ ID NO: 687896 - RNA, 22 nt, Human
ccuggcuggauggagccccugg

SEQ ID NO: 687897 - RNA, 22 nt, Human
cugggccuggcguuccaggcug

SEQ ID NO: 687898 - RNA, 22 nt, Human
uggccugcagaggcuguggggc

SEQ ID NO: 687899 - RNA, 22 nt, Human
aguacaugcagaacuaacagau

SEQ ID NO: 687900 - RNA, 18 nt, Human
ggagcugggccccacucc

SEQ ID NO: 687901 - RNA, 22 nt, Human
gugagguccuaauagacaucga

SEQ ID NO: 687902 - RNA, 22 nt, Human
cuccagcugcuggucugagacu

SEQ ID NO: 687903 - RNA, 22 nt, Human
guuauucugcacaccuuuaaaa

SEQ ID NO: 687904 - RNA, 22 nt, Human
acaguaguacacaucuaugucc

SEQ ID NO: 687905 - RNA, 22 nt, Human
gacagcaacacaugcuuagugc

SEQ ID NO: 687906 - RNA, 22 nt, Human
uucauuacauucaaaaggcauu

SEQ ID NO: 687907 - RNA, 22 nt, Human
aaaaauagaaggauugacugag

SEQ ID NO: 687908 - RNA, 22 nt, Human
ggacucagcagccaggaguggc

SEQ ID NO: 687909 - RNA, 22 nt, Human
ucacauacugaaaguccaguga

SEQ ID NO: 687910 - RNA, 22 nt, Human
ggccucacccaucggugccuuu

SEQ ID NO: 687911 - RNA, 22 nt, Human
ucucaugccuggaauuaucauu

SEQ ID NO: 687912 - RNA, 22 nt, Human
aagcagccacuggccaguuaua

SEQ ID NO: 687913 - RNA, 22 nt, Human
gcauuuuugaucccacuaggau

SEQ ID NO: 687914 - RNA, 21 nt, Human
cagaggcaggcucugugugug

SEQ ID NO: 687915 - RNA, 22 nt, Human
ggcauggcucggagucagaaca

SEQ ID NO: 687916 - RNA, 22 nt, Human
cucaggaggaugacugccuugg

SEQ ID NO: 687917 - RNA, 22 nt, Human
cucccuccucaaauaucuuugu

SEQ ID NO: 687918 - RNA, 22 nt, Human
agaagccauugaagcagaccuc

SEQ ID NO: 687919 - RNA, 22 nt, Human
ucagccuccgaaagugcuggga

SEQ ID NO: 687920 - RNA, 22 nt, Human
uucaucauugccagucuuuaaa

SEQ ID NO: 687921 - RNA, 22 nt, Human
uauucccauuccacuuaucaag

SEQ ID NO: 687922 - RNA, 22 nt, Human
ccaugcuaggaacucucaggga

SEQ ID NO: 687923 - RNA, 23 nt, Human
aaagugcaguugaggaaucauag

SEQ ID NO: 687924 - RNA, 22 nt, Human
acuuuucaaaugggaaacucag

SEQ ID NO: 687925 - RNA, 22 nt, Human
gcagaccucaggacaucauuag

SEQ ID NO: 687926 - RNA, 22 nt, Human
aggaaaaugaaacagcaacugu

SEQ ID NO: 687927 - RNA, 22 nt, Human
auggcuccagcugguagagauu

SEQ ID NO: 687928 - RNA, 22 nt, Human
aaugccguguuucuuacguuca

SEQ ID NO: 687929 - RNA, 22 nt, Human
gcaaggcuuugugaauuuuaaa

SEQ ID NO: 687930 - RNA, 22 nt, Human
aacacagguucauucugugagg

SEQ ID NO: 687931 - RNA, 22 nt, Human
agauguaacgguagguggcauu

SEQ ID NO: 687932 - RNA, 20 nt, Human
ccaaggauuggcaagcagca

SEQ ID NO: 687933 - RNA, 22 nt, Human
aggaucuugcuguagaggauag

SEQ ID NO: 687934 - RNA, 22 nt, Human
agucaggagauauuuugauaug

SEQ ID NO: 687935 - RNA, 22 nt, Human
ggcggcccugcacgugcugagg

SEQ ID NO: 687936 - RNA, 22 nt, Human
agcaccaggucgcuggcacgcu

SEQ ID NO: 687937 - RNA, 22 nt, Human
agugucugugcuuugcagcaaa

SEQ ID NO: 687938 - RNA, 22 nt, Human
uccuggcccuguggccugcagu

SEQ ID NO: 687939 - RNA, 22 nt, Human
aaagguuuuuauuuauccugga

SEQ ID NO: 687940 - RNA, 22 nt, Human
uccaggaauagaucagagauuu

SEQ ID NO: 687941 - RNA, 22 nt, Human
uccuucaagugcaguaccugag

SEQ ID NO: 687942 - RNA, 22 nt, Human
uacaggguauagguacagauga

SEQ ID NO: 687943 - RNA, 22 nt, Human
ucagcaggguuugacuucuaau

SEQ ID NO: 687944 - RNA, 22 nt, Human
uuaguacauugauucauuaugu

SEQ ID NO: 687945 - RNA, 22 nt, Human
aggcuccagucuccucuggcag

SEQ ID NO: 687946 - RNA, 22 nt, Human
caggaggaaacuggauucacuu

SEQ ID NO: 687947 - RNA, 22 nt, Human
gcugagaaucaagauggagagg

SEQ ID NO: 687948 - RNA, 22 nt, Human
gcuggagguggugagaaaaggu

SEQ ID NO: 687949 - RNA, 22 nt, Human
aaagcuguuaaaugcauaaugc

SEQ ID NO: 687950 - RNA, 22 nt, Human
uggcaaaggaaaugauuuaaga

SEQ ID NO: 687951 - RNA, 22 nt, Human
uucuuacuaguauguuucagca

SEQ ID NO: 687952 - RNA, 22 nt, Human
ucccagccugacagugcaucaa

SEQ ID NO: 687953 - RNA, 22 nt, Human
ucacauuuuuuacuggacuuaa

SEQ ID NO: 687954 - RNA, 22 nt, Human
uggcccagugcuuaugcucuga

SEQ ID NO: 687955 - RNA, 22 nt, Human
cuggccagcauuuuugcuuuag

SEQ ID NO: 687956 - RNA, 22 nt, Human
aggcucagcaucugauucauau

SEQ ID NO: 687957 - RNA, 22 nt, Human
guggugaagcauugagaaguca

SEQ ID NO: 687958 - RNA, 17 nt, Human
aggcuggccuucacagu

SEQ ID NO: 687959 - RNA, 22 nt, Human
aggagcagcccacuccuguccu

SEQ ID NO: 687960 - RNA, 22 nt, Human
ugcauuuuugauaacuguguac

SEQ ID NO: 687961 - RNA, 22 nt, Human
ucuggcuucaguaggguucacu

SEQ ID NO: 687962 - RNA, 22 nt, Human
gugccagcucuccccacaucug

SEQ ID NO: 687963 - RNA, 22 nt, Human
ccccaccuugcaauuguucccu

SEQ ID NO: 687964 - RNA, 22 nt, Human
uggaauaaugaccacagaaaca

SEQ ID NO: 687965 - RNA, 22 nt, Human
acuggaagccaguugacaauca

SEQ ID NO: 687966 - RNA, 22 nt, Human
uucuuuccuugccucagugaag

SEQ ID NO: 687967 - RNA, 22 nt, Human
gucugguauucaauuauuauuu

SEQ ID NO: 687968 - RNA, 22 nt, Human
cagccccagcacuuagcugagu

SEQ ID NO: 687969 - RNA, 22 nt, Human
caauuucauggauaaaagaugu

SEQ ID NO: 687970 - RNA, 22 nt, Human
cacacaugaaucccuaguaccu

SEQ ID NO: 687971 - RNA, 22 nt, Human
aaacagacugcacugccaguca

SEQ ID NO: 687972 - RNA, 22 nt, Human
cauugcugugggcauuugcugc

SEQ ID NO: 687973 - RNA, 22 nt, Human
uuauuuguggcauaugagacga

SEQ ID NO: 687974 - RNA, 22 nt, Human
ucccuguguguauauaaacggu

SEQ ID NO: 687975 - RNA, 20 nt, Human
gagagcuggggaugaggcug

SEQ ID NO: 687976 - RNA, 22 nt, Human
guucacagaaggccagauggua

SEQ ID NO: 687977 - RNA, 22 nt, Human
auggaacaucagguuaagaaau

SEQ ID NO: 687978 - RNA, 22 nt, Human
ucucuguagcagcuuccuuccu

SEQ ID NO: 687979 - RNA, 22 nt, Human
ggcagcuguggacgucgucauu

SEQ ID NO: 687980 - RNA, 22 nt, Human
ccugcccacuccaggagcaacu

SEQ ID NO: 687981 - RNA, 22 nt, Human
agaguccauaugugggaggagu

SEQ ID NO: 687982 - RNA, 23 nt, Human
uggcagugcccagggagaugauc

SEQ ID NO: 687983 - RNA, 22 nt, Human
ccauuuuugacagaaggccuaa

SEQ ID NO: 687984 - RNA, 22 nt, Human
agccaaggucgccccagggcaa

SEQ ID NO: 687985 - RNA, 22 nt, Human
gaggagaggcuggacgcgguga

SEQ ID NO: 687986 - RNA, 22 nt, Human
uggcugagugaacauguccauu

SEQ ID NO: 687987 - RNA, 22 nt, Human
agcagagugccccaucacaagg

SEQ ID NO: 687988 - RNA, 22 nt, Human
uacaauacuuaaccuauuuugc

SEQ ID NO: 687989 - RNA, 22 nt, Human
ucccagcuuagauuugcucauu

SEQ ID NO: 687990 - RNA, 22 nt, Human
uagaaugugccuggaauacagu

SEQ ID NO: 687991 - RNA, 22 nt, Human
aaaguuugagugauuugacaca

SEQ ID NO: 687992 - RNA, 22 nt, Human
agcugcucuucauuucccccca

SEQ ID NO: 687993 - RNA, 22 nt, Human
ccagcccugaacccugcugcau

SEQ ID NO: 687994 - RNA, 23 nt, Human
gaauaguuuuagaaauuggagaa

SEQ ID NO: 687995 - RNA, 22 nt, Human
augcguguuuguauacacacaa

SEQ ID NO: 687996 - RNA, 22 nt, Human
uggcagaggaaaaagucacugg

SEQ ID NO: 687997 - RNA, 22 nt, Human
aaauacucucaauaaagaaagu

SEQ ID NO: 687998 - RNA, 22 nt, Human
auacagucagacuuuagccauu

SEQ ID NO: 687999 - RNA, 22 nt, Human
cccaggaaauagccaggaggug

SEQ ID NO: 688000 - RNA, 22 nt, Human
uccagcuccucuacccgaugcg

SEQ ID NO: 688001 - RNA, 22 nt, Human
ucaguugccuccauagucaucc

SEQ ID NO: 688002 - RNA, 22 nt, Human
auagaucauugauacuugcauc

SEQ ID NO: 688003 - RNA, 22 nt, Human
cacacagcuagugacaggagaa

SEQ ID NO: 688004 - RNA, 22 nt, Human
cugcaggagugaaagcaggccu

SEQ ID NO: 688005 - RNA, 22 nt, Human
agggcuuuggcccccugcugca

SEQ ID NO: 688006 - RNA, 22 nt, Human
uugugaaaagccgcaaguauag

SEQ ID NO: 688007 - RNA, 22 nt, Human
ugguggagaccucgcuaacccc

SEQ ID NO: 688008 - RNA, 22 nt, Human
uacaugguuggcccauucuucu

SEQ ID NO: 688009 - RNA, 22 nt, Human
aauccacuaaugaagaaugggc

SEQ ID NO: 688010 - RNA, 22 nt, Human
cacagagaccccuucuggggcc

SEQ ID NO: 688011 - RNA, 22 nt, Human
ucagacuugacuuuguaaguuu

SEQ ID NO: 688012 - RNA, 22 nt, Human
uacuuccagcaaucugcauauu

SEQ ID NO: 688013 - RNA, 22 nt, Human
aaguauacuuaggcauaauggu

SEQ ID NO: 688014 - RNA, 22 nt, Human
cccuggauuuacaucauucuga

SEQ ID NO: 688015 - RNA, 19 nt, Human
ucagggccaugagcgccac

SEQ ID NO: 688016 - RNA, 22 nt, Human
caugaucugguccuacuguggg

SEQ ID NO: 688017 - RNA, 22 nt, Human
aaugauugucauuccaaaaagu

SEQ ID NO: 688018 - RNA, 22 nt, Human
ccuggguccuggcagccuccug

SEQ ID NO: 688019 - RNA, 22 nt, Human
uuccucuuuagggcuggccagg

SEQ ID NO: 688020 - RNA, 20 nt, Human
aggagaccaagccaagugga

SEQ ID NO: 688021 - RNA, 22 nt, Human
uagcugagaggccaauugaacu

SEQ ID NO: 688022 - RNA, 22 nt, Human
cuaggccaguuaggaagagaag

SEQ ID NO: 688023 - RNA, 19 nt, Human
cgcagguggaaggagccgc

SEQ ID NO: 688024 - RNA, 22 nt, Human
acaggcugccuaccaaguauca

SEQ ID NO: 688025 - RNA, 22 nt, Human
aucauguacuugacaaauaugu

SEQ ID NO: 688026 - RNA, 22 nt, Human
ugccagagaguggcuggguguc

SEQ ID NO: 688027 - RNA, 22 nt, Human
aauacuuaugugaccucauuuu

SEQ ID NO: 688028 - RNA, 22 nt, Human
gaacacugacauuuuccugacu

SEQ ID NO: 688029 - RNA, 22 nt, Human
cucuauuuauggcaucuuuaug

SEQ ID NO: 688030 - RNA, 22 nt, Human
accuccccugacucgaaaccca

SEQ ID NO: 688031 - RNA, 22 nt, Human
gccuggugcuaugagggccagc

SEQ ID NO: 688032 - RNA, 22 nt, Human
cuccagugucucagagcagaug

SEQ ID NO: 688033 - RNA, 22 nt, Human
cauuucuaagaagaucugggua

SEQ ID NO: 688034 - RNA, 22 nt, Human
ugucuucagcaaaugccuuucu

SEQ ID NO: 688035 - RNA, 22 nt, Human
uacaguaaucuggacaugauuu

SEQ ID NO: 688036 - RNA, 22 nt, Human
ucccacaggggcucuguggguu

SEQ ID NO: 688037 - RNA, 22 nt, Human
ucacagaaaagcugagcaucag

SEQ ID NO: 688038 - RNA, 22 nt, Human
cuggccaauauagggaaaucuu

SEQ ID NO: 688039 - RNA, 22 nt, Human
gugcccuggagggguugaaggg

SEQ ID NO: 688040 - RNA, 22 nt, Human
cacuguucuuuuuguaguccaa

SEQ ID NO: 688041 - RNA, 22 nt, Human
uaaccagcaugaaaucugcagc

SEQ ID NO: 688042 - RNA, 22 nt, Human
ucucagucuuuuugguuacuca

SEQ ID NO: 688043 - RNA, 22 nt, Human
ucccccuccaauugccauguua

SEQ ID NO: 688044 - RNA, 22 nt, Human
uuccaggaugcugcugcuuuuu

SEQ ID NO: 688045 - RNA, 20 nt, Human
gagagcuggaaauaaagucc

SEQ ID NO: 688046 - RNA, 22 nt, Human
gugcaaaaauaauugugguuuu

SEQ ID NO: 688047 - RNA, 22 nt, Human
aacugcaauuacuuuugcgcca

SEQ ID NO: 688048 - RNA, 22 nt, Human
guuccugagaaauaaagagaga

SEQ ID NO: 688049 - RNA, 19 nt, Human
aaaaacuuaguccagaaag

SEQ ID NO: 688050 - RNA, 22 nt, Human
auaauggccgggggcugaaugc

SEQ ID NO: 688051 - RNA, 22 nt, Human
guguaauuauauaaagaucuac

SEQ ID NO: 688052 - RNA, 22 nt, Human
ccagagggagccaccagggugu

SEQ ID NO: 688053 - RNA, 22 nt, Human
agaggggcagggucuccggauu

SEQ ID NO: 688054 - RNA, 19 nt, Human
aaagcagaggagcaucuga

SEQ ID NO: 688055 - RNA, 22 nt, Human
ugucagugguagacccagaggu

SEQ ID NO: 688056 - RNA, 22 nt, Human
guagcagguauucuggugugag

SEQ ID NO: 688057 - RNA, 22 nt, Human
gcuuucugauugcgaaaacaaa

SEQ ID NO: 688058 - RNA, 22 nt, Human
ugagaaucauccagaggcuucu

SEQ ID NO: 688059 - RNA, 20 nt, Human
gcucaguggagaaaugcacc

SEQ ID NO: 688060 - RNA, 21 nt, Human
ugggauagaaauauggcugcu

SEQ ID NO: 688061 - RNA, 22 nt, Human
ccaggagcaggagcuggacaga

SEQ ID NO: 688062 - RNA, 22 nt, Human
cacugucuucaguuucacugca

SEQ ID NO: 688063 - RNA, 22 nt, Human
uucagagaagcaaaggcagauu

SEQ ID NO: 688064 - RNA, 22 nt, Human
aguccaaggccauacaguugug

SEQ ID NO: 688065 - RNA, 22 nt, Human
ucucagagagaugaaacuucca

SEQ ID NO: 688066 - RNA, 22 nt, Human
accugggaaagccguggaaagg

SEQ ID NO: 688067 - RNA, 22 nt, Human
cucagagcaaugaacaugcaaa

SEQ ID NO: 688068 - RNA, 22 nt, Human
ucagaagcauccauuucaccac

SEQ ID NO: 688069 - RNA, 22 nt, Human
ucugcuguucauucuuuuagcu

SEQ ID NO: 688070 - RNA, 22 nt, Human
gcuccaggaggcucccgcgucu

SEQ ID NO: 688071 - RNA, 22 nt, Human
ugacauuuuuauaagagucaaa

SEQ ID NO: 688072 - RNA, 22 nt, Human
gcacccaugcucuugucucagg

SEQ ID NO: 688073 - RNA, 22 nt, Human
gcagugugaugcuuccagccac

SEQ ID NO: 688074 - RNA, 22 nt, Human
cuguaaauggaacuauguagua

SEQ ID NO: 688075 - RNA, 22 nt, Human
uuaggaaaagaagacauuucua

SEQ ID NO: 688076 - RNA, 22 nt, Human
uuacauaguuaaauaguacagc

SEQ ID NO: 688077 - RNA, 22 nt, Human
ggcuccuggggaggugagcuug

SEQ ID NO: 688078 - RNA, 21 nt, Human
aguguaggucauuagcuguug

SEQ ID NO: 688079 - RNA, 22 nt, Human
caggccugacccugagcuucac

SEQ ID NO: 688080 - RNA, 22 nt, Human
ucuugguuaggggaaauaggca

SEQ ID NO: 688081 - RNA, 22 nt, Human
accugcagcuaaagauguaggg

SEQ ID NO: 688082 - RNA, 22 nt, Human
gacccugaggaugcaccagcag

SEQ ID NO: 688083 - RNA, 22 nt, Human
cgcaacagagcagguuugauga

SEQ ID NO: 688084 - RNA, 18 nt, Human
ugggccugcauccuaguc

SEQ ID NO: 688085 - RNA, 22 nt, Human
aacauugauugcaucuguucac

SEQ ID NO: 688086 - RNA, 22 nt, Human
gcaccugcaggaugagccaggg

SEQ ID NO: 688087 - RNA, 22 nt, Human
uccugcagaucaaagccuuuga

SEQ ID NO: 688088 - RNA, 21 nt, Human
ggccuuggcgggggccgaauu

SEQ ID NO: 688089 - RNA, 22 nt, Human
cgccggcuugaggcaggcggca

SEQ ID NO: 688090 - RNA, 22 nt, Human
guggcagcggcccaggccgucu

SEQ ID NO: 688091 - RNA, 22 nt, Human
ggagggaaugucuagcauucuu

SEQ ID NO: 688092 - RNA, 22 nt, Human
ucuucaguauuuggauaacauu

SEQ ID NO: 688093 - RNA, 22 nt, Human
guuuuauuggaacacagccaug

SEQ ID NO: 688094 - RNA, 22 nt, Human
aauccgauucguguacauuaau

SEQ ID NO: 688095 - RNA, 22 nt, Human
augcuguguauuuuacucuuuc

SEQ ID NO: 688096 - RNA, 22 nt, Human
auggccaagcaugccuguggcc

SEQ ID NO: 688097 - RNA, 22 nt, Human
uuucuugacugcuuaggaaugc

SEQ ID NO: 688098 - RNA, 22 nt, Human
agaauacaguaugcaaaaagau

SEQ ID NO: 688099 - RNA, 22 nt, Human
agacacagcaauaacuacuguu

SEQ ID NO: 688100 - RNA, 22 nt, Human
gagucaggaugcaaggggaugg

SEQ ID NO: 688101 - RNA, 22 nt, Human
ggcccuguuagagcucccacaa

SEQ ID NO: 688102 - RNA, 22 nt, Human
uccauuauacuucugauucaaa

SEQ ID NO: 688103 - RNA, 22 nt, Human
caggcugaggcaguaggguuug

SEQ ID NO: 688104 - RNA, 22 nt, Human
gagagcuggccagcuucaguau

SEQ ID NO: 688105 - RNA, 22 nt, Human
aauauuucuggugcuucucacu

SEQ ID NO: 688106 - RNA, 22 nt, Human
uuuccucuuccgagggggaggc

SEQ ID NO: 688107 - RNA, 22 nt, Human
gcagaguucucuuccagcuaac

SEQ ID NO: 688108 - RNA, 22 nt, Human
aaaguauucuugacuguuuuuc

SEQ ID NO: 688109 - RNA, 22 nt, Human
acaugcauacaagcacauguag

SEQ ID NO: 688110 - RNA, 22 nt, Human
gguaguucuucauggguuucau

SEQ ID NO: 688111 - RNA, 22 nt, Human
cugagcuucagugcacugggag

SEQ ID NO: 688112 - RNA, 22 nt, Human
gagcccagucugcuccugcgcc

SEQ ID NO: 688113 - RNA, 22 nt, Human
acagcuugucugguuucagguc

SEQ ID NO: 688114 - RNA, 22 nt, Human
ugcagccaucuuucuuggagga

SEQ ID NO: 688115 - RNA, 22 nt, Human
cuggcucuucagugcuugguuc

SEQ ID NO: 688116 - RNA, 22 nt, Human
ccccucugcaaauagccaggcu

SEQ ID NO: 688117 - RNA, 22 nt, Human
gggcugcuugcuggagacagac

SEQ ID NO: 688118 - RNA, 22 nt, Human
gacauucauuaagccuuucugu

SEQ ID NO: 688119 - RNA, 22 nt, Human
ggaaagcucagaucuuguugga

SEQ ID NO: 688120 - RNA, 20 nt, Human
uguuucugacgguaggagag

SEQ ID NO: 688121 - RNA, 22 nt, Human
aucaaaguccaucagaagguag

SEQ ID NO: 688122 - RNA, 22 nt, Human
aggguccuucuguuccugagca

SEQ ID NO: 688123 - RNA, 22 nt, Human
agacaaguucugugggucaccu

SEQ ID NO: 688124 - RNA, 22 nt, Human
cguggcugguggaccugagggc

SEQ ID NO: 688125 - RNA, 22 nt, Human
aaugucuuucucauaacagaua

SEQ ID NO: 688126 - RNA, 22 nt, Human
ucccucagauuggcaauuagau

SEQ ID NO: 688127 - RNA, 22 nt, Human
ggacugggucacuaagauagua

SEQ ID NO: 688128 - RNA, 22 nt, Human
gcagggaagacccggagcagcg

SEQ ID NO: 688129 - RNA, 22 nt, Human
aggagaggucucccuuccccag

SEQ ID NO: 688130 - RNA, 22 nt, Human
ugggguagggaaaagaagucga

SEQ ID NO: 688131 - RNA, 22 nt, Human
ucugaauagagagagguccuuu

SEQ ID NO: 688132 - RNA, 22 nt, Human
ugcaaagaagccuuugccuucu

SEQ ID NO: 688133 - RNA, 22 nt, Human
aaugcaaauucuagggcccuau

SEQ ID NO: 688134 - RNA, 22 nt, Human
acccugccgugggcugcuugug

SEQ ID NO: 688135 - RNA, 22 nt, Human
guguuaaaugcaaucacaugca

SEQ ID NO: 688136 - RNA, 22 nt, Human
ggcagacacucaaaagcuggga

SEQ ID NO: 688137 - RNA, 22 nt, Human
gugaggugaguagugagaagcc

SEQ ID NO: 688138 - RNA, 22 nt, Human
uugcuguaccaaagauuccuga

SEQ ID NO: 688139 - RNA, 17 nt, Human
uaaauacacaaggguau

SEQ ID NO: 688140 - RNA, 22 nt, Human
guucugcuuaaauuauugaucc

SEQ ID NO: 688141 - RNA, 22 nt, Human
agccaagcacucaacuccugga

SEQ ID NO: 688142 - RNA, 22 nt, Human
auuucuacugugagaaacauga

SEQ ID NO: 688143 - RNA, 22 nt, Human
ucuguucuuuccaacaagacag

SEQ ID NO: 688144 - RNA, 22 nt, Human
ugucauauguaauauguucauu

SEQ ID NO: 688145 - RNA, 22 nt, Human
aagcacugugccucauaucuga

SEQ ID NO: 688146 - RNA, 22 nt, Human
ugcuuaauacguauuugcugga

SEQ ID NO: 688147 - RNA, 22 nt, Human
aaagaacuaccuguaugauauu

SEQ ID NO: 688148 - RNA, 22 nt, Human
uuuagcacgguaacacauaaag

SEQ ID NO: 688149 - RNA, 22 nt, Human
uagggcaggugaagaaaagcua

SEQ ID NO: 688150 - RNA, 22 nt, Human
gauccuggcacagguugguccc

SEQ ID NO: 688151 - RNA, 22 nt, Human
uuccagaauugggagccuugag

SEQ ID NO: 688152 - RNA, 22 nt, Human
uggggaggauaugugaguuauu

SEQ ID NO: 688153 - RNA, 22 nt, Human
guccucugcccaggucaagguu

SEQ ID NO: 688154 - RNA, 22 nt, Human
agcugagauuaugcucuucuca

SEQ ID NO: 688155 - RNA, 22 nt, Human
aggugcaguggcucaugccugu

SEQ ID NO: 688156 - RNA, 22 nt, Human
ucuggagaagcagugagaguca

SEQ ID NO: 688157 - RNA, 22 nt, Human
uuagauaaauugcaacuugauu

SEQ ID NO: 688158 - RNA, 22 nt, Human
agaggcccucucugcucagucu

SEQ ID NO: 688159 - RNA, 22 nt, Human
ugcagccaauucauucauucuu

SEQ ID NO: 688160 - RNA, 21 nt, Human
ggccucagccaccuggcucug

SEQ ID NO: 688161 - RNA, 22 nt, Human
gccugcagacguguuuuccuca

SEQ ID NO: 688162 - RNA, 22 nt, Human
acuguggggugaggcccaagaa

SEQ ID NO: 688163 - RNA, 22 nt, Human
ccugagggcgccgagcucccag

SEQ ID NO: 688164 - RNA, 22 nt, Human
guuaugauggcaccacugcacu

SEQ ID NO: 688165 - RNA, 22 nt, Human
gagggcuuccauggggagcccc

SEQ ID NO: 688166 - RNA, 22 nt, Human
acauacaucaaguaucacaaga

SEQ ID NO: 688167 - RNA, 22 nt, Human
cuacauuuacacaguuaggcuu

SEQ ID NO: 688168 - RNA, 22 nt, Human
aagcuguuggcagauagcucug

SEQ ID NO: 688169 - RNA, 22 nt, Human
cucaccaggaacagcugcggag

SEQ ID NO: 688170 - RNA, 22 nt, Human
gaugucuuugccaugcaugugu

SEQ ID NO: 688171 - RNA, 22 nt, Human
cucugugggggagaggcagcug

SEQ ID NO: 688172 - RNA, 21 nt, Human
uacagcaccgaguaggcccuc

SEQ ID NO: 688173 - RNA, 22 nt, Human
caggccaauaaaugugauggcc

SEQ ID NO: 688174 - RNA, 22 nt, Human
uucuggcuucaucugacaagcc

SEQ ID NO: 688175 - RNA, 22 nt, Human
auuauggagaaauauguacagg

SEQ ID NO: 688176 - RNA, 22 nt, Human
ugugugaguaaggcugagagag

SEQ ID NO: 688177 - RNA, 22 nt, Human
gagagucacugucugcauuucc

SEQ ID NO: 688178 - RNA, 22 nt, Human
acugauuaugcguacucucuac

SEQ ID NO: 688179 - RNA, 22 nt, Human
ugguuaaaaugcagauucagua

SEQ ID NO: 688180 - RNA, 22 nt, Human
gguuggacacuagguaggagcg

SEQ ID NO: 688181 - RNA, 22 nt, Human
cauaaugugugucauacagacu

SEQ ID NO: 688182 - RNA, 22 nt, Human
aagauacauuaugucucucuga

SEQ ID NO: 688183 - RNA, 22 nt, Human
gaggagaagggcacggagaaaa

SEQ ID NO: 688184 - RNA, 22 nt, Human
accaggaacucacccgcagagg

SEQ ID NO: 688185 - RNA, 22 nt, Human
auuauagggaauucuagaaguc

SEQ ID NO: 688186 - RNA, 22 nt, Human
caggcugcuccaggguaggaaa

SEQ ID NO: 688187 - RNA, 22 nt, Human
acccucagacagcuguggccag

SEQ ID NO: 688188 - RNA, 22 nt, Human
uagauguuaagcuucuagaagg

SEQ ID NO: 688189 - RNA, 22 nt, Human
gaccacuggggugagggccauc

SEQ ID NO: 688190 - RNA, 22 nt, Human
ggagggguggucaccuggcagg

SEQ ID NO: 688191 - RNA, 22 nt, Human
gaaagguuucaucuacuuuuca

SEQ ID NO: 688192 - RNA, 17 nt, Human
ggcugugccaggugaga

SEQ ID NO: 688193 - RNA, 22 nt, Human
acugggaaauugcccuaguucu

SEQ ID NO: 688194 - RNA, 22 nt, Human
uccuuguaacguugggcugggg

SEQ ID NO: 688195 - RNA, 22 nt, Human
accaggggugucaacagcauuu

SEQ ID NO: 688196 - RNA, 21 nt, Human
aaagaaucauggguaauuuca

SEQ ID NO: 688197 - RNA, 22 nt, Human
gagcugguucuguccagggaau

SEQ ID NO: 688198 - RNA, 22 nt, Human
ccagcauccaugcucccucggg

SEQ ID NO: 688199 - RNA, 22 nt, Human
agaagucaaguggucuaugaaa

SEQ ID NO: 688200 - RNA, 22 nt, Human
agaaguaugugagaaauuaucc

SEQ ID NO: 688201 - RNA, 22 nt, Human
ucagugugauuaggcuaucuga

SEQ ID NO: 688202 - RNA, 22 nt, Human
aagggagaggagggucuuguug

SEQ ID NO: 688203 - RNA, 19 nt, Human
auacaguaagguguuugcc

SEQ ID NO: 688204 - RNA, 22 nt, Human
guuauucuagugcucagccauu

SEQ ID NO: 688205 - RNA, 22 nt, Human
guccucagucaguuuggugggg

SEQ ID NO: 688206 - RNA, 22 nt, Human
uuggcaauucaccaaggcucgc

SEQ ID NO: 688207 - RNA, 17 nt, Human
gaggccaaggcaggcgg

SEQ ID NO: 688208 - RNA, 22 nt, Human
agacaaaggauuaaugaugaug

SEQ ID NO: 688209 - RNA, 22 nt, Human
agugccaggagcaaggagcucc

SEQ ID NO: 688210 - RNA, 22 nt, Human
gagaacaaggaagagucggcag

SEQ ID NO: 688211 - RNA, 22 nt, Human
ucaggaaagaguguauccauca

SEQ ID NO: 688212 - RNA, 22 nt, Human
ucuuucuugguauaaagcaggg

SEQ ID NO: 688213 - RNA, 22 nt, Human
ugcuuugcagugucuaacagaa

SEQ ID NO: 688214 - RNA, 22 nt, Human
agaggccccaugggauggcggu

SEQ ID NO: 688215 - RNA, 22 nt, Human
aaucugaagggagauacaugua

SEQ ID NO: 688216 - RNA, 22 nt, Human
uagcacuuguguuaugccuugu

SEQ ID NO: 688217 - RNA, 22 nt, Human
aacagacauauuuuuaauaugc

SEQ ID NO: 688218 - RNA, 22 nt, Human
acagguggaggcuuuaggaggu

SEQ ID NO: 688219 - RNA, 22 nt, Human
cauguucagugacaguuauuga

SEQ ID NO: 688220 - RNA, 22 nt, Human
ugccuucucuucccugggagcu

SEQ ID NO: 688221 - RNA, 22 nt, Human
aaugaacaggugaaugucagau

SEQ ID NO: 688222 - RNA, 22 nt, Human
gcugcuguguuggagagggacu

SEQ ID NO: 688223 - RNA, 22 nt, Human
cucccagaaaauucucagacaa

SEQ ID NO: 688224 - RNA, 22 nt, Human
uuauucacucauuaaagcagga

SEQ ID NO: 688225 - RNA, 22 nt, Human
gacuugggcugagggccagcag

SEQ ID NO: 688226 - RNA, 22 nt, Human
gcaggugaugugaugugagcau

SEQ ID NO: 688227 - RNA, 22 nt, Human
caggaagugugaggguggugua

SEQ ID NO: 688228 - RNA, 22 nt, Human
uccaugcucuugucuagccucc

SEQ ID NO: 688229 - RNA, 17 nt, Human
ucacaucacacaagcaa

SEQ ID NO: 688230 - RNA, 17 nt, Human
auacaguuuauuuuaca

SEQ ID NO: 688231 - RNA, 22 nt, Human
cuggaggacagaggccaugucu

SEQ ID NO: 688232 - RNA, 22 nt, Human
gcuggagaggggucacucugag

SEQ ID NO: 688233 - RNA, 22 nt, Human
aaggaagagaauccuucucaga

SEQ ID NO: 688234 - RNA, 22 nt, Human
cugagaagguguggagaugggc

SEQ ID NO: 688235 - RNA, 23 nt, Human
uguguguguauucuacgcaaggu

SEQ ID NO: 688236 - RNA, 22 nt, Human
cugcagagcuugucuggaugug

SEQ ID NO: 688237 - RNA, 22 nt, Human
ucacagcacccugaggugcugg

SEQ ID NO: 688238 - RNA, 22 nt, Human
ucaugcagagccagucaggaua

SEQ ID NO: 688239 - RNA, 22 nt, Human
acaauagacaaagugaauggcu

SEQ ID NO: 688240 - RNA, 18 nt, Human
auuuuucccagauggaua

SEQ ID NO: 688241 - RNA, 22 nt, Human
ccagagguuccaggcuagggag

SEQ ID NO: 688242 - RNA, 22 nt, Human
uuuagugagugugaaucaaaug

SEQ ID NO: 688243 - RNA, 23 nt, Human
aguggggaaucaacagauucuuu

SEQ ID NO: 688244 - RNA, 22 nt, Human
aggcuucuacguggucccaggg

SEQ ID NO: 688245 - RNA, 22 nt, Human
auguuuccuguuggauuggccc

SEQ ID NO: 688246 - RNA, 22 nt, Human
gccuugcugauuaccuuccuuu

SEQ ID NO: 688247 - RNA, 22 nt, Human
acuucaaauuuucagaagaaau

SEQ ID NO: 688248 - RNA, 21 nt, Human
agcugcagucaagccagaggu

SEQ ID NO: 688249 - RNA, 22 nt, Human
ccugggcuuugcuggcaaggcc

SEQ ID NO: 688250 - RNA, 22 nt, Human
uuccagggcuaauuccugugga

SEQ ID NO: 688251 - RNA, 22 nt, Human
agggguggccugccuuacuccc

SEQ ID NO: 688252 - RNA, 21 nt, Human
auccauucuccgguuaaugag

SEQ ID NO: 688253 - RNA, 22 nt, Human
guuuccuguggccacagaauaa

SEQ ID NO: 688254 - RNA, 22 nt, Human
gauucauguuauagagagucag

SEQ ID NO: 688255 - RNA, 22 nt, Human
uaauaauuggcaauguugagca

SEQ ID NO: 688256 - RNA, 22 nt, Human
aacauauaaacucuuaaguuca

SEQ ID NO: 688257 - RNA, 22 nt, Human
agcugccauccuguucagcacc

SEQ ID NO: 688258 - RNA, 22 nt, Human
ugguggccgaagcccucucuca

SEQ ID NO: 688259 - RNA, 22 nt, Human
ucuccugacaugucuggaggaa

SEQ ID NO: 688260 - RNA, 22 nt, Human
ugaggccagccacagccacccu

SEQ ID NO: 688261 - RNA, 22 nt, Human
gcuuccagagagccccgccugg

SEQ ID NO: 688262 - RNA, 23 nt, Human
aggcaagaacggguuguucaccc

SEQ ID NO: 688263 - RNA, 22 nt, Human
guuucuuagacauaugccauga

SEQ ID NO: 688264 - RNA, 22 nt, Human
aauuuuaucucuaagcaggcuu

SEQ ID NO: 688265 - RNA, 22 nt, Human
gucugcugacagagcauggacc

SEQ ID NO: 688266 - RNA, 22 nt, Human
aggagugggggcgagaaguuaa

SEQ ID NO: 688267 - RNA, 22 nt, Human
ucucuuuguggccaggagagga

SEQ ID NO: 688268 - RNA, 22 nt, Human
uggccuggaaaaaugcagaugg

SEQ ID NO: 688269 - RNA, 22 nt, Human
cacaggagauugaucuauuggu

SEQ ID NO: 688270 - RNA, 18 nt, Human
uuuccuuguaugaacaua

SEQ ID NO: 688271 - RNA, 22 nt, Human
uuugacagugaugauauauaca

SEQ ID NO: 688272 - RNA, 22 nt, Human
uugaaugaaugguccauauaga

SEQ ID NO: 688273 - RNA, 22 nt, Human
aacaugcucuggauugcuguga

SEQ ID NO: 688274 - RNA, 22 nt, Human
acccucagcuggagauugaauu

SEQ ID NO: 688275 - RNA, 22 nt, Human
aaggcagguauugaugccacag

SEQ ID NO: 688276 - RNA, 22 nt, Human
gaagaggcaauugaauaagcua

SEQ ID NO: 688277 - RNA, 22 nt, Human
uuaauugguaaccucuggacua

SEQ ID NO: 688278 - RNA, 22 nt, Human
cugcaguucucaauuucuauug

SEQ ID NO: 688279 - RNA, 22 nt, Human
augucucucucugagugccaga

SEQ ID NO: 688280 - RNA, 22 nt, Human
gcaccugggcaaggauucagag

SEQ ID NO: 688281 - RNA, 22 nt, Human
ggcuuuauauuguuugagcaga

SEQ ID NO: 688282 - RNA, 22 nt, Human
uugggaaauauggauuguuauu

SEQ ID NO: 688283 - RNA, 22 nt, Human
ugacaauugcagacacagaagu

SEQ ID NO: 688284 - RNA, 22 nt, Human
gggagcugguuccugcccucca

SEQ ID NO: 688285 - RNA, 22 nt, Human
uuacuuuagaucauacugugug

SEQ ID NO: 688286 - RNA, 22 nt, Human
cauuugaaaauacucuuuucca

SEQ ID NO: 688287 - RNA, 22 nt, Human
ggguggcagcuguugccaaggu

SEQ ID NO: 688288 - RNA, 22 nt, Human
ugcauacacaagcauacaugua

SEQ ID NO: 688289 - RNA, 22 nt, Human
ugugcuaaggcagucuaucaca

SEQ ID NO: 688290 - RNA, 22 nt, Human
gaaauauugggacucagagcuu

SEQ ID NO: 688291 - RNA, 22 nt, Human
uaguauaucuuuaguacauagu

SEQ ID NO: 688292 - RNA, 22 nt, Human
uuccugggccuuaaaucuuuug

SEQ ID NO: 688293 - RNA, 22 nt, Human
cacaguuugguauagaagugau

SEQ ID NO: 688294 - RNA, 22 nt, Human
ugugccagaauguuuuuauaca

SEQ ID NO: 688295 - RNA, 22 nt, Human
aggagaguucacacuggucaga

SEQ ID NO: 688296 - RNA, 22 nt, Human
ggguaaaggucgcccucaaggu

SEQ ID NO: 688297 - RNA, 22 nt, Human
gccugggauagaggcaaugcau

SEQ ID NO: 688298 - RNA, 22 nt, Human
acaauauaguccaugagcaugc

SEQ ID NO: 688299 - RNA, 20 nt, Human
auucacaaagccaguguugc

SEQ ID NO: 688300 - RNA, 22 nt, Human
acugcugagcacacaagagugu

SEQ ID NO: 688301 - RNA, 22 nt, Human
augugacaauauuuggucuuau

SEQ ID NO: 688302 - RNA, 22 nt, Human
cuuggcuccaaucccagcucug

SEQ ID NO: 688303 - RNA, 22 nt, Human
uguccccuuuaccuccgcagcc

SEQ ID NO: 688304 - RNA, 22 nt, Human
uuccagaaaucuuucagcucaa

SEQ ID NO: 688305 - RNA, 22 nt, Human
caggaaagagagcuauucacuu

SEQ ID NO: 688306 - RNA, 22 nt, Human
ccaggagaagcaucugagugua

SEQ ID NO: 688307 - RNA, 22 nt, Human
uccagcucuggcuuggcuagcu

SEQ ID NO: 688308 - RNA, 22 nt, Human
uugcucuguccagccagcaggu

SEQ ID NO: 688309 - RNA, 22 nt, Human
acagcagaccccagugccaugg

SEQ ID NO: 688310 - RNA, 22 nt, Human
cuggcacacaguaggcaccaau

SEQ ID NO: 688311 - RNA, 22 nt, Human
ccuuggcuugcacacggccacc

SEQ ID NO: 688312 - RNA, 22 nt, Human
auguucuuccaaaucuguaaca

SEQ ID NO: 688313 - RNA, 22 nt, Human
aaagauucgagcgauguauaaa

SEQ ID NO: 688314 - RNA, 22 nt, Human
uaaucacugggcguuugguacu

SEQ ID NO: 688315 - RNA, 22 nt, Human
ucacuuaaaaauucuaguuaug

SEQ ID NO: 688316 - RNA, 22 nt, Human
uuuauauguuuguacaauuaag

SEQ ID NO: 688317 - RNA, 22 nt, Human
ugagcccagaagcccacucggc

SEQ ID NO: 688318 - RNA, 22 nt, Human
aaagacauggcaagagaugggg

SEQ ID NO: 688319 - RNA, 22 nt, Human
uugccuagaguugcacaucugg

SEQ ID NO: 688320 - RNA, 22 nt, Human
guuaaggcugagcaggacacug

SEQ ID NO: 688321 - RNA, 22 nt, Human
acagugaaugagaauggagaaa

SEQ ID NO: 688322 - RNA, 22 nt, Human
gugcagacccacguccagggcc

SEQ ID NO: 688323 - RNA, 22 nt, Human
uccagucucuacucugagauaa

SEQ ID NO: 688324 - RNA, 22 nt, Human
cugcgugcaugucugcgugcau

SEQ ID NO: 688325 - RNA, 22 nt, Human
cugucuccgcccucuugguagg

SEQ ID NO: 688326 - RNA, 22 nt, Human
caaagucccagcugcuuagaga

SEQ ID NO: 688327 - RNA, 21 nt, Human
uacuguauagauguguucuug

SEQ ID NO: 688328 - RNA, 18 nt, Human
gagcugagaagaggaugc

SEQ ID NO: 688329 - RNA, 22 nt, Human
ucucugagaaguuccuuuguga

SEQ ID NO: 688330 - RNA, 22 nt, Human
ccccagccagcuuguaguagaa

SEQ ID NO: 688331 - RNA, 22 nt, Human
ccagagggcaaaaugaagcuua

SEQ ID NO: 688332 - RNA, 22 nt, Human
ucaggagcagggucuguuacca

SEQ ID NO: 688333 - RNA, 21 nt, Human
uagcagaaacaguucaggcca

SEQ ID NO: 688334 - RNA, 22 nt, Human
gagaggcugcauaugcacacug

SEQ ID NO: 688335 - RNA, 22 nt, Human
ugguuucuggguuugucuagga

SEQ ID NO: 688336 - RNA, 22 nt, Human
acuaaauuugucaaugacacuu

SEQ ID NO: 688337 - RNA, 22 nt, Human
uggccagccauaaaagaaccca

SEQ ID NO: 688338 - RNA, 22 nt, Human
caggugggcugccucuccagcu

SEQ ID NO: 688339 - RNA, 22 nt, Human
ugguuccucagggcagcuguac

SEQ ID NO: 688340 - RNA, 22 nt, Human
ggaaaugguggaggaaggcuua

SEQ ID NO: 688341 - RNA, 22 nt, Human
agcagaacauuuucagggcugu

SEQ ID NO: 688342 - RNA, 22 nt, Human
agguaaaaugagucuccauuau

SEQ ID NO: 688343 - RNA, 22 nt, Human
ucuugagaaauaauuaaacaug

SEQ ID NO: 688344 - RNA, 22 nt, Human
gaggcagcaugguaccuuggag

SEQ ID NO: 688345 - RNA, 23 nt, Human
gcucacagaauguugaagggaau

SEQ ID NO: 688346 - RNA, 22 nt, Human
agucccuggauugucucuguca

SEQ ID NO: 688347 - RNA, 22 nt, Human
agugucugaucaguugacuaga

SEQ ID NO: 688348 - RNA, 22 nt, Human
gaggccagggaugcaaugagag

SEQ ID NO: 688349 - RNA, 22 nt, Human
auucuucaccauggauaauuug

SEQ ID NO: 688350 - RNA, 22 nt, Human
cucuucuguaccucggccucca

SEQ ID NO: 688351 - RNA, 22 nt, Human
ucaguaaaguucuuucuugcug

SEQ ID NO: 688352 - RNA, 22 nt, Human
acaugucuaaguacucaacaaa

SEQ ID NO: 688353 - RNA, 22 nt, Human
gaguuuauucaggaaauagcca

SEQ ID NO: 688354 - RNA, 22 nt, Human
ucuuuaauguacuuucuuucac

SEQ ID NO: 688355 - RNA, 22 nt, Human
aauucccauuugcagaaaauca

SEQ ID NO: 688356 - RNA, 22 nt, Human
ugaggcuuggagaggucaggga

SEQ ID NO: 688357 - RNA, 22 nt, Human
agaaggcuggccauggugcccu

SEQ ID NO: 688358 - RNA, 22 nt, Human
ugcugaggcuagaccuggaagu

SEQ ID NO: 688359 - RNA, 22 nt, Human
aagcuuccugaaugcucauuua

SEQ ID NO: 688360 - RNA, 22 nt, Human
aggaauuugagugcuguaggaa

SEQ ID NO: 688361 - RNA, 22 nt, Human
cagucuuagaggugacugugga

SEQ ID NO: 688362 - RNA, 22 nt, Human
cacacuugugaccgauauaaug

SEQ ID NO: 688363 - RNA, 22 nt, Human
gugaggggucuggacgcacagu

SEQ ID NO: 688364 - RNA, 22 nt, Human
uaaaaguauacuuucaaaggag

SEQ ID NO: 688365 - RNA, 18 nt, Human
uaaaggaagugggagagg

SEQ ID NO: 688366 - RNA, 22 nt, Human
gcaguaguuuauggcuaaaccu

SEQ ID NO: 688367 - RNA, 22 nt, Human
uuuacagcuucuauacuaugug

SEQ ID NO: 688368 - RNA, 22 nt, Human
gccacagggcagaugcgcagag

SEQ ID NO: 688369 - RNA, 22 nt, Human
augacaaauucagaccauagca

SEQ ID NO: 688370 - RNA, 19 nt, Human
agcugggcuuacucacucg

SEQ ID NO: 688371 - RNA, 22 nt, Human
gggaaggcaggccucuguugga

SEQ ID NO: 688372 - RNA, 20 nt, Human
uuuauuggccuuucaggaac

SEQ ID NO: 688373 - RNA, 22 nt, Human
auacaguguacuauuuagcagu

SEQ ID NO: 688374 - RNA, 22 nt, Human
ccaggguuggucucucugaggu

SEQ ID NO: 688375 - RNA, 22 nt, Human
aaggugaaacuggaagcuggcc

SEQ ID NO: 688376 - RNA, 22 nt, Human
gaaaugauuuuaguuuaucaug

SEQ ID NO: 688377 - RNA, 20 nt, Human
cccagggguuguggugagga

SEQ ID NO: 688378 - RNA, 22 nt, Human
aucugaagaggucauggcugac

SEQ ID NO: 688379 - RNA, 22 nt, Human
cagcucugccaucaucugccuu

SEQ ID NO: 688380 - RNA, 22 nt, Human
acagcugacauuggcagcuauu

SEQ ID NO: 688381 - RNA, 22 nt, Human
aggaccugacuggcuccugcuu

SEQ ID NO: 688382 - RNA, 22 nt, Human
cggggcuguagcacagcugagc

SEQ ID NO: 688383 - RNA, 22 nt, Human
guauauaucggcacuauuuuaa

SEQ ID NO: 688384 - RNA, 22 nt, Human
ccaggcacucacggggcacugg

SEQ ID NO: 688385 - RNA, 22 nt, Human
uugaaagggauauaucuuucug

SEQ ID NO: 688386 - RNA, 22 nt, Human
auuaauaaaauaccacuuuguu

SEQ ID NO: 688387 - RNA, 22 nt, Human
guggacagcuucuaggugccag

SEQ ID NO: 688388 - RNA, 22 nt, Human
aagaguuucuuacuggcaucua

SEQ ID NO: 688389 - RNA, 23 nt, Human
acagggcauugcuggccucgagg

SEQ ID NO: 688390 - RNA, 22 nt, Human
ucuuucuuaaauagguggauug

SEQ ID NO: 688391 - RNA, 22 nt, Human
uucuccaagguucauauuuauc

SEQ ID NO: 688392 - RNA, 22 nt, Human
ucacaguucaacuaguucagau

SEQ ID NO: 688393 - RNA, 22 nt, Human
ccuucauugcaucuuuaagaga

SEQ ID NO: 688394 - RNA, 22 nt, Human
uggcugagugauauuugcaaag

SEQ ID NO: 688395 - RNA, 22 nt, Human
uguacacacacguguguaucua

SEQ ID NO: 688396 - RNA, 22 nt, Human
ugagccugguugcagugucugg

SEQ ID NO: 688397 - RNA, 19 nt, Human
cagguggcgcucuacaggg

SEQ ID NO: 688398 - RNA, 22 nt, Human
acacauguuuguguagucaguu

SEQ ID NO: 688399 - RNA, 22 nt, Human
cucuccagucauauucucaguc

SEQ ID NO: 688400 - RNA, 22 nt, Human
cugccccaccccaaccugaggu

SEQ ID NO: 688401 - RNA, 22 nt, Human
gguccaggaucaaggcaucacc

SEQ ID NO: 688402 - RNA, 22 nt, Human
ucagggaccaccacucacccag

SEQ ID NO: 688403 - RNA, 22 nt, Human
cuggaguuagaguagacacuga

SEQ ID NO: 688404 - RNA, 22 nt, Human
auguuuccauagaagucacagu

SEQ ID NO: 688405 - RNA, 22 nt, Human
uagcagcaauuucagaaguuug

SEQ ID NO: 688406 - RNA, 22 nt, Human
ucaccuuagcuagaggaagaga

SEQ ID NO: 688407 - RNA, 22 nt, Human
cuguaguugggcauuauaauag

SEQ ID NO: 688408 - RNA, 22 nt, Human
ggggcuuuugcacgugggaggc

SEQ ID NO: 688409 - RNA, 22 nt, Human
caggcacagaguuauucauuua

SEQ ID NO: 688410 - RNA, 22 nt, Human
augaggcacaucacagccaaug

SEQ ID NO: 688411 - RNA, 22 nt, Human
gcacccagggacuuggcuggcc

SEQ ID NO: 688412 - RNA, 22 nt, Human
uggcuuccuggacagaugcggu

SEQ ID NO: 688413 - RNA, 19 nt, Human
agagauccagcuucuagcu

SEQ ID NO: 688414 - RNA, 22 nt, Human
aaaucagacacagugaaaguua

SEQ ID NO: 688415 - RNA, 22 nt, Human
ucugcgccgcauguguucuuuc

SEQ ID NO: 688416 - RNA, 22 nt, Human
uuagaaagcuuuccauagucaa

SEQ ID NO: 688417 - RNA, 22 nt, Human
gcccugagggucuggguuccca

SEQ ID NO: 688418 - RNA, 22 nt, Human
uauggaaauaauuagacaagug

SEQ ID NO: 688419 - RNA, 22 nt, Human
gcuggccuucugcagaguucug

SEQ ID NO: 688420 - RNA, 22 nt, Human
gaggggcaaugagggaaagagu

SEQ ID NO: 688421 - RNA, 22 nt, Human
aagaagcaugagaagauuuuau

SEQ ID NO: 688422 - RNA, 22 nt, Human
ccuguguggaaggcaggaggcc

SEQ ID NO: 688423 - RNA, 22 nt, Human
ucacaguauaaccucauauagg

SEQ ID NO: 688424 - RNA, 22 nt, Human
uuagaauuauuguuuccuucua

SEQ ID NO: 688425 - RNA, 20 nt, Human
uaacaguaagugauguuaca

SEQ ID NO: 688426 - RNA, 22 nt, Human
uucaaaauuguucuaagcucug

SEQ ID NO: 688427 - RNA, 19 nt, Human
ugugacugguugucucgcu

SEQ ID NO: 688428 - RNA, 22 nt, Human
caggauggucuucauuuggcuc

SEQ ID NO: 688429 - RNA, 21 nt, Human
augcaucuaucuucuacucca

SEQ ID NO: 688430 - RNA, 22 nt, Human
agcacugcuuuagagccucugc

SEQ ID NO: 688431 - RNA, 22 nt, Human
uccuugagaggacagagccaua

SEQ ID NO: 688432 - RNA, 22 nt, Human
cagcuucuccggccuggugcgg

SEQ ID NO: 688433 - RNA, 22 nt, Human
uugaaaguuaucuagauucuga

SEQ ID NO: 688434 - RNA, 20 nt, Human
cacaggcuauaugagagcca

SEQ ID NO: 688435 - RNA, 17 nt, Human
cugggccucugcccuuu

SEQ ID NO: 688436 - RNA, 22 nt, Human
cuacagaagaaacuaucacuau

SEQ ID NO: 688437 - RNA, 22 nt, Human
acauuucacuguucacagcagg

SEQ ID NO: 688438 - RNA, 20 nt, Human
cugggcugcccagcuauggg

SEQ ID NO: 688439 - RNA, 22 nt, Human
ugcaaacacuucaacgugcauc

SEQ ID NO: 688440 - RNA, 22 nt, Human
auucaaaguacuagcuauuuuu

SEQ ID NO: 688441 - RNA, 20 nt, Human
cccuggagagaagcuccacg

SEQ ID NO: 688442 - RNA, 22 nt, Human
cugccagggaggcugggaaguu

SEQ ID NO: 688443 - RNA, 22 nt, Human
cugaggugaugucaaauggguu

SEQ ID NO: 688444 - RNA, 21 nt, Human
aaaaugugagcgugaugcuua

SEQ ID NO: 688445 - RNA, 22 nt, Human
accagggcugggauaggucagg

SEQ ID NO: 688446 - RNA, 22 nt, Human
gcccugggauuggguggaggcu

SEQ ID NO: 688447 - RNA, 22 nt, Human
ugugcuucucuuucucacuuaa

SEQ ID NO: 688448 - RNA, 22 nt, Human
uggcuuccccuaccuuccaauu

SEQ ID NO: 688449 - RNA, 22 nt, Human
gcuggcucaagugugcuuccca

SEQ ID NO: 688450 - RNA, 21 nt, Human
gagacagacuuucguccccug

SEQ ID NO: 688451 - RNA, 22 nt, Human
uggaacaauucuugaagggaau

SEQ ID NO: 688452 - RNA, 22 nt, Human
caguagacacauuaauauggaa

SEQ ID NO: 688453 - RNA, 22 nt, Human
gauggucuuugucucugauaag

SEQ ID NO: 688454 - RNA, 22 nt, Human
ggugaggggagagugaaagaaa

SEQ ID NO: 688455 - RNA, 22 nt, Human
ugcaggaaucagaggggaagcg

SEQ ID NO: 688456 - RNA, 22 nt, Human
ucacuugacccuucucuagccu

SEQ ID NO: 688457 - RNA, 22 nt, Human
gcacacagaacauuuggauccu

SEQ ID NO: 688458 - RNA, 22 nt, Human
agggcuggcaagggauugaaau

SEQ ID NO: 688459 - RNA, 22 nt, Human
acugcaucugaacugugaaugg

SEQ ID NO: 688460 - RNA, 22 nt, Human
uuuaauguauucuuuggaacca

SEQ ID NO: 688461 - RNA, 22 nt, Human
uuaacauuguccuuagcagauu

SEQ ID NO: 688462 - RNA, 17 nt, Human
aaaauucuguaaagagg

SEQ ID NO: 688463 - RNA, 22 nt, Human
cugcagcuccucucugugcccc

SEQ ID NO: 688464 - RNA, 22 nt, Human
acaguguuacuugauaguguau

SEQ ID NO: 688465 - RNA, 23 nt, Human
cuuuuaacuagaguaucagcugc

SEQ ID NO: 688466 - RNA, 22 nt, Human
caggucuuuguugcagcaugga

SEQ ID NO: 688467 - RNA, 22 nt, Human
gauacagcucuggccagaugug

SEQ ID NO: 688468 - RNA, 22 nt, Human
ucauccaugucagagcauguau

SEQ ID NO: 688469 - RNA, 22 nt, Human
uagagcaguguuguccaucaga

SEQ ID NO: 688470 - RNA, 22 nt, Human
gagaccaggaaguacagcagcc

SEQ ID NO: 688471 - RNA, 22 nt, Human
gagcacagauccuggagccaca

SEQ ID NO: 688472 - RNA, 22 nt, Human
ucagcaaaggaccagcacaggc

SEQ ID NO: 688473 - RNA, 22 nt, Human
augcuccucgagugucucacag

SEQ ID NO: 688474 - RNA, 22 nt, Human
ggguggagagaaagaaacguga

SEQ ID NO: 688475 - RNA, 22 nt, Human
ucaguccucucuggguuucuua

SEQ ID NO: 688476 - RNA, 22 nt, Human
aagggugcaaagcacucuagcu

SEQ ID NO: 688477 - RNA, 22 nt, Human
aguagcaauggcucugagcuau

SEQ ID NO: 688478 - RNA, 22 nt, Human
gaggaaggagggaaagcgcgcg

SEQ ID NO: 688479 - RNA, 21 nt, Human
auggaaauuggcaaaugcuac

SEQ ID NO: 688480 - RNA, 22 nt, Human
agcagacucuucuccuggggcu

SEQ ID NO: 688481 - RNA, 22 nt, Human
gagcuggucaguuucagggcca

SEQ ID NO: 688482 - RNA, 22 nt, Human
uggagcccagacacuggcauug

SEQ ID NO: 688483 - RNA, 22 nt, Human
aauagauucaugguuaagagca

SEQ ID NO: 688484 - RNA, 22 nt, Human
cagagguauugcaaaagccuag

SEQ ID NO: 688485 - RNA, 22 nt, Human
aggauggaauuagguagcaagu

SEQ ID NO: 688486 - RNA, 22 nt, Human
gcuuggcucuaagacaccuauu

SEQ ID NO: 688487 - RNA, 22 nt, Human
agagcuccgugccuggcugcca

SEQ ID NO: 688488 - RNA, 22 nt, Human
auaucacaguaguuguuuaguu

SEQ ID NO: 688489 - RNA, 22 nt, Human
uaccagcaucacagcauguugg

SEQ ID NO: 688490 - RNA, 22 nt, Human
ugcaggcucaucucaagaguag

SEQ ID NO: 688491 - RNA, 22 nt, Human
gcugagguggcugccuuaguaa

SEQ ID NO: 688492 - RNA, 22 nt, Human
auguuauuaaaguacagauucu

SEQ ID NO: 688493 - RNA, 22 nt, Human
gcugggugucacggggcucgug

SEQ ID NO: 688494 - RNA, 22 nt, Human
ccuuggaggacugcugcuucuu

SEQ ID NO: 688495 - RNA, 22 nt, Human
agcugugccuauucguggcaag

SEQ ID NO: 688496 - RNA, 22 nt, Human
ccagaggcagacuuacacucca

SEQ ID NO: 688497 - RNA, 22 nt, Human
gggaggaaaugugcagcgaauu

SEQ ID NO: 688498 - RNA, 22 nt, Human
ugagacagucccaugaucugca

SEQ ID NO: 688499 - RNA, 22 nt, Human
cugaggccuggugaggugguga

SEQ ID NO: 688500 - RNA, 22 nt, Human
ugacaauacagagagagcaaaa

SEQ ID NO: 688501 - RNA, 19 nt, Human
uccaggcugagagucagcu

SEQ ID NO: 688502 - RNA, 22 nt, Human
augugugguuuguaaaugauuu

SEQ ID NO: 688503 - RNA, 22 nt, Human
cuuccucuguggccagagugua

SEQ ID NO: 688504 - RNA, 22 nt, Human
aaggcaggagcuguaucuuauu

SEQ ID NO: 688505 - RNA, 22 nt, Human
uucuguuugccauauauaguag

SEQ ID NO: 688506 - RNA, 22 nt, Human
gcuuagcagucacacauuguuc

SEQ ID NO: 688507 - RNA, 22 nt, Human
gggggccagucaucucccaaga

SEQ ID NO: 688508 - RNA, 17 nt, Human
guccuacccauggucua

SEQ ID NO: 688509 - RNA, 22 nt, Human
ugcauggaggaagaugaaugca

SEQ ID NO: 688510 - RNA, 22 nt, Human
gucugccugggacgcugggagu

SEQ ID NO: 688511 - RNA, 22 nt, Human
ugucucuucccacucagacccc

SEQ ID NO: 688512 - RNA, 22 nt, Human
uguguguauaauaaugucugca

SEQ ID NO: 688513 - RNA, 20 nt, Human
aggcagcugggaaaugaggg

SEQ ID NO: 688514 - RNA, 22 nt, Human
aauucagagacucauucuggag

SEQ ID NO: 688515 - RNA, 17 nt, Human
ggaacaaauacuaugca

SEQ ID NO: 688516 - RNA, 23 nt, Human
uccaggcugggacuucaacuggc

SEQ ID NO: 688517 - RNA, 22 nt, Human
aaagcagagguugcagugagcu

SEQ ID NO: 688518 - RNA, 22 nt, Human
aaggaacucuagagccuugaac

SEQ ID NO: 688519 - RNA, 22 nt, Human
accagcauccuuccuauuaaca

SEQ ID NO: 688520 - RNA, 22 nt, Human
ugcaauaacuacuuuaauguug

SEQ ID NO: 688521 - RNA, 21 nt, Human
cccaggugggaugguugccuc

SEQ ID NO: 688522 - RNA, 22 nt, Human
uaaaaugcacagcaguugaaag

SEQ ID NO: 688523 - RNA, 22 nt, Human
ccacccagccagaugcaggaag

SEQ ID NO: 688524 - RNA, 19 nt, Human
uaagguuuaccagcaaaau

SEQ ID NO: 688525 - RNA, 22 nt, Human
gugaccaucaucucagcuaguu

SEQ ID NO: 688526 - RNA, 22 nt, Human
cggggacacacuggcagcuccu

SEQ ID NO: 688527 - RNA, 22 nt, Human
aucagcaagcaugguuaggugu

SEQ ID NO: 688528 - RNA, 22 nt, Human
agaaucaaggugaagcccacag

SEQ ID NO: 688529 - RNA, 22 nt, Human
cuugagguuuugacucagcuuu

SEQ ID NO: 688530 - RNA, 22 nt, Human
agcagucauuuuaggucaugca

SEQ ID NO: 688531 - RNA, 22 nt, Human
uuucucuuaaugucucugugcu

SEQ ID NO: 688532 - RNA, 22 nt, Human
uacaguagaaucuuauagccca

SEQ ID NO: 688533 - RNA, 22 nt, Human
acaugaaguggucagaucaaac

SEQ ID NO: 688534 - RNA, 22 nt, Human
aggauuugaaauauuuaguaaa

SEQ ID NO: 688535 - RNA, 22 nt, Human
cucaaguaagaaacagaauugg

SEQ ID NO: 688536 - RNA, 22 nt, Human
uaccaguaauaguaugugagau

SEQ ID NO: 688537 - RNA, 22 nt, Human
cauaaaauggcuuguucuuuaa

SEQ ID NO: 688538 - RNA, 23 nt, Human
cucccuggaguuucuggaagaug

SEQ ID NO: 688539 - RNA, 22 nt, Human
gcagaugcugcuccucucuaga

SEQ ID NO: 688540 - RNA, 22 nt, Human
aagagccagugggaaagucuug

SEQ ID NO: 688541 - RNA, 22 nt, Human
uugaggucaaguaaccacugga

SEQ ID NO: 688542 - RNA, 22 nt, Human
caaggcuaagcuuuggcuuucu

SEQ ID NO: 688543 - RNA, 22 nt, Human
ucuucauguauuugacaaccau

SEQ ID NO: 688544 - RNA, 22 nt, Human
agcuuugggccacuggcuggau

SEQ ID NO: 688545 - RNA, 22 nt, Human
cagaucaagcuguauggucaga

SEQ ID NO: 688546 - RNA, 22 nt, Human
ucucaggagccacagcgggagu

SEQ ID NO: 688547 - RNA, 22 nt, Human
aaauuauucucauguguuucuu

SEQ ID NO: 688548 - RNA, 22 nt, Human
ccugaggcuccaccuccagaga

SEQ ID NO: 688549 - RNA, 22 nt, Human
uacaugaccuagacuugcuaaa

SEQ ID NO: 688550 - RNA, 22 nt, Human
gaagaaauugaauucaugagcu

SEQ ID NO: 688551 - RNA, 23 nt, Human
aaaugcagggucgcagguuacag

SEQ ID NO: 688552 - RNA, 22 nt, Human
uccgggggugguagauuuccuu

SEQ ID NO: 688553 - RNA, 23 nt, Human
uuacuuuugcaccaaccuaauau

SEQ ID NO: 688554 - RNA, 22 nt, Human
aacauuuguuucguuaugugaa

SEQ ID NO: 688555 - RNA, 22 nt, Human
aggaccuguagggccugcaucc

SEQ ID NO: 688556 - RNA, 22 nt, Human
caggcacagugggguccucucu

SEQ ID NO: 688557 - RNA, 22 nt, Human
cagcuucuguuuauugugugcc

SEQ ID NO: 688558 - RNA, 22 nt, Human
caucacuguccaaaguucaguu

SEQ ID NO: 688559 - RNA, 22 nt, Human
cagcuccagccgacuguaagaa

SEQ ID NO: 688560 - RNA, 20 nt, Human
uuuauugagcacguacugug

SEQ ID NO: 688561 - RNA, 22 nt, Human
acaggccucccauccggagccc

SEQ ID NO: 688562 - RNA, 22 nt, Human
ccacccaugugacuaccucaug

SEQ ID NO: 688563 - RNA, 22 nt, Human
uggagugaaguaaagaggacaa

SEQ ID NO: 688564 - RNA, 22 nt, Human
ucagaggaaaggucagauggcu

SEQ ID NO: 688565 - RNA, 22 nt, Human
gacauguauuagucaugcacag

SEQ ID NO: 688566 - RNA, 22 nt, Human
cgcaggugaaagaggcugggca

SEQ ID NO: 688567 - RNA, 22 nt, Human
aagagauguggaaucauuuaca

SEQ ID NO: 688568 - RNA, 22 nt, Human
ccauguacaugaacacggcggc

SEQ ID NO: 688569 - RNA, 22 nt, Human
ucuucacaaagcuguuguuaaa

SEQ ID NO: 688570 - RNA, 22 nt, Human
ucuuaaaaguaugccaauugga

SEQ ID NO: 688571 - RNA, 22 nt, Human
auccaugauuaguaggauaaag

SEQ ID NO: 688572 - RNA, 22 nt, Human
ccugcuccugcuauucuucugg

SEQ ID NO: 688573 - RNA, 22 nt, Human
cagugucugguuggcucuacgu

SEQ ID NO: 688574 - RNA, 22 nt, Human
ccugggcucugucagaauuggg

SEQ ID NO: 688575 - RNA, 22 nt, Human
uuccaggggcagcagugauggu

SEQ ID NO: 688576 - RNA, 22 nt, Human
ucaagcaaguguuugguguaaa

SEQ ID NO: 688577 - RNA, 22 nt, Human
ccauggcuucuuucucugccag

SEQ ID NO: 688578 - RNA, 22 nt, Human
cucagccugugaagagcagagg

SEQ ID NO: 688579 - RNA, 22 nt, Human
agccagcaggugagugcagccu

SEQ ID NO: 688580 - RNA, 22 nt, Human
augcuuuggccaaugagaagug

SEQ ID NO: 688581 - RNA, 22 nt, Human
caggcacucagucuggaucccu

SEQ ID NO: 688582 - RNA, 22 nt, Human
ugucccaguuuugcagguuaga

SEQ ID NO: 688583 - RNA, 22 nt, Human
ggugcaggcgguggggcaagua

SEQ ID NO: 688584 - RNA, 22 nt, Human
uuucaucuaacacuacauaggg

SEQ ID NO: 688585 - RNA, 22 nt, Human
uuguacauucuauggguuugga

SEQ ID NO: 688586 - RNA, 22 nt, Human
acacuuguggccuuucuaguaa

SEQ ID NO: 688587 - RNA, 22 nt, Human
cugugggcgccugucagccuca

SEQ ID NO: 688588 - RNA, 23 nt, Human
gaacauucauugguugcuuuaga

SEQ ID NO: 688589 - RNA, 22 nt, Human
ggugcccagcaagcuuucaaug

SEQ ID NO: 688590 - RNA, 22 nt, Human
cuaguaaaucagaagcuguggg

SEQ ID NO: 688591 - RNA, 22 nt, Human
ucacacgugagguucuauccug

SEQ ID NO: 688592 - RNA, 22 nt, Human
cuucagcagccucuugcauaaa

SEQ ID NO: 688593 - RNA, 22 nt, Human
uggucaaauuuagucucuggaa

SEQ ID NO: 688594 - RNA, 18 nt, Human
acacacacaccuguguau

SEQ ID NO: 688595 - RNA, 22 nt, Human
aaggcccuggcaggaagcagga

SEQ ID NO: 688596 - RNA, 22 nt, Human
uggagguggaguuggaaacuga

SEQ ID NO: 688597 - RNA, 22 nt, Human
gguggggagucaggcauucuug

SEQ ID NO: 688598 - RNA, 22 nt, Human
aggccugaaggaagaugagcug

SEQ ID NO: 688599 - RNA, 22 nt, Human
acauuucuuugcuagacagcag

SEQ ID NO: 688600 - RNA, 22 nt, Human
ugaguaauaaacugucuugcuc

SEQ ID NO: 688601 - RNA, 20 nt, Human
ggcagcaggaguuuccucuu

SEQ ID NO: 688602 - RNA, 22 nt, Human
uuacacguguguguaucuguau

SEQ ID NO: 688603 - RNA, 22 nt, Human
gccucuggggcagcugagucau

SEQ ID NO: 688604 - RNA, 20 nt, Human
agcuacaaugcgaagcuggc

SEQ ID NO: 688605 - RNA, 22 nt, Human
aguggcaggaaaguggaagaga

SEQ ID NO: 688606 - RNA, 22 nt, Human
uuggccagugaaccaggccugg

SEQ ID NO: 688607 - RNA, 23 nt, Human
uuucauguuggcaugacugacuu

SEQ ID NO: 688608 - RNA, 22 nt, Human
gcucagugaaacaucaaauagu

SEQ ID NO: 688609 - RNA, 22 nt, Human
uguaugaagccagaaucuguuu

SEQ ID NO: 688610 - RNA, 22 nt, Human
ccacaggacaguuaaugugcag

SEQ ID NO: 688611 - RNA, 22 nt, Human
agccugugagggaugcugcagu

SEQ ID NO: 688612 - RNA, 22 nt, Human
ccagcagagggcgcuucacacc

SEQ ID NO: 688613 - RNA, 22 nt, Human
uguucaaguggauguggcuuuu

SEQ ID NO: 688614 - RNA, 22 nt, Human
ccaguguguuuaaugcauucca

SEQ ID NO: 688615 - RNA, 22 nt, Human
aauucagagacaugaagugaca

SEQ ID NO: 688616 - RNA, 22 nt, Human
cauuuagagaguaaaaauuagc

SEQ ID NO: 688617 - RNA, 22 nt, Human
aggaaaaauaaggcagcagggc

SEQ ID NO: 688618 - RNA, 22 nt, Human
acugcacagucccagaggaugc

SEQ ID NO: 688619 - RNA, 20 nt, Human
cuuuggcaaugagaacaggg

SEQ ID NO: 688620 - RNA, 22 nt, Human
acauucucuccaugucuucuuu

SEQ ID NO: 688621 - RNA, 22 nt, Human
gagagagaggugcugccaggca

SEQ ID NO: 688622 - RNA, 20 nt, Human
gaggcugcggacugcuggac

SEQ ID NO: 688623 - RNA, 19 nt, Human
accaggccucagaggcccu

SEQ ID NO: 688624 - RNA, 22 nt, Human
acucuuauucccucagaaauau

SEQ ID NO: 688625 - RNA, 22 nt, Human
acaaguucugggaauuaggaca

SEQ ID NO: 688626 - RNA, 22 nt, Human
guacaagaggagaaaauggagu

SEQ ID NO: 688627 - RNA, 22 nt, Human
ugcaaauacaaaaugguacagc

SEQ ID NO: 688628 - RNA, 22 nt, Human
agcagcauguaugagggugaac

SEQ ID NO: 688629 - RNA, 21 nt, Human
aggagcuguguuagcuggucg

SEQ ID NO: 688630 - RNA, 22 nt, Human
agucacaggguacacaaggauu

SEQ ID NO: 688631 - RNA, 22 nt, Human
uucuauaugacuucuaggcagg

SEQ ID NO: 688632 - RNA, 22 nt, Human
gccuggugugcgccgcgcagcu

SEQ ID NO: 688633 - RNA, 22 nt, Human
agggagguaggagcuucuagcu

SEQ ID NO: 688634 - RNA, 22 nt, Human
cccagagaucuuguccuuucca

SEQ ID NO: 688635 - RNA, 22 nt, Human
acaugugcucuugcuguacagc

SEQ ID NO: 688636 - RNA, 22 nt, Human
cagacacagauaugcauauggc

SEQ ID NO: 688637 - RNA, 22 nt, Human
acuguuacagagcaggaaauug

SEQ ID NO: 688638 - RNA, 20 nt, Human
caggcuccgcaggacuaggg

SEQ ID NO: 688639 - RNA, 22 nt, Human
cagugucaggaucaguauauuu

SEQ ID NO: 688640 - RNA, 22 nt, Human
auugagaaaauucgagcaaguu

SEQ ID NO: 688641 - RNA, 22 nt, Human
uggguuaaaaguugaaugaauu

SEQ ID NO: 688642 - RNA, 22 nt, Human
ucccugcuuggaaugacccuua

SEQ ID NO: 688643 - RNA, 22 nt, Human
acaguguugaggugcuuguuuc

SEQ ID NO: 688644 - RNA, 22 nt, Human
gaggagggagcuggaagcucuu

SEQ ID NO: 688645 - RNA, 22 nt, Human
aucuguuguuuuucaccaccca

SEQ ID NO: 688646 - RNA, 22 nt, Human
caccagacagguguaugcauau

SEQ ID NO: 688647 - RNA, 22 nt, Human
acagcucugggugcaggaggug

SEQ ID NO: 688648 - RNA, 22 nt, Human
agucuauuuuugguucuucggg

SEQ ID NO: 688649 - RNA, 22 nt, Human
gauuuauugucccuguccugcu

SEQ ID NO: 688650 - RNA, 22 nt, Human
ugaaggagaauuaauaggcauu

SEQ ID NO: 688651 - RNA, 22 nt, Human
uccugccauuugcuuuuucucc

SEQ ID NO: 688652 - RNA, 22 nt, Human
uccccaccuacacacugcuccu

SEQ ID NO: 688653 - RNA, 22 nt, Human
aaaaaaucagaucuuugguuaa

SEQ ID NO: 688654 - RNA, 22 nt, Human
uacagugucccuuuuucagaca

SEQ ID NO: 688655 - RNA, 22 nt, Human
aguggaccagaagacugaagcu

SEQ ID NO: 688656 - RNA, 22 nt, Human
cuguggcugaguuccuuauguu

SEQ ID NO: 688657 - RNA, 22 nt, Human
cagcagcaaggugaggguggag

SEQ ID NO: 688658 - RNA, 22 nt, Human
cugacucugacaggacuugugg

SEQ ID NO: 688659 - RNA, 22 nt, Human
acgggcagacagagcuacucgc

SEQ ID NO: 688660 - RNA, 22 nt, Human
cacaggccaguaagacuguguu

SEQ ID NO: 688661 - RNA, 22 nt, Human
caucauauauuucuacaagugc

SEQ ID NO: 688662 - RNA, 23 nt, Human
ucucaagccagaccaggccucgc

SEQ ID NO: 688663 - RNA, 22 nt, Human
uuguuuaaaauguagcaagaaa

SEQ ID NO: 688664 - RNA, 22 nt, Human
uuauguaauuuguuugcucuuc

SEQ ID NO: 688665 - RNA, 22 nt, Human
aggaaaaaagucugugauuaua

SEQ ID NO: 688666 - RNA, 22 nt, Human
ugucacaaggccaugaaaagaa

SEQ ID NO: 688667 - RNA, 22 nt, Human
aaguuucauguggagguagacu

SEQ ID NO: 688668 - RNA, 22 nt, Human
acaauggcaugcuagcaaaugg

SEQ ID NO: 688669 - RNA, 22 nt, Human
cagcagugcuucagugugagau

SEQ ID NO: 688670 - RNA, 22 nt, Human
ggcuuaagaugguagcuuugag

SEQ ID NO: 688671 - RNA, 22 nt, Human
ucuccuggcauuugguugagua

SEQ ID NO: 688672 - RNA, 22 nt, Human
gcuggcuuuguggucucuccuc

SEQ ID NO: 688673 - RNA, 23 nt, Human
aucucucuuuauucuuggggaua

SEQ ID NO: 688674 - RNA, 22 nt, Human
acaaggagagcacacaugggga

SEQ ID NO: 688675 - RNA, 22 nt, Human
ugcucauugcugauuuacaugu

SEQ ID NO: 688676 - RNA, 22 nt, Human
auaaagcuaagacuuacaugaa

SEQ ID NO: 688677 - RNA, 22 nt, Human
ggauccagaggugaagauggga

SEQ ID NO: 688678 - RNA, 22 nt, Human
cuggagagaauguggaaugauu

SEQ ID NO: 688679 - RNA, 22 nt, Human
cuggggcaucauccauucuuuc

SEQ ID NO: 688680 - RNA, 22 nt, Human
ugcccagcuauuccuuucuuag

SEQ ID NO: 688681 - RNA, 22 nt, Human
acagggcuccuugggcugacac

SEQ ID NO: 688682 - RNA, 22 nt, Human
uugguuuagcaacuuccugugu

SEQ ID NO: 688683 - RNA, 22 nt, Human
agggaugguggagguugcaagu

SEQ ID NO: 688684 - RNA, 22 nt, Human
augcugugaaaaagaaggcuga

SEQ ID NO: 688685 - RNA, 22 nt, Human
cagcacuguucccagaccacug

SEQ ID NO: 688686 - RNA, 22 nt, Human
cuccucaguugucccauggaga

SEQ ID NO: 688687 - RNA, 22 nt, Human
uugccuauuguucuuacauguu

SEQ ID NO: 688688 - RNA, 22 nt, Human
aggcuagacuuuggcgaagcac

SEQ ID NO: 688689 - RNA, 18 nt, Human
ucucuuuccucaguggag

SEQ ID NO: 688690 - RNA, 22 nt, Human
uuucuugaccacuauguugaua

SEQ ID NO: 688691 - RNA, 22 nt, Human
ccuuucucuuugcugaucaugu

SEQ ID NO: 688692 - RNA, 22 nt, Human
cacaggaccaauucacauucca

SEQ ID NO: 688693 - RNA, 22 nt, Human
acuuuuuuauaaggaagaagau

SEQ ID NO: 688694 - RNA, 22 nt, Human
uggaaguggcagaaaaugaaca

SEQ ID NO: 688695 - RNA, 23 nt, Human
aggcugcagaagaauagggucau

SEQ ID NO: 688696 - RNA, 22 nt, Human
uaaccugaacacacaauaggga

SEQ ID NO: 688697 - RNA, 22 nt, Human
auuaauuuuucugacagccaca

SEQ ID NO: 688698 - RNA, 23 nt, Human
ucucaagaggaagcagggcucau

SEQ ID NO: 688699 - RNA, 22 nt, Human
gccagggaacccaagggccuca

SEQ ID NO: 688700 - RNA, 22 nt, Human
gaggcugcuguuagcccugggc

SEQ ID NO: 688701 - RNA, 22 nt, Human
ccucaaauagcccccagucuag

SEQ ID NO: 688702 - RNA, 22 nt, Human
uauuucuuuucgugacuuauug

SEQ ID NO: 688703 - RNA, 23 nt, Human
acaaaguaauuccugcuuccaaa

SEQ ID NO: 688704 - RNA, 22 nt, Human
cugggagaucuccugagggcag

SEQ ID NO: 688705 - RNA, 22 nt, Human
uuaaaggaauugaguuucuugu

SEQ ID NO: 688706 - RNA, 22 nt, Human
ucaagaugaaccaggacauuca

SEQ ID NO: 688707 - RNA, 22 nt, Human
uccaggucuuccuauuccaggu

SEQ ID NO: 688708 - RNA, 22 nt, Human
gacagguaaagaugguggcagg

SEQ ID NO: 688709 - RNA, 22 nt, Human
agaagugguguguggccgagcu

SEQ ID NO: 688710 - RNA, 22 nt, Human
gggggggucuucagaccucaga

SEQ ID NO: 688711 - RNA, 22 nt, Human
cuucuuuaccaagagauagagu

SEQ ID NO: 688712 - RNA, 22 nt, Human
agugauauuagcaaaugguuau

SEQ ID NO: 688713 - RNA, 22 nt, Human
gaaauaagaguccaugccaggu

SEQ ID NO: 688714 - RNA, 22 nt, Human
cagaaacuagauuuagacacaa

SEQ ID NO: 688715 - RNA, 16 nt, Human
ugggaccuguggccaa

SEQ ID NO: 688716 - RNA, 22 nt, Human
auguuuauggagcagguauuag

SEQ ID NO: 688717 - RNA, 22 nt, Human
aggugccugggagcucccugag

SEQ ID NO: 688718 - RNA, 22 nt, Human
ggcucuguggcuggccaugaug

SEQ ID NO: 688719 - RNA, 22 nt, Human
cuucaagaagacagcagagcau

SEQ ID NO: 688720 - RNA, 22 nt, Human
acucuuuaacagacuuugaucu

SEQ ID NO: 688721 - RNA, 22 nt, Human
uggggcuggggaucuugagccu

SEQ ID NO: 688722 - RNA, 22 nt, Human
gcagcccagguguagcucuuug

SEQ ID NO: 688723 - RNA, 22 nt, Human
auauauuuuuugagacagaguc

SEQ ID NO: 688724 - RNA, 18 nt, Human
uggaagcuggugagcaga

SEQ ID NO: 688725 - RNA, 22 nt, Human
ugcaggaauagcuacagagcug

SEQ ID NO: 688726 - RNA, 22 nt, Human
uuauucagugcauauauuaaaa

SEQ ID NO: 688727 - RNA, 22 nt, Human
aaguguguauuuuucuucagug

SEQ ID NO: 688728 - RNA, 22 nt, Human
uuccauaaugagauucccagcc

SEQ ID NO: 688729 - RNA, 22 nt, Human
cagagccacugucugccaggca

SEQ ID NO: 688730 - RNA, 22 nt, Human
aauagcuuaguccugauucugu

SEQ ID NO: 688731 - RNA, 22 nt, Human
ccugaagcaaggguaggcaggu

SEQ ID NO: 688732 - RNA, 22 nt, Human
cagccacguagcccuuggccgu

SEQ ID NO: 688733 - RNA, 22 nt, Human
gugccuuuucuucauaguuacu

SEQ ID NO: 688734 - RNA, 22 nt, Human
uuauaacaacaguuuacuuuaa

SEQ ID NO: 688735 - RNA, 22 nt, Human
ugccugugcccuucuuggcauu

SEQ ID NO: 688736 - RNA, 22 nt, Human
acucucagggacagggucuggg

SEQ ID NO: 688737 - RNA, 18 nt, Human
gauggguaaaggcauaaa

SEQ ID NO: 688738 - RNA, 22 nt, Human
ucaggccuuucuucagagcuuc

SEQ ID NO: 688739 - RNA, 22 nt, Human
cuucuggggauggagcccagaa

SEQ ID NO: 688740 - RNA, 22 nt, Human
gugauuuugagaccuauauagu

SEQ ID NO: 688741 - RNA, 22 nt, Human
ucauguuuuaaugccuuuuucu

SEQ ID NO: 688742 - RNA, 22 nt, Human
caaacauucaaguacaagucuu

SEQ ID NO: 688743 - RNA, 22 nt, Human
gacuucaaaucaugcuaaaccu

SEQ ID NO: 688744 - RNA, 22 nt, Human
agaagccaauucugugugaguc

SEQ ID NO: 688745 - RNA, 20 nt, Human
uuucaguuaucuugaccuuc

SEQ ID NO: 688746 - RNA, 22 nt, Human
ccagagguuacuuugccuugga

SEQ ID NO: 688747 - RNA, 22 nt, Human
cuuuggaagugaccacaauccu

SEQ ID NO: 688748 - RNA, 22 nt, Human
agagguucaaacuucauaauuu

SEQ ID NO: 688749 - RNA, 22 nt, Human
cacaugcuagaauaaaucucca

SEQ ID NO: 688750 - RNA, 22 nt, Human
auuccagugugcaugguacaca

SEQ ID NO: 688751 - RNA, 23 nt, Human
uggaauguuucuuguacugaaug

SEQ ID NO: 688752 - RNA, 19 nt, Human
agggccugcagcucaagcu

SEQ ID NO: 688753 - RNA, 22 nt, Human
ugguccugucucaaggagccuu

SEQ ID NO: 688754 - RNA, 22 nt, Human
caggcaugagccaggccccucc

SEQ ID NO: 688755 - RNA, 22 nt, Human
uucacuuauagggauguuauug

SEQ ID NO: 688756 - RNA, 22 nt, Human
ccauggcucuuaccuuguuaua

SEQ ID NO: 688757 - RNA, 22 nt, Human
uuuagugcuuugcuauucaugg

SEQ ID NO: 688758 - RNA, 22 nt, Human
guggccucugugcuccugccua

SEQ ID NO: 688759 - RNA, 22 nt, Human
uggcugaguucuccaggaguag

SEQ ID NO: 688760 - RNA, 22 nt, Human
ccaggaaguaugacccaacaga

SEQ ID NO: 688761 - RNA, 22 nt, Human
gaaaauguuuccuguuauuugc

SEQ ID NO: 688762 - RNA, 22 nt, Human
uuuaaauucugucugccgcuua

SEQ ID NO: 688763 - RNA, 22 nt, Human
uucguuuucuaggaccaacaga

SEQ ID NO: 688764 - RNA, 17 nt, Human
gcagugaaaagagauca

SEQ ID NO: 688765 - RNA, 22 nt, Human
aguguaggguggucagagcaga

SEQ ID NO: 688766 - RNA, 22 nt, Human
gacagugcauuuccuggcaugg

SEQ ID NO: 688767 - RNA, 22 nt, Human
agcuguguggugucugacagcu

SEQ ID NO: 688768 - RNA, 18 nt, Human
ccagagcuggcuccucgc

SEQ ID NO: 688769 - RNA, 22 nt, Human
uucugcugagugggcaggugca

SEQ ID NO: 688770 - RNA, 22 nt, Human
gcugaguggagcagucagcgcu

SEQ ID NO: 688771 - RNA, 22 nt, Human
ugagcuucaaaauaugugaauc

SEQ ID NO: 688772 - RNA, 22 nt, Human
uucaguauauuacucuugucaa

SEQ ID NO: 688773 - RNA, 22 nt, Human
uucaucauuacagucauguuau

SEQ ID NO: 688774 - RNA, 22 nt, Human
uauucagugacaggguauuaug

SEQ ID NO: 688775 - RNA, 22 nt, Human
caggcacaguuccaagcauuuu

SEQ ID NO: 688776 - RNA, 22 nt, Human
ucugagcuucugcauuuccaac

SEQ ID NO: 688777 - RNA, 22 nt, Human
uucugggcacacaggcccuggu

SEQ ID NO: 688778 - RNA, 20 nt, Human
gcaacuagggagacacagcu

SEQ ID NO: 688779 - RNA, 22 nt, Human
aauagcaaaugcucauuugaaa

SEQ ID NO: 688780 - RNA, 22 nt, Human
aggcauuacaucuaaauauuua

SEQ ID NO: 688781 - RNA, 22 nt, Human
agcaucagagagaaguuaacua

SEQ ID NO: 688782 - RNA, 22 nt, Human
uaggaauugaaaaguggucuga

SEQ ID NO: 688783 - RNA, 20 nt, Human
ugcuccaggaacacuggccg

SEQ ID NO: 688784 - RNA, 22 nt, Human
uucugaggaggagcaaaaacuc

SEQ ID NO: 688785 - RNA, 22 nt, Human
gagggggcucccugaagccagu

SEQ ID NO: 688786 - RNA, 20 nt, Human
auagacaaagacaugccaga

SEQ ID NO: 688787 - RNA, 22 nt, Human
acuguuuaguaaauugaaaugg

SEQ ID NO: 688788 - RNA, 22 nt, Human
uguaguccaggaauugugucug

SEQ ID NO: 688789 - RNA, 22 nt, Human
aacaucaggaucuuguuacagu

SEQ ID NO: 688790 - RNA, 22 nt, Human
auauagacagaugacagggaua

SEQ ID NO: 688791 - RNA, 21 nt, Human
acagugugcuucucucccucc

SEQ ID NO: 688792 - RNA, 22 nt, Human
acuaaaugagauacugucuuca

SEQ ID NO: 688793 - RNA, 20 nt, Human
uagcagcagaaagaacuuag

SEQ ID NO: 688794 - RNA, 22 nt, Human
aggugcugugcuaugcacuugu

SEQ ID NO: 688795 - RNA, 18 nt, Human
aauugcauuuguuuccuu

SEQ ID NO: 688796 - RNA, 22 nt, Human
caagagugaaacucugucucaa

SEQ ID NO: 688797 - RNA, 22 nt, Human
cccagagcugagucugauauau

SEQ ID NO: 688798 - RNA, 22 nt, Human
ucagaagcagaaaauagguggg

SEQ ID NO: 688799 - RNA, 22 nt, Human
ucaggcugaaaggacuccaguu

SEQ ID NO: 688800 - RNA, 18 nt, Human
uggccuggagacaacucu

SEQ ID NO: 688801 - RNA, 22 nt, Human
gaggcugguucugaaguacugu

SEQ ID NO: 688802 - RNA, 22 nt, Human
gagccagggcugugagcugagc

SEQ ID NO: 688803 - RNA, 22 nt, Human
cccaggagauaacguucccaag

SEQ ID NO: 688804 - RNA, 22 nt, Human
gagguggugguggaggcauagc

SEQ ID NO: 688805 - RNA, 22 nt, Human
ccuggguacgcagggcuccucu

SEQ ID NO: 688806 - RNA, 22 nt, Human
agugaauucuccacccaguagg

SEQ ID NO: 688807 - RNA, 22 nt, Human
aaggaaaucuuuguaacaucuu

SEQ ID NO: 688808 - RNA, 22 nt, Human
agaucuauuagcaaacugccau

SEQ ID NO: 688809 - RNA, 22 nt, Human
gagcccugacacugagggaguu

SEQ ID NO: 688810 - RNA, 22 nt, Human
ucaggaaauggacaucuuugcu

SEQ ID NO: 688811 - RNA, 23 nt, Human
aucuuacauauuuagcaccugaa

SEQ ID NO: 688812 - RNA, 22 nt, Human
aaacagucgucuuaauaguauu

SEQ ID NO: 688813 - RNA, 22 nt, Human
agauaauguucugauccauuuc

SEQ ID NO: 688814 - RNA, 22 nt, Human
guucacaggguuaggaaucacu

SEQ ID NO: 688815 - RNA, 22 nt, Human
uuugauugucaccuaccuugca

SEQ ID NO: 688816 - RNA, 22 nt, Human
ucugguaauaggcaauagcuug

SEQ ID NO: 688817 - RNA, 22 nt, Human
uggucagguaccucuggcuguc

SEQ ID NO: 688818 - RNA, 22 nt, Human
ugguuaaguccagaaaggaagc

SEQ ID NO: 688819 - RNA, 22 nt, Human
agcuagggcuuucguagacagu

SEQ ID NO: 688820 - RNA, 22 nt, Human
uacaaagucacauugaaaugaa

SEQ ID NO: 688821 - RNA, 22 nt, Human
gaaaucugcuucuugcauagua

SEQ ID NO: 688822 - RNA, 22 nt, Human
uuagugcaauucagagaacaau

SEQ ID NO: 688823 - RNA, 22 nt, Human
ugucucugcugcaccuucuggg

SEQ ID NO: 688824 - RNA, 22 nt, Human
aggaguuuauccgagggcauaa

SEQ ID NO: 688825 - RNA, 18 nt, Human
accuccccauuuucugaa

SEQ ID NO: 688826 - RNA, 22 nt, Human
ugagcagggacuuugaguguag

SEQ ID NO: 688827 - RNA, 18 nt, Human
acaaaugugucacaggaa

SEQ ID NO: 688828 - RNA, 22 nt, Human
guagcuauuuaugauacucaug

SEQ ID NO: 688829 - RNA, 22 nt, Human
augcaaaauaaggcagaaacau

SEQ ID NO: 688830 - RNA, 22 nt, Human
cacagugcaaucggccacaaau

SEQ ID NO: 688831 - RNA, 22 nt, Human
ugcuuaauauugugauguaaua

SEQ ID NO: 688832 - RNA, 22 nt, Human
ugccugucuucaggagugucac

SEQ ID NO: 688833 - RNA, 22 nt, Human
uaccauaacguaaugaacuuga

SEQ ID NO: 688834 - RNA, 22 nt, Human
gaauagauuauacuugaagcau

SEQ ID NO: 688835 - RNA, 22 nt, Human
acauuguagacuuuucauaugu

SEQ ID NO: 688836 - RNA, 22 nt, Human
gcuggcuguaucaccuggccag

SEQ ID NO: 688837 - RNA, 22 nt, Human
caguauuuguuacagcauuagc

SEQ ID NO: 688838 - RNA, 21 nt, Human
cuguccucagauguggacgag

SEQ ID NO: 688839 - RNA, 22 nt, Human
uacuccacacgcuauuauaaug

SEQ ID NO: 688840 - RNA, 22 nt, Human
ucuguucuuaaagcauucuugc

SEQ ID NO: 688841 - RNA, 22 nt, Human
uaucugcaucugcauguguauu

SEQ ID NO: 688842 - RNA, 21 nt, Human
acugugauaaugcuuuuucug

SEQ ID NO: 688843 - RNA, 22 nt, Human
guggaagguaaugcagcuuacu

SEQ ID NO: 688844 - RNA, 22 nt, Human
agagagaacacccucggcaugg

SEQ ID NO: 688845 - RNA, 22 nt, Human
ucccauugccauagauaggaca

SEQ ID NO: 688846 - RNA, 17 nt, Human
gcugccaccuuuggagc

SEQ ID NO: 688847 - RNA, 22 nt, Human
gcugagcacagcaaagagacaa

SEQ ID NO: 688848 - RNA, 22 nt, Human
aaggcuggucagauguggugaa

SEQ ID NO: 688849 - RNA, 22 nt, Human
augcauauuucuuggagcaccu

SEQ ID NO: 688850 - RNA, 22 nt, Human
gggccccaagaaccuccuccug

SEQ ID NO: 688851 - RNA, 22 nt, Human
ucuuuccuaggugauaugcaau

SEQ ID NO: 688852 - RNA, 22 nt, Human
caugggagcuaucuccaucacu

SEQ ID NO: 688853 - RNA, 22 nt, Human
guaaagaaggcaaccugguuau

SEQ ID NO: 688854 - RNA, 22 nt, Human
uaggcuucccgcucacaugccc

SEQ ID NO: 688855 - RNA, 22 nt, Human
uaacaacugaggaagaggcaga

SEQ ID NO: 688856 - RNA, 23 nt, Human
ccacaggcacagaggcuugcauc

SEQ ID NO: 688857 - RNA, 20 nt, Human
agugaguuaucagcuacagu

SEQ ID NO: 688858 - RNA, 22 nt, Human
acagcuugaaucuuaagcucuu

SEQ ID NO: 688859 - RNA, 22 nt, Human
uuuuaucugugacaucuggcag

SEQ ID NO: 688860 - RNA, 22 nt, Human
ucaucugucugagagacuucug

SEQ ID NO: 688861 - RNA, 23 nt, Human
uaaauugaugguauggguuaagc

SEQ ID NO: 688862 - RNA, 22 nt, Human
ccaaggagcaaguuuacaccug

SEQ ID NO: 688863 - RNA, 22 nt, Human
uuucuucaauugcuaacaagga

SEQ ID NO: 688864 - RNA, 22 nt, Human
ucugaaauuuuaguuauagaaa

SEQ ID NO: 688865 - RNA, 19 nt, Human
acuucaaaucuuagagaaa

SEQ ID NO: 688866 - RNA, 22 nt, Human
cucagcucuuuauacuagcugu

SEQ ID NO: 688867 - RNA, 22 nt, Human
agaggcacuguucuuagcgacu

SEQ ID NO: 688868 - RNA, 21 nt, Human
ugaagggcagccucaggcucc

SEQ ID NO: 688869 - RNA, 21 nt, Human
gagacagcccagugccagggc

SEQ ID NO: 688870 - RNA, 22 nt, Human
uacaguuuacaugagaggaagc

SEQ ID NO: 688871 - RNA, 22 nt, Human
cuguggcuggccugucugacau

SEQ ID NO: 688872 - RNA, 22 nt, Human
uuuauucugugcuacaugaaga

SEQ ID NO: 688873 - RNA, 22 nt, Human
gcagccucugcaguucaggagg

SEQ ID NO: 688874 - RNA, 20 nt, Human
ucucuucaggagguccaugu

SEQ ID NO: 688875 - RNA, 22 nt, Human
acuuggagggagcuggguggaa

SEQ ID NO: 688876 - RNA, 22 nt, Human
cagauggaaggcauagagguuu

SEQ ID NO: 688877 - RNA, 22 nt, Human
cagcucuuuauugccaauauuc

SEQ ID NO: 688878 - RNA, 22 nt, Human
uauaacacucagaaagaaucau

SEQ ID NO: 688879 - RNA, 22 nt, Human
uacauugugucucuaucuaguc

SEQ ID NO: 688880 - RNA, 22 nt, Human
gggugcaggggacccuagggac

SEQ ID NO: 688881 - RNA, 22 nt, Human
auauuugucaucugccuuaguu

SEQ ID NO: 688882 - RNA, 19 nt, Human
uuuauuugagacaugccuu

SEQ ID NO: 688883 - RNA, 22 nt, Human
uuaauacagucuccagaaguaa

SEQ ID NO: 688884 - RNA, 22 nt, Human
uagcuacaaucacuguccuuug

SEQ ID NO: 688885 - RNA, 22 nt, Human
agcuggcacuagcguuuccaag

SEQ ID NO: 688886 - RNA, 22 nt, Human
guucacacuuuugauaugugaa

SEQ ID NO: 688887 - RNA, 22 nt, Human
aaacugaauucccaagggcaug

SEQ ID NO: 688888 - RNA, 22 nt, Human
auuaauugggaacuuguugaaa

SEQ ID NO: 688889 - RNA, 22 nt, Human
gccucugcugcaagccugguug

SEQ ID NO: 688890 - RNA, 22 nt, Human
ugucuuuaguuuuacugucugg

SEQ ID NO: 688891 - RNA, 22 nt, Human
ccucaguguguuuggggugagg

SEQ ID NO: 688892 - RNA, 22 nt, Human
uguauuugguguauuuaaugag

SEQ ID NO: 688893 - RNA, 22 nt, Human
agcagggcugugcuccuuccga

SEQ ID NO: 688894 - RNA, 22 nt, Human
auuaacaugcagccagacacac

SEQ ID NO: 688895 - RNA, 22 nt, Human
gcgccuggcacacagcaagggc

SEQ ID NO: 688896 - RNA, 22 nt, Human
cugaggagaccaucaacuaauu

SEQ ID NO: 688897 - RNA, 22 nt, Human
uucuucaaugugcccuguuuuc

SEQ ID NO: 688898 - RNA, 22 nt, Human
gaauugcuugcugagauuaaag

SEQ ID NO: 688899 - RNA, 22 nt, Human
acacuucaccccugcucccagu

SEQ ID NO: 688900 - RNA, 22 nt, Human
ccugccugguguaagucuaagg

SEQ ID NO: 688901 - RNA, 23 nt, Human
uccaggcugaaggagcagauuuu

SEQ ID NO: 688902 - RNA, 22 nt, Human
gggcucugugguugugcuuugu

SEQ ID NO: 688903 - RNA, 22 nt, Human
uuauagaaggagcauucacuua

SEQ ID NO: 688904 - RNA, 23 nt, Human
ggaaaaacacugugucuuggcag

SEQ ID NO: 688905 - RNA, 22 nt, Human
gccucugcucucagguagccuc

SEQ ID NO: 688906 - RNA, 22 nt, Human
agaauucugacaauagaauugg

SEQ ID NO: 688907 - RNA, 22 nt, Human
ggcugcuccuuuacccuggcag

SEQ ID NO: 688908 - RNA, 23 nt, Human
ugaauuuuggcauauucugaaau

SEQ ID NO: 688909 - RNA, 22 nt, Human
gaaacagcuagaaagccauugg

SEQ ID NO: 688910 - RNA, 22 nt, Human
gccaccuguuucgcuugcccag

SEQ ID NO: 688911 - RNA, 22 nt, Human
aggcacugauucuguuuuccau

SEQ ID NO: 688912 - RNA, 22 nt, Human
uuuagaaauugcagagugggug

SEQ ID NO: 688913 - RNA, 22 nt, Human
cuagaauugcauucuaugaaua

SEQ ID NO: 688914 - RNA, 22 nt, Human
cggcagcaucgaaacuacauuc

SEQ ID NO: 688915 - RNA, 22 nt, Human
agcacauguauucuccuugaau

SEQ ID NO: 688916 - RNA, 22 nt, Human
aggucaccauggcaugcuccac

SEQ ID NO: 688917 - RNA, 22 nt, Human
auuuguucauggguuguuaugc

SEQ ID NO: 688918 - RNA, 22 nt, Human
aaguaacaugggaacaucugaa

SEQ ID NO: 688919 - RNA, 20 nt, Human
ggagcuggcauccagccucu

SEQ ID NO: 688920 - RNA, 22 nt, Human
ucaucacauaugucaugauuug

SEQ ID NO: 688921 - RNA, 22 nt, Human
agcuuccuugaauucuguagaa

SEQ ID NO: 688922 - RNA, 22 nt, Human
cuagugugucuaugucuguucc

SEQ ID NO: 688923 - RNA, 22 nt, Human
uaugaagauauaucugaucucu

SEQ ID NO: 688924 - RNA, 22 nt, Human
ggcucugcccgcggcugcccac

SEQ ID NO: 688925 - RNA, 19 nt, Human
ucugcccacaagaaaggga

SEQ ID NO: 688926 - RNA, 22 nt, Human
augcuguccacucuugguguuu

SEQ ID NO: 688927 - RNA, 22 nt, Human
uggcuggagccccucaagagca

SEQ ID NO: 688928 - RNA, 22 nt, Human
guucucucugcuuccaagaugg

SEQ ID NO: 688929 - RNA, 22 nt, Human
agggcagccaugagccuucagg

SEQ ID NO: 688930 - RNA, 22 nt, Human
aucuuugugcuaauguaguucu

SEQ ID NO: 688931 - RNA, 22 nt, Human
ccugcagaugugggacagcugu

SEQ ID NO: 688932 - RNA, 22 nt, Human
acuauucaagugcucauucaga

SEQ ID NO: 688933 - RNA, 22 nt, Human
agcacauuuaaguaugaaauau

SEQ ID NO: 688934 - RNA, 22 nt, Human
auuaaauacugcaggcuaagca

SEQ ID NO: 688935 - RNA, 22 nt, Human
aggaaacauugauauugggaaa

SEQ ID NO: 688936 - RNA, 19 nt, Human
agacagagcucaguggguu

SEQ ID NO: 688937 - RNA, 22 nt, Human
gcaguguuacuuggaguacuaa

SEQ ID NO: 688938 - RNA, 22 nt, Human
uggucaguugcaucagagaagu

SEQ ID NO: 688939 - RNA, 22 nt, Human
ugaagauuuucggguacuugau

SEQ ID NO: 688940 - RNA, 22 nt, Human
gggcugacaaucucuuuacuua

SEQ ID NO: 688941 - RNA, 19 nt, Human
gagggcuugauggacccga

SEQ ID NO: 688942 - RNA, 22 nt, Human
agguguguauaaacauacauau

SEQ ID NO: 688943 - RNA, 22 nt, Human
cccaaggccucuccuuggcuug

SEQ ID NO: 688944 - RNA, 22 nt, Human
auuaagugacuaaaguaaugcu

SEQ ID NO: 688945 - RNA, 22 nt, Human
gggguggagaugguggcccuuu

SEQ ID NO: 688946 - RNA, 22 nt, Human
gaugucugccaaagaaucaagc

SEQ ID NO: 688947 - RNA, 22 nt, Human
agaucgauuucauauccucuua

SEQ ID NO: 688948 - RNA, 22 nt, Human
auugaaagcauggauuuggauu

SEQ ID NO: 688949 - RNA, 22 nt, Human
ccugugucuuccccacuggugu

SEQ ID NO: 688950 - RNA, 22 nt, Human
cccaggcuaguaugauaucagu

SEQ ID NO: 688951 - RNA, 22 nt, Human
uccuaggguaaucagcauacau

SEQ ID NO: 688952 - RNA, 22 nt, Human
ugccugugcccuuugcugggag

SEQ ID NO: 688953 - RNA, 22 nt, Human
gagcuuugcuggaagccugggg

SEQ ID NO: 688954 - RNA, 22 nt, Human
uugcaaauuauauaagggaugc

SEQ ID NO: 688955 - RNA, 22 nt, Human
aggcugaggcgggaggaucacu

SEQ ID NO: 688956 - RNA, 19 nt, Human
cuguacagguugcuucugg

SEQ ID NO: 688957 - RNA, 22 nt, Human
agggcaguucagccacaggcuc

SEQ ID NO: 688958 - RNA, 22 nt, Human
gcucuucucagauuguacacuc

SEQ ID NO: 688959 - RNA, 22 nt, Human
cagcaggcuguggaaauccugg

SEQ ID NO: 688960 - RNA, 22 nt, Human
cagggcuccccgcaccgcagcc

SEQ ID NO: 688961 - RNA, 22 nt, Human
augucuuucuuauggucuguug

SEQ ID NO: 688962 - RNA, 22 nt, Human
uggcagugccccuugaccagug

SEQ ID NO: 688963 - RNA, 22 nt, Human
cugcugcugagagcucagccug

SEQ ID NO: 688964 - RNA, 22 nt, Human
gugcauuauucuuaccuuucuu

SEQ ID NO: 688965 - RNA, 22 nt, Human
ucacauugaauggaagaauaga

SEQ ID NO: 688966 - RNA, 22 nt, Human
ugcagagguuugugguguugcu

SEQ ID NO: 688967 - RNA, 22 nt, Human
gugcccugaugcaauugucuca

SEQ ID NO: 688968 - RNA, 23 nt, Human
agccccucauggugucuagacag

SEQ ID NO: 688969 - RNA, 22 nt, Human
uccccaaguaaagauccugaga

SEQ ID NO: 688970 - RNA, 23 nt, Human
cuacaagagcaagcauggacaag

SEQ ID NO: 688971 - RNA, 18 nt, Human
caaauucucauugauuuc

SEQ ID NO: 688972 - RNA, 21 nt, Human
ucaaagcacauauuugcacau

SEQ ID NO: 688973 - RNA, 22 nt, Human
ccucagucauuggccuacacuu

SEQ ID NO: 688974 - RNA, 22 nt, Human
cagccacuggugccaggcuguu

SEQ ID NO: 688975 - RNA, 22 nt, Human
cugaaggggguuucacugagcu

SEQ ID NO: 688976 - RNA, 22 nt, Human
agagacacaucauauaaguaua

SEQ ID NO: 688977 - RNA, 22 nt, Human
ggcggguguaaguaggacagcg

SEQ ID NO: 688978 - RNA, 22 nt, Human
cagcccacgucagggccacuca

SEQ ID NO: 688979 - RNA, 22 nt, Human
guggcaacaaaagagccuagug

SEQ ID NO: 688980 - RNA, 22 nt, Human
ccagggucacaaauaacugcag

SEQ ID NO: 688981 - RNA, 22 nt, Human
aagauuucugcuuuuggaggca

SEQ ID NO: 688982 - RNA, 22 nt, Human
cugagcugggaguagagacucu

SEQ ID NO: 688983 - RNA, 22 nt, Human
aaucagaacuucucaggguggg

SEQ ID NO: 688984 - RNA, 22 nt, Human
acuugcaucuuagagacucacc

SEQ ID NO: 688985 - RNA, 22 nt, Human
uuugaauggacugagaaucuug

SEQ ID NO: 688986 - RNA, 22 nt, Human
gggugccacagagcuuccacuu

SEQ ID NO: 688987 - RNA, 22 nt, Human
aaugcacauguuguaauaaaua

SEQ ID NO: 688988 - RNA, 22 nt, Human
uaacauguucagacuaccugug

SEQ ID NO: 688989 - RNA, 22 nt, Human
ugacauuucagauaugguauuu

SEQ ID NO: 688990 - RNA, 22 nt, Human
ggacuucuaagugccagacacu

SEQ ID NO: 688991 - RNA, 22 nt, Human
gcagaggccaggccaccagcaa

SEQ ID NO: 688992 - RNA, 22 nt, Human
acauacuuuguccuuaacguac

SEQ ID NO: 688993 - RNA, 22 nt, Human
cugggccugguguggcaccugc

SEQ ID NO: 688994 - RNA, 22 nt, Human
ucucaaauguaaagcaugauuu

SEQ ID NO: 688995 - RNA, 22 nt, Human
cagguuucuaguucuaagaaua

SEQ ID NO: 688996 - RNA, 22 nt, Human
gagcagcagguggcugugaugg

SEQ ID NO: 688997 - RNA, 22 nt, Human
gcuuuaaugcaauuucaccuca

SEQ ID NO: 688998 - RNA, 22 nt, Human
gaggcagcuuaggguacugacu

SEQ ID NO: 688999 - RNA, 22 nt, Human
agcaacaggguggucuucagaa

SEQ ID NO: 689000 - RNA, 22 nt, Human
uuaggauuugaaaaggggcaga

SEQ ID NO: 689001 - RNA, 19 nt, Human
cagcaagaaugaaggcaua

SEQ ID NO: 689002 - RNA, 22 nt, Human
ccuugggagaaauugcagaguc

SEQ ID NO: 689003 - RNA, 22 nt, Human
acuuugcaauacuuaauacaaa

SEQ ID NO: 689004 - RNA, 22 nt, Human
agcccugcacaggucuguggcu

SEQ ID NO: 689005 - RNA, 22 nt, Human
uaagagcauaggcuugaaaaua

SEQ ID NO: 689006 - RNA, 18 nt, Human
augggcagguaagaucca

SEQ ID NO: 689007 - RNA, 22 nt, Human
uuuugagauggagucuugcucu

SEQ ID NO: 689008 - RNA, 22 nt, Human
auccuuaauuuacuugcaucuu

SEQ ID NO: 689009 - RNA, 22 nt, Human
auuugcuugacuauggcuugca

SEQ ID NO: 689010 - RNA, 22 nt, Human
agguacagggugaaaguuuaug

SEQ ID NO: 689011 - RNA, 22 nt, Human
caggaggaggugagguagaacu

SEQ ID NO: 689012 - RNA, 22 nt, Human
uuuucaagggcagggaaaucau

SEQ ID NO: 689013 - RNA, 22 nt, Human
gagagcuaacuaccuggaaaug

SEQ ID NO: 689014 - RNA, 22 nt, Human
cucuggcuucuaccuugcaguu

SEQ ID NO: 689015 - RNA, 22 nt, Human
acauagcagaggacugagcaga

SEQ ID NO: 689016 - RNA, 22 nt, Human
gcucagagaaaacuggggcuug

SEQ ID NO: 689017 - RNA, 22 nt, Human
ucucuggggaaaaggcugauac

SEQ ID NO: 689018 - RNA, 22 nt, Human
aacaugcucuguuucuuggaug

SEQ ID NO: 689019 - RNA, 22 nt, Human
aauagauacuacuuagauguag

SEQ ID NO: 689020 - RNA, 22 nt, Human
uggcuaugguauugauggguuu

SEQ ID NO: 689021 - RNA, 22 nt, Human
aucaguauccugcaguuucuau

SEQ ID NO: 689022 - RNA, 22 nt, Human
uggcucuguugugcugagccag

SEQ ID NO: 689023 - RNA, 22 nt, Human
ucuacaagucaagucuaucaag

SEQ ID NO: 689024 - RNA, 21 nt, Human
agcaccuuacagcuauaaugg

SEQ ID NO: 689025 - RNA, 21 nt, Human
cuguccaguaauuccuggcac

SEQ ID NO: 689026 - RNA, 19 nt, Human
aaguugaucauuuugacag

SEQ ID NO: 689027 - RNA, 22 nt, Human
agccaccucuaucuugggcucc

SEQ ID NO: 689028 - RNA, 22 nt, Human
uucuuacauuacuuuacaugug

SEQ ID NO: 689029 - RNA, 22 nt, Human
gggcaguugauggaggucugga

SEQ ID NO: 689030 - RNA, 22 nt, Human
gcucagagaaucagcagacacc

SEQ ID NO: 689031 - RNA, 22 nt, Human
cugcuuuggcucagugacauca

SEQ ID NO: 689032 - RNA, 22 nt, Human
cccuccaggccugucauguucc

SEQ ID NO: 689033 - RNA, 22 nt, Human
agaaaucuuggagucuguggua

SEQ ID NO: 689034 - RNA, 22 nt, Human
gauuuggcuuggaugauuaaac

SEQ ID NO: 689035 - RNA, 22 nt, Human
gcagaagggaauaaggagcuuu

SEQ ID NO: 689036 - RNA, 22 nt, Human
ccaagggaaaccgagaggcugg

SEQ ID NO: 689037 - RNA, 22 nt, Human
ggcaccagggcaagggucuuuc

SEQ ID NO: 689038 - RNA, 18 nt, Human
gagaaggccacuuguuuu

SEQ ID NO: 689039 - RNA, 22 nt, Human
ggggaggccaguggaccguccc

SEQ ID NO: 689040 - RNA, 22 nt, Human
auggcuccuucugugcaguuuu

SEQ ID NO: 689041 - RNA, 22 nt, Human
cuagccagaugauucccaaaua

SEQ ID NO: 689042 - RNA, 22 nt, Human
cacagucacauaucuaugugug

SEQ ID NO: 689043 - RNA, 22 nt, Human
ggccucucuccagucagugcag

SEQ ID NO: 689044 - RNA, 22 nt, Human
cuuuugcacccagaguuauuug

SEQ ID NO: 689045 - RNA, 16 nt, Human
agaggccuugaggaag

SEQ ID NO: 689046 - RNA, 22 nt, Human
ucauaaaguucuaagaauugua

SEQ ID NO: 689047 - RNA, 22 nt, Human
gagcaaugcccuucaccagccc

SEQ ID NO: 689048 - RNA, 22 nt, Human
ugcagggacaggcucuggggau

SEQ ID NO: 689049 - RNA, 22 nt, Human
uaagcugugggagauuggcaua

SEQ ID NO: 689050 - RNA, 22 nt, Human
ggagaaggaauauuggaguagg

SEQ ID NO: 689051 - RNA, 22 nt, Human
agcccuagagcuggaggucagu

SEQ ID NO: 689052 - RNA, 22 nt, Human
acagcagggucacauucccucu

SEQ ID NO: 689053 - RNA, 22 nt, Human
uccaggcauaagccuugagugu

SEQ ID NO: 689054 - RNA, 22 nt, Human
ccuucugucucccucauauuga

SEQ ID NO: 689055 - RNA, 22 nt, Human
aucuuugaugacuaaugcuuug

SEQ ID NO: 689056 - RNA, 22 nt, Human
uuaauuaaauucaugagcauug

SEQ ID NO: 689057 - RNA, 22 nt, Human
guuuacaugcaugcaagaauga

SEQ ID NO: 689058 - RNA, 22 nt, Human
uauaggaaacauacgugacuag

SEQ ID NO: 689059 - RNA, 22 nt, Human
uccagcccuccugggaucacag

SEQ ID NO: 689060 - RNA, 22 nt, Human
agugcaaagggaucagauuggg

SEQ ID NO: 689061 - RNA, 23 nt, Human
ugauugaaaugaggaguauuugu

SEQ ID NO: 689062 - RNA, 22 nt, Human
gaaaagagaacaucugaggauc

SEQ ID NO: 689063 - RNA, 22 nt, Human
agccaaucauccucagacucuc

SEQ ID NO: 689064 - RNA, 22 nt, Human
cugacaaaggcaaggcaggggg

SEQ ID NO: 689065 - RNA, 22 nt, Human
ucagcccugaggacagaggcag

SEQ ID NO: 689066 - RNA, 22 nt, Human
gcaagacaauggagcauaaacg

SEQ ID NO: 689067 - RNA, 19 nt, Human
uaugaagaauguggcaaag

SEQ ID NO: 689068 - RNA, 22 nt, Human
gaugaaaaaagacgagcauaua

SEQ ID NO: 689069 - RNA, 22 nt, Human
gugcuuuuccuuauuuggugcu

SEQ ID NO: 689070 - RNA, 22 nt, Human
agggugcagguguggagucuag

SEQ ID NO: 689071 - RNA, 23 nt, Human
gaagugucugagcuguauuuuuc

SEQ ID NO: 689072 - RNA, 22 nt, Human
acccaggcgggagugcaguguc

SEQ ID NO: 689073 - RNA, 22 nt, Human
cuacuagaucaguaugccucaa

SEQ ID NO: 689074 - RNA, 22 nt, Human
aauguuaugugguucaacuuaa

SEQ ID NO: 689075 - RNA, 22 nt, Human
aagcaggagaugcaggaaugua

SEQ ID NO: 689076 - RNA, 23 nt, Human
cauguguaauuucugguugggug

SEQ ID NO: 689077 - RNA, 22 nt, Human
augaaacaaggguauuuucucu

SEQ ID NO: 689078 - RNA, 22 nt, Human
uuauuugcugauuucaguuuca

SEQ ID NO: 689079 - RNA, 22 nt, Human
cagcugucuaaguugagcagga

SEQ ID NO: 689080 - RNA, 21 nt, Human
acacugcuguagcauauuggg

SEQ ID NO: 689081 - RNA, 22 nt, Human
uacauuaacuuacguccacaug

SEQ ID NO: 689082 - RNA, 22 nt, Human
aagcuucaaugagauaauuguu

SEQ ID NO: 689083 - RNA, 22 nt, Human
gcuggagcggguucgggccgcu

SEQ ID NO: 689084 - RNA, 22 nt, Human
cugcacugcugaucccaggucu

SEQ ID NO: 689085 - RNA, 22 nt, Human
caggcggccaugaucuggcagg

SEQ ID NO: 689086 - RNA, 22 nt, Human
ccuuuagaauucugccccuccu

SEQ ID NO: 689087 - RNA, 22 nt, Human
uccaggauugucagccagaagg

SEQ ID NO: 689088 - RNA, 22 nt, Human
uucaacugggcggaucugagaa

SEQ ID NO: 689089 - RNA, 21 nt, Human
ccugucuuggacugaggcacc

SEQ ID NO: 689090 - RNA, 22 nt, Human
cccugcagaucuaggguccuuc

SEQ ID NO: 689091 - RNA, 22 nt, Human
uuguguacagguguuuccaagu

SEQ ID NO: 689092 - RNA, 22 nt, Human
caucacagguccugaugacauu

SEQ ID NO: 689093 - RNA, 22 nt, Human
guauuucuagaaugguagcacu

SEQ ID NO: 689094 - RNA, 19 nt, Human
caaaugggacaggaaggca

SEQ ID NO: 689095 - RNA, 22 nt, Human
acuucacagguuuucauaaaac

SEQ ID NO: 689096 - RNA, 22 nt, Human
uaaggcagccgcucagagaggu

SEQ ID NO: 689097 - RNA, 22 nt, Human
gugggagcuucaucaagcaguu

SEQ ID NO: 689098 - RNA, 22 nt, Human
ucagaagguacugaagacaugg

SEQ ID NO: 689099 - RNA, 22 nt, Human
guggccuggauagacuccaucu

SEQ ID NO: 689100 - RNA, 22 nt, Human
caugagaagggguggaguuaga

SEQ ID NO: 689101 - RNA, 22 nt, Human
gugugggcugcagaggcacagc

SEQ ID NO: 689102 - RNA, 22 nt, Human
ggacccagcucugagacccugc

SEQ ID NO: 689103 - RNA, 22 nt, Human
guauacagauacuuagacgugc

SEQ ID NO: 689104 - RNA, 22 nt, Human
uguccaggaauugacccugcaa

SEQ ID NO: 689105 - RNA, 22 nt, Human
aaauccuaaggagaauaugauu

SEQ ID NO: 689106 - RNA, 22 nt, Human
acaccaaaguagaauuaaugua

SEQ ID NO: 689107 - RNA, 22 nt, Human
aggucuaacugauagaauucau

SEQ ID NO: 689108 - RNA, 22 nt, Human
guugaggagcaagcaugugucu

SEQ ID NO: 689109 - RNA, 22 nt, Human
auuugucuuugagugcccugcu

SEQ ID NO: 689110 - RNA, 22 nt, Human
cugcucuagguuccugcauaug

SEQ ID NO: 689111 - RNA, 22 nt, Human
agcagccuugugacuccggggu

SEQ ID NO: 689112 - RNA, 22 nt, Human
agaacuguccccagagagcacu

SEQ ID NO: 689113 - RNA, 21 nt, Human
uauuuaucucaggcuaucuuu

SEQ ID NO: 689114 - RNA, 22 nt, Human
ugcugccuugaccuccugggcu

SEQ ID NO: 689115 - RNA, 19 nt, Human
uagggcuggccgggcggug

SEQ ID NO: 689116 - RNA, 22 nt, Human
uugaaucauuacaauagauaag

SEQ ID NO: 689117 - RNA, 22 nt, Human
cagaggccuuucuacagugaua

SEQ ID NO: 689118 - RNA, 22 nt, Human
auuacaguaaaugcuacaggca

SEQ ID NO: 689119 - RNA, 22 nt, Human
auacagaauucacuacaguuuc

SEQ ID NO: 689120 - RNA, 22 nt, Human
ugugucaauuuucauuccuacu

SEQ ID NO: 689121 - RNA, 22 nt, Human
ugccuacauuccuugcuuaugg

SEQ ID NO: 689122 - RNA, 22 nt, Human
aaacauuguacauucuguagcu

SEQ ID NO: 689123 - RNA, 22 nt, Human
cagugguuuaggucaaggggag

SEQ ID NO: 689124 - RNA, 22 nt, Human
aagcagccaccucaucuccacu

SEQ ID NO: 689125 - RNA, 22 nt, Human
caaguuuacaauguguaugugu

SEQ ID NO: 689126 - RNA, 22 nt, Human
ucaaugcaaucauuggacaagu

SEQ ID NO: 689127 - RNA, 18 nt, Human
cuggcauucuucccugga

SEQ ID NO: 689128 - RNA, 22 nt, Human
cuggauggucccaugagcagcu

SEQ ID NO: 689129 - RNA, 21 nt, Human
uccuuauauuugaauacuuua

SEQ ID NO: 689130 - RNA, 22 nt, Human
ucugccaggcuuggugcuagau

SEQ ID NO: 689131 - RNA, 22 nt, Human
aaggcuuuugggaauuuucaac

SEQ ID NO: 689132 - RNA, 21 nt, Human
uguuacaguccaaauguuugu

SEQ ID NO: 689133 - RNA, 22 nt, Human
acaauucugaugguuucccagu

SEQ ID NO: 689134 - RNA, 22 nt, Human
gagccuccuccuggugugccga

SEQ ID NO: 689135 - RNA, 22 nt, Human
uacucaaaaaguuaugaaucau

SEQ ID NO: 689136 - RNA, 22 nt, Human
cacagcccccuugacacucugg

SEQ ID NO: 689137 - RNA, 22 nt, Human
cuggcugcuuguagacucgacu

SEQ ID NO: 689138 - RNA, 22 nt, Human
cuggucaccagguagcauugua

SEQ ID NO: 689139 - RNA, 22 nt, Human
gagguggcuccuucagggaaua

SEQ ID NO: 689140 - RNA, 22 nt, Human
uccaggugccggggacugaggc

SEQ ID NO: 689141 - RNA, 22 nt, Human
gcucugccuggucgcgugcugg

SEQ ID NO: 689142 - RNA, 19 nt, Human
cacagggagaccacauguc

SEQ ID NO: 689143 - RNA, 22 nt, Human
uggcauugcuucugaaguggag

SEQ ID NO: 689144 - RNA, 22 nt, Human
cagucuggcucagcacaaaggg

SEQ ID NO: 689145 - RNA, 22 nt, Human
cagugguuuccaaacuuguucc

SEQ ID NO: 689146 - RNA, 22 nt, Human
caugaauauuuaguauuuacuu

SEQ ID NO: 689147 - RNA, 22 nt, Human
acauuucuaucauccuguaaug

SEQ ID NO: 689148 - RNA, 22 nt, Human
aucauaaaccacuuuguaaucu

SEQ ID NO: 689149 - RNA, 23 nt, Human
auuuuuagccucucugagcugag

SEQ ID NO: 689150 - RNA, 21 nt, Human
guggcccugguguggcugcac

SEQ ID NO: 689151 - RNA, 22 nt, Human
cuggccugaggucggcuguagg

SEQ ID NO: 689152 - RNA, 22 nt, Human
cucagacccccagagcugcuaa

SEQ ID NO: 689153 - RNA, 22 nt, Human
cucuccagaauuauuacuauua

SEQ ID NO: 689154 - RNA, 22 nt, Human
uucuaacuggugcagugcugca

SEQ ID NO: 689155 - RNA, 22 nt, Human
auagaagcugauaaacuacuuc

SEQ ID NO: 689156 - RNA, 22 nt, Human
auaaauuuauaauuguuuccug

SEQ ID NO: 689157 - RNA, 21 nt, Human
aggaggccaguacugcugaac

SEQ ID NO: 689158 - RNA, 22 nt, Human
agauccugccaauggaagcagg

SEQ ID NO: 689159 - RNA, 22 nt, Human
cacaguuugggucuccggggca

SEQ ID NO: 689160 - RNA, 22 nt, Human
ucagcauuucagaaguggcaua

SEQ ID NO: 689161 - RNA, 21 nt, Human
gcaacuuaucgcauucugcag

SEQ ID NO: 689162 - RNA, 21 nt, Human
uauuucuuugacucucucccu

SEQ ID NO: 689163 - RNA, 22 nt, Human
guuccugggaggcaugggcugg

SEQ ID NO: 689164 - RNA, 22 nt, Human
uugcuuccucuaguuucuugaa

SEQ ID NO: 689165 - RNA, 22 nt, Human
accuccagcuuuuuagagacau

SEQ ID NO: 689166 - RNA, 22 nt, Human
aaacacaagaggcaggguacag

SEQ ID NO: 689167 - RNA, 22 nt, Human
uuguauuuuuuccuggcggugg

SEQ ID NO: 689168 - RNA, 22 nt, Human
cuuagaaaucgaacucagguua

SEQ ID NO: 689169 - RNA, 22 nt, Human
uuucuaaaauagauuuuauggu

SEQ ID NO: 689170 - RNA, 22 nt, Human
cugaaaagugucuguugaguua

SEQ ID NO: 689171 - RNA, 22 nt, Human
uccuggaguuuguaaggugagc

SEQ ID NO: 689172 - RNA, 22 nt, Human
ucaguuuucaauuucaucagag

SEQ ID NO: 689173 - RNA, 22 nt, Human
uuccauuuuucuaacucucaga

SEQ ID NO: 689174 - RNA, 22 nt, Human
aggcggugcuguggacagugac

SEQ ID NO: 689175 - RNA, 18 nt, Human
ugacagaaccuggagccu

SEQ ID NO: 689176 - RNA, 22 nt, Human
uuccaagguguucugcugguuu

SEQ ID NO: 689177 - RNA, 22 nt, Human
augcuggucugcagaguuggga

SEQ ID NO: 689178 - RNA, 22 nt, Human
uggauggauugacgaaggcagc

SEQ ID NO: 689179 - RNA, 23 nt, Human
ucucaggacacacaugucuauca

SEQ ID NO: 689180 - RNA, 22 nt, Human
uuaaaauuauggcccauuugga

SEQ ID NO: 689181 - RNA, 22 nt, Human
ugaaaaacacuaauuggaaagc

SEQ ID NO: 689182 - RNA, 22 nt, Human
aagaggcugaaugagaaaguac

SEQ ID NO: 689183 - RNA, 22 nt, Human
acaugcuaaaucugagaugcuu

SEQ ID NO: 689184 - RNA, 22 nt, Human
uaugacaggcaugagauccuaa

SEQ ID NO: 689185 - RNA, 22 nt, Human
ugcuggaaugagucggggaggg

SEQ ID NO: 689186 - RNA, 22 nt, Human
ugugaaauauuggcaauuucau

SEQ ID NO: 689187 - RNA, 22 nt, Human
acugcccuguaacugccaggua

SEQ ID NO: 689188 - RNA, 22 nt, Human
uuggcuuuagaccugagacugu

SEQ ID NO: 689189 - RNA, 22 nt, Human
uuuccaaaguugccauaagcuu

SEQ ID NO: 689190 - RNA, 18 nt, Human
aggugcccuccuuacacu

SEQ ID NO: 689191 - RNA, 22 nt, Human
acagggcuuagaaaucuguugc

SEQ ID NO: 689192 - RNA, 22 nt, Human
aaaugcucuggggauaagacug

SEQ ID NO: 689193 - RNA, 20 nt, Human
ugaaaaggucaggagacaug

SEQ ID NO: 689194 - RNA, 22 nt, Human
ucaggcuguuagccaccuccuc

SEQ ID NO: 689195 - RNA, 22 nt, Human
ggaggccagaaucuguguugga

SEQ ID NO: 689196 - RNA, 22 nt, Human
auucacaauuagaaguagauaa

SEQ ID NO: 689197 - RNA, 22 nt, Human
agcagcaaagaauaggcccucu

SEQ ID NO: 689198 - RNA, 22 nt, Human
uccaggcaaaaaccaacuacag

SEQ ID NO: 689199 - RNA, 23 nt, Human
agcagcaaaaauuuaucuuucug

SEQ ID NO: 689200 - RNA, 22 nt, Human
agagauggauguuauuaugggu

SEQ ID NO: 689201 - RNA, 22 nt, Human
gacaguuuagguucaaaucuca

SEQ ID NO: 689202 - RNA, 17 nt, Human
agcccccacucccaagu

SEQ ID NO: 689203 - RNA, 22 nt, Human
ggcuuccuccuuccugcuguca

SEQ ID NO: 689204 - RNA, 22 nt, Human
cuaaaugccuuuccuaccuaac

SEQ ID NO: 689205 - RNA, 22 nt, Human
gugaguguuaacccacugcuuc

SEQ ID NO: 689206 - RNA, 22 nt, Human
cagauuccaguuuguggcuccc

SEQ ID NO: 689207 - RNA, 22 nt, Human
uccuggagauaauugcagugaa

SEQ ID NO: 689208 - RNA, 22 nt, Human
agacacagugcugggugcugag

SEQ ID NO: 689209 - RNA, 22 nt, Human
uccaggucuggccugcuaggca

SEQ ID NO: 689210 - RNA, 22 nt, Human
ccccgcgcguugucccgcaggu

SEQ ID NO: 689211 - RNA, 22 nt, Human
ugugaggauaaaaaggaaggag

SEQ ID NO: 689212 - RNA, 22 nt, Human
auuauucaaucauauuaaaagu

SEQ ID NO: 689213 - RNA, 22 nt, Human
agagaugaaaaggguacugagg

SEQ ID NO: 689214 - RNA, 22 nt, Human
gacagaagaggaacuuggacag

SEQ ID NO: 689215 - RNA, 22 nt, Human
uggcucuguggauguucugacc

SEQ ID NO: 689216 - RNA, 22 nt, Human
ugaauuuaucaaagauucuuaa

SEQ ID NO: 689217 - RNA, 22 nt, Human
caagccucagaaucuucuccau

SEQ ID NO: 689218 - RNA, 22 nt, Human
cuagaaacgccuuuagcacaac

SEQ ID NO: 689219 - RNA, 22 nt, Human
uuuagcauccaagguuaugacu

SEQ ID NO: 689220 - RNA, 22 nt, Human
ucuuucucucuaaucaagcaca

SEQ ID NO: 689221 - RNA, 22 nt, Human
gccaggucgucuccauguccaa

SEQ ID NO: 689222 - RNA, 22 nt, Human
uaacauuugcugucuccuaugu

SEQ ID NO: 689223 - RNA, 22 nt, Human
ucagaacagaagaaggaacacg

SEQ ID NO: 689224 - RNA, 22 nt, Human
acacauuucuaaauuuuuaccg

SEQ ID NO: 689225 - RNA, 22 nt, Human
ugccaggcccagcuccagagcu

SEQ ID NO: 689226 - RNA, 22 nt, Human
aaucaguucuacaucuuaucca

SEQ ID NO: 689227 - RNA, 22 nt, Human
uuauggagcagacagcugguca

SEQ ID NO: 689228 - RNA, 22 nt, Human
cugaagccacgauagcuuccua

SEQ ID NO: 689229 - RNA, 22 nt, Human
gugaaccucugaaaggcaguga

SEQ ID NO: 689230 - RNA, 22 nt, Human
agagaccuuccugacuccagag

SEQ ID NO: 689231 - RNA, 22 nt, Human
caugucuuucucaucacaucua

SEQ ID NO: 689232 - RNA, 22 nt, Human
auuaagaucauuguagaagauu

SEQ ID NO: 689233 - RNA, 22 nt, Human
gaggugaguggggucuccaggg

SEQ ID NO: 689234 - RNA, 22 nt, Human
aacagaguuucaaauaacaucu

SEQ ID NO: 689235 - RNA, 22 nt, Human
cauuugcaaaccaacaagauga

SEQ ID NO: 689236 - RNA, 22 nt, Human
auucaccuguuaguaaaaaucu

SEQ ID NO: 689237 - RNA, 22 nt, Human
aaggcauaggacaaaucaguga

SEQ ID NO: 689238 - RNA, 22 nt, Human
uuauuccagugggugguuucuc

SEQ ID NO: 689239 - RNA, 22 nt, Human
aaggcuguuuauuagaaaaagu

SEQ ID NO: 689240 - RNA, 22 nt, Human
uuucaguuuuugcucgauguau

SEQ ID NO: 689241 - RNA, 22 nt, Human
cugggcagcacaucaucguauc

SEQ ID NO: 689242 - RNA, 22 nt, Human
acuucuugggacccuggcaccg

SEQ ID NO: 689243 - RNA, 19 nt, Human
ggcuggcaagugacagugu

SEQ ID NO: 689244 - RNA, 16 nt, Human
ccuuucucugccuucc

SEQ ID NO: 689245 - RNA, 22 nt, Human
caaaugaauauuuccauggguu

SEQ ID NO: 689246 - RNA, 23 nt, Human
ucucauuucccuugaucuaucuu

SEQ ID NO: 689247 - RNA, 22 nt, Human
agagaaggguguagccugggcc

SEQ ID NO: 689248 - RNA, 22 nt, Human
acuauucacagauucaguguuc

SEQ ID NO: 689249 - RNA, 22 nt, Human
acagcauaaucacuucuuucuu

SEQ ID NO: 689250 - RNA, 22 nt, Human
uggcugagagcaauugacucug

SEQ ID NO: 689251 - RNA, 22 nt, Human
gaauuuugcuuuuaugucaagu

SEQ ID NO: 689252 - RNA, 22 nt, Human
uacagccuccacaggccaagug

SEQ ID NO: 689253 - RNA, 22 nt, Human
gagacauggcaaaagcacuggu

SEQ ID NO: 689254 - RNA, 22 nt, Human
agcauuuaauccuacauagauc

SEQ ID NO: 689255 - RNA, 22 nt, Human
ggugggcacauucagucucugu

SEQ ID NO: 689256 - RNA, 22 nt, Human
acugggccgaaauggacagaau

SEQ ID NO: 689257 - RNA, 22 nt, Human
gaaacaauuuuuguugucuaag

SEQ ID NO: 689258 - RNA, 22 nt, Human
caggacaguuugcuuugcccug

SEQ ID NO: 689259 - RNA, 20 nt, Human
uggucuggagccagugagga

SEQ ID NO: 689260 - RNA, 22 nt, Human
gaugcauugcaucgaguagcuu

SEQ ID NO: 689261 - RNA, 22 nt, Human
gaaaugcagaaccugagaccau

SEQ ID NO: 689262 - RNA, 22 nt, Human
acacuuuaucucaucucagaca

SEQ ID NO: 689263 - RNA, 22 nt, Human
uuguauuccagccaccacaggc

SEQ ID NO: 689264 - RNA, 22 nt, Human
agguauuuaugagagcacauau

SEQ ID NO: 689265 - RNA, 23 nt, Human
aaagacugaggaaagucucuguc

SEQ ID NO: 689266 - RNA, 19 nt, Human
auucucugguuugcuggcu

SEQ ID NO: 689267 - RNA, 22 nt, Human
cucccugaguuuguggcuaagu

SEQ ID NO: 689268 - RNA, 20 nt, Human
accuuucaaaugauucagca

SEQ ID NO: 689269 - RNA, 22 nt, Human
aucuuggggacugucucuugua

SEQ ID NO: 689270 - RNA, 22 nt, Human
cagaagucuuucuguuucaccu

SEQ ID NO: 689271 - RNA, 22 nt, Human
aaguguuuggggaucauuuuaa

SEQ ID NO: 689272 - RNA, 22 nt, Human
gcagagauuaugccauggaaag

SEQ ID NO: 689273 - RNA, 22 nt, Human
ugauucuguaaacaugucuuua

SEQ ID NO: 689274 - RNA, 22 nt, Human
gcaggcugccaccuucugaguu

SEQ ID NO: 689275 - RNA, 22 nt, Human
aggaaucugugguuuuaacagg

SEQ ID NO: 689276 - RNA, 22 nt, Human
guggucaucuggguuuguggca

SEQ ID NO: 689277 - RNA, 22 nt, Human
ccagcucaucucagugaaaugc

SEQ ID NO: 689278 - RNA, 22 nt, Human
aguugcugcuucucucuagaga

SEQ ID NO: 689279 - RNA, 22 nt, Human
ggccagaggccacagcuguguc

SEQ ID NO: 689280 - RNA, 22 nt, Human
agucagagacccuagaucuaau

SEQ ID NO: 689281 - RNA, 22 nt, Human
cuagggagggauguuggcauga

SEQ ID NO: 689282 - RNA, 22 nt, Human
agcuuuaucacaauauuggcua

SEQ ID NO: 689283 - RNA, 22 nt, Human
aucuggggagguaucuguaguc

SEQ ID NO: 689284 - RNA, 19 nt, Human
ucagugugacuuggucagu

SEQ ID NO: 689285 - RNA, 22 nt, Human
ugaggagccacucuagcaguca

SEQ ID NO: 689286 - RNA, 22 nt, Human
cugccccugcucauggcugucc

SEQ ID NO: 689287 - RNA, 22 nt, Human
gccccagaaggggaaagccugg

SEQ ID NO: 689288 - RNA, 22 nt, Human
ggucacagcuuuuucagcagca

SEQ ID NO: 689289 - RNA, 22 nt, Human
gcuuucaaggaauuugguauuu

SEQ ID NO: 689290 - RNA, 22 nt, Human
gggaagagggagcuggaaugau

SEQ ID NO: 689291 - RNA, 22 nt, Human
ugggcagaaaucaguaucagau

SEQ ID NO: 689292 - RNA, 22 nt, Human
agagcuggggcauaaaugccac

SEQ ID NO: 689293 - RNA, 22 nt, Human
auuuagagaauaagacauaaau

SEQ ID NO: 689294 - RNA, 22 nt, Human
agugacagcugggaaggugaaa

SEQ ID NO: 689295 - RNA, 22 nt, Human
uucucccugccaaagcugccuc

SEQ ID NO: 689296 - RNA, 22 nt, Human
uaggcucacauagcacuaagug

SEQ ID NO: 689297 - RNA, 22 nt, Human
uucuaguccuagaaacuacaug

SEQ ID NO: 689298 - RNA, 22 nt, Human
cugggccuagaggaagcugaca

SEQ ID NO: 689299 - RNA, 22 nt, Human
uuucagagucuggcugcagccu

SEQ ID NO: 689300 - RNA, 22 nt, Human
gggcaaaaccugggcaucauga

SEQ ID NO: 689301 - RNA, 22 nt, Human
gggaagcagcauugugcuggcu

SEQ ID NO: 689302 - RNA, 22 nt, Human
uggaaauagcuccaguuucauu

SEQ ID NO: 689303 - RNA, 22 nt, Human
ucugacugaaccaauuauuuac

SEQ ID NO: 689304 - RNA, 18 nt, Human
uggagcugagggcaaugc

SEQ ID NO: 689305 - RNA, 23 nt, Human
uggggagaguuacccuggaagcg

SEQ ID NO: 689306 - RNA, 20 nt, Human
auguuaaauagcauuuagag

SEQ ID NO: 689307 - RNA, 22 nt, Human
aggcuguguccucauuuuauau

SEQ ID NO: 689308 - RNA, 22 nt, Human
uaaugcaaggaauuccaaguag

SEQ ID NO: 689309 - RNA, 22 nt, Human
aucaggauggguuuggcuuagg

SEQ ID NO: 689310 - RNA, 22 nt, Human
uucuaccuacccucugcauaca

SEQ ID NO: 689311 - RNA, 22 nt, Human
aggagccauggaggugaggcgg

SEQ ID NO: 689312 - RNA, 22 nt, Human
ucugucaucaaauaugcuuucu

SEQ ID NO: 689313 - RNA, 22 nt, Human
acugagcauggcucacagagag

SEQ ID NO: 689314 - RNA, 22 nt, Human
uugcccuuguggaguuuacaug

SEQ ID NO: 689315 - RNA, 22 nt, Human
uccagucaacuuaaucucuuua

SEQ ID NO: 689316 - RNA, 22 nt, Human
ccugauucugccacuacuagcc

SEQ ID NO: 689317 - RNA, 22 nt, Human
auagauacauuagguaacuugu

SEQ ID NO: 689318 - RNA, 22 nt, Human
agauaaaaugguucaaaggcua

SEQ ID NO: 689319 - RNA, 22 nt, Human
cuguuguauuuccaacuaugua

SEQ ID NO: 689320 - RNA, 22 nt, Human
ugucccacugacuucacaucca

SEQ ID NO: 689321 - RNA, 22 nt, Human
agucugucuacuuaaagucugu

SEQ ID NO: 689322 - RNA, 22 nt, Human
aagcccugccacccauucacug

SEQ ID NO: 689323 - RNA, 22 nt, Human
ccugccagcauggcuuaucucc

SEQ ID NO: 689324 - RNA, 19 nt, Human
gucucuggauuucaggucc

SEQ ID NO: 689325 - RNA, 22 nt, Human
uuuaaggaugaugugauauaua

SEQ ID NO: 689326 - RNA, 22 nt, Human
guaagaggaucaaggcggugca

SEQ ID NO: 689327 - RNA, 22 nt, Human
aauuucagaccauuugcaauua

SEQ ID NO: 689328 - RNA, 22 nt, Human
aaggaaaggaugagcaugcauu

SEQ ID NO: 689329 - RNA, 22 nt, Human
gaagcaaagagcuagugccgcu

SEQ ID NO: 689330 - RNA, 22 nt, Human
cugcccugugaggguccuuggg

SEQ ID NO: 689331 - RNA, 22 nt, Human
cccagcuccaagggacagcgaa

SEQ ID NO: 689332 - RNA, 22 nt, Human
ugccaggcccucccacagauua

SEQ ID NO: 689333 - RNA, 22 nt, Human
uuuggcaagugggaaauuagua

SEQ ID NO: 689334 - RNA, 22 nt, Human
uucagaggggcuaaguacuugc

SEQ ID NO: 689335 - RNA, 22 nt, Human
uucagcaucuacauauuuagaa

SEQ ID NO: 689336 - RNA, 18 nt, Human
acagugauuguucuaugc

SEQ ID NO: 689337 - RNA, 22 nt, Human
ugucuuaauuuggaugauguuu

SEQ ID NO: 689338 - RNA, 22 nt, Human
gcaugauagcuaacuccccuca

SEQ ID NO: 689339 - RNA, 22 nt, Human
uugcaacuucucccaucacucu

SEQ ID NO: 689340 - RNA, 23 nt, Human
uggcaaggaaugggauggagacu

SEQ ID NO: 689341 - RNA, 22 nt, Human
ugacaauggauauuaguugugg

SEQ ID NO: 689342 - RNA, 22 nt, Human
cugcuacaccggaauagugaca

SEQ ID NO: 689343 - RNA, 22 nt, Human
cugagggccuucuaugcugagc

SEQ ID NO: 689344 - RNA, 20 nt, Human
ucuaauuaaaauugucuagu

SEQ ID NO: 689345 - RNA, 22 nt, Human
auguuuauuuugcagaguaggg

SEQ ID NO: 689346 - RNA, 22 nt, Human
uuaaagucuauguacuacacuu

SEQ ID NO: 689347 - RNA, 22 nt, Human
gugggcaguggggucuucugcc

SEQ ID NO: 689348 - RNA, 22 nt, Human
ugugcuauuacacauuuauuua

SEQ ID NO: 689349 - RNA, 22 nt, Human
ggcagggaggaggugaaaguga

SEQ ID NO: 689350 - RNA, 22 nt, Human
agagugaaggccagguuacagu

SEQ ID NO: 689351 - RNA, 22 nt, Human
guucuugccagcauccucaggu

SEQ ID NO: 689352 - RNA, 22 nt, Human
ccagaacugggcaacagaaagu

SEQ ID NO: 689353 - RNA, 22 nt, Human
auugagaauccauuugagauga

SEQ ID NO: 689354 - RNA, 22 nt, Human
guggcccaggcacccugaugac

SEQ ID NO: 689355 - RNA, 22 nt, Human
uagcauuccuuguggcuucuga

SEQ ID NO: 689356 - RNA, 22 nt, Human
gcugaauaauucuuuguugugg

SEQ ID NO: 689357 - RNA, 22 nt, Human
agcuguggggcaggcagcgagg

SEQ ID NO: 689358 - RNA, 22 nt, Human
cuggagggcuggacuaaggaaa

SEQ ID NO: 689359 - RNA, 22 nt, Human
uuuguagaacuguagaacaaug

SEQ ID NO: 689360 - RNA, 23 nt, Human
cuguuauauucuagggagcugca

SEQ ID NO: 689361 - RNA, 20 nt, Human
agccaaaggagaacagugcu

SEQ ID NO: 689362 - RNA, 22 nt, Human
ggcaccuggagguuuacuggau

SEQ ID NO: 689363 - RNA, 22 nt, Human
gucaggauuuuaaaaucccagu

SEQ ID NO: 689364 - RNA, 22 nt, Human
aagggaggggauguaagccugg

SEQ ID NO: 689365 - RNA, 22 nt, Human
ggcaggugacggggaugaguau

SEQ ID NO: 689366 - RNA, 22 nt, Human
cccuaggggcaaugauggugcu

SEQ ID NO: 689367 - RNA, 22 nt, Human
agaggucuaugcuaggggaacu

SEQ ID NO: 689368 - RNA, 22 nt, Human
guggucaucuaacuaaauuuuc

SEQ ID NO: 689369 - RNA, 22 nt, Human
gcacaauggaccgugugcucug

SEQ ID NO: 689370 - RNA, 22 nt, Human
cugggaaauauaauaaaguggu

SEQ ID NO: 689371 - RNA, 22 nt, Human
uagggguguuucgagagagguu

SEQ ID NO: 689372 - RNA, 22 nt, Human
ucagaguguuuuacuaaacaag

SEQ ID NO: 689373 - RNA, 22 nt, Human
gggagggccaggcucacccagg

SEQ ID NO: 689374 - RNA, 22 nt, Human
ccugagccgagcgcucuuucuc

SEQ ID NO: 689375 - RNA, 22 nt, Human
ccaggagagcagaagcccaggc

SEQ ID NO: 689376 - RNA, 22 nt, Human
ucagcacuuggauuucagagau

SEQ ID NO: 689377 - RNA, 22 nt, Human
cugucuguacugagaguucugu

SEQ ID NO: 689378 - RNA, 22 nt, Human
cugaagccaugugcucacuggu

SEQ ID NO: 689379 - RNA, 22 nt, Human
caaagaccauguggccugaaaa

SEQ ID NO: 689380 - RNA, 22 nt, Human
agguggcaugagacuguaccag

SEQ ID NO: 689381 - RNA, 22 nt, Human
agcuccugauacaugcaggaau

SEQ ID NO: 689382 - RNA, 22 nt, Human
gugcaugugucuuuauaguagc

SEQ ID NO: 689383 - RNA, 22 nt, Human
gggaucugaguugucaggaagg

SEQ ID NO: 689384 - RNA, 22 nt, Human
cuggccaggcucucacgugguc

SEQ ID NO: 689385 - RNA, 22 nt, Human
uuucaguuguccuguuaauagc

SEQ ID NO: 689386 - RNA, 22 nt, Human
uugcaccauuucacuuccauua

SEQ ID NO: 689387 - RNA, 22 nt, Human
uaaugucuagaucagaccucga

SEQ ID NO: 689388 - RNA, 22 nt, Human
cccaugccuucugacucacagg

SEQ ID NO: 689389 - RNA, 21 nt, Human
uccagcuccugccacuccuua

SEQ ID NO: 689390 - RNA, 22 nt, Human
uccuccagcuguauccugccug

SEQ ID NO: 689391 - RNA, 22 nt, Human
uuaggaaaauggaguccuuuua

SEQ ID NO: 689392 - RNA, 22 nt, Human
caggaaggaaaggguguggaga

SEQ ID NO: 689393 - RNA, 22 nt, Human
agaacaaaucgauggaagccug

SEQ ID NO: 689394 - RNA, 22 nt, Human
uacaugaauguuucaauauugu

SEQ ID NO: 689395 - RNA, 22 nt, Human
cucuccuuugaagcaacuguau

SEQ ID NO: 689396 - RNA, 22 nt, Human
cguccauauucaugagcugagu

SEQ ID NO: 689397 - RNA, 23 nt, Human
agauuuggaaagcugaguggcgu

SEQ ID NO: 689398 - RNA, 22 nt, Human
ucaguuaacaacuauuuauuga

SEQ ID NO: 689399 - RNA, 22 nt, Human
aagcagaguuagcuugucaccu

SEQ ID NO: 689400 - RNA, 22 nt, Human
ggccuuggauccaagcugcggc

SEQ ID NO: 689401 - RNA, 22 nt, Human
aggaucauguggucauuccuga

SEQ ID NO: 689402 - RNA, 22 nt, Human
guuaacauucaauuaaacaguc

SEQ ID NO: 689403 - RNA, 22 nt, Human
gaaaguuuauagguuauauaau

SEQ ID NO: 689404 - RNA, 22 nt, Human
ucagaggcuucuggccagucug

SEQ ID NO: 689405 - RNA, 22 nt, Human
gggaggaaagagaaguggucca

SEQ ID NO: 689406 - RNA, 22 nt, Human
uuacuguucauguuguacacuu

SEQ ID NO: 689407 - RNA, 22 nt, Human
uggagcugccuggcaccuacag

SEQ ID NO: 689408 - RNA, 22 nt, Human
cugaaaggagagcugcaaggau

SEQ ID NO: 689409 - RNA, 22 nt, Human
aaaugguaguagcauuccauau

SEQ ID NO: 689410 - RNA, 22 nt, Human
ucuggaguggacccagagcacu

SEQ ID NO: 689411 - RNA, 22 nt, Human
gagggugggccagauaugaggg

SEQ ID NO: 689412 - RNA, 20 nt, Human
uccaugcaguuuccauacag

SEQ ID NO: 689413 - RNA, 22 nt, Human
gcacagcaauuucuauaagcuc

SEQ ID NO: 689414 - RNA, 22 nt, Human
cccugcugucccucaguccugc

SEQ ID NO: 689415 - RNA, 22 nt, Human
uagaguccuucauucugugcag

SEQ ID NO: 689416 - RNA, 22 nt, Human
ugcagcuuuaagcuuucaucag

SEQ ID NO: 689417 - RNA, 22 nt, Human
accagggccgcgggcgacuagc

SEQ ID NO: 689418 - RNA, 22 nt, Human
aacugcuuaucuuugguagaug

SEQ ID NO: 689419 - RNA, 22 nt, Human
auuuaacuuucagccccucuuc

SEQ ID NO: 689420 - RNA, 22 nt, Human
gaggcagccucaguggaccucg

SEQ ID NO: 689421 - RNA, 22 nt, Human
cagcuguuguguaucaggcaga

SEQ ID NO: 689422 - RNA, 22 nt, Human
gccuggagacaaggacaaaggg

SEQ ID NO: 689423 - RNA, 22 nt, Human
aaagcugccaaggagaauacua

SEQ ID NO: 689424 - RNA, 22 nt, Human
ucugcgcugccuugauccuugg

SEQ ID NO: 689425 - RNA, 22 nt, Human
cacaguuucaauaauuauucuu

SEQ ID NO: 689426 - RNA, 22 nt, Human
acucuguacuuucuuguugugu

SEQ ID NO: 689427 - RNA, 19 nt, Human
gcaggcccagucgggcugg

SEQ ID NO: 689428 - RNA, 22 nt, Human
uguggaagaacuucuugcuugg

SEQ ID NO: 689429 - RNA, 22 nt, Human
ccaaagugcugggauucaggca

SEQ ID NO: 689430 - RNA, 22 nt, Human
cagcagaaauggauuuugagau

SEQ ID NO: 689431 - RNA, 22 nt, Human
ugcaugcauguuuuuacccaca

SEQ ID NO: 689432 - RNA, 22 nt, Human
acuuuuugcauaguaagugucu

SEQ ID NO: 689433 - RNA, 18 nt, Human
gagcagaggcucaacugg

SEQ ID NO: 689434 - RNA, 22 nt, Human
uucucugaguacguuucagugu

SEQ ID NO: 689435 - RNA, 22 nt, Human
aggcagggucuugcuauguugc

SEQ ID NO: 689436 - RNA, 22 nt, Human
gggccugcagguucugagaggc

SEQ ID NO: 689437 - RNA, 22 nt, Human
agucucuuacccaagcagaaug

SEQ ID NO: 689438 - RNA, 22 nt, Human
ccugcagguuucccccggacgg

SEQ ID NO: 689439 - RNA, 22 nt, Human
aggcuucccagcugagcucagc

SEQ ID NO: 689440 - RNA, 22 nt, Human
gugcugcagagucucgugccgc

SEQ ID NO: 689441 - RNA, 21 nt, Human
agauccagugccauaaggccc

SEQ ID NO: 689442 - RNA, 22 nt, Human
gaguccugcuuucaauucuuuu

SEQ ID NO: 689443 - RNA, 22 nt, Human
ugaugacagcaaaaaaugcuag

SEQ ID NO: 689444 - RNA, 22 nt, Human
cucugagggcucgagggacgcg

SEQ ID NO: 689445 - RNA, 22 nt, Human
ugccugggguuggcaaacugcu

SEQ ID NO: 689446 - RNA, 22 nt, Human
ggacauggaaaucggcuugcuc

SEQ ID NO: 689447 - RNA, 22 nt, Human
gcugggcaccucucccagauug

SEQ ID NO: 689448 - RNA, 22 nt, Human
uacuuacauaaaaacugaaugu

SEQ ID NO: 689449 - RNA, 22 nt, Human
ggauacaagguguucuaucacu

SEQ ID NO: 689450 - RNA, 22 nt, Human
ucccagaggucucugcugguuc

SEQ ID NO: 689451 - RNA, 22 nt, Human
ugcuaucucuauauccauuuau

SEQ ID NO: 689452 - RNA, 22 nt, Human
ccucugagagaaggccuucagc

SEQ ID NO: 689453 - RNA, 22 nt, Human
aaggcauggcaggguuuacaca

SEQ ID NO: 689454 - RNA, 22 nt, Human
ugcugagacaccuaagguaaau

SEQ ID NO: 689455 - RNA, 22 nt, Human
ucaucugucccaggcuuuuuuc

SEQ ID NO: 689456 - RNA, 22 nt, Human
acguuaaacauuuagcauagua

SEQ ID NO: 689457 - RNA, 22 nt, Human
uuuggcacauucugucacauuc

SEQ ID NO: 689458 - RNA, 22 nt, Human
ugccuuuucuguagcucuggaa

SEQ ID NO: 689459 - RNA, 22 nt, Human
uccaggaggcucugguugacgu

SEQ ID NO: 689460 - RNA, 22 nt, Human
gccuuuccugcucuggcauuca

SEQ ID NO: 689461 - RNA, 22 nt, Human
cagcagcucacugaauaaugac

SEQ ID NO: 689462 - RNA, 22 nt, Human
uacagaccaguaguucucagcg

SEQ ID NO: 689463 - RNA, 22 nt, Human
uuacuuuagggauguuuugcuu

SEQ ID NO: 689464 - RNA, 20 nt, Human
gcuguugccaguacagaugg

SEQ ID NO: 689465 - RNA, 18 nt, Human
guggaggguucucagaau

SEQ ID NO: 689466 - RNA, 23 nt, Human
gugcuugaaagaugcagaauuaa

SEQ ID NO: 689467 - RNA, 21 nt, Human
uucagcaagcacucuggacac

SEQ ID NO: 689468 - RNA, 22 nt, Human
gcacagcccugagcgcaugucu

SEQ ID NO: 689469 - RNA, 19 nt, Human
ucuagacaccaaaguuguc

SEQ ID NO: 689470 - RNA, 22 nt, Human
aguaugaaaguuaaucaauuua

SEQ ID NO: 689471 - RNA, 20 nt, Human
agccagccacuuccugcucc

SEQ ID NO: 689472 - RNA, 22 nt, Human
ugcacagaugcuaggaggugaa

SEQ ID NO: 689473 - RNA, 22 nt, Human
ggcugcucuucuuggcgaccuc

SEQ ID NO: 689474 - RNA, 22 nt, Human
uggcugucagucgccugcauuc

SEQ ID NO: 689475 - RNA, 22 nt, Human
ucagcugcauaagucaccuugc

SEQ ID NO: 689476 - RNA, 22 nt, Human
aaaguuuuauucaagcauuagu

SEQ ID NO: 689477 - RNA, 22 nt, Human
uccuucagugucccgcucaggu

SEQ ID NO: 689478 - RNA, 22 nt, Human
ggucuccugaggcugccacacc

SEQ ID NO: 689479 - RNA, 22 nt, Human
aggaugggccugggauaugcuu

SEQ ID NO: 689480 - RNA, 22 nt, Human
agcucugcuucuugggaagaug

SEQ ID NO: 689481 - RNA, 22 nt, Human
uacauacauguauguguguauu

SEQ ID NO: 689482 - RNA, 22 nt, Human
aaagcaggcagcaggcuggauu

SEQ ID NO: 689483 - RNA, 22 nt, Human
aagccaugcaagccacaaggug

SEQ ID NO: 689484 - RNA, 16 nt, Human
agcagaggugagugaa

SEQ ID NO: 689485 - RNA, 22 nt, Human
gcagagaguugggcugcgccag

SEQ ID NO: 689486 - RNA, 22 nt, Human
aaaauaugacugugcuccuuaa

SEQ ID NO: 689487 - RNA, 22 nt, Human
cagguggguguaugaaugcaaa

SEQ ID NO: 689488 - RNA, 23 nt, Human
acaugcaaaaaucacagucuccu

SEQ ID NO: 689489 - RNA, 22 nt, Human
auacauuagcucauaugauuaa

SEQ ID NO: 689490 - RNA, 22 nt, Human
auggcugcucuggauggagucc

SEQ ID NO: 689491 - RNA, 22 nt, Human
accuucaagaaacauuuccuug

SEQ ID NO: 689492 - RNA, 22 nt, Human
cugccuuggcccuaguucaugg

SEQ ID NO: 689493 - RNA, 22 nt, Human
ccucucauagucuguauccuuu

SEQ ID NO: 689494 - RNA, 22 nt, Human
cugcaccacagccugaggcagc

SEQ ID NO: 689495 - RNA, 22 nt, Human
gcagugaaaaagugcacccugu

SEQ ID NO: 689496 - RNA, 22 nt, Human
aaacugaggaguuagacuaggg

SEQ ID NO: 689497 - RNA, 22 nt, Human
ccagaggaugcuggucagccuc

SEQ ID NO: 689498 - RNA, 22 nt, Human
acugcuuacaaaaggaaagaau

SEQ ID NO: 689499 - RNA, 22 nt, Human
caagucugucugcuccugugug

SEQ ID NO: 689500 - RNA, 20 nt, Human
cucugcugcgcaucccacuu

SEQ ID NO: 689501 - RNA, 22 nt, Human
agaagugagugugacucagcag

SEQ ID NO: 689502 - RNA, 22 nt, Human
ugggccugugaugcugggcuau

SEQ ID NO: 689503 - RNA, 21 nt, Human
ugcaguucaagucaaucuacu

SEQ ID NO: 689504 - RNA, 22 nt, Human
acuguaaaaugagauauguaua

SEQ ID NO: 689505 - RNA, 21 nt, Human
guuuuaagggagaaaaccuag

SEQ ID NO: 689506 - RNA, 22 nt, Human
gagggccaaagagcaagagccu

SEQ ID NO: 689507 - RNA, 20 nt, Human
uacccuggcuaugcuucuga

SEQ ID NO: 689508 - RNA, 22 nt, Human
ggcuguccaccuaccaugccgg

SEQ ID NO: 689509 - RNA, 22 nt, Human
ucucagagccuaacuaaccuaa

SEQ ID NO: 689510 - RNA, 22 nt, Human
uucuuuucuuggcaggaguaga

SEQ ID NO: 689511 - RNA, 22 nt, Human
guaauugaacauuaaguugaag

SEQ ID NO: 689512 - RNA, 22 nt, Human
agcagcugccacuggaauagga

SEQ ID NO: 689513 - RNA, 22 nt, Human
aaugacaagacauagucucuga

SEQ ID NO: 689514 - RNA, 22 nt, Human
gcaaauugcuagcuuucucugc

SEQ ID NO: 689515 - RNA, 20 nt, Human
ccagagcagccacugaaguu

SEQ ID NO: 689516 - RNA, 22 nt, Human
aguucacugcuuaagccuuuga

SEQ ID NO: 689517 - RNA, 22 nt, Human
uauucagaggugaaguagggag

SEQ ID NO: 689518 - RNA, 22 nt, Human
uccacagugguggaauuguuca

SEQ ID NO: 689519 - RNA, 21 nt, Human
ugggugggcagagucucuuca

SEQ ID NO: 689520 - RNA, 22 nt, Human
cugcagaauggggccaagugga

SEQ ID NO: 689521 - RNA, 22 nt, Human
uggcagcaguagccaccccagc

SEQ ID NO: 689522 - RNA, 22 nt, Human
uuucuacauuuguaaccagauu

SEQ ID NO: 689523 - RNA, 21 nt, Human
cacacaguggagugcccuugc

SEQ ID NO: 689524 - RNA, 22 nt, Human
ugaacauugucacauuccuagc

SEQ ID NO: 689525 - RNA, 22 nt, Human
ugcauuuaagaaaacaugaguc

SEQ ID NO: 689526 - RNA, 22 nt, Human
uacuauuuuugcaacguauaca

SEQ ID NO: 689527 - RNA, 22 nt, Human
uuauuucauauaauguuaucaa

SEQ ID NO: 689528 - RNA, 22 nt, Human
auccgcuuaucucagcuggcag

SEQ ID NO: 689529 - RNA, 22 nt, Human
gggccugggaacuugcauuuag

SEQ ID NO: 689530 - RNA, 22 nt, Human
gagcuuggaugucuuuuguuca

SEQ ID NO: 689531 - RNA, 22 nt, Human
gaagugucuccguuuuuaaagg

SEQ ID NO: 689532 - RNA, 22 nt, Human
ucucugggaucagguggcccag

SEQ ID NO: 689533 - RNA, 22 nt, Human
auucuucauaccuacugagguu

SEQ ID NO: 689534 - RNA, 22 nt, Human
uugaucaaaucagcuacugagg

SEQ ID NO: 689535 - RNA, 22 nt, Human
gcucagagggaacaaggggcug

SEQ ID NO: 689536 - RNA, 22 nt, Human
aggcagggcucauuucuuaggc

SEQ ID NO: 689537 - RNA, 22 nt, Human
cuuggcuggaacuccugagaaa

SEQ ID NO: 689538 - RNA, 22 nt, Human
aaagcuguaaugcaugcuuucu

SEQ ID NO: 689539 - RNA, 22 nt, Human
auuuugcuggucugaauuacuu

SEQ ID NO: 689540 - RNA, 22 nt, Human
ggucccuggggaacuaggcugu

SEQ ID NO: 689541 - RNA, 22 nt, Human
agaugacagccaaggagaugaa

SEQ ID NO: 689542 - RNA, 22 nt, Human
cacaaacaucaauccuguuuuc

SEQ ID NO: 689543 - RNA, 22 nt, Human
ggcagugcaaggcagccuggau

SEQ ID NO: 689544 - RNA, 22 nt, Human
ggcugugccucuggcagcacau

SEQ ID NO: 689545 - RNA, 21 nt, Human
agaguaauuccugcuggaaag

SEQ ID NO: 689546 - RNA, 22 nt, Human
gagccaagcaccacauuaaguu

SEQ ID NO: 689547 - RNA, 22 nt, Human
uagcauuccaucacucagcacc

SEQ ID NO: 689548 - RNA, 22 nt, Human
uaacucuagucccaggcaugaa

SEQ ID NO: 689549 - RNA, 22 nt, Human
aaggaagguucauagucaaaga

SEQ ID NO: 689550 - RNA, 22 nt, Human
ugucuggacagagauucucaau

SEQ ID NO: 689551 - RNA, 22 nt, Human
ggcuccaggagaugcugggcag

SEQ ID NO: 689552 - RNA, 22 nt, Human
cuguagagaaagcauggaagcu

SEQ ID NO: 689553 - RNA, 22 nt, Human
uuaagugucauaauuuccaaga

SEQ ID NO: 689554 - RNA, 22 nt, Human
aggcuaugauauuauugagaca

SEQ ID NO: 689555 - RNA, 22 nt, Human
aaagcaaacagaaccccaagcu

SEQ ID NO: 689556 - RNA, 22 nt, Human
ugaagcagauggucuggucauu

SEQ ID NO: 689557 - RNA, 22 nt, Human
gauccguugcaaccaauuagca

SEQ ID NO: 689558 - RNA, 22 nt, Human
ucuuucagcucuucaggaccca

SEQ ID NO: 689559 - RNA, 22 nt, Human
agccagaggccagccugccuca

SEQ ID NO: 689560 - RNA, 22 nt, Human
cuggagcucagcccagguucca

SEQ ID NO: 689561 - RNA, 22 nt, Human
gagaggggcgcgcagcucgcga

SEQ ID NO: 689562 - RNA, 22 nt, Human
caggcacacauccgugagagau

SEQ ID NO: 689563 - RNA, 22 nt, Human
agauacaacucagaaguguggu

SEQ ID NO: 689564 - RNA, 22 nt, Human
gcagaagcccggucagcgcacg

SEQ ID NO: 689565 - RNA, 22 nt, Human
aagaaugucucuggugaggcgc

SEQ ID NO: 689566 - RNA, 22 nt, Human
agauuuuggcuggcuggagaga

SEQ ID NO: 689567 - RNA, 17 nt, Human
ggcuuccagguggcucu

SEQ ID NO: 689568 - RNA, 22 nt, Human
cuuaagauuugagauaccuaau

SEQ ID NO: 689569 - RNA, 22 nt, Human
cuguacaggucaaugauaagau

SEQ ID NO: 689570 - RNA, 22 nt, Human
gagccaggaggcagagacugca

SEQ ID NO: 689571 - RNA, 22 nt, Human
ccaggaacaaagccccauccac

SEQ ID NO: 689572 - RNA, 22 nt, Human
aggccacaguacuuugcagacc

SEQ ID NO: 689573 - RNA, 21 nt, Human
agaaaaguauuugaaucaaga

SEQ ID NO: 689574 - RNA, 20 nt, Human
acagcagccuugcuagaaac

SEQ ID NO: 689575 - RNA, 22 nt, Human
uccugggccuguacuccauccg

SEQ ID NO: 689576 - RNA, 22 nt, Human
caguauuuccucuucuuaacuu

SEQ ID NO: 689577 - RNA, 22 nt, Human
aaaauagcagggaugugggaaa

SEQ ID NO: 689578 - RNA, 22 nt, Human
cagggagcucugggccggacuc

SEQ ID NO: 689579 - RNA, 22 nt, Human
cuuggagagggagaaaaauaac

SEQ ID NO: 689580 - RNA, 22 nt, Human
uucaggauucugugucugacaa

SEQ ID NO: 689581 - RNA, 20 nt, Human
ugccuggccuuucucugccc

SEQ ID NO: 689582 - RNA, 22 nt, Human
cauuguuaccaucuuuuaccua

SEQ ID NO: 689583 - RNA, 22 nt, Human
agacgagggccuggcacacagu

SEQ ID NO: 689584 - RNA, 22 nt, Human
auacuguuuugugacuuaucuu

SEQ ID NO: 689585 - RNA, 22 nt, Human
cauguaguccuaaugcugguga

SEQ ID NO: 689586 - RNA, 23 nt, Human
agagagaguuugugucagguacc

SEQ ID NO: 689587 - RNA, 22 nt, Human
gugugucagguacugugcuagg

SEQ ID NO: 689588 - RNA, 22 nt, Human
cuggcugugcugacugagaggg

SEQ ID NO: 689589 - RNA, 22 nt, Human
cugccuuggaaaaugugguaau

SEQ ID NO: 689590 - RNA, 22 nt, Human
ucugagcugcagaguggggugg

SEQ ID NO: 689591 - RNA, 22 nt, Human
gaauuuuaaguguucgccucuu

SEQ ID NO: 689592 - RNA, 22 nt, Human
ggucugaggugggacccaggaa

SEQ ID NO: 689593 - RNA, 22 nt, Human
aguccagaucaugcagcaaacc

SEQ ID NO: 689594 - RNA, 22 nt, Human
uucugaugauggcggcuggagc

SEQ ID NO: 689595 - RNA, 22 nt, Human
uuuaacauguucaagaaacaua

SEQ ID NO: 689596 - RNA, 18 nt, Human
acacaggcugacagcacc

SEQ ID NO: 689597 - RNA, 22 nt, Human
gccagguugcugacgacgaucu

SEQ ID NO: 689598 - RNA, 22 nt, Human
ucugugcggucuguguuaugaa

SEQ ID NO: 689599 - RNA, 19 nt, Human
auaaauaaaaagugggaga

SEQ ID NO: 689600 - RNA, 22 nt, Human
uucaaacaaaacuguucccaua

SEQ ID NO: 689601 - RNA, 20 nt, Human
agagugagacuccaucucag

SEQ ID NO: 689602 - RNA, 22 nt, Human
aguagacauuuugcaacaucug

SEQ ID NO: 689603 - RNA, 22 nt, Human
gucugggcuccuggcaggcagc

SEQ ID NO: 689604 - RNA, 22 nt, Human
ucauugauaaaguacugcuuuu

SEQ ID NO: 689605 - RNA, 22 nt, Human
cugugcaguaggucagggcugg

SEQ ID NO: 689606 - RNA, 22 nt, Human
aagcaguuacuauuuacuauua

SEQ ID NO: 689607 - RNA, 22 nt, Human
ucacugcaaucucugccuucca

SEQ ID NO: 689608 - RNA, 22 nt, Human
agugcagaguacauuuguggca

SEQ ID NO: 689609 - RNA, 22 nt, Human
agagaacauauuuuguaugauu

SEQ ID NO: 689610 - RNA, 22 nt, Human
cagcucuggcgucagggagcga

SEQ ID NO: 689611 - RNA, 22 nt, Human
uaacaguaaaguaaguuagcuu

SEQ ID NO: 689612 - RNA, 22 nt, Human
gagcuaagcuauguuaugcagc

SEQ ID NO: 689613 - RNA, 22 nt, Human
acacugaguuuuaccaggcaca

SEQ ID NO: 689614 - RNA, 22 nt, Human
agggguuggacauaagacagaa

SEQ ID NO: 689615 - RNA, 23 nt, Human
cuguccaggauucuugagagaac

SEQ ID NO: 689616 - RNA, 22 nt, Human
ccaggccuucugaggacacucu

SEQ ID NO: 689617 - RNA, 22 nt, Human
ugcagcucauugcuggggucug

SEQ ID NO: 689618 - RNA, 18 nt, Human
cugucagcagcuucacga

SEQ ID NO: 689619 - RNA, 22 nt, Human
acauuaaauuucauagugauua

SEQ ID NO: 689620 - RNA, 22 nt, Human
ucccaggugaugcugaggccac

SEQ ID NO: 689621 - RNA, 22 nt, Human
acuucaugcuuuagagagauga

SEQ ID NO: 689622 - RNA, 22 nt, Human
aaggacagagagccauuccaga

SEQ ID NO: 689623 - RNA, 22 nt, Human
uugucugcauuguuucuauggg

SEQ ID NO: 689624 - RNA, 22 nt, Human
cuugacacugucacucaggcca

SEQ ID NO: 689625 - RNA, 22 nt, Human
auauacacuccacugauacagg

SEQ ID NO: 689626 - RNA, 22 nt, Human
auucagaaacucugggcagaac

SEQ ID NO: 689627 - RNA, 22 nt, Human
ggagggagcagagaacccaacc

SEQ ID NO: 689628 - RNA, 22 nt, Human
acuuugcagguacaugagcauc

SEQ ID NO: 689629 - RNA, 22 nt, Human
accagugucuuauugaccaucu

SEQ ID NO: 689630 - RNA, 22 nt, Human
cuguuauuuaugcugcuccauu

SEQ ID NO: 689631 - RNA, 22 nt, Human
uuacaucuaaacugugaacaau

SEQ ID NO: 689632 - RNA, 22 nt, Human
uggcuuucucccccagcuucuc

SEQ ID NO: 689633 - RNA, 22 nt, Human
agcaccuccgugcagcguggcc

SEQ ID NO: 689634 - RNA, 22 nt, Human
cuauuuuccgcagcaggaagua

SEQ ID NO: 689635 - RNA, 19 nt, Human
agaggcaagggcucaugac

SEQ ID NO: 689636 - RNA, 22 nt, Human
agccuauuccaggaugagcuca

SEQ ID NO: 689637 - RNA, 22 nt, Human
uucugugcccauuuuaaaaugg

SEQ ID NO: 689638 - RNA, 22 nt, Human
ucauguacauguaagucagaaa

SEQ ID NO: 689639 - RNA, 22 nt, Human
gggggucccaagcugggcugcu

SEQ ID NO: 689640 - RNA, 22 nt, Human
cccagagcuccgguccugccca

SEQ ID NO: 689641 - RNA, 22 nt, Human
ucagccagaggcuucuugguuu

SEQ ID NO: 689642 - RNA, 22 nt, Human
agacacugccacuucuguuccc

SEQ ID NO: 689643 - RNA, 22 nt, Human
ugacaaugauuagguagcuucu

SEQ ID NO: 689644 - RNA, 22 nt, Human
ccucugccugcacaucauccug

SEQ ID NO: 689645 - RNA, 22 nt, Human
aucuggcucgcuaggcucuggg

SEQ ID NO: 689646 - RNA, 22 nt, Human
aggugucuucagggugagacag

SEQ ID NO: 689647 - RNA, 22 nt, Human
gccagguguaguggccacaccu

SEQ ID NO: 689648 - RNA, 22 nt, Human
uagagcugcuggacuguaacag

SEQ ID NO: 689649 - RNA, 22 nt, Human
cuggcagcaguuaugaaacaau

SEQ ID NO: 689650 - RNA, 22 nt, Human
ucccagugagaugaaacaggua

SEQ ID NO: 689651 - RNA, 22 nt, Human
ugauuuuacuuagcaugauguu

SEQ ID NO: 689652 - RNA, 22 nt, Human
cucaggaugaaagucaugguga

SEQ ID NO: 689653 - RNA, 22 nt, Human
aacuccucacugccucuggcac

SEQ ID NO: 689654 - RNA, 22 nt, Human
uaguggagaggauguggagaaa

SEQ ID NO: 689655 - RNA, 22 nt, Human
ucaggcagagggagaagccaag

SEQ ID NO: 689656 - RNA, 22 nt, Human
cauggaacuguauaaaggcacu

SEQ ID NO: 689657 - RNA, 22 nt, Human
uggcagggugccaguugcgagu

SEQ ID NO: 689658 - RNA, 22 nt, Human
gcaugcaugguuugugacugug

SEQ ID NO: 689659 - RNA, 22 nt, Human
ugucccaggccucauguugcca

SEQ ID NO: 689660 - RNA, 22 nt, Human
aggcugcguuagccucacuccc

SEQ ID NO: 689661 - RNA, 22 nt, Human
caggaacaacucccagcaucuc

SEQ ID NO: 689662 - RNA, 22 nt, Human
uucaucaauguguuuaauaaug

SEQ ID NO: 689663 - RNA, 22 nt, Human
gaaucuuuuuucuugccaggca

SEQ ID NO: 689664 - RNA, 22 nt, Human
uacagugucuggauaucaaagg

SEQ ID NO: 689665 - RNA, 19 nt, Human
uggcauguuuggcuaagga

SEQ ID NO: 689666 - RNA, 22 nt, Human
ucucccucuuugucugcuuugg

SEQ ID NO: 689667 - RNA, 22 nt, Human
cugacagauacuuaugacauaa

SEQ ID NO: 689668 - RNA, 22 nt, Human
auaucacagcucuuucauugcu

SEQ ID NO: 689669 - RNA, 22 nt, Human
aggaggcugggcacaguggccu

SEQ ID NO: 689670 - RNA, 22 nt, Human
gucucagaccacccucuuuggc

SEQ ID NO: 689671 - RNA, 22 nt, Human
acuccaaggccacaugcauucc

SEQ ID NO: 689672 - RNA, 22 nt, Human
gcuaugcaggagccuaaugaca

SEQ ID NO: 689673 - RNA, 22 nt, Human
uagguucagcuuccacugccua

SEQ ID NO: 689674 - RNA, 22 nt, Human
ggggcuguuuuuggaauggcug

SEQ ID NO: 689675 - RNA, 20 nt, Human
ucagagaaggagcuuuccug

SEQ ID NO: 689676 - RNA, 22 nt, Human
ucucucaggaggcagguuccua

SEQ ID NO: 689677 - RNA, 22 nt, Human
ccaaaauauuagugcuuaagua

SEQ ID NO: 689678 - RNA, 19 nt, Human
ccucugcgcuguccugcuc

SEQ ID NO: 689679 - RNA, 22 nt, Human
auuucccaugugaaucaauugg

SEQ ID NO: 689680 - RNA, 22 nt, Human
gaagcagcugccagagaugucu

SEQ ID NO: 689681 - RNA, 22 nt, Human
gaggguuggugcaaaugggaug

SEQ ID NO: 689682 - RNA, 22 nt, Human
ucucuagacauggggaauguca

SEQ ID NO: 689683 - RNA, 22 nt, Human
ugcacaggaggcuguggagaag

SEQ ID NO: 689684 - RNA, 22 nt, Human
gugagcagaacagguggcuucu

SEQ ID NO: 689685 - RNA, 22 nt, Human
aaagacauauuucuaaguuuau

SEQ ID NO: 689686 - RNA, 22 nt, Human
ugaaugaugcaguauaaugaua

SEQ ID NO: 689687 - RNA, 22 nt, Human
uggcaguaaagcuggaaaagug

SEQ ID NO: 689688 - RNA, 23 nt, Human
uucauugagcuguucuugaggau

SEQ ID NO: 689689 - RNA, 22 nt, Human
gcuucucaauucucacccucca

SEQ ID NO: 689690 - RNA, 22 nt, Human
cauucacucagcgaugccagua

SEQ ID NO: 689691 - RNA, 22 nt, Human
ugucauuuggacuuugguauua

SEQ ID NO: 689692 - RNA, 22 nt, Human
cccaggcaggagugugguggcu

SEQ ID NO: 689693 - RNA, 22 nt, Human
ccucagagguucugugugggaa

SEQ ID NO: 689694 - RNA, 21 nt, Human
gauaaagcagcuugccuaagg

SEQ ID NO: 689695 - RNA, 19 nt, Human
ggaaggugacaguggugaa

SEQ ID NO: 689696 - RNA, 17 nt, Human
agcaggcugcagaggcc

SEQ ID NO: 689697 - RNA, 22 nt, Human
aggggaugauccucccgcagcg

SEQ ID NO: 689698 - RNA, 18 nt, Human
ucccucagaauuauagaa

SEQ ID NO: 689699 - RNA, 22 nt, Human
gcccucagcaggaaagaucaac

SEQ ID NO: 689700 - RNA, 22 nt, Human
cuccucacuuuccagacugggc

SEQ ID NO: 689701 - RNA, 22 nt, Human
guucugucacacacugguacuu

SEQ ID NO: 689702 - RNA, 22 nt, Human
cucugggguuaagcuuccaugg

SEQ ID NO: 689703 - RNA, 22 nt, Human
gaagaagccucuguggaucuga

SEQ ID NO: 689704 - RNA, 22 nt, Human
ugucagacacagccagagacug

SEQ ID NO: 689705 - RNA, 22 nt, Human
caggcaaggacucugguaauuu

SEQ ID NO: 689706 - RNA, 22 nt, Human
uuggaaggcccugccuagcagg

SEQ ID NO: 689707 - RNA, 22 nt, Human
uggcggggcagcucuggcuucu

SEQ ID NO: 689708 - RNA, 22 nt, Human
aagcaaagacaguuugagugga

SEQ ID NO: 689709 - RNA, 22 nt, Human
caggcagagcugaagauagaug

SEQ ID NO: 689710 - RNA, 22 nt, Human
cacauaaguggguuccauugca

SEQ ID NO: 689711 - RNA, 17 nt, Human
uggccagagcaggcccc

SEQ ID NO: 689712 - RNA, 22 nt, Human
ccugucugagccagggugggca

SEQ ID NO: 689713 - RNA, 22 nt, Human
agcaggggcaggguuuugugcu

SEQ ID NO: 689714 - RNA, 22 nt, Human
aacuccagggggucaauauuua

SEQ ID NO: 689715 - RNA, 22 nt, Human
auguggcuaguggacacaguau

SEQ ID NO: 689716 - RNA, 22 nt, Human
ugucuguauugaggugcauauu

SEQ ID NO: 689717 - RNA, 22 nt, Human
acacaaugauucacaagcagca

SEQ ID NO: 689718 - RNA, 22 nt, Human
augaggcagaaaaaagucggag

SEQ ID NO: 689719 - RNA, 18 nt, Human
uggagcaggaagccuggc

SEQ ID NO: 689720 - RNA, 22 nt, Human
uguucucacuggaugcuucaca

SEQ ID NO: 689721 - RNA, 22 nt, Human
ugccuguguugauuacuuuguc

SEQ ID NO: 689722 - RNA, 22 nt, Human
ugauaaacuuagaaagaauguu

SEQ ID NO: 689723 - RNA, 22 nt, Human
aaucauccugaagucaauaaag

SEQ ID NO: 689724 - RNA, 22 nt, Human
gagcccagcugcggcccucagc

SEQ ID NO: 689725 - RNA, 22 nt, Human
uaacauuuaaauuuuucacaua

SEQ ID NO: 689726 - RNA, 22 nt, Human
aggcucugaguagagcugccag

SEQ ID NO: 689727 - RNA, 21 nt, Human
agcaggcuuuggaguggggcu

SEQ ID NO: 689728 - RNA, 22 nt, Human
acuauuuacucaaaugagguug

SEQ ID NO: 689729 - RNA, 22 nt, Human
auuaaauuuucacuaggcuccc

SEQ ID NO: 689730 - RNA, 22 nt, Human
gauaccagacagggagggagaa

SEQ ID NO: 689731 - RNA, 22 nt, Human
aagugucuaacugguuacuucu

SEQ ID NO: 689732 - RNA, 22 nt, Human
gaugggggccagggccugcuuu

SEQ ID NO: 689733 - RNA, 19 nt, Human
cgcagagggcuucugagag

SEQ ID NO: 689734 - RNA, 22 nt, Human
ugggccacaagccaugggacca

SEQ ID NO: 689735 - RNA, 20 nt, Human
aaagagaagccucaccuugu

SEQ ID NO: 689736 - RNA, 22 nt, Human
uggcccagcugcagauggugga

SEQ ID NO: 689737 - RNA, 22 nt, Human
uggacugauuuucauuuuaaau

SEQ ID NO: 689738 - RNA, 22 nt, Human
ugaggcucagaaauguaaguuu

SEQ ID NO: 689739 - RNA, 22 nt, Human
ugucugagcuggggcagacaga

SEQ ID NO: 689740 - RNA, 18 nt, Human
ugcucuggucucacuugg

SEQ ID NO: 689741 - RNA, 22 nt, Human
ggugugaauuuugaccuuuuaa

SEQ ID NO: 689742 - RNA, 22 nt, Human
uuaguuaggauuuggugguaua

SEQ ID NO: 689743 - RNA, 22 nt, Human
caugcugagcacauucuguauu

SEQ ID NO: 689744 - RNA, 22 nt, Human
uggggacauagccagucuggcu

SEQ ID NO: 689745 - RNA, 22 nt, Human
acugcacacuuagcaucuggga

SEQ ID NO: 689746 - RNA, 22 nt, Human
cuguccuugcuggccagguaug

SEQ ID NO: 689747 - RNA, 22 nt, Human
caugugugucuccaccagcugc

SEQ ID NO: 689748 - RNA, 22 nt, Human
agagaggcauucggugauccca

SEQ ID NO: 689749 - RNA, 22 nt, Human
uaagcauauuccagucaugucc

SEQ ID NO: 689750 - RNA, 22 nt, Human
aaaaguuuaagacucauucuag

SEQ ID NO: 689751 - RNA, 22 nt, Human
aagacaugacugcacagccaaa

SEQ ID NO: 689752 - RNA, 22 nt, Human
gagacugcauuguccaaggguu

SEQ ID NO: 689753 - RNA, 22 nt, Human
agcuggguggugcugagccuug

SEQ ID NO: 689754 - RNA, 22 nt, Human
gaggcuagagcaggggcucaau

SEQ ID NO: 689755 - RNA, 22 nt, Human
aaagucauguaaugauaugauu

SEQ ID NO: 689756 - RNA, 22 nt, Human
ucucaucucggaucagaaguga

SEQ ID NO: 689757 - RNA, 22 nt, Human
ugcagaagaccuuccagggcug

SEQ ID NO: 689758 - RNA, 22 nt, Human
acuagaaccagaggaggcaggu

SEQ ID NO: 689759 - RNA, 22 nt, Human
uggagcagccuuuucuaagcaa

SEQ ID NO: 689760 - RNA, 22 nt, Human
aggcugucaucuuugcaggcag

SEQ ID NO: 689761 - RNA, 22 nt, Human
gugcuuccccaagccacagccu

SEQ ID NO: 689762 - RNA, 22 nt, Human
ggaaaacugaggcucucagcag

SEQ ID NO: 689763 - RNA, 22 nt, Human
gcugcaggcgccugcggucucu

SEQ ID NO: 689764 - RNA, 22 nt, Human
cagcagcccuuuggcugaacug

SEQ ID NO: 689765 - RNA, 22 nt, Human
ucuagcuuggcguuugccuucu

SEQ ID NO: 689766 - RNA, 22 nt, Human
cuucuggguauuccagauaccu

SEQ ID NO: 689767 - RNA, 22 nt, Human
guggguggaucaccugagguca

SEQ ID NO: 689768 - RNA, 22 nt, Human
acacuaaaugagucuacaguac

SEQ ID NO: 689769 - RNA, 22 nt, Human
agaucacauaauuuccugugac

SEQ ID NO: 689770 - RNA, 22 nt, Human
ugaggccacaguaucagaacag

SEQ ID NO: 689771 - RNA, 22 nt, Human
uauucugcuucccguggcacaa

SEQ ID NO: 689772 - RNA, 22 nt, Human
agcugugugugaauuuggccua

SEQ ID NO: 689773 - RNA, 22 nt, Human
ugucauggugcuauuuaauuag

SEQ ID NO: 689774 - RNA, 22 nt, Human
guguggcugaaaucaaggcagg

SEQ ID NO: 689775 - RNA, 22 nt, Human
gacaaucagccauauccagggu

SEQ ID NO: 689776 - RNA, 22 nt, Human
uggaaggcgucucgaaggccua

SEQ ID NO: 689777 - RNA, 22 nt, Human
ggaggccaaggcagguggauca

SEQ ID NO: 689778 - RNA, 22 nt, Human
cagggacagccuugggguggcg

SEQ ID NO: 689779 - RNA, 23 nt, Human
cacauauagcagccacuaagguc

SEQ ID NO: 689780 - RNA, 22 nt, Human
auagcagaaaccaagcuucuuc

SEQ ID NO: 689781 - RNA, 22 nt, Human
gagcucuguguggcuugggugg

SEQ ID NO: 689782 - RNA, 22 nt, Human
agagucugaggcagcugcagcc

SEQ ID NO: 689783 - RNA, 22 nt, Human
ggccagcaggcccugugauccu

SEQ ID NO: 689784 - RNA, 22 nt, Human
uagcaacaccaucuggugagaa

SEQ ID NO: 689785 - RNA, 22 nt, Human
ccuucagccuuuguuuaucaga

SEQ ID NO: 689786 - RNA, 22 nt, Human
agccugguuuaagcauuuuaua

SEQ ID NO: 689787 - RNA, 22 nt, Human
ggcuggcacugaggagagcucu

SEQ ID NO: 689788 - RNA, 22 nt, Human
aggcuccuuauggcuuuggggu

SEQ ID NO: 689789 - RNA, 20 nt, Human
aaacauucauguacaaguga

SEQ ID NO: 689790 - RNA, 22 nt, Human
ugcccaagguggccuuuuacuc

SEQ ID NO: 689791 - RNA, 22 nt, Human
uuucucauagucaugccucuua

SEQ ID NO: 689792 - RNA, 22 nt, Human
aaauacagauuccagggucuua

SEQ ID NO: 689793 - RNA, 20 nt, Human
aauacuaaacacaaagcagu

SEQ ID NO: 689794 - RNA, 22 nt, Human
cuucugggcauucagcugcaca

SEQ ID NO: 689795 - RNA, 22 nt, Human
uuaccaauucagacaucucuuc

SEQ ID NO: 689796 - RNA, 20 nt, Human
cagaagcaaggcagguaccu

SEQ ID NO: 689797 - RNA, 22 nt, Human
agaccaagugcaggugccacua

SEQ ID NO: 689798 - RNA, 22 nt, Human
cuggaggcacccuuagagaggc

SEQ ID NO: 689799 - RNA, 22 nt, Human
ugcaaacauccgacugaaagcc

SEQ ID NO: 689800 - RNA, 22 nt, Human
uccaggcugacgcagcuauuua

SEQ ID NO: 689801 - RNA, 22 nt, Human
ggaaggaagugaccaggauauc

SEQ ID NO: 689802 - RNA, 22 nt, Human
gccuggcucacagagcagccuu

SEQ ID NO: 689803 - RNA, 20 nt, Human
cugaaccaaggcuuucucag

SEQ ID NO: 689804 - RNA, 22 nt, Human
ccucuggaucuuucuccacacu

SEQ ID NO: 689805 - RNA, 22 nt, Human
cacagcaaagacacucucaacu

SEQ ID NO: 689806 - RNA, 22 nt, Human
cugggagaggcugcuccgcucu

SEQ ID NO: 689807 - RNA, 22 nt, Human
caggcagagucagauuagacuu

SEQ ID NO: 689808 - RNA, 20 nt, Human
uacauauuauaucagcugca

SEQ ID NO: 689809 - RNA, 22 nt, Human
gggccagccuacugcuagaccc

SEQ ID NO: 689810 - RNA, 22 nt, Human
ccacuggcauccagcugccauc

SEQ ID NO: 689811 - RNA, 22 nt, Human
gugagagcugcuccagaucucu

SEQ ID NO: 689812 - RNA, 22 nt, Human
guguccuuauuucugucucuca

SEQ ID NO: 689813 - RNA, 22 nt, Human
gucugagaaucuugcauaucau

SEQ ID NO: 689814 - RNA, 22 nt, Human
ugaagugggggaacgagaguuc

SEQ ID NO: 689815 - RNA, 19 nt, Human
ccucugugggagucaguga

SEQ ID NO: 689816 - RNA, 22 nt, Human
cucucuggaccucaacuauuuu

SEQ ID NO: 689817 - RNA, 22 nt, Human
augcuugaaaaccccaugaaua

SEQ ID NO: 689818 - RNA, 22 nt, Human
aaccuguucccugguccuugac

SEQ ID NO: 689819 - RNA, 22 nt, Human
cauaguaaauaaugcagaugau

SEQ ID NO: 689820 - RNA, 22 nt, Human
gaggccaggaagcccaagauca

SEQ ID NO: 689821 - RNA, 23 nt, Human
ugguggcuugugguggccaccag

SEQ ID NO: 689822 - RNA, 22 nt, Human
ccaggguugcagggagccagca

SEQ ID NO: 689823 - RNA, 20 nt, Human
ugggcaccagaugggaugcc

SEQ ID NO: 689824 - RNA, 22 nt, Human
acugauggcccaccuuggucuc

SEQ ID NO: 689825 - RNA, 22 nt, Human
uaggcagagguaugguaaggac

SEQ ID NO: 689826 - RNA, 22 nt, Human
ggagggaguuucauuccugccc

SEQ ID NO: 689827 - RNA, 22 nt, Human
uauguuaaauguuugauguuua

SEQ ID NO: 689828 - RNA, 19 nt, Human
ugggccugcaucugggucu

SEQ ID NO: 689829 - RNA, 22 nt, Human
aaaggagaguagguuacuccau

SEQ ID NO: 689830 - RNA, 22 nt, Human
auaugagagaggaaagauuuua

SEQ ID NO: 689831 - RNA, 18 nt, Human
uggcugcuggaguagggu

SEQ ID NO: 689832 - RNA, 21 nt, Human
ccccucauacacucuccuugc

SEQ ID NO: 689833 - RNA, 22 nt, Human
caggcagaaugagauuacuuca

SEQ ID NO: 689834 - RNA, 22 nt, Human
cagcaccccuccuggcuaugaa

SEQ ID NO: 689835 - RNA, 22 nt, Human
caacagagcaguugaucaggaa

SEQ ID NO: 689836 - RNA, 22 nt, Human
caaggagaaaacggcuucugaa

SEQ ID NO: 689837 - RNA, 22 nt, Human
ugcugccuuucugaauggugga

SEQ ID NO: 689838 - RNA, 22 nt, Human
ccugggcuguaccugugcgcgg

SEQ ID NO: 689839 - RNA, 22 nt, Human
acuuccugcaaucguccacucc

SEQ ID NO: 689840 - RNA, 22 nt, Human
cccagcuccuuacagggccgaa

SEQ ID NO: 689841 - RNA, 22 nt, Human
acucuggcccuccugcugccag

SEQ ID NO: 689842 - RNA, 22 nt, Human
cugggucucuuaccaugugacu

SEQ ID NO: 689843 - RNA, 22 nt, Human
ggcugcacgccucucagcuugc

SEQ ID NO: 689844 - RNA, 22 nt, Human
agagagcucuggcugggugacc

SEQ ID NO: 689845 - RNA, 22 nt, Human
ucucagaggcccgacguucucc

SEQ ID NO: 689846 - RNA, 22 nt, Human
auugaaagauauacuguucuca

SEQ ID NO: 689847 - RNA, 22 nt, Human
auuucucugccucagcuucugc

SEQ ID NO: 689848 - RNA, 22 nt, Human
ugauaaacagcugaugaagacc

SEQ ID NO: 689849 - RNA, 22 nt, Human
aaaggcacuggauagcugggga

SEQ ID NO: 689850 - RNA, 22 nt, Human
uguggguuuaagaggcagcaug

SEQ ID NO: 689851 - RNA, 22 nt, Human
gaggcauggccugaggcuagga

SEQ ID NO: 689852 - RNA, 22 nt, Human
ugaacacauuuucuucaguaga

SEQ ID NO: 689853 - RNA, 22 nt, Human
cuaagaaggaggaaaagugcca

SEQ ID NO: 689854 - RNA, 22 nt, Human
cuggcugaggucaccaguagcu

SEQ ID NO: 689855 - RNA, 22 nt, Human
gcagcccauaacauuugaggcc

SEQ ID NO: 689856 - RNA, 22 nt, Human
cagggccauuggaacaaagagg

SEQ ID NO: 689857 - RNA, 21 nt, Human
aaugaaguggcuauuuugagg

SEQ ID NO: 689858 - RNA, 20 nt, Human
agugcauggagggagagggc

SEQ ID NO: 689859 - RNA, 22 nt, Human
uaauacaucauucaucuaagga

SEQ ID NO: 689860 - RNA, 22 nt, Human
ucucagaaaaaggagaaacugg

SEQ ID NO: 689861 - RNA, 22 nt, Human
aaauugcugacacuugaccauu

SEQ ID NO: 689862 - RNA, 22 nt, Human
ucacugcucagucuguacuaca

SEQ ID NO: 689863 - RNA, 22 nt, Human
uacauacagccaaguaugaagu

SEQ ID NO: 689864 - RNA, 22 nt, Human
gaagaaggugccagaggcuuac

SEQ ID NO: 689865 - RNA, 22 nt, Human
uuggcagggccaggcucucucu

SEQ ID NO: 689866 - RNA, 22 nt, Human
uccccacucucuccuggagcuu

SEQ ID NO: 689867 - RNA, 20 nt, Human
ugggucugcuuggcuucagu

SEQ ID NO: 689868 - RNA, 22 nt, Human
acuguggggugcgaggcaguga

SEQ ID NO: 689869 - RNA, 22 nt, Human
acuaaaugcugcauaaaugcuu

SEQ ID NO: 689870 - RNA, 22 nt, Human
uccuccaguggcccaguccuuc

SEQ ID NO: 689871 - RNA, 22 nt, Human
gggagaaaugucuggccugcug

SEQ ID NO: 689872 - RNA, 22 nt, Human
gguggcucucuuaagggcagcg

SEQ ID NO: 689873 - RNA, 22 nt, Human
gggcucugcgcucagcuccagc

SEQ ID NO: 689874 - RNA, 22 nt, Human
agaauuuaggaugcaugugaau

SEQ ID NO: 689875 - RNA, 22 nt, Human
ugccuguguggggucugccgcc

SEQ ID NO: 689876 - RNA, 23 nt, Human
agcuaacagaucgacaaaguaua

SEQ ID NO: 689877 - RNA, 22 nt, Human
ccugagcugacucuccuuucag

SEQ ID NO: 689878 - RNA, 19 nt, Human
acuggcaguuucugcaugg

SEQ ID NO: 689879 - RNA, 22 nt, Human
uggcucugcgucuguucguggg

SEQ ID NO: 689880 - RNA, 22 nt, Human
uuggaaagggaggaauguagac

SEQ ID NO: 689881 - RNA, 22 nt, Human
cagaggcacagcuucuuuuaau

SEQ ID NO: 689882 - RNA, 22 nt, Human
ugcaggugucugggggcaacag

SEQ ID NO: 689883 - RNA, 21 nt, Human
ccaggguccagcugccauggu

SEQ ID NO: 689884 - RNA, 22 nt, Human
cuggaaugccucccugucagag

SEQ ID NO: 689885 - RNA, 22 nt, Human
ucaguuaccugacagugguuau

SEQ ID NO: 689886 - RNA, 22 nt, Human
cagauaacacaaagaaaugggc

SEQ ID NO: 689887 - RNA, 22 nt, Human
acauuacauaagauuguaaccu

SEQ ID NO: 689888 - RNA, 22 nt, Human
gagcugaggccagagucuucug

SEQ ID NO: 689889 - RNA, 22 nt, Human
accaggagccauagagucaggc

SEQ ID NO: 689890 - RNA, 22 nt, Human
acacuuuguuguggcauauacg

SEQ ID NO: 689891 - RNA, 22 nt, Human
gaggcugguuugccuuuuggca

SEQ ID NO: 689892 - RNA, 22 nt, Human
gccagggaggcuguaggguccu

SEQ ID NO: 689893 - RNA, 22 nt, Human
cuuguguuguacauucuauggg

SEQ ID NO: 689894 - RNA, 22 nt, Human
cugugccuuuguagcugugccu

SEQ ID NO: 689895 - RNA, 22 nt, Human
uggcuaggaauccaugacucuc

SEQ ID NO: 689896 - RNA, 22 nt, Human
uggcuccucuucuggguguccc

SEQ ID NO: 689897 - RNA, 22 nt, Human
ggccugugagaaucaaggaaaa

SEQ ID NO: 689898 - RNA, 22 nt, Human
aaagucacaguuuaggggauau

SEQ ID NO: 689899 - RNA, 22 nt, Human
uuuacucuugcuacacaacugu

SEQ ID NO: 689900 - RNA, 22 nt, Human
cuucuucaaccugaaaguuuca

SEQ ID NO: 689901 - RNA, 22 nt, Human
gcugcaggcggccgugguggcg

SEQ ID NO: 689902 - RNA, 22 nt, Human
uuuguuugccacacaaaacagu

SEQ ID NO: 689903 - RNA, 22 nt, Human
ggagcaaaugccaagugggagg

SEQ ID NO: 689904 - RNA, 22 nt, Human
auuuccaguccuaaugaucugg

SEQ ID NO: 689905 - RNA, 22 nt, Human
gccucagagggcagggugguga

SEQ ID NO: 689906 - RNA, 22 nt, Human
aggugggugccuauguauguau

SEQ ID NO: 689907 - RNA, 20 nt, Human
cuccugggacugcugguuau

SEQ ID NO: 689908 - RNA, 22 nt, Human
gguggcaggcccugagcauccc

SEQ ID NO: 689909 - RNA, 18 nt, Human
uuuuaauuucaggggugg

SEQ ID NO: 689910 - RNA, 19 nt, Human
aguuuauuauaggugauuc

SEQ ID NO: 689911 - RNA, 22 nt, Human
uauuuuugccucucagauaaaa

SEQ ID NO: 689912 - RNA, 22 nt, Human
aaagugcugaaauuacaggggu

SEQ ID NO: 689913 - RNA, 22 nt, Human
uugagcaagaguaggaacugaa

SEQ ID NO: 689914 - RNA, 23 nt, Human
uaugaacugcauugcuggugugu

SEQ ID NO: 689915 - RNA, 22 nt, Human
cagagccucucagaggucagac

SEQ ID NO: 689916 - RNA, 22 nt, Human
auuucacaaaccauccugauuu

SEQ ID NO: 689917 - RNA, 20 nt, Human
agcugcucucauccagaccu

SEQ ID NO: 689918 - RNA, 22 nt, Human
aaguccaugaucaagauguggc

SEQ ID NO: 689919 - RNA, 22 nt, Human
ccuggcugcuuucacuauggag

SEQ ID NO: 689920 - RNA, 22 nt, Human
ugccugugggugaugauuugau

SEQ ID NO: 689921 - RNA, 22 nt, Human
ugcucccugcucagagaggcca

SEQ ID NO: 689922 - RNA, 22 nt, Human
gcugucuggguugagggcccug

SEQ ID NO: 689923 - RNA, 22 nt, Human
auuuacagccuugaaaacagca

SEQ ID NO: 689924 - RNA, 22 nt, Human
cuuuaccacaaggacagaacuu

SEQ ID NO: 689925 - RNA, 22 nt, Human
acuucccacacccuguuuucuc

SEQ ID NO: 689926 - RNA, 22 nt, Human
uguucuuucaguuagacacagu

SEQ ID NO: 689927 - RNA, 21 nt, Human
agaagccuggguggagguggg

SEQ ID NO: 689928 - RNA, 22 nt, Human
gcuucucuuaaugccuggcuuu

SEQ ID NO: 689929 - RNA, 22 nt, Human
accuccauggcucaguuucaga

SEQ ID NO: 689930 - RNA, 22 nt, Human
aggcuuauagcuuauauuuaag

SEQ ID NO: 689931 - RNA, 22 nt, Human
cuggaagugggguuggcuugaa

SEQ ID NO: 689932 - RNA, 23 nt, Human
aagauacagguguggaaugguuu

SEQ ID NO: 689933 - RNA, 22 nt, Human
agagcagcuggggcagagacca

SEQ ID NO: 689934 - RNA, 23 nt, Human
ugauggaaaugaucugggucugu

SEQ ID NO: 689935 - RNA, 22 nt, Human
aaccuguaaauccaaacaaucu

SEQ ID NO: 689936 - RNA, 22 nt, Human
cacugucuguguguccuugggg

SEQ ID NO: 689937 - RNA, 22 nt, Human
aauggccuuugagaugaaaggg

SEQ ID NO: 689938 - RNA, 22 nt, Human
ugaguucuaguggcugcagauu

SEQ ID NO: 689939 - RNA, 21 nt, Human
uuuaucaucacgagcuugagc

SEQ ID NO: 689940 - RNA, 22 nt, Human
gaaguagaaagccucguaaaua

SEQ ID NO: 689941 - RNA, 23 nt, Human
cacaccuguuaagaagagugccu

SEQ ID NO: 689942 - RNA, 22 nt, Human
agagagccugaguggcagcuau

SEQ ID NO: 689943 - RNA, 22 nt, Human
acaaacaucuugaccucagauu

SEQ ID NO: 689944 - RNA, 21 nt, Human
gggagggauggaaaugauguu

SEQ ID NO: 689945 - RNA, 22 nt, Human
gccuccggaguugcagugucuu

SEQ ID NO: 689946 - RNA, 22 nt, Human
caacauuugaguaaagaaaugg

SEQ ID NO: 689947 - RNA, 22 nt, Human
cacaugcaucugucauguuugg

SEQ ID NO: 689948 - RNA, 22 nt, Human
aaacucuggggguggagcccag

SEQ ID NO: 689949 - RNA, 22 nt, Human
ugaguagagaauucagcuaagg

SEQ ID NO: 689950 - RNA, 22 nt, Human
aggucaagggagcugagggcca

SEQ ID NO: 689951 - RNA, 22 nt, Human
gccuaaggauaugcuuugcuug

SEQ ID NO: 689952 - RNA, 23 nt, Human
aggcagcagguuguccaggguga

SEQ ID NO: 689953 - RNA, 22 nt, Human
ugggagcucugagccugcuaug

SEQ ID NO: 689954 - RNA, 22 nt, Human
cuaaacauguuggugcuuuaaa

SEQ ID NO: 689955 - RNA, 22 nt, Human
uaaaacugaauacauacugagg

SEQ ID NO: 689956 - RNA, 23 nt, Human
ggacagggcccugcccuauggcc

SEQ ID NO: 689957 - RNA, 22 nt, Human
gggaagggcuccuuuuauugca

SEQ ID NO: 689958 - RNA, 22 nt, Human
cagccagaucaaacucagaugu

SEQ ID NO: 689959 - RNA, 22 nt, Human
acagacagauuuugucugaugu

SEQ ID NO: 689960 - RNA, 22 nt, Human
uuuuauauggcacauugguugg

SEQ ID NO: 689961 - RNA, 22 nt, Human
ggagcccuugcugaccuuccaa

SEQ ID NO: 689962 - RNA, 22 nt, Human
aucuggguucaccaugcuccug

SEQ ID NO: 689963 - RNA, 22 nt, Human
uuggcuucuguuuuggcucugu

SEQ ID NO: 689964 - RNA, 22 nt, Human
gagaacacaugcagacugggua

SEQ ID NO: 689965 - RNA, 22 nt, Human
ucaagaguuggucaaauccaaa

SEQ ID NO: 689966 - RNA, 22 nt, Human
ugucuaaaugcaauggauuucc

SEQ ID NO: 689967 - RNA, 22 nt, Human
uuauggcauauuccucauugua

SEQ ID NO: 689968 - RNA, 19 nt, Human
aagaggcaacccucgagcc

SEQ ID NO: 689969 - RNA, 22 nt, Human
cucagggaauugaaucuccuug

SEQ ID NO: 689970 - RNA, 22 nt, Human
ccaagcuucuuuccuacuacag

SEQ ID NO: 689971 - RNA, 19 nt, Human
aucugccuguuaucacaua

SEQ ID NO: 689972 - RNA, 22 nt, Human
cuuccucugcggcgccgggcgc

SEQ ID NO: 689973 - RNA, 22 nt, Human
cuuuaauucucaggugcacaua

SEQ ID NO: 689974 - RNA, 22 nt, Human
uuacacuaagcuacuucuauau

SEQ ID NO: 689975 - RNA, 22 nt, Human
cagugucucccccagguucugu

SEQ ID NO: 689976 - RNA, 22 nt, Human
gccaggagcccugggcaaguuc

SEQ ID NO: 689977 - RNA, 22 nt, Human
gcagagugaagcaguauggaaa

SEQ ID NO: 689978 - RNA, 22 nt, Human
uccagcaugaaggggcuuuuau

SEQ ID NO: 689979 - RNA, 16 nt, Human
cuccucuccuucagga

SEQ ID NO: 689980 - RNA, 22 nt, Human
aguccaagauuagggugacagc

SEQ ID NO: 689981 - RNA, 21 nt, Human
aguucacaggaacaagcaggg

SEQ ID NO: 689982 - RNA, 20 nt, Human
aguggcagggaaauggaaag

SEQ ID NO: 689983 - RNA, 22 nt, Human
ggccuggccuccagaugugggc

SEQ ID NO: 689984 - RNA, 22 nt, Human
agguccugacuccacguucuag

SEQ ID NO: 689985 - RNA, 22 nt, Human
augcaguagauaggcacuuuua

SEQ ID NO: 689986 - RNA, 17 nt, Human
uccaagccagcuugccu

SEQ ID NO: 689987 - RNA, 22 nt, Human
ugccuaacuccaccaggcaggu

SEQ ID NO: 689988 - RNA, 22 nt, Human
uguuccaugucuuuguaggacu

SEQ ID NO: 689989 - RNA, 22 nt, Human
ugagguaaauagaaaaaccaug

SEQ ID NO: 689990 - RNA, 21 nt, Human
ucacagacuggucagugaggc

SEQ ID NO: 689991 - RNA, 22 nt, Human
ccuccucuggugcugccaaccc

SEQ ID NO: 689992 - RNA, 22 nt, Human
acacuguguuuacauagagaau

SEQ ID NO: 689993 - RNA, 22 nt, Human
guggcucucgccagccugcggg

SEQ ID NO: 689994 - RNA, 22 nt, Human
acuccaggguuuugcaccugga

SEQ ID NO: 689995 - RNA, 22 nt, Human
uccuccugccuuugcuucuugu

SEQ ID NO: 689996 - RNA, 22 nt, Human
ugagcagagcaguaacaggagc

SEQ ID NO: 689997 - RNA, 18 nt, Human
ccaguaccuccuccucuc

SEQ ID NO: 689998 - RNA, 22 nt, Human
cccagagcugggugggcagcgg

SEQ ID NO: 689999 - RNA, 22 nt, Human
ccuggaagauucaccacuacca

SEQ ID NO: 690000 - RNA, 22 nt, Human
aacacagggcagcugcugggaa

SEQ ID NO: 690001 - RNA, 22 nt, Human
ugcuccacugugcguggccaua

SEQ ID NO: 690002 - RNA, 22 nt, Human
aguggcaguaacauuccacaau

SEQ ID NO: 690003 - RNA, 22 nt, Human
acuuuaauuaaugaacuguggc

SEQ ID NO: 690004 - RNA, 22 nt, Human
gcuggacaggccacauggagga

SEQ ID NO: 690005 - RNA, 22 nt, Human
uuuggaauuccauuucugcauu

SEQ ID NO: 690006 - RNA, 22 nt, Human
acauucuaacauuguacagaua

SEQ ID NO: 690007 - RNA, 22 nt, Human
uggagguccugcaggauggcac

SEQ ID NO: 690008 - RNA, 22 nt, Human
acauucuuaacaguuaaaaacu

SEQ ID NO: 690009 - RNA, 22 nt, Human
ugcagcagagugggccugggug

SEQ ID NO: 690010 - RNA, 22 nt, Human
ugcagggcuacaggacuacaac

SEQ ID NO: 690011 - RNA, 22 nt, Human
auugaaaguccuaucuaaggga

SEQ ID NO: 690012 - RNA, 22 nt, Human
gugagguccugagaggcuugug

SEQ ID NO: 690013 - RNA, 22 nt, Human
cuguccuccagacgacaguccc

SEQ ID NO: 690014 - RNA, 21 nt, Human
ugcagacagggacagaaugga

SEQ ID NO: 690015 - RNA, 22 nt, Human
caggugacccucucaccugcuu

SEQ ID NO: 690016 - RNA, 22 nt, Human
cccagagcugagggggcacguu

SEQ ID NO: 690017 - RNA, 22 nt, Human
gcaguaugaguguuuuagacau

SEQ ID NO: 690018 - RNA, 22 nt, Human
cuuauguaugcuacuuuguggu

SEQ ID NO: 690019 - RNA, 22 nt, Human
aaugagcuagaccugcuuccuc

SEQ ID NO: 690020 - RNA, 22 nt, Human
uggaagcagugauucuugucug

SEQ ID NO: 690021 - RNA, 22 nt, Human
auuucuguaacuuaugaaaguu

SEQ ID NO: 690022 - RNA, 22 nt, Human
uaacuucucugagccucauucc

SEQ ID NO: 690023 - RNA, 22 nt, Human
auacaugauacuuaguacguag

SEQ ID NO: 690024 - RNA, 22 nt, Human
uuaacuauuauuagcaucuuug

SEQ ID NO: 690025 - RNA, 22 nt, Human
gacagguggguucucguaucug

SEQ ID NO: 690026 - RNA, 22 nt, Human
aagccuaggccuacucugguuu

SEQ ID NO: 690027 - RNA, 22 nt, Human
uucagugucccuaguagaaguu

SEQ ID NO: 690028 - RNA, 22 nt, Human
aacaugaagguaggaugguuuu

SEQ ID NO: 690029 - RNA, 22 nt, Human
auguuucuaaaacuugcauggc

SEQ ID NO: 690030 - RNA, 22 nt, Human
aaacauugagcacuugcuauuu

SEQ ID NO: 690031 - RNA, 22 nt, Human
cagugugccugaaucaaguguu

SEQ ID NO: 690032 - RNA, 22 nt, Human
aaauuccugucauuugcacuuu

SEQ ID NO: 690033 - RNA, 22 nt, Human
uguccagugauucucaugagcc

SEQ ID NO: 690034 - RNA, 22 nt, Human
gccagcugccaaguugugagau

SEQ ID NO: 690035 - RNA, 22 nt, Human
cuuuuaagggauaauaagaugu

SEQ ID NO: 690036 - RNA, 22 nt, Human
cccaggugcugaaggaggccgc

SEQ ID NO: 690037 - RNA, 22 nt, Human
ugaggugggugucaggucagag

SEQ ID NO: 690038 - RNA, 22 nt, Human
aacaugcuugcuuagaaucagc

SEQ ID NO: 690039 - RNA, 22 nt, Human
gccaggcagauaugugagcuua

SEQ ID NO: 690040 - RNA, 22 nt, Human
guggccagucccgaugcuuguu

SEQ ID NO: 690041 - RNA, 20 nt, Human
uaucuaaaugcuuacauuac

SEQ ID NO: 690042 - RNA, 22 nt, Human
augggaggcagcagagcccagc

SEQ ID NO: 690043 - RNA, 22 nt, Human
cuguacuuuugcaggucacagc

SEQ ID NO: 690044 - RNA, 22 nt, Human
acaagauagguugagucuagcc

SEQ ID NO: 690045 - RNA, 22 nt, Human
acaggcuguacuucuaaucauc

SEQ ID NO: 690046 - RNA, 22 nt, Human
cuucuuggugauggcuuaccug

SEQ ID NO: 690047 - RNA, 22 nt, Human
caucuuuaacaauuuacaaugu

SEQ ID NO: 690048 - RNA, 22 nt, Human
aaauagaaaccaacaaggucag

SEQ ID NO: 690049 - RNA, 22 nt, Human
agaggcacuaagggaagagcag

SEQ ID NO: 690050 - RNA, 19 nt, Human
uguugccagguaucauguu

SEQ ID NO: 690051 - RNA, 22 nt, Human
ggucugccacaagauuuuugag

SEQ ID NO: 690052 - RNA, 22 nt, Human
acagauuuauugaagcugcugc

SEQ ID NO: 690053 - RNA, 21 nt, Human
aucagcaaaugccugucuccc

SEQ ID NO: 690054 - RNA, 22 nt, Human
agcugccaaguuggaguagcaa

SEQ ID NO: 690055 - RNA, 22 nt, Human
acucucugguauuggcaaguuu

SEQ ID NO: 690056 - RNA, 22 nt, Human
cccuggaggaagaaacaauggc

SEQ ID NO: 690057 - RNA, 22 nt, Human
uagcaguuaaucugagccaaga

SEQ ID NO: 690058 - RNA, 22 nt, Human
acagaugaggaauuuauuuggu

SEQ ID NO: 690059 - RNA, 20 nt, Human
ggcugcccacuccagaguac

SEQ ID NO: 690060 - RNA, 22 nt, Human
uccugaggaaaguucaugaaug

SEQ ID NO: 690061 - RNA, 22 nt, Human
guucacauggcauuuucacauc

SEQ ID NO: 690062 - RNA, 22 nt, Human
uuuuccuuucaucaggacaaag

SEQ ID NO: 690063 - RNA, 22 nt, Human
uuugugugguggauacugggua

SEQ ID NO: 690064 - RNA, 22 nt, Human
aguuuauagcccagauucaugg

SEQ ID NO: 690065 - RNA, 22 nt, Human
cuccaggacucaggccccuggg

SEQ ID NO: 690066 - RNA, 21 nt, Human
acacugagugaauuagcacau

SEQ ID NO: 690067 - RNA, 23 nt, Human
gggauauggaccuuggaggaguc

SEQ ID NO: 690068 - RNA, 22 nt, Human
cuucccagaccuuagagugcag

SEQ ID NO: 690069 - RNA, 22 nt, Human
gaaugauauuauuucgugcugg

SEQ ID NO: 690070 - RNA, 22 nt, Human
ucgugaggcucugcaucgcaca

SEQ ID NO: 690071 - RNA, 22 nt, Human
aguaacaagugccaacguuaga

SEQ ID NO: 690072 - RNA, 22 nt, Human
aaauccuuuggaggacaugaug

SEQ ID NO: 690073 - RNA, 22 nt, Human
agcaguggcugaagauguuccu

SEQ ID NO: 690074 - RNA, 22 nt, Human
uuaaguauauccauuugacugg

SEQ ID NO: 690075 - RNA, 22 nt, Human
uugaauuagacuuugcuacagg

SEQ ID NO: 690076 - RNA, 22 nt, Human
gacauacagcccucucccuggu

SEQ ID NO: 690077 - RNA, 22 nt, Human
auagauuagcccuauaguuuua

SEQ ID NO: 690078 - RNA, 22 nt, Human
cuuauauuugucaacuuuacaa

SEQ ID NO: 690079 - RNA, 22 nt, Human
auauguuacucuuucaagcaga

SEQ ID NO: 690080 - RNA, 22 nt, Human
aggccucagcucagugugacag

SEQ ID NO: 690081 - RNA, 22 nt, Human
acaggaguggagaggugccucu

SEQ ID NO: 690082 - RNA, 22 nt, Human
ggugcucaagagggcauccucu

SEQ ID NO: 690083 - RNA, 22 nt, Human
aggggagaauuucaacucaggu

SEQ ID NO: 690084 - RNA, 22 nt, Human
guggggcuaaaaacugugcagu

SEQ ID NO: 690085 - RNA, 22 nt, Human
aacugaaacggugaucuuuuaa

SEQ ID NO: 690086 - RNA, 22 nt, Human
gaauccuugguuuuaagcaaua

SEQ ID NO: 690087 - RNA, 19 nt, Human
uuaugaauagcuucaucca

SEQ ID NO: 690088 - RNA, 22 nt, Human
ggggugggguuacucauugugc

SEQ ID NO: 690089 - RNA, 22 nt, Human
cuugucugggcagcuugggagu

SEQ ID NO: 690090 - RNA, 22 nt, Human
ucuuuaagggauguucugcuuu

SEQ ID NO: 690091 - RNA, 22 nt, Human
ugacauuucgguguaugugaug

SEQ ID NO: 690092 - RNA, 22 nt, Human
augugucuucuaagccaagccu

SEQ ID NO: 690093 - RNA, 22 nt, Human
uucaggaucacuaaacccucca

SEQ ID NO: 690094 - RNA, 22 nt, Human
ugacauaaugcuuugaaguugc

SEQ ID NO: 690095 - RNA, 22 nt, Human
aaaguggucaccuucucauuuc

SEQ ID NO: 690096 - RNA, 22 nt, Human
uaagguuucuaguuucuaaacu

SEQ ID NO: 690097 - RNA, 22 nt, Human
aguuugaauugaaaugcagaug

SEQ ID NO: 690098 - RNA, 22 nt, Human
acauuuguauauaugcagcaua

SEQ ID NO: 690099 - RNA, 21 nt, Human
uucagcuuaugugucacuugc

SEQ ID NO: 690100 - RNA, 22 nt, Human
aguuagaauggauguugagagc

SEQ ID NO: 690101 - RNA, 22 nt, Human
gaggcuggggucugccuuucug

SEQ ID NO: 690102 - RNA, 22 nt, Human
uugauucaaaacaggagguagg

SEQ ID NO: 690103 - RNA, 21 nt, Human
uaaaugugagcagggcugggc

SEQ ID NO: 690104 - RNA, 22 nt, Human
cacaauuacuuuugcaccaaca

SEQ ID NO: 690105 - RNA, 22 nt, Human
aggaagccaagccugacacuca

SEQ ID NO: 690106 - RNA, 22 nt, Human
acacuuugauagauaaugcagg

SEQ ID NO: 690107 - RNA, 17 nt, Human
ccugagugggagaggaa

SEQ ID NO: 690108 - RNA, 22 nt, Human
ucagcaggugcuuuguuuacuc

SEQ ID NO: 690109 - RNA, 22 nt, Human
aauucaaucuaagaaaugauca

SEQ ID NO: 690110 - RNA, 22 nt, Human
auacaaagcuuucugucuggua

SEQ ID NO: 690111 - RNA, 22 nt, Human
uggcaguggcaucaccccaaua

SEQ ID NO: 690112 - RNA, 22 nt, Human
gcagcaucaauccaugcuucuc

SEQ ID NO: 690113 - RNA, 22 nt, Human
uggcucaguuuagcagcucagu

SEQ ID NO: 690114 - RNA, 22 nt, Human
acauauguauauguacacaguc

SEQ ID NO: 690115 - RNA, 18 nt, Human
ugugguggagcugccuuc

SEQ ID NO: 690116 - RNA, 22 nt, Human
acugagguuucauuuuaucgcu

SEQ ID NO: 690117 - RNA, 22 nt, Human
cagauucugaagucuagcugcu

SEQ ID NO: 690118 - RNA, 22 nt, Human
ugagugcucuguaugugccaga

SEQ ID NO: 690119 - RNA, 22 nt, Human
ccaccuccaccuauugccagcc

SEQ ID NO: 690120 - RNA, 22 nt, Human
gggcccuggggccugauuugca

SEQ ID NO: 690121 - RNA, 22 nt, Human
auguguauuuauuuggggcuua

SEQ ID NO: 690122 - RNA, 22 nt, Human
auuuuaacccucuuauauauac

SEQ ID NO: 690123 - RNA, 22 nt, Human
cccaguggggaaauagcuagcu

SEQ ID NO: 690124 - RNA, 22 nt, Human
aacaacuugcguucagagaugu

SEQ ID NO: 690125 - RNA, 22 nt, Human
guucacauguggucaugcuguc

SEQ ID NO: 690126 - RNA, 20 nt, Human
cuguggugagcaggagagua

SEQ ID NO: 690127 - RNA, 22 nt, Human
uggcugccaugacgccugggga

SEQ ID NO: 690128 - RNA, 22 nt, Human
aagagaaagcagacuuugucau

SEQ ID NO: 690129 - RNA, 22 nt, Human
ucuguguaagaccagugcuggg

SEQ ID NO: 690130 - RNA, 22 nt, Human
cuggcuccugaggcuuggcccc

SEQ ID NO: 690131 - RNA, 22 nt, Human
cgugggaggaaaaaugggcuuc

SEQ ID NO: 690132 - RNA, 22 nt, Human
auaauaucgcuccuuuuuuuga

SEQ ID NO: 690133 - RNA, 22 nt, Human
acuggagucagggaaaaagugu

SEQ ID NO: 690134 - RNA, 22 nt, Human
gcccaagaguuaagucucugcu

SEQ ID NO: 690135 - RNA, 22 nt, Human
ugacucaguacaucuggaguug

SEQ ID NO: 690136 - RNA, 22 nt, Human
uacagcauugcauuuuccuuug

SEQ ID NO: 690137 - RNA, 22 nt, Human
uuguguaacuugagcaaacaca

SEQ ID NO: 690138 - RNA, 22 nt, Human
uuccauacgacugaggucucgg

SEQ ID NO: 690139 - RNA, 22 nt, Human
ccucugcacuucaccuuagcuc

SEQ ID NO: 690140 - RNA, 22 nt, Human
ugaggcagucacccccuccugc

SEQ ID NO: 690141 - RNA, 22 nt, Human
agcucagcacugucagcacucc

SEQ ID NO: 690142 - RNA, 22 nt, Human
gugcugaggauacagcugugaa

SEQ ID NO: 690143 - RNA, 22 nt, Human
cauuuagucaaggacacguggc

SEQ ID NO: 690144 - RNA, 22 nt, Human
ucuagcugaggguaggagaccu

SEQ ID NO: 690145 - RNA, 20 nt, Human
augcaucugguaucuuuccu

SEQ ID NO: 690146 - RNA, 22 nt, Human
cauucauuugcccaguaaguca

SEQ ID NO: 690147 - RNA, 22 nt, Human
augaaauuuuaauuauaccucu

SEQ ID NO: 690148 - RNA, 22 nt, Human
uuucaagcauaacugggaagag

SEQ ID NO: 690149 - RNA, 22 nt, Human
ucugaagagucaucuuugggug

SEQ ID NO: 690150 - RNA, 22 nt, Human
ccacccagaccagggaucuggg

SEQ ID NO: 690151 - RNA, 22 nt, Human
cggcugaggaucuccaggccug

SEQ ID NO: 690152 - RNA, 22 nt, Human
uucuaugauucauuuagaaguu

SEQ ID NO: 690153 - RNA, 22 nt, Human
gagugugggucucagcuuuaag

SEQ ID NO: 690154 - RNA, 22 nt, Human
guuguaaauacagcagauaauu

SEQ ID NO: 690155 - RNA, 22 nt, Human
uccuggauggagcugcccucgc

SEQ ID NO: 690156 - RNA, 22 nt, Human
cugugcuugacagugggaagca

SEQ ID NO: 690157 - RNA, 22 nt, Human
agugaauguccccgcgggucag

SEQ ID NO: 690158 - RNA, 22 nt, Human
ggagaguuguuuuugccuagau

SEQ ID NO: 690159 - RNA, 22 nt, Human
caggcuucaugaauuaugcacc

SEQ ID NO: 690160 - RNA, 22 nt, Human
gccuggaguacuccuugaagug

SEQ ID NO: 690161 - RNA, 22 nt, Human
cugaggcacccaucuucuccug

SEQ ID NO: 690162 - RNA, 22 nt, Human
aaggcuguuugagcacuggagc

SEQ ID NO: 690163 - RNA, 22 nt, Human
uuugcauuucucguaaggaaac

SEQ ID NO: 690164 - RNA, 22 nt, Human
gugcugcucacaucuggaggua

SEQ ID NO: 690165 - RNA, 22 nt, Human
ucagauuuccuguugaagaagu

SEQ ID NO: 690166 - RNA, 22 nt, Human
gacaggaauguguggaugcgga

SEQ ID NO: 690167 - RNA, 18 nt, Human
ucacauuauaauguaaca

SEQ ID NO: 690168 - RNA, 22 nt, Human
ccugggugucaugggcagcugg

SEQ ID NO: 690169 - RNA, 22 nt, Human
acagaagaccagagagcuaacu

SEQ ID NO: 690170 - RNA, 22 nt, Human
uguaccacucuacuaaggguuc

SEQ ID NO: 690171 - RNA, 22 nt, Human
cugauacauaguagcaugucau

SEQ ID NO: 690172 - RNA, 20 nt, Human
acacaguagaugagugacug

SEQ ID NO: 690173 - RNA, 22 nt, Human
uccaagaacccaagcgaaugcc

SEQ ID NO: 690174 - RNA, 22 nt, Human
caggaagagaacauggaggcug

SEQ ID NO: 690175 - RNA, 22 nt, Human
uucauucaucacaugcagcugg

SEQ ID NO: 690176 - RNA, 22 nt, Human
ugcuucuggaaacaguggcugu

SEQ ID NO: 690177 - RNA, 22 nt, Human
uucuucaguuugguaaauguaa

SEQ ID NO: 690178 - RNA, 22 nt, Human
uccucugaaaucuagauuguga

SEQ ID NO: 690179 - RNA, 22 nt, Human
aauacauguuuucuacuauucu

SEQ ID NO: 690180 - RNA, 22 nt, Human
ugccacaccaacaucuuucagc

SEQ ID NO: 690181 - RNA, 22 nt, Human
cacacagacagcucucugaaga

SEQ ID NO: 690182 - RNA, 21 nt, Human
agucucucuaauaaaugcuug

SEQ ID NO: 690183 - RNA, 22 nt, Human
ggucaucuguaauucuguuccu

SEQ ID NO: 690184 - RNA, 22 nt, Human
agagccaggaaguggcgugggg

SEQ ID NO: 690185 - RNA, 22 nt, Human
uguccuggagacacaagguggu

SEQ ID NO: 690186 - RNA, 22 nt, Human
ugucaucuacccguuaggcuuu

SEQ ID NO: 690187 - RNA, 22 nt, Human
agcauacaggucugaaacagcu

SEQ ID NO: 690188 - RNA, 22 nt, Human
ccagaagucaaguaagaugaag

SEQ ID NO: 690189 - RNA, 22 nt, Human
ucuuagcaugcauguauaaaua

SEQ ID NO: 690190 - RNA, 22 nt, Human
acuucuuuucaaaucaugcaaa

SEQ ID NO: 690191 - RNA, 22 nt, Human
acauuuguaggacagaggaaga

SEQ ID NO: 690192 - RNA, 18 nt, Human
agggccagcugugaguag

SEQ ID NO: 690193 - RNA, 22 nt, Human
ucagaguuucaggauacaaaua

SEQ ID NO: 690194 - RNA, 22 nt, Human
cuuucucugugugguaaagggc

SEQ ID NO: 690195 - RNA, 22 nt, Human
acagcuugcaugcagaggcacu

SEQ ID NO: 690196 - RNA, 22 nt, Human
cuagagaauugucuugagaguu

SEQ ID NO: 690197 - RNA, 17 nt, Human
cagaggagcuuuggggg

SEQ ID NO: 690198 - RNA, 22 nt, Human
aggcuucagcagcccucucuug

SEQ ID NO: 690199 - RNA, 22 nt, Human
uccuuugguaguuuucuuaaag

SEQ ID NO: 690200 - RNA, 22 nt, Human
ucucuaaagccuggaagaggag

SEQ ID NO: 690201 - RNA, 22 nt, Human
gagggggcuagcgcagugccca

SEQ ID NO: 690202 - RNA, 22 nt, Human
ugucuuuuauaacugacauaua

SEQ ID NO: 690203 - RNA, 22 nt, Human
ugugugccugagccgugccugg

SEQ ID NO: 690204 - RNA, 22 nt, Human
gcaagagcgcucucuuucauua

SEQ ID NO: 690205 - RNA, 18 nt, Human
gggaagaggaucuggccc

SEQ ID NO: 690206 - RNA, 22 nt, Human
gcuucuguauuuauuguccuuu

SEQ ID NO: 690207 - RNA, 22 nt, Human
uacugaaauagcacucugaugc

SEQ ID NO: 690208 - RNA, 22 nt, Human
cacauuccugagcuucgaccug

SEQ ID NO: 690209 - RNA, 22 nt, Human
aggguggaagauggcacuaucu

SEQ ID NO: 690210 - RNA, 22 nt, Human
cugggaaguagaaucagaugag

SEQ ID NO: 690211 - RNA, 22 nt, Human
aacgugcaccaggaggucauga

SEQ ID NO: 690212 - RNA, 22 nt, Human
aaaccugauagauuuucagaau

SEQ ID NO: 690213 - RNA, 22 nt, Human
uucacaaaacacuauuuucugg

SEQ ID NO: 690214 - RNA, 22 nt, Human
ggccuuggaguccuccacugga

SEQ ID NO: 690215 - RNA, 22 nt, Human
acugcuuccuggauggccagca

SEQ ID NO: 690216 - RNA, 22 nt, Human
auucugggaacuuugucucuca

SEQ ID NO: 690217 - RNA, 22 nt, Human
aucagaagcuuguagucucucu

SEQ ID NO: 690218 - RNA, 22 nt, Human
aaacaguaaguucuaguauuau

SEQ ID NO: 690219 - RNA, 22 nt, Human
uaagagcuaggauuuuaaauca

SEQ ID NO: 690220 - RNA, 22 nt, Human
gugccuggacccucuuuccgga

SEQ ID NO: 690221 - RNA, 22 nt, Human
agcugggcagacugcagugguu

SEQ ID NO: 690222 - RNA, 22 nt, Human
uccaggcuagagugcaguggcc

SEQ ID NO: 690223 - RNA, 22 nt, Human
aguuagugugauggagguacga

SEQ ID NO: 690224 - RNA, 22 nt, Human
ugcugagggagcaucaaagaaa

SEQ ID NO: 690225 - RNA, 22 nt, Human
aaggagcucccggcagaccagg

SEQ ID NO: 690226 - RNA, 22 nt, Human
aagcagcauaauugcuauuuua

SEQ ID NO: 690227 - RNA, 22 nt, Human
cucccagguuccgacgccucuu

SEQ ID NO: 690228 - RNA, 22 nt, Human
auacuuuggucacuauuauugg

SEQ ID NO: 690229 - RNA, 22 nt, Human
gcacugugacccagagcaggug

SEQ ID NO: 690230 - RNA, 22 nt, Human
ugucuguauaucacuuuugucc

SEQ ID NO: 690231 - RNA, 22 nt, Human
ucuaagaauacucauaucuucu

SEQ ID NO: 690232 - RNA, 22 nt, Human
ggaagcuguuccuguguggcca

SEQ ID NO: 690233 - RNA, 22 nt, Human
uuauggaauaaccuuucugaaa

SEQ ID NO: 690234 - RNA, 22 nt, Human
gcugaggccucagaaggcugag

SEQ ID NO: 690235 - RNA, 22 nt, Human
auggaagcagacagguaauucc

SEQ ID NO: 690236 - RNA, 22 nt, Human
cuggagagggagcuguuggaag

SEQ ID NO: 690237 - RNA, 22 nt, Human
gagcaucugaugagauuggauu

SEQ ID NO: 690238 - RNA, 22 nt, Human
gugugugccaucaagagcuuuc

SEQ ID NO: 690239 - RNA, 20 nt, Human
gcuggcugaacugaaagcaa

SEQ ID NO: 690240 - RNA, 22 nt, Human
uuguuucuucaggcuuuuagga

SEQ ID NO: 690241 - RNA, 19 nt, Human
cagcaaacacuguaaaugg

SEQ ID NO: 690242 - RNA, 22 nt, Human
ccaggucuuugacuaauaugcu

SEQ ID NO: 690243 - RNA, 22 nt, Human
uucagcaccacuuccagagaag

SEQ ID NO: 690244 - RNA, 22 nt, Human
aaggcaauuggcuuguauaaga

SEQ ID NO: 690245 - RNA, 22 nt, Human
gaauuguacgcuuuacauaggu

SEQ ID NO: 690246 - RNA, 20 nt, Human
uacacuaaguaugaagugcu

SEQ ID NO: 690247 - RNA, 22 nt, Human
ugguuucaugagaugagaauuu

SEQ ID NO: 690248 - RNA, 22 nt, Human
cuugguaaaacugucuuaaauu

SEQ ID NO: 690249 - RNA, 22 nt, Human
aguaugaaccuggguucuggau

SEQ ID NO: 690250 - RNA, 22 nt, Human
ucuauguccuuucucccauucc

SEQ ID NO: 690251 - RNA, 22 nt, Human
gcuucugccuugcacuuuguca

SEQ ID NO: 690252 - RNA, 22 nt, Human
gggcagcaugaggacccucauc

SEQ ID NO: 690253 - RNA, 22 nt, Human
uaguuuaggaauuaugagggug

SEQ ID NO: 690254 - RNA, 22 nt, Human
ggucagaauuaggucuagagua

SEQ ID NO: 690255 - RNA, 22 nt, Human
gugcaaaaguaauggcaguuuu

SEQ ID NO: 690256 - RNA, 22 nt, Human
ucagccagagguggaugaguca

SEQ ID NO: 690257 - RNA, 16 nt, Human
cagcccaggggcgggc

SEQ ID NO: 690258 - RNA, 22 nt, Human
ggcuggaauagagacugacugg

SEQ ID NO: 690259 - RNA, 22 nt, Human
gcaggcucccuugcagagcagg

SEQ ID NO: 690260 - RNA, 22 nt, Human
uucuucaguguagcaacuguau

SEQ ID NO: 690261 - RNA, 22 nt, Human
augggcucuaugucuaggagau

SEQ ID NO: 690262 - RNA, 22 nt, Human
auuauuucagucagacacuggc

SEQ ID NO: 690263 - RNA, 22 nt, Human
acugacauuuuucccuaagcau

SEQ ID NO: 690264 - RNA, 22 nt, Human
ugaaaguuauuacugaugaugu

SEQ ID NO: 690265 - RNA, 22 nt, Human
agagcaucuaacacauaagccu

SEQ ID NO: 690266 - RNA, 22 nt, Human
uguguucaaugacuucaucuuu

SEQ ID NO: 690267 - RNA, 22 nt, Human
uagcagugccaggauuuugcug

SEQ ID NO: 690268 - RNA, 22 nt, Human
auuugccuuggugauuuguaaa

SEQ ID NO: 690269 - RNA, 22 nt, Human
uacaacagacaggaauaagauu

SEQ ID NO: 690270 - RNA, 22 nt, Human
aaaugcugcagcuaguguguuu

SEQ ID NO: 690271 - RNA, 22 nt, Human
uagggagaggaagcaggccgcu

SEQ ID NO: 690272 - RNA, 19 nt, Human
agaaaucucgagauuuguu

SEQ ID NO: 690273 - RNA, 22 nt, Human
aguuuuucugcuggucucacua

SEQ ID NO: 690274 - RNA, 22 nt, Human
uccuggaggacagaggcaucuc

SEQ ID NO: 690275 - RNA, 22 nt, Human
auuaacagaauuuuacaugcuu

SEQ ID NO: 690276 - RNA, 22 nt, Human
gacggagcugguugcugcggcu

SEQ ID NO: 690277 - RNA, 22 nt, Human
uccugggcgagguacuggggcu

SEQ ID NO: 690278 - RNA, 22 nt, Human
caagcagagagguuagaacaca

SEQ ID NO: 690279 - RNA, 17 nt, Human
cuccuggcagccucagg

SEQ ID NO: 690280 - RNA, 22 nt, Human
cugcguguuccugaagcgcgcu

SEQ ID NO: 690281 - RNA, 22 nt, Human
cccagcaugcacgcugacacuc

SEQ ID NO: 690282 - RNA, 22 nt, Human
uuucacagaaaggauaacauua

SEQ ID NO: 690283 - RNA, 22 nt, Human
cuguaacucugccaagaaggcu

SEQ ID NO: 690284 - RNA, 22 nt, Human
ucauggaaggaugcccugcaag

SEQ ID NO: 690285 - RNA, 22 nt, Human
gcagcaggcacuuaccguugcu

SEQ ID NO: 690286 - RNA, 22 nt, Human
aagagaugcuuuacaucggaug

SEQ ID NO: 690287 - RNA, 22 nt, Human
cgggcuuccuccagggaagugc

SEQ ID NO: 690288 - RNA, 22 nt, Human
ggcucaggccagaccacgacuc

SEQ ID NO: 690289 - RNA, 19 nt, Human
cugcucagagcagcuccag

SEQ ID NO: 690290 - RNA, 20 nt, Human
ugaagauuuuguguuuagaa

SEQ ID NO: 690291 - RNA, 22 nt, Human
agacagggucuugaucagagcu

SEQ ID NO: 690292 - RNA, 22 nt, Human
uccuuccugcucuaacauucag

SEQ ID NO: 690293 - RNA, 22 nt, Human
acagcuguguuuuauaaucagc

SEQ ID NO: 690294 - RNA, 22 nt, Human
caaagucauaaaacuuguaagu

SEQ ID NO: 690295 - RNA, 22 nt, Human
acugggcugguuaguuuuacua

SEQ ID NO: 690296 - RNA, 22 nt, Human
auucucaguucacuaguuucuu

SEQ ID NO: 690297 - RNA, 22 nt, Human
cccuggcagaaugucucugggc

SEQ ID NO: 690298 - RNA, 22 nt, Human
uaucaucuuguugucaugcagc

SEQ ID NO: 690299 - RNA, 23 nt, Human
aacaauagguuuuggcagaauag

SEQ ID NO: 690300 - RNA, 22 nt, Human
cugagaaagugaggguuaaaca

SEQ ID NO: 690301 - RNA, 22 nt, Human
uggcuccaugauaguucuuaca

SEQ ID NO: 690302 - RNA, 22 nt, Human
uggagccagcgagccgaggcgg

SEQ ID NO: 690303 - RNA, 22 nt, Human
cacuaguccugguuucaugcua

SEQ ID NO: 690304 - RNA, 22 nt, Human
gaaauugucugugcccaagucu

SEQ ID NO: 690305 - RNA, 22 nt, Human
uuuauguuugacaaugaucugg

SEQ ID NO: 690306 - RNA, 22 nt, Human
ccacagauuauuucuaaacagg

SEQ ID NO: 690307 - RNA, 22 nt, Human
gagaguucuugccuggguauua

SEQ ID NO: 690308 - RNA, 22 nt, Human
ggcaaaaaguucccaucagugu

SEQ ID NO: 690309 - RNA, 22 nt, Human
gucuaaacuuagggaucgaaca

SEQ ID NO: 690310 - RNA, 22 nt, Human
ugugccuuuaaggggagcugag

SEQ ID NO: 690311 - RNA, 22 nt, Human
ccucucucuccugcacacacac

SEQ ID NO: 690312 - RNA, 22 nt, Human
acaggcacuuugacaugccauc

SEQ ID NO: 690313 - RNA, 22 nt, Human
caggcagagugagguggucuaa

SEQ ID NO: 690314 - RNA, 22 nt, Human
ggagccuguggcugcuugaagc

SEQ ID NO: 690315 - RNA, 22 nt, Human
ucagcagugcagggugaggcag

SEQ ID NO: 690316 - RNA, 22 nt, Human
ucuccucugugccacagcuugg

SEQ ID NO: 690317 - RNA, 23 nt, Human
ugggccuggccucccaguccagc

SEQ ID NO: 690318 - RNA, 22 nt, Human
uccuguggucuggaaggaaugg

SEQ ID NO: 690319 - RNA, 22 nt, Human
cagcauggggaucacuguaggc

SEQ ID NO: 690320 - RNA, 22 nt, Human
uauguuuuucaagugcacacua

SEQ ID NO: 690321 - RNA, 22 nt, Human
agguuggccucagggaggcucu

SEQ ID NO: 690322 - RNA, 22 nt, Human
acuccagggcuucuaugauggu

SEQ ID NO: 690323 - RNA, 22 nt, Human
auguguaaaaagugcuuaauau

SEQ ID NO: 690324 - RNA, 22 nt, Human
cuucuugcaauuuucaucuuau

SEQ ID NO: 690325 - RNA, 22 nt, Human
ccagucuguucucaccucugag

SEQ ID NO: 690326 - RNA, 22 nt, Human
uggcucucugggagguccuggc

SEQ ID NO: 690327 - RNA, 22 nt, Human
uaucauaaguuaauuaaacagu

SEQ ID NO: 690328 - RNA, 20 nt, Human
ggacuacaauuugcagugug

SEQ ID NO: 690329 - RNA, 22 nt, Human
gagaauuuucuaguaguuucau

SEQ ID NO: 690330 - RNA, 22 nt, Human
uuacacuuuaaauccagcuugu

SEQ ID NO: 690331 - RNA, 22 nt, Human
guguuuaaugcagaugugggug

SEQ ID NO: 690332 - RNA, 22 nt, Human
uaucagaacacauguuuugcag

SEQ ID NO: 690333 - RNA, 22 nt, Human
uccagaguuguaaguguugaca

SEQ ID NO: 690334 - RNA, 22 nt, Human
uggccugggucacaccaggguc

SEQ ID NO: 690335 - RNA, 22 nt, Human
cuggcagucugccucuucacug

SEQ ID NO: 690336 - RNA, 22 nt, Human
ccuggcuucucugcauuguucu

SEQ ID NO: 690337 - RNA, 22 nt, Human
uuauuuccaguccagaaauuua

SEQ ID NO: 690338 - RNA, 22 nt, Human
aagaaagguguguuugcagaug

SEQ ID NO: 690339 - RNA, 22 nt, Human
acuguuucugccacaauagccc

SEQ ID NO: 690340 - RNA, 22 nt, Human
gcagcuggagaaauaccacccu

SEQ ID NO: 690341 - RNA, 22 nt, Human
cacacaggagagugcuggaggu

SEQ ID NO: 690342 - RNA, 22 nt, Human
uaccugaaguaacaaugaauau

SEQ ID NO: 690343 - RNA, 20 nt, Human
cagcacagagcuuggcucua

SEQ ID NO: 690344 - RNA, 20 nt, Human
gaauuuuaugaacacuacca

SEQ ID NO: 690345 - RNA, 22 nt, Human
agcccggcuuccccgguugcua

SEQ ID NO: 690346 - RNA, 22 nt, Human
uuacacuuaucuagagccaugg

SEQ ID NO: 690347 - RNA, 22 nt, Human
agguggcagagugacaggcuga

SEQ ID NO: 690348 - RNA, 22 nt, Human
gcugggcuuguggccagcuggg

SEQ ID NO: 690349 - RNA, 23 nt, Human
uggcacagcaggugugcuuuguu

SEQ ID NO: 690350 - RNA, 18 nt, Human
ucugaaggaaugauucca

SEQ ID NO: 690351 - RNA, 22 nt, Human
agucacacuucguaucucuagc

SEQ ID NO: 690352 - RNA, 22 nt, Human
aacccuggggcugcucugccug

SEQ ID NO: 690353 - RNA, 22 nt, Human
uuaguaauguguuaauaugaau

SEQ ID NO: 690354 - RNA, 22 nt, Human
gagagaaagccccugcaucccu

SEQ ID NO: 690355 - RNA, 22 nt, Human
uuugaaaggaaguuaauacuuu

SEQ ID NO: 690356 - RNA, 18 nt, Human
cucaggcagagaagcuuu

SEQ ID NO: 690357 - RNA, 22 nt, Human
uggcugccgacuggcucuuggc

SEQ ID NO: 690358 - RNA, 22 nt, Human
cauggcuucuaagugauaacgu

SEQ ID NO: 690359 - RNA, 22 nt, Human
auaugggucaugugauguucaa

SEQ ID NO: 690360 - RNA, 22 nt, Human
agaggaauaugggugcacuaga

SEQ ID NO: 690361 - RNA, 22 nt, Human
aaauagacacaugcguucauau

SEQ ID NO: 690362 - RNA, 22 nt, Human
acauugaagugucuggccuccu

SEQ ID NO: 690363 - RNA, 22 nt, Human
gacaugcugaauaacuauauga

SEQ ID NO: 690364 - RNA, 22 nt, Human
aauguucagcgagggaugcuag

SEQ ID NO: 690365 - RNA, 19 nt, Human
ucuggcuccgccucuuagu

SEQ ID NO: 690366 - RNA, 22 nt, Human
uucuggagaggaacagaaaggu

SEQ ID NO: 690367 - RNA, 22 nt, Human
gaauauuuguaauuacuguuga

SEQ ID NO: 690368 - RNA, 22 nt, Human
auguaucagauaaagcaugugg

SEQ ID NO: 690369 - RNA, 22 nt, Human
ccuuuggcugcauagggaaggg

SEQ ID NO: 690370 - RNA, 22 nt, Human
ccccucuggucaaccagucaca

SEQ ID NO: 690371 - RNA, 22 nt, Human
cuuaguuugcaugauuauggag

SEQ ID NO: 690372 - RNA, 22 nt, Human
cugccugugugugccugcagaa

SEQ ID NO: 690373 - RNA, 21 nt, Human
aagcuuggcugauguuauugg

SEQ ID NO: 690374 - RNA, 22 nt, Human
uaucuguuccaggcacucagcu

SEQ ID NO: 690375 - RNA, 22 nt, Human
agagccuguacuuuucugugaa

SEQ ID NO: 690376 - RNA, 22 nt, Human
agcucuaucaccugucaguugc

SEQ ID NO: 690377 - RNA, 22 nt, Human
ccugaaacaguccuugcccuca

SEQ ID NO: 690378 - RNA, 21 nt, Human
ucauggauuuucucugcuuuu

SEQ ID NO: 690379 - RNA, 22 nt, Human
uugaaagauauguuaaucuuuc

SEQ ID NO: 690380 - RNA, 22 nt, Human
ccucagacgcaggccuaugggc

SEQ ID NO: 690381 - RNA, 22 nt, Human
uuuuaagaggaggcuguuugaa

SEQ ID NO: 690382 - RNA, 22 nt, Human
cagaggaagcagacacaucuug

SEQ ID NO: 690383 - RNA, 22 nt, Human
caauguuuacuggggacccaga

SEQ ID NO: 690384 - RNA, 22 nt, Human
uagcuuuaaugaguugguaaga

SEQ ID NO: 690385 - RNA, 22 nt, Human
ggagugaaguggcgcgaucucg

SEQ ID NO: 690386 - RNA, 22 nt, Human
auguguuugguuauaugguauu

SEQ ID NO: 690387 - RNA, 22 nt, Human
uuucugcacauuucuaaaguug

SEQ ID NO: 690388 - RNA, 22 nt, Human
agaugcugaauuauugugcuuu

SEQ ID NO: 690389 - RNA, 22 nt, Human
uguauauuguucugucucuuca

SEQ ID NO: 690390 - RNA, 22 nt, Human
uagaaacucucacgagugaaac

SEQ ID NO: 690391 - RNA, 22 nt, Human
cugucaggggcggguggagcgg

SEQ ID NO: 690392 - RNA, 22 nt, Human
uggcagauacccaggcaaaugg

SEQ ID NO: 690393 - RNA, 22 nt, Human
cuuuacaaauuagcucucggga

SEQ ID NO: 690394 - RNA, 19 nt, Human
acacuguagauauagcuau

SEQ ID NO: 690395 - RNA, 22 nt, Human
uucaaaaugcacaaagggcuag

SEQ ID NO: 690396 - RNA, 22 nt, Human
agcugccaccucugccuuuggg

SEQ ID NO: 690397 - RNA, 20 nt, Human
uucuaacuacucucccuuug

SEQ ID NO: 690398 - RNA, 22 nt, Human
auucacaaaaugauauagauac

SEQ ID NO: 690399 - RNA, 22 nt, Human
aauuggcaagcagauuuccacu

SEQ ID NO: 690400 - RNA, 22 nt, Human
ucauaaugacaaacauacucag

SEQ ID NO: 690401 - RNA, 22 nt, Human
aagcagagguagggugugcagu

SEQ ID NO: 690402 - RNA, 22 nt, Human
ccucaggccugccagagcccca

SEQ ID NO: 690403 - RNA, 22 nt, Human
gacccuccacucacugcugugu

SEQ ID NO: 690404 - RNA, 21 nt, Human
ugcuucucuagaucaacuacu

SEQ ID NO: 690405 - RNA, 22 nt, Human
agaagccacugcucccagugag

SEQ ID NO: 690406 - RNA, 22 nt, Human
ucagaacaucccagauaguaga

SEQ ID NO: 690407 - RNA, 22 nt, Human
auucugccucacaggcagcugg

SEQ ID NO: 690408 - RNA, 19 nt, Human
gaguuauugccagggcaug

SEQ ID NO: 690409 - RNA, 22 nt, Human
augcacuuaaauaacauaacuu

SEQ ID NO: 690410 - RNA, 22 nt, Human
aacaggcuccuugugaauggau

SEQ ID NO: 690411 - RNA, 22 nt, Human
ccugggcagggagaccaggcuc

SEQ ID NO: 690412 - RNA, 23 nt, Human
ugcuggaagguccaauuugcuca

SEQ ID NO: 690413 - RNA, 22 nt, Human
agagcacaggcucaccauuguu

SEQ ID NO: 690414 - RNA, 20 nt, Human
ucacauccucucccaacaug

SEQ ID NO: 690415 - RNA, 22 nt, Human
uuuagaguccaaguucuucacu

SEQ ID NO: 690416 - RNA, 22 nt, Human
uugugucugggggagugacauc

SEQ ID NO: 690417 - RNA, 22 nt, Human
ucagcccagaccaccucauugc

SEQ ID NO: 690418 - RNA, 22 nt, Human
ggucuagaucaagaacagaacu

SEQ ID NO: 690419 - RNA, 22 nt, Human
uucaaacacuguuggcacuggg

SEQ ID NO: 690420 - RNA, 22 nt, Human
ucaaacuguuuacagugagaua

SEQ ID NO: 690421 - RNA, 22 nt, Human
agagaugguagaacagucauaa

SEQ ID NO: 690422 - RNA, 22 nt, Human
ggaggagguggguuaaguugua

SEQ ID NO: 690423 - RNA, 22 nt, Human
caaagugcugggauuagugcug

SEQ ID NO: 690424 - RNA, 22 nt, Human
gugcaccagucacaugggcaga

SEQ ID NO: 690425 - RNA, 22 nt, Human
aaucugaaaguauggagcagua

SEQ ID NO: 690426 - RNA, 22 nt, Human
uaggcaggugugcacugcccac

SEQ ID NO: 690427 - RNA, 22 nt, Human
gugugcagcagagacaggacuc

SEQ ID NO: 690428 - RNA, 22 nt, Human
ccucagagguuuucauucugua

SEQ ID NO: 690429 - RNA, 22 nt, Human
accugggaggcggagguugcag

SEQ ID NO: 690430 - RNA, 19 nt, Human
gcugaacaagucagcaacc

SEQ ID NO: 690431 - RNA, 22 nt, Human
acugaggucagggguaugugau

SEQ ID NO: 690432 - RNA, 19 nt, Human
ucacagacagagcaaucac

SEQ ID NO: 690433 - RNA, 22 nt, Human
gaagucugcugcucaggaguuu

SEQ ID NO: 690434 - RNA, 22 nt, Human
aggucacaggcuuugaaaucaa

SEQ ID NO: 690435 - RNA, 22 nt, Human
cuguguguuuauaucauuuccu

SEQ ID NO: 690436 - RNA, 22 nt, Human
agcugccucagcaacacagacc

SEQ ID NO: 690437 - RNA, 22 nt, Human
ugagagagccugaaucucuuac

SEQ ID NO: 690438 - RNA, 22 nt, Human
uccagcuuauagguagauuuaa

SEQ ID NO: 690439 - RNA, 22 nt, Human
uagcagaggcugucugacuuaa

SEQ ID NO: 690440 - RNA, 22 nt, Human
gaaacaaucaucaugugauuug

SEQ ID NO: 690441 - RNA, 22 nt, Human
aguguccccuacagaggcauuc

SEQ ID NO: 690442 - RNA, 22 nt, Human
aucaaaguucguaacugauaac

SEQ ID NO: 690443 - RNA, 22 nt, Human
agcaguaagacuuuuuucugug

SEQ ID NO: 690444 - RNA, 22 nt, Human
ggcugcuguuucagagacuguu

SEQ ID NO: 690445 - RNA, 22 nt, Human
augacaauggacauaguuaaaa

SEQ ID NO: 690446 - RNA, 22 nt, Human
auagacaugcaacacuuuuuac

SEQ ID NO: 690447 - RNA, 22 nt, Human
cacugucuuuugugaagacaau

SEQ ID NO: 690448 - RNA, 22 nt, Human
cagcucugguccagggagggca

SEQ ID NO: 690449 - RNA, 22 nt, Human
uaacacuguaaaccuagauguu

SEQ ID NO: 690450 - RNA, 22 nt, Human
cuccagugagugagcaggcgac

SEQ ID NO: 690451 - RNA, 22 nt, Human
uccccuccucuccugauauggg

SEQ ID NO: 690452 - RNA, 22 nt, Human
cccuccagugucccagugggga

SEQ ID NO: 690453 - RNA, 22 nt, Human
auugagcaccuacaguauuacc

SEQ ID NO: 690454 - RNA, 22 nt, Human
gccagccacuucccagacuggc

SEQ ID NO: 690455 - RNA, 22 nt, Human
uguggcaggcauucugaggcug

SEQ ID NO: 690456 - RNA, 22 nt, Human
caggcaccaauagggaucgugg

SEQ ID NO: 690457 - RNA, 22 nt, Human
ugagauucuguucagaaaaaug

SEQ ID NO: 690458 - RNA, 19 nt, Human
uagaggagaagggaagugg

SEQ ID NO: 690459 - RNA, 19 nt, Human
cucugggcaagucacuuaa

SEQ ID NO: 690460 - RNA, 22 nt, Human
ugauuuaugaccaaguuagaau

SEQ ID NO: 690461 - RNA, 22 nt, Human
aaguaacuuauuugcaaacagg

SEQ ID NO: 690462 - RNA, 22 nt, Human
ggacaggguaaguacuagugug

SEQ ID NO: 690463 - RNA, 22 nt, Human
acugugugaaacaucaaugugu

SEQ ID NO: 690464 - RNA, 22 nt, Human
gccagcugaaauuucaguucug

SEQ ID NO: 690465 - RNA, 22 nt, Human
agugucugccaacugcaugguc

SEQ ID NO: 690466 - RNA, 22 nt, Human
ugugcucuggaguugccuucac

SEQ ID NO: 690467 - RNA, 22 nt, Human
gcauugaaggacuuccauuaua

SEQ ID NO: 690468 - RNA, 22 nt, Human
guggccaacucaauguuuuuca

SEQ ID NO: 690469 - RNA, 22 nt, Human
uaaccugcugugcuggucaguc

SEQ ID NO: 690470 - RNA, 22 nt, Human
aauucagugucuggcacugcug

SEQ ID NO: 690471 - RNA, 22 nt, Human
uuacaacuugcagaggauguug

SEQ ID NO: 690472 - RNA, 22 nt, Human
acauuuuaauaugcuuagugug

SEQ ID NO: 690473 - RNA, 22 nt, Human
guuuauuggguauuguggagcc

SEQ ID NO: 690474 - RNA, 22 nt, Human
ggcagagcgcaugcgucgcaga

SEQ ID NO: 690475 - RNA, 22 nt, Human
uauuaauaagugacuacuagcu

SEQ ID NO: 690476 - RNA, 22 nt, Human
ggcugcucggcagcuccugagc

SEQ ID NO: 690477 - RNA, 22 nt, Human
cuccuggggcacuuagaagcaa

SEQ ID NO: 690478 - RNA, 22 nt, Human
uggcuucagaucugccccggag

SEQ ID NO: 690479 - RNA, 22 nt, Human
cuuauuugaauguaugaguuuu

SEQ ID NO: 690480 - RNA, 22 nt, Human
uuucaguuugaaggaaaggcca

SEQ ID NO: 690481 - RNA, 22 nt, Human
gcaugcauuacaugggauaugc

SEQ ID NO: 690482 - RNA, 22 nt, Human
cuguggcucauucuugguggca

SEQ ID NO: 690483 - RNA, 22 nt, Human
uuguaacagguacuaaauaacu

SEQ ID NO: 690484 - RNA, 22 nt, Human
gggcugcuguagagaacauguu

SEQ ID NO: 690485 - RNA, 22 nt, Human
uguuccuucacagcaguggaca

SEQ ID NO: 690486 - RNA, 22 nt, Human
aagugugugagccugucaggcu

SEQ ID NO: 690487 - RNA, 22 nt, Human
ucagucccaagguccugaggug

SEQ ID NO: 690488 - RNA, 22 nt, Human
gggcacaggaauuugggaugug

SEQ ID NO: 690489 - RNA, 23 nt, Human
uugauacagaagaaucaguuugu

SEQ ID NO: 690490 - RNA, 22 nt, Human
cagccagguucaaguccuuaua

SEQ ID NO: 690491 - RNA, 22 nt, Human
acacagggaggaggugcugugc

SEQ ID NO: 690492 - RNA, 20 nt, Human
aacaguaccauuuaucucag

SEQ ID NO: 690493 - RNA, 22 nt, Human
uggcaggaagcaucuauagguc

SEQ ID NO: 690494 - RNA, 22 nt, Human
cugcuuuuucuaggaggacaau

SEQ ID NO: 690495 - RNA, 22 nt, Human
cuccucagcugggaggaguccc

SEQ ID NO: 690496 - RNA, 22 nt, Human
ggguggugagauguagcugaug

SEQ ID NO: 690497 - RNA, 22 nt, Human
uggcuccagguugaacuuuggg

SEQ ID NO: 690498 - RNA, 22 nt, Human
agagaagagcaaugauaaauuu

SEQ ID NO: 690499 - RNA, 22 nt, Human
uugaggaguguuuagggugagg

SEQ ID NO: 690500 - RNA, 22 nt, Human
accucucaggucuuccucauau

SEQ ID NO: 690501 - RNA, 22 nt, Human
acugugggucccagcugugucu

SEQ ID NO: 690502 - RNA, 22 nt, Human
ucacaggccuggggcagagggc

SEQ ID NO: 690503 - RNA, 22 nt, Human
agccaggcuaaaugagccauga

SEQ ID NO: 690504 - RNA, 19 nt, Human
agcauagacuucucaggaa

SEQ ID NO: 690505 - RNA, 22 nt, Human
aaacuccugggcucaagcaguu

SEQ ID NO: 690506 - RNA, 22 nt, Human
ucuccugaagaccaugugcacu

SEQ ID NO: 690507 - RNA, 20 nt, Human
uguauucuucuccuuccucc

SEQ ID NO: 690508 - RNA, 22 nt, Human
augucugcuauucauagggaaa

SEQ ID NO: 690509 - RNA, 22 nt, Human
acuguaaugguggauccauguc

SEQ ID NO: 690510 - RNA, 22 nt, Human
uuacacugacagcugaaaagca

SEQ ID NO: 690511 - RNA, 22 nt, Human
uucaguuucuaaagauguuccu

SEQ ID NO: 690512 - RNA, 22 nt, Human
ccucugugacaaacaguccugg

SEQ ID NO: 690513 - RNA, 22 nt, Human
auccauucuaugugaaaugucc

SEQ ID NO: 690514 - RNA, 22 nt, Human
accugggaaaaggaguggccau

SEQ ID NO: 690515 - RNA, 22 nt, Human
ggcuaggcaggcucagagccua

SEQ ID NO: 690516 - RNA, 22 nt, Human
uaacauguuuguacacugaaac

SEQ ID NO: 690517 - RNA, 22 nt, Human
ggaaggaacaaacccugugugg

SEQ ID NO: 690518 - RNA, 22 nt, Human
ucacccaggguguuuggugucu

SEQ ID NO: 690519 - RNA, 22 nt, Human
gaggcuggacgugcauuucuac

SEQ ID NO: 690520 - RNA, 22 nt, Human
ggaagcagccugaagccaaggg

SEQ ID NO: 690521 - RNA, 22 nt, Human
uagcauuuggcaccaguuauuu

SEQ ID NO: 690522 - RNA, 22 nt, Human
ugcuucaggagaugucaccaug

SEQ ID NO: 690523 - RNA, 22 nt, Human
aucccucagcagacagcaaaau

SEQ ID NO: 690524 - RNA, 19 nt, Human
cuuauuucugguuuugggu

SEQ ID NO: 690525 - RNA, 22 nt, Human
uugaaugaagucccuuuuuacu

SEQ ID NO: 690526 - RNA, 22 nt, Human
uggcugucagcugccuggugcg

SEQ ID NO: 690527 - RNA, 22 nt, Human
gggaccagaggcugugcacaau

SEQ ID NO: 690528 - RNA, 23 nt, Human
ccucuccagacacugggccuugu

SEQ ID NO: 690529 - RNA, 22 nt, Human
acagcuuguaucccaauggagc

SEQ ID NO: 690530 - RNA, 22 nt, Human
uacaugcucuucaaggacucau

SEQ ID NO: 690531 - RNA, 22 nt, Human
auucugcacauccaagaacagg

SEQ ID NO: 690532 - RNA, 22 nt, Human
cagcuccugcagcugcugccgu

SEQ ID NO: 690533 - RNA, 22 nt, Human
ucagggaauaaguagaugagug

SEQ ID NO: 690534 - RNA, 22 nt, Human
ugggaggugauuaaauuauggg

SEQ ID NO: 690535 - RNA, 22 nt, Human
uccagccaaucagagcugaggc

SEQ ID NO: 690536 - RNA, 22 nt, Human
ggaagauucaguuaucucauga

SEQ ID NO: 690537 - RNA, 22 nt, Human
auggcagaaaggcaugugggcc

SEQ ID NO: 690538 - RNA, 22 nt, Human
ggucugaauauagaacuuaagu

SEQ ID NO: 690539 - RNA, 22 nt, Human
cugugacagagcuugagugaga

SEQ ID NO: 690540 - RNA, 22 nt, Human
ucuagcaagcucgugcucaagg

SEQ ID NO: 690541 - RNA, 22 nt, Human
aaaugucagaagcuuuacuucu

SEQ ID NO: 690542 - RNA, 22 nt, Human
ccaggcagagggaauagcaagu

SEQ ID NO: 690543 - RNA, 22 nt, Human
uguaaagaaauagcauuuguag

SEQ ID NO: 690544 - RNA, 22 nt, Human
agacagcauuucuagcaccagg

SEQ ID NO: 690545 - RNA, 21 nt, Human
cugcucugacagugaggccag

SEQ ID NO: 690546 - RNA, 22 nt, Human
cagcaucuguauccuaggcuga

SEQ ID NO: 690547 - RNA, 22 nt, Human
gacaugggaugagaugaagcau

SEQ ID NO: 690548 - RNA, 22 nt, Human
ugucaaaaagcugggacaagca

SEQ ID NO: 690549 - RNA, 22 nt, Human
cccuggcauaaaacuucuccag

SEQ ID NO: 690550 - RNA, 22 nt, Human
aaugaacagugggugagguacc

SEQ ID NO: 690551 - RNA, 22 nt, Human
ucugaggaagcagcaggaagug

SEQ ID NO: 690552 - RNA, 22 nt, Human
cacauugaaccauauauuagug

SEQ ID NO: 690553 - RNA, 22 nt, Human
gagggguggcccuggcguguac

SEQ ID NO: 690554 - RNA, 22 nt, Human
cagccugacuauggcugcaggu

SEQ ID NO: 690555 - RNA, 22 nt, Human
aaguacaucaaauguuuggcua

SEQ ID NO: 690556 - RNA, 22 nt, Human
gcggggggaggaacaucuugca

SEQ ID NO: 690557 - RNA, 22 nt, Human
aggcuaaaagagaaucauuuag

SEQ ID NO: 690558 - RNA, 22 nt, Human
ucaugcaaggcugaaacauggu

SEQ ID NO: 690559 - RNA, 22 nt, Human
aagcagagagcagaauuaaguu

SEQ ID NO: 690560 - RNA, 22 nt, Human
ggcuuguugaaacacagauugu

SEQ ID NO: 690561 - RNA, 22 nt, Human
gcuauuuauuaaaauggugaag

SEQ ID NO: 690562 - RNA, 22 nt, Human
ccacaugcucucucuccagguu

SEQ ID NO: 690563 - RNA, 22 nt, Human
cacuucaaccucugaguccugg

SEQ ID NO: 690564 - RNA, 22 nt, Human
aguaugaagaugaugaaaaaua

SEQ ID NO: 690565 - RNA, 22 nt, Human
uaauguguccugaaagcuucug

SEQ ID NO: 690566 - RNA, 19 nt, Human
agcagccauagacaauaug

SEQ ID NO: 690567 - RNA, 22 nt, Human
gaaagguugggugaauggugga

SEQ ID NO: 690568 - RNA, 22 nt, Human
ucaccacuaggaauuguguagu

SEQ ID NO: 690569 - RNA, 22 nt, Human
cacugaagcuuucauucucuug

SEQ ID NO: 690570 - RNA, 22 nt, Human
cacagccuugagcgaggacaag

SEQ ID NO: 690571 - RNA, 23 nt, Human
agacuggggcauaagaagauggc

SEQ ID NO: 690572 - RNA, 22 nt, Human
gcuuggaaguaggauugggaga

SEQ ID NO: 690573 - RNA, 22 nt, Human
cuggcuaugugguuagacauaa

SEQ ID NO: 690574 - RNA, 18 nt, Human
acccugggcaauucacuc

SEQ ID NO: 690575 - RNA, 22 nt, Human
uggauggguugaaaugugagcc

SEQ ID NO: 690576 - RNA, 22 nt, Human
ggggacugaggcacugaaggug

SEQ ID NO: 690577 - RNA, 22 nt, Human
ggcccaucucuugcucuggguu

SEQ ID NO: 690578 - RNA, 22 nt, Human
acacuucaugcauucuucacuc

SEQ ID NO: 690579 - RNA, 22 nt, Human
auagccaggagaugauggggga

SEQ ID NO: 690580 - RNA, 22 nt, Human
uagugaaagucaaagacagcua

SEQ ID NO: 690581 - RNA, 22 nt, Human
uuuguggaacucucuucuugca

SEQ ID NO: 690582 - RNA, 22 nt, Human
uuuaguaccaucauuugccucu

SEQ ID NO: 690583 - RNA, 22 nt, Human
aacauuucuucugaaacugagu

SEQ ID NO: 690584 - RNA, 22 nt, Human
ucagaguguggugagaugugca

SEQ ID NO: 690585 - RNA, 22 nt, Human
auuuccaauuucauccaugucc

SEQ ID NO: 690586 - RNA, 22 nt, Human
aggucucccaagggccagggag

SEQ ID NO: 690587 - RNA, 22 nt, Human
ggaugcaggaacacagcgaccu

SEQ ID NO: 690588 - RNA, 22 nt, Human
uccaggcccgagaugggcugga

SEQ ID NO: 690589 - RNA, 22 nt, Human
uccauucuuuugcugucuuccu

SEQ ID NO: 690590 - RNA, 22 nt, Human
uucccagagauaagacgucuua

SEQ ID NO: 690591 - RNA, 22 nt, Human
agaggagcugggaggcccucgu

SEQ ID NO: 690592 - RNA, 22 nt, Human
aaaggccacacugcucuuucuc

SEQ ID NO: 690593 - RNA, 19 nt, Human
cuugccuguuccuacagcu

SEQ ID NO: 690594 - RNA, 22 nt, Human
cuguucaugcugauucuguaug

SEQ ID NO: 690595 - RNA, 22 nt, Human
uguuucuugagaguauuacccu

SEQ ID NO: 690596 - RNA, 22 nt, Human
gauggcaggcaggugaguagag

SEQ ID NO: 690597 - RNA, 22 nt, Human
gaguagaaggaaguuaucuacc

SEQ ID NO: 690598 - RNA, 22 nt, Human
aaugcuuauaacguuagaaugu

SEQ ID NO: 690599 - RNA, 22 nt, Human
uuuauucuugagagugagaaga

SEQ ID NO: 690600 - RNA, 22 nt, Human
augacaaaggcugaaagggaaa

SEQ ID NO: 690601 - RNA, 22 nt, Human
ucuggcuccaccuccuuuacua

SEQ ID NO: 690602 - RNA, 22 nt, Human
uucuccugaguucccaggucua

SEQ ID NO: 690603 - RNA, 22 nt, Human
cuugugcauuucauuccucagg

SEQ ID NO: 690604 - RNA, 22 nt, Human
uucucugggguucaguaucucu

SEQ ID NO: 690605 - RNA, 22 nt, Human
gaagaagagauaauggggagca

SEQ ID NO: 690606 - RNA, 22 nt, Human
uuuuccuucaccucuugagccu

SEQ ID NO: 690607 - RNA, 22 nt, Human
cuccaaggugguuauuugagau

SEQ ID NO: 690608 - RNA, 22 nt, Human
cuggccagaagcaccuuuggcg

SEQ ID NO: 690609 - RNA, 22 nt, Human
agggacaugaggaugaucuaga

SEQ ID NO: 690610 - RNA, 22 nt, Human
cagcuguugucucucacauauu

SEQ ID NO: 690611 - RNA, 22 nt, Human
uuagcaaaguuugccaucuagu

SEQ ID NO: 690612 - RNA, 19 nt, Human
gcagacagguccagagagg

SEQ ID NO: 690613 - RNA, 22 nt, Human
uggcagcauguuauguaaggaa

SEQ ID NO: 690614 - RNA, 22 nt, Human
cucaacaugccuacucagucug

SEQ ID NO: 690615 - RNA, 21 nt, Human
ggucuucaaagcuuuuacgau

SEQ ID NO: 690616 - RNA, 22 nt, Human
acuguucauuuguccuguaucu

SEQ ID NO: 690617 - RNA, 22 nt, Human
aaggccagcuggagggaugagg

SEQ ID NO: 690618 - RNA, 22 nt, Human
aagcugccagcugagcugaggc

SEQ ID NO: 690619 - RNA, 22 nt, Human
gcaggagcuggaaagugauguu

SEQ ID NO: 690620 - RNA, 22 nt, Human
ugugaaauugaaugcccauugc

SEQ ID NO: 690621 - RNA, 23 nt, Human
ugagugugaaaauccuggagaug

SEQ ID NO: 690622 - RNA, 22 nt, Human
gcaggagucacugacuuggucc

SEQ ID NO: 690623 - RNA, 22 nt, Human
gaggccugcuuuggcacucugg

SEQ ID NO: 690624 - RNA, 22 nt, Human
gccucagcuguugcaggggccc

SEQ ID NO: 690625 - RNA, 22 nt, Human
uuauacccuccauaccuggccu

SEQ ID NO: 690626 - RNA, 19 nt, Human
gcaggcacagcccugggug

SEQ ID NO: 690627 - RNA, 22 nt, Human
gacacagaugaucaggugugga

SEQ ID NO: 690628 - RNA, 22 nt, Human
uagaaugagaaaguguagcagg

SEQ ID NO: 690629 - RNA, 22 nt, Human
cuguguauugaaaaaggguuaa

SEQ ID NO: 690630 - RNA, 20 nt, Human
cucuuuacaugucucuuccu

SEQ ID NO: 690631 - RNA, 19 nt, Human
ggagaagcaucuagaaaua

SEQ ID NO: 690632 - RNA, 22 nt, Human
uccaagucuuccuucccaaacc

SEQ ID NO: 690633 - RNA, 19 nt, Human
caagacaaagcccaucuuc

SEQ ID NO: 690634 - RNA, 22 nt, Human
agcaggaacucagggaguucuc

SEQ ID NO: 690635 - RNA, 22 nt, Human
agcagccagaaauccagaggug

SEQ ID NO: 690636 - RNA, 22 nt, Human
augcauaugcaucuguguacau

SEQ ID NO: 690637 - RNA, 20 nt, Human
gagacagcaaaagccucucc

SEQ ID NO: 690638 - RNA, 22 nt, Human
cugagaauguuuucugauugau

SEQ ID NO: 690639 - RNA, 22 nt, Human
auucugcaugguggugucucug

SEQ ID NO: 690640 - RNA, 22 nt, Human
gcugccaugccacagcacucac

SEQ ID NO: 690641 - RNA, 22 nt, Human
cauguaaaaaauuaggucaucu

SEQ ID NO: 690642 - RNA, 22 nt, Human
cugcccugcuugaugacagcga

SEQ ID NO: 690643 - RNA, 22 nt, Human
caguccuugcucaaagucuaca

SEQ ID NO: 690644 - RNA, 22 nt, Human
aagcacugagcacaguggcuga

SEQ ID NO: 690645 - RNA, 22 nt, Human
guccuucagcaccucccucggc

SEQ ID NO: 690646 - RNA, 22 nt, Human
uuugcugaacuaaaauucugaa

SEQ ID NO: 690647 - RNA, 22 nt, Human
gagugcugcuaaugcaagggug

SEQ ID NO: 690648 - RNA, 22 nt, Human
aaggagggaaagcagugcuucu

SEQ ID NO: 690649 - RNA, 22 nt, Human
ugacugugccgugccccuagga

SEQ ID NO: 690650 - RNA, 23 nt, Human
ggcuggugcccuuggccagucgg

SEQ ID NO: 690651 - RNA, 22 nt, Human
uccagagccuucgauaagaaga

SEQ ID NO: 690652 - RNA, 22 nt, Human
aacuuucucuggauggcuuccu

SEQ ID NO: 690653 - RNA, 22 nt, Human
guggggaggcauucuucucccu

SEQ ID NO: 690654 - RNA, 22 nt, Human
ucccaaagcuacucuucugacu

SEQ ID NO: 690655 - RNA, 22 nt, Human
augagguccagggaaguuaaau

SEQ ID NO: 690656 - RNA, 19 nt, Human
uccaggcauccuucaggcu

SEQ ID NO: 690657 - RNA, 22 nt, Human
cagugacagcaagcagugcugg

SEQ ID NO: 690658 - RNA, 22 nt, Human
aaaaagguugauccagauuagg

SEQ ID NO: 690659 - RNA, 22 nt, Human
ugugaaaugcuauuuccaugag

SEQ ID NO: 690660 - RNA, 22 nt, Human
gcucucugaggugcuggcagag

SEQ ID NO: 690661 - RNA, 22 nt, Human
uacacucuuaggaauugguuau

SEQ ID NO: 690662 - RNA, 22 nt, Human
uaggaaggccugucacuacuug

SEQ ID NO: 690663 - RNA, 22 nt, Human
guguuuaugagugaccuugucu

SEQ ID NO: 690664 - RNA, 22 nt, Human
ugucugagugugccugggcauu

SEQ ID NO: 690665 - RNA, 22 nt, Human
acacauggucuacuucuucuca

SEQ ID NO: 690666 - RNA, 22 nt, Human
auugcaaaauuguccuguggaa

SEQ ID NO: 690667 - RNA, 22 nt, Human
augaggcacguguuacuggccu

SEQ ID NO: 690668 - RNA, 22 nt, Human
cagagccaggccugcccucuuu

SEQ ID NO: 690669 - RNA, 22 nt, Human
uauuguucuucacuggucuuau

SEQ ID NO: 690670 - RNA, 22 nt, Human
gggcugagucugcugccuguca

SEQ ID NO: 690671 - RNA, 22 nt, Human
cucuuuccucgaugggcuccug

SEQ ID NO: 690672 - RNA, 22 nt, Human
acauggagaccagauggaagua

SEQ ID NO: 690673 - RNA, 22 nt, Human
uccaguggcaccuuggcccuca

SEQ ID NO: 690674 - RNA, 22 nt, Human
accccaagacaguagaagagaa

SEQ ID NO: 690675 - RNA, 22 nt, Human
aaauuauuaugccccucuauaa

SEQ ID NO: 690676 - RNA, 22 nt, Human
gcagcuguguaaugagcccaca

SEQ ID NO: 690677 - RNA, 22 nt, Human
cauaugaagaugucuuuuugua

SEQ ID NO: 690678 - RNA, 22 nt, Human
uggggaagcacuuugaacuuaa

SEQ ID NO: 690679 - RNA, 22 nt, Human
ugccccagacucugcucaccuc

SEQ ID NO: 690680 - RNA, 22 nt, Human
uagauacacacacagucaugug

SEQ ID NO: 690681 - RNA, 22 nt, Human
aaugcuuugauugauuaaaaca

SEQ ID NO: 690682 - RNA, 22 nt, Human
cuagggccaaaggcugugaugc

SEQ ID NO: 690683 - RNA, 22 nt, Human
ugcaggugcuccgggggugccc

SEQ ID NO: 690684 - RNA, 22 nt, Human
ucucuguggcaacuacuuagcu

SEQ ID NO: 690685 - RNA, 22 nt, Human
uucaaugagcccaagaacguga

SEQ ID NO: 690686 - RNA, 22 nt, Human
aaaaucacaagcuugggucacu

SEQ ID NO: 690687 - RNA, 22 nt, Human
ccucugugucuugguuucaaga

SEQ ID NO: 690688 - RNA, 22 nt, Human
ccaaauauuaacaaaguaauuu

SEQ ID NO: 690689 - RNA, 22 nt, Human
uuuuccagagcugucucuugca

SEQ ID NO: 690690 - RNA, 22 nt, Human
guuuguaugaauguuuuaugcu

SEQ ID NO: 690691 - RNA, 22 nt, Human
uggaauuaucugaagugauuug

SEQ ID NO: 690692 - RNA, 22 nt, Human
aagcuuuuuggauuugcuucag

SEQ ID NO: 690693 - RNA, 22 nt, Human
uccaugagacagauacuguaag

SEQ ID NO: 690694 - RNA, 22 nt, Human
uuauggcuucugugaagaauuu

SEQ ID NO: 690695 - RNA, 22 nt, Human
gaguccuuuguuccuugccaca

SEQ ID NO: 690696 - RNA, 22 nt, Human
aggaauuuuacaucucagagag

SEQ ID NO: 690697 - RNA, 22 nt, Human
agauucaggacuggccacagcc

SEQ ID NO: 690698 - RNA, 20 nt, Human
uccugcagucgcuagcgccc

SEQ ID NO: 690699 - RNA, 22 nt, Human
aauuucuugggagcucagagaa

SEQ ID NO: 690700 - RNA, 22 nt, Human
gccacugaacauuagagcuagu

SEQ ID NO: 690701 - RNA, 22 nt, Human
uaacuuugaagggaauuuuacu

SEQ ID NO: 690702 - RNA, 22 nt, Human
cugguucccagcaggaguguag

SEQ ID NO: 690703 - RNA, 22 nt, Human
cugcagggcuguggucuggagu

SEQ ID NO: 690704 - RNA, 22 nt, Human
agcaacugggcucauuuuuuaa

SEQ ID NO: 690705 - RNA, 22 nt, Human
ggucagaaggcaguuaaacaaa

SEQ ID NO: 690706 - RNA, 22 nt, Human
uggaggccaggaaggcagcgag

SEQ ID NO: 690707 - RNA, 22 nt, Human
auucacaguauggacgaaauga

SEQ ID NO: 690708 - RNA, 22 nt, Human
ucacacuggcagugcugaaggc

SEQ ID NO: 690709 - RNA, 22 nt, Human
uguucuuuucucuaaacugaua

SEQ ID NO: 690710 - RNA, 22 nt, Human
caggaaaaaugccaggagucag

SEQ ID NO: 690711 - RNA, 22 nt, Human
agagcugccgagcuggggccau

SEQ ID NO: 690712 - RNA, 22 nt, Human
gaugucuuuuuccaggcucuuu

SEQ ID NO: 690713 - RNA, 19 nt, Human
augacagaguugauaagug

SEQ ID NO: 690714 - RNA, 22 nt, Human
uaaugcuucuguuaggaucuuc

SEQ ID NO: 690715 - RNA, 22 nt, Human
uaaaacuucucauuuuuauggu

SEQ ID NO: 690716 - RNA, 22 nt, Human
cccaggaacagggcucagaccc

SEQ ID NO: 690717 - RNA, 22 nt, Human
cuaguuguuuaauauugauuga

SEQ ID NO: 690718 - RNA, 22 nt, Human
caaggaaaacagaugaucaaca

SEQ ID NO: 690719 - RNA, 22 nt, Human
augugugcgggaaggaaaguga

SEQ ID NO: 690720 - RNA, 22 nt, Human
gugcgccagcucaaggggaggc

SEQ ID NO: 690721 - RNA, 22 nt, Human
acagauauaaacuauaguagug

SEQ ID NO: 690722 - RNA, 22 nt, Human
gggccuuggcgaaguguggugg

SEQ ID NO: 690723 - RNA, 22 nt, Human
cuccucccugcgauugcucugc

SEQ ID NO: 690724 - RNA, 22 nt, Human
cuccccagcauucugacuuccu

SEQ ID NO: 690725 - RNA, 22 nt, Human
agcaucuguugaauauaauauu

SEQ ID NO: 690726 - RNA, 22 nt, Human
caggguacagaguuuucuaaac

SEQ ID NO: 690727 - RNA, 22 nt, Human
uaaaggcagccacugagcucaa

SEQ ID NO: 690728 - RNA, 22 nt, Human
aaggucagagcaggaaggaguc

SEQ ID NO: 690729 - RNA, 22 nt, Human
guuccaaauuuggaucuuuagg

SEQ ID NO: 690730 - RNA, 22 nt, Human
uaggcuccugaggacuccaugc

SEQ ID NO: 690731 - RNA, 22 nt, Human
agaaaguuuugugcuauauaug

SEQ ID NO: 690732 - RNA, 22 nt, Human
cucugcaacuucuagcaguguc

SEQ ID NO: 690733 - RNA, 22 nt, Human
caggauggagaguuguugguug

SEQ ID NO: 690734 - RNA, 22 nt, Human
acuaaggaauaugacaaacuca

SEQ ID NO: 690735 - RNA, 22 nt, Human
auacaugaucacuguauuauaa

SEQ ID NO: 690736 - RNA, 22 nt, Human
agcugggcuuggccaggucgcu

SEQ ID NO: 690737 - RNA, 22 nt, Human
aaacacugugggacaucuuacu

SEQ ID NO: 690738 - RNA, 22 nt, Human
aauacagaggggucacaauuca

SEQ ID NO: 690739 - RNA, 22 nt, Human
agguccaguugccagaauggcc

SEQ ID NO: 690740 - RNA, 22 nt, Human
uuggaagcaguguacacuguac

SEQ ID NO: 690741 - RNA, 22 nt, Human
cugcccucgggcccucccauag

SEQ ID NO: 690742 - RNA, 22 nt, Human
ugucugugacagaccuuugcua

SEQ ID NO: 690743 - RNA, 22 nt, Human
ugguggcacugacaucagacac

SEQ ID NO: 690744 - RNA, 22 nt, Human
acaguagucucaggaauaggca

SEQ ID NO: 690745 - RNA, 17 nt, Human
ggagaucuggcagaggg

SEQ ID NO: 690746 - RNA, 22 nt, Human
cauuuggauuuugaagagagua

SEQ ID NO: 690747 - RNA, 22 nt, Human
ucagggcccagagcucaggcaa

SEQ ID NO: 690748 - RNA, 22 nt, Human
cacagggcagaggguccguggc

SEQ ID NO: 690749 - RNA, 22 nt, Human
aggacagaccuaggacuggagc

SEQ ID NO: 690750 - RNA, 22 nt, Human
cagaaagaccugggcucaagag

SEQ ID NO: 690751 - RNA, 22 nt, Human
guggccagcaagugcugccucu

SEQ ID NO: 690752 - RNA, 22 nt, Human
cucugagaugauaccuucugga

SEQ ID NO: 690753 - RNA, 22 nt, Human
uucaggauucuuucagacuggg

SEQ ID NO: 690754 - RNA, 22 nt, Human
uccagcuguugauauucuaggu

SEQ ID NO: 690755 - RNA, 22 nt, Human
acacacuguaaggacuaucacu

SEQ ID NO: 690756 - RNA, 22 nt, Human
uuuguguguauauguauauaga

SEQ ID NO: 690757 - RNA, 22 nt, Human
gauagucaccucccuuaacuuu

SEQ ID NO: 690758 - RNA, 23 nt, Human
uguguuuaccugaggaucuuguu

SEQ ID NO: 690759 - RNA, 22 nt, Human
aaauaaguaaugucuuccuuuu

SEQ ID NO: 690760 - RNA, 23 nt, Human
aagaauaaaugacauuaaaggug

SEQ ID NO: 690761 - RNA, 22 nt, Human
uuuuagcacuaagugauaugcu

SEQ ID NO: 690762 - RNA, 22 nt, Human
agugucugcucagacagcuaca

SEQ ID NO: 690763 - RNA, 22 nt, Human
acccaggguuugagcucugcag

SEQ ID NO: 690764 - RNA, 22 nt, Human
gugagcagagaucgcgugauug

SEQ ID NO: 690765 - RNA, 22 nt, Human
agcagccuugcaggggucgcac

SEQ ID NO: 690766 - RNA, 22 nt, Human
guccuggggauacagaagugaa

SEQ ID NO: 690767 - RNA, 22 nt, Human
uuguguuucuggccaagaugga

SEQ ID NO: 690768 - RNA, 22 nt, Human
auuguacagcucugagaggggg

SEQ ID NO: 690769 - RNA, 19 nt, Human
uuugucucugaauaauauu

SEQ ID NO: 690770 - RNA, 22 nt, Human
uuccuggguugugcauuguaca

SEQ ID NO: 690771 - RNA, 22 nt, Human
aucaggaaagaaaagcuuggcg

SEQ ID NO: 690772 - RNA, 22 nt, Human
gcuguacaggguuauccuuucc

SEQ ID NO: 690773 - RNA, 22 nt, Human
gaggccuguagucauggaugua

SEQ ID NO: 690774 - RNA, 22 nt, Human
ucugcagaagccauggccuugc

SEQ ID NO: 690775 - RNA, 22 nt, Human
cugcuuucuuguugcaucuuaa

SEQ ID NO: 690776 - RNA, 22 nt, Human
gccacauuagcccucaccaucu

SEQ ID NO: 690777 - RNA, 22 nt, Human
cagggacaggggagaaaagaug

SEQ ID NO: 690778 - RNA, 22 nt, Human
uccaggucccagacugggcagc

SEQ ID NO: 690779 - RNA, 22 nt, Human
uagaaagcuggaggaauucuuu

SEQ ID NO: 690780 - RNA, 22 nt, Human
guggcuuccaagacuaagucac

SEQ ID NO: 690781 - RNA, 22 nt, Human
auuggaaguauuucaucaaaag

SEQ ID NO: 690782 - RNA, 20 nt, Human
uacaguguauguauuuaggc

SEQ ID NO: 690783 - RNA, 22 nt, Human
auuagcuauaugcuaugugcca

SEQ ID NO: 690784 - RNA, 22 nt, Human
acacaucuauauugcaucugca

SEQ ID NO: 690785 - RNA, 22 nt, Human
uucaggccuaauuucuagcccc

SEQ ID NO: 690786 - RNA, 22 nt, Human
agaagucaauaguuguuugaug

SEQ ID NO: 690787 - RNA, 17 nt, Human
caauuucauagguuuug

SEQ ID NO: 690788 - RNA, 22 nt, Human
agguuuaugccuuggagcuggg

SEQ ID NO: 690789 - RNA, 22 nt, Human
cuaggaaugguaccucuuacaa

SEQ ID NO: 690790 - RNA, 22 nt, Human
ggcuaggcucaccuggagaguu

SEQ ID NO: 690791 - RNA, 22 nt, Human
agcuaaggaacucuguaacacc

SEQ ID NO: 690792 - RNA, 22 nt, Human
ugucucugugagaucugacgau

SEQ ID NO: 690793 - RNA, 22 nt, Human
uagaaacagauguuuuugaaga

SEQ ID NO: 690794 - RNA, 22 nt, Human
uuugaaaguccuaggagagucc

SEQ ID NO: 690795 - RNA, 22 nt, Human
uuguguguguaacuuuaugaga

SEQ ID NO: 690796 - RNA, 22 nt, Human
agcagggaagccuccagaaccu

SEQ ID NO: 690797 - RNA, 22 nt, Human
gaaauguaggcauaauuauuuu

SEQ ID NO: 690798 - RNA, 22 nt, Human
uggcccugcugggucagagcug

SEQ ID NO: 690799 - RNA, 21 nt, Human
agcugugguuuuacaucuuuu

SEQ ID NO: 690800 - RNA, 22 nt, Human
cugcauguguuucugcuggguu

SEQ ID NO: 690801 - RNA, 20 nt, Human
ugugagaggguggcuugccc

SEQ ID NO: 690802 - RNA, 22 nt, Human
uuuacacauaccucuuuaaagu

SEQ ID NO: 690803 - RNA, 22 nt, Human
uuggaaaagcguucucuguagc

SEQ ID NO: 690804 - RNA, 22 nt, Human
gcacuggggucauagccuccag

SEQ ID NO: 690805 - RNA, 22 nt, Human
ugaaggagggaagaaggcucug

SEQ ID NO: 690806 - RNA, 22 nt, Human
ugaaucaauugucuuaagacau

SEQ ID NO: 690807 - RNA, 22 nt, Human
cagaugagcaugggcacaagca

SEQ ID NO: 690808 - RNA, 22 nt, Human
cccacucccuacgacacgcucc

SEQ ID NO: 690809 - RNA, 22 nt, Human
uuauauguuucuguuuggaggc

SEQ ID NO: 690810 - RNA, 22 nt, Human
gacagcuucuagaaauggucac

SEQ ID NO: 690811 - RNA, 22 nt, Human
uaauacuuuugccuuguauuca

SEQ ID NO: 690812 - RNA, 22 nt, Human
cugcaguuugaccuuguuuucu

SEQ ID NO: 690813 - RNA, 22 nt, Human
acagaaauauucguggugcuug

SEQ ID NO: 690814 - RNA, 22 nt, Human
auccagucaaaauuaguaaggu

SEQ ID NO: 690815 - RNA, 22 nt, Human
uccuucagaaaaccucagucuu

SEQ ID NO: 690816 - RNA, 22 nt, Human
caggccaauuucuugucauuua

SEQ ID NO: 690817 - RNA, 22 nt, Human
accauggaccauaguuccuauu

SEQ ID NO: 690818 - RNA, 22 nt, Human
uggucaggggcuucugagcugu

SEQ ID NO: 690819 - RNA, 22 nt, Human
cuccacagccccuccaguggca

SEQ ID NO: 690820 - RNA, 22 nt, Human
agucuggccuugccuugucgag

SEQ ID NO: 690821 - RNA, 22 nt, Human
gggagaaguggaaaucucauua

SEQ ID NO: 690822 - RNA, 22 nt, Human
agccucuguagaaagcagugug

SEQ ID NO: 690823 - RNA, 22 nt, Human
gagggucuuaccuaagcagggu

SEQ ID NO: 690824 - RNA, 22 nt, Human
cugagaggggaccaggguguuu

SEQ ID NO: 690825 - RNA, 22 nt, Human
cuuggcugaacuccaggaugca

SEQ ID NO: 690826 - RNA, 22 nt, Human
ugcacugaauaguagacuguac

SEQ ID NO: 690827 - RNA, 22 nt, Human
uuucugugaauuauaaaauuug

SEQ ID NO: 690828 - RNA, 22 nt, Human
cuuuggcucaugguuuuaucca

SEQ ID NO: 690829 - RNA, 22 nt, Human
aaacuacuaugggaauguacuu

SEQ ID NO: 690830 - RNA, 22 nt, Human
acaguauaacuccaugccaccc

SEQ ID NO: 690831 - RNA, 22 nt, Human
accugagcaugccaggagagug

SEQ ID NO: 690832 - RNA, 18 nt, Human
augcuucugauagaagca

SEQ ID NO: 690833 - RNA, 21 nt, Human
uugcacagaaaaccauagaga

SEQ ID NO: 690834 - RNA, 22 nt, Human
cagggcaguaccgcccucuggc

SEQ ID NO: 690835 - RNA, 22 nt, Human
ggaggaugccaagcugugcaca

SEQ ID NO: 690836 - RNA, 22 nt, Human
uuuucugugauucugagguugg

SEQ ID NO: 690837 - RNA, 22 nt, Human
uagcagggccaggcugggaacc

SEQ ID NO: 690838 - RNA, 22 nt, Human
auuaucacauggacuuugcuuu

SEQ ID NO: 690839 - RNA, 23 nt, Human
auugugagauuacuaucacacug

SEQ ID NO: 690840 - RNA, 22 nt, Human
uaucacaucaauguuuuaaaau

SEQ ID NO: 690841 - RNA, 22 nt, Human
ucugggugaugaaaugcacugu

SEQ ID NO: 690842 - RNA, 22 nt, Human
uucugccaaaggcuuuguuuug

SEQ ID NO: 690843 - RNA, 22 nt, Human
cagcagaguaauucucaccucu

SEQ ID NO: 690844 - RNA, 22 nt, Human
cagacaggcaggugcugcuuug

SEQ ID NO: 690845 - RNA, 22 nt, Human
agguggagugaaggaaaggcag

SEQ ID NO: 690846 - RNA, 22 nt, Human
aggagaggaaucauuauuacaa

SEQ ID NO: 690847 - RNA, 22 nt, Human
agggcagauggaacuuccccga

SEQ ID NO: 690848 - RNA, 22 nt, Human
agaagaaagauugaagguuccu

SEQ ID NO: 690849 - RNA, 22 nt, Human
ucaggagcagcaugggugagag

SEQ ID NO: 690850 - RNA, 22 nt, Human
acaguguuguggcucuuaauag

SEQ ID NO: 690851 - RNA, 22 nt, Human
gaagcagcuuucuggugaggag

SEQ ID NO: 690852 - RNA, 22 nt, Human
ccugagacaugaaccaggcucc

SEQ ID NO: 690853 - RNA, 22 nt, Human
gacagucugggcacacaugaaa

SEQ ID NO: 690854 - RNA, 22 nt, Human
cuauacagagcauccuuaacuu

SEQ ID NO: 690855 - RNA, 22 nt, Human
agcucacagaaauccugcagga

SEQ ID NO: 690856 - RNA, 22 nt, Human
ggguccagggccaguggcugag

SEQ ID NO: 690857 - RNA, 22 nt, Human
uggcuucauucuguaguuaaaa

SEQ ID NO: 690858 - RNA, 22 nt, Human
cagggaugucucuggaagggag

SEQ ID NO: 690859 - RNA, 22 nt, Human
agcaguguucaaugauacacug

SEQ ID NO: 690860 - RNA, 22 nt, Human
uccagggccaagucauggaacc

SEQ ID NO: 690861 - RNA, 22 nt, Human
ggucacccaugaucacaucacc

SEQ ID NO: 690862 - RNA, 21 nt, Human
aggaauguguauauauacaau

SEQ ID NO: 690863 - RNA, 22 nt, Human
uacaagauguacuaaaaauuau

SEQ ID NO: 690864 - RNA, 22 nt, Human
cuguugucuccucucagauuau

SEQ ID NO: 690865 - RNA, 22 nt, Human
cuuugcuugacacugugauugu

SEQ ID NO: 690866 - RNA, 22 nt, Human
uuauucaucagugcauuaauuu

SEQ ID NO: 690867 - RNA, 22 nt, Human
uaauuuaugaugcaaagaaaag

SEQ ID NO: 690868 - RNA, 22 nt, Human
cugugcacuucucuuuauuugu

SEQ ID NO: 690869 - RNA, 22 nt, Human
ugauuaaauuaauuaagaugag

SEQ ID NO: 690870 - RNA, 22 nt, Human
caaaaguaaucguggcuuuugc

SEQ ID NO: 690871 - RNA, 22 nt, Human
gggaggcgccgaggguagcuaa

SEQ ID NO: 690872 - RNA, 22 nt, Human
caucagcaggcaacacucuugg

SEQ ID NO: 690873 - RNA, 22 nt, Human
aagcccaguuucacacugagac

SEQ ID NO: 690874 - RNA, 22 nt, Human
uguggcuuuugcuagcuuugca

SEQ ID NO: 690875 - RNA, 22 nt, Human
auuuuucucuuuccacugagau

SEQ ID NO: 690876 - RNA, 22 nt, Human
aucacaaucccucucucugaua

SEQ ID NO: 690877 - RNA, 22 nt, Human
aggcaguuguagagagggcucu

SEQ ID NO: 690878 - RNA, 22 nt, Human
ccugugguuuacucuguggcua

SEQ ID NO: 690879 - RNA, 22 nt, Human
ugucucugugacuccuuccgcc

SEQ ID NO: 690880 - RNA, 22 nt, Human
cagcacaguagaguaguuguaa

SEQ ID NO: 690881 - RNA, 22 nt, Human
ugcgcaggagcucugccaggag

SEQ ID NO: 690882 - RNA, 22 nt, Human
uggcuuggugagcagaguguag

SEQ ID NO: 690883 - RNA, 22 nt, Human
caaacuuucaguuauaacauga

SEQ ID NO: 690884 - RNA, 22 nt, Human
aacuuuuagacuuggguauaaa

SEQ ID NO: 690885 - RNA, 22 nt, Human
cagugugugacucuggggguac

SEQ ID NO: 690886 - RNA, 16 nt, Human
aggcuccaagagcugu

SEQ ID NO: 690887 - RNA, 22 nt, Human
gaggucaaggucaagagacaga

SEQ ID NO: 690888 - RNA, 22 nt, Human
ucuguggcgcauaguugucucu

SEQ ID NO: 690889 - RNA, 19 nt, Human
ccaggacuuugcagacacu

SEQ ID NO: 690890 - RNA, 21 nt, Human
ugaauaaagcugcugucgaua

SEQ ID NO: 690891 - RNA, 22 nt, Human
ggcuuuauuucacuguaccaua

SEQ ID NO: 690892 - RNA, 22 nt, Human
gccaagagaaugugagagaaau

SEQ ID NO: 690893 - RNA, 22 nt, Human
cugggccaagaaguuguguaug

SEQ ID NO: 690894 - RNA, 22 nt, Human
cccacccugggaagcuaggcag

SEQ ID NO: 690895 - RNA, 22 nt, Human
uuuuaaaggauacucuugucua

SEQ ID NO: 690896 - RNA, 21 nt, Human
ugacaggcacccuggcuguga

SEQ ID NO: 690897 - RNA, 22 nt, Human
aacaggagaggggaauguagag

SEQ ID NO: 690898 - RNA, 22 nt, Human
gcucugggauuaccagccuuag

SEQ ID NO: 690899 - RNA, 22 nt, Human
gcagagcugcagcgaggccugg

SEQ ID NO: 690900 - RNA, 22 nt, Human
ugaaaaggaguccuuguuuuca

SEQ ID NO: 690901 - RNA, 22 nt, Human
ugccuggguugacucuuagcug

SEQ ID NO: 690902 - RNA, 22 nt, Human
uauuaacaugaacugacuuuuc

SEQ ID NO: 690903 - RNA, 22 nt, Human
uucacguuguugaagaaaauac

SEQ ID NO: 690904 - RNA, 22 nt, Human
ccugccuggcacauaguacucu

SEQ ID NO: 690905 - RNA, 22 nt, Human
aaacuucaaggauuugcaaauc

SEQ ID NO: 690906 - RNA, 22 nt, Human
gcagcaggauggccaauugcca

SEQ ID NO: 690907 - RNA, 22 nt, Human
cagaacauucacucauaugugg

SEQ ID NO: 690908 - RNA, 22 nt, Human
cugugucuaaucaggucaguca

SEQ ID NO: 690909 - RNA, 22 nt, Human
aggcauggacauuucggcagcu

SEQ ID NO: 690910 - RNA, 22 nt, Human
gcauggccauggcacuauggac

SEQ ID NO: 690911 - RNA, 22 nt, Human
gcagcucucuggccugcccugg

SEQ ID NO: 690912 - RNA, 21 nt, Human
gucauccaccucucgggcucu

SEQ ID NO: 690913 - RNA, 21 nt, Human
ggcuaggaugcugggguuucc

SEQ ID NO: 690914 - RNA, 19 nt, Human
gcuggcuggaggagggaca

SEQ ID NO: 690915 - RNA, 22 nt, Human
ggaggccuagaaaagugguucu

SEQ ID NO: 690916 - RNA, 22 nt, Human
cuguaggagugggaauuuauug

SEQ ID NO: 690917 - RNA, 22 nt, Human
uuucacagaggaggaagcugag

SEQ ID NO: 690918 - RNA, 22 nt, Human
ucagaaaauaacuguuaguuug

SEQ ID NO: 690919 - RNA, 22 nt, Human
cagcuucuaccaucaggaaauu

SEQ ID NO: 690920 - RNA, 22 nt, Human
auggcauucacauuuccagaga

SEQ ID NO: 690921 - RNA, 22 nt, Human
ugggcaucauggacagcagagg

SEQ ID NO: 690922 - RNA, 22 nt, Human
ccacuugaaauaucuuuguucu

SEQ ID NO: 690923 - RNA, 22 nt, Human
uguacuugcuuauuagaaaucu

SEQ ID NO: 690924 - RNA, 22 nt, Human
uaaaaguuuuaguuguacauaa

SEQ ID NO: 690925 - RNA, 23 nt, Human
cuagggcaguauuucacagacac

SEQ ID NO: 690926 - RNA, 22 nt, Human
gccaccugugugggccuuugug

SEQ ID NO: 690927 - RNA, 22 nt, Human
agaagcauuauaacaugcaagg

SEQ ID NO: 690928 - RNA, 22 nt, Human
uacaggauaucacuucauuucu

SEQ ID NO: 690929 - RNA, 22 nt, Human
aggcaauccccugaggauacuu

SEQ ID NO: 690930 - RNA, 22 nt, Human
aguuuuauaaaggcaccucagu

SEQ ID NO: 690931 - RNA, 22 nt, Human
gggaggaaggcuugggugagua

SEQ ID NO: 690932 - RNA, 22 nt, Human
aggacacuugagaguccaguca

SEQ ID NO: 690933 - RNA, 21 nt, Human
uuacauucagaggaguggaag

SEQ ID NO: 690934 - RNA, 22 nt, Human
aaagaaauaccuuucucagcuu

SEQ ID NO: 690935 - RNA, 22 nt, Human
ccuggcuuagagguugccuuuc

SEQ ID NO: 690936 - RNA, 22 nt, Human
aggcgugggaggaucugaggcc

SEQ ID NO: 690937 - RNA, 20 nt, Human
aguggcaggcgaucauuacu

SEQ ID NO: 690938 - RNA, 22 nt, Human
cuccugccaccgcgguguccug

SEQ ID NO: 690939 - RNA, 22 nt, Human
gccagaugccguaaagaugggc

SEQ ID NO: 690940 - RNA, 22 nt, Human
gggaccugaggagggguuucag

SEQ ID NO: 690941 - RNA, 22 nt, Human
ucucaaauucccuuuuccuccu

SEQ ID NO: 690942 - RNA, 22 nt, Human
uaggcuggaggaagcagugccu

SEQ ID NO: 690943 - RNA, 15 nt, Human
uaccagcugauccgu

SEQ ID NO: 690944 - RNA, 22 nt, Human
gaggguggaucagccugauugg

SEQ ID NO: 690945 - RNA, 22 nt, Human
uucugggaacaaaguggagugg

SEQ ID NO: 690946 - RNA, 22 nt, Human
acagccuuggguucucuggggg

SEQ ID NO: 690947 - RNA, 22 nt, Human
ccacagggcacagacaggaagc

SEQ ID NO: 690948 - RNA, 22 nt, Human
cugcuuuaauggaaaguguuuu

SEQ ID NO: 690949 - RNA, 22 nt, Human
aggcaguggcuuuuguuguguu

SEQ ID NO: 690950 - RNA, 22 nt, Human
cacacaugagucuccccauugg

SEQ ID NO: 690951 - RNA, 22 nt, Human
gagcagcuguucugacuugucu

SEQ ID NO: 690952 - RNA, 22 nt, Human
gaggggaaaguucugcacaagg

SEQ ID NO: 690953 - RNA, 22 nt, Human
ucaggagguccgcccgggaggg

SEQ ID NO: 690954 - RNA, 22 nt, Human
aagccaggccauucucugguuc

SEQ ID NO: 690955 - RNA, 23 nt, Human
acauuucaauacugagggucuga

SEQ ID NO: 690956 - RNA, 22 nt, Human
agcuagggcaaauaugagauac

SEQ ID NO: 690957 - RNA, 22 nt, Human
uuucucucugacugggagcuga

SEQ ID NO: 690958 - RNA, 22 nt, Human
ugagugaauucaaguaaagggc

SEQ ID NO: 690959 - RNA, 19 nt, Human
ggcagugagaagacuccug

SEQ ID NO: 690960 - RNA, 22 nt, Human
cagggacauuuccaagagaauu

SEQ ID NO: 690961 - RNA, 22 nt, Human
uacagagacccacaagagacug

SEQ ID NO: 690962 - RNA, 22 nt, Human
guuacaguuugggcuugauuca

SEQ ID NO: 690963 - RNA, 22 nt, Human
uaaagcuagaaggugcuguaca

SEQ ID NO: 690964 - RNA, 22 nt, Human
gugacgugaggggcuccuguug

SEQ ID NO: 690965 - RNA, 22 nt, Human
uguuuuguucacugcauugucc

SEQ ID NO: 690966 - RNA, 22 nt, Human
ucauuuucaaguuugaacagga

SEQ ID NO: 690967 - RNA, 22 nt, Human
ucagccuacacuccaacagcau

SEQ ID NO: 690968 - RNA, 23 nt, Human
uuauaagaagcaucacaggaaga

SEQ ID NO: 690969 - RNA, 22 nt, Human
cacuggugacuucugagcugga

SEQ ID NO: 690970 - RNA, 22 nt, Human
agggugcagucacaggaaaugu

SEQ ID NO: 690971 - RNA, 20 nt, Human
aggagccauugacugcagca

SEQ ID NO: 690972 - RNA, 22 nt, Human
uagggagaugcaagggacggag

SEQ ID NO: 690973 - RNA, 22 nt, Human
augagcauccagaacagugccu

SEQ ID NO: 690974 - RNA, 22 nt, Human
ucagccagggggagagaaugga

SEQ ID NO: 690975 - RNA, 22 nt, Human
ugugaggcuaccugccaggguc

SEQ ID NO: 690976 - RNA, 22 nt, Human
gccugcuggaggagccucaggg

SEQ ID NO: 690977 - RNA, 22 nt, Human
uuaaaccauaguuuaacauaag

SEQ ID NO: 690978 - RNA, 22 nt, Human
uagcaucuguucuuucauuaaa

SEQ ID NO: 690979 - RNA, 17 nt, Human
gcacugaacaauccugu

SEQ ID NO: 690980 - RNA, 22 nt, Human
caacagaccuggauucaaaaac

SEQ ID NO: 690981 - RNA, 22 nt, Human
uggaagaccagacuucccgaac

SEQ ID NO: 690982 - RNA, 22 nt, Human
caagacaagaucuaagcaugcu

SEQ ID NO: 690983 - RNA, 22 nt, Human
cugucaccucugcccuuugccc

SEQ ID NO: 690984 - RNA, 21 nt, Human
ccugugccagucuauguguuc

SEQ ID NO: 690985 - RNA, 22 nt, Human
auucacaguuacugcugaacca

SEQ ID NO: 690986 - RNA, 22 nt, Human
agacaaauuuccugcaaugaag

SEQ ID NO: 690987 - RNA, 22 nt, Human
ccuggcagaaagaguuacaccu

SEQ ID NO: 690988 - RNA, 22 nt, Human
caccagcuaauuaaaacagcag

SEQ ID NO: 690989 - RNA, 22 nt, Human
uguguuaauuuauugccucaga

SEQ ID NO: 690990 - RNA, 22 nt, Human
ugccagccuggccugagucuuu

SEQ ID NO: 690991 - RNA, 22 nt, Human
gugauugcccagcaccauuguu

SEQ ID NO: 690992 - RNA, 22 nt, Human
ccaggaaggcaggccuccccgc

SEQ ID NO: 690993 - RNA, 22 nt, Human
gagugucugaauuagagcacaa

SEQ ID NO: 690994 - RNA, 22 nt, Human
aacaggaccccgcguggugucu

SEQ ID NO: 690995 - RNA, 22 nt, Human
ggccaggaacuuuugggauggg

SEQ ID NO: 690996 - RNA, 22 nt, Human
cagcuggaucccugcagaacuu

SEQ ID NO: 690997 - RNA, 22 nt, Human
ucucaaauuugcuggaccagua

SEQ ID NO: 690998 - RNA, 22 nt, Human
agauuucuguggucauguaaug

SEQ ID NO: 690999 - RNA, 22 nt, Human
acagguguggggcugugguacu

SEQ ID NO: 691000 - RNA, 23 nt, Human
auacugaaacuguuguuuaucug

SEQ ID NO: 691001 - RNA, 22 nt, Human
cccaggaugucgaggcugcagu

SEQ ID NO: 691002 - RNA, 22 nt, Human
gauacagacaccacucuuuucc

SEQ ID NO: 691003 - RNA, 22 nt, Human
cugugcuuucaggccgcugugu

SEQ ID NO: 691004 - RNA, 22 nt, Human
uggcuucuggccaggcacagga

SEQ ID NO: 691005 - RNA, 19 nt, Human
gacuacagggggaagaagu

SEQ ID NO: 691006 - RNA, 22 nt, Human
ggcuucaaaaccuaucuuugau

SEQ ID NO: 691007 - RNA, 22 nt, Human
caaggccaagguuuugugaacu

SEQ ID NO: 691008 - RNA, 22 nt, Human
ggaagggguuaggggucccuga

SEQ ID NO: 691009 - RNA, 21 nt, Human
ugggggagaauugguugcuuu

SEQ ID NO: 691010 - RNA, 22 nt, Human
aaggcagcaagaauuccagguu

SEQ ID NO: 691011 - RNA, 22 nt, Human
uucuugaaggggauauaaauag

SEQ ID NO: 691012 - RNA, 22 nt, Human
gcucugagaggaugcugagcag

SEQ ID NO: 691013 - RNA, 22 nt, Human
gaagcaauuuagaaucagaagc

SEQ ID NO: 691014 - RNA, 23 nt, Human
aucaaaggauguagagaagaagc

SEQ ID NO: 691015 - RNA, 22 nt, Human
uguuuuccuccugguuucugcc

SEQ ID NO: 691016 - RNA, 17 nt, Human
cauguguaugugggagu

SEQ ID NO: 691017 - RNA, 22 nt, Human
gcugcaggagauuuugagaguc

SEQ ID NO: 691018 - RNA, 22 nt, Human
cuggacaaccacucagccucag

SEQ ID NO: 691019 - RNA, 22 nt, Human
ucagauuucuucuugcaacggc

SEQ ID NO: 691020 - RNA, 22 nt, Human
ucuacaggguaaggggcuugcc

SEQ ID NO: 691021 - RNA, 22 nt, Human
ugacacagggaaagcggaucca

SEQ ID NO: 691022 - RNA, 22 nt, Human
gcucagagcuugaaguuccacu

SEQ ID NO: 691023 - RNA, 22 nt, Human
aucauguuggcucugacaaaaa

SEQ ID NO: 691024 - RNA, 22 nt, Human
ugcaucugauucucaggcagaa

SEQ ID NO: 691025 - RNA, 22 nt, Human
gagguucacuuccugaaauagc

SEQ ID NO: 691026 - RNA, 22 nt, Human
caaagagguuuugagggcagcu

SEQ ID NO: 691027 - RNA, 22 nt, Human
gcagcuuucuaagcuuuauugc

SEQ ID NO: 691028 - RNA, 22 nt, Human
ccucugggggcuuccuuacccu

SEQ ID NO: 691029 - RNA, 22 nt, Human
ucuccaggggcugcugugccac

SEQ ID NO: 691030 - RNA, 19 nt, Human
uucugcuguuccuaggcug

SEQ ID NO: 691031 - RNA, 19 nt, Human
auaaggcaggaggaaauuu

SEQ ID NO: 691032 - RNA, 22 nt, Human
gagcagugagugaauguugccu

SEQ ID NO: 691033 - RNA, 22 nt, Human
agaaaaguuuaaaucuuggcac

SEQ ID NO: 691034 - RNA, 17 nt, Human
agcagaagucagaggga

SEQ ID NO: 691035 - RNA, 23 nt, Human
caugucugcuuucaugcuacaac

SEQ ID NO: 691036 - RNA, 22 nt, Human
acagcagggguggaauaaacgu

SEQ ID NO: 691037 - RNA, 22 nt, Human
ugggaagguacacgggaaagag

SEQ ID NO: 691038 - RNA, 22 nt, Human
cuccaggccccuggccuucugc

SEQ ID NO: 691039 - RNA, 22 nt, Human
gugaaggaguuaucagugguua

SEQ ID NO: 691040 - RNA, 22 nt, Human
ggaggccagggacccagucagc

SEQ ID NO: 691041 - RNA, 22 nt, Human
cgucccaguuccagccgcgcug

SEQ ID NO: 691042 - RNA, 22 nt, Human
cccccagucugaacagcagcug

SEQ ID NO: 691043 - RNA, 22 nt, Human
auagaugguauuuagacuagcg

SEQ ID NO: 691044 - RNA, 20 nt, Human
agggucaguagcacagagcu

SEQ ID NO: 691045 - RNA, 22 nt, Human
cuuccuugugguccuucucauu

SEQ ID NO: 691046 - RNA, 21 nt, Human
uucaaugaaaacaaagugagg

SEQ ID NO: 691047 - RNA, 22 nt, Human
ggcugaaacagauuucaagaca

SEQ ID NO: 691048 - RNA, 22 nt, Human
cagcagcugcaaauggaaacag

SEQ ID NO: 691049 - RNA, 22 nt, Human
guagaggacauuugacaugaug

SEQ ID NO: 691050 - RNA, 22 nt, Human
cucagcaagacccccaccgugu

SEQ ID NO: 691051 - RNA, 22 nt, Human
uagagagcuguuugaaagcagg

SEQ ID NO: 691052 - RNA, 22 nt, Human
guccccucauuuuagagaaaga

SEQ ID NO: 691053 - RNA, 22 nt, Human
ugucuuaauaugugcauucugu

SEQ ID NO: 691054 - RNA, 17 nt, Human
uggcgcucccagggugc

SEQ ID NO: 691055 - RNA, 22 nt, Human
acuguggcaaaagaacauugga

SEQ ID NO: 691056 - RNA, 22 nt, Human
gcaaugauauugaagugaugaa

SEQ ID NO: 691057 - RNA, 22 nt, Human
gacagugaacagguucccacug

SEQ ID NO: 691058 - RNA, 23 nt, Human
accuggcugcucaaccugcaggg

SEQ ID NO: 691059 - RNA, 21 nt, Human
gucagcagauccagcacuugu

SEQ ID NO: 691060 - RNA, 22 nt, Human
cauaggaagccaucucagucac

SEQ ID NO: 691061 - RNA, 22 nt, Human
aaguguggggucucagagcuga

SEQ ID NO: 691062 - RNA, 22 nt, Human
ggucucuucaggagcuugagcg

SEQ ID NO: 691063 - RNA, 22 nt, Human
guccagccaggcugcagcaccc

SEQ ID NO: 691064 - RNA, 22 nt, Human
cucagagggucuccuccagaau

SEQ ID NO: 691065 - RNA, 22 nt, Human
uggcgugcccuccagacuuggc

SEQ ID NO: 691066 - RNA, 22 nt, Human
aggagcugagucagcccgacag

SEQ ID NO: 691067 - RNA, 22 nt, Human
acuggaggggaaaaugguagua

SEQ ID NO: 691068 - RNA, 22 nt, Human
uggguccuaaaugcagucacau

SEQ ID NO: 691069 - RNA, 19 nt, Human
ucuuuagccagagcucugg

SEQ ID NO: 691070 - RNA, 22 nt, Human
gcagagcauguccucaggacag

SEQ ID NO: 691071 - RNA, 22 nt, Human
caggguggaagcuguagagugg

SEQ ID NO: 691072 - RNA, 22 nt, Human
uccagcccuguggcuuccaccc

SEQ ID NO: 691073 - RNA, 22 nt, Human
uccucauacauaucucagucuu

SEQ ID NO: 691074 - RNA, 22 nt, Human
cgaggaggaaacgcggagaacu

SEQ ID NO: 691075 - RNA, 22 nt, Human
agcugauuccacuuuuucccca

SEQ ID NO: 691076 - RNA, 22 nt, Human
acaguuugcccugacauucucc

SEQ ID NO: 691077 - RNA, 22 nt, Human
ugaagguggaagggugguucug

SEQ ID NO: 691078 - RNA, 22 nt, Human
aacuuccuucuaguucauaugu

SEQ ID NO: 691079 - RNA, 19 nt, Human
ugagugucacgucagugcc

SEQ ID NO: 691080 - RNA, 22 nt, Human
auuuuguugagguaauugucaa

SEQ ID NO: 691081 - RNA, 22 nt, Human
cacccaggcuggauugcagugg

SEQ ID NO: 691082 - RNA, 22 nt, Human
uguauuugaaacagugcauggg

SEQ ID NO: 691083 - RNA, 22 nt, Human
aggguggggugcuacaucuuua

SEQ ID NO: 691084 - RNA, 22 nt, Human
auucuccaucaccacuggcacu

SEQ ID NO: 691085 - RNA, 22 nt, Human
acucugaaccagagaucauacc

SEQ ID NO: 691086 - RNA, 22 nt, Human
aggcucaggcaggaauggcgga

SEQ ID NO: 691087 - RNA, 23 nt, Human
ucugggcugagacuuggaagguc

SEQ ID NO: 691088 - RNA, 22 nt, Human
gggcaugguggugcacaccugu

SEQ ID NO: 691089 - RNA, 22 nt, Human
ucugcaggaucagagccagagg

SEQ ID NO: 691090 - RNA, 22 nt, Human
auuuguaacacgugacagguug

SEQ ID NO: 691091 - RNA, 22 nt, Human
uccagaugcugcacauuccuga

SEQ ID NO: 691092 - RNA, 22 nt, Human
auggaauuugcaauaacaggau

SEQ ID NO: 691093 - RNA, 22 nt, Human
cuugcacagaacucuuagaggu

SEQ ID NO: 691094 - RNA, 23 nt, Human
uuggcaaagccuaugaaguccuc

SEQ ID NO: 691095 - RNA, 22 nt, Human
gcuuuacaugagaugaggacaa

SEQ ID NO: 691096 - RNA, 21 nt, Human
ugaaggggccaucacaaaggc

SEQ ID NO: 691097 - RNA, 22 nt, Human
uccucaggcggugaggaggggc

SEQ ID NO: 691098 - RNA, 18 nt, Human
uaagagcagacuguaggc

SEQ ID NO: 691099 - RNA, 22 nt, Human
ccucuggcuuacuguuggguuu

SEQ ID NO: 691100 - RNA, 22 nt, Human
guguacauagaauugugcuuug

SEQ ID NO: 691101 - RNA, 22 nt, Human
gugacucuuaccuacccagccu

SEQ ID NO: 691102 - RNA, 22 nt, Human
uaucagcaggccaaagcugcaa

SEQ ID NO: 691103 - RNA, 22 nt, Human
ccugucacgaugacugcacucu

SEQ ID NO: 691104 - RNA, 22 nt, Human
auauacaugggaauauguggag

SEQ ID NO: 691105 - RNA, 22 nt, Human
acaagguuugguaccacaucca

SEQ ID NO: 691106 - RNA, 22 nt, Human
uggagcagagaugggagcccaa

SEQ ID NO: 691107 - RNA, 22 nt, Human
aauguuuucauuauccuaacug

SEQ ID NO: 691108 - RNA, 22 nt, Human
uugaaugagaaguuauugccau

SEQ ID NO: 691109 - RNA, 20 nt, Human
ugucauucuucuuucacagg

SEQ ID NO: 691110 - RNA, 22 nt, Human
guaucuuugucuucauguugga

SEQ ID NO: 691111 - RNA, 18 nt, Human
ugagaggcagguagagga

SEQ ID NO: 691112 - RNA, 22 nt, Human
gcugagucuugagcacugagca

SEQ ID NO: 691113 - RNA, 22 nt, Human
ggcugcccucggggucgcaggc

SEQ ID NO: 691114 - RNA, 22 nt, Human
acauuuaaguuaaaaccucagu

SEQ ID NO: 691115 - RNA, 19 nt, Human
cugucugugcagagaugug

SEQ ID NO: 691116 - RNA, 22 nt, Human
acugaagcuuggguggaacuua

SEQ ID NO: 691117 - RNA, 22 nt, Human
ugguuagucaguaccugagugu

SEQ ID NO: 691118 - RNA, 22 nt, Human
gccuacaguuggcugagggccu

SEQ ID NO: 691119 - RNA, 22 nt, Human
cuucugcacugaccuuuugucc

SEQ ID NO: 691120 - RNA, 20 nt, Human
cgcccaggagggcccaugug

SEQ ID NO: 691121 - RNA, 22 nt, Human
ggcaggcuguucaccugcuuuu

SEQ ID NO: 691122 - RNA, 22 nt, Human
uaaggcaauggcauucuugaca

SEQ ID NO: 691123 - RNA, 22 nt, Human
cagguccaagagauccuccuac

SEQ ID NO: 691124 - RNA, 22 nt, Human
uaaagguaguuuuaaaggugcu

SEQ ID NO: 691125 - RNA, 22 nt, Human
ggccucugcccucacuccuguc

SEQ ID NO: 691126 - RNA, 22 nt, Human
augaggcccaaacauuacaaau

SEQ ID NO: 691127 - RNA, 22 nt, Human
uucaguuucguuaucuaugaga

SEQ ID NO: 691128 - RNA, 22 nt, Human
aggcacagguggacuucacagu

SEQ ID NO: 691129 - RNA, 22 nt, Human
aauugcuuuucaaggguacagc

SEQ ID NO: 691130 - RNA, 22 nt, Human
uauaaauuauuaggcugcuaaa

SEQ ID NO: 691131 - RNA, 22 nt, Human
aauaaacaaauccuuccuuccc

SEQ ID NO: 691132 - RNA, 22 nt, Human
aaagcaaugaugguagacacgu

SEQ ID NO: 691133 - RNA, 22 nt, Human
uccaggcucccucaggaugcac

SEQ ID NO: 691134 - RNA, 22 nt, Human
acacauuugggcuccuacauaa

SEQ ID NO: 691135 - RNA, 22 nt, Human
gaagaagguggcccagggguag

SEQ ID NO: 691136 - RNA, 22 nt, Human
aggaauagaccacuucacugag

SEQ ID NO: 691137 - RNA, 22 nt, Human
ucuaauugaaucuaagcauguu

SEQ ID NO: 691138 - RNA, 21 nt, Human
ucuggggaagacaucuaggau

SEQ ID NO: 691139 - RNA, 22 nt, Human
ucugggaaauagaggacccuag

SEQ ID NO: 691140 - RNA, 22 nt, Human
ucugaacagcauggaaucauuu

SEQ ID NO: 691141 - RNA, 22 nt, Human
gucuuugcugucuuugcucuca

SEQ ID NO: 691142 - RNA, 22 nt, Human
gggcaggagagaacagucaugg

SEQ ID NO: 691143 - RNA, 18 nt, Human
agggaucaucacugcagc

SEQ ID NO: 691144 - RNA, 22 nt, Human
aggcuucagacaaauguuaugg

SEQ ID NO: 691145 - RNA, 22 nt, Human
gugggaugguagguagguaaua

SEQ ID NO: 691146 - RNA, 22 nt, Human
aagauucagccaaauuguucau

SEQ ID NO: 691147 - RNA, 22 nt, Human
aaauugaaugauuaagugguga

SEQ ID NO: 691148 - RNA, 22 nt, Human
aggcaagugcauuagaagagca

SEQ ID NO: 691149 - RNA, 22 nt, Human
agaaagugugucauacuaagug

SEQ ID NO: 691150 - RNA, 22 nt, Human
acuguaaagguuuguagcccag

SEQ ID NO: 691151 - RNA, 22 nt, Human
auauccagcagcaggugaguau

SEQ ID NO: 691152 - RNA, 22 nt, Human
cacuuggaggcccccugugccc

SEQ ID NO: 691153 - RNA, 22 nt, Human
ggacaaaaaucagccaucucua

SEQ ID NO: 691154 - RNA, 22 nt, Human
ugggcacuguagcuggugcugg

SEQ ID NO: 691155 - RNA, 22 nt, Human
aucucagaaacauaucuaaucc

SEQ ID NO: 691156 - RNA, 22 nt, Human
aaucagcaguuggaauuagaua

SEQ ID NO: 691157 - RNA, 23 nt, Human
ugacaguguauuugacuauaugg

SEQ ID NO: 691158 - RNA, 22 nt, Human
cuugcuggugguguuuucuaug

SEQ ID NO: 691159 - RNA, 22 nt, Human
uuuacauagugcuuucccacua

SEQ ID NO: 691160 - RNA, 22 nt, Human
agauacaugucaagagacuuau

SEQ ID NO: 691161 - RNA, 22 nt, Human
cucaggauuuacuaauuucaag

SEQ ID NO: 691162 - RNA, 22 nt, Human
uaugcaacaucugguagaaauc

SEQ ID NO: 691163 - RNA, 22 nt, Human
ccaggagacaaagaugacugcu

SEQ ID NO: 691164 - RNA, 22 nt, Human
acaaagugcugacauuacaggc

SEQ ID NO: 691165 - RNA, 22 nt, Human
agcugugggccugggagagcug

SEQ ID NO: 691166 - RNA, 22 nt, Human
uuuacagugagagcuuagugag

SEQ ID NO: 691167 - RNA, 22 nt, Human
uggggccugaaagguucucgcc

SEQ ID NO: 691168 - RNA, 22 nt, Human
aggcucagacaggaaaaguaac

SEQ ID NO: 691169 - RNA, 22 nt, Human
gggcugaguuccugccucacuc

SEQ ID NO: 691170 - RNA, 22 nt, Human
uugccaggcuuguuucuaggcu

SEQ ID NO: 691171 - RNA, 22 nt, Human
caguggucugugcuucuguaca

SEQ ID NO: 691172 - RNA, 22 nt, Human
cagcuguugugauccauuuacg

SEQ ID NO: 691173 - RNA, 22 nt, Human
cauucucugaucuucacauacc

SEQ ID NO: 691174 - RNA, 22 nt, Human
uauucauaguaaacaaaagugg

SEQ ID NO: 691175 - RNA, 22 nt, Human
cagguggucaggcagaugggcu

SEQ ID NO: 691176 - RNA, 22 nt, Human
gaggccugguuugcaugagaau

SEQ ID NO: 691177 - RNA, 20 nt, Human
agacaggagcccccauucag

SEQ ID NO: 691178 - RNA, 22 nt, Human
ucugccugcgcucacggggccg

SEQ ID NO: 691179 - RNA, 22 nt, Human
gagcucagccugaggccuggcu

SEQ ID NO: 691180 - RNA, 22 nt, Human
agugcuuuauguuguugugcaa

SEQ ID NO: 691181 - RNA, 22 nt, Human
acacugcagcaucagcuacgga

SEQ ID NO: 691182 - RNA, 18 nt, Human
auaugcuugagcuaagga

SEQ ID NO: 691183 - RNA, 22 nt, Human
guggcaguggagacccgagccu

SEQ ID NO: 691184 - RNA, 22 nt, Human
agcaccaggccauggggucccu

SEQ ID NO: 691185 - RNA, 22 nt, Human
acaagcaugggcuuugacauca

SEQ ID NO: 691186 - RNA, 22 nt, Human
acaaugcagccuauggauccag

SEQ ID NO: 691187 - RNA, 22 nt, Human
auucaucagcuaauggacauuu

SEQ ID NO: 691188 - RNA, 22 nt, Human
uccaaagagcuuaggagagaaa

SEQ ID NO: 691189 - RNA, 22 nt, Human
ucugccuguucccgauuccaug

SEQ ID NO: 691190 - RNA, 22 nt, Human
cagugcccuuccaggacugcag

SEQ ID NO: 691191 - RNA, 20 nt, Human
ggcucugcuugugagcagcc

SEQ ID NO: 691192 - RNA, 22 nt, Human
aucaaagguaucuaugcugucu

SEQ ID NO: 691193 - RNA, 22 nt, Human
auaucagaaauaguaagcagag

SEQ ID NO: 691194 - RNA, 21 nt, Human
uccagccuuucccucacuucc

SEQ ID NO: 691195 - RNA, 22 nt, Human
caguguuuguugagaaaggcaa

SEQ ID NO: 691196 - RNA, 22 nt, Human
aaauuucuugaggcucucuagc

SEQ ID NO: 691197 - RNA, 22 nt, Human
agauggcugggcucguccgcag

SEQ ID NO: 691198 - RNA, 22 nt, Human
augugcaauuauuaagaagaga

SEQ ID NO: 691199 - RNA, 21 nt, Human
agacagcagauagucgaaagg

SEQ ID NO: 691200 - RNA, 23 nt, Human
uuuuagugacuccuuuaucugcc

SEQ ID NO: 691201 - RNA, 22 nt, Human
uuguacagggaaguaauacaag

SEQ ID NO: 691202 - RNA, 18 nt, Human
aacuaaagaucuuuaagc

SEQ ID NO: 691203 - RNA, 22 nt, Human
guaccagucucugugggcaccu

SEQ ID NO: 691204 - RNA, 22 nt, Human
ucauuuguucucauucucuacu

SEQ ID NO: 691205 - RNA, 22 nt, Human
cugcuugggguuaggguguccu

SEQ ID NO: 691206 - RNA, 22 nt, Human
agaaacucuggaagaacuuuua

SEQ ID NO: 691207 - RNA, 20 nt, Human
ccugugugguuugcacuaca

SEQ ID NO: 691208 - RNA, 22 nt, Human
acuguggcucaucaggcuggug

SEQ ID NO: 691209 - RNA, 22 nt, Human
aggcacugguccauuuucugca

SEQ ID NO: 691210 - RNA, 22 nt, Human
uucucuccuacccaguauccau

SEQ ID NO: 691211 - RNA, 22 nt, Human
gccaaugacagucucaguucug

SEQ ID NO: 691212 - RNA, 22 nt, Human
ccccagccagcaggaccucuga

SEQ ID NO: 691213 - RNA, 22 nt, Human
caucuuaaauuaaagcuuaagg

SEQ ID NO: 691214 - RNA, 22 nt, Human
ucaggcuguaaauggugugggu

SEQ ID NO: 691215 - RNA, 22 nt, Human
uaacucuuuacuauacauuuau

SEQ ID NO: 691216 - RNA, 21 nt, Human
gccauuguuuucuaccuggag

SEQ ID NO: 691217 - RNA, 22 nt, Human
aauuguacaagccuugugccau

SEQ ID NO: 691218 - RNA, 22 nt, Human
ggcagauggaaugagcugucua

SEQ ID NO: 691219 - RNA, 21 nt, Human
ucugugccucaacccucaucu

SEQ ID NO: 691220 - RNA, 22 nt, Human
cacccaggcuggagugcagggg

SEQ ID NO: 691221 - RNA, 22 nt, Human
gggugcugggaggcugacaucu

SEQ ID NO: 691222 - RNA, 22 nt, Human
uguguacagcaggauuucucaa

SEQ ID NO: 691223 - RNA, 22 nt, Human
cggggcugacagcaggugugcu

SEQ ID NO: 691224 - RNA, 22 nt, Human
gaggcagagguuguugcaguga

SEQ ID NO: 691225 - RNA, 22 nt, Human
caguuauaggagccauuguaua

SEQ ID NO: 691226 - RNA, 22 nt, Human
ucccagaggacuguuggugcua

SEQ ID NO: 691227 - RNA, 23 nt, Human
agcagcccaauggcaagcucugg

SEQ ID NO: 691228 - RNA, 22 nt, Human
augaaagaugauuuaaaguacu

SEQ ID NO: 691229 - RNA, 22 nt, Human
ucucacaccgucccuaaaccau

SEQ ID NO: 691230 - RNA, 22 nt, Human
ucugaaaauguugacuuuguuu

SEQ ID NO: 691231 - RNA, 22 nt, Human
uauugacaauaggcaacugagg

SEQ ID NO: 691232 - RNA, 22 nt, Human
auuauuguugcggcuguuaccg

SEQ ID NO: 691233 - RNA, 21 nt, Human
agggcagauuagcuguaagag

SEQ ID NO: 691234 - RNA, 22 nt, Human
uauaauuuuaagugguaaauua

SEQ ID NO: 691235 - RNA, 22 nt, Human
uuaaucuucagggacucuugcu

SEQ ID NO: 691236 - RNA, 22 nt, Human
auacaacuuuaucuguaaugag

SEQ ID NO: 691237 - RNA, 22 nt, Human
ucuauaaagggccagauaguag

SEQ ID NO: 691238 - RNA, 22 nt, Human
ugacaaauacaauaagaucugu

SEQ ID NO: 691239 - RNA, 22 nt, Human
cuuugauucagacuuugucggc

SEQ ID NO: 691240 - RNA, 22 nt, Human
aacuccagcucacacagugacc

SEQ ID NO: 691241 - RNA, 20 nt, Human
gaggcccagagaggugaagc

SEQ ID NO: 691242 - RNA, 22 nt, Human
uguacaaauucauugaacugua

SEQ ID NO: 691243 - RNA, 22 nt, Human
aaucacauugaaucugcuaccu

SEQ ID NO: 691244 - RNA, 22 nt, Human
auggauaaucaugaacuuugag

SEQ ID NO: 691245 - RNA, 22 nt, Human
aaacaugaguuaaaaguaacug

SEQ ID NO: 691246 - RNA, 22 nt, Human
cuggaugcugagagguaccaag

SEQ ID NO: 691247 - RNA, 22 nt, Human
caaggccauauugccuguaugu

SEQ ID NO: 691248 - RNA, 23 nt, Human
ucaucuguaaguaucuguggagu

SEQ ID NO: 691249 - RNA, 22 nt, Human
uauaagugacagauuauccaaa

SEQ ID NO: 691250 - RNA, 22 nt, Human
ugucucugaagcccccuccuuu

SEQ ID NO: 691251 - RNA, 22 nt, Human
auuucagugucuucuucucccu

SEQ ID NO: 691252 - RNA, 22 nt, Human
ggccucagaaauagaguaaaau

SEQ ID NO: 691253 - RNA, 22 nt, Human
augguacaauuuucauuugugg

SEQ ID NO: 691254 - RNA, 22 nt, Human
ugccugccuaggaagcugugaa

SEQ ID NO: 691255 - RNA, 22 nt, Human
gcuggcuggaggugaggaagaa

SEQ ID NO: 691256 - RNA, 22 nt, Human
agacaaaccuuguuuuaugaug

SEQ ID NO: 691257 - RNA, 22 nt, Human
aucagguagauuuaauauucug

SEQ ID NO: 691258 - RNA, 22 nt, Human
cauggcugaacacucagugacu

SEQ ID NO: 691259 - RNA, 22 nt, Human
ccugggcaacauagggagaccc

SEQ ID NO: 691260 - RNA, 22 nt, Human
uggagaguggauaugggagcaa

SEQ ID NO: 691261 - RNA, 22 nt, Human
uuguguaaaugucugucuuucu

SEQ ID NO: 691262 - RNA, 22 nt, Human
uuuaauaucucacacuuccaug

SEQ ID NO: 691263 - RNA, 19 nt, Human
cagaguacaccagauagga

SEQ ID NO: 691264 - RNA, 19 nt, Human
ccaggcuuuaugcaaauac

SEQ ID NO: 691265 - RNA, 22 nt, Human
agugaccaaucaugguuagauu

SEQ ID NO: 691266 - RNA, 22 nt, Human
gugcugugugauccaugcuggc

SEQ ID NO: 691267 - RNA, 22 nt, Human
ugguagggacacuaugcagaaa

SEQ ID NO: 691268 - RNA, 22 nt, Human
uuuccacacugcagccagcaaa

SEQ ID NO: 691269 - RNA, 22 nt, Human
acaaaggcagagaauucaacau

SEQ ID NO: 691270 - RNA, 22 nt, Human
uuguuuggaacuuggugccacc

SEQ ID NO: 691271 - RNA, 22 nt, Human
aggcugagauagguggaucauu

SEQ ID NO: 691272 - RNA, 22 nt, Human
uggcucaguuucugcccagcug

SEQ ID NO: 691273 - RNA, 22 nt, Human
uuuagcaauuagaauccagcau

SEQ ID NO: 691274 - RNA, 22 nt, Human
auuucagagaaugaaccuaauc

SEQ ID NO: 691275 - RNA, 22 nt, Human
aguggcucuugggucacugggc

SEQ ID NO: 691276 - RNA, 20 nt, Human
ugcucuggggguggagagac

SEQ ID NO: 691277 - RNA, 22 nt, Human
gcucuugaaaaucaaaagggaa

SEQ ID NO: 691278 - RNA, 21 nt, Human
ugaugaggucauagcacccuc

SEQ ID NO: 691279 - RNA, 22 nt, Human
cuggagauuaaguucucagcca

SEQ ID NO: 691280 - RNA, 22 nt, Human
gcaaagcaucaguagaaauguu

SEQ ID NO: 691281 - RNA, 22 nt, Human
guguuaaugaaaaacaacucau

SEQ ID NO: 691282 - RNA, 22 nt, Human
guucauuuaugauguaacaugu

SEQ ID NO: 691283 - RNA, 18 nt, Human
gugaagcuuuauugaaug

SEQ ID NO: 691284 - RNA, 22 nt, Human
auuuuuuagaaccuggccugau

SEQ ID NO: 691285 - RNA, 22 nt, Human
ggcugccuggaccuccucuuuc

SEQ ID NO: 691286 - RNA, 22 nt, Human
ucagagaguccuggucauuugc

SEQ ID NO: 691287 - RNA, 22 nt, Human
uaaacauuuguuauucuuguuu

SEQ ID NO: 691288 - RNA, 22 nt, Human
ucuucucuguggccugguggug

SEQ ID NO: 691289 - RNA, 22 nt, Human
ucugagcauugaauuuucuucc

SEQ ID NO: 691290 - RNA, 21 nt, Human
uucugcugugccaugccucug

SEQ ID NO: 691291 - RNA, 22 nt, Human
uguguaaaaucugauuaauacu

SEQ ID NO: 691292 - RNA, 22 nt, Human
aggaggggcaaugauagucugg

SEQ ID NO: 691293 - RNA, 22 nt, Human
ucuuggagacucuuguauauuu

SEQ ID NO: 691294 - RNA, 20 nt, Human
aggcacaguuccuaguuggg

SEQ ID NO: 691295 - RNA, 19 nt, Human
uucuuuccacaucuucucu

SEQ ID NO: 691296 - RNA, 22 nt, Human
agcaggcaggaggcuacuaagg

SEQ ID NO: 691297 - RNA, 22 nt, Human
ugcaggagccuuggacuugaaa

SEQ ID NO: 691298 - RNA, 21 nt, Human
cuuaacauuuuaaaugaaagg

SEQ ID NO: 691299 - RNA, 22 nt, Human
agaggaggaagagcuuuaaaau

SEQ ID NO: 691300 - RNA, 22 nt, Human
uggcuuccgccgcgggccucgg

SEQ ID NO: 691301 - RNA, 22 nt, Human
caucuucauuuuguccaguacu

SEQ ID NO: 691302 - RNA, 22 nt, Human
cucugggcggcccaggccaacc

SEQ ID NO: 691303 - RNA, 22 nt, Human
gcugagaguguaggauguuuac

SEQ ID NO: 691304 - RNA, 22 nt, Human
cauccugacaagaaagccagaa

SEQ ID NO: 691305 - RNA, 22 nt, Human
uccagguagggaauaaauguca

SEQ ID NO: 691306 - RNA, 22 nt, Human
ucugucacccagagugcagugg

SEQ ID NO: 691307 - RNA, 22 nt, Human
cacaauuuccuugcuucacuuu

SEQ ID NO: 691308 - RNA, 22 nt, Human
ccagggcugguggcugcagagg

SEQ ID NO: 691309 - RNA, 22 nt, Human
uaaguucucaauacauuguagc

SEQ ID NO: 691310 - RNA, 22 nt, Human
ggcagagcagccccaggguuug

SEQ ID NO: 691311 - RNA, 22 nt, Human
aggcccaaaagaaaccacuggg

SEQ ID NO: 691312 - RNA, 22 nt, Human
caggaacaugucuccaauuaga

SEQ ID NO: 691313 - RNA, 22 nt, Human
cccaggguugccugccucugcu

SEQ ID NO: 691314 - RNA, 22 nt, Human
ccuggcugcccauggacccucu

SEQ ID NO: 691315 - RNA, 22 nt, Human
uggaaacaucucugccuuuauu

SEQ ID NO: 691316 - RNA, 22 nt, Human
auuccaaagacagaagcagcug

SEQ ID NO: 691317 - RNA, 18 nt, Human
agagcagcggcaucacac

SEQ ID NO: 691318 - RNA, 20 nt, Human
gcugccagugccugaugcuu

SEQ ID NO: 691319 - RNA, 22 nt, Human
aggacuggugccagacaaggua

SEQ ID NO: 691320 - RNA, 22 nt, Human
cacugucugagcuggugauuag

SEQ ID NO: 691321 - RNA, 22 nt, Human
uauaagaaacaaggcaaauuuu

SEQ ID NO: 691322 - RNA, 22 nt, Human
augugucuggcauggaaagugu

SEQ ID NO: 691323 - RNA, 22 nt, Human
aucaggaacguucauggacugu

SEQ ID NO: 691324 - RNA, 22 nt, Human
aucaggaugaagcuguagcgaa

SEQ ID NO: 691325 - RNA, 22 nt, Human
cagccagaggggccagagucgg

SEQ ID NO: 691326 - RNA, 22 nt, Human
uuguauuucuuccggucucauu

SEQ ID NO: 691327 - RNA, 22 nt, Human
uaggaugacugauagugauucc

SEQ ID NO: 691328 - RNA, 22 nt, Human
gagguggcaauuuaaugcaguc

SEQ ID NO: 691329 - RNA, 22 nt, Human
uccaugccaggcagucgaugca

SEQ ID NO: 691330 - RNA, 22 nt, Human
acagauuuuaaauuuguaguug

SEQ ID NO: 691331 - RNA, 23 nt, Human
auuucccauugugucagcagagc

SEQ ID NO: 691332 - RNA, 22 nt, Human
uggcuuccuguguaaugaggug

SEQ ID NO: 691333 - RNA, 22 nt, Human
uguaacaaaauaccuuggauug

SEQ ID NO: 691334 - RNA, 22 nt, Human
auugucauuccagucauuguua

SEQ ID NO: 691335 - RNA, 22 nt, Human
ucauaagcuagcugcaccauau

SEQ ID NO: 691336 - RNA, 22 nt, Human
cccaaccagaaauugacagaga

SEQ ID NO: 691337 - RNA, 22 nt, Human
ugcaggagcuuggcucuguccc

SEQ ID NO: 691338 - RNA, 22 nt, Human
gaguaggaauguucugccaucu

SEQ ID NO: 691339 - RNA, 18 nt, Human
cccucuugcacaaagcaa

SEQ ID NO: 691340 - RNA, 22 nt, Human
cagggcuggauccuccagacuc

SEQ ID NO: 691341 - RNA, 22 nt, Human
gccuggcuccuaagagcacaac

SEQ ID NO: 691342 - RNA, 19 nt, Human
aucaccugguguuuccuug

SEQ ID NO: 691343 - RNA, 22 nt, Human
acacacaacucauuguguaaua

SEQ ID NO: 691344 - RNA, 22 nt, Human
aucuuuaauuuggaucagggcc

SEQ ID NO: 691345 - RNA, 22 nt, Human
uaugucaugggucaaaaugaag

SEQ ID NO: 691346 - RNA, 22 nt, Human
agaccuggugauagcuguccua

SEQ ID NO: 691347 - RNA, 22 nt, Human
uugaucuuggacuuuccagccu

SEQ ID NO: 691348 - RNA, 22 nt, Human
ggagacucucauugucaagcuu

SEQ ID NO: 691349 - RNA, 22 nt, Human
cuguaugugaaaaugucaagug

SEQ ID NO: 691350 - RNA, 22 nt, Human
uucagcagguggugaguucugc

SEQ ID NO: 691351 - RNA, 22 nt, Human
ugagauaauaaacaucuccuua

SEQ ID NO: 691352 - RNA, 22 nt, Human
gcccuucugcuguuagguagcc

SEQ ID NO: 691353 - RNA, 22 nt, Human
uauauagaaaagcagauguugg

SEQ ID NO: 691354 - RNA, 22 nt, Human
ggagggcaucaaucaggccugg

SEQ ID NO: 691355 - RNA, 22 nt, Human
acagagcagguccagaagugcc

SEQ ID NO: 691356 - RNA, 22 nt, Human
uaggaaccagagcacucugggc

SEQ ID NO: 691357 - RNA, 22 nt, Human
cugagccaaaaagcagagcuug

SEQ ID NO: 691358 - RNA, 22 nt, Human
uucuugauuucaugcaguuaag

SEQ ID NO: 691359 - RNA, 22 nt, Human
uauuaucauuaacuguugaauu

SEQ ID NO: 691360 - RNA, 21 nt, Human
uuucacaaaaguaugugacaa

SEQ ID NO: 691361 - RNA, 22 nt, Human
ggaagcacugaggcagagaggg

SEQ ID NO: 691362 - RNA, 22 nt, Human
cacauauaugggccccugaggg

SEQ ID NO: 691363 - RNA, 22 nt, Human
uacauggguagguuaagucaua

SEQ ID NO: 691364 - RNA, 22 nt, Human
agaguuugggugggacagcuug

SEQ ID NO: 691365 - RNA, 22 nt, Human
gaaauacagaaagggcugaaug

SEQ ID NO: 691366 - RNA, 22 nt, Human
ucacugaauuucaagcuagugg

SEQ ID NO: 691367 - RNA, 23 nt, Human
uucauguggaccuagaggccugu

SEQ ID NO: 691368 - RNA, 21 nt, Human
agcucagccgggcacaguggc

SEQ ID NO: 691369 - RNA, 22 nt, Human
uuagugugcauggaugccucaa

SEQ ID NO: 691370 - RNA, 21 nt, Human
uccucugcagugagguggccu

SEQ ID NO: 691371 - RNA, 22 nt, Human
uggcuucauucuccugugaaua

SEQ ID NO: 691372 - RNA, 22 nt, Human
acacugugacggaaauaaagaa

SEQ ID NO: 691373 - RNA, 22 nt, Human
aagugcugggauuacagguguc

SEQ ID NO: 691374 - RNA, 22 nt, Human
uugccugugucagcagguggaa

SEQ ID NO: 691375 - RNA, 22 nt, Human
agcaguccuucuuuagagagcc

SEQ ID NO: 691376 - RNA, 23 nt, Human
guccucuggagagaaaggcagua

SEQ ID NO: 691377 - RNA, 22 nt, Human
auccuuuauaagacuuguauuc

SEQ ID NO: 691378 - RNA, 22 nt, Human
uucugggcucacagagcagcag

SEQ ID NO: 691379 - RNA, 22 nt, Human
agugcgugggcaggcauggaag

SEQ ID NO: 691380 - RNA, 23 nt, Human
cucagaggccuguccaggguggu

SEQ ID NO: 691381 - RNA, 22 nt, Human
cuuggucauuucuuguccuguu

SEQ ID NO: 691382 - RNA, 23 nt, Human
aacugucuugcaagugugauacc

SEQ ID NO: 691383 - RNA, 22 nt, Human
gaaaucugcggugaggccugag

SEQ ID NO: 691384 - RNA, 18 nt, Human
agcuuagcauacuuuucc

SEQ ID NO: 691385 - RNA, 22 nt, Human
gcagcucuggggcaggccugag

SEQ ID NO: 691386 - RNA, 22 nt, Human
ucuugcacuucaugaauauguu

SEQ ID NO: 691387 - RNA, 22 nt, Human
uuuuagaaucagguugucuggg

SEQ ID NO: 691388 - RNA, 20 nt, Human
gcuggcagaugucuugagau

SEQ ID NO: 691389 - RNA, 22 nt, Human
uagggugggcaguucuugggga

SEQ ID NO: 691390 - RNA, 22 nt, Human
agggacacuugcuuucaggccc

SEQ ID NO: 691391 - RNA, 22 nt, Human
ggaugggaacuugguagggcau

SEQ ID NO: 691392 - RNA, 23 nt, Human
cucaacauccauucuugcccuuc

SEQ ID NO: 691393 - RNA, 22 nt, Human
cugcaucuguuagauuaucacc

SEQ ID NO: 691394 - RNA, 22 nt, Human
ugaccaggauacugcagggaug

SEQ ID NO: 691395 - RNA, 22 nt, Human
ugggaugagcuauauagaaagu

SEQ ID NO: 691396 - RNA, 22 nt, Human
cuacacuuugguugacuuugug

SEQ ID NO: 691397 - RNA, 20 nt, Human
gaaauguacacauuaccaca

SEQ ID NO: 691398 - RNA, 22 nt, Human
ucagaggacagcagcuaaauaa

SEQ ID NO: 691399 - RNA, 22 nt, Human
auucuucuugagucuuggacuc

SEQ ID NO: 691400 - RNA, 22 nt, Human
caaagcuggaaaaggaggcugg

SEQ ID NO: 691401 - RNA, 22 nt, Human
cuaaagcauucucagauuuugc

SEQ ID NO: 691402 - RNA, 22 nt, Human
cugggcaccaggcaugacaggg

SEQ ID NO: 691403 - RNA, 22 nt, Human
aucgaauaauugcauucuauaa

SEQ ID NO: 691404 - RNA, 19 nt, Human
cugcuuuaggccuuaaaag

SEQ ID NO: 691405 - RNA, 22 nt, Human
aguuuucuuucaucuaucagca

SEQ ID NO: 691406 - RNA, 22 nt, Human
gagggcugccacguugggcgag

SEQ ID NO: 691407 - RNA, 22 nt, Human
aucagaagugauguguguuauu

SEQ ID NO: 691408 - RNA, 22 nt, Human
ugcccuugaggacagcucccag

SEQ ID NO: 691409 - RNA, 22 nt, Human
acauggaaaacuaacugcuuuu

SEQ ID NO: 691410 - RNA, 20 nt, Human
gacaacagaguaccaggaag

SEQ ID NO: 691411 - RNA, 22 nt, Human
aucagcagugucuaccucggug

SEQ ID NO: 691412 - RNA, 22 nt, Human
ccugcucagcuguccucacgcu

SEQ ID NO: 691413 - RNA, 22 nt, Human
aaacagauugaaauucguagua

SEQ ID NO: 691414 - RNA, 23 nt, Human
ucauaaauauuagcacaguagga

SEQ ID NO: 691415 - RNA, 22 nt, Human
gugugccaacaaaagacagugc

SEQ ID NO: 691416 - RNA, 22 nt, Human
uuggcagaugagaccagggguu

SEQ ID NO: 691417 - RNA, 22 nt, Human
gggcugugugcaguacgggucc

SEQ ID NO: 691418 - RNA, 22 nt, Human
caggacagguguucuagaucag

SEQ ID NO: 691419 - RNA, 22 nt, Human
auccagagacccaaggacagaa

SEQ ID NO: 691420 - RNA, 22 nt, Human
ugugaggacauuggaggacuca

SEQ ID NO: 691421 - RNA, 22 nt, Human
ugcugcagaaauucugugagga

SEQ ID NO: 691422 - RNA, 22 nt, Human
uucaguuccuugugcgaauucc

SEQ ID NO: 691423 - RNA, 22 nt, Human
uccucuuuaaaugcuuuuaucu

SEQ ID NO: 691424 - RNA, 22 nt, Human
gacagcuguggagaggcaugug

SEQ ID NO: 691425 - RNA, 22 nt, Human
gcuguggcggcagcagcuggug

SEQ ID NO: 691426 - RNA, 22 nt, Human
acacagaugauguuccaggaac

SEQ ID NO: 691427 - RNA, 22 nt, Human
agagucuguuacuuguccccua

SEQ ID NO: 691428 - RNA, 22 nt, Human
gcucccacugcagcccugagcc

SEQ ID NO: 691429 - RNA, 22 nt, Human
aagucagagcaacugagacauu

SEQ ID NO: 691430 - RNA, 22 nt, Human
ugcuuccugaggccgucuucuc

SEQ ID NO: 691431 - RNA, 22 nt, Human
gcuucagaaauaucaucauuau

SEQ ID NO: 691432 - RNA, 23 nt, Human
augaggucagccauaagacggaa

SEQ ID NO: 691433 - RNA, 22 nt, Human
gugcacacaagcaaugcacuua

SEQ ID NO: 691434 - RNA, 22 nt, Human
uguuuaagugcugguaggguug

SEQ ID NO: 691435 - RNA, 22 nt, Human
cuuugaaaacuuaaauaacagc

SEQ ID NO: 691436 - RNA, 20 nt, Human
uaguauuugcauaaggauag

SEQ ID NO: 691437 - RNA, 22 nt, Human
cauaauaucuccgauuacuugc

SEQ ID NO: 691438 - RNA, 22 nt, Human
aaagcaguauaguggaagggcu

SEQ ID NO: 691439 - RNA, 22 nt, Human
gucacccugcuggcuguucagc

SEQ ID NO: 691440 - RNA, 22 nt, Human
agggcaguucaacuucauagug

SEQ ID NO: 691441 - RNA, 22 nt, Human
cacacaugcauguaagaccucu

SEQ ID NO: 691442 - RNA, 22 nt, Human
ccuguuuauugugaagaaccca

SEQ ID NO: 691443 - RNA, 22 nt, Human
uucugcaugaacaguuuauucc

SEQ ID NO: 691444 - RNA, 22 nt, Human
aaaugcacagagccuuagagau

SEQ ID NO: 691445 - RNA, 22 nt, Human
gguacagaauaaaaauccuaca

SEQ ID NO: 691446 - RNA, 22 nt, Human
caggcaagcaaggggucuugaa

SEQ ID NO: 691447 - RNA, 22 nt, Human
aaacuguguaugcagagagcau

SEQ ID NO: 691448 - RNA, 22 nt, Human
guguggcuagaagugucuuguu

SEQ ID NO: 691449 - RNA, 22 nt, Human
uccuuccaugguggggcugcuu

SEQ ID NO: 691450 - RNA, 22 nt, Human
gagcaacacgcaguaguauacg

SEQ ID NO: 691451 - RNA, 22 nt, Human
acauggugugcugagaaugaca

SEQ ID NO: 691452 - RNA, 22 nt, Human
caagagcugaggcuggagaggu

SEQ ID NO: 691453 - RNA, 22 nt, Human
ccugguggcuucuggguggacg

SEQ ID NO: 691454 - RNA, 22 nt, Human
gucagcucauccaucccggugg

SEQ ID NO: 691455 - RNA, 22 nt, Human
ugugugaauagcaguggcuggu

SEQ ID NO: 691456 - RNA, 22 nt, Human
gacuuuaaagguucugcugcuu

SEQ ID NO: 691457 - RNA, 22 nt, Human
augggcaacagcagucacaaug

SEQ ID NO: 691458 - RNA, 16 nt, Human
aggcucagaggcugga

SEQ ID NO: 691459 - RNA, 22 nt, Human
uaaccuuuguucaauguaagau

SEQ ID NO: 691460 - RNA, 22 nt, Human
gugacagaguuuuagaucucau

SEQ ID NO: 691461 - RNA, 22 nt, Human
aagugggaauagaaaugaaggu

SEQ ID NO: 691462 - RNA, 19 nt, Human
aaaggcaguggguggcgug

SEQ ID NO: 691463 - RNA, 22 nt, Human
uuuggccucaugaauuucuugc

SEQ ID NO: 691464 - RNA, 18 nt, Human
agagaugguguagaguuu

SEQ ID NO: 691465 - RNA, 22 nt, Human
gcugcuggagcuuugcagaagg

SEQ ID NO: 691466 - RNA, 22 nt, Human
uugauuucuauucagauguaga

SEQ ID NO: 691467 - RNA, 19 nt, Human
agagacugccaccagcugu

SEQ ID NO: 691468 - RNA, 22 nt, Human
cccgacuagcugggauuacagg

SEQ ID NO: 691469 - RNA, 21 nt, Human
ucagagagucacagugaacug

SEQ ID NO: 691470 - RNA, 22 nt, Human
aauguguuuaguuaaugaguug

SEQ ID NO: 691471 - RNA, 22 nt, Human
agcuaaggacaguugauuuaga

SEQ ID NO: 691472 - RNA, 22 nt, Human
cagagcaguccuugucaaucag

SEQ ID NO: 691473 - RNA, 22 nt, Human
cuguacauaugucuccagagug

SEQ ID NO: 691474 - RNA, 18 nt, Human
ucuggaacaacuucaugu

SEQ ID NO: 691475 - RNA, 22 nt, Human
caaaucauggcucuagcuuaca

SEQ ID NO: 691476 - RNA, 23 nt, Human
agcaguaacuucagaaacaucag

SEQ ID NO: 691477 - RNA, 22 nt, Human
uuuacacagaggacacugggcu

SEQ ID NO: 691478 - RNA, 22 nt, Human
agcaucugugauauuuuguuau

SEQ ID NO: 691479 - RNA, 22 nt, Human
auuguacaaugcugagguuugg

SEQ ID NO: 691480 - RNA, 22 nt, Human
ucaggaagccgguuaaauagau

SEQ ID NO: 691481 - RNA, 22 nt, Human
acuuucauuuguaauaaacuuc

SEQ ID NO: 691482 - RNA, 20 nt, Human
agcaaagccuuuagaguuug

SEQ ID NO: 691483 - RNA, 22 nt, Human
auagacauauggcuuuguuucu

SEQ ID NO: 691484 - RNA, 22 nt, Human
auaaagauuucuuuuucucuac

SEQ ID NO: 691485 - RNA, 22 nt, Human
uaauccacaauagagauuaucu

SEQ ID NO: 691486 - RNA, 22 nt, Human
agggccagcuagagcccucgcc

SEQ ID NO: 691487 - RNA, 22 nt, Human
uacaaugcugugcauguaaugg

SEQ ID NO: 691488 - RNA, 22 nt, Human
gcugggucagaaucucccugug

SEQ ID NO: 691489 - RNA, 22 nt, Human
cuuaauuuaagccuagaaugca

SEQ ID NO: 691490 - RNA, 22 nt, Human
cuaaaaauccacacuaggugaa

SEQ ID NO: 691491 - RNA, 22 nt, Human
cugucuguuucaaaagugguua

SEQ ID NO: 691492 - RNA, 22 nt, Human
caguaacaggcucugugguaua

SEQ ID NO: 691493 - RNA, 22 nt, Human
ggaaggggucaccuccugauga

SEQ ID NO: 691494 - RNA, 22 nt, Human
gaaaccucuuagccucucuuug

SEQ ID NO: 691495 - RNA, 22 nt, Human
gguggaaggcagcagucucagg

SEQ ID NO: 691496 - RNA, 22 nt, Human
uauguggccauucuguuugugu

SEQ ID NO: 691497 - RNA, 22 nt, Human
gaggcuccagcgacaccuaggc

SEQ ID NO: 691498 - RNA, 23 nt, Human
agcaccaggaacagugugguccu

SEQ ID NO: 691499 - RNA, 22 nt, Human
ccagagagaaaauggagggcca

SEQ ID NO: 691500 - RNA, 21 nt, Human
cacucucccaauccuugcuga

SEQ ID NO: 691501 - RNA, 22 nt, Human
ugaacauuaguugaguaaaguc

SEQ ID NO: 691502 - RNA, 22 nt, Human
cagccagggagcaaagaguuga

SEQ ID NO: 691503 - RNA, 22 nt, Human
ucauguaaauguggaugcuucc

SEQ ID NO: 691504 - RNA, 22 nt, Human
acacauagaaaauaaauaguua

SEQ ID NO: 691505 - RNA, 22 nt, Human
cuggggcugugggagacaaggc

SEQ ID NO: 691506 - RNA, 22 nt, Human
ucuacaaugagaaaugaucagu

SEQ ID NO: 691507 - RNA, 22 nt, Human
ccagggcuuuaucugccuuuga

SEQ ID NO: 691508 - RNA, 22 nt, Human
aacagaauauuuugccuuucuc

SEQ ID NO: 691509 - RNA, 22 nt, Human
gcccugcucuuuugcccaccca

SEQ ID NO: 691510 - RNA, 22 nt, Human
aggcaagcccccagugaggcuc

SEQ ID NO: 691511 - RNA, 22 nt, Human
aaaguguaaggaauuuaaguaa

SEQ ID NO: 691512 - RNA, 22 nt, Human
uaaggaagucacaagaaucgcu

SEQ ID NO: 691513 - RNA, 22 nt, Human
agcccaggaguccuuaaggacc

SEQ ID NO: 691514 - RNA, 18 nt, Human
auugcuuuuguaccaacc

SEQ ID NO: 691515 - RNA, 22 nt, Human
auggcagagggauugaacagcu

SEQ ID NO: 691516 - RNA, 19 nt, Human
cuuugcaggggauggguga

SEQ ID NO: 691517 - RNA, 22 nt, Human
gcucagggcuaaggcugagggg

SEQ ID NO: 691518 - RNA, 22 nt, Human
gacagccaacuggggagggcau

SEQ ID NO: 691519 - RNA, 21 nt, Human
ugcacagccauacccuccuug

SEQ ID NO: 691520 - RNA, 20 nt, Human
uggccaccugcgucccagcc

SEQ ID NO: 691521 - RNA, 22 nt, Human
gaguaauuccaauauaaaucac

SEQ ID NO: 691522 - RNA, 22 nt, Human
gugucccagcagcacauuggcu

SEQ ID NO: 691523 - RNA, 22 nt, Human
cuguguggccucaagccagccu

SEQ ID NO: 691524 - RNA, 22 nt, Human
ccugcccacugcccggucagcc

SEQ ID NO: 691525 - RNA, 22 nt, Human
uaagcauaagauacaugagaca

SEQ ID NO: 691526 - RNA, 22 nt, Human
augcugagauccucaggccaga

SEQ ID NO: 691527 - RNA, 22 nt, Human
uucugaaaggcaugucagguag

SEQ ID NO: 691528 - RNA, 22 nt, Human
uacugugguuacugcuauuaga

SEQ ID NO: 691529 - RNA, 19 nt, Human
gcgggcggcgccugcgagg

SEQ ID NO: 691530 - RNA, 22 nt, Human
gucugccucagccgggggccgc

SEQ ID NO: 691531 - RNA, 22 nt, Human
guguggccguguauccauggcu

SEQ ID NO: 691532 - RNA, 22 nt, Human
uuuccagagcugagaaggcuug

SEQ ID NO: 691533 - RNA, 22 nt, Human
ucaggaauccagacagggcaca

SEQ ID NO: 691534 - RNA, 22 nt, Human
uauuuagaacagacaauagaaa

SEQ ID NO: 691535 - RNA, 22 nt, Human
uuucuccuugugucuccuuuga

SEQ ID NO: 691536 - RNA, 22 nt, Human
uugcauugaaugcacauuuuua

SEQ ID NO: 691537 - RNA, 21 nt, Human
aggagccauguggucugaugg

SEQ ID NO: 691538 - RNA, 22 nt, Human
aaggcugguggauuaugagguc

SEQ ID NO: 691539 - RNA, 22 nt, Human
guggggcaguggccugggagca

SEQ ID NO: 691540 - RNA, 22 nt, Human
auggccaccauuuaaugaagcu

SEQ ID NO: 691541 - RNA, 22 nt, Human
agagcugcaccuaugcagaccu

SEQ ID NO: 691542 - RNA, 22 nt, Human
agaaaaugugaacuugugaauu

SEQ ID NO: 691543 - RNA, 22 nt, Human
aauaagaucuuaaagguuauau

SEQ ID NO: 691544 - RNA, 22 nt, Human
aaggacaggcuaaccugacauu

SEQ ID NO: 691545 - RNA, 22 nt, Human
ccucuccuugcacccgucccgc

SEQ ID NO: 691546 - RNA, 19 nt, Human
aagagggaaagugcuaugc

SEQ ID NO: 691547 - RNA, 22 nt, Human
uuucuuccuuaccuuacuagag

SEQ ID NO: 691548 - RNA, 22 nt, Human
caguccugaauacuggacggug

SEQ ID NO: 691549 - RNA, 22 nt, Human
agccaggacaucucuagcugcu

SEQ ID NO: 691550 - RNA, 22 nt, Human
acaugaggugcuauaggucuac

SEQ ID NO: 691551 - RNA, 22 nt, Human
uuuguuaaauauuuauugagug

SEQ ID NO: 691552 - RNA, 22 nt, Human
uugagcucccgcuucuucuuug

SEQ ID NO: 691553 - RNA, 22 nt, Human
ccuggcagcauugguagagauu

SEQ ID NO: 691554 - RNA, 22 nt, Human
cugaggaugguguggucuucuc

SEQ ID NO: 691555 - RNA, 22 nt, Human
uagcaggguuuugaagaggguu

SEQ ID NO: 691556 - RNA, 23 nt, Human
uccuccuuuugcuugugcuuccc

SEQ ID NO: 691557 - RNA, 22 nt, Human
uacagcuaggcaaaaaugacau

SEQ ID NO: 691558 - RNA, 22 nt, Human
auacauuagugaacaaaagaga

SEQ ID NO: 691559 - RNA, 22 nt, Human
uccaguuucauagcuaaggaac

SEQ ID NO: 691560 - RNA, 22 nt, Human
uguucuaugcucuuuaagguga

SEQ ID NO: 691561 - RNA, 22 nt, Human
aaguguuuuguaaacagaaaag

SEQ ID NO: 691562 - RNA, 22 nt, Human
uauuuccaccuauuauuuucug

SEQ ID NO: 691563 - RNA, 22 nt, Human
ggccacugcccuggcuacaccg

SEQ ID NO: 691564 - RNA, 22 nt, Human
ccuccacaggagcugcagugcu

SEQ ID NO: 691565 - RNA, 20 nt, Human
ccccuucaucuacagccuga

SEQ ID NO: 691566 - RNA, 22 nt, Human
ugccugccaggugcuucuucau

SEQ ID NO: 691567 - RNA, 20 nt, Human
cgcccagugcgguucugacc

SEQ ID NO: 691568 - RNA, 22 nt, Human
aucaggauagucuguaaauugu

SEQ ID NO: 691569 - RNA, 17 nt, Human
aguuuauuuagccuucu

SEQ ID NO: 691570 - RNA, 22 nt, Human
acauaugugcuuauauccauga

SEQ ID NO: 691571 - RNA, 22 nt, Human
cauuacaaccccaaauuacaaa

SEQ ID NO: 691572 - RNA, 22 nt, Human
uaaguucauuagacuacagaua

SEQ ID NO: 691573 - RNA, 21 nt, Human
uggccucccacacuuccaugg

SEQ ID NO: 691574 - RNA, 22 nt, Human
uauuaacauuuuaugaaaauaa

SEQ ID NO: 691575 - RNA, 22 nt, Human
uuuauuggaugggucagcucua

SEQ ID NO: 691576 - RNA, 22 nt, Human
ucccacugugaauccaaggccu

SEQ ID NO: 691577 - RNA, 22 nt, Human
gugcauugcgaugcagacgacc

SEQ ID NO: 691578 - RNA, 22 nt, Human
ugagggagagggcgaaaaugaa

SEQ ID NO: 691579 - RNA, 22 nt, Human
uucucuuaucuggcauuauugg

SEQ ID NO: 691580 - RNA, 22 nt, Human
cuagcacugagaauagugcaua

SEQ ID NO: 691581 - RNA, 19 nt, Human
ccaggucuggggccagauu

SEQ ID NO: 691582 - RNA, 22 nt, Human
ugcagguggauucaauguggga

SEQ ID NO: 691583 - RNA, 22 nt, Human
ucagggcacaggccuguggguu

SEQ ID NO: 691584 - RNA, 22 nt, Human
uaaaaccaggucuugggauuua

SEQ ID NO: 691585 - RNA, 22 nt, Human
uaggggaggggaucaugugcug

SEQ ID NO: 691586 - RNA, 22 nt, Human
ugagugaaaaauuugccuggag

SEQ ID NO: 691587 - RNA, 22 nt, Human
uuuauaguagcaugauuuauaa

SEQ ID NO: 691588 - RNA, 21 nt, Human
cacuccacuuagaacaggguu

SEQ ID NO: 691589 - RNA, 22 nt, Human
ggaagagggaaccacgacugua

SEQ ID NO: 691590 - RNA, 22 nt, Human
agacauaaacuuacugaaauac

SEQ ID NO: 691591 - RNA, 22 nt, Human
uuuuaugagaaugcgccacuug

SEQ ID NO: 691592 - RNA, 22 nt, Human
gagaugcaagcaagucuauuuu

SEQ ID NO: 691593 - RNA, 22 nt, Human
uuuaaaaccaaagaaagccucu

SEQ ID NO: 691594 - RNA, 22 nt, Human
aguggccacugacuuggaaauc

SEQ ID NO: 691595 - RNA, 23 nt, Human
aggcaguggugguaacaugucaa

SEQ ID NO: 691596 - RNA, 22 nt, Human
ggccucucugagagcagacguu

SEQ ID NO: 691597 - RNA, 22 nt, Human
gagguccugucugagaauggag

SEQ ID NO: 691598 - RNA, 20 nt, Human
acauaugugugcauaucuuu

SEQ ID NO: 691599 - RNA, 22 nt, Human
cacuccagccucagugacagag

SEQ ID NO: 691600 - RNA, 22 nt, Human
aucugccugagucuagguuuuc

SEQ ID NO: 691601 - RNA, 18 nt, Human
ccaauguuggccccaagg

SEQ ID NO: 691602 - RNA, 22 nt, Human
acuguauuuggauauaagaucu

SEQ ID NO: 691603 - RNA, 22 nt, Human
aaagauuuaugaaguucaauua

SEQ ID NO: 691604 - RNA, 21 nt, Human
ucccucagaagguagccaagc

SEQ ID NO: 691605 - RNA, 22 nt, Human
uagcuguuauuuugcuacccau

SEQ ID NO: 691606 - RNA, 22 nt, Human
auguuuacugaaaagauuucaa

SEQ ID NO: 691607 - RNA, 22 nt, Human
guagcugauccugaggacaggg

SEQ ID NO: 691608 - RNA, 22 nt, Human
ugaaguccuagaacuccuggua

SEQ ID NO: 691609 - RNA, 22 nt, Human
cauuucaaguaacagauugcuu

SEQ ID NO: 691610 - RNA, 22 nt, Human
ucugaauaauguccuuguauca

SEQ ID NO: 691611 - RNA, 22 nt, Human
ccugaggcuugggaguuccgcc

SEQ ID NO: 691612 - RNA, 22 nt, Human
gccaugcuugguaugcugugag

SEQ ID NO: 691613 - RNA, 22 nt, Human
cacugggcguguccugggugag

SEQ ID NO: 691614 - RNA, 22 nt, Human
gguggaaggccuggaaggaggc

SEQ ID NO: 691615 - RNA, 22 nt, Human
gacauucaacuuugaugauuau

SEQ ID NO: 691616 - RNA, 22 nt, Human
cuucuugguugguuucauucca

SEQ ID NO: 691617 - RNA, 22 nt, Human
gacugaaccucaaauuuggcuc

SEQ ID NO: 691618 - RNA, 22 nt, Human
ucacacagcuccuuuccuuagu

SEQ ID NO: 691619 - RNA, 22 nt, Human
acaaauuauagaaaauugagcu

SEQ ID NO: 691620 - RNA, 22 nt, Human
ggccaggaggcaggggcucaau

SEQ ID NO: 691621 - RNA, 22 nt, Human
ugggugggagcgcccugucugg

SEQ ID NO: 691622 - RNA, 22 nt, Human
gguggcaucucuuuccagauuu

SEQ ID NO: 691623 - RNA, 22 nt, Human
guuacacacaauauauccuaaa

SEQ ID NO: 691624 - RNA, 22 nt, Human
aaccaggugacucauggugagc

SEQ ID NO: 691625 - RNA, 22 nt, Human
caguguggagggagagagccug

SEQ ID NO: 691626 - RNA, 22 nt, Human
uccagcccucagccaaguggaa

SEQ ID NO: 691627 - RNA, 22 nt, Human
uacacagggagagauuggaaac

SEQ ID NO: 691628 - RNA, 23 nt, Human
ugcccucccaaugcuucggucac

SEQ ID NO: 691629 - RNA, 22 nt, Human
uaaccuggggccugaagaccau

SEQ ID NO: 691630 - RNA, 22 nt, Human
agucucagaaaagaagcaugga

SEQ ID NO: 691631 - RNA, 22 nt, Human
uccagucaugguguccucacaa

SEQ ID NO: 691632 - RNA, 22 nt, Human
ucaggaauuuuguucuguaucc

SEQ ID NO: 691633 - RNA, 22 nt, Human
aagaugauagaucugucaaugu

SEQ ID NO: 691634 - RNA, 22 nt, Human
ccagaagucaggaaugagucuu

SEQ ID NO: 691635 - RNA, 22 nt, Human
ucugucuuagccaucucaggcu

SEQ ID NO: 691636 - RNA, 22 nt, Human
aaucucuugguucagaagccuc

SEQ ID NO: 691637 - RNA, 22 nt, Human
uaaggccaccguuauagaacca

SEQ ID NO: 691638 - RNA, 22 nt, Human
ggugucuaugauucaguuuaug

SEQ ID NO: 691639 - RNA, 22 nt, Human
uggcucuggauuaaucuaggaa

SEQ ID NO: 691640 - RNA, 22 nt, Human
aguggcaucaaaucaagguuug

SEQ ID NO: 691641 - RNA, 22 nt, Human
ugagggaggcccuuugagcaga

SEQ ID NO: 691642 - RNA, 22 nt, Human
uuaaagaauagugccccuauug

SEQ ID NO: 691643 - RNA, 22 nt, Human
uguuugaguucuagcgcauuua

SEQ ID NO: 691644 - RNA, 22 nt, Human
uuccaggacucguucuggcuca

SEQ ID NO: 691645 - RNA, 22 nt, Human
guguuaaauuucuaauuuguga

SEQ ID NO: 691646 - RNA, 22 nt, Human
uuugaacucagcuucagacaac

SEQ ID NO: 691647 - RNA, 22 nt, Human
agacuuuaaugugcaaaugaaa

SEQ ID NO: 691648 - RNA, 22 nt, Human
uuuccccagguagauagauaau

SEQ ID NO: 691649 - RNA, 22 nt, Human
aggcugaggcuggcagcuccag

SEQ ID NO: 691650 - RNA, 22 nt, Human
aauuaggggaggacguaucaua

SEQ ID NO: 691651 - RNA, 22 nt, Human
aggccagcgcugcuagcucccg

SEQ ID NO: 691652 - RNA, 22 nt, Human
gggaggcucagugguguccucu

SEQ ID NO: 691653 - RNA, 20 nt, Human
acucauuuccagcaucugau

SEQ ID NO: 691654 - RNA, 22 nt, Human
ucugaggccuucagcaugaauc

SEQ ID NO: 691655 - RNA, 22 nt, Human
uuugaagcagaugguuaagcuu

SEQ ID NO: 691656 - RNA, 22 nt, Human
aauccacuuugugccccucucu

SEQ ID NO: 691657 - RNA, 22 nt, Human
uuucucugccaguuauuuuccu

SEQ ID NO: 691658 - RNA, 22 nt, Human
ugcaaauggagcauguauaaga

SEQ ID NO: 691659 - RNA, 22 nt, Human
gcauccagagguagccacugug

SEQ ID NO: 691660 - RNA, 22 nt, Human
auauuucuggggguguguuucu

SEQ ID NO: 691661 - RNA, 22 nt, Human
ggagagagagauuguguuuauu

SEQ ID NO: 691662 - RNA, 20 nt, Human
ucaaggacucccugggaaga

SEQ ID NO: 691663 - RNA, 22 nt, Human
ugugaaauguguguauaauuaa

SEQ ID NO: 691664 - RNA, 22 nt, Human
cagccacuguggucuagcugca

SEQ ID NO: 691665 - RNA, 21 nt, Human
aucucuucaaggcugauuuac

SEQ ID NO: 691666 - RNA, 22 nt, Human
caguguacuuggaauguaacag

SEQ ID NO: 691667 - RNA, 22 nt, Human
uauacacaggaaucugugaaaa

SEQ ID NO: 691668 - RNA, 22 nt, Human
aggagggcuaggaaaaccagga

SEQ ID NO: 691669 - RNA, 22 nt, Human
uggcuuccagagcugcuccacc

SEQ ID NO: 691670 - RNA, 22 nt, Human
ucuuaaguaccuccuuuaucac

SEQ ID NO: 691671 - RNA, 22 nt, Human
ugucaagucuaguugcuggcuu

SEQ ID NO: 691672 - RNA, 22 nt, Human
cuuuuuacucuguugucucagc

SEQ ID NO: 691673 - RNA, 22 nt, Human
ucccugugaaucagaagcaggu

SEQ ID NO: 691674 - RNA, 22 nt, Human
uugauacauagcacaguuuagg

SEQ ID NO: 691675 - RNA, 22 nt, Human
cugccuucaucucugagcuggg

SEQ ID NO: 691676 - RNA, 19 nt, Human
uucuaaguuuugcuugcug

SEQ ID NO: 691677 - RNA, 22 nt, Human
acauuuuucacauuuguagggu

SEQ ID NO: 691678 - RNA, 22 nt, Human
ucuuuuauccuacauuuagcuc

SEQ ID NO: 691679 - RNA, 22 nt, Human
uuagaaucuaacauucuuaucu

SEQ ID NO: 691680 - RNA, 22 nt, Human
ggcuacagaggccgugagccug

SEQ ID NO: 691681 - RNA, 22 nt, Human
gugugcgcgcucauaggugugu

SEQ ID NO: 691682 - RNA, 22 nt, Human
uacagccucacauuuacuuaca

SEQ ID NO: 691683 - RNA, 22 nt, Human
aguaaacacgugggguuucuuu

SEQ ID NO: 691684 - RNA, 19 nt, Human
gacaggacgaagggaaguu

SEQ ID NO: 691685 - RNA, 22 nt, Human
ucaggaaugaggauaaacauug

SEQ ID NO: 691686 - RNA, 22 nt, Human
aaggagcuuguucgccuuccuc

SEQ ID NO: 691687 - RNA, 22 nt, Human
uuccaagaagucaacagguagu

SEQ ID NO: 691688 - RNA, 22 nt, Human
auugcagcuggucaggguaauu

SEQ ID NO: 691689 - RNA, 22 nt, Human
ucccagcugcugagauagugcu

SEQ ID NO: 691690 - RNA, 22 nt, Human
caugauggaugugcacuucgcu

SEQ ID NO: 691691 - RNA, 22 nt, Human
guguggggcucagugggaaugu

SEQ ID NO: 691692 - RNA, 22 nt, Human
ugagauaacuauucugucaacu

SEQ ID NO: 691693 - RNA, 22 nt, Human
agauguuuuggagacacuaacc

SEQ ID NO: 691694 - RNA, 18 nt, Human
agugucuggauauuuggg

SEQ ID NO: 691695 - RNA, 22 nt, Human
aaggacuccaauucuuucaucu

SEQ ID NO: 691696 - RNA, 22 nt, Human
ugagcccuccaaacccaggauu

SEQ ID NO: 691697 - RNA, 21 nt, Human
ccuggcagaagccugauaugc

SEQ ID NO: 691698 - RNA, 22 nt, Human
ugccucccucucugccacugga

SEQ ID NO: 691699 - RNA, 19 nt, Human
caggacagacuucaaagcc

SEQ ID NO: 691700 - RNA, 22 nt, Human
ccacagcaugcaggccugacac

SEQ ID NO: 691701 - RNA, 22 nt, Human
acauuaccuggcauuugaucuu

SEQ ID NO: 691702 - RNA, 23 nt, Human
cagaucauauauccagcuguaag

SEQ ID NO: 691703 - RNA, 22 nt, Human
gcucccaccaggcagaccuacc

SEQ ID NO: 691704 - RNA, 21 nt, Human
ucucuucccaucaggacacua

SEQ ID NO: 691705 - RNA, 22 nt, Human
ggagggagcauccccuugcuga

SEQ ID NO: 691706 - RNA, 22 nt, Human
cucagcaacccuagaacauuug

SEQ ID NO: 691707 - RNA, 22 nt, Human
uugcaaaaaccacaauuacuuu

SEQ ID NO: 691708 - RNA, 17 nt, Human
gcacauguguucuuuua

SEQ ID NO: 691709 - RNA, 22 nt, Human
uuuuauucuaaguaugauggga

SEQ ID NO: 691710 - RNA, 22 nt, Human
ugcuugcuaugcauccugaacu

SEQ ID NO: 691711 - RNA, 23 nt, Human
aaaggcaggccuaggacauauug

SEQ ID NO: 691712 - RNA, 22 nt, Human
gaaauguaugucuucccccauu

SEQ ID NO: 691713 - RNA, 22 nt, Human
ugugcacauauacucauauucc

SEQ ID NO: 691714 - RNA, 22 nt, Human
uacuagaaugccacuguuagug

SEQ ID NO: 691715 - RNA, 22 nt, Human
gucccugcccuccugggacuca

SEQ ID NO: 691716 - RNA, 22 nt, Human
uucagcaacauuuguugagugc

SEQ ID NO: 691717 - RNA, 22 nt, Human
cuuccuagugucuacuuuggag

SEQ ID NO: 691718 - RNA, 22 nt, Human
uaaccugacugcucuuuagaau

SEQ ID NO: 691719 - RNA, 18 nt, Human
aagcugggaaggagacag

SEQ ID NO: 691720 - RNA, 22 nt, Human
gugcuguacuucuguguugaag

SEQ ID NO: 691721 - RNA, 15 nt, Human
ccaggcugggugagc

SEQ ID NO: 691722 - RNA, 22 nt, Human
ugaauagauggugacaguauga

SEQ ID NO: 691723 - RNA, 22 nt, Human
cuggaaagaccugcuugcuuuu

SEQ ID NO: 691724 - RNA, 22 nt, Human
uacaaaggaguagagaaggcuu

SEQ ID NO: 691725 - RNA, 22 nt, Human
ucuuccucaauguaacaacccc

SEQ ID NO: 691726 - RNA, 22 nt, Human
gaugcaaagauaaaacagacgc

SEQ ID NO: 691727 - RNA, 22 nt, Human
uguaaucaugcaucaguuaguu

SEQ ID NO: 691728 - RNA, 22 nt, Human
gaugaugaggccaugaggcagg

SEQ ID NO: 691729 - RNA, 22 nt, Human
ggcuucagauuucucaguuguu

SEQ ID NO: 691730 - RNA, 20 nt, Human
uuucuggguacucucccucu

SEQ ID NO: 691731 - RNA, 22 nt, Human
ugagacaguaauuguauaguuu

SEQ ID NO: 691732 - RNA, 22 nt, Human
ccaagaugagcuggcuccaugg

SEQ ID NO: 691733 - RNA, 22 nt, Human
guaggaagcucugaggcuaguu

SEQ ID NO: 691734 - RNA, 22 nt, Human
aaaguuugaaugauauauuagu

SEQ ID NO: 691735 - RNA, 22 nt, Human
cuuuaacaaaugacucuugucu

SEQ ID NO: 691736 - RNA, 22 nt, Human
guucaaauuuucuaggugggug

SEQ ID NO: 691737 - RNA, 22 nt, Human
guguacugcaaaugcugcugcc

SEQ ID NO: 691738 - RNA, 22 nt, Human
gaaauuaagcaggggucugugg

SEQ ID NO: 691739 - RNA, 22 nt, Human
cucagaaaucccacucugugua

SEQ ID NO: 691740 - RNA, 22 nt, Human
aagacugucugggacaagauga

SEQ ID NO: 691741 - RNA, 22 nt, Human
uuuauuauccaguguugucaug

SEQ ID NO: 691742 - RNA, 22 nt, Human
aguggcugcuucugguugcucc

SEQ ID NO: 691743 - RNA, 22 nt, Human
ugagcuggucacuccuucugaa

SEQ ID NO: 691744 - RNA, 22 nt, Human
uuguuauaaagacuaaauaugu

SEQ ID NO: 691745 - RNA, 22 nt, Human
auacaugugugugcauacaugu

SEQ ID NO: 691746 - RNA, 22 nt, Human
cugccugcucuauccaggccug

SEQ ID NO: 691747 - RNA, 22 nt, Human
agucagugacuuuugcugagag

SEQ ID NO: 691748 - RNA, 22 nt, Human
aaucauugagacaaauuagcuu

SEQ ID NO: 691749 - RNA, 22 nt, Human
ugaaauguugguaauuuuauau

SEQ ID NO: 691750 - RNA, 22 nt, Human
gccaguggagacugaaacccau

SEQ ID NO: 691751 - RNA, 22 nt, Human
cucagcaagauuaagcagcuug

SEQ ID NO: 691752 - RNA, 22 nt, Human
cuguauaucaugguuuugcagu

SEQ ID NO: 691753 - RNA, 22 nt, Human
uaucuguuaggaucagagcugg

SEQ ID NO: 691754 - RNA, 22 nt, Human
ggcugugcagggcagagucuca

SEQ ID NO: 691755 - RNA, 22 nt, Human
auagaacucgggcuuuggaauc

SEQ ID NO: 691756 - RNA, 22 nt, Human
aaaugcuagggagaaacucucc

SEQ ID NO: 691757 - RNA, 22 nt, Human
cuggcugacaccuugauagcag

SEQ ID NO: 691758 - RNA, 22 nt, Human
ccuaaggaccagggcuuccagc

SEQ ID NO: 691759 - RNA, 22 nt, Human
ugauacagagaaagcaucuuuu

SEQ ID NO: 691760 - RNA, 22 nt, Human
uggccugguuauauugcuauca

SEQ ID NO: 691761 - RNA, 22 nt, Human
augccuggauuugggacucaaa

SEQ ID NO: 691762 - RNA, 22 nt, Human
acagaguuguguuuguacaacg

SEQ ID NO: 691763 - RNA, 22 nt, Human
ucugugauaguuuuucagcuau

SEQ ID NO: 691764 - RNA, 21 nt, Human
ucaacccuugcgucaccaagc

SEQ ID NO: 691765 - RNA, 22 nt, Human
caggagccgccaggcacguugg

SEQ ID NO: 691766 - RNA, 19 nt, Human
ucuggagcugaugcaggug

SEQ ID NO: 691767 - RNA, 22 nt, Human
auuguaacaacaauaguuuagg

SEQ ID NO: 691768 - RNA, 22 nt, Human
caaguucauuguagcauuauug

SEQ ID NO: 691769 - RNA, 22 nt, Human
uuccagggcagcaagugaaugg

SEQ ID NO: 691770 - RNA, 22 nt, Human
augaagauuucccagagacaug

SEQ ID NO: 691771 - RNA, 22 nt, Human
uucucuacuugagauuuuaaug

SEQ ID NO: 691772 - RNA, 22 nt, Human
caggguagacaguaggugucug

SEQ ID NO: 691773 - RNA, 22 nt, Human
gaggcacugagagugggggaug

SEQ ID NO: 691774 - RNA, 22 nt, Human
ucacacagguuugcaaugauuu

SEQ ID NO: 691775 - RNA, 22 nt, Human
gcuggagguagggagguccugu

SEQ ID NO: 691776 - RNA, 22 nt, Human
auuaaaugauggcaugucuuau

SEQ ID NO: 691777 - RNA, 18 nt, Human
acaaauguagugucuuaa

SEQ ID NO: 691778 - RNA, 22 nt, Human
ucaugacaugugaauugaauau

SEQ ID NO: 691779 - RNA, 22 nt, Human
ccaugcugugacacaguaguua

SEQ ID NO: 691780 - RNA, 22 nt, Human
gaggugaaaguuauucauuuau

SEQ ID NO: 691781 - RNA, 22 nt, Human
uagcacagcuucuugaugucac

SEQ ID NO: 691782 - RNA, 22 nt, Human
aagaaagugaugagcuacagau

SEQ ID NO: 691783 - RNA, 22 nt, Human
auucuacaaaagaacuggaucu

SEQ ID NO: 691784 - RNA, 22 nt, Human
gaggcagcugaagcuucaaaga

SEQ ID NO: 691785 - RNA, 22 nt, Human
gacagcagggaaaguccagacc

SEQ ID NO: 691786 - RNA, 22 nt, Human
agcaccaggcuguuggaagccc

SEQ ID NO: 691787 - RNA, 22 nt, Human
auacauacauguaugcacauac

SEQ ID NO: 691788 - RNA, 22 nt, Human
gaucuugagcaaguugcauccc

SEQ ID NO: 691789 - RNA, 22 nt, Human
aagugcaaugaauagcugcaau

SEQ ID NO: 691790 - RNA, 22 nt, Human
ucuaguuaauuccuuugguguu

SEQ ID NO: 691791 - RNA, 22 nt, Human
ccaggccaaauucagucagcag

SEQ ID NO: 691792 - RNA, 22 nt, Human
aagaacaguugggaggugagcc

SEQ ID NO: 691793 - RNA, 22 nt, Human
aaacacuuuagaaagggacuug

SEQ ID NO: 691794 - RNA, 22 nt, Human
aguggcagaagucacuggguag

SEQ ID NO: 691795 - RNA, 21 nt, Human
ugacaacagaacugggcaagc

SEQ ID NO: 691796 - RNA, 22 nt, Human
ccugggccuugaccucgugggc

SEQ ID NO: 691797 - RNA, 22 nt, Human
guccuggggaauacagaagccg

SEQ ID NO: 691798 - RNA, 22 nt, Human
ccucuguggcccugacucucuu

SEQ ID NO: 691799 - RNA, 22 nt, Human
cuggaucuaaagguggauguag

SEQ ID NO: 691800 - RNA, 22 nt, Human
ucccagcagcauagcucagaau

SEQ ID NO: 691801 - RNA, 22 nt, Human
gggucuggagggcagcccuucu

SEQ ID NO: 691802 - RNA, 22 nt, Human
agccuccuggaguuucugggau

SEQ ID NO: 691803 - RNA, 16 nt, Human
uuucucucugcuauuu

SEQ ID NO: 691804 - RNA, 22 nt, Human
ccugggucccagccaggcuuug

SEQ ID NO: 691805 - RNA, 22 nt, Human
ggcuuuauguuuuucauguggu

SEQ ID NO: 691806 - RNA, 21 nt, Human
ucagucccuggguguguccca

SEQ ID NO: 691807 - RNA, 22 nt, Human
auugaaagauaggcuacugugg

SEQ ID NO: 691808 - RNA, 20 nt, Human
acccagcucugugcccuggg

SEQ ID NO: 691809 - RNA, 22 nt, Human
gcucuaacuauuaagaggucau

SEQ ID NO: 691810 - RNA, 21 nt, Human
aguccaggaggaggccagguu

SEQ ID NO: 691811 - RNA, 21 nt, Human
ggagcugcaggagccgaaggc

SEQ ID NO: 691812 - RNA, 22 nt, Human
agcaccaucagaugcaauaucu

SEQ ID NO: 691813 - RNA, 22 nt, Human
ucccauguuagguguuucuguu

SEQ ID NO: 691814 - RNA, 22 nt, Human
uaggaaacaaaguggaugaaau

SEQ ID NO: 691815 - RNA, 22 nt, Human
uucuuggaaauacauucaauaa

SEQ ID NO: 691816 - RNA, 22 nt, Human
uggcuccagcguccacguccug

SEQ ID NO: 691817 - RNA, 22 nt, Human
cuagggcuagacagacgcaugu

SEQ ID NO: 691818 - RNA, 22 nt, Human
uauuugcugaaucugauucaga

SEQ ID NO: 691819 - RNA, 22 nt, Human
ggcccugaagugauugugaguu

SEQ ID NO: 691820 - RNA, 22 nt, Human
acaggccugacacacagagggc

SEQ ID NO: 691821 - RNA, 23 nt, Human
gcugccaaggaggcaggggugcc

SEQ ID NO: 691822 - RNA, 22 nt, Human
gggccugccauugcugccccag

SEQ ID NO: 691823 - RNA, 22 nt, Human
uuacauguacaaacaauucuua

SEQ ID NO: 691824 - RNA, 20 nt, Human
cuuagcuucuaagguucugg

SEQ ID NO: 691825 - RNA, 22 nt, Human
gaggucaggugaggaauuaaga

SEQ ID NO: 691826 - RNA, 19 nt, Human
ugugaaagcuaguguucuu

SEQ ID NO: 691827 - RNA, 22 nt, Human
uuggagcccugaggaucuggau

SEQ ID NO: 691828 - RNA, 22 nt, Human
gcuggggagcaagaguagugag

SEQ ID NO: 691829 - RNA, 18 nt, Human
ccuggcagccaugcgcgc

SEQ ID NO: 691830 - RNA, 22 nt, Human
caggccaggguugagaagagaa

SEQ ID NO: 691831 - RNA, 22 nt, Human
ucagaaguuucaaucccagcug

SEQ ID NO: 691832 - RNA, 22 nt, Human
gacaggcuuagggagggugcuc

SEQ ID NO: 691833 - RNA, 22 nt, Human
auguuuuuaaauagacuuacag

SEQ ID NO: 691834 - RNA, 22 nt, Human
agaggcuccaccuucucugucc

SEQ ID NO: 691835 - RNA, 23 nt, Human
uuccugagugcuggagagagugc

SEQ ID NO: 691836 - RNA, 18 nt, Human
cccugagaugaugcugug

SEQ ID NO: 691837 - RNA, 22 nt, Human
aaaguguugggaagaaagugca

SEQ ID NO: 691838 - RNA, 22 nt, Human
ucuccucuauuucuguauguau

SEQ ID NO: 691839 - RNA, 21 nt, Human
acucaucuuuuuggagaccag

SEQ ID NO: 691840 - RNA, 22 nt, Human
agugaguggauguaggaauugg

SEQ ID NO: 691841 - RNA, 22 nt, Human
acucacagcagacuaugaggga

SEQ ID NO: 691842 - RNA, 22 nt, Human
uaaguugauuauaaccacugga

SEQ ID NO: 691843 - RNA, 22 nt, Human
aaacacaucauucaugucguca

SEQ ID NO: 691844 - RNA, 22 nt, Human
aggggagcaacauagucacucu

SEQ ID NO: 691845 - RNA, 22 nt, Human
ggagucugagcuuguguccugg

SEQ ID NO: 691846 - RNA, 22 nt, Human
augucacaggcaacaagauugc

SEQ ID NO: 691847 - RNA, 22 nt, Human
ccugacaguccuuuucuagugu

SEQ ID NO: 691848 - RNA, 22 nt, Human
uuucacagauccuacagcuugu

SEQ ID NO: 691849 - RNA, 22 nt, Human
accucccucgccguccacucug

SEQ ID NO: 691850 - RNA, 22 nt, Human
cugagugauagcgauggggaac

SEQ ID NO: 691851 - RNA, 22 nt, Human
ggcagcccaccagcccacgucu

SEQ ID NO: 691852 - RNA, 22 nt, Human
ccugucucuguuaccacauuug

SEQ ID NO: 691853 - RNA, 19 nt, Human
uuacaugacacuccagccu

SEQ ID NO: 691854 - RNA, 22 nt, Human
caccuggauauguuucagcuug

SEQ ID NO: 691855 - RNA, 22 nt, Human
aagggcugcaauccaaaacacu

SEQ ID NO: 691856 - RNA, 21 nt, Human
uuacacacugcuucuagaaug

SEQ ID NO: 691857 - RNA, 22 nt, Human
aaaccucuccacuacaugacag

SEQ ID NO: 691858 - RNA, 22 nt, Human
ucugcugugucccuggucuccu

SEQ ID NO: 691859 - RNA, 17 nt, Human
uggcagcugaaagcucu

SEQ ID NO: 691860 - RNA, 16 nt, Human
ggggaaggcaagaggg

SEQ ID NO: 691861 - RNA, 17 nt, Human
cuggagcuguguaaccu

SEQ ID NO: 691862 - RNA, 22 nt, Human
uuucuaguucucugccaaaaaa

SEQ ID NO: 691863 - RNA, 22 nt, Human
ugaggaagcaaaggcuugugug

SEQ ID NO: 691864 - RNA, 22 nt, Human
ggcaggcaacggaccacuaguc

SEQ ID NO: 691865 - RNA, 22 nt, Human
caagauguggugggcugaguuu

SEQ ID NO: 691866 - RNA, 22 nt, Human
gcacacuuaauacucacugugc

SEQ ID NO: 691867 - RNA, 22 nt, Human
ggcagauguuauaugaucugag

SEQ ID NO: 691868 - RNA, 22 nt, Human
aaugguuucaaacacacuaagu

SEQ ID NO: 691869 - RNA, 22 nt, Human
uagcauaauuuguagaaaauca

SEQ ID NO: 691870 - RNA, 22 nt, Human
cuaaaccuuugugcuugcaauu

SEQ ID NO: 691871 - RNA, 22 nt, Human
gucaaacagccuccuguucuaa

SEQ ID NO: 691872 - RNA, 22 nt, Human
uugguuuugggauguacaaagg

SEQ ID NO: 691873 - RNA, 22 nt, Human
cuuggcaugcagcaggcacuca

SEQ ID NO: 691874 - RNA, 22 nt, Human
aacagccacugauacugaauag

SEQ ID NO: 691875 - RNA, 22 nt, Human
cacagggcaccaguuggccauc

SEQ ID NO: 691876 - RNA, 22 nt, Human
gagcagagucuauuuccacacu

SEQ ID NO: 691877 - RNA, 22 nt, Human
ugguccagucguuccuuuccuu

SEQ ID NO: 691878 - RNA, 22 nt, Human
cagauaggaaaagcuaggcaua

SEQ ID NO: 691879 - RNA, 22 nt, Human
cugccuggaaggagcaagggga

SEQ ID NO: 691880 - RNA, 22 nt, Human
cugggccugggaggccaggucu

SEQ ID NO: 691881 - RNA, 22 nt, Human
uaggugagggagcauugugaga

SEQ ID NO: 691882 - RNA, 22 nt, Human
caugggggucuggacaacaggc

SEQ ID NO: 691883 - RNA, 22 nt, Human
uaacucuuccaacacuccuucc

SEQ ID NO: 691884 - RNA, 22 nt, Human
uccuccccugcccaugaggagg

SEQ ID NO: 691885 - RNA, 22 nt, Human
uuuaggcagaacauggacuuug

SEQ ID NO: 691886 - RNA, 22 nt, Human
ucauuucugagccuuccaugau

SEQ ID NO: 691887 - RNA, 22 nt, Human
aaagcaauagaggguaagacug

SEQ ID NO: 691888 - RNA, 22 nt, Human
uaacuguugugcgggucucugg

SEQ ID NO: 691889 - RNA, 22 nt, Human
gacugaaauuauaccaaguggu

SEQ ID NO: 691890 - RNA, 22 nt, Human
gcugaggguaacacuucgggau

SEQ ID NO: 691891 - RNA, 22 nt, Human
gagucuggcccugaugcaucau

SEQ ID NO: 691892 - RNA, 22 nt, Human
cagaaauaucaguugaaagugc

SEQ ID NO: 691893 - RNA, 22 nt, Human
gcuccucuccucggagucgggg

SEQ ID NO: 691894 - RNA, 22 nt, Human
ucucugugacagcuggguaugu

SEQ ID NO: 691895 - RNA, 22 nt, Human
cucuggagcaccgggcuaucca

SEQ ID NO: 691896 - RNA, 22 nt, Human
aaaagggacuacucucagcucc

SEQ ID NO: 691897 - RNA, 22 nt, Human
cugugcuuaccugcccagguga

SEQ ID NO: 691898 - RNA, 22 nt, Human
agaggauguucuaggcacucau

SEQ ID NO: 691899 - RNA, 22 nt, Human
cugccugcguugccucgugccu

SEQ ID NO: 691900 - RNA, 22 nt, Human
ucugcugguuccgaauuaggcc

SEQ ID NO: 691901 - RNA, 22 nt, Human
ggagugaagcaaauaaugcugg

SEQ ID NO: 691902 - RNA, 22 nt, Human
uuccuggugguggugacagcac

SEQ ID NO: 691903 - RNA, 22 nt, Human
cauggccagcccugagguucag

SEQ ID NO: 691904 - RNA, 22 nt, Human
uggagggcaugcuguccauggg

SEQ ID NO: 691905 - RNA, 20 nt, Human
ccaauguuuacagauuacuu

SEQ ID NO: 691906 - RNA, 22 nt, Human
aaguuuaguuaaguaaacucuu

SEQ ID NO: 691907 - RNA, 20 nt, Human
ccaggcacugucccaugcag

SEQ ID NO: 691908 - RNA, 22 nt, Human
ucuaacauugaauggcugauua

SEQ ID NO: 691909 - RNA, 22 nt, Human
caaacuauuguucacaagacaa

SEQ ID NO: 691910 - RNA, 22 nt, Human
cugggagcuagcucugagcuga

SEQ ID NO: 691911 - RNA, 23 nt, Human
gcucaggcaucauucuuccuggc

SEQ ID NO: 691912 - RNA, 22 nt, Human
uuucucugggcacucuccaaac

SEQ ID NO: 691913 - RNA, 22 nt, Human
aucaguuuguauaugaaacacu

SEQ ID NO: 691914 - RNA, 22 nt, Human
ugggcugaggggccuugaugac

SEQ ID NO: 691915 - RNA, 22 nt, Human
auauagaauacacagggaaagu

SEQ ID NO: 691916 - RNA, 22 nt, Human
uguuuacugcauucuauuugcu

SEQ ID NO: 691917 - RNA, 22 nt, Human
cuggcuuguuuuaagaauacaa

SEQ ID NO: 691918 - RNA, 22 nt, Human
gggaagugagcuggaaucaagg

SEQ ID NO: 691919 - RNA, 22 nt, Human
guuuauaaauucugcuuuuguu

SEQ ID NO: 691920 - RNA, 22 nt, Human
gugggcuuugcuggauccuucc

SEQ ID NO: 691921 - RNA, 22 nt, Human
uuugacaacacguuauuugccu

SEQ ID NO: 691922 - RNA, 22 nt, Human
ggauuagcuuuuguucuugacu

SEQ ID NO: 691923 - RNA, 22 nt, Human
uggcuccaccgccgcggagcuc

SEQ ID NO: 691924 - RNA, 22 nt, Human
ggcugcuggcagauguaguuua

SEQ ID NO: 691925 - RNA, 21 nt, Human
ucacuggaauacaauugauuu

SEQ ID NO: 691926 - RNA, 22 nt, Human
uaggccaccaggguuccauuua

SEQ ID NO: 691927 - RNA, 22 nt, Human
aggcuucagaugaccuuagcau

SEQ ID NO: 691928 - RNA, 22 nt, Human
gggccccuugcugcucugcugg

SEQ ID NO: 691929 - RNA, 22 nt, Human
agggagccuuccuggcuguggu

SEQ ID NO: 691930 - RNA, 22 nt, Human
ucuacacuguagaauuauaagg

SEQ ID NO: 691931 - RNA, 19 nt, Human
gccaggccuggaccugcag

SEQ ID NO: 691932 - RNA, 22 nt, Human
uggauuucuccagcucuccauu

SEQ ID NO: 691933 - RNA, 22 nt, Human
acagcagucuuaacacauugca

SEQ ID NO: 691934 - RNA, 22 nt, Human
cuccacucuggggugggugaga

SEQ ID NO: 691935 - RNA, 22 nt, Human
ugaggugccacccaagagccuu

SEQ ID NO: 691936 - RNA, 22 nt, Human
cuacauuuuaauaagcugcuua

SEQ ID NO: 691937 - RNA, 22 nt, Human
gggcuccaacggugagcaugga

SEQ ID NO: 691938 - RNA, 22 nt, Human
acacagggcugcgccugacccc

SEQ ID NO: 691939 - RNA, 22 nt, Human
caaggccagagccagcgauaag

SEQ ID NO: 691940 - RNA, 22 nt, Human
uuuagcaaagguaggguucaga

SEQ ID NO: 691941 - RNA, 22 nt, Human
aagcaauaggguaaucuacuca

SEQ ID NO: 691942 - RNA, 22 nt, Human
gggagcuguaguccagauaccg

SEQ ID NO: 691943 - RNA, 22 nt, Human
ccauggaucuggaucuaucuuu

SEQ ID NO: 691944 - RNA, 22 nt, Human
cuugcaggcagggccuccugga

SEQ ID NO: 691945 - RNA, 22 nt, Human
gccacagggaggcguuuucagg

SEQ ID NO: 691946 - RNA, 22 nt, Human
gcaggcaguuugcuuuucccuc

SEQ ID NO: 691947 - RNA, 22 nt, Human
uagcaagaucgugucucuaaaa

SEQ ID NO: 691948 - RNA, 22 nt, Human
uggcagaguuggagguggaaga

SEQ ID NO: 691949 - RNA, 22 nt, Human
cuggcccuggcuggagcccagg

SEQ ID NO: 691950 - RNA, 22 nt, Human
uugagcaucuuauagaaagagc

SEQ ID NO: 691951 - RNA, 22 nt, Human
cucugcugcccaugaugguaua

SEQ ID NO: 691952 - RNA, 22 nt, Human
uuauuugauuaguaaaccugua

SEQ ID NO: 691953 - RNA, 22 nt, Human
gcagccagccccucugaccucu

SEQ ID NO: 691954 - RNA, 22 nt, Human
cgccuggaaccucuaggaccag

SEQ ID NO: 691955 - RNA, 22 nt, Human
cagcaccuguuagcauuaaaua

SEQ ID NO: 691956 - RNA, 22 nt, Human
agcuaacaugacuagaagcuuc

SEQ ID NO: 691957 - RNA, 18 nt, Human
auugagcaugacagaccu

SEQ ID NO: 691958 - RNA, 22 nt, Human
uucaggacuaggggcuucaagg

SEQ ID NO: 691959 - RNA, 22 nt, Human
cuguuuccaccuucauggcuaa

SEQ ID NO: 691960 - RNA, 22 nt, Human
ucugggccuuggaguggggaga

SEQ ID NO: 691961 - RNA, 22 nt, Human
cagauggccagaggcagcugca

SEQ ID NO: 691962 - RNA, 22 nt, Human
agcagggcacuggaaggcacug

SEQ ID NO: 691963 - RNA, 22 nt, Human
ggccuuggugcucuguguugca

SEQ ID NO: 691964 - RNA, 22 nt, Human
ggugggacagguaggaguggcu

SEQ ID NO: 691965 - RNA, 22 nt, Human
uccuucaugaugcuuagcagag

SEQ ID NO: 691966 - RNA, 22 nt, Human
uuguacauaaugaaaggaggcu

SEQ ID NO: 691967 - RNA, 22 nt, Human
aucaggauccaccuugagccug

SEQ ID NO: 691968 - RNA, 22 nt, Human
uuugacauuauccuguuacugg

SEQ ID NO: 691969 - RNA, 22 nt, Human
ucucagagauucagggagaagu

SEQ ID NO: 691970 - RNA, 22 nt, Human
acacagauauuguacuugaucc

SEQ ID NO: 691971 - RNA, 22 nt, Human
cugcaugucacucugcuguccc

SEQ ID NO: 691972 - RNA, 22 nt, Human
aaauacuguccaccauggagca

SEQ ID NO: 691973 - RNA, 22 nt, Human
guucagauuugacugguuucuc

SEQ ID NO: 691974 - RNA, 22 nt, Human
ugaaagcagugauuucuccuuc

SEQ ID NO: 691975 - RNA, 22 nt, Human
auagacauggucuuuugucauu

SEQ ID NO: 691976 - RNA, 22 nt, Human
uugacuguuaagacuuggcucu

SEQ ID NO: 691977 - RNA, 19 nt, Human
ccuggcucugagcccagcc

SEQ ID NO: 691978 - RNA, 23 nt, Human
ugcuggagaagcaaaguucugag

SEQ ID NO: 691979 - RNA, 18 nt, Human
uccagucccagcucugcc

SEQ ID NO: 691980 - RNA, 22 nt, Human
uccaggcuggagugcaguggca

SEQ ID NO: 691981 - RNA, 19 nt, Human
aggguccagggagcggcuc

SEQ ID NO: 691982 - RNA, 22 nt, Human
gcugggaaguggcagagcugga

SEQ ID NO: 691983 - RNA, 22 nt, Human
ucuguuagcugucaaaguguuu

SEQ ID NO: 691984 - RNA, 22 nt, Human
gagcuaggcuagggggagucgc

SEQ ID NO: 691985 - RNA, 22 nt, Human
aauggcaguaguugcaugagag

SEQ ID NO: 691986 - RNA, 22 nt, Human
aucugaaaagcuuuaaugagcu

SEQ ID NO: 691987 - RNA, 22 nt, Human
uuggaggacuaguuaagagacc

SEQ ID NO: 691988 - RNA, 19 nt, Human
acucuguuguacuugaggg

SEQ ID NO: 691989 - RNA, 22 nt, Human
acugggcuguaaagagaggcaa

SEQ ID NO: 691990 - RNA, 22 nt, Human
cugggcuggauaauucuuugcu

SEQ ID NO: 691991 - RNA, 22 nt, Human
ggagccugggcauuaguaauuu

SEQ ID NO: 691992 - RNA, 20 nt, Human
aaaguucauguuugcacuuu

SEQ ID NO: 691993 - RNA, 18 nt, Human
ggcuggaagcuguugcug

SEQ ID NO: 691994 - RNA, 22 nt, Human
gcuggcuguguuccuucugcca

SEQ ID NO: 691995 - RNA, 22 nt, Human
ucucagggaccaugaugaugac

SEQ ID NO: 691996 - RNA, 22 nt, Human
uauggguaucuguacugauugu

SEQ ID NO: 691997 - RNA, 20 nt, Human
agcugcagaacccacuggac

SEQ ID NO: 691998 - RNA, 17 nt, Human
gcacucccccaccuccu

SEQ ID NO: 691999 - RNA, 22 nt, Human
ucagagguucuucucaguggcc

SEQ ID NO: 692000 - RNA, 22 nt, Human
caccaucagcagcaggugucaa

SEQ ID NO: 692001 - RNA, 22 nt, Human
agcuguauuugugaauauuuaa

SEQ ID NO: 692002 - RNA, 18 nt, Human
cuccugggcugcagaugc

SEQ ID NO: 692003 - RNA, 22 nt, Human
gaggaacaugaggugaccuggg

SEQ ID NO: 692004 - RNA, 22 nt, Human
auguaaacuuuaccagcucuga

SEQ ID NO: 692005 - RNA, 22 nt, Human
ggcaggugugagaucgaggcca

SEQ ID NO: 692006 - RNA, 22 nt, Human
gugcuggcuggggcaucaggca

SEQ ID NO: 692007 - RNA, 22 nt, Human
ccagcugcuaucaugccauuuc

SEQ ID NO: 692008 - RNA, 22 nt, Human
uggagggaacccaggcugcucu

SEQ ID NO: 692009 - RNA, 22 nt, Human
gcagcaguggcugcagguccca

SEQ ID NO: 692010 - RNA, 22 nt, Human
acauucacaagccuacaagguu

SEQ ID NO: 692011 - RNA, 22 nt, Human
uguuuacuggaccagggagggg

SEQ ID NO: 692012 - RNA, 22 nt, Human
cagauagcaaauggguaagcua

SEQ ID NO: 692013 - RNA, 20 nt, Human
ugggccuguggcagaagucu

SEQ ID NO: 692014 - RNA, 22 nt, Human
aguugcagccuucaggagaccc

SEQ ID NO: 692015 - RNA, 22 nt, Human
cauucacagagggggaagcauc

SEQ ID NO: 692016 - RNA, 22 nt, Human
cagcacugugauaacugagcca

SEQ ID NO: 692017 - RNA, 22 nt, Human
ugacaaacucuuugagaacaag

SEQ ID NO: 692018 - RNA, 22 nt, Human
uuuuugaaggcugaugugauua

SEQ ID NO: 692019 - RNA, 22 nt, Human
accccucagcucuucgugcccc

SEQ ID NO: 692020 - RNA, 22 nt, Human
gccugcagcaugcuaggucuug

SEQ ID NO: 692021 - RNA, 22 nt, Human
uuccuggggugaagauauuuuu

SEQ ID NO: 692022 - RNA, 22 nt, Human
gccaggugagaggacugaggcu

SEQ ID NO: 692023 - RNA, 22 nt, Human
acacagaguuauuaugugaacu

SEQ ID NO: 692024 - RNA, 22 nt, Human
augcacaauuaggauauagcuu

SEQ ID NO: 692025 - RNA, 22 nt, Human
aggcucuaaggagggcugucua

SEQ ID NO: 692026 - RNA, 22 nt, Human
uucugguuuaagaaagugcugg

SEQ ID NO: 692027 - RNA, 22 nt, Human
cuuugcagcaauuucuguuaaa

SEQ ID NO: 692028 - RNA, 21 nt, Human
agacuucuagaagugagauag

SEQ ID NO: 692029 - RNA, 22 nt, Human
ggcuguguuucuguuugacauu

SEQ ID NO: 692030 - RNA, 22 nt, Human
auguacauagcaucaucuagga

SEQ ID NO: 692031 - RNA, 22 nt, Human
acagagacugggaugccugccu

SEQ ID NO: 692032 - RNA, 23 nt, Human
gccagccagaauuucuccacugu

SEQ ID NO: 692033 - RNA, 20 nt, Human
gaaauguaucucuugauucu

SEQ ID NO: 692034 - RNA, 22 nt, Human
ggcugcagggcagcuggugugg

SEQ ID NO: 692035 - RNA, 22 nt, Human
cagcuguucuugggacagacag

SEQ ID NO: 692036 - RNA, 22 nt, Human
ccaccugugcuugguacuccau

SEQ ID NO: 692037 - RNA, 22 nt, Human
ucuucuguuuuagauugcauac

SEQ ID NO: 692038 - RNA, 22 nt, Human
uaccucucggggucuguuugug

SEQ ID NO: 692039 - RNA, 18 nt, Human
uccugccugcgggcuccc

SEQ ID NO: 692040 - RNA, 22 nt, Human
ucuauuuucuugccaaaacugc

SEQ ID NO: 692041 - RNA, 22 nt, Human
aaaugcauucuguuuucacuag

SEQ ID NO: 692042 - RNA, 22 nt, Human
agggccugacacccuugccagc

SEQ ID NO: 692043 - RNA, 22 nt, Human
cuacaguacuggaugcucagcc

SEQ ID NO: 692044 - RNA, 22 nt, Human
ucauuuguggaagugauugugg

SEQ ID NO: 692045 - RNA, 22 nt, Human
gcugcuucagggacgugccagc

SEQ ID NO: 692046 - RNA, 22 nt, Human
agcaugaagacuucagagcuag

SEQ ID NO: 692047 - RNA, 22 nt, Human
ugcacguauggcaguggagccc

SEQ ID NO: 692048 - RNA, 22 nt, Human
aaguuugagagccuuuaguaua

SEQ ID NO: 692049 - RNA, 22 nt, Human
ucugccugaaauucacauguaa

SEQ ID NO: 692050 - RNA, 22 nt, Human
gguggcucccacccagcuuuga

SEQ ID NO: 692051 - RNA, 22 nt, Human
guugaaaaugacuuuauaccau

SEQ ID NO: 692052 - RNA, 23 nt, Human
uagcaaaguuguuugggaaauuu

SEQ ID NO: 692053 - RNA, 22 nt, Human
gucugggcuuagggacauggca

SEQ ID NO: 692054 - RNA, 22 nt, Human
gccuggagggucccucucugga

SEQ ID NO: 692055 - RNA, 22 nt, Human
uuacaauuacuugaucucagcu

SEQ ID NO: 692056 - RNA, 22 nt, Human
agugcuccugccagcuuucugg

SEQ ID NO: 692057 - RNA, 22 nt, Human
aacaauaauugcgguucucuau

SEQ ID NO: 692058 - RNA, 22 nt, Human
aauaacuucaguucuuacauua

SEQ ID NO: 692059 - RNA, 22 nt, Human
augugcuguaauccauugaagg

SEQ ID NO: 692060 - RNA, 19 nt, Human
cuguggcugaccucuggcc

SEQ ID NO: 692061 - RNA, 20 nt, Human
cugggcucaagugagccucc

SEQ ID NO: 692062 - RNA, 22 nt, Human
uucuugauuagucucaugccaa

SEQ ID NO: 692063 - RNA, 22 nt, Human
ucaggcuuccaggcucugcuga

SEQ ID NO: 692064 - RNA, 22 nt, Human
agggguaguaggauaacaaauu

SEQ ID NO: 692065 - RNA, 22 nt, Human
gccuccugguugcuucuccaac

SEQ ID NO: 692066 - RNA, 22 nt, Human
uacugucuaauaagauugaugg

SEQ ID NO: 692067 - RNA, 22 nt, Human
ucauuuauuugacuuuggagug

SEQ ID NO: 692068 - RNA, 22 nt, Human
gcaauguuaagaucacaccugg

SEQ ID NO: 692069 - RNA, 22 nt, Human
ucauccuggagaagcuccuucg

SEQ ID NO: 692070 - RNA, 19 nt, Human
agcagguggguaagaaaau

SEQ ID NO: 692071 - RNA, 22 nt, Human
uucaacuuuaugcauauguauu

SEQ ID NO: 692072 - RNA, 22 nt, Human
gcuggugccuuguuguuguuac

SEQ ID NO: 692073 - RNA, 22 nt, Human
aggcuucaguauucaccgcaug

SEQ ID NO: 692074 - RNA, 20 nt, Human
cugcugcccugucagccucu

SEQ ID NO: 692075 - RNA, 22 nt, Human
gguuucagcccugcuguuccug

SEQ ID NO: 692076 - RNA, 22 nt, Human
uccuuagagacaagaccaguuu

SEQ ID NO: 692077 - RNA, 21 nt, Human
gccagcugggucuugcaggag

SEQ ID NO: 692078 - RNA, 22 nt, Human
agaaauguggaggaacagggcu

SEQ ID NO: 692079 - RNA, 22 nt, Human
cuuguagaccccuggacucacg

SEQ ID NO: 692080 - RNA, 22 nt, Human
aggaagguaaugaacugaggag

SEQ ID NO: 692081 - RNA, 22 nt, Human
ugcauuggucuuaaucuucagg

SEQ ID NO: 692082 - RNA, 22 nt, Human
guuuggggucugcagagcggcg

SEQ ID NO: 692083 - RNA, 22 nt, Human
agcugguaugaacaggauagga

SEQ ID NO: 692084 - RNA, 23 nt, Human
ucacaggggccagcgcucugugg

SEQ ID NO: 692085 - RNA, 22 nt, Human
uccacauuauguuucuccuuuc

SEQ ID NO: 692086 - RNA, 22 nt, Human
ugugcagagcggggaagagcac

SEQ ID NO: 692087 - RNA, 22 nt, Human
accaaggagacaaagguguauu

SEQ ID NO: 692088 - RNA, 22 nt, Human
ugggccagcugaagugccgccc

SEQ ID NO: 692089 - RNA, 22 nt, Human
gaaggaagauucuguuggaauc

SEQ ID NO: 692090 - RNA, 22 nt, Human
ccugggcuguugcaucauccuu

SEQ ID NO: 692091 - RNA, 22 nt, Human
guacauuuauuuuugcagcaua

SEQ ID NO: 692092 - RNA, 22 nt, Human
aucugggcucgaauccuagcuc

SEQ ID NO: 692093 - RNA, 22 nt, Human
caccugaauggaacuuugaacc

SEQ ID NO: 692094 - RNA, 22 nt, Human
uccuccccucagggcaacggau

SEQ ID NO: 692095 - RNA, 22 nt, Human
guaaauguugcauuuaugggua

SEQ ID NO: 692096 - RNA, 18 nt, Human
ugcacuagaugcuggcag

SEQ ID NO: 692097 - RNA, 23 nt, Human
auggacaggguuucagggucaca

SEQ ID NO: 692098 - RNA, 22 nt, Human
ggaauaaagaaucugguucccc

SEQ ID NO: 692099 - RNA, 22 nt, Human
gggcuucucugggaguccuggu

SEQ ID NO: 692100 - RNA, 22 nt, Human
uagccuucucaagacaaaguug

SEQ ID NO: 692101 - RNA, 22 nt, Human
uguaaaagacauuucuaagcaa

SEQ ID NO: 692102 - RNA, 22 nt, Human
agcucacaguguccuuccucaa

SEQ ID NO: 692103 - RNA, 17 nt, Human
ccacagccuggcacuug

SEQ ID NO: 692104 - RNA, 18 nt, Human
ucucugaauauuuuaugu

SEQ ID NO: 692105 - RNA, 22 nt, Human
uccagcagugcucaggacucac

SEQ ID NO: 692106 - RNA, 22 nt, Human
ggcuuagcaacuccugaggcuc

SEQ ID NO: 692107 - RNA, 22 nt, Human
uuucacauuagauaugucauuu

SEQ ID NO: 692108 - RNA, 22 nt, Human
uggauaaauggugcuaucaccc

SEQ ID NO: 692109 - RNA, 22 nt, Human
gcauuggcauuucuccagcgga

SEQ ID NO: 692110 - RNA, 22 nt, Human
cuggagucucuucuguagcuac

SEQ ID NO: 692111 - RNA, 22 nt, Human
cagggccagcgcccaggcccag

SEQ ID NO: 692112 - RNA, 22 nt, Human
cuggccuuuuguuucuggagaa

SEQ ID NO: 692113 - RNA, 22 nt, Human
caguauaaugcccccugugggg

SEQ ID NO: 692114 - RNA, 22 nt, Human
cuucccuuccccucacggagac

SEQ ID NO: 692115 - RNA, 22 nt, Human
augaacaguaugcaacaugauu

SEQ ID NO: 692116 - RNA, 22 nt, Human
ccagaggcuggcaagggcuccu

SEQ ID NO: 692117 - RNA, 18 nt, Human
gccuucagacugcaugcu

SEQ ID NO: 692118 - RNA, 22 nt, Human
augauucagcccaauuuuucua

SEQ ID NO: 692119 - RNA, 21 nt, Human
uggaaacagcgccaucugccg

SEQ ID NO: 692120 - RNA, 22 nt, Human
cuuuguagcugcuucugauuua

SEQ ID NO: 692121 - RNA, 22 nt, Human
ccacuccccacgugcugucaga

SEQ ID NO: 692122 - RNA, 22 nt, Human
uccgaggccaaagcugugaaua

SEQ ID NO: 692123 - RNA, 22 nt, Human
cugccucuuaaguggauggagu

SEQ ID NO: 692124 - RNA, 22 nt, Human
cuguuuccugucuucucacuau

SEQ ID NO: 692125 - RNA, 22 nt, Human
ugguuuggguaguuauuauuau

SEQ ID NO: 692126 - RNA, 22 nt, Human
ugcuggaggggaugccuucacu

SEQ ID NO: 692127 - RNA, 22 nt, Human
ggcugcagcccucgccuagcca

SEQ ID NO: 692128 - RNA, 21 nt, Human
aguuacaaguuuauucagagg

SEQ ID NO: 692129 - RNA, 22 nt, Human
ucucugaagcuguuguagucuc

SEQ ID NO: 692130 - RNA, 22 nt, Human
aucaaauacaaagggcauaagg

SEQ ID NO: 692131 - RNA, 22 nt, Human
uccuggcuccuggagaccugcu

SEQ ID NO: 692132 - RNA, 22 nt, Human
ugcagggcuaagucagagccug

SEQ ID NO: 692133 - RNA, 22 nt, Human
cuggcccagucucagaguguca

SEQ ID NO: 692134 - RNA, 22 nt, Human
acucaggcacucagcccucgcc

SEQ ID NO: 692135 - RNA, 22 nt, Human
uggaggcauuugauguucauaa

SEQ ID NO: 692136 - RNA, 17 nt, Human
ugcagcugauggggaaa

SEQ ID NO: 692137 - RNA, 22 nt, Human
agaaaugugagccccuuaucaa

SEQ ID NO: 692138 - RNA, 22 nt, Human
uucacaaagcugguuccuucug

SEQ ID NO: 692139 - RNA, 22 nt, Human
aaaugacauuaggauccugcau

SEQ ID NO: 692140 - RNA, 22 nt, Human
cuguguagccucaugugggcuu

SEQ ID NO: 692141 - RNA, 22 nt, Human
caggcugccgugaagcaggccu

SEQ ID NO: 692142 - RNA, 22 nt, Human
uguguauauauguuuaagucau

SEQ ID NO: 692143 - RNA, 22 nt, Human
cagagcuggcucugcauguaca

SEQ ID NO: 692144 - RNA, 22 nt, Human
uacuaguuucuaccuuacagaa

SEQ ID NO: 692145 - RNA, 22 nt, Human
caguguaucauuagugugauga

SEQ ID NO: 692146 - RNA, 22 nt, Human
uauccaauucaccauugauggg

SEQ ID NO: 692147 - RNA, 22 nt, Human
ugaaacagucuccagacuugga

SEQ ID NO: 692148 - RNA, 22 nt, Human
aacaggggugggugcuacugga

SEQ ID NO: 692149 - RNA, 22 nt, Human
ccugggucuugguucaugcucu

SEQ ID NO: 692150 - RNA, 22 nt, Human
guucacagggauccuuguugaa

SEQ ID NO: 692151 - RNA, 23 nt, Human
agcagcccugggaccuggccugc

SEQ ID NO: 692152 - RNA, 22 nt, Human
agggaagaagcugguaguaggu

SEQ ID NO: 692153 - RNA, 22 nt, Human
uuucuucucugauuaaggcuca

SEQ ID NO: 692154 - RNA, 22 nt, Human
ucacacuuuauuuauuucaugc

SEQ ID NO: 692155 - RNA, 19 nt, Human
agcuuuuacuaacagcaga

SEQ ID NO: 692156 - RNA, 22 nt, Human
cccaagcagggugcagaggcau

SEQ ID NO: 692157 - RNA, 22 nt, Human
gcacagagcuuguuuacauuug

SEQ ID NO: 692158 - RNA, 22 nt, Human
gggaugaauugagucagaaggg

SEQ ID NO: 692159 - RNA, 22 nt, Human
uggcuucuauugcuguggcauu

SEQ ID NO: 692160 - RNA, 22 nt, Human
gagacacaaucucauuuacauu

SEQ ID NO: 692161 - RNA, 22 nt, Human
ugccagggugucaggagagcua

SEQ ID NO: 692162 - RNA, 22 nt, Human
gcucugugagccacuugaugua

SEQ ID NO: 692163 - RNA, 22 nt, Human
ggcaagggacggccgugagaca

SEQ ID NO: 692164 - RNA, 22 nt, Human
ugcaaaugcccauuuauuuucu

SEQ ID NO: 692165 - RNA, 22 nt, Human
aagcacagacucccucugagug

SEQ ID NO: 692166 - RNA, 22 nt, Human
uugaauaauguguauguuguua

SEQ ID NO: 692167 - RNA, 22 nt, Human
augaagcuaaacccugcagcca

SEQ ID NO: 692168 - RNA, 22 nt, Human
ugccugucuuuccucccucgua

SEQ ID NO: 692169 - RNA, 22 nt, Human
gcugccagcucacucuccugag

SEQ ID NO: 692170 - RNA, 22 nt, Human
acagcagguagcuuugugccuc

SEQ ID NO: 692171 - RNA, 22 nt, Human
agaaauguacacgacacccaga

SEQ ID NO: 692172 - RNA, 22 nt, Human
uaggccuaguuacugcuuacuu

SEQ ID NO: 692173 - RNA, 22 nt, Human
uggcagugggaauggacaaaca

SEQ ID NO: 692174 - RNA, 22 nt, Human
uaauugucuuagucugugcagg

SEQ ID NO: 692175 - RNA, 22 nt, Human
ugccuaggcuggaaugcagugg

SEQ ID NO: 692176 - RNA, 22 nt, Human
gagacagcagggccagggccug

SEQ ID NO: 692177 - RNA, 22 nt, Human
cagggugguaccagcaucuagu

SEQ ID NO: 692178 - RNA, 22 nt, Human
acuucauucauuuucacgaaug

SEQ ID NO: 692179 - RNA, 22 nt, Human
uccauggggcccaggaugagag

SEQ ID NO: 692180 - RNA, 22 nt, Human
ugaaaguauuugauuucuauua

SEQ ID NO: 692181 - RNA, 22 nt, Human
gcagcuggggccacacuuaggc

SEQ ID NO: 692182 - RNA, 20 nt, Human
cagaaggucuaagcuuuaga

SEQ ID NO: 692183 - RNA, 22 nt, Human
uccacccccagacagcugguga

SEQ ID NO: 692184 - RNA, 21 nt, Human
ugcugaugucagagaagcaag

SEQ ID NO: 692185 - RNA, 22 nt, Human
cugcggugggcugggcuguccc

SEQ ID NO: 692186 - RNA, 22 nt, Human
aucuuauguuguauucaaaauc

SEQ ID NO: 692187 - RNA, 22 nt, Human
ucugggcccugagauguucuuc

SEQ ID NO: 692188 - RNA, 22 nt, Human
cuucauuuggagaacugugcuu

SEQ ID NO: 692189 - RNA, 22 nt, Human
cagaaaaccugacucuagaacu

SEQ ID NO: 692190 - RNA, 22 nt, Human
cagcaggcucugaguggcugcc

SEQ ID NO: 692191 - RNA, 22 nt, Human
cagugggacaugggcacugggc

SEQ ID NO: 692192 - RNA, 22 nt, Human
uuuuggcucugcagguuugcac

SEQ ID NO: 692193 - RNA, 23 nt, Human
aguaacaugcaaauaacagucug

SEQ ID NO: 692194 - RNA, 22 nt, Human
ggcaguguccuugcagcucuac

SEQ ID NO: 692195 - RNA, 20 nt, Human
agcuucugcugccuuucggc

SEQ ID NO: 692196 - RNA, 22 nt, Human
agcugcuuagagucucuucuua

SEQ ID NO: 692197 - RNA, 19 nt, Human
agcagcagcaccagggauu

SEQ ID NO: 692198 - RNA, 22 nt, Human
uuucaaaguaaggauuuucauc

SEQ ID NO: 692199 - RNA, 22 nt, Human
aagauggucuugagauauuaua

SEQ ID NO: 692200 - RNA, 22 nt, Human
ucagcuuugccaccagcuguaa

SEQ ID NO: 692201 - RNA, 22 nt, Human
ucugggcuggugcucaugaauu

SEQ ID NO: 692202 - RNA, 23 nt, Human
ucugggaauuggcuguccacagg

SEQ ID NO: 692203 - RNA, 22 nt, Human
aagaucaagaucagagaacagc

SEQ ID NO: 692204 - RNA, 22 nt, Human
gaauguuuuucaaaccuguggc

SEQ ID NO: 692205 - RNA, 22 nt, Human
uuucaaagucaauaucauuacc

SEQ ID NO: 692206 - RNA, 22 nt, Human
cccaguuguugccggcucugga

SEQ ID NO: 692207 - RNA, 22 nt, Human
agaggaagcugagaugccucuu

SEQ ID NO: 692208 - RNA, 20 nt, Human
cucagcucuucagggcaagu

SEQ ID NO: 692209 - RNA, 22 nt, Human
acaacaggguaaggcaggccau

SEQ ID NO: 692210 - RNA, 22 nt, Human
agcaccuccuuagcuaugacca

SEQ ID NO: 692211 - RNA, 22 nt, Human
caguacauuucauaugauucua

SEQ ID NO: 692212 - RNA, 22 nt, Human
ugauggaauggaggacaugugg

SEQ ID NO: 692213 - RNA, 22 nt, Human
ucaugcaguuugaaguucaggg

SEQ ID NO: 692214 - RNA, 22 nt, Human
aguacaaugucugacacaguag

SEQ ID NO: 692215 - RNA, 16 nt, Human
gaaggagauucagaaa

SEQ ID NO: 692216 - RNA, 22 nt, Human
ggcaggaggaagaguuagcacc

SEQ ID NO: 692217 - RNA, 19 nt, Human
auuuacugccuaaaaucuc

SEQ ID NO: 692218 - RNA, 22 nt, Human
ucaguguuuuuaaagcaauaua

SEQ ID NO: 692219 - RNA, 22 nt, Human
ggaacuggguuagggucucuuc

SEQ ID NO: 692220 - RNA, 22 nt, Human
uuuuagauuauaagucuaauuc

SEQ ID NO: 692221 - RNA, 22 nt, Human
aggaagcugggaaacugacauu

SEQ ID NO: 692222 - RNA, 22 nt, Human
ccugagaggcccucucacuguc

SEQ ID NO: 692223 - RNA, 20 nt, Human
agguuccuuuguggagaauu

SEQ ID NO: 692224 - RNA, 22 nt, Human
acagcagaguggagaugagcac

SEQ ID NO: 692225 - RNA, 22 nt, Human
ccccacuuugaguagcacuuga

SEQ ID NO: 692226 - RNA, 22 nt, Human
ugagagguaggaaaugaacaag

SEQ ID NO: 692227 - RNA, 22 nt, Human
uccccuccaacuccaacuaugg

SEQ ID NO: 692228 - RNA, 22 nt, Human
aaggauuuuuggaaugagaugg

SEQ ID NO: 692229 - RNA, 22 nt, Human
uuaagaauggaaugaggaauuu

SEQ ID NO: 692230 - RNA, 19 nt, Human
ccagagcccgccagauggg

SEQ ID NO: 692231 - RNA, 22 nt, Human
aacaaaguguacuuccauacug

SEQ ID NO: 692232 - RNA, 22 nt, Human
uccucagucucucaaaugaggc

SEQ ID NO: 692233 - RNA, 18 nt, Human
auuuugaacaaugcugua

SEQ ID NO: 692234 - RNA, 22 nt, Human
cccacacacuggcugcugccaa

SEQ ID NO: 692235 - RNA, 22 nt, Human
agacagcauggagcugauaaca

SEQ ID NO: 692236 - RNA, 22 nt, Human
caggggccaggcugucugcugu

SEQ ID NO: 692237 - RNA, 22 nt, Human
agcauauaggaaauguugaauc

SEQ ID NO: 692238 - RNA, 22 nt, Human
ggguagggugacuuaggcuggc

SEQ ID NO: 692239 - RNA, 18 nt, Human
acaaaggucugcaagacc

SEQ ID NO: 692240 - RNA, 22 nt, Human
augccuuauuccaacaaucuag

SEQ ID NO: 692241 - RNA, 22 nt, Human
guggagcccugguagggacccc

SEQ ID NO: 692242 - RNA, 22 nt, Human
uccaccagcuucuucaccagcu

SEQ ID NO: 692243 - RNA, 22 nt, Human
gacaggcagaccugugcccugg

SEQ ID NO: 692244 - RNA, 22 nt, Human
ucagugcagugaaagguuuacu

SEQ ID NO: 692245 - RNA, 22 nt, Human
gcguuuaagugaugaucgucuu

SEQ ID NO: 692246 - RNA, 22 nt, Human
ggacaggcugcaucugagcaug

SEQ ID NO: 692247 - RNA, 19 nt, Human
ggcugccuccugggagauu

SEQ ID NO: 692248 - RNA, 22 nt, Human
uuaugcuguuaggaaaaucaaa

SEQ ID NO: 692249 - RNA, 22 nt, Human
uuacacuugaaaacaggauuua

SEQ ID NO: 692250 - RNA, 21 nt, Human
ggcacugagccagauggacuc

SEQ ID NO: 692251 - RNA, 22 nt, Human
aaggccagccugagagcuaaca

SEQ ID NO: 692252 - RNA, 22 nt, Human
gugcaggagcucccgcaguggu

SEQ ID NO: 692253 - RNA, 22 nt, Human
cagcugguuggaagggagcuga

SEQ ID NO: 692254 - RNA, 22 nt, Human
aaagugcugggauuacaggccu

SEQ ID NO: 692255 - RNA, 22 nt, Human
acacagaguccuuacugaggua

SEQ ID NO: 692256 - RNA, 22 nt, Human
accaggcacuccugaggucuga

SEQ ID NO: 692257 - RNA, 22 nt, Human
ggugcucaaggugacaggacau

SEQ ID NO: 692258 - RNA, 22 nt, Human
aaguuuaguggugguguuccau

SEQ ID NO: 692259 - RNA, 22 nt, Human
ugaggaacugccagacuguuuu

SEQ ID NO: 692260 - RNA, 22 nt, Human
uuguuucagcccagaucuuuac

SEQ ID NO: 692261 - RNA, 22 nt, Human
caaugacauggauaaucauauu

SEQ ID NO: 692262 - RNA, 22 nt, Human
cucagacauuuguagaaagugc

SEQ ID NO: 692263 - RNA, 22 nt, Human
cuugggcucagcaccgugugga

SEQ ID NO: 692264 - RNA, 22 nt, Human
augcuggcagccgagugcucca

SEQ ID NO: 692265 - RNA, 22 nt, Human
uuacacacaauuagcauaguaa

SEQ ID NO: 692266 - RNA, 22 nt, Human
ccugaguuaguugcugugucuc

SEQ ID NO: 692267 - RNA, 22 nt, Human
ugucuccaccaucaucuuacca

SEQ ID NO: 692268 - RNA, 22 nt, Human
gagccaccuucaacucaggaau

SEQ ID NO: 692269 - RNA, 22 nt, Human
augcaaaugucaccacuucuaa

SEQ ID NO: 692270 - RNA, 22 nt, Human
uuuugagauggugucucgcucc

SEQ ID NO: 692271 - RNA, 22 nt, Human
ugagcuccggcauauggaauua

SEQ ID NO: 692272 - RNA, 22 nt, Human
uccaggcauaaugcccaguggu

SEQ ID NO: 692273 - RNA, 21 nt, Human
gcccagaagacuggcucugcc

SEQ ID NO: 692274 - RNA, 22 nt, Human
uuccucagcuguuugggcucau

SEQ ID NO: 692275 - RNA, 22 nt, Human
cugagcugcuuugcuuuugggg

SEQ ID NO: 692276 - RNA, 21 nt, Human
agaugcagugacccacugggg

SEQ ID NO: 692277 - RNA, 22 nt, Human
guuugaaagaccaauuagauuu

SEQ ID NO: 692278 - RNA, 22 nt, Human
cugggccuuuaccuacggaguu

SEQ ID NO: 692279 - RNA, 22 nt, Human
ggcaccagggaaggaaggcugg

SEQ ID NO: 692280 - RNA, 22 nt, Human
gauaaacacugaugauaugggg

SEQ ID NO: 692281 - RNA, 22 nt, Human
uuugcaaauaaauaagugcucg

SEQ ID NO: 692282 - RNA, 22 nt, Human
gaaggcuggcuuucugagagca

SEQ ID NO: 692283 - RNA, 22 nt, Human
uuuucagugguaucuuuguaaa

SEQ ID NO: 692284 - RNA, 22 nt, Human
gcccaggauggagaauaguggu

SEQ ID NO: 692285 - RNA, 22 nt, Human
aggcuggguaccugucauaugc

SEQ ID NO: 692286 - RNA, 22 nt, Human
agagcauccauuuuugucacau

SEQ ID NO: 692287 - RNA, 22 nt, Human
uacagaaauacagucaggccua

SEQ ID NO: 692288 - RNA, 22 nt, Human
agugugaguuugguugagacuu

SEQ ID NO: 692289 - RNA, 22 nt, Human
cagccucuguggcugccacacc

SEQ ID NO: 692290 - RNA, 22 nt, Human
ugcugaugaguccuucuaucgc

SEQ ID NO: 692291 - RNA, 22 nt, Human
uggugcugccaccuccucugcu

SEQ ID NO: 692292 - RNA, 22 nt, Human
gcagccacuaguuuuccuguuu

SEQ ID NO: 692293 - RNA, 22 nt, Human
ggcucuucuacuucagaugggg

SEQ ID NO: 692294 - RNA, 22 nt, Human
uuuucuguaagaggacuuuaau

SEQ ID NO: 692295 - RNA, 22 nt, Human
cagcccuuuccuucucagcuuu

SEQ ID NO: 692296 - RNA, 22 nt, Human
ugcugggauauagcuucuaggg

SEQ ID NO: 692297 - RNA, 22 nt, Human
ggaggggaggauuaaugacaaa

SEQ ID NO: 692298 - RNA, 22 nt, Human
ucagugucuugggcuugaaugc

SEQ ID NO: 692299 - RNA, 22 nt, Human
cuccauggaaccggggcugcuu

SEQ ID NO: 692300 - RNA, 23 nt, Human
ugccagggcccugugugcaaugc

SEQ ID NO: 692301 - RNA, 21 nt, Human
ccagagccugagaggauuaug

SEQ ID NO: 692302 - RNA, 22 nt, Human
uaaagagcacgcuuuucucucu

SEQ ID NO: 692303 - RNA, 22 nt, Human
auguauaugcaugcauucaaag

SEQ ID NO: 692304 - RNA, 22 nt, Human
ugcccaaguccuccaccgaggu

SEQ ID NO: 692305 - RNA, 22 nt, Human
gccacagggauuguuuugugag

SEQ ID NO: 692306 - RNA, 22 nt, Human
cagcauuggguuaccuuuguuu

SEQ ID NO: 692307 - RNA, 22 nt, Human
ccucuucaccucgggcacacug

SEQ ID NO: 692308 - RNA, 22 nt, Human
cacccaggcaaggauucugcaa

SEQ ID NO: 692309 - RNA, 22 nt, Human
uggcagagcaaaaagauagaau

SEQ ID NO: 692310 - RNA, 22 nt, Human
uagcuccuggugagccuacucu

SEQ ID NO: 692311 - RNA, 22 nt, Human
caguaacauuucaagguagagg

SEQ ID NO: 692312 - RNA, 22 nt, Human
ucaaaguuuguggcaauuuauu

SEQ ID NO: 692313 - RNA, 22 nt, Human
uggcacagagggacccagcagc

SEQ ID NO: 692314 - RNA, 22 nt, Human
uaagagaugcuuuucuaaauaa

SEQ ID NO: 692315 - RNA, 22 nt, Human
agagcuggacgucugagcccua

SEQ ID NO: 692316 - RNA, 22 nt, Human
ucagcucugccuguggaggcac

SEQ ID NO: 692317 - RNA, 22 nt, Human
aauccauucagaaauugggaau

SEQ ID NO: 692318 - RNA, 22 nt, Human
cagaggccaguggacaagggcc

SEQ ID NO: 692319 - RNA, 22 nt, Human
aagaggaaaugauugacuauau

SEQ ID NO: 692320 - RNA, 22 nt, Human
uacauguauguguacgugcaug

SEQ ID NO: 692321 - RNA, 22 nt, Human
ucaggcuguagggccccuggag

SEQ ID NO: 692322 - RNA, 22 nt, Human
uugauacaggccuucuagauga

SEQ ID NO: 692323 - RNA, 22 nt, Human
agaggccagcuagcgggccauc

SEQ ID NO: 692324 - RNA, 19 nt, Human
cugugcccuaugacuugua

SEQ ID NO: 692325 - RNA, 22 nt, Human
auguaugcuuugauuuuagaug

SEQ ID NO: 692326 - RNA, 23 nt, Human
uccuuuaaugcuggaauggcuag

SEQ ID NO: 692327 - RNA, 19 nt, Human
ugggaaaguaacauacaaa

SEQ ID NO: 692328 - RNA, 22 nt, Human
cccuggcuuggcacucuccacu

SEQ ID NO: 692329 - RNA, 19 nt, Human
ugcuuugcucuuggacuca

SEQ ID NO: 692330 - RNA, 22 nt, Human
augcucugggcuuuugaagugg

SEQ ID NO: 692331 - RNA, 22 nt, Human
agcagagcugggauccuggguc

SEQ ID NO: 692332 - RNA, 22 nt, Human
aucuacauguugauuuaaagaa

SEQ ID NO: 692333 - RNA, 23 nt, Human
ugauagaugucauggucuugagu

SEQ ID NO: 692334 - RNA, 23 nt, Human
ucagagagcuguugagagcugcc

SEQ ID NO: 692335 - RNA, 19 nt, Human
uuguccagaaaggcauugc

SEQ ID NO: 692336 - RNA, 22 nt, Human
aguguuagauucuuacucaguu

SEQ ID NO: 692337 - RNA, 22 nt, Human
gcugaggacaucauggaaggaa

SEQ ID NO: 692338 - RNA, 22 nt, Human
uccuucagcuuauuucuuagga

SEQ ID NO: 692339 - RNA, 22 nt, Human
gugccaggcccagggagcgggg

SEQ ID NO: 692340 - RNA, 22 nt, Human
gacagacagggguucuccugga

SEQ ID NO: 692341 - RNA, 22 nt, Human
aacacugaagccguuaaaccuu

SEQ ID NO: 692342 - RNA, 22 nt, Human
cacugugucuggagugagcugg

SEQ ID NO: 692343 - RNA, 22 nt, Human
aaauuucuggaagugucagagu

SEQ ID NO: 692344 - RNA, 22 nt, Human
augaguugaagcuacaagaggc

SEQ ID NO: 692345 - RNA, 22 nt, Human
ugaggcccucugggcugguccu

SEQ ID NO: 692346 - RNA, 16 nt, Human
caauacauggcauuuc

SEQ ID NO: 692347 - RNA, 22 nt, Human
ucucccacagucucccauggcu

SEQ ID NO: 692348 - RNA, 22 nt, Human
agcagccauagauagcaugcaa

SEQ ID NO: 692349 - RNA, 22 nt, Human
ugaggcugacaaaagaugaggu

SEQ ID NO: 692350 - RNA, 22 nt, Human
caacacagggguuaugccaugg

SEQ ID NO: 692351 - RNA, 22 nt, Human
agcagaacugaugagacuugag

SEQ ID NO: 692352 - RNA, 22 nt, Human
gccaggacccuggagggcaucu

SEQ ID NO: 692353 - RNA, 22 nt, Human
cccaggagauggagguugcagu

SEQ ID NO: 692354 - RNA, 22 nt, Human
ggcuggagugggcuccagaguu

SEQ ID NO: 692355 - RNA, 19 nt, Human
acacauguaacaguuuuuc

SEQ ID NO: 692356 - RNA, 22 nt, Human
ugaggcaggaggauugcaggau

SEQ ID NO: 692357 - RNA, 22 nt, Human
gccagccugugggggcucugug

SEQ ID NO: 692358 - RNA, 22 nt, Human
agauauguuacugcaucauggg

SEQ ID NO: 692359 - RNA, 22 nt, Human
uugcagaggcaaaaaugaacuc

SEQ ID NO: 692360 - RNA, 22 nt, Human
gaguuaguauguucuguaagua

SEQ ID NO: 692361 - RNA, 22 nt, Human
uucagaaaucgaguuucauguc

SEQ ID NO: 692362 - RNA, 22 nt, Human
aaguauauuuagcugagcuugu

SEQ ID NO: 692363 - RNA, 22 nt, Human
agggaagggcagggucuaugca

SEQ ID NO: 692364 - RNA, 22 nt, Human
ggacugaggcccacuugaggga

SEQ ID NO: 692365 - RNA, 21 nt, Human
ugucaguuauaaucaccacag

SEQ ID NO: 692366 - RNA, 22 nt, Human
gugccagcaguuauggugauuu

SEQ ID NO: 692367 - RNA, 22 nt, Human
uguguuaacacugcaugauaau

SEQ ID NO: 692368 - RNA, 22 nt, Human
aacugcaguuacuuuugcacca

SEQ ID NO: 692369 - RNA, 22 nt, Human
ggaacacucgucaaauagcggg

SEQ ID NO: 692370 - RNA, 22 nt, Human
gccaggacugagaaugggagca

SEQ ID NO: 692371 - RNA, 22 nt, Human
augaagcagaauuucccacucu

SEQ ID NO: 692372 - RNA, 22 nt, Human
uuucugaaaucucuuuugagga

SEQ ID NO: 692373 - RNA, 20 nt, Human
cuguggcaucugucauggug

SEQ ID NO: 692374 - RNA, 22 nt, Human
uaaccuggggcgguuucccaau

SEQ ID NO: 692375 - RNA, 22 nt, Human
uagcauuaaagguaagacauua

SEQ ID NO: 692376 - RNA, 22 nt, Human
gcacagagggcagugagccucu

SEQ ID NO: 692377 - RNA, 23 nt, Human
acagaagccaggagccgcugggc

SEQ ID NO: 692378 - RNA, 22 nt, Human
gaaucuuaccucucuauuguug

SEQ ID NO: 692379 - RNA, 22 nt, Human
aacagcagcaaguaagcagguc

SEQ ID NO: 692380 - RNA, 22 nt, Human
uacaaacucuuuauauuucaua

SEQ ID NO: 692381 - RNA, 22 nt, Human
uccuucuucaugaagauauaug

SEQ ID NO: 692382 - RNA, 22 nt, Human
uccauugucuuugguccuagcc

SEQ ID NO: 692383 - RNA, 22 nt, Human
ccugagcaaaggcccagaggga

SEQ ID NO: 692384 - RNA, 22 nt, Human
auuagcuuaucccauuucugaa

SEQ ID NO: 692385 - RNA, 22 nt, Human
ucagaggcuuccuuccucggag

SEQ ID NO: 692386 - RNA, 22 nt, Human
gggcuccuggcagucaugcuca

SEQ ID NO: 692387 - RNA, 22 nt, Human
ggcagcucugugucugggaagc

SEQ ID NO: 692388 - RNA, 22 nt, Human
uaaguuuccagauuguaagucc

SEQ ID NO: 692389 - RNA, 22 nt, Human
gaaaugugggucaugacccauu

SEQ ID NO: 692390 - RNA, 22 nt, Human
acaggcugccacuugcauccaa

SEQ ID NO: 692391 - RNA, 21 nt, Human
cccugcaggccagggcugagc

SEQ ID NO: 692392 - RNA, 22 nt, Human
auuauuguacuuucaauaaggu

SEQ ID NO: 692393 - RNA, 22 nt, Human
auggcuucgaguauauacauag

SEQ ID NO: 692394 - RNA, 22 nt, Human
ugagcccuggagcccucuguua

SEQ ID NO: 692395 - RNA, 22 nt, Human
uaggcuggaacuuaggcagagg

SEQ ID NO: 692396 - RNA, 22 nt, Human
acaucuauuuuuuucuguccau

SEQ ID NO: 692397 - RNA, 22 nt, Human
caggcccagugaucagggcucu

SEQ ID NO: 692398 - RNA, 22 nt, Human
cagaggcuggcggccgccccga

SEQ ID NO: 692399 - RNA, 22 nt, Human
guuguacagcauuccauauagg

SEQ ID NO: 692400 - RNA, 22 nt, Human
uuugaacaugcugcaugauaau

SEQ ID NO: 692401 - RNA, 22 nt, Human
uacaugacauuucuuucuguuc

SEQ ID NO: 692402 - RNA, 22 nt, Human
cuguggaguuccaucaggggag

SEQ ID NO: 692403 - RNA, 18 nt, Human
ugugaacacauuuuucug

SEQ ID NO: 692404 - RNA, 22 nt, Human
aggcagcuaagauggauaauga

SEQ ID NO: 692405 - RNA, 18 nt, Human
ggcagccuacccacuugu

SEQ ID NO: 692406 - RNA, 22 nt, Human
agaaggaaggcugagugcugau

SEQ ID NO: 692407 - RNA, 22 nt, Human
auucacaaagucacccuuacac

SEQ ID NO: 692408 - RNA, 20 nt, Human
uuuggcuucaagugcauugc

SEQ ID NO: 692409 - RNA, 22 nt, Human
ucagcuucagaucagcuagaga

SEQ ID NO: 692410 - RNA, 22 nt, Human
acacugugacaagaaagagcug

SEQ ID NO: 692411 - RNA, 22 nt, Human
gucuccagaagccuagacagcc

SEQ ID NO: 692412 - RNA, 22 nt, Human
ccugggcuuacgaccucugacu

SEQ ID NO: 692413 - RNA, 22 nt, Human
aucuauuaugcugagaaacugu

SEQ ID NO: 692414 - RNA, 22 nt, Human
gagaugacaugccuguuguagg

SEQ ID NO: 692415 - RNA, 22 nt, Human
ugagccagccucagaagucacg

SEQ ID NO: 692416 - RNA, 20 nt, Human
cucucuggaaggugggagcc

SEQ ID NO: 692417 - RNA, 22 nt, Human
ggugccguugaggaaguaacug

SEQ ID NO: 692418 - RNA, 22 nt, Human
cccagcuugcucaccauuccca

SEQ ID NO: 692419 - RNA, 22 nt, Human
auucuucaucacuaccuuguga

SEQ ID NO: 692420 - RNA, 22 nt, Human
ggaguuccagaaucugcuuuuu

SEQ ID NO: 692421 - RNA, 22 nt, Human
uguggccagccacaggcauggu

SEQ ID NO: 692422 - RNA, 22 nt, Human
cugucuggaaugcaguacauag

SEQ ID NO: 692423 - RNA, 23 nt, Human
ggcugggagcuccgggugcacgu

SEQ ID NO: 692424 - RNA, 22 nt, Human
aggguagguguaagauagcccu

SEQ ID NO: 692425 - RNA, 22 nt, Human
ucccucagcucauauuuaugcc

SEQ ID NO: 692426 - RNA, 22 nt, Human
uuaaaguucauuaaaugagcca

SEQ ID NO: 692427 - RNA, 22 nt, Human
aacuguaagaaauaaaauucug

SEQ ID NO: 692428 - RNA, 22 nt, Human
cuuugcagugauuguucuugga

SEQ ID NO: 692429 - RNA, 19 nt, Human
agcuuuggacuugcauuuc

SEQ ID NO: 692430 - RNA, 22 nt, Human
gggcugaugaugagcagaggug

SEQ ID NO: 692431 - RNA, 22 nt, Human
ucuuggauuuuaauggaucaaa

SEQ ID NO: 692432 - RNA, 22 nt, Human
uucauuuucuuucacgcugcug

SEQ ID NO: 692433 - RNA, 22 nt, Human
ucuuuacaagucacauuuucug

SEQ ID NO: 692434 - RNA, 22 nt, Human
uggccuggaagagaggucgagg

SEQ ID NO: 692435 - RNA, 22 nt, Human
aaugccuuuccacuggguauca

SEQ ID NO: 692436 - RNA, 22 nt, Human
acuggagacugugucuuuugau

SEQ ID NO: 692437 - RNA, 22 nt, Human
uuuacagaagagaaggaugcuu

SEQ ID NO: 692438 - RNA, 22 nt, Human
uagcagcuccauuucucuggca

SEQ ID NO: 692439 - RNA, 22 nt, Human
caggaguuucuauuguuccaaa

SEQ ID NO: 692440 - RNA, 22 nt, Human
ccuaguccccaggaggucagug

SEQ ID NO: 692441 - RNA, 22 nt, Human
ucauaauuguauacauuuaugg

SEQ ID NO: 692442 - RNA, 22 nt, Human
cugccuuugugaucaguucuuu

SEQ ID NO: 692443 - RNA, 22 nt, Human
ggucugcccacuacucuccauu

SEQ ID NO: 692444 - RNA, 22 nt, Human
agugucaacugucuacagggag

SEQ ID NO: 692445 - RNA, 22 nt, Human
cuggcagugacauugcaggugc

SEQ ID NO: 692446 - RNA, 22 nt, Human
uggcuaauggcauuuccugggu

SEQ ID NO: 692447 - RNA, 22 nt, Human
ugaagcuggaagcaugcagacu

SEQ ID NO: 692448 - RNA, 22 nt, Human
cccagcagugguucucaaacuu

SEQ ID NO: 692449 - RNA, 22 nt, Human
acuuccaaauaccaucacauug

SEQ ID NO: 692450 - RNA, 22 nt, Human
ugcagaaaucacauuuaacccu

SEQ ID NO: 692451 - RNA, 22 nt, Human
uccacaggcugaggcccuucug

SEQ ID NO: 692452 - RNA, 22 nt, Human
accagggcggcuugaggaggca

SEQ ID NO: 692453 - RNA, 22 nt, Human
gaaggcaagaucucaguggagg

SEQ ID NO: 692454 - RNA, 22 nt, Human
cuaaagaagcuagcaaucuaua

SEQ ID NO: 692455 - RNA, 22 nt, Human
uuucuuauauucugucauuguu

SEQ ID NO: 692456 - RNA, 22 nt, Human
ggucuggauuuugaacaaaauu

SEQ ID NO: 692457 - RNA, 22 nt, Human
gccagcuguaucuuuggccagc

SEQ ID NO: 692458 - RNA, 21 nt, Human
uccagggaacuucucaggaau

SEQ ID NO: 692459 - RNA, 22 nt, Human
gacaggcaguuuuccagaucag

SEQ ID NO: 692460 - RNA, 20 nt, Human
uccaugaguuagagacuaua

SEQ ID NO: 692461 - RNA, 22 nt, Human
guccuagagauccgggagggga

SEQ ID NO: 692462 - RNA, 22 nt, Human
gguggcaggcuggcauuggcaa

SEQ ID NO: 692463 - RNA, 22 nt, Human
gaggcuggaggucaaagaugaa

SEQ ID NO: 692464 - RNA, 22 nt, Human
uucauguaauuccauaagguaa

SEQ ID NO: 692465 - RNA, 22 nt, Human
gauuucaguggcugucucaaau

SEQ ID NO: 692466 - RNA, 22 nt, Human
gaguggggcccacugcugggug

SEQ ID NO: 692467 - RNA, 22 nt, Human
agaauguguuuuaacaugggaa

SEQ ID NO: 692468 - RNA, 22 nt, Human
uuucaggccauagcacagggaa

SEQ ID NO: 692469 - RNA, 23 nt, Human
ugauuacaggaaguucaaguguu

SEQ ID NO: 692470 - RNA, 22 nt, Human
agcagagcggggccuccggaag

SEQ ID NO: 692471 - RNA, 22 nt, Human
guccccuggcccccagcgucgg

SEQ ID NO: 692472 - RNA, 22 nt, Human
aagucacacaguuaacaugagg

SEQ ID NO: 692473 - RNA, 22 nt, Human
aaaugcaugugcuauagaugug

SEQ ID NO: 692474 - RNA, 22 nt, Human
uuuuauguuccugaagcuaucu

SEQ ID NO: 692475 - RNA, 22 nt, Human
gcucucugccauaugaggauac

SEQ ID NO: 692476 - RNA, 22 nt, Human
gucacagaucucuugagucaag

SEQ ID NO: 692477 - RNA, 19 nt, Human
uuuaaagugacugguauuu

SEQ ID NO: 692478 - RNA, 22 nt, Human
aggugagaaaacgaggguugca

SEQ ID NO: 692479 - RNA, 22 nt, Human
caagguuuacuuuaugauccag

SEQ ID NO: 692480 - RNA, 22 nt, Human
aagggugguguaggagaucaaa

SEQ ID NO: 692481 - RNA, 22 nt, Human
ggaagcugguaauuguugggac

SEQ ID NO: 692482 - RNA, 22 nt, Human
ugcacaggugguccaucugcac

SEQ ID NO: 692483 - RNA, 22 nt, Human
gaaagugcaugugcccaccauu

SEQ ID NO: 692484 - RNA, 22 nt, Human
gaccacagcuacaagggcaagg

SEQ ID NO: 692485 - RNA, 21 nt, Human
aggaguugagugcacaguugg

SEQ ID NO: 692486 - RNA, 22 nt, Human
cagagauaccauugcuaaaauu

SEQ ID NO: 692487 - RNA, 22 nt, Human
cggaagagggacagcgccagcc

SEQ ID NO: 692488 - RNA, 22 nt, Human
gccucccuguucuuccacaaua

SEQ ID NO: 692489 - RNA, 22 nt, Human
uccuggaggcacucgcuggggc

SEQ ID NO: 692490 - RNA, 22 nt, Human
ugucauuuucuaaucuguuguc

SEQ ID NO: 692491 - RNA, 22 nt, Human
uguggaaaguggucuaagcaca

SEQ ID NO: 692492 - RNA, 22 nt, Human
uagaaauggguuacauuuagag

SEQ ID NO: 692493 - RNA, 22 nt, Human
aaguccagugauacuggcagga

SEQ ID NO: 692494 - RNA, 22 nt, Human
caugccagggcuugcugccugg

SEQ ID NO: 692495 - RNA, 22 nt, Human
uuucugcaaacuuccacgucuc

SEQ ID NO: 692496 - RNA, 22 nt, Human
uuucaguuuaaguaacugcuau

SEQ ID NO: 692497 - RNA, 22 nt, Human
ugaggccaagccuccucugcca

SEQ ID NO: 692498 - RNA, 22 nt, Human
caggcuugugucucagcugcag

SEQ ID NO: 692499 - RNA, 22 nt, Human
agaguuugggguaugauuguuu

SEQ ID NO: 692500 - RNA, 20 nt, Human
uauggcuugcagccacccuu

SEQ ID NO: 692501 - RNA, 22 nt, Human
gcagggcugauggcuucccuca

SEQ ID NO: 692502 - RNA, 22 nt, Human
gguguggggagguucugcuucu

SEQ ID NO: 692503 - RNA, 22 nt, Human
cagcacauaagccgaagacugu

SEQ ID NO: 692504 - RNA, 17 nt, Human
cacaacuggcugauuga

SEQ ID NO: 692505 - RNA, 22 nt, Human
auacaacugcucucagauaagu

SEQ ID NO: 692506 - RNA, 22 nt, Human
agagcagacauccuugucuugu

SEQ ID NO: 692507 - RNA, 22 nt, Human
gcccagcccugaggucacagcu

SEQ ID NO: 692508 - RNA, 22 nt, Human
agccagcacggcgccauggagu

SEQ ID NO: 692509 - RNA, 20 nt, Human
ucuauuuguaaagggcugug

SEQ ID NO: 692510 - RNA, 22 nt, Human
ccugugacgugucuccuggcac

SEQ ID NO: 692511 - RNA, 22 nt, Human
ugccaggggaccuagggauguc

SEQ ID NO: 692512 - RNA, 22 nt, Human
uguggcuggauugauuuuaccu

SEQ ID NO: 692513 - RNA, 19 nt, Human
ggccuggcuaucccugcug

SEQ ID NO: 692514 - RNA, 22 nt, Human
aguuuuaagaugcgcuucuguu

SEQ ID NO: 692515 - RNA, 22 nt, Human
augggaggaucacuugaggcca

SEQ ID NO: 692516 - RNA, 22 nt, Human
agcagggcuggggcacgagcca

SEQ ID NO: 692517 - RNA, 22 nt, Human
guccagcccgggcuccgccagc

SEQ ID NO: 692518 - RNA, 22 nt, Human
uacccagauucacaagccaagg

SEQ ID NO: 692519 - RNA, 22 nt, Human
ccagcuccacugucagaugaga

SEQ ID NO: 692520 - RNA, 22 nt, Human
uccugggacuuucaaggcuagg

SEQ ID NO: 692521 - RNA, 22 nt, Human
ugaauaugcuuugcaauccuaa

SEQ ID NO: 692522 - RNA, 22 nt, Human
aucugggucacaguggcaucua

SEQ ID NO: 692523 - RNA, 22 nt, Human
caaagggcauuuuagugaacug

SEQ ID NO: 692524 - RNA, 22 nt, Human
caggcuccucacucaugcuccc

SEQ ID NO: 692525 - RNA, 22 nt, Human
uagucagauauaugacuuacgu

SEQ ID NO: 692526 - RNA, 22 nt, Human
ucaauuuuaugaaacaaaguga

SEQ ID NO: 692527 - RNA, 22 nt, Human
uuuagacauuugugguuugcaa

SEQ ID NO: 692528 - RNA, 23 nt, Human
uugaggcaaacauguaaguagga

SEQ ID NO: 692529 - RNA, 22 nt, Human
augccacugacauggacaauuu

SEQ ID NO: 692530 - RNA, 22 nt, Human
ccuaacuucacuucauugaagu

SEQ ID NO: 692531 - RNA, 22 nt, Human
aauuucagauauuaaagaauga

SEQ ID NO: 692532 - RNA, 22 nt, Human
aagcagcauuguaaccaaugcc

SEQ ID NO: 692533 - RNA, 22 nt, Human
auacuacacuaugcauggaugu

SEQ ID NO: 692534 - RNA, 22 nt, Human
uugcugaagugaagguauguuu

SEQ ID NO: 692535 - RNA, 22 nt, Human
uggaaagaauuccuaugguuca

SEQ ID NO: 692536 - RNA, 22 nt, Human
ggcagggagagcaugcugauaa

SEQ ID NO: 692537 - RNA, 22 nt, Human
gagaacucagacgcaggucaug

SEQ ID NO: 692538 - RNA, 22 nt, Human
cuggagcuaggaaguccaagau

SEQ ID NO: 692539 - RNA, 22 nt, Human
aaauaauguuaggccuuugcuc

SEQ ID NO: 692540 - RNA, 22 nt, Human
augugauucccacugaaucacu

SEQ ID NO: 692541 - RNA, 22 nt, Human
agacaguggaucgggaugcacu

SEQ ID NO: 692542 - RNA, 22 nt, Human
aaacagucugaugccaucugcc

SEQ ID NO: 692543 - RNA, 22 nt, Human
agcagggcuugccgcuuguccu

SEQ ID NO: 692544 - RNA, 22 nt, Human
uggcccuguguccugcugccag

SEQ ID NO: 692545 - RNA, 22 nt, Human
uacaauguuccuagcaggaaag

SEQ ID NO: 692546 - RNA, 22 nt, Human
caccuguuguuuauucaucucu

SEQ ID NO: 692547 - RNA, 22 nt, Human
agagccagcaacucuagcccug

SEQ ID NO: 692548 - RNA, 22 nt, Human
cuucuguguagaaagguagccc

SEQ ID NO: 692549 - RNA, 22 nt, Human
uccuaacuccacuagccuuggg

SEQ ID NO: 692550 - RNA, 22 nt, Human
aagcaucuuagaccugaguucc

SEQ ID NO: 692551 - RNA, 22 nt, Human
gggggcucugacucccucagcu

SEQ ID NO: 692552 - RNA, 22 nt, Human
cuuauguaaaacggaaagggaa

SEQ ID NO: 692553 - RNA, 20 nt, Human
ugcuccaucuaaagugauua

SEQ ID NO: 692554 - RNA, 22 nt, Human
aaaacugaaccuugagaucuuu

SEQ ID NO: 692555 - RNA, 21 nt, Human
agagucugcauuucugacaag

SEQ ID NO: 692556 - RNA, 22 nt, Human
aagagcaucaaugacucgcagu

SEQ ID NO: 692557 - RNA, 22 nt, Human
gcugcugggucccucugugcca

SEQ ID NO: 692558 - RNA, 22 nt, Human
auucacacuguauacacaggau

SEQ ID NO: 692559 - RNA, 22 nt, Human
aaacacugcaggguuuacuuga

SEQ ID NO: 692560 - RNA, 22 nt, Human
augcuaaauguuaauguuaccu

SEQ ID NO: 692561 - RNA, 22 nt, Human
cauucaguggaguauuauucag

SEQ ID NO: 692562 - RNA, 22 nt, Human
cuaguguuuauuaaucaugagg

SEQ ID NO: 692563 - RNA, 18 nt, Human
gauggaaaguguaugagu

SEQ ID NO: 692564 - RNA, 22 nt, Human
agauccauccagcacucuugcc

SEQ ID NO: 692565 - RNA, 22 nt, Human
uaguuaaaauaauggagauguu

SEQ ID NO: 692566 - RNA, 22 nt, Human
ccaauucaccuccuaugcacau

SEQ ID NO: 692567 - RNA, 22 nt, Human
augggaagguuuugagagcggg

SEQ ID NO: 692568 - RNA, 22 nt, Human
caacacugauuauggcugagcu

SEQ ID NO: 692569 - RNA, 22 nt, Human
aucugaaaagccucuuacuccu

SEQ ID NO: 692570 - RNA, 22 nt, Human
ugacauuuaaucccuaaauauu

SEQ ID NO: 692571 - RNA, 22 nt, Human
cugugcuuccaggauggcagcu

SEQ ID NO: 692572 - RNA, 22 nt, Human
uggcugugaacaaagagaauaa

SEQ ID NO: 692573 - RNA, 22 nt, Human
gcugccagggaggugguggagg

SEQ ID NO: 692574 - RNA, 22 nt, Human
uagcauuuauuccagauuugga

SEQ ID NO: 692575 - RNA, 22 nt, Human
cagcaucuucuagauccaggcu

SEQ ID NO: 692576 - RNA, 22 nt, Human
gcacaugagaagcuggcgaugc

SEQ ID NO: 692577 - RNA, 20 nt, Human
cagggcucugggccuggccu

SEQ ID NO: 692578 - RNA, 22 nt, Human
agaaugugggggaaaagagugu

SEQ ID NO: 692579 - RNA, 22 nt, Human
gugcuuucugcaugguuccuac

SEQ ID NO: 692580 - RNA, 22 nt, Human
aaaguuucaauagaggaagugg

SEQ ID NO: 692581 - RNA, 21 nt, Human
acuuuacaauuuacauaguga

SEQ ID NO: 692582 - RNA, 22 nt, Human
ugcuggaacuuagcaugcucuc

SEQ ID NO: 692583 - RNA, 22 nt, Human
cuacaaaaguaauugugguuuu

SEQ ID NO: 692584 - RNA, 22 nt, Human
aguauggggcugugugugcaca

SEQ ID NO: 692585 - RNA, 22 nt, Human
cccaguguuccuugaggggcug

SEQ ID NO: 692586 - RNA, 22 nt, Human
gcuggcagucccaucagcuggg

SEQ ID NO: 692587 - RNA, 22 nt, Human
ucaguuccuguugcacagcauc

SEQ ID NO: 692588 - RNA, 22 nt, Human
uuuucucagcugcacuguauua

SEQ ID NO: 692589 - RNA, 22 nt, Human
ccauucugagucuuaugucuuu

SEQ ID NO: 692590 - RNA, 22 nt, Human
aaaugcaugguaaaugauugcc

SEQ ID NO: 692591 - RNA, 22 nt, Human
ucugagccaccugagcccaugg

SEQ ID NO: 692592 - RNA, 22 nt, Human
uaaguaacugcauaauuaaauu

SEQ ID NO: 692593 - RNA, 22 nt, Human
gcauggccuugcuguaguggua

SEQ ID NO: 692594 - RNA, 22 nt, Human
ucuuuagagcacgggaaaaaca

SEQ ID NO: 692595 - RNA, 22 nt, Human
ucagauuuaugaauauacuaug

SEQ ID NO: 692596 - RNA, 22 nt, Human
cccagcuugucugauucagccu

SEQ ID NO: 692597 - RNA, 22 nt, Human
gacacaugucagacggacaccc

SEQ ID NO: 692598 - RNA, 22 nt, Human
uugcauauccuccaacacaugg

SEQ ID NO: 692599 - RNA, 22 nt, Human
uccuucagcucucuauuuagau

SEQ ID NO: 692600 - RNA, 22 nt, Human
aaugagauggaauucccgccua

SEQ ID NO: 692601 - RNA, 22 nt, Human
uuaagguugagcucacuuuuau

SEQ ID NO: 692602 - RNA, 22 nt, Human
uggcucacuuccguggagaggu

SEQ ID NO: 692603 - RNA, 22 nt, Human
uccagugaucuagggagcugga

SEQ ID NO: 692604 - RNA, 22 nt, Human
acggggcuagagaagguuucuu

SEQ ID NO: 692605 - RNA, 22 nt, Human
ggcucugcuucagaaggcucau

SEQ ID NO: 692606 - RNA, 21 nt, Human
gccacugcacuccagccuggg

SEQ ID NO: 692607 - RNA, 22 nt, Human
cacagcaggcacuauacagggc

SEQ ID NO: 692608 - RNA, 22 nt, Human
agaggagguggugaugcuuuaa

SEQ ID NO: 692609 - RNA, 22 nt, Human
uggcuuucccccagcccaguug

SEQ ID NO: 692610 - RNA, 21 nt, Human
auucuuugaugugcaauaagu

SEQ ID NO: 692611 - RNA, 19 nt, Human
ccagagucaugucuccccc

SEQ ID NO: 692612 - RNA, 22 nt, Human
ucucacacuucuguguugcaca

SEQ ID NO: 692613 - RNA, 22 nt, Human
uuccuggaaauuaugcucaccu

SEQ ID NO: 692614 - RNA, 22 nt, Human
ucgugcaaaccugacacagcca

SEQ ID NO: 692615 - RNA, 22 nt, Human
auggcccuaucaccuuugcuuc

SEQ ID NO: 692616 - RNA, 22 nt, Human
ugggguagguaugaaaacuagg

SEQ ID NO: 692617 - RNA, 22 nt, Human
aauaagaauuuacuugucaaga

SEQ ID NO: 692618 - RNA, 22 nt, Human
aauagaauguaaucuaauacau

SEQ ID NO: 692619 - RNA, 22 nt, Human
acagaucaccuguuagccaaaa

SEQ ID NO: 692620 - RNA, 22 nt, Human
uuacauguucucauacacagag

SEQ ID NO: 692621 - RNA, 22 nt, Human
uuucaggacaccuuuaaaaacg

SEQ ID NO: 692622 - RNA, 22 nt, Human
guagggagcccagagcccagug

SEQ ID NO: 692623 - RNA, 22 nt, Human
acuacaguacuauaucuauagg

SEQ ID NO: 692624 - RNA, 22 nt, Human
ucuuuggaugcguuacuuuuac

SEQ ID NO: 692625 - RNA, 22 nt, Human
uuaaggaaggugaauuucuugg

SEQ ID NO: 692626 - RNA, 22 nt, Human
acaguaauuaaaauggaucugc

SEQ ID NO: 692627 - RNA, 20 nt, Human
aacuuguucuaccuguuuca

SEQ ID NO: 692628 - RNA, 22 nt, Human
ugaagcagagaauuugacaguc

SEQ ID NO: 692629 - RNA, 22 nt, Human
guggagccaggggcuguaggua

SEQ ID NO: 692630 - RNA, 22 nt, Human
cagagaugugauccagcugucu

SEQ ID NO: 692631 - RNA, 22 nt, Human
ccuuuuauacucuguccucugg

SEQ ID NO: 692632 - RNA, 22 nt, Human
ccaggcuuccuaaugugugcag

SEQ ID NO: 692633 - RNA, 22 nt, Human
gggcugagaauucagcuuuccu

SEQ ID NO: 692634 - RNA, 22 nt, Human
aacacagaucaaaauauuuccu

SEQ ID NO: 692635 - RNA, 22 nt, Human
aauaacaggguugauuugcaau

SEQ ID NO: 692636 - RNA, 22 nt, Human
auucuagcaguuacaggcugau

SEQ ID NO: 692637 - RNA, 22 nt, Human
aauuuuaagcauaugacugguu

SEQ ID NO: 692638 - RNA, 22 nt, Human
agcagccagagucugaacauua

SEQ ID NO: 692639 - RNA, 22 nt, Human
caggcuccaagcccucugaugu

SEQ ID NO: 692640 - RNA, 22 nt, Human
uccuccagugguacuggccaau

SEQ ID NO: 692641 - RNA, 22 nt, Human
aaacucugcacugcgguaaggu

SEQ ID NO: 692642 - RNA, 22 nt, Human
aaaaucacacaaguagaugggg

SEQ ID NO: 692643 - RNA, 20 nt, Human
cagagcagugcccaggcggc

SEQ ID NO: 692644 - RNA, 22 nt, Human
uuagaaagguuuugcucugaaa

SEQ ID NO: 692645 - RNA, 22 nt, Human
gaaugcuguagacagacucuau

SEQ ID NO: 692646 - RNA, 22 nt, Human
cauuucuagggaucauaaagua

SEQ ID NO: 692647 - RNA, 22 nt, Human
gccugugcauagcagcggacuc

SEQ ID NO: 692648 - RNA, 22 nt, Human
aagauccugcuuuugcuucugu

SEQ ID NO: 692649 - RNA, 22 nt, Human
caaaugaauagggagugugaug

SEQ ID NO: 692650 - RNA, 22 nt, Human
aagcaggcaagguuguggggca

SEQ ID NO: 692651 - RNA, 22 nt, Human
auuaaaauuccaagguaugcca

SEQ ID NO: 692652 - RNA, 22 nt, Human
uauggcuucugggccaaauuua

SEQ ID NO: 692653 - RNA, 22 nt, Human
ugcuucacaagaauucaggacc

SEQ ID NO: 692654 - RNA, 21 nt, Human
ccuaguguuaaaacaguuuaa

SEQ ID NO: 692655 - RNA, 22 nt, Human
cauuucauaguugucacaauaa

SEQ ID NO: 692656 - RNA, 22 nt, Human
uggaacaacaugcuggaaaauu

SEQ ID NO: 692657 - RNA, 22 nt, Human
gguuuuaaccauucacaaguga

SEQ ID NO: 692658 - RNA, 18 nt, Human
cagaaaguuauuuacucu

SEQ ID NO: 692659 - RNA, 22 nt, Human
gggggaggugaaugcaauaagg

SEQ ID NO: 692660 - RNA, 22 nt, Human
uggcucaguuccaucaucugga

SEQ ID NO: 692661 - RNA, 22 nt, Human
ugucacucaaguuccaauuuac

SEQ ID NO: 692662 - RNA, 22 nt, Human
agugaggggauucaggcaaggu

SEQ ID NO: 692663 - RNA, 22 nt, Human
ggggacgggacuuagcaugagu

SEQ ID NO: 692664 - RNA, 22 nt, Human
ugagcucauagcucuuauuaug

SEQ ID NO: 692665 - RNA, 20 nt, Human
cuuuagaagaacccaagcau

SEQ ID NO: 692666 - RNA, 22 nt, Human
accagaguaauguguggaaauu

SEQ ID NO: 692667 - RNA, 22 nt, Human
aaugaucauuauaaagugcucu

SEQ ID NO: 692668 - RNA, 22 nt, Human
aaaacauaaacugacagcccau

SEQ ID NO: 692669 - RNA, 22 nt, Human
ucugugucugguugggccagua

SEQ ID NO: 692670 - RNA, 22 nt, Human
aauugaacaaguaauagaagag

SEQ ID NO: 692671 - RNA, 22 nt, Human
agggcucagggucaccaucugu

SEQ ID NO: 692672 - RNA, 22 nt, Human
uugcaggguugacacugccugc

SEQ ID NO: 692673 - RNA, 22 nt, Human
uuccagugaaacaugaggugug

SEQ ID NO: 692674 - RNA, 22 nt, Human
ucacuccaucuuugcuacuggu

SEQ ID NO: 692675 - RNA, 22 nt, Human
ucugcagaauucgaggaagaaa

SEQ ID NO: 692676 - RNA, 22 nt, Human
cuguggauuuaggcagagcuga

SEQ ID NO: 692677 - RNA, 22 nt, Human
ucucagagauguuagggaagag

SEQ ID NO: 692678 - RNA, 21 nt, Human
ggugacacguggccccgcucu

SEQ ID NO: 692679 - RNA, 22 nt, Human
agggagcuguggucagcucagu

SEQ ID NO: 692680 - RNA, 22 nt, Human
acaugaucccaccugccuauaa

SEQ ID NO: 692681 - RNA, 22 nt, Human
ucaguucugaaguucugccucc

SEQ ID NO: 692682 - RNA, 22 nt, Human
aagcacagauaaaacaggauuc

SEQ ID NO: 692683 - RNA, 22 nt, Human
ugaaaucaguaugucuuucuca

SEQ ID NO: 692684 - RNA, 22 nt, Human
gguuauauaauucagugcuuuc

SEQ ID NO: 692685 - RNA, 22 nt, Human
caggcuggagugcaguugugca

SEQ ID NO: 692686 - RNA, 22 nt, Human
caggcagcaggagcccugcucg

SEQ ID NO: 692687 - RNA, 22 nt, Human
aauuaaaugacaggggaagaug

SEQ ID NO: 692688 - RNA, 22 nt, Human
cuuccagagauagggccucaag

SEQ ID NO: 692689 - RNA, 22 nt, Human
cuucuuguaucugccgccgagc

SEQ ID NO: 692690 - RNA, 22 nt, Human
agacaacugcagagcaaagaau

SEQ ID NO: 692691 - RNA, 22 nt, Human
ugcucuagccuguaaaacauga

SEQ ID NO: 692692 - RNA, 22 nt, Human
acagagaugcaaguguguauuu

SEQ ID NO: 692693 - RNA, 17 nt, Human
ugugacauugggacauu

SEQ ID NO: 692694 - RNA, 22 nt, Human
ucuuuggcuuugccacacccaa

SEQ ID NO: 692695 - RNA, 19 nt, Human
caauucugcaacacugucc

SEQ ID NO: 692696 - RNA, 22 nt, Human
cucaguuucuucauauuguagg

SEQ ID NO: 692697 - RNA, 22 nt, Human
agcagggcuuuggcuggcuuuc

SEQ ID NO: 692698 - RNA, 22 nt, Human
cacacauugguuuuacuccuuu

SEQ ID NO: 692699 - RNA, 22 nt, Human
auguguauuaccucgauuguga

SEQ ID NO: 692700 - RNA, 22 nt, Human
cugaggcacugucagcugaggc

SEQ ID NO: 692701 - RNA, 22 nt, Human
gguuucaacucagcuaguaagg

SEQ ID NO: 692702 - RNA, 22 nt, Human
ucuucauuuuacaggcagaccu

SEQ ID NO: 692703 - RNA, 22 nt, Human
uuucuuucaauucuccuaaugc

SEQ ID NO: 692704 - RNA, 22 nt, Human
caggguggcacaucacagcauu

SEQ ID NO: 692705 - RNA, 22 nt, Human
cuuaacaugggggguaagucug

SEQ ID NO: 692706 - RNA, 22 nt, Human
aucuaaaguguuucaugaaaga

SEQ ID NO: 692707 - RNA, 20 nt, Human
auguagaugaaagcaaaggc

SEQ ID NO: 692708 - RNA, 22 nt, Human
uauuucuuguuauucucguuga

SEQ ID NO: 692709 - RNA, 21 nt, Human
agcauucugcuucuuuccugg

SEQ ID NO: 692710 - RNA, 22 nt, Human
uaauuuugucccccugcacaua

SEQ ID NO: 692711 - RNA, 22 nt, Human
ggcuggcagaggggagucugug

SEQ ID NO: 692712 - RNA, 22 nt, Human
uggaggaggaacuucuuaucuc

SEQ ID NO: 692713 - RNA, 22 nt, Human
agcaucuucaacaggcauuuua

SEQ ID NO: 692714 - RNA, 22 nt, Human
agggacacugaugagaaauucu

SEQ ID NO: 692715 - RNA, 20 nt, Human
uggcuggcuuguauuuccuu

SEQ ID NO: 692716 - RNA, 22 nt, Human
aauguguuuuaugagagaauau

SEQ ID NO: 692717 - RNA, 22 nt, Human
agaagaaaugaggccguucugc

SEQ ID NO: 692718 - RNA, 22 nt, Human
uucucuuugacauuauucaggu

SEQ ID NO: 692719 - RNA, 20 nt, Human
aaguugcagagaguugucuu

SEQ ID NO: 692720 - RNA, 20 nt, Human
acucuggggcucauuagggg

SEQ ID NO: 692721 - RNA, 22 nt, Human
gaguccaguguuuaccaggggu

SEQ ID NO: 692722 - RNA, 22 nt, Human
cauacauuuauacacaucuaug

SEQ ID NO: 692723 - RNA, 22 nt, Human
cugucuuuucuucucauugaug

SEQ ID NO: 692724 - RNA, 22 nt, Human
uagauuuguuuccuucucucca

SEQ ID NO: 692725 - RNA, 22 nt, Human
acaggaggggcaugaaagacgg

SEQ ID NO: 692726 - RNA, 22 nt, Human
gcccucagugaccacugauuca

SEQ ID NO: 692727 - RNA, 22 nt, Human
aggccagacagcuagaaacagg

SEQ ID NO: 692728 - RNA, 22 nt, Human
auacaaaguauuaauccuggau

SEQ ID NO: 692729 - RNA, 19 nt, Human
cccaggaagcggagguugc

SEQ ID NO: 692730 - RNA, 19 nt, Human
cucugcuugguccauaugc

SEQ ID NO: 692731 - RNA, 22 nt, Human
agcagcuagacuucagaaucug

SEQ ID NO: 692732 - RNA, 20 nt, Human
agcugcccuuuucacauguu

SEQ ID NO: 692733 - RNA, 22 nt, Human
ggagaaagcuguaguggaaugu

SEQ ID NO: 692734 - RNA, 22 nt, Human
uacaauauguggccuuuuguga

SEQ ID NO: 692735 - RNA, 22 nt, Human
ucugaaggaaaaggguagauau

SEQ ID NO: 692736 - RNA, 22 nt, Human
aagauacugaugauguaggcua

SEQ ID NO: 692737 - RNA, 22 nt, Human
gggauggacuuggggacuccag

SEQ ID NO: 692738 - RNA, 22 nt, Human
ucagacaggccucuccagccuc

SEQ ID NO: 692739 - RNA, 22 nt, Human
acuucagaguuaguuauagacc

SEQ ID NO: 692740 - RNA, 18 nt, Human
caaagcaggugacagugu

SEQ ID NO: 692741 - RNA, 22 nt, Human
ggaaugcucaguucuuggugcu

SEQ ID NO: 692742 - RNA, 22 nt, Human
uccaggcagucauuaaucucua

SEQ ID NO: 692743 - RNA, 22 nt, Human
uacauguauguuuaucuugaga

SEQ ID NO: 692744 - RNA, 22 nt, Human
uggagguguccaacucgugggu

SEQ ID NO: 692745 - RNA, 23 nt, Human
cccugagcugguccaggcucaac

SEQ ID NO: 692746 - RNA, 22 nt, Human
uacacaugacaguggacugaga

SEQ ID NO: 692747 - RNA, 22 nt, Human
cagcagagcugugugggaaggg

SEQ ID NO: 692748 - RNA, 22 nt, Human
gcuucugucuuagcuaccuccc

SEQ ID NO: 692749 - RNA, 22 nt, Human
gagcugucuggggacucugggu

SEQ ID NO: 692750 - RNA, 22 nt, Human
gugcaaaaguaauugcaguacu

SEQ ID NO: 692751 - RNA, 22 nt, Human
gccuucugauugcuggacugac

SEQ ID NO: 692752 - RNA, 21 nt, Human
ucugugcugccgucaacaucc

SEQ ID NO: 692753 - RNA, 22 nt, Human
aauuucaguaugaaguuucaca

SEQ ID NO: 692754 - RNA, 22 nt, Human
cuugccuuugucuucaaaggcu

SEQ ID NO: 692755 - RNA, 22 nt, Human
ucucagugcagcuugacagaga

SEQ ID NO: 692756 - RNA, 19 nt, Human
accuugggcaagugccuuc

SEQ ID NO: 692757 - RNA, 22 nt, Human
agggagcauugugacauaucac

SEQ ID NO: 692758 - RNA, 22 nt, Human
gggcacaccuugucugagcaca

SEQ ID NO: 692759 - RNA, 20 nt, Human
gugccaggcaagacaggugg

SEQ ID NO: 692760 - RNA, 22 nt, Human
gggcugcuuccuggggaaugcu

SEQ ID NO: 692761 - RNA, 22 nt, Human
uucuggggccccaguguccucg

SEQ ID NO: 692762 - RNA, 22 nt, Human
guuuuccacuggauuguuugga

SEQ ID NO: 692763 - RNA, 22 nt, Human
aaagcacuucaggagcaguuug

SEQ ID NO: 692764 - RNA, 22 nt, Human
gacaggguacgggcuaggcaca

SEQ ID NO: 692765 - RNA, 22 nt, Human
agaagcagacucugaggcaagg

SEQ ID NO: 692766 - RNA, 22 nt, Human
cacagucccgugcuuaccaugu

SEQ ID NO: 692767 - RNA, 22 nt, Human
gcaggguacauugggaugggau

SEQ ID NO: 692768 - RNA, 23 nt, Human
agaaggguccuuggcagcgacag

SEQ ID NO: 692769 - RNA, 22 nt, Human
uauugugaguucagacuaaaaa

SEQ ID NO: 692770 - RNA, 22 nt, Human
cucaagaagagggagaccuaca

SEQ ID NO: 692771 - RNA, 22 nt, Human
ucuaaggacaguuauuacuggg

SEQ ID NO: 692772 - RNA, 22 nt, Human
uggugggggaggcugucuagca

SEQ ID NO: 692773 - RNA, 22 nt, Human
uugugagcaugugcagccucug

SEQ ID NO: 692774 - RNA, 22 nt, Human
uggcuucucuguuuuaguauuu

SEQ ID NO: 692775 - RNA, 22 nt, Human
uguguucauguauguauacaua

SEQ ID NO: 692776 - RNA, 22 nt, Human
uaaauuaugucacaugacucug

SEQ ID NO: 692777 - RNA, 22 nt, Human
uccuggagccaaugugcugcug

SEQ ID NO: 692778 - RNA, 19 nt, Human
uuucugucuguguuuugcc

SEQ ID NO: 692779 - RNA, 22 nt, Human
cugaggcagagggcagaccaga

SEQ ID NO: 692780 - RNA, 22 nt, Human
gucacacuagggccaaguggag

SEQ ID NO: 692781 - RNA, 22 nt, Human
gugggccucuugaggguggcua

SEQ ID NO: 692782 - RNA, 18 nt, Human
ucacaugacagcuguugc

SEQ ID NO: 692783 - RNA, 22 nt, Human
gcacagccagcaucugagggau

SEQ ID NO: 692784 - RNA, 22 nt, Human
agaaagaacgcacuugugcugc

SEQ ID NO: 692785 - RNA, 22 nt, Human
ggcugccuccugcugggcugga

SEQ ID NO: 692786 - RNA, 22 nt, Human
caaacuguaugacccuaggccg

SEQ ID NO: 692787 - RNA, 22 nt, Human
caguggguccuaaguacaguuc

SEQ ID NO: 692788 - RNA, 22 nt, Human
gccgcggcauggcgagcaggac

SEQ ID NO: 692789 - RNA, 22 nt, Human
agaagugaggaaauccucuuua

SEQ ID NO: 692790 - RNA, 22 nt, Human
gugggugauguacuggaggcca

SEQ ID NO: 692791 - RNA, 22 nt, Human
aagaccauaauguaagaugaau

SEQ ID NO: 692792 - RNA, 22 nt, Human
ugggugcaggaugagugcuggc

SEQ ID NO: 692793 - RNA, 22 nt, Human
uuuccuuugggagcaugaauuu

SEQ ID NO: 692794 - RNA, 22 nt, Human
ugagguagaagccuggguugag

SEQ ID NO: 692795 - RNA, 22 nt, Human
ugaggugagucaugcauuggag

SEQ ID NO: 692796 - RNA, 22 nt, Human
gaucuuuucagaauuuaucagu

SEQ ID NO: 692797 - RNA, 20 nt, Human
uaaagcagccguggagggua

SEQ ID NO: 692798 - RNA, 22 nt, Human
aaaugcagauucaugagcccca

SEQ ID NO: 692799 - RNA, 19 nt, Human
ccuuugguuuccaugacau

SEQ ID NO: 692800 - RNA, 22 nt, Human
cagccagggucaggcagcuucu

SEQ ID NO: 692801 - RNA, 22 nt, Human
uugaaagaacaauucugugaug

SEQ ID NO: 692802 - RNA, 22 nt, Human
ucuuccagcuccccacgguguc

SEQ ID NO: 692803 - RNA, 22 nt, Human
agaggcaagauuaucagggcau

SEQ ID NO: 692804 - RNA, 20 nt, Human
uaagcauaguugucaggguc

SEQ ID NO: 692805 - RNA, 22 nt, Human
aagcucaggaaagagucugguu

SEQ ID NO: 692806 - RNA, 22 nt, Human
gcccugucccuuggcuucuagg

SEQ ID NO: 692807 - RNA, 22 nt, Human
cagugguuauacuuacuguuuc

SEQ ID NO: 692808 - RNA, 22 nt, Human
gaccuucaguguguuucucaca

SEQ ID NO: 692809 - RNA, 22 nt, Human
uauuuauguauguggauguguu

SEQ ID NO: 692810 - RNA, 22 nt, Human
aucuacauaaaacgaauacaua

SEQ ID NO: 692811 - RNA, 22 nt, Human
uugagcaggaacuagaagauag

SEQ ID NO: 692812 - RNA, 22 nt, Human
guccuucauggaguuacagccu

SEQ ID NO: 692813 - RNA, 22 nt, Human
cagcucugguuccugggcccag

SEQ ID NO: 692814 - RNA, 22 nt, Human
cucugggacaucccuuggccua

SEQ ID NO: 692815 - RNA, 22 nt, Human
uuaacagagugccuggcaugua

SEQ ID NO: 692816 - RNA, 23 nt, Human
guuuucaacacaauaaauguaac

SEQ ID NO: 692817 - RNA, 22 nt, Human
auguggcagugggaggugaauu

SEQ ID NO: 692818 - RNA, 22 nt, Human
uggcaucucaaacaggcagauu

SEQ ID NO: 692819 - RNA, 22 nt, Human
cuguuuguuggcuauugacagu

SEQ ID NO: 692820 - RNA, 22 nt, Human
uuacuuuaugugauggauuagu

SEQ ID NO: 692821 - RNA, 22 nt, Human
ugucuuuaguugcuuagauuug

SEQ ID NO: 692822 - RNA, 22 nt, Human
uggccaccuucccacuucugcc

SEQ ID NO: 692823 - RNA, 22 nt, Human
cugcacugaagaaaggagcucu

SEQ ID NO: 692824 - RNA, 22 nt, Human
ugugaucuuagacaacucacug

SEQ ID NO: 692825 - RNA, 22 nt, Human
aggcaucuauacauuauguuca

SEQ ID NO: 692826 - RNA, 22 nt, Human
cugggcugauuuagucacguuu

SEQ ID NO: 692827 - RNA, 22 nt, Human
guggcugcagcccagcggcacg

SEQ ID NO: 692828 - RNA, 22 nt, Human
caggcugcagcagcaguggccc

SEQ ID NO: 692829 - RNA, 22 nt, Human
uuucagggaaguguugaaaagg

SEQ ID NO: 692830 - RNA, 22 nt, Human
ucugagaagcuagaggacaaag

SEQ ID NO: 692831 - RNA, 22 nt, Human
augggccacacacgauugggug

SEQ ID NO: 692832 - RNA, 21 nt, Human
gcucaugguggagaaaagcag

SEQ ID NO: 692833 - RNA, 17 nt, Human
uuucuggaaugggcaaa

SEQ ID NO: 692834 - RNA, 23 nt, Human
gaggugugaauucugggugcugc

SEQ ID NO: 692835 - RNA, 22 nt, Human
auaccauggcaguuuauucacg

SEQ ID NO: 692836 - RNA, 17 nt, Human
gcuuuccuugccccucc

SEQ ID NO: 692837 - RNA, 22 nt, Human
acagggcuauauuccucagagc

SEQ ID NO: 692838 - RNA, 22 nt, Human
accaggggaugguuggcacugu

SEQ ID NO: 692839 - RNA, 22 nt, Human
ugacaaagcaugauggugacag

SEQ ID NO: 692840 - RNA, 22 nt, Human
ugcauauuguccuugauauuau

SEQ ID NO: 692841 - RNA, 18 nt, Human
aguaaagcuuauuacaug

SEQ ID NO: 692842 - RNA, 22 nt, Human
ccagcucucugcagaaaggacu

SEQ ID NO: 692843 - RNA, 22 nt, Human
uagaaacccauguuuauucagu

SEQ ID NO: 692844 - RNA, 22 nt, Human
uucucagagcucacuguaguaa

SEQ ID NO: 692845 - RNA, 18 nt, Human
uccuuucaccccuucucu

SEQ ID NO: 692846 - RNA, 22 nt, Human
ucccugccaguccuggucugaa

SEQ ID NO: 692847 - RNA, 22 nt, Human
cuugccuucuuuuccuauagaa

SEQ ID NO: 692848 - RNA, 22 nt, Human
accagucauagaaagcaguggu

SEQ ID NO: 692849 - RNA, 22 nt, Human
cagcaugaucccaguugauugc

SEQ ID NO: 692850 - RNA, 21 nt, Human
gcucagcugcuugguuccugu

SEQ ID NO: 692851 - RNA, 22 nt, Human
gccaggaccucagaugcagggc

SEQ ID NO: 692852 - RNA, 22 nt, Human
ucuuaugcauauucauaacaca

SEQ ID NO: 692853 - RNA, 22 nt, Human
uugcagcugaggaaauugaagc

SEQ ID NO: 692854 - RNA, 22 nt, Human
uacuguaugaauuauguuauuu

SEQ ID NO: 692855 - RNA, 22 nt, Human
aauaauguacauacauauuucg

SEQ ID NO: 692856 - RNA, 16 nt, Human
ugcuccagaggaccca

SEQ ID NO: 692857 - RNA, 22 nt, Human
ggcugggcaggucugcacaggg

SEQ ID NO: 692858 - RNA, 22 nt, Human
gggacacagagaaacuggagaa

SEQ ID NO: 692859 - RNA, 22 nt, Human
uaaggcauucucaugcugugaa

SEQ ID NO: 692860 - RNA, 22 nt, Human
ugcuggaguucgacauugcaaa

SEQ ID NO: 692861 - RNA, 22 nt, Human
uucaugagcagaagggaggggu

SEQ ID NO: 692862 - RNA, 22 nt, Human
ucauaaaguuaucaccaaaucc

SEQ ID NO: 692863 - RNA, 22 nt, Human
uguauaugugcacaugugcuuc

SEQ ID NO: 692864 - RNA, 22 nt, Human
ucuuggucuuucauccuucaac

SEQ ID NO: 692865 - RNA, 22 nt, Human
ucuuucccuguguuagccugua

SEQ ID NO: 692866 - RNA, 22 nt, Human
ucucuguagagacagcacugug

SEQ ID NO: 692867 - RNA, 22 nt, Human
uagaaacagaauaugagugaga

SEQ ID NO: 692868 - RNA, 22 nt, Human
gcagagacuccacugucuugug

SEQ ID NO: 692869 - RNA, 22 nt, Human
aacauacuuguacuaugcauau

SEQ ID NO: 692870 - RNA, 22 nt, Human
agacauuguuggccuauccucu

SEQ ID NO: 692871 - RNA, 16 nt, Human
cacauauauuuauaug

SEQ ID NO: 692872 - RNA, 20 nt, Human
acacuugacaccagaaaugg

SEQ ID NO: 692873 - RNA, 22 nt, Human
uacacugugacaaucaugacag

SEQ ID NO: 692874 - RNA, 22 nt, Human
ucuccaggcccacugauuuaua

SEQ ID NO: 692875 - RNA, 22 nt, Human
aaggagaaaugguagaugugca

SEQ ID NO: 692876 - RNA, 22 nt, Human
aguccaggaguugggugacauu

SEQ ID NO: 692877 - RNA, 22 nt, Human
acugaggauggauaggucauau

SEQ ID NO: 692878 - RNA, 22 nt, Human
auguuucauccacuggccuuuc

SEQ ID NO: 692879 - RNA, 22 nt, Human
auaaagcaagcauaccauuaag

SEQ ID NO: 692880 - RNA, 21 nt, Human
ugcccaccaagcuccacacug

SEQ ID NO: 692881 - RNA, 22 nt, Human
gguuucuagcagagucucuuua

SEQ ID NO: 692882 - RNA, 22 nt, Human
aauauuaguuucucaagagaga

SEQ ID NO: 692883 - RNA, 22 nt, Human
uccagcauucuuagaccucuau

SEQ ID NO: 692884 - RNA, 22 nt, Human
auguggcccagcggucaggcug

SEQ ID NO: 692885 - RNA, 22 nt, Human
uagccucuggaauccuuucucu

SEQ ID NO: 692886 - RNA, 22 nt, Human
augucuguguuaucuguagaau

SEQ ID NO: 692887 - RNA, 22 nt, Human
ccucaggauacaggagccacag

SEQ ID NO: 692888 - RNA, 22 nt, Human
guggccuggcgagcuggcgcgg

SEQ ID NO: 692889 - RNA, 22 nt, Human
ggcuuuauuugcagccauuguu

SEQ ID NO: 692890 - RNA, 22 nt, Human
cccugagcuaccuauguaagca

SEQ ID NO: 692891 - RNA, 20 nt, Human
gcugucuggauuagaagccu

SEQ ID NO: 692892 - RNA, 22 nt, Human
acaaagggggacugcagagggu

SEQ ID NO: 692893 - RNA, 22 nt, Human
ugaaggaaugagggaguggguc

SEQ ID NO: 692894 - RNA, 22 nt, Human
uaaccuuuuuaucuuaccucca

SEQ ID NO: 692895 - RNA, 20 nt, Human
uccaggcagcucagaguguc

SEQ ID NO: 692896 - RNA, 22 nt, Human
aggccaagggcaaagcggagag

SEQ ID NO: 692897 - RNA, 22 nt, Human
uauggguaaauaauaauuuuag

SEQ ID NO: 692898 - RNA, 22 nt, Human
ccccaggcagggccuaacagag

SEQ ID NO: 692899 - RNA, 23 nt, Human
ucugagugauuagccucuggggu

SEQ ID NO: 692900 - RNA, 22 nt, Human
ugagcccugugacugcuuugag

SEQ ID NO: 692901 - RNA, 22 nt, Human
gcuggccugcaaagcccggcug

SEQ ID NO: 692902 - RNA, 22 nt, Human
aggucuggugggcuuuagauug

SEQ ID NO: 692903 - RNA, 22 nt, Human
aaagggcugucaaauaagcaac

SEQ ID NO: 692904 - RNA, 22 nt, Human
ugaaucaugccacugagcuccc

SEQ ID NO: 692905 - RNA, 22 nt, Human
gggcagcacagacagugaaggc

SEQ ID NO: 692906 - RNA, 22 nt, Human
gaugcuuaagauguugguggca

SEQ ID NO: 692907 - RNA, 22 nt, Human
acugcugauauaagaaaagauu

SEQ ID NO: 692908 - RNA, 22 nt, Human
gugcuuuaguucuugcaacugg

SEQ ID NO: 692909 - RNA, 22 nt, Human
aggcugagcugaccugguuugg

SEQ ID NO: 692910 - RNA, 23 nt, Human
uguaugaauaugccacaguuuaa

SEQ ID NO: 692911 - RNA, 22 nt, Human
aaauuguauauuccauuuguau

SEQ ID NO: 692912 - RNA, 22 nt, Human
uuauuauggcaguuuucuaggu

SEQ ID NO: 692913 - RNA, 22 nt, Human
ucccagggacucucugccuucc

SEQ ID NO: 692914 - RNA, 22 nt, Human
ugcuuuuaagaacaaugcugcu

SEQ ID NO: 692915 - RNA, 22 nt, Human
uguuagaauauuguaauauucg

SEQ ID NO: 692916 - RNA, 20 nt, Human
gccacugggcaccagcaggg

SEQ ID NO: 692917 - RNA, 22 nt, Human
auguuagaaucucugaaugugg

SEQ ID NO: 692918 - RNA, 22 nt, Human
ucucuucacauuccuggcaaac

SEQ ID NO: 692919 - RNA, 22 nt, Human
uuacaaugacagguguaucauu

SEQ ID NO: 692920 - RNA, 22 nt, Human
uuauuccaauuucuccuacaaa

SEQ ID NO: 692921 - RNA, 22 nt, Human
caggugcucugcugcagguaag

SEQ ID NO: 692922 - RNA, 22 nt, Human
gaaauguuaugagauauguacu

SEQ ID NO: 692923 - RNA, 22 nt, Human
gcaaugggcacagcccagccca

SEQ ID NO: 692924 - RNA, 22 nt, Human
ucagaagccgggcagguuuugg

SEQ ID NO: 692925 - RNA, 22 nt, Human
uuucagagaaagcccaaagacu

SEQ ID NO: 692926 - RNA, 22 nt, Human
uucugggcucucuuucugugug

SEQ ID NO: 692927 - RNA, 22 nt, Human
auacuguaucacuugugaguga

SEQ ID NO: 692928 - RNA, 22 nt, Human
ugagcaauuaacagagucuaaa

SEQ ID NO: 692929 - RNA, 22 nt, Human
accuucaaguaugugggcugaa

SEQ ID NO: 692930 - RNA, 22 nt, Human
ucugaaauagaagugucuuucu

SEQ ID NO: 692931 - RNA, 22 nt, Human
uuucagagccugcaaucccaau

SEQ ID NO: 692932 - RNA, 22 nt, Human
cuccagaggaugcaggugaggg

SEQ ID NO: 692933 - RNA, 22 nt, Human
agauccaggaugucccaaaaua

SEQ ID NO: 692934 - RNA, 22 nt, Human
uccugagggacugguuccucgc

SEQ ID NO: 692935 - RNA, 22 nt, Human
gaaguggaauuacugggucaua

SEQ ID NO: 692936 - RNA, 22 nt, Human
gcaguccuagggugcucugcag

SEQ ID NO: 692937 - RNA, 22 nt, Human
acaugcauucucuaaaagcaaa

SEQ ID NO: 692938 - RNA, 22 nt, Human
guauuagguuggugcaaaauug

SEQ ID NO: 692939 - RNA, 22 nt, Human
agcuugguggcccuccuggcug

SEQ ID NO: 692940 - RNA, 22 nt, Human
cccugaggauagggcaggaccc

SEQ ID NO: 692941 - RNA, 22 nt, Human
gggagcugcugaacacaagggu

SEQ ID NO: 692942 - RNA, 22 nt, Human
uggaauucccaaguaacuuuua

SEQ ID NO: 692943 - RNA, 22 nt, Human
ugacuuccugcacucaggugau

SEQ ID NO: 692944 - RNA, 22 nt, Human
agugauuuacuaccauauuggg

SEQ ID NO: 692945 - RNA, 18 nt, Human
agauugugucuacaaauc

SEQ ID NO: 692946 - RNA, 22 nt, Human
ucaaaaauguuuuauauuggua

SEQ ID NO: 692947 - RNA, 22 nt, Human
cccugggacccgcugcagaggc

SEQ ID NO: 692948 - RNA, 22 nt, Human
aggucagcaugaguagaaggua

SEQ ID NO: 692949 - RNA, 22 nt, Human
cugaacaucauagaguguacuu

SEQ ID NO: 692950 - RNA, 22 nt, Human
ucuuuacaucacaauuguaugg

SEQ ID NO: 692951 - RNA, 22 nt, Human
cuggcuuuuccuaaacugggaa

SEQ ID NO: 692952 - RNA, 22 nt, Human
gcucuguguugucagaggcacc

SEQ ID NO: 692953 - RNA, 22 nt, Human
augcuuggaugcugccauggga

SEQ ID NO: 692954 - RNA, 22 nt, Human
uucaagauaauaggaaugaaaa

SEQ ID NO: 692955 - RNA, 22 nt, Human
uuuuuccuuggaugugucucuc

SEQ ID NO: 692956 - RNA, 22 nt, Human
gggugggauggcaggagccgcu

SEQ ID NO: 692957 - RNA, 22 nt, Human
aacaauaggcuauaugcuaggc

SEQ ID NO: 692958 - RNA, 22 nt, Human
ccgggccucgggacaccgggua

SEQ ID NO: 692959 - RNA, 22 nt, Human
uggaaggcgcagugaugaugcu

SEQ ID NO: 692960 - RNA, 19 nt, Human
ucuuucauuucuagcucug

SEQ ID NO: 692961 - RNA, 22 nt, Human
ucugcagcuucuugccagagag

SEQ ID NO: 692962 - RNA, 20 nt, Human
gccaggagggugugaugagc

SEQ ID NO: 692963 - RNA, 22 nt, Human
auucuaguguuuccauuacaag

SEQ ID NO: 692964 - RNA, 22 nt, Human
agagcacagaagaauaggugcu

SEQ ID NO: 692965 - RNA, 22 nt, Human
cugguccuugcuacccagcaag

SEQ ID NO: 692966 - RNA, 22 nt, Human
ggugcaugugagaaagacuggg

SEQ ID NO: 692967 - RNA, 22 nt, Human
uuagaaaggcuuauggugccuu

SEQ ID NO: 692968 - RNA, 22 nt, Human
cagagcccuaguccugauggcc

SEQ ID NO: 692969 - RNA, 22 nt, Human
agggaaaggcugaugcuguggg

SEQ ID NO: 692970 - RNA, 22 nt, Human
uuaaauggagggggaaauacgu

SEQ ID NO: 692971 - RNA, 22 nt, Human
ucacaggguaucugggauggau

SEQ ID NO: 692972 - RNA, 18 nt, Human
uccagagguguuggagcc

SEQ ID NO: 692973 - RNA, 22 nt, Human
uuucuucuaagauuucaaacua

SEQ ID NO: 692974 - RNA, 20 nt, Human
acacacuuugaucuugagcc

SEQ ID NO: 692975 - RNA, 22 nt, Human
ccagcugugccuaggagcaggg

SEQ ID NO: 692976 - RNA, 22 nt, Human
aaccagcugagaaugcuucugc

SEQ ID NO: 692977 - RNA, 22 nt, Human
acugcagggcauccuggccaag

SEQ ID NO: 692978 - RNA, 22 nt, Human
gaggggucuuuuguugucaggg

SEQ ID NO: 692979 - RNA, 22 nt, Human
gcuauuuccaaagcugcuguuc

SEQ ID NO: 692980 - RNA, 21 nt, Human
ucaggggcuguguuuuccauc

SEQ ID NO: 692981 - RNA, 22 nt, Human
agaaucucuacucaaguacuug

SEQ ID NO: 692982 - RNA, 22 nt, Human
agaaggcagaugggacggagca

SEQ ID NO: 692983 - RNA, 22 nt, Human
uucucucccaugaagcuucuau

SEQ ID NO: 692984 - RNA, 22 nt, Human
gucugggcucccagggucggcg

SEQ ID NO: 692985 - RNA, 22 nt, Human
gcaaauuaaccaaucaugcucg

SEQ ID NO: 692986 - RNA, 22 nt, Human
auauguauguacgcacauauuc

SEQ ID NO: 692987 - RNA, 22 nt, Human
cauugcacuccacccuaggcaa

SEQ ID NO: 692988 - RNA, 22 nt, Human
uccagcugagguggccucugug

SEQ ID NO: 692989 - RNA, 22 nt, Human
acugggaagcuguuuugcuuuu

SEQ ID NO: 692990 - RNA, 22 nt, Human
gugcugugucuaucaggaauaa

SEQ ID NO: 692991 - RNA, 22 nt, Human
uacagaaaaacuuggaggcuuu

SEQ ID NO: 692992 - RNA, 22 nt, Human
uccaggggcugucuuggaaucu

SEQ ID NO: 692993 - RNA, 22 nt, Human
aaagguuuuauguuuuccacuu

SEQ ID NO: 692994 - RNA, 22 nt, Human
uguaacaaguaauccaugggag

SEQ ID NO: 692995 - RNA, 22 nt, Human
cuccacucaccagaugccagga

SEQ ID NO: 692996 - RNA, 22 nt, Human
gcuuacaaucauuucaguuuag

SEQ ID NO: 692997 - RNA, 22 nt, Human
uaauuuacuugcaaauaacaau

SEQ ID NO: 692998 - RNA, 22 nt, Human
gauguacaaguaaaauaugugu

SEQ ID NO: 692999 - RNA, 22 nt, Human
uuuccugucuuuugugaaggau

SEQ ID NO: 693000 - RNA, 22 nt, Human
gcaguguguuucugagauaugg

SEQ ID NO: 693001 - RNA, 22 nt, Human
aaaccugguggaacggugaaua

SEQ ID NO: 693002 - RNA, 22 nt, Human
auggaagacuaacagaaacaug

SEQ ID NO: 693003 - RNA, 22 nt, Human
acagacauuuaauaaaugcuga

SEQ ID NO: 693004 - RNA, 22 nt, Human
aaugcuacagaagugaucuugg

SEQ ID NO: 693005 - RNA, 21 nt, Human
cuacagaaucgagcauucugg

SEQ ID NO: 693006 - RNA, 22 nt, Human
uccggacucaccugacaauggc

SEQ ID NO: 693007 - RNA, 19 nt, Human
gcugagggccacccagccc

SEQ ID NO: 693008 - RNA, 22 nt, Human
aaagugcucggcgcugguccca

SEQ ID NO: 693009 - RNA, 22 nt, Human
gccuucaguagugucagcugua

SEQ ID NO: 693010 - RNA, 22 nt, Human
uggaugagaaacucuggugacu

SEQ ID NO: 693011 - RNA, 23 nt, Human
uucuuuggaauugggcugcaagg

SEQ ID NO: 693012 - RNA, 22 nt, Human
agauauacagagaauuauucac

SEQ ID NO: 693013 - RNA, 22 nt, Human
ccagccuucugagcugccugga

SEQ ID NO: 693014 - RNA, 22 nt, Human
ccauccugaauggucucagcca

SEQ ID NO: 693015 - RNA, 22 nt, Human
agggcagcuuccauagucuggc

SEQ ID NO: 693016 - RNA, 18 nt, Human
uugauucauauuaaccau

SEQ ID NO: 693017 - RNA, 22 nt, Human
ugaaauaggaaacagauguuuc

SEQ ID NO: 693018 - RNA, 22 nt, Human
agaggaguauuuucuaagggaa

SEQ ID NO: 693019 - RNA, 18 nt, Human
gggaggccccagcaggag

SEQ ID NO: 693020 - RNA, 22 nt, Human
gaagccacagggaaggagaaca

SEQ ID NO: 693021 - RNA, 22 nt, Human
acauaugauauugaggaucuca

SEQ ID NO: 693022 - RNA, 22 nt, Human
caggcagaguuagagcaacugg

SEQ ID NO: 693023 - RNA, 22 nt, Human
ucucugggugauggcagggcac

SEQ ID NO: 693024 - RNA, 22 nt, Human
acauguuuaaguuuaaugaaaa

SEQ ID NO: 693025 - RNA, 22 nt, Human
cagggauucagcugaaggaggc

SEQ ID NO: 693026 - RNA, 19 nt, Human
uuaaagugcgagaagucuu

SEQ ID NO: 693027 - RNA, 21 nt, Human
ucauggaaguaacaaacauau

SEQ ID NO: 693028 - RNA, 22 nt, Human
uuuuacaggucauagguauagu

SEQ ID NO: 693029 - RNA, 22 nt, Human
gggcagcauucugugggcaggu

SEQ ID NO: 693030 - RNA, 22 nt, Human
caccagcaccagcucugugccu

SEQ ID NO: 693031 - RNA, 22 nt, Human
guagaucaugagaauguuuuug

SEQ ID NO: 693032 - RNA, 22 nt, Human
gcagagcucuguucuuaucucc

SEQ ID NO: 693033 - RNA, 22 nt, Human
cuuccugcauggagucugaaug

SEQ ID NO: 693034 - RNA, 22 nt, Human
ugaaauagacacagugcuauac

SEQ ID NO: 693035 - RNA, 22 nt, Human
aaguucaaguguaaucuuuauu

SEQ ID NO: 693036 - RNA, 22 nt, Human
cucccaagggguaagggagcug

SEQ ID NO: 693037 - RNA, 22 nt, Human
accuggcauaagggcuugaguc

SEQ ID NO: 693038 - RNA, 22 nt, Human
gcaagaguggaacaaaggcagc

SEQ ID NO: 693039 - RNA, 22 nt, Human
uuacagaguggucuggcuaugu

SEQ ID NO: 693040 - RNA, 22 nt, Human
uggcucaucuuuuuagacuuau

SEQ ID NO: 693041 - RNA, 22 nt, Human
gcugaccauuaggaggacgaua

SEQ ID NO: 693042 - RNA, 22 nt, Human
uuuugcagaaugggaagguagu

SEQ ID NO: 693043 - RNA, 22 nt, Human
uuccugcccugccugugccacu

SEQ ID NO: 693044 - RNA, 22 nt, Human
aauuuccugggauaaaaagcca

SEQ ID NO: 693045 - RNA, 22 nt, Human
ucgggcucgcucuccuagcgga

SEQ ID NO: 693046 - RNA, 22 nt, Human
gcuggcuucccuaccugcaccu

SEQ ID NO: 693047 - RNA, 18 nt, Human
uggcuucuauuuuacuca

SEQ ID NO: 693048 - RNA, 22 nt, Human
uucuuuuccuguggcucaucca

SEQ ID NO: 693049 - RNA, 22 nt, Human
guccuuggcacccaugugauuc

SEQ ID NO: 693050 - RNA, 18 nt, Human
uggcuucugcuagcugga

SEQ ID NO: 693051 - RNA, 22 nt, Human
uggcucuguuuuaugaguacca

SEQ ID NO: 693052 - RNA, 22 nt, Human
gagugugggcacgggggccuug

SEQ ID NO: 693053 - RNA, 22 nt, Human
gcagcuggcccugacacgcaga

SEQ ID NO: 693054 - RNA, 22 nt, Human
agacucaagacugcagaagacg

SEQ ID NO: 693055 - RNA, 22 nt, Human
cuggccccagaguuucacuugg

SEQ ID NO: 693056 - RNA, 22 nt, Human
gaauuuaagaggaugaaucugu

SEQ ID NO: 693057 - RNA, 22 nt, Human
ggugggcgacugagagggguuu

SEQ ID NO: 693058 - RNA, 22 nt, Human
aagaccuugucuaaacauguag

SEQ ID NO: 693059 - RNA, 22 nt, Human
aaaauggcuguggucuggcaag

SEQ ID NO: 693060 - RNA, 17 nt, Human
ugcgaugucuguguuug

SEQ ID NO: 693061 - RNA, 22 nt, Human
caaaagcagcaaguuuauaugu

SEQ ID NO: 693062 - RNA, 22 nt, Human
cauuauggcagccaggauauug

SEQ ID NO: 693063 - RNA, 23 nt, Human
caguggagacucaugcuuccuua

SEQ ID NO: 693064 - RNA, 19 nt, Human
uggcuggagaucugcuacu

SEQ ID NO: 693065 - RNA, 22 nt, Human
uuguuuaagccacccaaucugu

SEQ ID NO: 693066 - RNA, 22 nt, Human
ugagaaggaaacaauggcuuuu

SEQ ID NO: 693067 - RNA, 22 nt, Human
aggccgccuggggagaggcccu

SEQ ID NO: 693068 - RNA, 22 nt, Human
ccuuggguuccaagucacugaa

SEQ ID NO: 693069 - RNA, 22 nt, Human
ccagccuugcaccgagccagcc

SEQ ID NO: 693070 - RNA, 22 nt, Human
uggaggauuccacuuacaugag

SEQ ID NO: 693071 - RNA, 22 nt, Human
caguaacacaaccacuccguga

SEQ ID NO: 693072 - RNA, 22 nt, Human
guggagcaaucagagggucagu

SEQ ID NO: 693073 - RNA, 22 nt, Human
aaacacauuuuaggaaaaucua

SEQ ID NO: 693074 - RNA, 22 nt, Human
gaauauuuuuaaagggacuaau

SEQ ID NO: 693075 - RNA, 22 nt, Human
gucauucaaacuguaucacuug

SEQ ID NO: 693076 - RNA, 22 nt, Human
ugucauuuucauccuaaggagc

SEQ ID NO: 693077 - RNA, 19 nt, Human
ccagaggacuguuaaugaa

SEQ ID NO: 693078 - RNA, 22 nt, Human
ugagcuacacacuaggcauggg

SEQ ID NO: 693079 - RNA, 22 nt, Human
cacaggacucgacugcagacag

SEQ ID NO: 693080 - RNA, 22 nt, Human
uccuggccuugcgucuugggag

SEQ ID NO: 693081 - RNA, 22 nt, Human
agcuccugaaaauccagacugg

SEQ ID NO: 693082 - RNA, 22 nt, Human
ucacagcaccaggaucucucca

SEQ ID NO: 693083 - RNA, 22 nt, Human
gugaauuaggacaaaagggcuu

SEQ ID NO: 693084 - RNA, 22 nt, Human
ucccuggagguguuugcucagg

SEQ ID NO: 693085 - RNA, 22 nt, Human
cauggccaggccaagagaguac

SEQ ID NO: 693086 - RNA, 22 nt, Human
auauuaaugggauuuagucagg

SEQ ID NO: 693087 - RNA, 18 nt, Human
gaucucugcagugccuac

SEQ ID NO: 693088 - RNA, 22 nt, Human
gcugccugaucauacaccaggg

SEQ ID NO: 693089 - RNA, 22 nt, Human
acaaaugacucaaacaccacuu

SEQ ID NO: 693090 - RNA, 23 nt, Human
agcuccugaggccagccucuccu

SEQ ID NO: 693091 - RNA, 22 nt, Human
uggagcuguagccaccacccug

SEQ ID NO: 693092 - RNA, 22 nt, Human
uaggaagauaaacauuuguaug

SEQ ID NO: 693093 - RNA, 22 nt, Human
gccacaggcacuuaagggcugg

SEQ ID NO: 693094 - RNA, 22 nt, Human
augcacaggaaguguccccauu

SEQ ID NO: 693095 - RNA, 22 nt, Human
auacaaagacaaaucucaaucu

SEQ ID NO: 693096 - RNA, 22 nt, Human
aaaugcucuccaaaaugaaagu

SEQ ID NO: 693097 - RNA, 22 nt, Human
aggagguugccagucugggggu

SEQ ID NO: 693098 - RNA, 18 nt, Human
ucuuuuccuuccacuucc

SEQ ID NO: 693099 - RNA, 22 nt, Human
uacaucaaaucaauguuccagu

SEQ ID NO: 693100 - RNA, 22 nt, Human
auuuuaguuuuagcauccaugc

SEQ ID NO: 693101 - RNA, 22 nt, Human
cugcuuuaacaaggcugaucag

SEQ ID NO: 693102 - RNA, 22 nt, Human
cagccuucgacaguuggaguag

SEQ ID NO: 693103 - RNA, 22 nt, Human
agguacagcaauauaagagguc

SEQ ID NO: 693104 - RNA, 22 nt, Human
gaggcagugaacaauuccugug

SEQ ID NO: 693105 - RNA, 22 nt, Human
uggaccugaagaauaggaagua

SEQ ID NO: 693106 - RNA, 18 nt, Human
ggcuguggacaagauuag

SEQ ID NO: 693107 - RNA, 22 nt, Human
ccucaaaguagagggagaugag

SEQ ID NO: 693108 - RNA, 20 nt, Human
gaaaccagaacgcagcccug

SEQ ID NO: 693109 - RNA, 22 nt, Human
uaaacaaggguuacugagcaug

SEQ ID NO: 693110 - RNA, 22 nt, Human
auucaguuagaucauccuaauu

SEQ ID NO: 693111 - RNA, 21 nt, Human
ggcagugaugugaagugcauc

SEQ ID NO: 693112 - RNA, 22 nt, Human
agugcuguuggauaaugcuguc

SEQ ID NO: 693113 - RNA, 22 nt, Human
uucaaacacagacagcagcaug

SEQ ID NO: 693114 - RNA, 22 nt, Human
augaggccuaucuuggcagagg

SEQ ID NO: 693115 - RNA, 22 nt, Human
uguauguauguauguauuuggg

SEQ ID NO: 693116 - RNA, 22 nt, Human
uugaggucucuacagaagagug

SEQ ID NO: 693117 - RNA, 22 nt, Human
ggccccaggccuuuggucuggc

SEQ ID NO: 693118 - RNA, 22 nt, Human
uuauuacuguauuaauccagag

SEQ ID NO: 693119 - RNA, 19 nt, Human
cuucuggcccugagccacc

SEQ ID NO: 693120 - RNA, 22 nt, Human
uaguuacagugcauagcaagau

SEQ ID NO: 693121 - RNA, 21 nt, Human
guuuagaaguagucuggcuca

SEQ ID NO: 693122 - RNA, 22 nt, Human
agccacagcgaaccucucuucc

SEQ ID NO: 693123 - RNA, 22 nt, Human
agccccucuguggcucugccuc

SEQ ID NO: 693124 - RNA, 22 nt, Human
cagcuuuaggacucauaauaaa

SEQ ID NO: 693125 - RNA, 22 nt, Human
gaaggcuggggcaucagugaaa

SEQ ID NO: 693126 - RNA, 22 nt, Human
aacaguaguggucaauaugcca

SEQ ID NO: 693127 - RNA, 22 nt, Human
aaaaggaggacaugguuacaga

SEQ ID NO: 693128 - RNA, 22 nt, Human
guuucauuaccugacccaugag

SEQ ID NO: 693129 - RNA, 22 nt, Human
uggugcaggccaagcugcgagc

SEQ ID NO: 693130 - RNA, 22 nt, Human
aagggagccaagaaagcagggc

SEQ ID NO: 693131 - RNA, 22 nt, Human
cacaggagaaaggggaagcucg

SEQ ID NO: 693132 - RNA, 22 nt, Human
ggaggugcagaguaggguuggu

SEQ ID NO: 693133 - RNA, 22 nt, Human
cuccagaggcgacuugcaucac

SEQ ID NO: 693134 - RNA, 22 nt, Human
aaaaguuaccucuguaauauaa

SEQ ID NO: 693135 - RNA, 22 nt, Human
uggucucuucuuccaagauggc

SEQ ID NO: 693136 - RNA, 22 nt, Human
uucauggaucaugccuuuugug

SEQ ID NO: 693137 - RNA, 22 nt, Human
ugcuuucuguuuuucauauaau

SEQ ID NO: 693138 - RNA, 22 nt, Human
ucugugcagucagggcucaguc

SEQ ID NO: 693139 - RNA, 22 nt, Human
ccacaucuguucuuaguucuga

SEQ ID NO: 693140 - RNA, 22 nt, Human
gucauuuuuuucguaauagugg

SEQ ID NO: 693141 - RNA, 22 nt, Human
aaggagaguacaggaguuggua

SEQ ID NO: 693142 - RNA, 22 nt, Human
acuuccuggauucccaagggcu

SEQ ID NO: 693143 - RNA, 22 nt, Human
gcugccugccugcauuuaaucc

SEQ ID NO: 693144 - RNA, 22 nt, Human
ucagaguccuuuggccugacag

SEQ ID NO: 693145 - RNA, 22 nt, Human
caggcagauuugcugcccucca

SEQ ID NO: 693146 - RNA, 18 nt, Human
gccugagggucaagugug

SEQ ID NO: 693147 - RNA, 22 nt, Human
uuguauuuuguuaugcuacugc

SEQ ID NO: 693148 - RNA, 22 nt, Human
cugcaagauuggaagaugcaau

SEQ ID NO: 693149 - RNA, 22 nt, Human
aguggccagugcugcucugggg

SEQ ID NO: 693150 - RNA, 22 nt, Human
cuugaauguccuguggcaaagu

SEQ ID NO: 693151 - RNA, 20 nt, Human
ggcagagcuaugucuguugc

SEQ ID NO: 693152 - RNA, 16 nt, Human
cuggucuugcugccga

SEQ ID NO: 693153 - RNA, 22 nt, Human
gguggcagggagugucccuggg

SEQ ID NO: 693154 - RNA, 22 nt, Human
uuccucacacucccccauucga

SEQ ID NO: 693155 - RNA, 22 nt, Human
uuggaucuuaugaagguggcau

SEQ ID NO: 693156 - RNA, 22 nt, Human
cauguuuuguguacagaauauu

SEQ ID NO: 693157 - RNA, 22 nt, Human
ccaggcuggagugcaauggugc

SEQ ID NO: 693158 - RNA, 22 nt, Human
augaugguuguccuaggugcau

SEQ ID NO: 693159 - RNA, 20 nt, Human
aggcaucugagucacaucuu

SEQ ID NO: 693160 - RNA, 22 nt, Human
gagguucugggggucugccugg

SEQ ID NO: 693161 - RNA, 22 nt, Human
uccagagauaacuauuuaggag

SEQ ID NO: 693162 - RNA, 22 nt, Human
ggccugccucacagucagcacc

SEQ ID NO: 693163 - RNA, 20 nt, Human
ucauacacaugagcaugcag

SEQ ID NO: 693164 - RNA, 22 nt, Human
gcugggcuugguuucccugcuu

SEQ ID NO: 693165 - RNA, 22 nt, Human
gcaucuaaauaaacgugggagu

SEQ ID NO: 693166 - RNA, 22 nt, Human
ggccagcugcucagugucucug

SEQ ID NO: 693167 - RNA, 22 nt, Human
ugaauuguacaguaugugaauu

SEQ ID NO: 693168 - RNA, 22 nt, Human
uccugggcgauuuucugaauau

SEQ ID NO: 693169 - RNA, 22 nt, Human
gaaacaugucugacaauuuacc

SEQ ID NO: 693170 - RNA, 22 nt, Human
caacuuggcucucuggcuaucc

SEQ ID NO: 693171 - RNA, 22 nt, Human
ggguucagacuaaagcuaugca

SEQ ID NO: 693172 - RNA, 22 nt, Human
acccugagggaugagaguugca

SEQ ID NO: 693173 - RNA, 22 nt, Human
uuaacacaucccugcucuaccc

SEQ ID NO: 693174 - RNA, 22 nt, Human
agauuuauguggucacacucag

SEQ ID NO: 693175 - RNA, 22 nt, Human
ggcagugccacuaagcucugcu

SEQ ID NO: 693176 - RNA, 22 nt, Human
uggcuggagucuggugcuagcc

SEQ ID NO: 693177 - RNA, 22 nt, Human
ccuggcuccgugucacgugccc

SEQ ID NO: 693178 - RNA, 22 nt, Human
caggaaaauggaaucaccugua

SEQ ID NO: 693179 - RNA, 22 nt, Human
ugcaggcuuggaucacaucucc

SEQ ID NO: 693180 - RNA, 22 nt, Human
ucuuuguaaaugccuagcauaa

SEQ ID NO: 693181 - RNA, 20 nt, Human
gauaaauugucucuuaagug

SEQ ID NO: 693182 - RNA, 22 nt, Human
aaaaguaauugugguuuuugcc

SEQ ID NO: 693183 - RNA, 22 nt, Human
agagcuggugcauauucagaaa

SEQ ID NO: 693184 - RNA, 22 nt, Human
uugggagauggggagauaauau

SEQ ID NO: 693185 - RNA, 22 nt, Human
agcucagcuuccucuccaugcu

SEQ ID NO: 693186 - RNA, 19 nt, Human
auauacauacugugugcau

SEQ ID NO: 693187 - RNA, 22 nt, Human
ucugcaagggcacagccaaccc

SEQ ID NO: 693188 - RNA, 22 nt, Human
gcagguggauuaucagaagugc

SEQ ID NO: 693189 - RNA, 22 nt, Human
ucuguaaacaccauguuagagu

SEQ ID NO: 693190 - RNA, 22 nt, Human
aaacucuaaucaaauauagcau

SEQ ID NO: 693191 - RNA, 22 nt, Human
auacauguugagaaaauaucug

SEQ ID NO: 693192 - RNA, 22 nt, Human
caauugcuuuguggaagccuuu

SEQ ID NO: 693193 - RNA, 22 nt, Human
acagugugugcuuucccuuacg

SEQ ID NO: 693194 - RNA, 22 nt, Human
guaucuuuugguggaaaaauaa

SEQ ID NO: 693195 - RNA, 22 nt, Human
cauguaaagaauuucacacaag

SEQ ID NO: 693196 - RNA, 22 nt, Human
gguggcugcacccuggcuaacu

SEQ ID NO: 693197 - RNA, 22 nt, Human
ucuucagagugagcagugucau

SEQ ID NO: 693198 - RNA, 17 nt, Human
agcaggaccccagagca

SEQ ID NO: 693199 - RNA, 22 nt, Human
aggcuggacccgacaccugccc

SEQ ID NO: 693200 - RNA, 22 nt, Human
uggagagcgcgacgggaggaag

SEQ ID NO: 693201 - RNA, 22 nt, Human
aaacacaauguuucuuuguucu

SEQ ID NO: 693202 - RNA, 22 nt, Human
uuuuccuguccaggcaauuauu

SEQ ID NO: 693203 - RNA, 22 nt, Human
ucuggagcuggcagggcccugg

SEQ ID NO: 693204 - RNA, 22 nt, Human
uuugguuugaaugagcauaaga

SEQ ID NO: 693205 - RNA, 22 nt, Human
ucaaguuaggugguuguuagga

SEQ ID NO: 693206 - RNA, 20 nt, Human
auggagguggaugugacugc

SEQ ID NO: 693207 - RNA, 22 nt, Human
cuauuucagcugccuuugacug

SEQ ID NO: 693208 - RNA, 17 nt, Human
gaguaguuacaacagac

SEQ ID NO: 693209 - RNA, 22 nt, Human
ccagagaguaaacauuuuccgg

SEQ ID NO: 693210 - RNA, 22 nt, Human
cacugagcaugagugggcugug

SEQ ID NO: 693211 - RNA, 20 nt, Human
augugaaguaggaagggugu

SEQ ID NO: 693212 - RNA, 22 nt, Human
augacaugaccugguagagaca

SEQ ID NO: 693213 - RNA, 22 nt, Human
uccgcccgcacguauggagugg

SEQ ID NO: 693214 - RNA, 22 nt, Human
cuuuggcuugcccuggcaguac

SEQ ID NO: 693215 - RNA, 22 nt, Human
uagggcucugagaguucagccu

SEQ ID NO: 693216 - RNA, 22 nt, Human
ccauuaaacuuguggacccagu

SEQ ID NO: 693217 - RNA, 22 nt, Human
ugugugugcacaugcauauaca

SEQ ID NO: 693218 - RNA, 22 nt, Human
uaugcauauauuuucccaucuu

SEQ ID NO: 693219 - RNA, 22 nt, Human
uuggcccuagacucuaaguccg

SEQ ID NO: 693220 - RNA, 22 nt, Human
agugcucugucauuggugggau

SEQ ID NO: 693221 - RNA, 22 nt, Human
gguccuggaugagacagguagu

SEQ ID NO: 693222 - RNA, 22 nt, Human
uguuauuugggaaaguuguaca

SEQ ID NO: 693223 - RNA, 22 nt, Human
ucugucuuugucaggaccagag

SEQ ID NO: 693224 - RNA, 22 nt, Human
aaaguugugguuugaugcaguu

SEQ ID NO: 693225 - RNA, 22 nt, Human
uucauucaaagaggcauccaag

SEQ ID NO: 693226 - RNA, 22 nt, Human
uucauugugauucuuggcuagc

SEQ ID NO: 693227 - RNA, 22 nt, Human
ccacagugguucucaaccaggg

SEQ ID NO: 693228 - RNA, 21 nt, Human
ggcuuugcucagcuuaccaaa

SEQ ID NO: 693229 - RNA, 22 nt, Human
gcuguggcuccaauggugagcc

SEQ ID NO: 693230 - RNA, 22 nt, Human
ccuagagcucugcuuuaucuaa

SEQ ID NO: 693231 - RNA, 22 nt, Human
ugacacaaaggaaagcauaauc

SEQ ID NO: 693232 - RNA, 22 nt, Human
ugaucuuuuuggucauuugggu

SEQ ID NO: 693233 - RNA, 22 nt, Human
aagaaagccaaaguucauaccu

SEQ ID NO: 693234 - RNA, 20 nt, Human
uucuacaaaacugauucuga

SEQ ID NO: 693235 - RNA, 22 nt, Human
acgggccuucucuucaggcgag

SEQ ID NO: 693236 - RNA, 22 nt, Human
acucagagcuuggcuccuugcu

SEQ ID NO: 693237 - RNA, 22 nt, Human
uugcagacuuacuucgagaaau

SEQ ID NO: 693238 - RNA, 22 nt, Human
acaugcuagguacagaucuaaa

SEQ ID NO: 693239 - RNA, 22 nt, Human
aaauaugauacucccuuuuagu

SEQ ID NO: 693240 - RNA, 22 nt, Human
uaaaucacauucgucugcuccu

SEQ ID NO: 693241 - RNA, 22 nt, Human
gccagcugacaccuugauuuug

SEQ ID NO: 693242 - RNA, 21 nt, Human
aaauucaccuaguaaaacuuc

SEQ ID NO: 693243 - RNA, 22 nt, Human
auguacauuuguaguaauauca

SEQ ID NO: 693244 - RNA, 22 nt, Human
agaggaauguauuucccugcaa

SEQ ID NO: 693245 - RNA, 18 nt, Human
uguggcugguccacacug

SEQ ID NO: 693246 - RNA, 21 nt, Human
aucauucuggaaaauucaagc

SEQ ID NO: 693247 - RNA, 22 nt, Human
caggucuguauuaacagagggu

SEQ ID NO: 693248 - RNA, 22 nt, Human
cugccugugccaaugcuccuuu

SEQ ID NO: 693249 - RNA, 22 nt, Human
gacaucugaauauuagagagaa

SEQ ID NO: 693250 - RNA, 22 nt, Human
gauguguaacaugcugugacau

SEQ ID NO: 693251 - RNA, 22 nt, Human
cagaacagggcccaaggggucg

SEQ ID NO: 693252 - RNA, 22 nt, Human
guuuuacacaccuaugaaagac

SEQ ID NO: 693253 - RNA, 22 nt, Human
uagcugccuuugggcuccugcu

SEQ ID NO: 693254 - RNA, 22 nt, Human
ucugggcagccaugugccuggc

SEQ ID NO: 693255 - RNA, 22 nt, Human
ccagcucccauucuucaccugu

SEQ ID NO: 693256 - RNA, 22 nt, Human
gggagagagagcucauguugaa

SEQ ID NO: 693257 - RNA, 22 nt, Human
accaaaaccugcuacuaaagga

SEQ ID NO: 693258 - RNA, 22 nt, Human
uucaugaauguuccaugugagu

SEQ ID NO: 693259 - RNA, 22 nt, Human
uuuaucuguuguacauuuaugc

SEQ ID NO: 693260 - RNA, 22 nt, Human
ucuggaauagguccugaguauu

SEQ ID NO: 693261 - RNA, 22 nt, Human
ggagaaggcacacccaccucug

SEQ ID NO: 693262 - RNA, 22 nt, Human
augaggcaugugaggagaaggg

SEQ ID NO: 693263 - RNA, 22 nt, Human
acaaaauagaguucuccccugg

SEQ ID NO: 693264 - RNA, 19 nt, Human
uaaggccaaaaguaagugu

SEQ ID NO: 693265 - RNA, 22 nt, Human
gcccugucggaacugcgaccuc

SEQ ID NO: 693266 - RNA, 22 nt, Human
aaauuccaccagaaucaguaau

SEQ ID NO: 693267 - RNA, 22 nt, Human
acaacuuuucuaucauguggaa

SEQ ID NO: 693268 - RNA, 22 nt, Human
aaguguauauaugacuuauaaa

SEQ ID NO: 693269 - RNA, 22 nt, Human
uucagaaaaaacuucaauaagu

SEQ ID NO: 693270 - RNA, 22 nt, Human
uucacagggcagaucauuucug

SEQ ID NO: 693271 - RNA, 22 nt, Human
uaaauuuacccaaggaacaugu

SEQ ID NO: 693272 - RNA, 22 nt, Human
ugcuuugccagacaguucccuu

SEQ ID NO: 693273 - RNA, 22 nt, Human
uauaccaaaaaaauucuugucu

SEQ ID NO: 693274 - RNA, 22 nt, Human
ugucaaagcaaggauuaaaugu

SEQ ID NO: 693275 - RNA, 22 nt, Human
gcuaagaggcuauaucuuucuc

SEQ ID NO: 693276 - RNA, 22 nt, Human
gauggcuuugugcaccaugauu

SEQ ID NO: 693277 - RNA, 21 nt, Human
acacacucugagucuucuauu

SEQ ID NO: 693278 - RNA, 22 nt, Human
ggagcccuccaucccuugcggc

SEQ ID NO: 693279 - RNA, 22 nt, Human
uguguaugucuguaugcacaca

SEQ ID NO: 693280 - RNA, 22 nt, Human
cagccuggccugggacugcuga

SEQ ID NO: 693281 - RNA, 23 nt, Human
ugaagcccagugauuuuguuuca

SEQ ID NO: 693282 - RNA, 22 nt, Human
agacuaagcgguucuuuucaau

SEQ ID NO: 693283 - RNA, 22 nt, Human
agggaggcaggaaaguugucug

SEQ ID NO: 693284 - RNA, 22 nt, Human
cugcuggguuugccuuucacca

SEQ ID NO: 693285 - RNA, 23 nt, Human
agucagagagugugagacaacug

SEQ ID NO: 693286 - RNA, 22 nt, Human
uaagcauucaaugcuuagcacu

SEQ ID NO: 693287 - RNA, 22 nt, Human
aagauccuucucacugcagugu

SEQ ID NO: 693288 - RNA, 22 nt, Human
ucugaggaguugggccagugcu

SEQ ID NO: 693289 - RNA, 22 nt, Human
acuaaauagccucugguaguug

SEQ ID NO: 693290 - RNA, 22 nt, Human
ugcaaacaccacagagacaauu

SEQ ID NO: 693291 - RNA, 22 nt, Human
gccuuggcuguuggagcuugau

SEQ ID NO: 693292 - RNA, 22 nt, Human
agagagcuuccauucuagugau

SEQ ID NO: 693293 - RNA, 20 nt, Human
ggguccugacuuggucuccu

SEQ ID NO: 693294 - RNA, 20 nt, Human
uguuucauaagcuguccuau

SEQ ID NO: 693295 - RNA, 22 nt, Human
ggcaaaggaaaacgucucagcu

SEQ ID NO: 693296 - RNA, 22 nt, Human
ugcuccuggacuggugugagau

SEQ ID NO: 693297 - RNA, 22 nt, Human
ccagaagcaaaacagacaguuu

SEQ ID NO: 693298 - RNA, 22 nt, Human
ucagcuuugggggucucaggag

SEQ ID NO: 693299 - RNA, 22 nt, Human
cugcuuugauuagaagaguaca

SEQ ID NO: 693300 - RNA, 22 nt, Human
uggcagaugugguuugagacag

SEQ ID NO: 693301 - RNA, 22 nt, Human
uacuaggaagcagcugcauugg

SEQ ID NO: 693302 - RNA, 22 nt, Human
gagcuccagggaacagcagcua

SEQ ID NO: 693303 - RNA, 23 nt, Human
agcuccagggaacaggcaguagg

SEQ ID NO: 693304 - RNA, 22 nt, Human
caugggcuacagaagcaugcug

SEQ ID NO: 693305 - RNA, 22 nt, Human
aaaaguauuuugagcacuuuau

SEQ ID NO: 693306 - RNA, 22 nt, Human
ucugaaagcauuacaguuuauu

SEQ ID NO: 693307 - RNA, 22 nt, Human
uacaguaacauguuguacaagc

SEQ ID NO: 693308 - RNA, 22 nt, Human
augcaacaccccuauggaugga

SEQ ID NO: 693309 - RNA, 22 nt, Human
auucacaugugcuucuuaucac

SEQ ID NO: 693310 - RNA, 22 nt, Human
agaagccacuggagguugagau

SEQ ID NO: 693311 - RNA, 22 nt, Human
ggagcuguagaucagcuaaucu

SEQ ID NO: 693312 - RNA, 22 nt, Human
aaacauagauaauagauagaug

SEQ ID NO: 693313 - RNA, 22 nt, Human
agggccugagaccguggcuuga

SEQ ID NO: 693314 - RNA, 22 nt, Human
gaaauguauuugacaguccuug

SEQ ID NO: 693315 - RNA, 20 nt, Human
auaaccugcccagaggauga

SEQ ID NO: 693316 - RNA, 22 nt, Human
agaaucaaagagaaauacuuug

SEQ ID NO: 693317 - RNA, 20 nt, Human
ggaaggggcaaaguguguga

SEQ ID NO: 693318 - RNA, 21 nt, Human
ucacagagccacagaauuggu

SEQ ID NO: 693319 - RNA, 20 nt, Human
uauuucugggcaaccauuua

SEQ ID NO: 693320 - RNA, 22 nt, Human
ugaagcugugggcaguggagcc

SEQ ID NO: 693321 - RNA, 22 nt, Human
caguuucuuaucuucaaaauug

SEQ ID NO: 693322 - RNA, 23 nt, Human
ugaaggcccuggagccacgaggc

SEQ ID NO: 693323 - RNA, 22 nt, Human
uuaccaagcucugcauguuaag

SEQ ID NO: 693324 - RNA, 22 nt, Human
uaagcuucaaagaacauauugg

SEQ ID NO: 693325 - RNA, 22 nt, Human
ccugucuguauugguuugcuau

SEQ ID NO: 693326 - RNA, 22 nt, Human
gagguucaggaaaugggcaaag

SEQ ID NO: 693327 - RNA, 22 nt, Human
ugucagugaguuaguugcaagu

SEQ ID NO: 693328 - RNA, 22 nt, Human
gcagcuuuagaaacaagggcug

SEQ ID NO: 693329 - RNA, 22 nt, Human
ggccugugagcccuugcaugua

SEQ ID NO: 693330 - RNA, 22 nt, Human
uccccagaggugaggcagcuuu

SEQ ID NO: 693331 - RNA, 22 nt, Human
ggcuagaugguauauaaggaug

SEQ ID NO: 693332 - RNA, 22 nt, Human
uccuggguuaauuaugauucac

SEQ ID NO: 693333 - RNA, 22 nt, Human
auucaagguauuuaaaacauaa

SEQ ID NO: 693334 - RNA, 22 nt, Human
gaaaucugaacaacagcuguca

SEQ ID NO: 693335 - RNA, 22 nt, Human
ggauccuuaacuaucacaguga

SEQ ID NO: 693336 - RNA, 22 nt, Human
ugcccuccuccugagcccaugu

SEQ ID NO: 693337 - RNA, 22 nt, Human
uccuagagaguaauacaguuuu

SEQ ID NO: 693338 - RNA, 22 nt, Human
ugggcgaggagaaugcugugaa

SEQ ID NO: 693339 - RNA, 22 nt, Human
augucuugauauuuuacuguuu

SEQ ID NO: 693340 - RNA, 22 nt, Human
cagacauggaaauuuaguguua

SEQ ID NO: 693341 - RNA, 22 nt, Human
uauauuuuagacacccucacgc

SEQ ID NO: 693342 - RNA, 22 nt, Human
uacagagacuuuauggcacaaa

SEQ ID NO: 693343 - RNA, 22 nt, Human
auguagauuugcuucuccugcc

SEQ ID NO: 693344 - RNA, 22 nt, Human
ugcuucugcuuuacuugguuca

SEQ ID NO: 693345 - RNA, 22 nt, Human
ucuuaugaaaagcacuuagaac

SEQ ID NO: 693346 - RNA, 22 nt, Human
ugagcagggagcugggcugagc

SEQ ID NO: 693347 - RNA, 22 nt, Human
uauuaaauauaucuguuaguug

SEQ ID NO: 693348 - RNA, 22 nt, Human
uaagucguggaugauucuucgg

SEQ ID NO: 693349 - RNA, 22 nt, Human
aaacugcagagccaugguucaa

SEQ ID NO: 693350 - RNA, 22 nt, Human
uugcauuuacugcaccgugagu

SEQ ID NO: 693351 - RNA, 22 nt, Human
aaccaacauaggaaugcagaga

SEQ ID NO: 693352 - RNA, 22 nt, Human
cacagggcagagaccugggugc

SEQ ID NO: 693353 - RNA, 22 nt, Human
uccagggcuguuacuuuacaua

SEQ ID NO: 693354 - RNA, 17 nt, Human
ugcuuggcuucuuuagg

SEQ ID NO: 693355 - RNA, 22 nt, Human
uugggguaaggaaauauggcuu

SEQ ID NO: 693356 - RNA, 22 nt, Human
cauaacuagagugaaauguuga

SEQ ID NO: 693357 - RNA, 22 nt, Human
uccugggaggcaggaccccuuu

SEQ ID NO: 693358 - RNA, 22 nt, Human
cagauucuccaggggcugcaga

SEQ ID NO: 693359 - RNA, 22 nt, Human
agcagagccagaauuggaccag

SEQ ID NO: 693360 - RNA, 22 nt, Human
uuacauggauguaaaaaaguua

SEQ ID NO: 693361 - RNA, 22 nt, Human
cugggcaaauugugccagcuau

SEQ ID NO: 693362 - RNA, 22 nt, Human
ucugugucagaagauaucaugg

SEQ ID NO: 693363 - RNA, 22 nt, Human
gcugguuagaaaacagagcuca

SEQ ID NO: 693364 - RNA, 21 nt, Human
gaagacaaaugggaauagcug

SEQ ID NO: 693365 - RNA, 22 nt, Human
gcagagauaaguagacaggaug

SEQ ID NO: 693366 - RNA, 22 nt, Human
cucccaggugucccuucugcca

SEQ ID NO: 693367 - RNA, 22 nt, Human
gugcagcaaacuagugcgaggg

SEQ ID NO: 693368 - RNA, 22 nt, Human
ucugagugaguguaggccugac

SEQ ID NO: 693369 - RNA, 22 nt, Human
gucaggacauuuuaccauccug

SEQ ID NO: 693370 - RNA, 22 nt, Human
ccucacugucacuuauaguggu

SEQ ID NO: 693371 - RNA, 22 nt, Human
agucaaaacauguacuuuccuu

SEQ ID NO: 693372 - RNA, 22 nt, Human
acuguggagcaguggcuaggga

SEQ ID NO: 693373 - RNA, 20 nt, Human
uggaaggcaucugcauuauu

SEQ ID NO: 693374 - RNA, 22 nt, Human
gggaugagaguagggugugaaa

SEQ ID NO: 693375 - RNA, 22 nt, Human
uuuugcuuuuguaacacagugu

SEQ ID NO: 693376 - RNA, 22 nt, Human
augcaugugugaauuauuugac

SEQ ID NO: 693377 - RNA, 22 nt, Human
uauguguaaucaaacacaugcu

SEQ ID NO: 693378 - RNA, 22 nt, Human
ugcuaagcugaggaagaugaga

SEQ ID NO: 693379 - RNA, 22 nt, Human
gaguggagaucgugccacugca

SEQ ID NO: 693380 - RNA, 22 nt, Human
gggcaagcacagcgagcgugcg

SEQ ID NO: 693381 - RNA, 22 nt, Human
ccagaugguauaguagggagag

SEQ ID NO: 693382 - RNA, 20 nt, Human
ccuagggcaagugggugggc

SEQ ID NO: 693383 - RNA, 22 nt, Human
augaauuuuucuaagcuuuugu

SEQ ID NO: 693384 - RNA, 22 nt, Human
agagaaucugggaagauguuaa

SEQ ID NO: 693385 - RNA, 22 nt, Human
uagcaaaauguggauguaguug

SEQ ID NO: 693386 - RNA, 22 nt, Human
auguguuggauauuagugggga

SEQ ID NO: 693387 - RNA, 22 nt, Human
uaccagccugacccugucugac

SEQ ID NO: 693388 - RNA, 22 nt, Human
gauccuguuauaauuuggaugu

SEQ ID NO: 693389 - RNA, 22 nt, Human
ugugcuucuugcagcuccugua

SEQ ID NO: 693390 - RNA, 22 nt, Human
gcagaggagaugaagauacuuu

SEQ ID NO: 693391 - RNA, 22 nt, Human
uacagcaaagaaacccucaguc

SEQ ID NO: 693392 - RNA, 22 nt, Human
cagucuaaguuaauuuccacaa

SEQ ID NO: 693393 - RNA, 22 nt, Human
aggcugagcaaagggccuuacc

SEQ ID NO: 693394 - RNA, 22 nt, Human
uuuuccuucugauacuccauuu

SEQ ID NO: 693395 - RNA, 22 nt, Human
cagagguugagcaaaaaugaua

SEQ ID NO: 693396 - RNA, 22 nt, Human
aaacaagagcuuacauggcugc

SEQ ID NO: 693397 - RNA, 22 nt, Human
ugcugagaaucacagguuauaa

SEQ ID NO: 693398 - RNA, 22 nt, Human
cuggcuaaagagcaagaagaug

SEQ ID NO: 693399 - RNA, 22 nt, Human
uccaccaggcuccauguucagu

SEQ ID NO: 693400 - RNA, 22 nt, Human
cuguggcaagucugccugucac

SEQ ID NO: 693401 - RNA, 23 nt, Human
uaagacacccgacuccagagaug

SEQ ID NO: 693402 - RNA, 22 nt, Human
gcccugagccuaugagccucuc

SEQ ID NO: 693403 - RNA, 22 nt, Human
gaugucuucccauguucaugug

SEQ ID NO: 693404 - RNA, 22 nt, Human
gagcagcucugggugacccagu

SEQ ID NO: 693405 - RNA, 19 nt, Human
cuccagaauacauguuccu

SEQ ID NO: 693406 - RNA, 22 nt, Human
cagaacuucauauugacguuag

SEQ ID NO: 693407 - RNA, 22 nt, Human
ugcagcugaggccagcuaugcc

SEQ ID NO: 693408 - RNA, 22 nt, Human
aagcacugaggaaaaauuugau

SEQ ID NO: 693409 - RNA, 22 nt, Human
acugggcaugaugagucaccua

SEQ ID NO: 693410 - RNA, 22 nt, Human
ucagcuccucagagccucaguu

SEQ ID NO: 693411 - RNA, 22 nt, Human
caccauuuucuaaaaauaugac

SEQ ID NO: 693412 - RNA, 22 nt, Human
ugcacacacucguguauaugag

SEQ ID NO: 693413 - RNA, 22 nt, Human
caguaauagaggcuuugagucu

SEQ ID NO: 693414 - RNA, 22 nt, Human
ucagcaagcagggggauguuca

SEQ ID NO: 693415 - RNA, 18 nt, Human
ggacuacaggcacaggga

SEQ ID NO: 693416 - RNA, 22 nt, Human
uucugcuugguucuugguauga

SEQ ID NO: 693417 - RNA, 22 nt, Human
acacaguaggccaccaugucau

SEQ ID NO: 693418 - RNA, 22 nt, Human
uugagacagugggguguugccg

SEQ ID NO: 693419 - RNA, 22 nt, Human
gggcuccaggcaggcaggaaau

SEQ ID NO: 693420 - RNA, 22 nt, Human
cucucuggauauuuguaugcug

SEQ ID NO: 693421 - RNA, 22 nt, Human
aacaucuacuaagugccaggca

SEQ ID NO: 693422 - RNA, 22 nt, Human
uuaaguaacuuguccaaaugag

SEQ ID NO: 693423 - RNA, 22 nt, Human
aagacuuucaaguaugcaugca

SEQ ID NO: 693424 - RNA, 22 nt, Human
acagugugcaagaaauggggga

SEQ ID NO: 693425 - RNA, 22 nt, Human
cagucaccuagacagaacuuac

SEQ ID NO: 693426 - RNA, 22 nt, Human
acugaagucucuuuuguucucu

SEQ ID NO: 693427 - RNA, 22 nt, Human
gcugcuguacuuggggggugcu

SEQ ID NO: 693428 - RNA, 22 nt, Human
ucaucuucuauuaauagggaga

SEQ ID NO: 693429 - RNA, 22 nt, Human
agauaacuuuuggguauucaug

SEQ ID NO: 693430 - RNA, 22 nt, Human
cucagccagacaugacccaguc

SEQ ID NO: 693431 - RNA, 22 nt, Human
acuuuuaucaaggaagugaucu

SEQ ID NO: 693432 - RNA, 22 nt, Human
agcaggcuaagggaccuguuua

SEQ ID NO: 693433 - RNA, 22 nt, Human
ugccugaguuuaacccucagag

SEQ ID NO: 693434 - RNA, 22 nt, Human
ugccagggucagcugcagcucu

SEQ ID NO: 693435 - RNA, 22 nt, Human
caaucacaaagagacaaguguc

SEQ ID NO: 693436 - RNA, 22 nt, Human
ugagcaaaaguugauggugcuu

SEQ ID NO: 693437 - RNA, 22 nt, Human
ccugcauccgaaagugaucaua

SEQ ID NO: 693438 - RNA, 22 nt, Human
uggccaggggaguuccccucca

SEQ ID NO: 693439 - RNA, 22 nt, Human
gcugugagcacugcugggugga

SEQ ID NO: 693440 - RNA, 22 nt, Human
ggguggcaucucucugagcugu

SEQ ID NO: 693441 - RNA, 20 nt, Human
caguccaggcuagaaaacaa

SEQ ID NO: 693442 - RNA, 23 nt, Human
uuuuuugucuugcuaggcugccc

SEQ ID NO: 693443 - RNA, 22 nt, Human
aucagcaaucucguguauuagg

SEQ ID NO: 693444 - RNA, 22 nt, Human
uguuuuuaucucuguguacaac

SEQ ID NO: 693445 - RNA, 19 nt, Human
uacaaugauguuaccuuug

SEQ ID NO: 693446 - RNA, 22 nt, Human
ucuuugugccaugcagugaggc

SEQ ID NO: 693447 - RNA, 22 nt, Human
uaggcaaguggaccagagguuu

SEQ ID NO: 693448 - RNA, 22 nt, Human
ucauuuguugcuguuaccugag

SEQ ID NO: 693449 - RNA, 22 nt, Human
gucuggaaaggggcuuuuaucu

SEQ ID NO: 693450 - RNA, 22 nt, Human
ggggccagcuucgcgugcucuu

SEQ ID NO: 693451 - RNA, 22 nt, Human
aaaaguauuggccaccauuucu

SEQ ID NO: 693452 - RNA, 22 nt, Human
uuccugagggccccagaggagg

SEQ ID NO: 693453 - RNA, 22 nt, Human
uuuaaggaggggcucacguggg

SEQ ID NO: 693454 - RNA, 22 nt, Human
uccagggagauggcagaggcug

SEQ ID NO: 693455 - RNA, 22 nt, Human
aacaaucuguucgauagaaaau

SEQ ID NO: 693456 - RNA, 22 nt, Human
ugcccauguuucucuguauccc

SEQ ID NO: 693457 - RNA, 22 nt, Human
cuuuagaauuucauguuugguc

SEQ ID NO: 693458 - RNA, 22 nt, Human
gugcugccuccauauccgucag

SEQ ID NO: 693459 - RNA, 20 nt, Human
guauauaaccauagugacua

SEQ ID NO: 693460 - RNA, 22 nt, Human
gguuugcacgauauuuccaugg

SEQ ID NO: 693461 - RNA, 21 nt, Human
gaaaauacaaugagcuugacc

SEQ ID NO: 693462 - RNA, 22 nt, Human
gagguggauguugcagugagcu

SEQ ID NO: 693463 - RNA, 22 nt, Human
augaaaauacugugguugauag

SEQ ID NO: 693464 - RNA, 22 nt, Human
uguucuuugccagugauuuaau

SEQ ID NO: 693465 - RNA, 22 nt, Human
uccuuagagauacugucuugaa

SEQ ID NO: 693466 - RNA, 22 nt, Human
ucucuguaagagaggcuuucau

SEQ ID NO: 693467 - RNA, 22 nt, Human
ccugggagaacugcuggguugg

SEQ ID NO: 693468 - RNA, 23 nt, Human
cuuguuauaagaagacugucugg

SEQ ID NO: 693469 - RNA, 22 nt, Human
uguuucuucucacacaaacuca

SEQ ID NO: 693470 - RNA, 22 nt, Human
ggagcucugaggaugcauuggu

SEQ ID NO: 693471 - RNA, 22 nt, Human
caggccaaaauucaggcauucu

SEQ ID NO: 693472 - RNA, 22 nt, Human
gccuaauaugcaaaauugauac

SEQ ID NO: 693473 - RNA, 22 nt, Human
uuccaguucccaugaggauuaa

SEQ ID NO: 693474 - RNA, 22 nt, Human
ggcagguggaaggucuccauuc

SEQ ID NO: 693475 - RNA, 22 nt, Human
ucucaugcaugcauaagucuag

SEQ ID NO: 693476 - RNA, 22 nt, Human
ggcaggcucagcagccaaggag

SEQ ID NO: 693477 - RNA, 20 nt, Human
uggccucuguagaggccaag

SEQ ID NO: 693478 - RNA, 22 nt, Human
aggcuucauuguggcaucagga

SEQ ID NO: 693479 - RNA, 22 nt, Human
aaucuuuaaggacucagucucu

SEQ ID NO: 693480 - RNA, 22 nt, Human
caagagacuuauguggaaaccu

SEQ ID NO: 693481 - RNA, 22 nt, Human
auguaacauaugugaucgcauu

SEQ ID NO: 693482 - RNA, 22 nt, Human
augcacaagcaagagauaaugg

SEQ ID NO: 693483 - RNA, 22 nt, Human
uaucucuagcgcacagaagaaa

SEQ ID NO: 693484 - RNA, 22 nt, Human
gacagacagagaaugggcuuga

SEQ ID NO: 693485 - RNA, 22 nt, Human
ccugccagaaaagagggaguuc

SEQ ID NO: 693486 - RNA, 22 nt, Human
cagugaguugugcugaggacca

SEQ ID NO: 693487 - RNA, 22 nt, Human
aagaugauguuguguuuucacu

SEQ ID NO: 693488 - RNA, 22 nt, Human
uuucaaacuaugugucaggcag

SEQ ID NO: 693489 - RNA, 22 nt, Human
ggugaggggcgccucugcccag

SEQ ID NO: 693490 - RNA, 22 nt, Human
gucugggcagcagcauuucuua

SEQ ID NO: 693491 - RNA, 22 nt, Human
ucacucaagcaucuacagggau

SEQ ID NO: 693492 - RNA, 22 nt, Human
guccuuaacaaacggggaaaag

SEQ ID NO: 693493 - RNA, 22 nt, Human
aaagcucuuuuccaaguauuga

SEQ ID NO: 693494 - RNA, 22 nt, Human
gacuaaauaaaagccaaacuuc

SEQ ID NO: 693495 - RNA, 22 nt, Human
ggcuccaaagggcagugugagg

SEQ ID NO: 693496 - RNA, 22 nt, Human
cccugacccaaaacugucagaa

SEQ ID NO: 693497 - RNA, 22 nt, Human
cagcaucuguucccaacgagau

SEQ ID NO: 693498 - RNA, 22 nt, Human
aaggaggacacccaggacuggg

SEQ ID NO: 693499 - RNA, 22 nt, Human
uuccauaaaggugauaguauac

SEQ ID NO: 693500 - RNA, 22 nt, Human
ggacacagcugcagccacaccc

SEQ ID NO: 693501 - RNA, 22 nt, Human
agguacauggggugugugcacg

SEQ ID NO: 693502 - RNA, 22 nt, Human
cccaggagagagacuugaaucu

SEQ ID NO: 693503 - RNA, 22 nt, Human
ucagaggugguaaaggacagca

SEQ ID NO: 693504 - RNA, 22 nt, Human
aggagcuggguuccuuuggugg

SEQ ID NO: 693505 - RNA, 22 nt, Human
uugaaagacuucuccugugaaa

SEQ ID NO: 693506 - RNA, 22 nt, Human
ucugagcucuaucugugggaau

SEQ ID NO: 693507 - RNA, 19 nt, Human
ggcacuggggccaggacca

SEQ ID NO: 693508 - RNA, 22 nt, Human
uucaaaauccgggaggcgcccc

SEQ ID NO: 693509 - RNA, 22 nt, Human
uacccaaggcccuuucaauuuc

SEQ ID NO: 693510 - RNA, 22 nt, Human
ggggccagauaucacuaagguu

SEQ ID NO: 693511 - RNA, 22 nt, Human
cuggcugcgcuaguccagaaga

SEQ ID NO: 693512 - RNA, 18 nt, Human
gcaacaguaucagcaggc

SEQ ID NO: 693513 - RNA, 21 nt, Human
aggagcuggagaaaacuuucc

SEQ ID NO: 693514 - RNA, 22 nt, Human
auggaaagggaagcaaggaaca

SEQ ID NO: 693515 - RNA, 22 nt, Human
accaccucaucaagcuggauug

SEQ ID NO: 693516 - RNA, 22 nt, Human
cuggaucugucuuuuggauccc

SEQ ID NO: 693517 - RNA, 22 nt, Human
gacacagaaggucacauguuca

SEQ ID NO: 693518 - RNA, 22 nt, Human
agcacagaguugcucacugccg

SEQ ID NO: 693519 - RNA, 22 nt, Human
uuaugcaaaggggccucuuccu

SEQ ID NO: 693520 - RNA, 22 nt, Human
gcccauggucagggaggcaggg

SEQ ID NO: 693521 - RNA, 22 nt, Human
ucagcauucuuuacaaggauga

SEQ ID NO: 693522 - RNA, 22 nt, Human
cugcaaaggugggggaggagcu

SEQ ID NO: 693523 - RNA, 22 nt, Human
uauuuaauuugcucauugugau

SEQ ID NO: 693524 - RNA, 22 nt, Human
ggcugagaacaggcccagccuc

SEQ ID NO: 693525 - RNA, 22 nt, Human
uuuaucuuuggaucuucagaaa

SEQ ID NO: 693526 - RNA, 22 nt, Human
uggcucuguugagguauggauu

SEQ ID NO: 693527 - RNA, 20 nt, Human
gcuggaagggcuagagggcu

SEQ ID NO: 693528 - RNA, 22 nt, Human
gcaaauguggcuuccuuucuag

SEQ ID NO: 693529 - RNA, 22 nt, Human
acacaggacggcccuguggcuu

SEQ ID NO: 693530 - RNA, 20 nt, Human
aggaagauccuuucuuuuaa

SEQ ID NO: 693531 - RNA, 22 nt, Human
guccaaguacauguguguacau

SEQ ID NO: 693532 - RNA, 21 nt, Human
acagagccgggcacaaagcug

SEQ ID NO: 693533 - RNA, 20 nt, Human
auacacauucauagaaaaau

SEQ ID NO: 693534 - RNA, 22 nt, Human
guuuuauuuccaugagagaccg

SEQ ID NO: 693535 - RNA, 22 nt, Human
cuccugggucauugccagcaaa

SEQ ID NO: 693536 - RNA, 22 nt, Human
ugggccaguuggugacuacaaa

SEQ ID NO: 693537 - RNA, 22 nt, Human
uccaggagugugugcuaauggg

SEQ ID NO: 693538 - RNA, 22 nt, Human
cuguaugaggaucagacuggac

SEQ ID NO: 693539 - RNA, 22 nt, Human
aucuggcucauucagggaacgg

SEQ ID NO: 693540 - RNA, 22 nt, Human
ucugaaagaagggcagucuuuu

SEQ ID NO: 693541 - RNA, 22 nt, Human
auuggcauacuuucuauauuca

SEQ ID NO: 693542 - RNA, 22 nt, Human
uugggcuggcagagguggucuu

SEQ ID NO: 693543 - RNA, 22 nt, Human
cugacugucucuucucccauga

SEQ ID NO: 693544 - RNA, 22 nt, Human
caaaugcaggucagcagguguc

SEQ ID NO: 693545 - RNA, 22 nt, Human
agaggcuaggaccauguaucau

SEQ ID NO: 693546 - RNA, 19 nt, Human
cuuggagaaggcuaugacc

SEQ ID NO: 693547 - RNA, 22 nt, Human
uuguuaaaauauuggagaaagg

SEQ ID NO: 693548 - RNA, 22 nt, Human
uaguuuagagaauuggggauga

SEQ ID NO: 693549 - RNA, 22 nt, Human
acagagguuaggauggguugua

SEQ ID NO: 693550 - RNA, 20 nt, Human
caggcaguuugugguuaggg

SEQ ID NO: 693551 - RNA, 22 nt, Human
uucucucuuacugccaugcugu

SEQ ID NO: 693552 - RNA, 22 nt, Human
aaacugguaaucggcaagugag

SEQ ID NO: 693553 - RNA, 22 nt, Human
uaugcacacauguaugcaugug

SEQ ID NO: 693554 - RNA, 22 nt, Human
ccacagugggcacagcaggacu

SEQ ID NO: 693555 - RNA, 22 nt, Human
aucucuguaauuacaugauauu

SEQ ID NO: 693556 - RNA, 22 nt, Human
aguuuucugggaucacuggaau

SEQ ID NO: 693557 - RNA, 20 nt, Human
uggcccaguggggcagggug

SEQ ID NO: 693558 - RNA, 22 nt, Human
acugagggguuggagagugagg

SEQ ID NO: 693559 - RNA, 22 nt, Human
ugaaaucuuauacuuugguagu

SEQ ID NO: 693560 - RNA, 22 nt, Human
uucugaaggucagcagcuuggu

SEQ ID NO: 693561 - RNA, 22 nt, Human
gggccccacuggggcugccugc

SEQ ID NO: 693562 - RNA, 22 nt, Human
cuuagggagaaugccucugcag

SEQ ID NO: 693563 - RNA, 22 nt, Human
aagcugauucuaaaauuuauua

SEQ ID NO: 693564 - RNA, 22 nt, Human
agacuugggaccuaggaaugga

SEQ ID NO: 693565 - RNA, 22 nt, Human
ucucagaguuugaaucuggagu

SEQ ID NO: 693566 - RNA, 22 nt, Human
cugagcugcaguccuggcucug

SEQ ID NO: 693567 - RNA, 22 nt, Human
aaaauagauucuaggaugucuu

SEQ ID NO: 693568 - RNA, 22 nt, Human
ucauggaauagagcaguggcaa

SEQ ID NO: 693569 - RNA, 22 nt, Human
ucccuucaagauuuggggaaau

SEQ ID NO: 693570 - RNA, 22 nt, Human
gcucuggugaguguaguucagg

SEQ ID NO: 693571 - RNA, 22 nt, Human
uauuagcacaaagcaagguauu

SEQ ID NO: 693572 - RNA, 22 nt, Human
ggcugccugccgcccacuuggc

SEQ ID NO: 693573 - RNA, 22 nt, Human
gccaucugcgcgguguccagcu

SEQ ID NO: 693574 - RNA, 22 nt, Human
auuagugauaugugacuagacc

SEQ ID NO: 693575 - RNA, 22 nt, Human
aggagguggcugaacuugaggg

SEQ ID NO: 693576 - RNA, 22 nt, Human
ugcacacacaugaaguagcaug

SEQ ID NO: 693577 - RNA, 22 nt, Human
agggcuccaaggaaguguagcu

SEQ ID NO: 693578 - RNA, 22 nt, Human
uggaagcaucacuucuugccug

SEQ ID NO: 693579 - RNA, 22 nt, Human
uucagagaguccaguaugcagu

SEQ ID NO: 693580 - RNA, 20 nt, Human
uggcugcccgaggcacacac

SEQ ID NO: 693581 - RNA, 22 nt, Human
uuucacaaguaaaguccuaagu

SEQ ID NO: 693582 - RNA, 22 nt, Human
ggccagcccuccucccuggguu

SEQ ID NO: 693583 - RNA, 22 nt, Human
uuugguuuauuaaauuguaggc

SEQ ID NO: 693584 - RNA, 22 nt, Human
ccaaucuugcuguccacuuggu

SEQ ID NO: 693585 - RNA, 22 nt, Human
cccaggcucacuguccgcuucc

SEQ ID NO: 693586 - RNA, 22 nt, Human
gcaguccugggauucuguccuu

SEQ ID NO: 693587 - RNA, 22 nt, Human
gccugcagggccugggccuacc

SEQ ID NO: 693588 - RNA, 21 nt, Human
ugaguuucagaggggaaggaa

SEQ ID NO: 693589 - RNA, 22 nt, Human
auuugcaggugucgauuagucu

SEQ ID NO: 693590 - RNA, 22 nt, Human
gguguugcaguugaagacuggu

SEQ ID NO: 693591 - RNA, 22 nt, Human
gcaguguuacuugguuugcaga

SEQ ID NO: 693592 - RNA, 22 nt, Human
cugcugacucuuccuggaguga

SEQ ID NO: 693593 - RNA, 22 nt, Human
cagacacaccaggcccauucug

SEQ ID NO: 693594 - RNA, 23 nt, Human
gggaagcuccauggaggugcugg

SEQ ID NO: 693595 - RNA, 22 nt, Human
ucaaugucagcugguaggaaau

SEQ ID NO: 693596 - RNA, 22 nt, Human
aguggaaggcugggaaaugcgg

SEQ ID NO: 693597 - RNA, 22 nt, Human
gaaagaccguuugggcucuaaa

SEQ ID NO: 693598 - RNA, 22 nt, Human
uacacaugaucauuuaguagca

SEQ ID NO: 693599 - RNA, 22 nt, Human
ccaaauagucuuucauugaauu

SEQ ID NO: 693600 - RNA, 22 nt, Human
aucauguuccagaaacagugau

SEQ ID NO: 693601 - RNA, 22 nt, Human
aggaagcuagagccaccggacu

SEQ ID NO: 693602 - RNA, 22 nt, Human
auauuuuccgaacuugagguag

SEQ ID NO: 693603 - RNA, 22 nt, Human
ucauuacaguguuuauaugucu

SEQ ID NO: 693604 - RNA, 20 nt, Human
gcacuguuacaaagcacacc

SEQ ID NO: 693605 - RNA, 22 nt, Human
agucucugccagcuuguccucu

SEQ ID NO: 693606 - RNA, 22 nt, Human
gcugucuugcucacucuugcag

SEQ ID NO: 693607 - RNA, 22 nt, Human
augaagcugaccuugucuugcu

SEQ ID NO: 693608 - RNA, 22 nt, Human
gcugguccacucccuggaggcu

SEQ ID NO: 693609 - RNA, 22 nt, Human
cacagaggaaaugacuuucuua

SEQ ID NO: 693610 - RNA, 22 nt, Human
acagaaugcagagaugcccaga

SEQ ID NO: 693611 - RNA, 22 nt, Human
uauuaugaucgugacucaagga

SEQ ID NO: 693612 - RNA, 22 nt, Human
caggcucccacaagcucccagc

SEQ ID NO: 693613 - RNA, 17 nt, Human
agcagcugaagcagcca

SEQ ID NO: 693614 - RNA, 22 nt, Human
cuaacugucaugcacauguguu

SEQ ID NO: 693615 - RNA, 22 nt, Human
ccacacagggggaugaguuauu

SEQ ID NO: 693616 - RNA, 22 nt, Human
aucuucaacuuuggggcugccu

SEQ ID NO: 693617 - RNA, 22 nt, Human
caguaaaugagaagcuaguaau

SEQ ID NO: 693618 - RNA, 21 nt, Human
uccauuguuuucccaggguuu

SEQ ID NO: 693619 - RNA, 22 nt, Human
accugcucaacuggcuucucgc

SEQ ID NO: 693620 - RNA, 17 nt, Human
uuccaguuuaguauugu

SEQ ID NO: 693621 - RNA, 22 nt, Human
ccucugacuccuggacuugggg

SEQ ID NO: 693622 - RNA, 22 nt, Human
ugcacaucuuucagcaucauac

SEQ ID NO: 693623 - RNA, 22 nt, Human
aagauccaugagggcagagauu

SEQ ID NO: 693624 - RNA, 22 nt, Human
uauacagcuauggcaagacaaa

SEQ ID NO: 693625 - RNA, 22 nt, Human
augaguuaggggccugagugga

SEQ ID NO: 693626 - RNA, 22 nt, Human
acauauguguuguacaugcaug

SEQ ID NO: 693627 - RNA, 22 nt, Human
uggccuccccuaacagccucuu

SEQ ID NO: 693628 - RNA, 22 nt, Human
cuguccaucagaaaggggcuua

SEQ ID NO: 693629 - RNA, 22 nt, Human
ugcaugcaugauguuugguagc

SEQ ID NO: 693630 - RNA, 22 nt, Human
aggugucuggauggguguccuu

SEQ ID NO: 693631 - RNA, 22 nt, Human
gugaacuauuggguaucauaaa

SEQ ID NO: 693632 - RNA, 22 nt, Human
aggucuggcucuucuccacaga

SEQ ID NO: 693633 - RNA, 22 nt, Human
uagggcagaguccaggaugggc

SEQ ID NO: 693634 - RNA, 22 nt, Human
ccuagucuuccgcguccccacc

SEQ ID NO: 693635 - RNA, 22 nt, Human
uuuugucuaagaacuuugcaaa

SEQ ID NO: 693636 - RNA, 20 nt, Human
uaacacuugcuuuuugacuu

SEQ ID NO: 693637 - RNA, 22 nt, Human
uuccagcacagaaguauacauu

SEQ ID NO: 693638 - RNA, 22 nt, Human
ugccugucuuggaguccuggcc

SEQ ID NO: 693639 - RNA, 22 nt, Human
ggccugcuggggccucagacac

SEQ ID NO: 693640 - RNA, 22 nt, Human
ugcugggcuggagcugccaggg

SEQ ID NO: 693641 - RNA, 22 nt, Human
ucguaugcucucuguguccugu

SEQ ID NO: 693642 - RNA, 19 nt, Human
guucaaacacugauucagc

SEQ ID NO: 693643 - RNA, 19 nt, Human
uggcuucuguuuucauguu

SEQ ID NO: 693644 - RNA, 22 nt, Human
agguaguguagcugagugggau

SEQ ID NO: 693645 - RNA, 22 nt, Human
aagcugccacacggugaguacu

SEQ ID NO: 693646 - RNA, 20 nt, Human
cuuguuaaauaugcagguag

SEQ ID NO: 693647 - RNA, 18 nt, Human
gggcacuggggacuggag

SEQ ID NO: 693648 - RNA, 22 nt, Human
cugccugguacuuuaggcacuu

SEQ ID NO: 693649 - RNA, 22 nt, Human
uuucaaacuguacuuuccccua

SEQ ID NO: 693650 - RNA, 22 nt, Human
ugcugccaccccucaccagagc

SEQ ID NO: 693651 - RNA, 22 nt, Human
ucucugagggagauggccugcc

SEQ ID NO: 693652 - RNA, 22 nt, Human
ggacagaggguugacagaguau

SEQ ID NO: 693653 - RNA, 22 nt, Human
agugacaggaccaggucuggaa

SEQ ID NO: 693654 - RNA, 22 nt, Human
ucuuuucuagcaaauccaggag

SEQ ID NO: 693655 - RNA, 22 nt, Human
aauuucucauggauucaguuau

SEQ ID NO: 693656 - RNA, 22 nt, Human
agaugcagaaaaacuaagugau

SEQ ID NO: 693657 - RNA, 22 nt, Human
cugcccugcccaggccuugggc

SEQ ID NO: 693658 - RNA, 22 nt, Human
aaagguuuucugacccuuagua

SEQ ID NO: 693659 - RNA, 22 nt, Human
ugaucaaagccaaaguugagau

SEQ ID NO: 693660 - RNA, 20 nt, Human
aaaggcacagcaacagagcu

SEQ ID NO: 693661 - RNA, 22 nt, Human
augcuuaauacacuguuaaagg

SEQ ID NO: 693662 - RNA, 22 nt, Human
uuugaacuguucuaggauuuaa

SEQ ID NO: 693663 - RNA, 22 nt, Human
ucucuguaucagcaccugcugg

SEQ ID NO: 693664 - RNA, 22 nt, Human
cagagucagcuagucuugggau

SEQ ID NO: 693665 - RNA, 18 nt, Human
aagauguuuaaugggaag

SEQ ID NO: 693666 - RNA, 22 nt, Human
cuggccccgguuccuaaaaacc

SEQ ID NO: 693667 - RNA, 22 nt, Human
ucugcaagcgucacaugauucu

SEQ ID NO: 693668 - RNA, 22 nt, Human
aaucuuuugauucuagggcugu

SEQ ID NO: 693669 - RNA, 22 nt, Human
uaaaugugucuuuuuaaggccu

SEQ ID NO: 693670 - RNA, 23 nt, Human
gaggaccaaauauauacauggaa

SEQ ID NO: 693671 - RNA, 22 nt, Human
gcaaagaaagccaaggucuaac

SEQ ID NO: 693672 - RNA, 23 nt, Human
uugcacugaucaauuugauaagc

SEQ ID NO: 693673 - RNA, 19 nt, Human
cugagcaggcagguaggau

SEQ ID NO: 693674 - RNA, 22 nt, Human
ucacacagcuuggaguuauggu

SEQ ID NO: 693675 - RNA, 22 nt, Human
ggagcugggacccugucaucug

SEQ ID NO: 693676 - RNA, 22 nt, Human
aagaccauuuaauggagaaaga

SEQ ID NO: 693677 - RNA, 22 nt, Human
cagugcaauguuaaauaggaaa

SEQ ID NO: 693678 - RNA, 22 nt, Human
ucuggggagcagcccuggugag

SEQ ID NO: 693679 - RNA, 22 nt, Human
auuccucauuauuuacugagga

SEQ ID NO: 693680 - RNA, 22 nt, Human
auggaucagaaucccgggaggg

SEQ ID NO: 693681 - RNA, 22 nt, Human
cucaggaucgcuugcccuaggg

SEQ ID NO: 693682 - RNA, 22 nt, Human
uaguccagguuaaucccugccu

SEQ ID NO: 693683 - RNA, 22 nt, Human
augcauaugcaaugcacaauuu

SEQ ID NO: 693684 - RNA, 22 nt, Human
ugaggagcgggcagggaugcag

SEQ ID NO: 693685 - RNA, 22 nt, Human
agugcuuucagugugcucuuuu

SEQ ID NO: 693686 - RNA, 22 nt, Human
augaaaguguuuaaguuuaugu

SEQ ID NO: 693687 - RNA, 22 nt, Human
auucuauagacagaaggucaau

SEQ ID NO: 693688 - RNA, 22 nt, Human
gggcacagcugcuacccagugc

SEQ ID NO: 693689 - RNA, 22 nt, Human
acacauugcagacaucucauua

SEQ ID NO: 693690 - RNA, 19 nt, Human
ccaguccucuuugggccug

SEQ ID NO: 693691 - RNA, 22 nt, Human
guggcuucuggcugggccucag

SEQ ID NO: 693692 - RNA, 20 nt, Human
agaaccuaaguuaaaacaca

SEQ ID NO: 693693 - RNA, 21 nt, Human
accuuuggguguuuauaauag

SEQ ID NO: 693694 - RNA, 22 nt, Human
auagauauuagcaaaauuuuau

SEQ ID NO: 693695 - RNA, 22 nt, Human
auagacaaugguuugccaagaa

SEQ ID NO: 693696 - RNA, 17 nt, Human
cugaaauauuaugauaa

SEQ ID NO: 693697 - RNA, 20 nt, Human
uaucaguaggauauucugcc

SEQ ID NO: 693698 - RNA, 22 nt, Human
acaauuugugucuuuugcuuau

SEQ ID NO: 693699 - RNA, 22 nt, Human
aguuuagacaaagucuugcauu

SEQ ID NO: 693700 - RNA, 22 nt, Human
uccuggccagaggacaaagcug

SEQ ID NO: 693701 - RNA, 19 nt, Human
auggccaguuuagagguuu

SEQ ID NO: 693702 - RNA, 22 nt, Human
aguugacauccagagacauucu

SEQ ID NO: 693703 - RNA, 22 nt, Human
caguccucucugugucugcacc

SEQ ID NO: 693704 - RNA, 22 nt, Human
auugguuuuguuaucuccauuc

SEQ ID NO: 693705 - RNA, 22 nt, Human
gaagugcaaccugaaauacuag

SEQ ID NO: 693706 - RNA, 22 nt, Human
ugugaaagauacuaggcagagg

SEQ ID NO: 693707 - RNA, 22 nt, Human
agcugguguccuccuggagcug

SEQ ID NO: 693708 - RNA, 22 nt, Human
ucuucagcucugaggcucuggc

SEQ ID NO: 693709 - RNA, 22 nt, Human
aagagagacaauagguagcauu

SEQ ID NO: 693710 - RNA, 22 nt, Human
caucagcucuucauucuugauu

SEQ ID NO: 693711 - RNA, 22 nt, Human
ucuuagaaugucaacugauguu

SEQ ID NO: 693712 - RNA, 22 nt, Human
uggauggggcagcuuaggugug

SEQ ID NO: 693713 - RNA, 18 nt, Human
gugugcaguugcaggggu

SEQ ID NO: 693714 - RNA, 22 nt, Human
agggcugcaucugccuggugaa

SEQ ID NO: 693715 - RNA, 22 nt, Human
ggagucaccaaguaggagucuu

SEQ ID NO: 693716 - RNA, 22 nt, Human
ccugaggucagccauucuugcc

SEQ ID NO: 693717 - RNA, 22 nt, Human
aucuuuuuugucuuggucacug

SEQ ID NO: 693718 - RNA, 17 nt, Human
uaaccucucugaaccug

SEQ ID NO: 693719 - RNA, 22 nt, Human
gccuggagccucagcaaggagg

SEQ ID NO: 693720 - RNA, 22 nt, Human
uuagaguuuuuguaaguacaau

SEQ ID NO: 693721 - RNA, 22 nt, Human
gggcugcuuuuaagggucucag

SEQ ID NO: 693722 - RNA, 22 nt, Human
ucacaucugccuccauagcacc

SEQ ID NO: 693723 - RNA, 22 nt, Human
uccagagccugggguuuguaac

SEQ ID NO: 693724 - RNA, 22 nt, Human
cuuugggcaaagggccaauucg

SEQ ID NO: 693725 - RNA, 23 nt, Human
gggcuucauuuuaauucagcugc

SEQ ID NO: 693726 - RNA, 22 nt, Human
cccagccugaucucggccagcu

SEQ ID NO: 693727 - RNA, 22 nt, Human
uguuuuaagagcgcacuuuaua

SEQ ID NO: 693728 - RNA, 22 nt, Human
gcccaggaguuggaggcugcag

SEQ ID NO: 693729 - RNA, 22 nt, Human
ggcucagagguugaggccggca

SEQ ID NO: 693730 - RNA, 22 nt, Human
uauuuugcuuuagcugacuguu

SEQ ID NO: 693731 - RNA, 22 nt, Human
cauuuaaucuggcucaugagca

SEQ ID NO: 693732 - RNA, 22 nt, Human
cguguuucagccagggccaccu

SEQ ID NO: 693733 - RNA, 22 nt, Human
ugaguucugacugugaugccag

SEQ ID NO: 693734 - RNA, 22 nt, Human
uaguggaguagaaaccaaagaa

SEQ ID NO: 693735 - RNA, 22 nt, Human
gaauugcuaauccaagugacug

SEQ ID NO: 693736 - RNA, 22 nt, Human
ggagucugacucugacccugga

SEQ ID NO: 693737 - RNA, 22 nt, Human
caucuuuuggccuauucugagg

SEQ ID NO: 693738 - RNA, 22 nt, Human
gucauucagagaugcagguaga

SEQ ID NO: 693739 - RNA, 22 nt, Human
auucacaaauaacaggugcaga

SEQ ID NO: 693740 - RNA, 22 nt, Human
gcagggcucauucuaguacaau

SEQ ID NO: 693741 - RNA, 22 nt, Human
cauccaggcaccacaaccagcu

SEQ ID NO: 693742 - RNA, 21 nt, Human
cucaaagaccaaaaguguaga

SEQ ID NO: 693743 - RNA, 22 nt, Human
cccaguccagaccaugaccuca

SEQ ID NO: 693744 - RNA, 22 nt, Human
acuuaguggcuaugugaccuua

SEQ ID NO: 693745 - RNA, 22 nt, Human
uccagucugguaugaauccuag

SEQ ID NO: 693746 - RNA, 22 nt, Human
agaugaguaaauggagucuucc

SEQ ID NO: 693747 - RNA, 22 nt, Human
uaguguuuaguacauaugcaua

SEQ ID NO: 693748 - RNA, 22 nt, Human
augugugugcauuucucucccu

SEQ ID NO: 693749 - RNA, 22 nt, Human
uucauuugcacuggauuacugg

SEQ ID NO: 693750 - RNA, 22 nt, Human
gccucugcaucuucgccgcacu

SEQ ID NO: 693751 - RNA, 22 nt, Human
auucauuagccacuaacuagca

SEQ ID NO: 693752 - RNA, 22 nt, Human
aggcugcuuucauggccgcccc

SEQ ID NO: 693753 - RNA, 22 nt, Human
uuccugguaacaaucucaaagu

SEQ ID NO: 693754 - RNA, 22 nt, Human
cacuuuauauucuaagacggcc

SEQ ID NO: 693755 - RNA, 22 nt, Human
aauuguacaggaaguugcugga

SEQ ID NO: 693756 - RNA, 21 nt, Human
ugaggaugugcagcagcagga

SEQ ID NO: 693757 - RNA, 22 nt, Human
aguccaggcauuccagccauuc

SEQ ID NO: 693758 - RNA, 22 nt, Human
gcauuugaaaugcaagaaagug

SEQ ID NO: 693759 - RNA, 22 nt, Human
uguuuaaccaccauucuauucu

SEQ ID NO: 693760 - RNA, 20 nt, Human
aacaaacuacaaaauuaugu

SEQ ID NO: 693761 - RNA, 22 nt, Human
ugucuaaacuuguuuuaucuca

SEQ ID NO: 693762 - RNA, 22 nt, Human
ccagucugugugccagccugcg

SEQ ID NO: 693763 - RNA, 22 nt, Human
gucuugaaaaguggccaguuug

SEQ ID NO: 693764 - RNA, 22 nt, Human
ccuggcucgcugaccucagggg

SEQ ID NO: 693765 - RNA, 20 nt, Human
gcacacauagaaaugcauau

SEQ ID NO: 693766 - RNA, 22 nt, Human
uccaggagaaaacugacggugg

SEQ ID NO: 693767 - RNA, 22 nt, Human
uggggaagacagcagacacugu

SEQ ID NO: 693768 - RNA, 22 nt, Human
gguggcuggaggagcugaugga

SEQ ID NO: 693769 - RNA, 22 nt, Human
aacaugaugacauuguaagcuu

SEQ ID NO: 693770 - RNA, 22 nt, Human
ggcuucaguggccagagaugau

SEQ ID NO: 693771 - RNA, 22 nt, Human
guaguggagucuccuguccugg

SEQ ID NO: 693772 - RNA, 22 nt, Human
caggaaauucaagagaggcugc

SEQ ID NO: 693773 - RNA, 23 nt, Human
ggcaccaggccauggagcgggag

SEQ ID NO: 693774 - RNA, 22 nt, Human
uaaggcagauguggaaucaauu

SEQ ID NO: 693775 - RNA, 22 nt, Human
caggagacuauggcccaaggcc

SEQ ID NO: 693776 - RNA, 22 nt, Human
cauguauaguuggaacuacauc

SEQ ID NO: 693777 - RNA, 22 nt, Human
ugagcugucaagguacagugaa

SEQ ID NO: 693778 - RNA, 22 nt, Human
ugugugggugguaaggaaggcc

SEQ ID NO: 693779 - RNA, 22 nt, Human
acagggcagagaggcaggcuug

SEQ ID NO: 693780 - RNA, 22 nt, Human
gguuuaauggagauauuucaga

SEQ ID NO: 693781 - RNA, 22 nt, Human
cugcacaggggaugagggcagu

SEQ ID NO: 693782 - RNA, 22 nt, Human
ugucacaugaaacuugcucauc

SEQ ID NO: 693783 - RNA, 22 nt, Human
cugucucuguugccuguaggug

SEQ ID NO: 693784 - RNA, 22 nt, Human
uuacagcagcagggacagacua

SEQ ID NO: 693785 - RNA, 22 nt, Human
ggcagcugucucugaguuagca

SEQ ID NO: 693786 - RNA, 22 nt, Human
ucaguuuauggucuaguucaug

SEQ ID NO: 693787 - RNA, 17 nt, Human
cauuuguugaucaguug

SEQ ID NO: 693788 - RNA, 22 nt, Human
cgucccuaccuggcagcugcgc

SEQ ID NO: 693789 - RNA, 22 nt, Human
agccagaaaggggcauuaucug

SEQ ID NO: 693790 - RNA, 22 nt, Human
cuguugaucucaguuagcuaga

SEQ ID NO: 693791 - RNA, 22 nt, Human
ucuuucugguuauguauagaga

SEQ ID NO: 693792 - RNA, 22 nt, Human
ucagggaaauuuccauguguuu

SEQ ID NO: 693793 - RNA, 22 nt, Human
uuauucagcucucuagaggcac

SEQ ID NO: 693794 - RNA, 22 nt, Human
gagucaggcuagaggugagucu

SEQ ID NO: 693795 - RNA, 22 nt, Human
gcccugccugccgguguggguc

SEQ ID NO: 693796 - RNA, 22 nt, Human
agucaacugcauuaggaaauga

SEQ ID NO: 693797 - RNA, 22 nt, Human
ucagagagcagaacuuuuuuac

SEQ ID NO: 693798 - RNA, 22 nt, Human
agacacugagcauuuuccuagc

SEQ ID NO: 693799 - RNA, 22 nt, Human
agagguagagguugcagugagc

SEQ ID NO: 693800 - RNA, 22 nt, Human
uuuggaauguaguuuaaucauc

SEQ ID NO: 693801 - RNA, 22 nt, Human
gugagcuguuggaguggcagag

SEQ ID NO: 693802 - RNA, 21 nt, Human
aggcucagagaucaaacagua

SEQ ID NO: 693803 - RNA, 22 nt, Human
ucaaauauuggcuauuucacau

SEQ ID NO: 693804 - RNA, 22 nt, Human
gugcaggugguuggcccagccg

SEQ ID NO: 693805 - RNA, 22 nt, Human
uacagacauuuacuccacuccu

SEQ ID NO: 693806 - RNA, 22 nt, Human
ugcacuggggucccagcgcacg

SEQ ID NO: 693807 - RNA, 22 nt, Human
cuguuaauggaggacuacagga

SEQ ID NO: 693808 - RNA, 22 nt, Human
aauauaguguuagcucauuuga

SEQ ID NO: 693809 - RNA, 22 nt, Human
ucuauacacacaaagaaugcuu

SEQ ID NO: 693810 - RNA, 22 nt, Human
cugagagaaacaugacucagga

SEQ ID NO: 693811 - RNA, 22 nt, Human
ucaguguuuauucaauguuauu

SEQ ID NO: 693812 - RNA, 19 nt, Human
cuuccuggaggagagccuc

SEQ ID NO: 693813 - RNA, 22 nt, Human
cagggagaggcaucauagggaa

SEQ ID NO: 693814 - RNA, 22 nt, Human
ucuuucaaaugcuugaauugga

SEQ ID NO: 693815 - RNA, 22 nt, Human
ugaagaucugucaaccccauau

SEQ ID NO: 693816 - RNA, 22 nt, Human
aaagagcuucauuuccauuuau

SEQ ID NO: 693817 - RNA, 22 nt, Human
cugacagaugcugcuggcagua

SEQ ID NO: 693818 - RNA, 22 nt, Human
gaggaagaagcaaaccagcuaa

SEQ ID NO: 693819 - RNA, 22 nt, Human
gacagugauuaguuacuauaaa

SEQ ID NO: 693820 - RNA, 22 nt, Human
ucucuacagaaucuuauuauug

SEQ ID NO: 693821 - RNA, 22 nt, Human
cagggcuggcuguggcaaucuc

SEQ ID NO: 693822 - RNA, 22 nt, Human
aaagcaauggcacaugauggua

SEQ ID NO: 693823 - RNA, 23 nt, Human
cccugcaucugucccucaccagu

SEQ ID NO: 693824 - RNA, 22 nt, Human
ugcguuauugugucuggcuaug

SEQ ID NO: 693825 - RNA, 22 nt, Human
cuuggccugcaggcagcagcgc

SEQ ID NO: 693826 - RNA, 22 nt, Human
uagcaacugcucuauucuagga

SEQ ID NO: 693827 - RNA, 22 nt, Human
gcaugauuaauaugcuuacugu

SEQ ID NO: 693828 - RNA, 22 nt, Human
aacccuggggcagcugcuaggg

SEQ ID NO: 693829 - RNA, 22 nt, Human
gugcaaaaguaauugagguuuu

SEQ ID NO: 693830 - RNA, 22 nt, Human
ggggaccuucccagagcaguug

SEQ ID NO: 693831 - RNA, 22 nt, Human
uuugagaaaugggcucugugcu

SEQ ID NO: 693832 - RNA, 18 nt, Human
ugaaacaagaauggugca

SEQ ID NO: 693833 - RNA, 22 nt, Human
augcauuuuugaguaugaauga

SEQ ID NO: 693834 - RNA, 22 nt, Human
uggcagauaaacaugugauaaa

SEQ ID NO: 693835 - RNA, 22 nt, Human
aguacaaaaugcagcaucauca

SEQ ID NO: 693836 - RNA, 22 nt, Human
guguccagagaacugugggagc

SEQ ID NO: 693837 - RNA, 22 nt, Human
gcagggcuuuuugaaacauggu

SEQ ID NO: 693838 - RNA, 22 nt, Human
cccagccucuggguucugccgg

SEQ ID NO: 693839 - RNA, 22 nt, Human
uuauucucaucucccuacuuag

SEQ ID NO: 693840 - RNA, 22 nt, Human
ccucagcuugauuucugcagag

SEQ ID NO: 693841 - RNA, 22 nt, Human
uccuuaacaagauggcauuugu

SEQ ID NO: 693842 - RNA, 22 nt, Human
uugggcuccuguugauccuguc

SEQ ID NO: 693843 - RNA, 22 nt, Human
uucugggcucccacauauuuca

SEQ ID NO: 693844 - RNA, 22 nt, Human
cucaugauguagcgaaugagaa

SEQ ID NO: 693845 - RNA, 22 nt, Human
aaauguuccggguaaggagaaa

SEQ ID NO: 693846 - RNA, 22 nt, Human
uaagcauuaugguaaagaagua

SEQ ID NO: 693847 - RNA, 22 nt, Human
uugcauuugaucuuggguucuc

SEQ ID NO: 693848 - RNA, 22 nt, Human
aaaugugucauauucaaaguca

SEQ ID NO: 693849 - RNA, 22 nt, Human
caaaaguaccuugugugcuuug

SEQ ID NO: 693850 - RNA, 22 nt, Human
auugucuuuaaaaauauacaac

SEQ ID NO: 693851 - RNA, 22 nt, Human
auggcagaccuccuggccacaa

SEQ ID NO: 693852 - RNA, 22 nt, Human
uccuucaccuuagcccuccuag

SEQ ID NO: 693853 - RNA, 22 nt, Human
uggcagauguggcauagagcau

SEQ ID NO: 693854 - RNA, 22 nt, Human
ggcaucucggaacacgccuccg

SEQ ID NO: 693855 - RNA, 20 nt, Human
uccagggcuagggagcucau

SEQ ID NO: 693856 - RNA, 22 nt, Human
acauuuuuauccugagugccag

SEQ ID NO: 693857 - RNA, 22 nt, Human
uaaacaagcugucugauauucu

SEQ ID NO: 693858 - RNA, 22 nt, Human
guucacaguguuuucuuugcau

SEQ ID NO: 693859 - RNA, 22 nt, Human
uagcagcaaaaugaccuucuaa

SEQ ID NO: 693860 - RNA, 18 nt, Human
ugaagacaugagguuagu

SEQ ID NO: 693861 - RNA, 18 nt, Human
ucuuggaguaaugaucaa

SEQ ID NO: 693862 - RNA, 22 nt, Human
uuaaguccuugguaauuuucuu

SEQ ID NO: 693863 - RNA, 22 nt, Human
uuuacagucugucuagcaaugu

SEQ ID NO: 693864 - RNA, 22 nt, Human
guguuuuauggagucauaacgu

SEQ ID NO: 693865 - RNA, 22 nt, Human
uaaguucaccaguuguaauaag

SEQ ID NO: 693866 - RNA, 21 nt, Human
agacccugcauauguucagua

SEQ ID NO: 693867 - RNA, 22 nt, Human
acaguguaauaugggagucagu

SEQ ID NO: 693868 - RNA, 22 nt, Human
ucagugcuugccucuggaggag

SEQ ID NO: 693869 - RNA, 22 nt, Human
uauugacagagggucagaagag

SEQ ID NO: 693870 - RNA, 22 nt, Human
uugcuaaguuauagaguaucuu

SEQ ID NO: 693871 - RNA, 22 nt, Human
ucaggcugauaggaggaacuga

SEQ ID NO: 693872 - RNA, 22 nt, Human
guuguaaauacaguacugaaac

SEQ ID NO: 693873 - RNA, 22 nt, Human
uuuuacauugggaaaugccucu

SEQ ID NO: 693874 - RNA, 19 nt, Human
cuuugucagaacaugcuuc

SEQ ID NO: 693875 - RNA, 22 nt, Human
aaggugguuguaggcuggucug

SEQ ID NO: 693876 - RNA, 21 nt, Human
ccauccaucucccuuugcugg

SEQ ID NO: 693877 - RNA, 22 nt, Human
caguguccucagccagcagcua

SEQ ID NO: 693878 - RNA, 22 nt, Human
gaaacauucagucaacaguguu

SEQ ID NO: 693879 - RNA, 22 nt, Human
agugaggauaccaauguguaga

SEQ ID NO: 693880 - RNA, 22 nt, Human
ggccuuccuucccagccuacug

SEQ ID NO: 693881 - RNA, 21 nt, Human
cuguuucuugugaagugacac

SEQ ID NO: 693882 - RNA, 22 nt, Human
ucaggacaauagugauuuuuac

SEQ ID NO: 693883 - RNA, 22 nt, Human
uagucuggacuucuuaguguca

SEQ ID NO: 693884 - RNA, 22 nt, Human
gaucuuuagccaagacacacca

SEQ ID NO: 693885 - RNA, 22 nt, Human
uggccacauccuuuccuuguca

SEQ ID NO: 693886 - RNA, 22 nt, Human
caggcagaagaaguggaaggac

SEQ ID NO: 693887 - RNA, 22 nt, Human
agggcucaccacugugcacucc

SEQ ID NO: 693888 - RNA, 22 nt, Human
ucccaagcuuagggcucucagu

SEQ ID NO: 693889 - RNA, 20 nt, Human
auccucacccucaguccuag

SEQ ID NO: 693890 - RNA, 22 nt, Human
agaaaugaaaccaaagccuaga

SEQ ID NO: 693891 - RNA, 22 nt, Human
ugcuuccuugaucauucccaaa

SEQ ID NO: 693892 - RNA, 22 nt, Human
aggccugggcaagaaggggcgu

SEQ ID NO: 693893 - RNA, 22 nt, Human
acauuuuuacugggcaucugca

SEQ ID NO: 693894 - RNA, 22 nt, Human
cuccagguuuuacaaggucuau

SEQ ID NO: 693895 - RNA, 22 nt, Human
agcagcugagaugguaagauuc

SEQ ID NO: 693896 - RNA, 22 nt, Human
ugcugcaggaacuuaagaagcu

SEQ ID NO: 693897 - RNA, 19 nt, Human
uuccuuagaggaggcggug

SEQ ID NO: 693898 - RNA, 22 nt, Human
uaaaggcacggaguuguuaugg

SEQ ID NO: 693899 - RNA, 22 nt, Human
uuauuuucuccucagaaagugg

SEQ ID NO: 693900 - RNA, 22 nt, Human
uugggcuugucugggaaacugc

SEQ ID NO: 693901 - RNA, 22 nt, Human
aaagcuauuuauuacagagaau

SEQ ID NO: 693902 - RNA, 22 nt, Human
cuugauguauaaguugauaugu

SEQ ID NO: 693903 - RNA, 22 nt, Human
gugccugggcaugagcuuguug

SEQ ID NO: 693904 - RNA, 22 nt, Human
gccugcagugagugcagaaggu

SEQ ID NO: 693905 - RNA, 22 nt, Human
uguuccagauucggcgugggac

SEQ ID NO: 693906 - RNA, 22 nt, Human
ccaaggacuggacacacagguu

SEQ ID NO: 693907 - RNA, 22 nt, Human
uuuaaggagcuacucaccguca

SEQ ID NO: 693908 - RNA, 17 nt, Human
aaacuucauucucagga

SEQ ID NO: 693909 - RNA, 22 nt, Human
ugagguagguggugaaaaauga

SEQ ID NO: 693910 - RNA, 22 nt, Human
aauuuuauuagaaggcaagggg

SEQ ID NO: 693911 - RNA, 22 nt, Human
uggcaaaguuuaucaggaauau

SEQ ID NO: 693912 - RNA, 22 nt, Human
aacacuuugggcauggccuucc

SEQ ID NO: 693913 - RNA, 22 nt, Human
agaaaugacacacaugagacau

SEQ ID NO: 693914 - RNA, 22 nt, Human
ucucccuuggucacagauuccu

SEQ ID NO: 693915 - RNA, 22 nt, Human
uuggaaacgucaccuuuuccuu

SEQ ID NO: 693916 - RNA, 22 nt, Human
uuagaaccaggaacucuaauau

SEQ ID NO: 693917 - RNA, 22 nt, Human
uccagagcuacuugcucaacuu

SEQ ID NO: 693918 - RNA, 22 nt, Human
aacacugugcaguguaaugcug

SEQ ID NO: 693919 - RNA, 22 nt, Human
ccuuccaagugcugcuuuuucc

SEQ ID NO: 693920 - RNA, 22 nt, Human
augcaauguuacagaauguacu

SEQ ID NO: 693921 - RNA, 22 nt, Human
uuccuuccagcuugugacaguc

SEQ ID NO: 693922 - RNA, 22 nt, Human
gcaagagacuuuuaugucugcc

SEQ ID NO: 693923 - RNA, 22 nt, Human
agggucuucccaccauuccugc

SEQ ID NO: 693924 - RNA, 22 nt, Human
caccuggcagcuguuggccacg

SEQ ID NO: 693925 - RNA, 22 nt, Human
cugagccagcgggcucacuuuu

SEQ ID NO: 693926 - RNA, 22 nt, Human
cagccaggcccccgagucguug

SEQ ID NO: 693927 - RNA, 22 nt, Human
uacuucuagccugccccuugug

SEQ ID NO: 693928 - RNA, 22 nt, Human
augcucauuuuauugagaauga

SEQ ID NO: 693929 - RNA, 22 nt, Human
auguacaaucuaucacaagaag

SEQ ID NO: 693930 - RNA, 22 nt, Human
cuccagggagcuguggagguuu

SEQ ID NO: 693931 - RNA, 22 nt, Human
caggcuucgcucugugggcagg

SEQ ID NO: 693932 - RNA, 23 nt, Human
cagggcugguagggaagagcgug

SEQ ID NO: 693933 - RNA, 22 nt, Human
uuucacauucagauauagacuu

SEQ ID NO: 693934 - RNA, 22 nt, Human
agacaaauuuguuuuccugucu

SEQ ID NO: 693935 - RNA, 22 nt, Human
uguacagaaggcacuaagguca

SEQ ID NO: 693936 - RNA, 22 nt, Human
agacuucuugagcuggcacuuc

SEQ ID NO: 693937 - RNA, 22 nt, Human
ggcugccagugagugcagaccg

SEQ ID NO: 693938 - RNA, 23 nt, Human
aggauaugacuugucugccaacc

SEQ ID NO: 693939 - RNA, 19 nt, Human
ucauuguugguuugucggg

SEQ ID NO: 693940 - RNA, 21 nt, Human
gcugggucagcagguccucug

SEQ ID NO: 693941 - RNA, 22 nt, Human
uuuuccuggagauggaguuguu

SEQ ID NO: 693942 - RNA, 22 nt, Human
cuucacaguaaauccagaagaa

SEQ ID NO: 693943 - RNA, 22 nt, Human
uccuggugggacagaaaaccuc

SEQ ID NO: 693944 - RNA, 22 nt, Human
gacuggacucugaagaugggug

SEQ ID NO: 693945 - RNA, 22 nt, Human
cuucaggauuuaggaagaugaa

SEQ ID NO: 693946 - RNA, 22 nt, Human
auaaagacaugcuuacuugccc

SEQ ID NO: 693947 - RNA, 22 nt, Human
uauuagggaacugcaagacuaa

SEQ ID NO: 693948 - RNA, 22 nt, Human
cuuuaccagauuccauugcaag

SEQ ID NO: 693949 - RNA, 22 nt, Human
gacagggacacagccagugagg

SEQ ID NO: 693950 - RNA, 21 nt, Human
cucaggcauuugaggagaguc

SEQ ID NO: 693951 - RNA, 22 nt, Human
agauauuuaaaucagacaaaga

SEQ ID NO: 693952 - RNA, 22 nt, Human
agcuguaugcccaagaugcuau

SEQ ID NO: 693953 - RNA, 22 nt, Human
cagcaggaggugagaugugacc

SEQ ID NO: 693954 - RNA, 20 nt, Human
ggucccugcccucugucauc

SEQ ID NO: 693955 - RNA, 22 nt, Human
uucucuucuguucagugcccaa

SEQ ID NO: 693956 - RNA, 22 nt, Human
agcauaaacucagggacacaca

SEQ ID NO: 693957 - RNA, 22 nt, Human
acacuaagguuggagucacagu

SEQ ID NO: 693958 - RNA, 22 nt, Human
auagauguucaaucagauauuu

SEQ ID NO: 693959 - RNA, 22 nt, Human
augugucuuucaagguauagaa

SEQ ID NO: 693960 - RNA, 22 nt, Human
aucugccucuucuucauugcga

SEQ ID NO: 693961 - RNA, 18 nt, Human
uggcagguagacucaggu

SEQ ID NO: 693962 - RNA, 22 nt, Human
ggaguggcuguuucugccccca

SEQ ID NO: 693963 - RNA, 22 nt, Human
uaaguccacuauauccuucucu

SEQ ID NO: 693964 - RNA, 22 nt, Human
uauggcaagagaaucaacugaa

SEQ ID NO: 693965 - RNA, 22 nt, Human
aucagaaaucuaggauucagaa

SEQ ID NO: 693966 - RNA, 22 nt, Human
uccugcgagugcgcuuuugguc

SEQ ID NO: 693967 - RNA, 22 nt, Human
ccugucucuuucaaucugagag

SEQ ID NO: 693968 - RNA, 22 nt, Human
ggaggcucccacgcagcucaca

SEQ ID NO: 693969 - RNA, 23 nt, Human
cuuucauugugguuucacagagc

SEQ ID NO: 693970 - RNA, 22 nt, Human
aaaauaacuucuacuauuugca

SEQ ID NO: 693971 - RNA, 22 nt, Human
cuguccugauggugccacuggu

SEQ ID NO: 693972 - RNA, 23 nt, Human
agagcaaggaaaugaggugugau

SEQ ID NO: 693973 - RNA, 22 nt, Human
accugaggacuggaugguagaa

SEQ ID NO: 693974 - RNA, 22 nt, Human
guauuauucucagcuuugggau

SEQ ID NO: 693975 - RNA, 22 nt, Human
aucugggccuguucccucaccu

SEQ ID NO: 693976 - RNA, 22 nt, Human
uagcagcuccuaaacaguggug

SEQ ID NO: 693977 - RNA, 22 nt, Human
aaggaggagcggaggcuuguug

SEQ ID NO: 693978 - RNA, 22 nt, Human
ggggagcugggaggugaguuac

SEQ ID NO: 693979 - RNA, 22 nt, Human
aauacaaucaaauucacuagca

SEQ ID NO: 693980 - RNA, 22 nt, Human
gugggugucaguaucuuuaacg

SEQ ID NO: 693981 - RNA, 22 nt, Human
guaguaauaguacauuagaaug

SEQ ID NO: 693982 - RNA, 22 nt, Human
aacauacauauuucagugucca

SEQ ID NO: 693983 - RNA, 22 nt, Human
guccugguccugccuccccaug

SEQ ID NO: 693984 - RNA, 22 nt, Human
uaugagcaagaguuugugaagg

SEQ ID NO: 693985 - RNA, 22 nt, Human
ucuuuucugccacagccugagc

SEQ ID NO: 693986 - RNA, 22 nt, Human
cagugcaggcugggggcccugc

SEQ ID NO: 693987 - RNA, 19 nt, Human
auucauuggccaggguggu

SEQ ID NO: 693988 - RNA, 20 nt, Human
cccagccccuaccuguugcc

SEQ ID NO: 693989 - RNA, 22 nt, Human
ccaagggcucugacuugccugc

SEQ ID NO: 693990 - RNA, 22 nt, Human
uaacugauguucccuuacugua

SEQ ID NO: 693991 - RNA, 19 nt, Human
ccugggacuuaggcugggu

SEQ ID NO: 693992 - RNA, 22 nt, Human
aacuuaggaaaauaaggcauga

SEQ ID NO: 693993 - RNA, 18 nt, Human
uggcaggggcaguacgcc

SEQ ID NO: 693994 - RNA, 22 nt, Human
agaaaaggauugauggaucaga

SEQ ID NO: 693995 - RNA, 22 nt, Human
cugcuggagguuggagcaugca

SEQ ID NO: 693996 - RNA, 22 nt, Human
gggacccugggaggcuggcgca

SEQ ID NO: 693997 - RNA, 22 nt, Human
aucugaaaaaucuccuuuguca

SEQ ID NO: 693998 - RNA, 23 nt, Human
cuccccaguguccucaugcaucu

SEQ ID NO: 693999 - RNA, 22 nt, Human
ucucagcagccagauccagagc

SEQ ID NO: 694000 - RNA, 19 nt, Human
ggcugggucuggcagguuc

SEQ ID NO: 694001 - RNA, 22 nt, Human
cuguggccagauggugccaguu

SEQ ID NO: 694002 - RNA, 22 nt, Human
gaagccuuugccuaaaacauua

SEQ ID NO: 694003 - RNA, 22 nt, Human
ggaaagauguaauauuaucuaa

SEQ ID NO: 694004 - RNA, 22 nt, Human
ucccuggguucccguggaagug

SEQ ID NO: 694005 - RNA, 22 nt, Human
uauaucagcaaagcauuuaaaa

SEQ ID NO: 694006 - RNA, 22 nt, Human
caucaucugugcuggagagccu

SEQ ID NO: 694007 - RNA, 22 nt, Human
gugggagaagcccuguucguag

SEQ ID NO: 694008 - RNA, 22 nt, Human
uggcacagacauuuaauagccu

SEQ ID NO: 694009 - RNA, 22 nt, Human
gaacagaugggcucagauccug

SEQ ID NO: 694010 - RNA, 22 nt, Human
aggccagcuucuacccucuguu

SEQ ID NO: 694011 - RNA, 22 nt, Human
gacaagacaugugaugacauca

SEQ ID NO: 694012 - RNA, 22 nt, Human
ucagaaagaacacaggcaguag

SEQ ID NO: 694013 - RNA, 22 nt, Human
aauaagcugcuaggaacuuagu

SEQ ID NO: 694014 - RNA, 22 nt, Human
ucuacccugcggucuuggggca

SEQ ID NO: 694015 - RNA, 23 nt, Human
aggaaagcauucauuuuuaccau

SEQ ID NO: 694016 - RNA, 22 nt, Human
ggccccucuuguggcacauacg

SEQ ID NO: 694017 - RNA, 22 nt, Human
gucugccucuuucuuucugggu

SEQ ID NO: 694018 - RNA, 22 nt, Human
ugcccugcccaucuacccuguc

SEQ ID NO: 694019 - RNA, 22 nt, Human
cuuugcagaaauaaacuugaug

SEQ ID NO: 694020 - RNA, 20 nt, Human
caugauacuuggaagggcuu

SEQ ID NO: 694021 - RNA, 22 nt, Human
cuuuguauucauccguaauaau

SEQ ID NO: 694022 - RNA, 22 nt, Human
cuguacagaagcuagagcaaau

SEQ ID NO: 694023 - RNA, 22 nt, Human
uugaucuuuauaauaguuuuga

SEQ ID NO: 694024 - RNA, 22 nt, Human
cuggccaguugccuuccugggu

SEQ ID NO: 694025 - RNA, 21 nt, Human
ccuccugcccgcaagcuaggg

SEQ ID NO: 694026 - RNA, 22 nt, Human
ggugugguuugaagggagaugg

SEQ ID NO: 694027 - RNA, 20 nt, Human
ugucuccagggcugagugga

SEQ ID NO: 694028 - RNA, 22 nt, Human
cucaggaugcaauuccaucaag

SEQ ID NO: 694029 - RNA, 22 nt, Human
gugcucaggaagcuguuccugc

SEQ ID NO: 694030 - RNA, 22 nt, Human
caggcuggagugcaauggugcu

SEQ ID NO: 694031 - RNA, 22 nt, Human
cuaggugauccacugcucucuu

SEQ ID NO: 694032 - RNA, 22 nt, Human
acuuucuuauccaugaucucac

SEQ ID NO: 694033 - RNA, 22 nt, Human
ugacagagcauguagugacagc

SEQ ID NO: 694034 - RNA, 22 nt, Human
gugcuggggguuucuguagguc

SEQ ID NO: 694035 - RNA, 22 nt, Human
ugugugcauguuaaugagaaaa

SEQ ID NO: 694036 - RNA, 22 nt, Human
agaaucagugagcaguugugau

SEQ ID NO: 694037 - RNA, 22 nt, Human
aauuuguuagcauacucuaguu

SEQ ID NO: 694038 - RNA, 22 nt, Human
caguccugagcuccugggcuga

SEQ ID NO: 694039 - RNA, 22 nt, Human
auguaacaggugaagcucugag

SEQ ID NO: 694040 - RNA, 22 nt, Human
ggcucuggggaagcucucuuca

SEQ ID NO: 694041 - RNA, 22 nt, Human
gaggcucagagaagucauggua

SEQ ID NO: 694042 - RNA, 22 nt, Human
uuaguguuuaaagguuucagag

SEQ ID NO: 694043 - RNA, 22 nt, Human
ugugcccuguuaaaugcacagu

SEQ ID NO: 694044 - RNA, 22 nt, Human
aguguccuugauuccuguuguu

SEQ ID NO: 694045 - RNA, 21 nt, Human
ucucuuugggaacauuaauca

SEQ ID NO: 694046 - RNA, 23 nt, Human
cacacccaucacuaagagcuccu

SEQ ID NO: 694047 - RNA, 20 nt, Human
uguguaugugcacaugcgaa

SEQ ID NO: 694048 - RNA, 22 nt, Human
uaugucuuuuucucacuauagu

SEQ ID NO: 694049 - RNA, 22 nt, Human
ugcguuuaguuucaagacacgu

SEQ ID NO: 694050 - RNA, 22 nt, Human
gcagagcuaucuucuggauuug

SEQ ID NO: 694051 - RNA, 22 nt, Human
uggcucaggccacuucuuuuau

SEQ ID NO: 694052 - RNA, 22 nt, Human
uuuucuauucauugucuauggu

SEQ ID NO: 694053 - RNA, 22 nt, Human
gagaaggggugauguggguaau

SEQ ID NO: 694054 - RNA, 22 nt, Human
gagaggaaugagguuaaggacu

SEQ ID NO: 694055 - RNA, 20 nt, Human
gugcugagggcugggcaaug

SEQ ID NO: 694056 - RNA, 22 nt, Human
aagaacaugcuauaauuaucuu

SEQ ID NO: 694057 - RNA, 22 nt, Human
uauacaagugagaagaagaguu

SEQ ID NO: 694058 - RNA, 22 nt, Human
ccagggaaucucugaguguguu

SEQ ID NO: 694059 - RNA, 22 nt, Human
cacauguaguaagcaggcaaug

SEQ ID NO: 694060 - RNA, 23 nt, Human
cugcugugaaacaugguuuuggu

SEQ ID NO: 694061 - RNA, 22 nt, Human
uggucugauaccggauuccagu

SEQ ID NO: 694062 - RNA, 22 nt, Human
cacccagagggcuugcugaaca

SEQ ID NO: 694063 - RNA, 22 nt, Human
agagccuggcucccagcuaccg

SEQ ID NO: 694064 - RNA, 22 nt, Human
aacuugaaguugcagaaaguac

SEQ ID NO: 694065 - RNA, 22 nt, Human
caggcugcagugcaguggcuau

SEQ ID NO: 694066 - RNA, 22 nt, Human
cugccagcucucuggaggcucu

SEQ ID NO: 694067 - RNA, 22 nt, Human
auaacaugaccugugcuucaca

SEQ ID NO: 694068 - RNA, 22 nt, Human
uagcagaaacuguuacagaagg

SEQ ID NO: 694069 - RNA, 22 nt, Human
uccagcacccaauguggcuaag

SEQ ID NO: 694070 - RNA, 23 nt, Human
aagauccauucaaauuauguauc

SEQ ID NO: 694071 - RNA, 22 nt, Human
cagcuuuccagagaccugcccc

SEQ ID NO: 694072 - RNA, 22 nt, Human
acuguucaagcaaaugacauug

SEQ ID NO: 694073 - RNA, 22 nt, Human
ugcugaggcaguccuaacagga

SEQ ID NO: 694074 - RNA, 22 nt, Human
aaauuucuguuguuuugagcca

SEQ ID NO: 694075 - RNA, 22 nt, Human
cccaggaggaggaaaaagcucg

SEQ ID NO: 694076 - RNA, 22 nt, Human
agauggcaggcccugugggggu

SEQ ID NO: 694077 - RNA, 22 nt, Human
ucacuuuuugauaucauucugc

SEQ ID NO: 694078 - RNA, 22 nt, Human
ccuggcuggacuggaccguggc

SEQ ID NO: 694079 - RNA, 22 nt, Human
ucucagaggugcccuggcaucu

SEQ ID NO: 694080 - RNA, 22 nt, Human
cagugauucagacucaucauuu

SEQ ID NO: 694081 - RNA, 22 nt, Human
uuacacauugcagaucaaaaug

SEQ ID NO: 694082 - RNA, 20 nt, Human
gcaguguguaugaauagcug

SEQ ID NO: 694083 - RNA, 22 nt, Human
ugcggcaggagaagguguuaug

SEQ ID NO: 694084 - RNA, 22 nt, Human
cuuuuuguuguccacacuagga

SEQ ID NO: 694085 - RNA, 22 nt, Human
ucucccaacauguggaggucag

SEQ ID NO: 694086 - RNA, 22 nt, Human
ugcuggagacauagcaggcagc

SEQ ID NO: 694087 - RNA, 22 nt, Human
aacugcaagcucuuuacugcua

SEQ ID NO: 694088 - RNA, 22 nt, Human
acaguguagugugaugucaaaa

SEQ ID NO: 694089 - RNA, 22 nt, Human
ucugaggggcuggaagggcugc

SEQ ID NO: 694090 - RNA, 21 nt, Human
ugcucacagaugugcucagug

SEQ ID NO: 694091 - RNA, 22 nt, Human
aucccugcccucauggagcuua

SEQ ID NO: 694092 - RNA, 22 nt, Human
cuggcugccagcauuuggggga

SEQ ID NO: 694093 - RNA, 22 nt, Human
auucuacaccucucucauuuag

SEQ ID NO: 694094 - RNA, 22 nt, Human
agguggcauuuacaccauggga

SEQ ID NO: 694095 - RNA, 22 nt, Human
gcagggcagcucacugugguuc

SEQ ID NO: 694096 - RNA, 22 nt, Human
ucugugcuaaugcuucacaaua

SEQ ID NO: 694097 - RNA, 22 nt, Human
aguguuuacucccugcccucca

SEQ ID NO: 694098 - RNA, 20 nt, Human
cagguccagcacgugcacgg

SEQ ID NO: 694099 - RNA, 22 nt, Human
gcagagcaccaaagugaaagau

SEQ ID NO: 694100 - RNA, 22 nt, Human
uuuaccaagcuuuaauuacaua

SEQ ID NO: 694101 - RNA, 22 nt, Human
gggucucucucggcuccacgcg

SEQ ID NO: 694102 - RNA, 23 nt, Human
gccuggcuuccaagguaggggag

SEQ ID NO: 694103 - RNA, 22 nt, Human
uagcaggaauaaaaauguaccc

SEQ ID NO: 694104 - RNA, 22 nt, Human
acaugcauggacauguauauau

SEQ ID NO: 694105 - RNA, 22 nt, Human
agugagaguauuaaugugaacu

SEQ ID NO: 694106 - RNA, 20 nt, Human
agaagaggauacaaccaggc

SEQ ID NO: 694107 - RNA, 22 nt, Human
cccuggccccucacuccgaggc

SEQ ID NO: 694108 - RNA, 22 nt, Human
uuucuaagugugauuuuagauu

SEQ ID NO: 694109 - RNA, 22 nt, Human
ugaggccuuuucugucuggcua

SEQ ID NO: 694110 - RNA, 22 nt, Human
aauugcuuuaguuaccauagug

SEQ ID NO: 694111 - RNA, 22 nt, Human
ucaagucuugaugagacaaacc

SEQ ID NO: 694112 - RNA, 22 nt, Human
uacagagaggugacccuugggc

SEQ ID NO: 694113 - RNA, 22 nt, Human
gaugaaaugugaaaguucuggg

SEQ ID NO: 694114 - RNA, 22 nt, Human
aggcacuguacuagguacaggg

SEQ ID NO: 694115 - RNA, 22 nt, Human
augcauguaacaguguuaugaa

SEQ ID NO: 694116 - RNA, 22 nt, Human
uggaggcugguuucugcugagg

SEQ ID NO: 694117 - RNA, 19 nt, Human
gcugccugucuuagccagu

SEQ ID NO: 694118 - RNA, 22 nt, Human
aucuucaaggaaaaaauacagu

SEQ ID NO: 694119 - RNA, 22 nt, Human
uauuuagugauagaagcaagga

SEQ ID NO: 694120 - RNA, 22 nt, Human
ccuugggauuucucaugccaau

SEQ ID NO: 694121 - RNA, 22 nt, Human
aagaaaguguggagagccuagc

SEQ ID NO: 694122 - RNA, 22 nt, Human
uucuuauuucccccuucaucau

SEQ ID NO: 694123 - RNA, 22 nt, Human
gccaggaaggcugaagccagaa

SEQ ID NO: 694124 - RNA, 22 nt, Human
aggcuguuuuguauaaacugga

SEQ ID NO: 694125 - RNA, 22 nt, Human
ugaaaagacugcaagagagcau

SEQ ID NO: 694126 - RNA, 22 nt, Human
ugcaugauagagaugguauuag

SEQ ID NO: 694127 - RNA, 22 nt, Human
ggcagaggugaaguucacaagg

SEQ ID NO: 694128 - RNA, 22 nt, Human
agcccugaagcuggccaugucc

SEQ ID NO: 694129 - RNA, 22 nt, Human
ggagccagagucugcaguguaa

SEQ ID NO: 694130 - RNA, 22 nt, Human
ggucuggcacucaugcagcagg

SEQ ID NO: 694131 - RNA, 22 nt, Human
caugaucaccacuugacagccc

SEQ ID NO: 694132 - RNA, 22 nt, Human
cugugacugggugacaguccuc

SEQ ID NO: 694133 - RNA, 22 nt, Human
uggcacugccaaccugcuaggu

SEQ ID NO: 694134 - RNA, 22 nt, Human
aggcagccuuuagacagucugc

SEQ ID NO: 694135 - RNA, 22 nt, Human
uucaacaauuaaguaucagccu

SEQ ID NO: 694136 - RNA, 19 nt, Human
cauacaauuaccauaggau

SEQ ID NO: 694137 - RNA, 22 nt, Human
ugcaugaaauauuuucuguagg

SEQ ID NO: 694138 - RNA, 18 nt, Human
gagcugccauauuuaguu

SEQ ID NO: 694139 - RNA, 22 nt, Human
gaauuucagagguaacaucauc

SEQ ID NO: 694140 - RNA, 22 nt, Human
ggcugcucugccuuccagcugg

SEQ ID NO: 694141 - RNA, 22 nt, Human
aaaugauguuauaagaccagga

SEQ ID NO: 694142 - RNA, 22 nt, Human
acguggagagaauagggcacca

SEQ ID NO: 694143 - RNA, 22 nt, Human
augagagacaggaacgagcugg

SEQ ID NO: 694144 - RNA, 22 nt, Human
uuccagaaaaaaauguauaucu

SEQ ID NO: 694145 - RNA, 22 nt, Human
cugccuggguucaaguccuguu

SEQ ID NO: 694146 - RNA, 22 nt, Human
cugcagggaugugaggcccguu

SEQ ID NO: 694147 - RNA, 22 nt, Human
agcagagcugcaguggccugcu

SEQ ID NO: 694148 - RNA, 22 nt, Human
auacaugugccauguuggugua

SEQ ID NO: 694149 - RNA, 22 nt, Human
gccaagggaacugagccggagg

SEQ ID NO: 694150 - RNA, 19 nt, Human
cugcugaauuagcucugga

SEQ ID NO: 694151 - RNA, 19 nt, Human
cagggauggguagggacuc

SEQ ID NO: 694152 - RNA, 22 nt, Human
gacagcagguaauuaguuaaca

SEQ ID NO: 694153 - RNA, 22 nt, Human
gagcccagcccagagccauaug

SEQ ID NO: 694154 - RNA, 22 nt, Human
gcucuggcuaguuaccucuuac

SEQ ID NO: 694155 - RNA, 21 nt, Human
gacuucaugggucaaccaauu

SEQ ID NO: 694156 - RNA, 22 nt, Human
ugagucugggcauguucacuuu

SEQ ID NO: 694157 - RNA, 22 nt, Human
auguucuuguucaaaugucagu

SEQ ID NO: 694158 - RNA, 22 nt, Human
cagagguagggagcuauguuau

SEQ ID NO: 694159 - RNA, 22 nt, Human
uuccuggcaaagugagcaucac

SEQ ID NO: 694160 - RNA, 22 nt, Human
aucaauucuuaggaaaauagcu

SEQ ID NO: 694161 - RNA, 19 nt, Human
ugaggcacuagucuggucc

SEQ ID NO: 694162 - RNA, 22 nt, Human
gcagccuguuguaccagccugu

SEQ ID NO: 694163 - RNA, 22 nt, Human
guggaccaagguggaagauaaa

SEQ ID NO: 694164 - RNA, 22 nt, Human
aucuucugauuuauggagcaau

SEQ ID NO: 694165 - RNA, 22 nt, Human
acaugcuuuaucggauugacac

SEQ ID NO: 694166 - RNA, 22 nt, Human
uacagcauuaacaggcuguuua

SEQ ID NO: 694167 - RNA, 22 nt, Human
gacagcauggugucuguucagg

SEQ ID NO: 694168 - RNA, 22 nt, Human
cagcauugaucccaggcugugg

SEQ ID NO: 694169 - RNA, 22 nt, Human
ucuaaggacaaggucuuggaga

SEQ ID NO: 694170 - RNA, 22 nt, Human
cucagaguucuccugggaggug

SEQ ID NO: 694171 - RNA, 22 nt, Human
aagcuggaggcugagaucacca

SEQ ID NO: 694172 - RNA, 22 nt, Human
cuggggcagagcccagcaauuu

SEQ ID NO: 694173 - RNA, 22 nt, Human
uuuucaguaaugucuacauaau

SEQ ID NO: 694174 - RNA, 23 nt, Human
aggaggaaaaguuaucugcugag

SEQ ID NO: 694175 - RNA, 22 nt, Human
ucccgggcaggucgagcgagcc

SEQ ID NO: 694176 - RNA, 22 nt, Human
acugcuuuucagagucugccug

SEQ ID NO: 694177 - RNA, 22 nt, Human
uuacauuuugggguaaggauaa

SEQ ID NO: 694178 - RNA, 22 nt, Human
ugagcuucuuuauuuggccaga

SEQ ID NO: 694179 - RNA, 22 nt, Human
uuuacauugcauuagguauuau

SEQ ID NO: 694180 - RNA, 22 nt, Human
gccagcugaagcccugguggaa

SEQ ID NO: 694181 - RNA, 22 nt, Human
uuucagagaugucuagccuauu

SEQ ID NO: 694182 - RNA, 22 nt, Human
agcuucuuaaguuccugcagca

SEQ ID NO: 694183 - RNA, 18 nt, Human
aauggaaggggugcuguu

SEQ ID NO: 694184 - RNA, 22 nt, Human
guguguguaucugccuaucaca

SEQ ID NO: 694185 - RNA, 22 nt, Human
uucaacaaaauauauuuuucca

SEQ ID NO: 694186 - RNA, 22 nt, Human
cuacuuuaauuuucugcagaga

SEQ ID NO: 694187 - RNA, 22 nt, Human
acuguuuaaaggcuuccuuucu

SEQ ID NO: 694188 - RNA, 22 nt, Human
aaacaguagaaguguauuuuau

SEQ ID NO: 694189 - RNA, 22 nt, Human
aggcacuguucccaguuauccu

SEQ ID NO: 694190 - RNA, 22 nt, Human
ccugaggauuguuggugcuucc

SEQ ID NO: 694191 - RNA, 22 nt, Human
aagauucuuaccuauacccagu

SEQ ID NO: 694192 - RNA, 22 nt, Human
uggcuagaauuggguucacagg

SEQ ID NO: 694193 - RNA, 22 nt, Human
agcuuugguugaggggagugug

SEQ ID NO: 694194 - RNA, 22 nt, Human
cuuuucagagcugagaucaccg

SEQ ID NO: 694195 - RNA, 22 nt, Human
cuacauuuguucuauagcuuuu

SEQ ID NO: 694196 - RNA, 22 nt, Human
agaggucugagcaaucucaagc

SEQ ID NO: 694197 - RNA, 22 nt, Human
aauuccaagagcuuccuaagug

SEQ ID NO: 694198 - RNA, 22 nt, Human
uucuucuguuggcagagcauac

SEQ ID NO: 694199 - RNA, 22 nt, Human
ucaagacauauuaaaugugcga

SEQ ID NO: 694200 - RNA, 22 nt, Human
uugaaugaguguuuuacucaug

SEQ ID NO: 694201 - RNA, 22 nt, Human
aaaggcauuuuaauucuaaaga

SEQ ID NO: 694202 - RNA, 22 nt, Human
cacagagaaugaugagucacug

SEQ ID NO: 694203 - RNA, 22 nt, Human
uguggccaccagagcugcuauu

SEQ ID NO: 694204 - RNA, 22 nt, Human
uacuguaugauuucauguauau

SEQ ID NO: 694205 - RNA, 22 nt, Human
cacuucauugggaccagggcug

SEQ ID NO: 694206 - RNA, 23 nt, Human
uguuccugucaaauuuucuuccc

SEQ ID NO: 694207 - RNA, 22 nt, Human
ugcggaggucggugcugcgggc

SEQ ID NO: 694208 - RNA, 22 nt, Human
gcggcccgagcaggacgggugg

SEQ ID NO: 694209 - RNA, 22 nt, Human
caggagcucaagaccacccugg

SEQ ID NO: 694210 - RNA, 22 nt, Human
uccucuggcccagcugccucug

SEQ ID NO: 694211 - RNA, 22 nt, Human
ucgauagaaaagagcugcaggg

SEQ ID NO: 694212 - RNA, 22 nt, Human
uauuguacauuucaaaguagcu

SEQ ID NO: 694213 - RNA, 22 nt, Human
aaaacuguaucuucuugggacu

SEQ ID NO: 694214 - RNA, 22 nt, Human
guucaguauuaaugagaugauu

SEQ ID NO: 694215 - RNA, 22 nt, Human
augacaguucuacacuuaaucu

SEQ ID NO: 694216 - RNA, 22 nt, Human
cuugacagaagguuuuauccua

SEQ ID NO: 694217 - RNA, 22 nt, Human
ggcacagcacuguaggccuggg

SEQ ID NO: 694218 - RNA, 22 nt, Human
caggucugugugccauuuccaa

SEQ ID NO: 694219 - RNA, 22 nt, Human
uuccaugccuagaacaggauuc

SEQ ID NO: 694220 - RNA, 19 nt, Human
acaaauuguccucaucaag

SEQ ID NO: 694221 - RNA, 22 nt, Human
ggagcggucagcuggccacacg

SEQ ID NO: 694222 - RNA, 20 nt, Human
gggagaagggcugaugagag

SEQ ID NO: 694223 - RNA, 22 nt, Human
uacauuguacuuacaaauagug

SEQ ID NO: 694224 - RNA, 22 nt, Human
uaaagugcucauaaaaauggau

SEQ ID NO: 694225 - RNA, 22 nt, Human
ugcauuccacauaaagcgauaa

SEQ ID NO: 694226 - RNA, 22 nt, Human
uaugagaauuugcuaauuggcu

SEQ ID NO: 694227 - RNA, 22 nt, Human
cuauuauuuccucaucuauaaa

SEQ ID NO: 694228 - RNA, 22 nt, Human
uccaggacagaguagaagcagc

SEQ ID NO: 694229 - RNA, 22 nt, Human
uuguuuaaaagaaaucauagaa

SEQ ID NO: 694230 - RNA, 22 nt, Human
auggcuuuugaugcuaagccaa

SEQ ID NO: 694231 - RNA, 22 nt, Human
ugcagagagauauggcaagagg

SEQ ID NO: 694232 - RNA, 22 nt, Human
uaauuguauggagaaggcugca

SEQ ID NO: 694233 - RNA, 22 nt, Human
ucugcagcaaccuuucaccucc

SEQ ID NO: 694234 - RNA, 22 nt, Human
gugggcagugguuugcgcgguc

SEQ ID NO: 694235 - RNA, 22 nt, Human
acacauauguaugcaucaugug

SEQ ID NO: 694236 - RNA, 19 nt, Human
agcuggagauuggagggca

SEQ ID NO: 694237 - RNA, 20 nt, Human
gagggcaggcacccauuuca

SEQ ID NO: 694238 - RNA, 22 nt, Human
augccugccauuuagaagucuu

SEQ ID NO: 694239 - RNA, 22 nt, Human
uccaaagaaccuggcuacuguc

SEQ ID NO: 694240 - RNA, 22 nt, Human
gucuucuaaguaucaaagcaga

SEQ ID NO: 694241 - RNA, 22 nt, Human
cauaauuacugauaugcugauu

SEQ ID NO: 694242 - RNA, 22 nt, Human
cagguccuuuaguguccagaac

SEQ ID NO: 694243 - RNA, 22 nt, Human
uucccacauucuuuacauucau

SEQ ID NO: 694244 - RNA, 22 nt, Human
uggagccaaugaacauuugcug

SEQ ID NO: 694245 - RNA, 22 nt, Human
ggugucuggacagugagccagg

SEQ ID NO: 694246 - RNA, 22 nt, Human
uuagaaucagguguuauaauca

SEQ ID NO: 694247 - RNA, 18 nt, Human
ucaggagacacagacgca

SEQ ID NO: 694248 - RNA, 22 nt, Human
uccaucacuauuaucuacaaca

SEQ ID NO: 694249 - RNA, 22 nt, Human
cccucccugugugccucauuug

SEQ ID NO: 694250 - RNA, 22 nt, Human
guggauggagcuggaagccauu

SEQ ID NO: 694251 - RNA, 22 nt, Human
uagaaguuaaaggaauacagaa

SEQ ID NO: 694252 - RNA, 22 nt, Human
aaaguauauuuacuuacuguga

SEQ ID NO: 694253 - RNA, 22 nt, Human
uccugggacucuuuaucagaga

SEQ ID NO: 694254 - RNA, 22 nt, Human
cugugugagcaucacuucagau

SEQ ID NO: 694255 - RNA, 22 nt, Human
uaaguuucuacuugucgggucu

SEQ ID NO: 694256 - RNA, 20 nt, Human
gucucagaauggauuugcau

SEQ ID NO: 694257 - RNA, 22 nt, Human
ucaauguuuggaaauccuuugu

SEQ ID NO: 694258 - RNA, 22 nt, Human
ucaguguggaaaauccuuuggc

SEQ ID NO: 694259 - RNA, 22 nt, Human
auuuauuaagcaucugcuaugu

SEQ ID NO: 694260 - RNA, 22 nt, Human
uucucagaggcugcuaagugca

SEQ ID NO: 694261 - RNA, 21 nt, Human
aggcagcaucugauuuauaug

SEQ ID NO: 694262 - RNA, 22 nt, Human
caggaacaauaucuguccuggu

SEQ ID NO: 694263 - RNA, 22 nt, Human
ugugcccauuccacuugaguac

SEQ ID NO: 694264 - RNA, 22 nt, Human
ucugcugaaucagauagcuaag

SEQ ID NO: 694265 - RNA, 22 nt, Human
uggccacacugcccccacuggg

SEQ ID NO: 694266 - RNA, 22 nt, Human
ugcagagguuuuuaauacauuu

SEQ ID NO: 694267 - RNA, 22 nt, Human
ucacaugucacaaaacacugcc

SEQ ID NO: 694268 - RNA, 22 nt, Human
gcagguggugggggagccguuc

SEQ ID NO: 694269 - RNA, 22 nt, Human
aaggaacugcugauguggugac

SEQ ID NO: 694270 - RNA, 22 nt, Human
gcuuccuagcauuagccauugc

SEQ ID NO: 694271 - RNA, 22 nt, Human
augguuaaauugguuauuuaug

SEQ ID NO: 694272 - RNA, 22 nt, Human
agaaguuaccacauacuucucu

SEQ ID NO: 694273 - RNA, 22 nt, Human
acaaccuguucguuuccacaga

SEQ ID NO: 694274 - RNA, 22 nt, Human
aaagauugaaagagaauuuguc

SEQ ID NO: 694275 - RNA, 22 nt, Human
guguaugagccuccagcugggc

SEQ ID NO: 694276 - RNA, 22 nt, Human
cccaggcaucccauuaaggagc

SEQ ID NO: 694277 - RNA, 22 nt, Human
ucacccagguaauagcaguuug

SEQ ID NO: 694278 - RNA, 22 nt, Human
uccuggagugucuuccccaagg

SEQ ID NO: 694279 - RNA, 22 nt, Human
guacugaacuuaaaaauccccu

SEQ ID NO: 694280 - RNA, 22 nt, Human
ggcucagggaaugaggaagaau

SEQ ID NO: 694281 - RNA, 22 nt, Human
aggcccugagcauccgagggca

SEQ ID NO: 694282 - RNA, 23 nt, Human
acugagguacugagguugugaca

SEQ ID NO: 694283 - RNA, 22 nt, Human
ggcacugaaccaggacacaagc

SEQ ID NO: 694284 - RNA, 20 nt, Human
gaguauauuucuuccuuugc

SEQ ID NO: 694285 - RNA, 22 nt, Human
agcuccuggucuuuguccagag

SEQ ID NO: 694286 - RNA, 22 nt, Human
gagccagccuucuucugagguc

SEQ ID NO: 694287 - RNA, 22 nt, Human
uaucuguuuauuguuacuguca

SEQ ID NO: 694288 - RNA, 22 nt, Human
cucuccagggcaugaguuccac

SEQ ID NO: 694289 - RNA, 22 nt, Human
auucagacugucuaaaugguuu

SEQ ID NO: 694290 - RNA, 22 nt, Human
gcagggcugauguuauugacga

SEQ ID NO: 694291 - RNA, 22 nt, Human
ccagcuuuucagaaucugccug

SEQ ID NO: 694292 - RNA, 22 nt, Human
cuggcuccauccuaggcaaaug

SEQ ID NO: 694293 - RNA, 22 nt, Human
gugucccaauguucaggacggc

SEQ ID NO: 694294 - RNA, 22 nt, Human
uugcaguagguggagugaauuu

SEQ ID NO: 694295 - RNA, 22 nt, Human
uuauucaggaagguguuacuua

SEQ ID NO: 694296 - RNA, 22 nt, Human
uuguuuuaagccagucugccua

SEQ ID NO: 694297 - RNA, 20 nt, Human
aucuucuuggccagcuugcu

SEQ ID NO: 694298 - RNA, 22 nt, Human
auguccucggcucugugcugcu

SEQ ID NO: 694299 - RNA, 19 nt, Human
agagaaagaauugagucua

SEQ ID NO: 694300 - RNA, 18 nt, Human
ucauuagggauugcaaag

SEQ ID NO: 694301 - RNA, 22 nt, Human
gcuggugcauuagcugcaguuc

SEQ ID NO: 694302 - RNA, 22 nt, Human
aagcagcugugugacauaaucu

SEQ ID NO: 694303 - RNA, 22 nt, Human
aaggcauguguccucagagaga

SEQ ID NO: 694304 - RNA, 22 nt, Human
gcuccaggcgagcuggaccaga

SEQ ID NO: 694305 - RNA, 19 nt, Human
ccagccucucuuccacccc

SEQ ID NO: 694306 - RNA, 22 nt, Human
ugcuuggcuucauuuaaguuuu

SEQ ID NO: 694307 - RNA, 22 nt, Human
uuuguguauguaugcuuguaca

SEQ ID NO: 694308 - RNA, 20 nt, Human
ccauucugggugcagucugg

SEQ ID NO: 694309 - RNA, 22 nt, Human
ucacaagacagaaaacauuuag

SEQ ID NO: 694310 - RNA, 22 nt, Human
gggugggaugccgcugucucca

SEQ ID NO: 694311 - RNA, 19 nt, Human
uaugacaaguacuaguucu

SEQ ID NO: 694312 - RNA, 22 nt, Human
ugaagcagcaccauuuuagagc

SEQ ID NO: 694313 - RNA, 20 nt, Human
aguggaauuucagauacccc

SEQ ID NO: 694314 - RNA, 22 nt, Human
cauguaaagcacuucauaacag

SEQ ID NO: 694315 - RNA, 22 nt, Human
ugaggcagguaagcaaguuuug

SEQ ID NO: 694316 - RNA, 17 nt, Human
ugaagaugcauggcagc

SEQ ID NO: 694317 - RNA, 22 nt, Human
gugacuguaauuaccuuagcaa

SEQ ID NO: 694318 - RNA, 22 nt, Human
uguucugcaaugcugccuccuu

SEQ ID NO: 694319 - RNA, 22 nt, Human
caaaauaccacgacuuguuuua

SEQ ID NO: 694320 - RNA, 22 nt, Human
gacuucaaaagcugacauucau

SEQ ID NO: 694321 - RNA, 22 nt, Human
cacauuuaugggcugggaggca

SEQ ID NO: 694322 - RNA, 22 nt, Human
uccucacagcugguucauucag

SEQ ID NO: 694323 - RNA, 22 nt, Human
acaggcagugauuuccucuggu

SEQ ID NO: 694324 - RNA, 22 nt, Human
cccaggcagccccagaagcuug

SEQ ID NO: 694325 - RNA, 22 nt, Human
uaacuguauagcuuggacuaaa

SEQ ID NO: 694326 - RNA, 22 nt, Human
uuccccucucagaucuggccua

SEQ ID NO: 694327 - RNA, 22 nt, Human
ugcuuucaugaagucuauagag

SEQ ID NO: 694328 - RNA, 22 nt, Human
uuacagaaagguugugggauag

SEQ ID NO: 694329 - RNA, 22 nt, Human
ucaggaagggcucagucugugc

SEQ ID NO: 694330 - RNA, 22 nt, Human
aaauguguguauguacauauau

SEQ ID NO: 694331 - RNA, 22 nt, Human
augagcugugggauuccagagg

SEQ ID NO: 694332 - RNA, 22 nt, Human
uuuccuaugauauucuaugugu

SEQ ID NO: 694333 - RNA, 22 nt, Human
ucauaguucuguuuugaaggau

SEQ ID NO: 694334 - RNA, 22 nt, Human
uaaucuguuguuaauauugacu

SEQ ID NO: 694335 - RNA, 22 nt, Human
uuggaaggcugaauggccucuc

SEQ ID NO: 694336 - RNA, 22 nt, Human
acugaggauuagcccaggcuag

SEQ ID NO: 694337 - RNA, 22 nt, Human
acagagcacauagauuggaguu

SEQ ID NO: 694338 - RNA, 22 nt, Human
ucugcuucugugaaggcagucu

SEQ ID NO: 694339 - RNA, 22 nt, Human
uuacuuuggguccugcuuauaa

SEQ ID NO: 694340 - RNA, 22 nt, Human
aguacccuagggugggagcuca

SEQ ID NO: 694341 - RNA, 22 nt, Human
augaaacucuaacuuaacaagu

SEQ ID NO: 694342 - RNA, 22 nt, Human
cauggcuuacuuucagggagua

SEQ ID NO: 694343 - RNA, 22 nt, Human
gauccguuuauacugaguuuga

SEQ ID NO: 694344 - RNA, 18 nt, Human
agcaggugugcagaaugu

SEQ ID NO: 694345 - RNA, 22 nt, Human
uucucuuucuacagugugauug

SEQ ID NO: 694346 - RNA, 22 nt, Human
ugcagagaucugggcgucggcu

SEQ ID NO: 694347 - RNA, 22 nt, Human
agcagcauggaugggccucagc

SEQ ID NO: 694348 - RNA, 22 nt, Human
auaaguucagguaaagaaauca

SEQ ID NO: 694349 - RNA, 22 nt, Human
acauuugucuucuuucagauua

SEQ ID NO: 694350 - RNA, 22 nt, Human
acacuuauuucuugucuaacca

SEQ ID NO: 694351 - RNA, 22 nt, Human
gaggaaccaaaucagcuugcac

SEQ ID NO: 694352 - RNA, 20 nt, Human
ugcagggccuaaaaagggaa

SEQ ID NO: 694353 - RNA, 22 nt, Human
ccugaccuauuuuucucagcug

SEQ ID NO: 694354 - RNA, 18 nt, Human
caauuuuacccagucccu

SEQ ID NO: 694355 - RNA, 22 nt, Human
ccaauguuaggcucugguuuua

SEQ ID NO: 694356 - RNA, 22 nt, Human
ugcaggaacauagguuccuugg

SEQ ID NO: 694357 - RNA, 22 nt, Human
uuucacagcuagugagcuucua

SEQ ID NO: 694358 - RNA, 22 nt, Human
cagcccaggacugcagguguuu

SEQ ID NO: 694359 - RNA, 22 nt, Human
aagcagccuggacuugggcugg

SEQ ID NO: 694360 - RNA, 22 nt, Human
ggggggugacaaguagagguug

SEQ ID NO: 694361 - RNA, 22 nt, Human
guggaguggccuggcccugaga

SEQ ID NO: 694362 - RNA, 22 nt, Human
agcagcuuacauguggccuauc

SEQ ID NO: 694363 - RNA, 22 nt, Human
guucacaguuucuaaucccagc

SEQ ID NO: 694364 - RNA, 22 nt, Human
uguuuaaugcauugaccuuggg

SEQ ID NO: 694365 - RNA, 23 nt, Human
aagcaauaccaggugugggcccu

SEQ ID NO: 694366 - RNA, 20 nt, Human
uguuccaugacuauuuggau

SEQ ID NO: 694367 - RNA, 22 nt, Human
cugcucugcagcuuggacuccc

SEQ ID NO: 694368 - RNA, 22 nt, Human
gcacagcacagcaacauguuuu

SEQ ID NO: 694369 - RNA, 22 nt, Human
ucugccuaugcuguaccuuugu

SEQ ID NO: 694370 - RNA, 22 nt, Human
uucagguuuuuaaguucugccu

SEQ ID NO: 694371 - RNA, 22 nt, Human
uaggcagagaggccauaagaau

SEQ ID NO: 694372 - RNA, 22 nt, Human
ggcuucuugugugucaggcucu

SEQ ID NO: 694373 - RNA, 22 nt, Human
aggccaaagcacagagcuggaa

SEQ ID NO: 694374 - RNA, 23 nt, Human
ucugagguccaccaguuugcaga

SEQ ID NO: 694375 - RNA, 22 nt, Human
cugugucccuugucccagagcc

SEQ ID NO: 694376 - RNA, 22 nt, Human
ucuaacuauacaaagaaaacau

SEQ ID NO: 694377 - RNA, 22 nt, Human
auuacaguaacagcuacaaugc

SEQ ID NO: 694378 - RNA, 22 nt, Human
ugcagcagccaagguucugugc

SEQ ID NO: 694379 - RNA, 22 nt, Human
uuuaucagagauauguguggac

SEQ ID NO: 694380 - RNA, 22 nt, Human
cucugugucugaguuauggucu

SEQ ID NO: 694381 - RNA, 22 nt, Human
caccuggaugccacaaagccac

SEQ ID NO: 694382 - RNA, 22 nt, Human
ccuauugacaauucucuucucc

SEQ ID NO: 694383 - RNA, 22 nt, Human
cgguccuguacuugaugagaua

SEQ ID NO: 694384 - RNA, 22 nt, Human
cauuacaacaaucugccauggc

SEQ ID NO: 694385 - RNA, 22 nt, Human
ugcugccaaaugcgagcucugu

SEQ ID NO: 694386 - RNA, 22 nt, Human
uuggcugagagaggaaaagggc

SEQ ID NO: 694387 - RNA, 22 nt, Human
gaagcaaguggccugauucaga

SEQ ID NO: 694388 - RNA, 22 nt, Human
aauuggcagaacuuuauauauu

SEQ ID NO: 694389 - RNA, 22 nt, Human
uuagaggacuguaggugggaau

SEQ ID NO: 694390 - RNA, 22 nt, Human
ugcugccuaauaagucgagggu

SEQ ID NO: 694391 - RNA, 22 nt, Human
auaauauuugcauuacugugau

SEQ ID NO: 694392 - RNA, 22 nt, Human
auuuccuucccagauuugguuc

SEQ ID NO: 694393 - RNA, 22 nt, Human
uuucaaggugcaggaggguuuu

SEQ ID NO: 694394 - RNA, 22 nt, Human
aguaaacaauguaugaggacag

SEQ ID NO: 694395 - RNA, 22 nt, Human
cuggcugacacaaagguaucga

SEQ ID NO: 694396 - RNA, 22 nt, Human
gaggccuggguuggaggugcau

SEQ ID NO: 694397 - RNA, 22 nt, Human
augaaugcugggacaaauauau

SEQ ID NO: 694398 - RNA, 22 nt, Human
agaugauggccauguccucucc

SEQ ID NO: 694399 - RNA, 22 nt, Human
cugguccuugacgcgugggagg

SEQ ID NO: 694400 - RNA, 22 nt, Human
gcaguaguucugauuggaacuu

SEQ ID NO: 694401 - RNA, 22 nt, Human
acagaagcaaaagcaggaucuu

SEQ ID NO: 694402 - RNA, 22 nt, Human
acacauaagccuaaucaucucc

SEQ ID NO: 694403 - RNA, 22 nt, Human
guggccagagugucauuuuauu

SEQ ID NO: 694404 - RNA, 22 nt, Human
gcagcagaugugggcccagagc

SEQ ID NO: 694405 - RNA, 20 nt, Human
aggcccugugcaucuuguuu

SEQ ID NO: 694406 - RNA, 22 nt, Human
uugugugcugagggccugcugu

SEQ ID NO: 694407 - RNA, 22 nt, Human
cacauacaagccauggggggau

SEQ ID NO: 694408 - RNA, 22 nt, Human
cuaaggaaaaggauauauaugu

SEQ ID NO: 694409 - RNA, 22 nt, Human
uuuacacauuauuuucagugug

SEQ ID NO: 694410 - RNA, 19 nt, Human
auucuuguuaagugucauc

SEQ ID NO: 694411 - RNA, 22 nt, Human
guguuacauauaccugagcuua

SEQ ID NO: 694412 - RNA, 21 nt, Human
acugugacuggguguaugggu

SEQ ID NO: 694413 - RNA, 22 nt, Human
auggcucuagaauaccccucag

SEQ ID NO: 694414 - RNA, 22 nt, Human
gggagcuggaugauugaggcaa

SEQ ID NO: 694415 - RNA, 22 nt, Human
cuggcacagagugagcauucaa

SEQ ID NO: 694416 - RNA, 22 nt, Human
cagaggaaaugggaaggagaua

SEQ ID NO: 694417 - RNA, 22 nt, Human
guucauccaugucagcguauau

SEQ ID NO: 694418 - RNA, 22 nt, Human
caggaaaggugugucaugaugg

SEQ ID NO: 694419 - RNA, 22 nt, Human
uuuagacaagauccuucugaau

SEQ ID NO: 694420 - RNA, 22 nt, Human
ugcaggcuccacguuguugucc

SEQ ID NO: 694421 - RNA, 22 nt, Human
uuaugucuuaaguaugcuaauu

SEQ ID NO: 694422 - RNA, 23 nt, Human
ucggugggcguggaggccgaggc

SEQ ID NO: 694423 - RNA, 22 nt, Human
ccuggugccacuagagaauguc

SEQ ID NO: 694424 - RNA, 22 nt, Human
cagcccugagagaaccaucuau

SEQ ID NO: 694425 - RNA, 22 nt, Human
uaggcaugcaaauaaaugugca

SEQ ID NO: 694426 - RNA, 22 nt, Human
ugccuugguucucuacuuggag

SEQ ID NO: 694427 - RNA, 22 nt, Human
uccugggacucaacuuagaagg

SEQ ID NO: 694428 - RNA, 22 nt, Human
ggaaacuuguuauuguauuuuc

SEQ ID NO: 694429 - RNA, 22 nt, Human
uacaaagucagaauaacaggug

SEQ ID NO: 694430 - RNA, 22 nt, Human
acauccaccacaugccaggcuc

SEQ ID NO: 694431 - RNA, 19 nt, Human
cugucugcggggccuguuc

SEQ ID NO: 694432 - RNA, 21 nt, Human
agguggucugcagcagcugaa

SEQ ID NO: 694433 - RNA, 22 nt, Human
cccuguuuuaaguugauauuga

SEQ ID NO: 694434 - RNA, 18 nt, Human
uccugguauugcaagcac

SEQ ID NO: 694435 - RNA, 22 nt, Human
uucuuaauaccuauuuucuacc

SEQ ID NO: 694436 - RNA, 22 nt, Human
cuuugugucuguuaauaauuau

SEQ ID NO: 694437 - RNA, 22 nt, Human
uagauacuuauaaucuuccaag

SEQ ID NO: 694438 - RNA, 22 nt, Human
aagugguuauuuugaucuagaa

SEQ ID NO: 694439 - RNA, 22 nt, Human
uccugcaggcuugaguccucag

SEQ ID NO: 694440 - RNA, 22 nt, Human
gcagaggcuccauuuuacagau

SEQ ID NO: 694441 - RNA, 18 nt, Human
agcaacagaaacauaugg

SEQ ID NO: 694442 - RNA, 22 nt, Human
uauuuauaaucugccaaagaga

SEQ ID NO: 694443 - RNA, 22 nt, Human
gaggacaggagacucacuguuu

SEQ ID NO: 694444 - RNA, 22 nt, Human
auuuuacuucauuugaaaugcc

SEQ ID NO: 694445 - RNA, 22 nt, Human
gucagcuucccuuugguuuauu

SEQ ID NO: 694446 - RNA, 22 nt, Human
aagggcuggaauaucucuuaga

SEQ ID NO: 694447 - RNA, 22 nt, Human
cuggcuuuuuucccauuaugca

SEQ ID NO: 694448 - RNA, 22 nt, Human
gcugcugcugaggaugcaccug

SEQ ID NO: 694449 - RNA, 22 nt, Human
uauauaauuuguaaaagcaccu

SEQ ID NO: 694450 - RNA, 23 nt, Human
cuguagcuaaaagcugggauuug

SEQ ID NO: 694451 - RNA, 22 nt, Human
uucuuagaugauuaaugauggg

SEQ ID NO: 694452 - RNA, 22 nt, Human
gcuauuuuugagccauuuauaa

SEQ ID NO: 694453 - RNA, 23 nt, Human
ugcugugccuuugucugccucca

SEQ ID NO: 694454 - RNA, 22 nt, Human
ugcaccaguuucucagagaauc

SEQ ID NO: 694455 - RNA, 22 nt, Human
uggcuaaacuugggucagaugu

SEQ ID NO: 694456 - RNA, 22 nt, Human
auaaauuaggaucugggguucc

SEQ ID NO: 694457 - RNA, 22 nt, Human
gcugucuguggugucagcugac

SEQ ID NO: 694458 - RNA, 22 nt, Human
aauuccaacagacaaaguuaga

SEQ ID NO: 694459 - RNA, 22 nt, Human
uucuuuggcugccagucuggag

SEQ ID NO: 694460 - RNA, 22 nt, Human
cucuuucugauucgcugggacc

SEQ ID NO: 694461 - RNA, 22 nt, Human
gccuuucaguuccaucaaagga

SEQ ID NO: 694462 - RNA, 18 nt, Human
ucaggcucucuggcuaga

SEQ ID NO: 694463 - RNA, 22 nt, Human
acaaaguuucuucuaacaucug

SEQ ID NO: 694464 - RNA, 22 nt, Human
aaacgguugcucauaguuacau

SEQ ID NO: 694465 - RNA, 22 nt, Human
uagcagcuaugccauuuugaca

SEQ ID NO: 694466 - RNA, 22 nt, Human
uuuaacauguaauugcugcuuu

SEQ ID NO: 694467 - RNA, 22 nt, Human
aacauguagcagaaacgacuaa

SEQ ID NO: 694468 - RNA, 22 nt, Human
aagauucuugacuagaaugauu

SEQ ID NO: 694469 - RNA, 22 nt, Human
uuguagaauuuggaucucggca

SEQ ID NO: 694470 - RNA, 23 nt, Human
uuguauuuuuaguagagacaggg

SEQ ID NO: 694471 - RNA, 22 nt, Human
ucacaaauuucagcucccugaa

SEQ ID NO: 694472 - RNA, 22 nt, Human
aaauggcaacagaagggaguuc

SEQ ID NO: 694473 - RNA, 22 nt, Human
ugugaggauggaguucuacagg

SEQ ID NO: 694474 - RNA, 22 nt, Human
uuucugaggaauuaauacagaa

SEQ ID NO: 694475 - RNA, 22 nt, Human
gagccagaaaagcugccugacu

SEQ ID NO: 694476 - RNA, 22 nt, Human
auuuugaaaagcauuugaguaa

SEQ ID NO: 694477 - RNA, 22 nt, Human
agggccugggauguccuccuag

SEQ ID NO: 694478 - RNA, 22 nt, Human
cagaccucaaagcugcagugcu

SEQ ID NO: 694479 - RNA, 22 nt, Human
ugcuggggucauggggcgcccg

SEQ ID NO: 694480 - RNA, 22 nt, Human
ccaaguacagauuccuccacug

SEQ ID NO: 694481 - RNA, 22 nt, Human
cucagaggcaagcaaggagcug

SEQ ID NO: 694482 - RNA, 22 nt, Human
uguuaaauguauuauguguucu

SEQ ID NO: 694483 - RNA, 19 nt, Human
ugggcagguucaguaaugg

SEQ ID NO: 694484 - RNA, 22 nt, Human
ggccucucuccuuggcuugcag

SEQ ID NO: 694485 - RNA, 22 nt, Human
auuccaguuaguggcagcuuau

SEQ ID NO: 694486 - RNA, 22 nt, Human
aauauaugacuccacugcauga

SEQ ID NO: 694487 - RNA, 22 nt, Human
auuugaaaucuggguuacucug

SEQ ID NO: 694488 - RNA, 22 nt, Human
aggaaacuggguaugguuauac

SEQ ID NO: 694489 - RNA, 23 nt, Human
cccagcuuucccacugccgagag

SEQ ID NO: 694490 - RNA, 22 nt, Human
aaaccugaauguaugucagaag

SEQ ID NO: 694491 - RNA, 22 nt, Human
uuuccucugggcccugccaccc

SEQ ID NO: 694492 - RNA, 21 nt, Human
cagugguugcugaauuagugg

SEQ ID NO: 694493 - RNA, 22 nt, Human
uaggaacaaagagccucacauu

SEQ ID NO: 694494 - RNA, 21 nt, Human
ccagaggccucucuuggccac

SEQ ID NO: 694495 - RNA, 22 nt, Human
uagcagcaauuacacaguccgu

SEQ ID NO: 694496 - RNA, 22 nt, Human
cauuucaagcauugacuucuau

SEQ ID NO: 694497 - RNA, 22 nt, Human
ucaggaagucucaauuagcuac

SEQ ID NO: 694498 - RNA, 22 nt, Human
ggagcccugcccuaggcagcuc

SEQ ID NO: 694499 - RNA, 22 nt, Human
accuggcaugaagcaugccuua

SEQ ID NO: 694500 - RNA, 21 nt, Human
cuuggcacagggaagaugcac

SEQ ID NO: 694501 - RNA, 22 nt, Human
uuuuagauugggaaauguaaag

SEQ ID NO: 694502 - RNA, 22 nt, Human
gguggguauugaauacaggugu

SEQ ID NO: 694503 - RNA, 22 nt, Human
cagagcagggugcaccuugggc

SEQ ID NO: 694504 - RNA, 22 nt, Human
uggcagguuuccuccucauagu

SEQ ID NO: 694505 - RNA, 22 nt, Human
ucacagaagguggccauagcug

SEQ ID NO: 694506 - RNA, 22 nt, Human
cccagggacagcuagguggggc

SEQ ID NO: 694507 - RNA, 22 nt, Human
gcuggcuggaguaaggagggag

SEQ ID NO: 694508 - RNA, 22 nt, Human
uucugaaauaggagauagcugu

SEQ ID NO: 694509 - RNA, 22 nt, Human
aauccugaccugggcaugcuug

SEQ ID NO: 694510 - RNA, 22 nt, Human
gccuggguuccaugaucuccag

SEQ ID NO: 694511 - RNA, 22 nt, Human
cucugugugguaugauugucau

SEQ ID NO: 694512 - RNA, 22 nt, Human
gcugggcacugucccauaggcu

SEQ ID NO: 694513 - RNA, 22 nt, Human
cacacuuugugcuaaucuauuu

SEQ ID NO: 694514 - RNA, 22 nt, Human
uggccugaggcucggcaugggu

SEQ ID NO: 694515 - RNA, 22 nt, Human
aaagugcugggauuccaggcgu

SEQ ID NO: 694516 - RNA, 22 nt, Human
uuugagaagaguuugagguauu

SEQ ID NO: 694517 - RNA, 22 nt, Human
acauuucuuuucaucucuauau

SEQ ID NO: 694518 - RNA, 22 nt, Human
ccacucugcugugcuccaugau

SEQ ID NO: 694519 - RNA, 21 nt, Human
ugggcaccaaaaccuaggagu

SEQ ID NO: 694520 - RNA, 22 nt, Human
acacacuguugcucauccaggc

SEQ ID NO: 694521 - RNA, 22 nt, Human
aggggaggcagcgauaaaccug

SEQ ID NO: 694522 - RNA, 22 nt, Human
ugcuaaauaaguggaauagaca

SEQ ID NO: 694523 - RNA, 22 nt, Human
cuccccuccuuaggucuucuag

SEQ ID NO: 694524 - RNA, 22 nt, Human
agcaccuguggcucaugcucgu

SEQ ID NO: 694525 - RNA, 22 nt, Human
cucugggaagggcugagcacug

SEQ ID NO: 694526 - RNA, 22 nt, Human
ucaguaucaggcuggaauuaag

SEQ ID NO: 694527 - RNA, 22 nt, Human
ugcauacugaaucugccaucac

SEQ ID NO: 694528 - RNA, 22 nt, Human
accuuuuauguaaauauauguu

SEQ ID NO: 694529 - RNA, 22 nt, Human
agcagggacugagccaguggga

SEQ ID NO: 694530 - RNA, 16 nt, Human
gggagggaguuggugg

SEQ ID NO: 694531 - RNA, 20 nt, Human
cagaaagaagguagauuuuu

SEQ ID NO: 694532 - RNA, 22 nt, Human
guggccagggcccacaggauga

SEQ ID NO: 694533 - RNA, 22 nt, Human
ccuggagagagaggccaacugc

SEQ ID NO: 694534 - RNA, 22 nt, Human
ucaauacagaaaggauauuuug

SEQ ID NO: 694535 - RNA, 20 nt, Human
cagcagccauucuaguagua

SEQ ID NO: 694536 - RNA, 22 nt, Human
aaugucugagucucuguauccc

SEQ ID NO: 694537 - RNA, 22 nt, Human
acucugaggagugacuagaggu

SEQ ID NO: 694538 - RNA, 22 nt, Human
uacacaguauaugggaucacag

SEQ ID NO: 694539 - RNA, 22 nt, Human
gggcugugagaguggggcugcu

SEQ ID NO: 694540 - RNA, 22 nt, Human
uauugcuuucaguugcuuugag

SEQ ID NO: 694541 - RNA, 22 nt, Human
uuacaggugggaaaacuaagcu

SEQ ID NO: 694542 - RNA, 22 nt, Human
aaauugucucuauuuugauucg

SEQ ID NO: 694543 - RNA, 22 nt, Human
auaaaucucuuaagacucaaca

SEQ ID NO: 694544 - RNA, 22 nt, Human
cauugcacuuuggguccaggac

SEQ ID NO: 694545 - RNA, 22 nt, Human
gcacaaauacaaaguugagaaa

SEQ ID NO: 694546 - RNA, 22 nt, Human
gacuacaggugugugccaccau

SEQ ID NO: 694547 - RNA, 22 nt, Human
cuccucuccaucagcgccaccc

SEQ ID NO: 694548 - RNA, 22 nt, Human
aucugcuuccuccuuagggaaa

SEQ ID NO: 694549 - RNA, 22 nt, Human
ugcagcugcuggcccaggugcu

SEQ ID NO: 694550 - RNA, 22 nt, Human
cccagagguuccuuagggacca

SEQ ID NO: 694551 - RNA, 21 nt, Human
uuccagagauuguuucaccug

SEQ ID NO: 694552 - RNA, 22 nt, Human
uccugacuccagguccugugug

SEQ ID NO: 694553 - RNA, 22 nt, Human
cagcucaggcucuccaugcucc

SEQ ID NO: 694554 - RNA, 22 nt, Human
uccaggcuggcucuucaaaauu

SEQ ID NO: 694555 - RNA, 23 nt, Human
gguccaggaaaggcagcagcacc

SEQ ID NO: 694556 - RNA, 22 nt, Human
cagcugugagagugcauugaag

SEQ ID NO: 694557 - RNA, 22 nt, Human
aucuuuaccaccaaagaaugcu

SEQ ID NO: 694558 - RNA, 22 nt, Human
ucagggcuuuggcuuuuacucu

SEQ ID NO: 694559 - RNA, 23 nt, Human
uaguuauuuucucuguaauuugc

SEQ ID NO: 694560 - RNA, 22 nt, Human
ggagaggugagagguacaaguu

SEQ ID NO: 694561 - RNA, 22 nt, Human
cugaaguucauacaauggccau

SEQ ID NO: 694562 - RNA, 22 nt, Human
ggaggcuccaugagcuccugca

SEQ ID NO: 694563 - RNA, 22 nt, Human
uuuagcuucaguucuagcuucu

SEQ ID NO: 694564 - RNA, 22 nt, Human
aaaugcauugguuucuacuugu

SEQ ID NO: 694565 - RNA, 22 nt, Human
uuggcagacugacaaucuguuu

SEQ ID NO: 694566 - RNA, 22 nt, Human
uaaugcaguacugauauaaaca

SEQ ID NO: 694567 - RNA, 22 nt, Human
caguccuuauuccuauauuccu

SEQ ID NO: 694568 - RNA, 19 nt, Human
agcaggccaggcagguggc

SEQ ID NO: 694569 - RNA, 22 nt, Human
acagaugaggcuggcgagggca

SEQ ID NO: 694570 - RNA, 22 nt, Human
aucuggcuuuuacugaauugcu

SEQ ID NO: 694571 - RNA, 22 nt, Human
ucucugaagauauuuauuauua

SEQ ID NO: 694572 - RNA, 22 nt, Human
ugaaugaucuaguuuuguagac

SEQ ID NO: 694573 - RNA, 23 nt, Human
acugccugugccgaucucucuca

SEQ ID NO: 694574 - RNA, 22 nt, Human
ucucugggaauucacaagcccu

SEQ ID NO: 694575 - RNA, 22 nt, Human
uuuucaguuccaucucugcucu

SEQ ID NO: 694576 - RNA, 22 nt, Human
cacugaagccacuggaagagga

SEQ ID NO: 694577 - RNA, 22 nt, Human
agcccugggucccaguccuggc

SEQ ID NO: 694578 - RNA, 22 nt, Human
auuacacauagacauucguuca

SEQ ID NO: 694579 - RNA, 22 nt, Human
ccuggagcaggagcugcagagg

SEQ ID NO: 694580 - RNA, 20 nt, Human
uuacucaguuccugccaugc

SEQ ID NO: 694581 - RNA, 22 nt, Human
uaccauuucuacauaucuuguc

SEQ ID NO: 694582 - RNA, 22 nt, Human
cacagggccacuuucccaguaa

SEQ ID NO: 694583 - RNA, 22 nt, Human
cauuugaacuaauaacugugcu

SEQ ID NO: 694584 - RNA, 22 nt, Human
uuuguucaacaggugaaauaga

SEQ ID NO: 694585 - RNA, 22 nt, Human
cuauacagugacuagaaguaau

SEQ ID NO: 694586 - RNA, 22 nt, Human
gaggggugggcuggaaguuaua

SEQ ID NO: 694587 - RNA, 22 nt, Human
ucagcagacuaggcagauuacu

SEQ ID NO: 694588 - RNA, 19 nt, Human
cuucuccagcuucuagaag

SEQ ID NO: 694589 - RNA, 22 nt, Human
auuguacagacaugggaaacaa

SEQ ID NO: 694590 - RNA, 22 nt, Human
uaauguguugaauauuuguaca

SEQ ID NO: 694591 - RNA, 22 nt, Human
ucccgauaggcagggcucuggc

SEQ ID NO: 694592 - RNA, 22 nt, Human
auguauauacuuacaugugugg

SEQ ID NO: 694593 - RNA, 22 nt, Human
uuccacagucauccugggaauu

SEQ ID NO: 694594 - RNA, 22 nt, Human
ugagcuggcacuuuuccuggga

SEQ ID NO: 694595 - RNA, 22 nt, Human
ggcugaauguuggacacuuacg

SEQ ID NO: 694596 - RNA, 22 nt, Human
cuccuguggcuuucugauuuca

SEQ ID NO: 694597 - RNA, 17 nt, Human
cccagagaugcugccuu

SEQ ID NO: 694598 - RNA, 21 nt, Human
acacaggcagugucccgaggu

SEQ ID NO: 694599 - RNA, 22 nt, Human
uccugaaaaauuacauguucag

SEQ ID NO: 694600 - RNA, 22 nt, Human
acagugaaaauucuauugauuu

SEQ ID NO: 694601 - RNA, 23 nt, Human
ggauuggccccaggaguaugggu

SEQ ID NO: 694602 - RNA, 22 nt, Human
guccauacaguggcacacaucu

SEQ ID NO: 694603 - RNA, 22 nt, Human
augaagacuauuugaaggugcc

SEQ ID NO: 694604 - RNA, 22 nt, Human
agugugugcaugcauucgugca

SEQ ID NO: 694605 - RNA, 22 nt, Human
ugcagccuuggcaaccagggac

SEQ ID NO: 694606 - RNA, 22 nt, Human
augcaugcagggaagacaguag

SEQ ID NO: 694607 - RNA, 21 nt, Human
uagaagcacauagguucaaag

SEQ ID NO: 694608 - RNA, 22 nt, Human
cuggagccgcauggagcaggga

SEQ ID NO: 694609 - RNA, 22 nt, Human
ccacgagggaaccagguggggu

SEQ ID NO: 694610 - RNA, 19 nt, Human
gcuuuaguuuacucaucua

SEQ ID NO: 694611 - RNA, 22 nt, Human
uccugaggagaagagugcuagg

SEQ ID NO: 694612 - RNA, 22 nt, Human
agccagcuaccggggcuccugg

SEQ ID NO: 694613 - RNA, 22 nt, Human
uaaaguuuggcagacaauaaca

SEQ ID NO: 694614 - RNA, 20 nt, Human
ggcagggcaucaacagcucu

SEQ ID NO: 694615 - RNA, 22 nt, Human
uuacagacaaacuguguuaagu

SEQ ID NO: 694616 - RNA, 22 nt, Human
agagagaauuggauaaauuggu

SEQ ID NO: 694617 - RNA, 22 nt, Human
aaaguauucaaaaauauuuggu

SEQ ID NO: 694618 - RNA, 22 nt, Human
uacagggcugagugagacaugg

SEQ ID NO: 694619 - RNA, 22 nt, Human
aggugacaugaaaaauguugag

SEQ ID NO: 694620 - RNA, 17 nt, Human
ccagagaguaguuagga

SEQ ID NO: 694621 - RNA, 22 nt, Human
cugugcacacgugcccaacagu

SEQ ID NO: 694622 - RNA, 22 nt, Human
ugagacaguuuuucuauuucca

SEQ ID NO: 694623 - RNA, 22 nt, Human
acuguuuugugccuuaguuucc

SEQ ID NO: 694624 - RNA, 22 nt, Human
caggucucggguucagcaguga

SEQ ID NO: 694625 - RNA, 22 nt, Human
agaauaaccaguguuucacagu

SEQ ID NO: 694626 - RNA, 22 nt, Human
aaacucuagggcuccacauucc

SEQ ID NO: 694627 - RNA, 22 nt, Human
acugaauagaaaugcucauagg

SEQ ID NO: 694628 - RNA, 22 nt, Human
caguagauuugguaaacuagga

SEQ ID NO: 694629 - RNA, 22 nt, Human
aagaacauuuuguagaaugaca

SEQ ID NO: 694630 - RNA, 21 nt, Human
agaagccaugugguggagaac

SEQ ID NO: 694631 - RNA, 22 nt, Human
gggcccacuggcugucugaccc

SEQ ID NO: 694632 - RNA, 22 nt, Human
caggaauguuugugcuccuuua

SEQ ID NO: 694633 - RNA, 22 nt, Human
gcuugagaacuucaacucagug

SEQ ID NO: 694634 - RNA, 22 nt, Human
gagugucuguggggcauggaca

SEQ ID NO: 694635 - RNA, 22 nt, Human
uaugguuauccucaaaagagga

SEQ ID NO: 694636 - RNA, 22 nt, Human
agucacauucugggguacuggg

SEQ ID NO: 694637 - RNA, 22 nt, Human
gcagagcagagccugcauuggc

SEQ ID NO: 694638 - RNA, 22 nt, Human
agcgagugggucagcguugcag

SEQ ID NO: 694639 - RNA, 22 nt, Human
cuggaacccaggccuggaagcc

SEQ ID NO: 694640 - RNA, 22 nt, Human
ggggcccagcaccccuccucgc

SEQ ID NO: 694641 - RNA, 22 nt, Human
uagcaaggacaacauaugagag

SEQ ID NO: 694642 - RNA, 22 nt, Human
ucagaggcuacagucugggagu

SEQ ID NO: 694643 - RNA, 22 nt, Human
auagcuuugagggcuccuuagg

SEQ ID NO: 694644 - RNA, 22 nt, Human
uaagacauuugaaaugugaucc

SEQ ID NO: 694645 - RNA, 22 nt, Human
cuggucaggcugaacugccaca

SEQ ID NO: 694646 - RNA, 21 nt, Human
auaaacugcaucaaguuggug

SEQ ID NO: 694647 - RNA, 22 nt, Human
gggaaagaagaagagccauuuu

SEQ ID NO: 694648 - RNA, 22 nt, Human
gcagcagaguuugggagauggu

SEQ ID NO: 694649 - RNA, 22 nt, Human
ggcaggcuugguggcaccgguu

SEQ ID NO: 694650 - RNA, 22 nt, Human
cucguugcugaagccaaaguca

SEQ ID NO: 694651 - RNA, 22 nt, Human
gagcuggcaggaggcuccccga

SEQ ID NO: 694652 - RNA, 22 nt, Human
ugcugcuguauccuuaguguca

SEQ ID NO: 694653 - RNA, 20 nt, Human
uccagauauuaagacaggca

SEQ ID NO: 694654 - RNA, 22 nt, Human
uagaggagaacacaaauuauag

SEQ ID NO: 694655 - RNA, 22 nt, Human
cccuggguucuggcugggcugc

SEQ ID NO: 694656 - RNA, 22 nt, Human
uguaaaugaaguaugcuuuacu

SEQ ID NO: 694657 - RNA, 22 nt, Human
ugucaguggucauaguagaaaa

SEQ ID NO: 694658 - RNA, 22 nt, Human
ccucagggaggccucuguggcu

SEQ ID NO: 694659 - RNA, 22 nt, Human
aaacagcuggucucaaauguuc

SEQ ID NO: 694660 - RNA, 22 nt, Human
gacagagaggcugagcaguaca

SEQ ID NO: 694661 - RNA, 22 nt, Human
gaagggcucaucagguggccgc

SEQ ID NO: 694662 - RNA, 22 nt, Human
acugaaguagucauugucauua

SEQ ID NO: 694663 - RNA, 22 nt, Human
uugacaaaggcugagaggaaaa

SEQ ID NO: 694664 - RNA, 22 nt, Human
guuaacauaggaguuuguugua

SEQ ID NO: 694665 - RNA, 22 nt, Human
uuagaacauuuuuagaccaaua

SEQ ID NO: 694666 - RNA, 22 nt, Human
ccauacacacaccaaauuugua

SEQ ID NO: 694667 - RNA, 22 nt, Human
aucacauuauguagugaaaagg

SEQ ID NO: 694668 - RNA, 22 nt, Human
auauacacaucuuuuuaaauau

SEQ ID NO: 694669 - RNA, 22 nt, Human
aaauugcuaguugcuuuuuuca

SEQ ID NO: 694670 - RNA, 20 nt, Human
aauguucaguaauuguuuua

SEQ ID NO: 694671 - RNA, 22 nt, Human
agcggcugucggccagccggag

SEQ ID NO: 694672 - RNA, 22 nt, Human
ccagggccucguguucugagug

SEQ ID NO: 694673 - RNA, 22 nt, Human
uccagggcagccgcgggugcgc

SEQ ID NO: 694674 - RNA, 23 nt, Human
ucucuuaucacaauucauuuugc

SEQ ID NO: 694675 - RNA, 22 nt, Human
uagacaaaagggggcagauaug

SEQ ID NO: 694676 - RNA, 22 nt, Human
gcauuuuucaucccucuugggu

SEQ ID NO: 694677 - RNA, 22 nt, Human
ucacucuguguuugaacucaag

SEQ ID NO: 694678 - RNA, 22 nt, Human
acacacuuuaaauuaaaccucu

SEQ ID NO: 694679 - RNA, 22 nt, Human
ucaggaaagguuuguugaaugg

SEQ ID NO: 694680 - RNA, 22 nt, Human
uagguagggaccaccuugggga

SEQ ID NO: 694681 - RNA, 22 nt, Human
gaagaaacaggggcuuggggag

SEQ ID NO: 694682 - RNA, 22 nt, Human
ccucugccaccucccacgaggc

SEQ ID NO: 694683 - RNA, 21 nt, Human
uaaggccaagucuauuucugu

SEQ ID NO: 694684 - RNA, 22 nt, Human
agucacuuccagacaccugccu

SEQ ID NO: 694685 - RNA, 18 nt, Human
agagggaaagcaggcuga

SEQ ID NO: 694686 - RNA, 22 nt, Human
acuguguggaccacucugaggc

SEQ ID NO: 694687 - RNA, 22 nt, Human
ccucugacuccacacuugaacu

SEQ ID NO: 694688 - RNA, 22 nt, Human
uugaucucuguugcugucuuug

SEQ ID NO: 694689 - RNA, 23 nt, Human
ggcagcugggcagcacucauggg

SEQ ID NO: 694690 - RNA, 22 nt, Human
gaaauacaaagccagccauuuu

SEQ ID NO: 694691 - RNA, 22 nt, Human
ugcagaggagucagccugggca

SEQ ID NO: 694692 - RNA, 22 nt, Human
uguaagaagggccagagcucca

SEQ ID NO: 694693 - RNA, 22 nt, Human
ucuucagcuguagucauuguuc

SEQ ID NO: 694694 - RNA, 22 nt, Human
aggcugcuucagcugcagggag

SEQ ID NO: 694695 - RNA, 22 nt, Human
aaaguugugaaaccgaacaugu

SEQ ID NO: 694696 - RNA, 22 nt, Human
gcucuggauccggcugggucug

SEQ ID NO: 694697 - RNA, 21 nt, Human
gccugcagaccccaccaggcu

SEQ ID NO: 694698 - RNA, 22 nt, Human
gaacacugagaaagucagcuuu

SEQ ID NO: 694699 - RNA, 21 nt, Human
auaauguacaaaaacugucuu

SEQ ID NO: 694700 - RNA, 22 nt, Human
auugaacugaauccuggauugc

SEQ ID NO: 694701 - RNA, 22 nt, Human
gggauggcuuuguggcugacuc

SEQ ID NO: 694702 - RNA, 22 nt, Human
cugcagcuuuuugugcuuguaa

SEQ ID NO: 694703 - RNA, 22 nt, Human
agcuccugaguagcuuuacuca

SEQ ID NO: 694704 - RNA, 22 nt, Human
cacgagggcacacgugggaggg

SEQ ID NO: 694705 - RNA, 22 nt, Human
ucagaggccaaacugagcaggg

SEQ ID NO: 694706 - RNA, 22 nt, Human
cauggcuuuuuagcauauucaa

SEQ ID NO: 694707 - RNA, 22 nt, Human
cacaggcaggagguucuccagu

SEQ ID NO: 694708 - RNA, 22 nt, Human
ucagugcagacuguaaguugga

SEQ ID NO: 694709 - RNA, 20 nt, Human
uuucagugguuugugccuag

SEQ ID NO: 694710 - RNA, 22 nt, Human
aaggccaucuacuuacggaauu

SEQ ID NO: 694711 - RNA, 22 nt, Human
guuucucuguaccucuguccca

SEQ ID NO: 694712 - RNA, 22 nt, Human
uggcuaagauuuaaauguuugc

SEQ ID NO: 694713 - RNA, 22 nt, Human
cucuggcuggcugggccucagu

SEQ ID NO: 694714 - RNA, 22 nt, Human
uacagugaggugguuuccuuua

SEQ ID NO: 694715 - RNA, 22 nt, Human
agcaggagacauggggguggug

SEQ ID NO: 694716 - RNA, 22 nt, Human
acucagacgaaaacaugaacau

SEQ ID NO: 694717 - RNA, 22 nt, Human
auguaaacuacugacuacacua

SEQ ID NO: 694718 - RNA, 22 nt, Human
acagugaaaagaauauuagaau

SEQ ID NO: 694719 - RNA, 22 nt, Human
auugaaagcacaaagaacaagu

SEQ ID NO: 694720 - RNA, 22 nt, Human
gaacuguaaaauaauuggcaau

SEQ ID NO: 694721 - RNA, 22 nt, Human
ucagcccugggacccagggaug

SEQ ID NO: 694722 - RNA, 19 nt, Human
uggcagccuccacuuuugc

SEQ ID NO: 694723 - RNA, 22 nt, Human
aucagcaaaaaugccuucagaa

SEQ ID NO: 694724 - RNA, 22 nt, Human
uuuuucauauuccccucucugg

SEQ ID NO: 694725 - RNA, 22 nt, Human
ccagagguuacacccucagccc

SEQ ID NO: 694726 - RNA, 23 nt, Human
cuugagcucaggaagagcugagu

SEQ ID NO: 694727 - RNA, 22 nt, Human
ggucuggaagcgcaguaggcug

SEQ ID NO: 694728 - RNA, 22 nt, Human
ugggaggaagugcuaaugggag

SEQ ID NO: 694729 - RNA, 22 nt, Human
uuuacuuucucaaguauauagg

SEQ ID NO: 694730 - RNA, 22 nt, Human
uucuucuuuaucucaguauccu

SEQ ID NO: 694731 - RNA, 23 nt, Human
ggagcugcuguugggggagcugc

SEQ ID NO: 694732 - RNA, 22 nt, Human
cagugucuccagaugcuccaau

SEQ ID NO: 694733 - RNA, 22 nt, Human
aaaugcacugaauauuccaaau

SEQ ID NO: 694734 - RNA, 22 nt, Human
augcuuuaguucaaaggacuua

SEQ ID NO: 694735 - RNA, 22 nt, Human
auacaugugcuauguuggugua

SEQ ID NO: 694736 - RNA, 22 nt, Human
ggucugagguuugggauucacu

SEQ ID NO: 694737 - RNA, 22 nt, Human
cccaggcucagacuggcuuguu

SEQ ID NO: 694738 - RNA, 22 nt, Human
uggcccaggucucucugagccc

SEQ ID NO: 694739 - RNA, 22 nt, Human
cucagucucuugggcugugaag

SEQ ID NO: 694740 - RNA, 22 nt, Human
gaauuguaugcugucuugauag

SEQ ID NO: 694741 - RNA, 22 nt, Human
uagaugugagcccaggcugcuu

SEQ ID NO: 694742 - RNA, 22 nt, Human
ugagggccgaggagcugugggu

SEQ ID NO: 694743 - RNA, 22 nt, Human
aaggccaaagacaccuacacag

SEQ ID NO: 694744 - RNA, 22 nt, Human
cagcacagugcagaugcugacu

SEQ ID NO: 694745 - RNA, 22 nt, Human
caggcagggagccacuguauaa

SEQ ID NO: 694746 - RNA, 22 nt, Human
ugcugccuuagcagccaggcaa

SEQ ID NO: 694747 - RNA, 22 nt, Human
aucuggagcuuguuagauguuu

SEQ ID NO: 694748 - RNA, 18 nt, Human
uccagcagcauaguuucc

SEQ ID NO: 694749 - RNA, 22 nt, Human
ggggaagaaugcucucuagaga

SEQ ID NO: 694750 - RNA, 22 nt, Human
agcucagaagccuaugcauagu

SEQ ID NO: 694751 - RNA, 22 nt, Human
acuguuuucuuagcucccugcu

SEQ ID NO: 694752 - RNA, 22 nt, Human
aguggagguuacagcuguacau

SEQ ID NO: 694753 - RNA, 22 nt, Human
gacacugugcuagcugggcuua

SEQ ID NO: 694754 - RNA, 22 nt, Human
aaucugagggaacuugaacucc

SEQ ID NO: 694755 - RNA, 22 nt, Human
acagagacugggagcaagaggc

SEQ ID NO: 694756 - RNA, 22 nt, Human
cugucaaauggaaacuuauccu

SEQ ID NO: 694757 - RNA, 22 nt, Human
uccucaucucggaaccugccac

SEQ ID NO: 694758 - RNA, 22 nt, Human
aagguggcgcuggagcuggucc

SEQ ID NO: 694759 - RNA, 22 nt, Human
acuuagaacaggcagaauucca

SEQ ID NO: 694760 - RNA, 22 nt, Human
ggauuugggcuugcagcagagc

SEQ ID NO: 694761 - RNA, 22 nt, Human
cuggugggaagauggaaaacau

SEQ ID NO: 694762 - RNA, 20 nt, Human
aggcugccuaaggcucugca

SEQ ID NO: 694763 - RNA, 22 nt, Human
auguggcuuuucuaacccuucc

SEQ ID NO: 694764 - RNA, 22 nt, Human
aggaaaugcaggcaaauacucu

SEQ ID NO: 694765 - RNA, 22 nt, Human
auaagcauguuagaauauuuga

SEQ ID NO: 694766 - RNA, 22 nt, Human
agcagcugagccccagcuguga

SEQ ID NO: 694767 - RNA, 22 nt, Human
cuagaagcaacuagaucuguuu

SEQ ID NO: 694768 - RNA, 22 nt, Human
ccaggcucaggugcgagagaca

SEQ ID NO: 694769 - RNA, 22 nt, Human
uauugaauuagacccuaaaaug

SEQ ID NO: 694770 - RNA, 17 nt, Human
agccaggcauaugaagu

SEQ ID NO: 694771 - RNA, 17 nt, Human
gcuggcuucuccuugcu

SEQ ID NO: 694772 - RNA, 22 nt, Human
ccuggcucagaccccaguucug

SEQ ID NO: 694773 - RNA, 22 nt, Human
ccagaaguggcuuucucaggga

SEQ ID NO: 694774 - RNA, 22 nt, Human
gucuccacuaaaaacuuucacg

SEQ ID NO: 694775 - RNA, 22 nt, Human
ucacagaaggagggaagcuagu

SEQ ID NO: 694776 - RNA, 22 nt, Human
auucagggaggaaaggggccuc

SEQ ID NO: 694777 - RNA, 22 nt, Human
augccauugcuuuaaaauuaag

SEQ ID NO: 694778 - RNA, 19 nt, Human
gcugugggacagcagggug

SEQ ID NO: 694779 - RNA, 22 nt, Human
aaggagcugggagggacacaug

SEQ ID NO: 694780 - RNA, 22 nt, Human
uuccaggacuggguguuugaag

SEQ ID NO: 694781 - RNA, 22 nt, Human
cucuucagauaaaagggauauu

SEQ ID NO: 694782 - RNA, 22 nt, Human
gaacuaaaugaaauuacuggug

SEQ ID NO: 694783 - RNA, 22 nt, Human
guucauccauauuauagcaugu

SEQ ID NO: 694784 - RNA, 20 nt, Human
ugcagcuucaccugugucau

SEQ ID NO: 694785 - RNA, 22 nt, Human
agaugacagcuacgggaugaaa

SEQ ID NO: 694786 - RNA, 22 nt, Human
ucagagaaaugaaguagggauu

SEQ ID NO: 694787 - RNA, 22 nt, Human
uaucuagauggauuuuagugaa

SEQ ID NO: 694788 - RNA, 22 nt, Human
ccuggucaccccucucucugca

SEQ ID NO: 694789 - RNA, 22 nt, Human
cagcccaggcucagauguuggg

SEQ ID NO: 694790 - RNA, 22 nt, Human
ugcaucauuuauaaugucuuug

SEQ ID NO: 694791 - RNA, 22 nt, Human
acagggcagguggcuacugguc

SEQ ID NO: 694792 - RNA, 22 nt, Human
aaugccaacuuggauauacauu

SEQ ID NO: 694793 - RNA, 22 nt, Human
cauuuguuggucagauuguagu

SEQ ID NO: 694794 - RNA, 22 nt, Human
ggauuuuagaguaccuaagugu

SEQ ID NO: 694795 - RNA, 22 nt, Human
acaggggauugauuggaagucu

SEQ ID NO: 694796 - RNA, 22 nt, Human
ucacagcuaagcuuggucacug

SEQ ID NO: 694797 - RNA, 22 nt, Human
uggcaggaagacguggggcacc

SEQ ID NO: 694798 - RNA, 22 nt, Human
uuucuuuaucauagcaucuuug

SEQ ID NO: 694799 - RNA, 21 nt, Human
ccugggagaauuggguguggc

SEQ ID NO: 694800 - RNA, 22 nt, Human
cgaagacagaccaucugaguag

SEQ ID NO: 694801 - RNA, 22 nt, Human
cccagguaguuggaagagacaa

SEQ ID NO: 694802 - RNA, 22 nt, Human
ucccaggaucugagggcagaga

SEQ ID NO: 694803 - RNA, 22 nt, Human
auuuccuauccuggucuuaaaa

SEQ ID NO: 694804 - RNA, 22 nt, Human
ccagagcugcauccagcagguu

SEQ ID NO: 694805 - RNA, 22 nt, Human
uccaagaucuacagcaguuuag

SEQ ID NO: 694806 - RNA, 22 nt, Human
caagcuggaguuccucagagug

SEQ ID NO: 694807 - RNA, 22 nt, Human
aguaaacaguuucuuagaagaa

SEQ ID NO: 694808 - RNA, 22 nt, Human
acuuuacccgcacucagacaca

SEQ ID NO: 694809 - RNA, 22 nt, Human
gaagccugguucgcuggccacc

SEQ ID NO: 694810 - RNA, 20 nt, Human
cacaggccuugugagcagac

SEQ ID NO: 694811 - RNA, 22 nt, Human
auuuuacauaaggaagguuuaa

SEQ ID NO: 694812 - RNA, 22 nt, Human
ucugaaauuccuuccagacuuu

SEQ ID NO: 694813 - RNA, 22 nt, Human
uugagggaacaugagaaucauc

SEQ ID NO: 694814 - RNA, 22 nt, Human
gucccuggaucugggacagcug

SEQ ID NO: 694815 - RNA, 22 nt, Human
uggccucuggcugaggacuaac

SEQ ID NO: 694816 - RNA, 22 nt, Human
cagaugcagcaaaaugacaggc

SEQ ID NO: 694817 - RNA, 22 nt, Human
uucuucagucuaggccuuucuu

SEQ ID NO: 694818 - RNA, 22 nt, Human
uguaacuguggucuagggacug

SEQ ID NO: 694819 - RNA, 22 nt, Human
agcaguggcugacagacuuacc

SEQ ID NO: 694820 - RNA, 20 nt, Human
acacaguagcaauuagugca

SEQ ID NO: 694821 - RNA, 22 nt, Human
gcgaaucucagcuggugcugcg

SEQ ID NO: 694822 - RNA, 22 nt, Human
aagccagccagugccagucuua

SEQ ID NO: 694823 - RNA, 22 nt, Human
uauacaaguaaugcugaaugau

SEQ ID NO: 694824 - RNA, 23 nt, Human
uuccagaggaagaagucaugacu

SEQ ID NO: 694825 - RNA, 22 nt, Human
aacccaggguggagguugcagu

SEQ ID NO: 694826 - RNA, 22 nt, Human
uacaugcuuaaaaugcaauguu

SEQ ID NO: 694827 - RNA, 22 nt, Human
agagcagcuuuucggaaccacu

SEQ ID NO: 694828 - RNA, 22 nt, Human
aggcucccaugguguggcagga

SEQ ID NO: 694829 - RNA, 22 nt, Human
uuguuuauguguugucuauggc

SEQ ID NO: 694830 - RNA, 22 nt, Human
uagggcugccauuugcuuuucu

SEQ ID NO: 694831 - RNA, 22 nt, Human
auggcuagcaccgcguugcugg

SEQ ID NO: 694832 - RNA, 22 nt, Human
cauuaacaaauggaagcaugaa

SEQ ID NO: 694833 - RNA, 23 nt, Human
uaucuguauuuguucacugcugu

SEQ ID NO: 694834 - RNA, 22 nt, Human
ugcagaccucccauggcugccu

SEQ ID NO: 694835 - RNA, 22 nt, Human
ugggauggccuuugaaagccag

SEQ ID NO: 694836 - RNA, 22 nt, Human
gcucagggagcgauuuaccaug

SEQ ID NO: 694837 - RNA, 22 nt, Human
agugcauguucacuggcauggu

SEQ ID NO: 694838 - RNA, 22 nt, Human
aaucucacucaaagaauucucu

SEQ ID NO: 694839 - RNA, 22 nt, Human
ccuggagcucacugggagccgg

SEQ ID NO: 694840 - RNA, 22 nt, Human
gugggcaucuccuuggaagcca

SEQ ID NO: 694841 - RNA, 22 nt, Human
uuuuuuguagcaagcgcagaua

SEQ ID NO: 694842 - RNA, 22 nt, Human
gagugcugagcccacuuccuug

SEQ ID NO: 694843 - RNA, 22 nt, Human
gggcagcucggaagugggaaag

SEQ ID NO: 694844 - RNA, 22 nt, Human
gcaauuauuaugugacuuuuac

SEQ ID NO: 694845 - RNA, 22 nt, Human
agugcuuucccugaaaccuucc

SEQ ID NO: 694846 - RNA, 22 nt, Human
cuguugguguugauuaaauagu

SEQ ID NO: 694847 - RNA, 23 nt, Human
ugggguugaauuguagcugugcc

SEQ ID NO: 694848 - RNA, 22 nt, Human
ccaggagcauuaagagaacaua

SEQ ID NO: 694849 - RNA, 22 nt, Human
aaacuaagacuaaugaagaacu

SEQ ID NO: 694850 - RNA, 22 nt, Human
gaguacauguauagagauuaac

SEQ ID NO: 694851 - RNA, 22 nt, Human
ucagguccccaacucuucucac

SEQ ID NO: 694852 - RNA, 22 nt, Human
uucuuuuccuacacagcgauuu

SEQ ID NO: 694853 - RNA, 22 nt, Human
ccagcagcucccucaggguccg

SEQ ID NO: 694854 - RNA, 18 nt, Human
guuauucucucugcagua

SEQ ID NO: 694855 - RNA, 22 nt, Human
gcuuugcauuguuuaaucagga

SEQ ID NO: 694856 - RNA, 22 nt, Human
cuggcuugaaguuaugcaccag

SEQ ID NO: 694857 - RNA, 22 nt, Human
acuguucauuuggauuucucug

SEQ ID NO: 694858 - RNA, 22 nt, Human
aggcugaggcaagaggaucacu

SEQ ID NO: 694859 - RNA, 22 nt, Human
ggccuugagagccagugcaggc

SEQ ID NO: 694860 - RNA, 22 nt, Human
agagcuggggccagagucaagg

SEQ ID NO: 694861 - RNA, 22 nt, Human
cuucugggccauggccuuccuc

SEQ ID NO: 694862 - RNA, 22 nt, Human
uuuauugacuucagugagucuu

SEQ ID NO: 694863 - RNA, 22 nt, Human
uccaaaggcccugaguucacuu

SEQ ID NO: 694864 - RNA, 22 nt, Human
uuuacuuuugguaaggucauuu

SEQ ID NO: 694865 - RNA, 21 nt, Human
gcacagggacagaucaucaca

SEQ ID NO: 694866 - RNA, 22 nt, Human
gggcuccaucggacuuggguuu

SEQ ID NO: 694867 - RNA, 22 nt, Human
ucacaccuguaaucccaggccu

SEQ ID NO: 694868 - RNA, 22 nt, Human
auacauagauagauaaucuggc

SEQ ID NO: 694869 - RNA, 22 nt, Human
aagcagggcucccuggggacuc

SEQ ID NO: 694870 - RNA, 22 nt, Human
aaacuguaaagcaggugaguag

SEQ ID NO: 694871 - RNA, 22 nt, Human
ucugauaauggacuucucaucu

SEQ ID NO: 694872 - RNA, 22 nt, Human
cugaggcugagacaggugaaau

SEQ ID NO: 694873 - RNA, 22 nt, Human
uuacauacuuacuagaucuaug

SEQ ID NO: 694874 - RNA, 22 nt, Human
uuacagaaguauugagagaucc

SEQ ID NO: 694875 - RNA, 20 nt, Human
uucugagaguucacagcccc

SEQ ID NO: 694876 - RNA, 22 nt, Human
ggcaggcauggccacucccuag

SEQ ID NO: 694877 - RNA, 22 nt, Human
ucuguagguuaaaaguagacaa

SEQ ID NO: 694878 - RNA, 22 nt, Human
guguuaaaaaucccaugauaug

SEQ ID NO: 694879 - RNA, 22 nt, Human
uuuaaaaaacuagucugagucu

SEQ ID NO: 694880 - RNA, 22 nt, Human
agaaaguuagcagacucuuggc

SEQ ID NO: 694881 - RNA, 22 nt, Human
aguaaugucccuuaaauguggu

SEQ ID NO: 694882 - RNA, 18 nt, Human
ccuguguguguugcaggc

SEQ ID NO: 694883 - RNA, 20 nt, Human
uugcacagagaaggaggcag

SEQ ID NO: 694884 - RNA, 22 nt, Human
gccucugggguuaauagaguuu

SEQ ID NO: 694885 - RNA, 22 nt, Human
ucaggccccaucccagacuuau

SEQ ID NO: 694886 - RNA, 22 nt, Human
uguacacaugcccacuugaagc

SEQ ID NO: 694887 - RNA, 22 nt, Human
ucccaucacuagcaucugcacc

SEQ ID NO: 694888 - RNA, 22 nt, Human
aaucuugagggacucaugaggu

SEQ ID NO: 694889 - RNA, 20 nt, Human
gccagaggccggcaggggcu

SEQ ID NO: 694890 - RNA, 22 nt, Human
ccagaggucuccugcacgggau

SEQ ID NO: 694891 - RNA, 22 nt, Human
ugaggugaauggugucccugga

SEQ ID NO: 694892 - RNA, 22 nt, Human
ucugugucagcagcacucagcc

SEQ ID NO: 694893 - RNA, 22 nt, Human
uucagaaagguuaaucuggauu

SEQ ID NO: 694894 - RNA, 22 nt, Human
gaaugcacucacccaucacuca

SEQ ID NO: 694895 - RNA, 22 nt, Human
ggcuacaguggcucagugcugg

SEQ ID NO: 694896 - RNA, 22 nt, Human
guggcuucacauggcauuuggc

SEQ ID NO: 694897 - RNA, 22 nt, Human
uccugaggugcucagccaggaa

SEQ ID NO: 694898 - RNA, 22 nt, Human
aacuguaaugaauuguucauga

SEQ ID NO: 694899 - RNA, 22 nt, Human
gagcugaguaugaaggauguga

SEQ ID NO: 694900 - RNA, 22 nt, Human
ugcccagcaauaaaccagaaga

SEQ ID NO: 694901 - RNA, 22 nt, Human
aagccaauggauugguugcuuu

SEQ ID NO: 694902 - RNA, 22 nt, Human
uuucauguuacauuuaaaaugu

SEQ ID NO: 694903 - RNA, 22 nt, Human
cagcaacugugccugacacaca

SEQ ID NO: 694904 - RNA, 22 nt, Human
acucaggcuacaggggcagaag

SEQ ID NO: 694905 - RNA, 22 nt, Human
gacuguggccuuggaccauggg

SEQ ID NO: 694906 - RNA, 22 nt, Human
ucuuuuagcucugcaaggaaag

SEQ ID NO: 694907 - RNA, 22 nt, Human
cuuuucuagagccgcagcccua

SEQ ID NO: 694908 - RNA, 20 nt, Human
gaaggcaaugguuuggcaca

SEQ ID NO: 694909 - RNA, 22 nt, Human
ucugggaacugagcuccccuag

SEQ ID NO: 694910 - RNA, 22 nt, Human
ugcagagaagaggacaguucua

SEQ ID NO: 694911 - RNA, 22 nt, Human
caggggcuuuuccucuauaagg

SEQ ID NO: 694912 - RNA, 22 nt, Human
gauguguagagggaauuucaaa

SEQ ID NO: 694913 - RNA, 22 nt, Human
auacauucaucacuuuuggucc

SEQ ID NO: 694914 - RNA, 22 nt, Human
cccaggaguuagagguuguggu

SEQ ID NO: 694915 - RNA, 22 nt, Human
cacuccuauaauuaaagaugca

SEQ ID NO: 694916 - RNA, 22 nt, Human
uucacagugcugcaccuggcuu

SEQ ID NO: 694917 - RNA, 23 nt, Human
gcauucugaugguucucugugau

SEQ ID NO: 694918 - RNA, 22 nt, Human
uguguagcucauauuaguguua

SEQ ID NO: 694919 - RNA, 22 nt, Human
agggucaguucugugagguguu

SEQ ID NO: 694920 - RNA, 21 nt, Human
ucccucagaagcucuugguca

SEQ ID NO: 694921 - RNA, 22 nt, Human
caacauucaaccaacauuuaug

SEQ ID NO: 694922 - RNA, 22 nt, Human
acugaugaaagguaagacucca

SEQ ID NO: 694923 - RNA, 22 nt, Human
uucuucaacaaggacacuguua

SEQ ID NO: 694924 - RNA, 21 nt, Human
uucaauacuauuucaauaguc

SEQ ID NO: 694925 - RNA, 22 nt, Human
aaaaaguauuggccaugguuga

SEQ ID NO: 694926 - RNA, 19 nt, Human
ugccccuuaagaguuucuc

SEQ ID NO: 694927 - RNA, 22 nt, Human
uggguccucuggagcagcagca

SEQ ID NO: 694928 - RNA, 22 nt, Human
agaauaaaauagucugaagaug

SEQ ID NO: 694929 - RNA, 22 nt, Human
uucaggaauauaggcauugaca

SEQ ID NO: 694930 - RNA, 22 nt, Human
ugcuuuauaacuuaguuuaugg

SEQ ID NO: 694931 - RNA, 22 nt, Human
aagccaaugagagaggccucag

SEQ ID NO: 694932 - RNA, 22 nt, Human
ggcaugcucuuuguccacagua

SEQ ID NO: 694933 - RNA, 22 nt, Human
gcuggccaggaagagucucaga

SEQ ID NO: 694934 - RNA, 22 nt, Human
gaccuggcauauucauuggcac

SEQ ID NO: 694935 - RNA, 22 nt, Human
ucugaagagucuugcaagaaag

SEQ ID NO: 694936 - RNA, 21 nt, Human
aggaggaacccguggcugggc

SEQ ID NO: 694937 - RNA, 20 nt, Human
cuuaaacacagagauagauu

SEQ ID NO: 694938 - RNA, 22 nt, Human
aguggggaagauuuugcaguca

SEQ ID NO: 694939 - RNA, 22 nt, Human
guggcugcugguacucugggaa

SEQ ID NO: 694940 - RNA, 22 nt, Human
auuuucaguguaaauguuuuau

SEQ ID NO: 694941 - RNA, 22 nt, Human
augacacauuugugcuguugaa

SEQ ID NO: 694942 - RNA, 22 nt, Human
uuccuguaguugugcaauguac

SEQ ID NO: 694943 - RNA, 22 nt, Human
uccugacuuggcuguuggcccu

SEQ ID NO: 694944 - RNA, 20 nt, Human
uugauucaagggcugaugga

SEQ ID NO: 694945 - RNA, 22 nt, Human
ucaagcuggcuguugcuauuuc

SEQ ID NO: 694946 - RNA, 20 nt, Human
uggcacagaacccuugccua

SEQ ID NO: 694947 - RNA, 22 nt, Human
uguuauucucugccuacaaguc

SEQ ID NO: 694948 - RNA, 22 nt, Human
agaagaugucacugcagacagc

SEQ ID NO: 694949 - RNA, 22 nt, Human
ccaaagugcugggguuacaggc

SEQ ID NO: 694950 - RNA, 22 nt, Human
cauguggauaugaauuguagaa

SEQ ID NO: 694951 - RNA, 22 nt, Human
gcagaggugugggaggggccac

SEQ ID NO: 694952 - RNA, 22 nt, Human
ggcaggaaguagcagucugagc

SEQ ID NO: 694953 - RNA, 22 nt, Human
gacuguguccaugugcuggauu

SEQ ID NO: 694954 - RNA, 22 nt, Human
ucauggaaacaaugcggaaaaa

SEQ ID NO: 694955 - RNA, 22 nt, Human
guccuguguacuccugauacuu

SEQ ID NO: 694956 - RNA, 22 nt, Human
gaggucugagugcggaaagccu

SEQ ID NO: 694957 - RNA, 22 nt, Human
ucuguggcuuucuuauguugua

SEQ ID NO: 694958 - RNA, 22 nt, Human
cagggcucccaaauaucucuuc

SEQ ID NO: 694959 - RNA, 22 nt, Human
gaccuggacugaguuagauggc

SEQ ID NO: 694960 - RNA, 19 nt, Human
aggcuggagacaccaggcc

SEQ ID NO: 694961 - RNA, 22 nt, Human
uaaauguacugaggcaacagga

SEQ ID NO: 694962 - RNA, 22 nt, Human
ucaaagagcucuaucuucaaaa

SEQ ID NO: 694963 - RNA, 22 nt, Human
uccugggcugugugccacucug

SEQ ID NO: 694964 - RNA, 22 nt, Human
uucucaaaacucaggguaucug

SEQ ID NO: 694965 - RNA, 22 nt, Human
acuaagugauucuaagcaucuu

SEQ ID NO: 694966 - RNA, 22 nt, Human
uucuguuuuagaaauaaguagu

SEQ ID NO: 694967 - RNA, 22 nt, Human
ugaacagucauuuagaaugugc

SEQ ID NO: 694968 - RNA, 22 nt, Human
aagagggguggucugugaggau

SEQ ID NO: 694969 - RNA, 22 nt, Human
caacuucaccaggguuccuaga

SEQ ID NO: 694970 - RNA, 22 nt, Human
cucugcuucugagauggaagcu

SEQ ID NO: 694971 - RNA, 22 nt, Human
gauugcaaaucauuacaaagga

SEQ ID NO: 694972 - RNA, 18 nt, Human
agguuugguggaaacaua

SEQ ID NO: 694973 - RNA, 22 nt, Human
ugaaggagauuuuuagggaggc

SEQ ID NO: 694974 - RNA, 22 nt, Human
acugucuguccugcucuccgug

SEQ ID NO: 694975 - RNA, 22 nt, Human
acucuggccccaggaucugugu

SEQ ID NO: 694976 - RNA, 22 nt, Human
gaagguuuuguuugcaaaucau

SEQ ID NO: 694977 - RNA, 22 nt, Human
ucuuggccccaccugugccagc

SEQ ID NO: 694978 - RNA, 22 nt, Human
gaguucuauuaugguuagaagu

SEQ ID NO: 694979 - RNA, 22 nt, Human
ugucugaacugcauuugcuccu

SEQ ID NO: 694980 - RNA, 22 nt, Human
uuagauuuacaagcacuguuua

SEQ ID NO: 694981 - RNA, 22 nt, Human
ugcaauuucaggcauauauugu

SEQ ID NO: 694982 - RNA, 22 nt, Human
uuccacagauguaugaaguggu

SEQ ID NO: 694983 - RNA, 20 nt, Human
uguccccuagaucccagcuc

SEQ ID NO: 694984 - RNA, 22 nt, Human
uggaagggggaagacagcucug

SEQ ID NO: 694985 - RNA, 22 nt, Human
ggcacugauuccauucaugaag

SEQ ID NO: 694986 - RNA, 16 nt, Human
ucauugaagacaguac

SEQ ID NO: 694987 - RNA, 22 nt, Human
guggguggggagcucucuggag

SEQ ID NO: 694988 - RNA, 22 nt, Human
cagucuaagacucacgccaaga

SEQ ID NO: 694989 - RNA, 22 nt, Human
aggccucagccugccaggccug

SEQ ID NO: 694990 - RNA, 22 nt, Human
cagagcaccugcucauugccag

SEQ ID NO: 694991 - RNA, 22 nt, Human
uuucucugugggcuuuaugcau

SEQ ID NO: 694992 - RNA, 21 nt, Human
aguuuccucaucugcauagga

SEQ ID NO: 694993 - RNA, 22 nt, Human
ugaaucaauaguugcaaguauu

SEQ ID NO: 694994 - RNA, 22 nt, Human
gcccagcacuccucucugacau

SEQ ID NO: 694995 - RNA, 22 nt, Human
cgugcaugauauaugaguuguu

SEQ ID NO: 694996 - RNA, 22 nt, Human
cgccccucagcgacccaccagc

SEQ ID NO: 694997 - RNA, 22 nt, Human
uaagugucuaaaaggcagaacu

SEQ ID NO: 694998 - RNA, 22 nt, Human
cccaaguuaauuuguagcugaa

SEQ ID NO: 694999 - RNA, 22 nt, Human
uccaguggaacagauguugccu

SEQ ID NO: 695000 - RNA, 22 nt, Human
ugcaggaaaacaccuaucaccc

SEQ ID NO: 695001 - RNA, 22 nt, Human
acaggacuguggaaggaucucu

SEQ ID NO: 695002 - RNA, 22 nt, Human
accagccccaccgggacugcag

SEQ ID NO: 695003 - RNA, 18 nt, Human
auggcuucugaguggagg

SEQ ID NO: 695004 - RNA, 22 nt, Human
ccacagagucuuccuucucuuc

SEQ ID NO: 695005 - RNA, 22 nt, Human
acagcuuuucugauagauccug

SEQ ID NO: 695006 - RNA, 22 nt, Human
cugguacaaaaugcugauauca

SEQ ID NO: 695007 - RNA, 22 nt, Human
uuacuguuugaaaaaugaaugu

SEQ ID NO: 695008 - RNA, 22 nt, Human
caguccugcccaggcugacaga

SEQ ID NO: 695009 - RNA, 23 nt, Human
gcccacccucagcguccucacgg

SEQ ID NO: 695010 - RNA, 22 nt, Human
aucauucuagcuguuguguuga

SEQ ID NO: 695011 - RNA, 21 nt, Human
uugcuguuuucccaaugcagu

SEQ ID NO: 695012 - RNA, 22 nt, Human
gcauucccaaaagacacuuacc

SEQ ID NO: 695013 - RNA, 22 nt, Human
cuuccuuccuuccccgaaaugc

SEQ ID NO: 695014 - RNA, 23 nt, Human
uacaugcuauaauuucacccuca

SEQ ID NO: 695015 - RNA, 22 nt, Human
cuucucccugggggcucuuuau

SEQ ID NO: 695016 - RNA, 22 nt, Human
aaacuagaugauuaugaagcau

SEQ ID NO: 695017 - RNA, 22 nt, Human
augaucauggaagugcacccau

SEQ ID NO: 695018 - RNA, 22 nt, Human
uucuguuagcauucugaucucc

SEQ ID NO: 695019 - RNA, 22 nt, Human
uccuggucagcuuugagguugu

SEQ ID NO: 695020 - RNA, 22 nt, Human
uagagaugcccuagcugaagua

SEQ ID NO: 695021 - RNA, 22 nt, Human
uuuaacuuagaagagauauccu

SEQ ID NO: 695022 - RNA, 18 nt, Human
ucaaagucuggcuccacu

SEQ ID NO: 695023 - RNA, 22 nt, Human
aaaucucuggcagaaauaaacu

SEQ ID NO: 695024 - RNA, 22 nt, Human
cagcccuggcccaggugccuua

SEQ ID NO: 695025 - RNA, 22 nt, Human
uauucaucuucauagucacagu

SEQ ID NO: 695026 - RNA, 22 nt, Human
acuuuugaagaauuaugcaaaa

SEQ ID NO: 695027 - RNA, 22 nt, Human
caguauuuggaauauagcuaag

SEQ ID NO: 695028 - RNA, 22 nt, Human
ugcguaguacgaauuugugccu

SEQ ID NO: 695029 - RNA, 22 nt, Human
uuuggaaugaaacagcagagcc

SEQ ID NO: 695030 - RNA, 21 nt, Human
aaauuucugcaagccucaacu

SEQ ID NO: 695031 - RNA, 22 nt, Human
uuuccagugaauuagucuguuu

SEQ ID NO: 695032 - RNA, 22 nt, Human
ucucugcccaugagcaaucugc

SEQ ID NO: 695033 - RNA, 22 nt, Human
uacauuauccugucuuuguccu

SEQ ID NO: 695034 - RNA, 22 nt, Human
ugguggucauagcagaggccgu

SEQ ID NO: 695035 - RNA, 23 nt, Human
agaaaccacugaagagauccagu

SEQ ID NO: 695036 - RNA, 22 nt, Human
acagucuucccuuauuccacuc

SEQ ID NO: 695037 - RNA, 22 nt, Human
aguaaacugugugccuuugacu

SEQ ID NO: 695038 - RNA, 22 nt, Human
gaaggcauucuauucuacauau

SEQ ID NO: 695039 - RNA, 22 nt, Human
ccucagugagaugcucagcgaa

SEQ ID NO: 695040 - RNA, 22 nt, Human
gugcuggcaccccucuccaguu

SEQ ID NO: 695041 - RNA, 22 nt, Human
aaggaaauuagguuauuuugcu

SEQ ID NO: 695042 - RNA, 22 nt, Human
cugcacccucaaacuccugggc

SEQ ID NO: 695043 - RNA, 22 nt, Human
aacacugugagguaaugaccua

SEQ ID NO: 695044 - RNA, 22 nt, Human
cugguugggagguuggcuuuca

SEQ ID NO: 695045 - RNA, 22 nt, Human
gugauccgaugucagucgcaga

SEQ ID NO: 695046 - RNA, 22 nt, Human
cagagagaauauguaguaugga

SEQ ID NO: 695047 - RNA, 22 nt, Human
ugccugucuccucugcagggug

SEQ ID NO: 695048 - RNA, 22 nt, Human
uuuagcauuacuaaaaugaaaa

SEQ ID NO: 695049 - RNA, 18 nt, Human
ucaggcuggaaguuugcc

SEQ ID NO: 695050 - RNA, 22 nt, Human
uauaggcuuuuguugcagaaca

SEQ ID NO: 695051 - RNA, 22 nt, Human
aggcuggugccugcagugaauc

SEQ ID NO: 695052 - RNA, 22 nt, Human
guuccaggcaagugggauagga

SEQ ID NO: 695053 - RNA, 22 nt, Human
uggcaagcagagucuggugggg

SEQ ID NO: 695054 - RNA, 22 nt, Human
auaugggggggcgugcagagga

SEQ ID NO: 695055 - RNA, 22 nt, Human
caugcauuacaauugcauagua

SEQ ID NO: 695056 - RNA, 22 nt, Human
gcugucuguucgagcguguguu

SEQ ID NO: 695057 - RNA, 22 nt, Human
guggcugcuaagucuccuuccu

SEQ ID NO: 695058 - RNA, 22 nt, Human
cagaucaugggacugucucagc

SEQ ID NO: 695059 - RNA, 22 nt, Human
agccuuaaaugcuagauucaua

SEQ ID NO: 695060 - RNA, 22 nt, Human
ugcauuaagguaauuguauaau

SEQ ID NO: 695061 - RNA, 22 nt, Human
aaagucaucauuucuuuucaaa

SEQ ID NO: 695062 - RNA, 20 nt, Human
agugccagggcaggugagag

SEQ ID NO: 695063 - RNA, 22 nt, Human
ugcaguguggccaugucagcua

SEQ ID NO: 695064 - RNA, 22 nt, Human
aggaaaugggaauagaugguau

SEQ ID NO: 695065 - RNA, 22 nt, Human
ccauuuguuuucgcuaccaugg

SEQ ID NO: 695066 - RNA, 22 nt, Human
ucuuggaaucuccauagaguga

SEQ ID NO: 695067 - RNA, 23 nt, Human
uucucuuuagauuuacauuacuc

SEQ ID NO: 695068 - RNA, 22 nt, Human
ugucccagguccuagaugacca

SEQ ID NO: 695069 - RNA, 22 nt, Human
uaugcuuucauucauaugugag

SEQ ID NO: 695070 - RNA, 22 nt, Human
ugaaagguguccaauauuucuc

SEQ ID NO: 695071 - RNA, 22 nt, Human
ucacauuuggagaaagccugcc

SEQ ID NO: 695072 - RNA, 22 nt, Human
uauucugcaugaaaauaaacag

SEQ ID NO: 695073 - RNA, 22 nt, Human
uuacaguuguucuaucagcaug

SEQ ID NO: 695074 - RNA, 22 nt, Human
agaaguaucuugggaaggcacu

SEQ ID NO: 695075 - RNA, 22 nt, Human
aaugcacagcguuccaugcuug

SEQ ID NO: 695076 - RNA, 21 nt, Human
agccuggcccagggggaggcu

SEQ ID NO: 695077 - RNA, 22 nt, Human
uugggagguaauggagccaagu

SEQ ID NO: 695078 - RNA, 22 nt, Human
ucaccacugaacagaccuuugg

SEQ ID NO: 695079 - RNA, 22 nt, Human
cauguuaaaauauacauucuga

SEQ ID NO: 695080 - RNA, 22 nt, Human
aauaaagcaugaggcauuuauc

SEQ ID NO: 695081 - RNA, 18 nt, Human
gugcaaugaauagcagag

SEQ ID NO: 695082 - RNA, 22 nt, Human
aggccucaguucuugccaggug

SEQ ID NO: 695083 - RNA, 22 nt, Human
cacccuggccucgcucucugca

SEQ ID NO: 695084 - RNA, 22 nt, Human
gacaauugcuuuugccgaauaa

SEQ ID NO: 695085 - RNA, 22 nt, Human
auuuaccauauguacugaguau

SEQ ID NO: 695086 - RNA, 22 nt, Human
auugucuucuggucuuaucuuu

SEQ ID NO: 695087 - RNA, 22 nt, Human
aggccacaguugaggccagcaa

SEQ ID NO: 695088 - RNA, 22 nt, Human
agugggggcuggcucugucugu

SEQ ID NO: 695089 - RNA, 22 nt, Human
gcaagcagacauucagguaggu

SEQ ID NO: 695090 - RNA, 18 nt, Human
guuuccugucuuacgggg

SEQ ID NO: 695091 - RNA, 22 nt, Human
uccuggcuccagcagcucuucc

SEQ ID NO: 695092 - RNA, 22 nt, Human
gcccaggaguugguggcugcag

SEQ ID NO: 695093 - RNA, 22 nt, Human
ccugagaguaggugucucuuua

SEQ ID NO: 695094 - RNA, 19 nt, Human
gcugcagaguauucuuggg

SEQ ID NO: 695095 - RNA, 22 nt, Human
ggcuccagguuuaaggguaugu

SEQ ID NO: 695096 - RNA, 22 nt, Human
gagacugauggggcucccagaa

SEQ ID NO: 695097 - RNA, 22 nt, Human
ggccagggccuggggacugucc

SEQ ID NO: 695098 - RNA, 22 nt, Human
ugccacagagcaauucugcuga

SEQ ID NO: 695099 - RNA, 22 nt, Human
uucagcagucguccaggaaaag

SEQ ID NO: 695100 - RNA, 22 nt, Human
auguguuaguuugugauuauac

SEQ ID NO: 695101 - RNA, 22 nt, Human
aaggggaaaaaguguuaggagu

SEQ ID NO: 695102 - RNA, 22 nt, Human
uauguuauuuucauacaacaga

SEQ ID NO: 695103 - RNA, 22 nt, Human
cugaggagcguuggucacgugu

SEQ ID NO: 695104 - RNA, 22 nt, Human
aagcuuuaugaucucucagcua

SEQ ID NO: 695105 - RNA, 22 nt, Human
gaguccuucuggcuggcaggau

SEQ ID NO: 695106 - RNA, 22 nt, Human
auucaguuacucuagacacuuc

SEQ ID NO: 695107 - RNA, 22 nt, Human
gaaaguauuuaaguccauauuu

SEQ ID NO: 695108 - RNA, 22 nt, Human
aggugccaauuuucagugaaca

SEQ ID NO: 695109 - RNA, 23 nt, Human
ggcuggaagaaaacagaauuguu

SEQ ID NO: 695110 - RNA, 22 nt, Human
gcagaggucuagcaccaagaau

SEQ ID NO: 695111 - RNA, 20 nt, Human
cugcugagagccuggcuugc

SEQ ID NO: 695112 - RNA, 22 nt, Human
caggaaaugcuaucauagcuga

SEQ ID NO: 695113 - RNA, 22 nt, Human
ugaaaugacagucuuaagcucu

SEQ ID NO: 695114 - RNA, 22 nt, Human
uacauucagagaaaguuuccau

SEQ ID NO: 695115 - RNA, 22 nt, Human
acaagaguaucuuugacuuuag

SEQ ID NO: 695116 - RNA, 22 nt, Human
ucaguguugaauuuuuugcaaa

SEQ ID NO: 695117 - RNA, 22 nt, Human
gaaauccaguucccuacucuua

SEQ ID NO: 695118 - RNA, 22 nt, Human
uuccaaacucauaguauggugu

SEQ ID NO: 695119 - RNA, 22 nt, Human
ccagcagcauccugcagcacuu

SEQ ID NO: 695120 - RNA, 21 nt, Human
gucacacaggccuggagcuga

SEQ ID NO: 695121 - RNA, 22 nt, Human
ucauagaaauguggccagaaac

SEQ ID NO: 695122 - RNA, 22 nt, Human
uggauauguuggaggugaaggu

SEQ ID NO: 695123 - RNA, 22 nt, Human
cucuuugacgugcccauguccc

SEQ ID NO: 695124 - RNA, 22 nt, Human
cugcagagcauaaaucugaaua

SEQ ID NO: 695125 - RNA, 22 nt, Human
ucuguccagagguccuggagac

SEQ ID NO: 695126 - RNA, 22 nt, Human
aaauaaacugaagcacagagag

SEQ ID NO: 695127 - RNA, 22 nt, Human
acagcauucaauaaauaauaac

SEQ ID NO: 695128 - RNA, 22 nt, Human
uacaaguguaagcuugugagac

SEQ ID NO: 695129 - RNA, 22 nt, Human
guggcagagguuccucagugug

SEQ ID NO: 695130 - RNA, 22 nt, Human
aacaaacaaacauuuugucauc

SEQ ID NO: 695131 - RNA, 22 nt, Human
aacugaaacguauuuuugagau

SEQ ID NO: 695132 - RNA, 22 nt, Human
uuagcugcauuaucaaaguuau

SEQ ID NO: 695133 - RNA, 22 nt, Human
aguuuucucuguguucugcuua

SEQ ID NO: 695134 - RNA, 22 nt, Human
ucacugcucgauaacaugauua

SEQ ID NO: 695135 - RNA, 22 nt, Human
uagaauuaugccuugcugucca

SEQ ID NO: 695136 - RNA, 22 nt, Human
ccagggcaugggaagaacugaa

SEQ ID NO: 695137 - RNA, 22 nt, Human
ggguggagcuuggacaccagua

SEQ ID NO: 695138 - RNA, 22 nt, Human
uucuggcugaaaguuuauuuga

SEQ ID NO: 695139 - RNA, 22 nt, Human
gagugagggccaacauccagcu

SEQ ID NO: 695140 - RNA, 22 nt, Human
gcugaaaucccagcauucccca

SEQ ID NO: 695141 - RNA, 22 nt, Human
ucuggauuuguggaaaaucugc

SEQ ID NO: 695142 - RNA, 22 nt, Human
caggccagaguccaacuccaga

SEQ ID NO: 695143 - RNA, 22 nt, Human
ugcccugccaagacucaguggu

SEQ ID NO: 695144 - RNA, 22 nt, Human
auuagcuuaguguuuccguaau

SEQ ID NO: 695145 - RNA, 22 nt, Human
uuuguaugggcagaaauuagau

SEQ ID NO: 695146 - RNA, 22 nt, Human
accaggcccaccgcaugcuccu

SEQ ID NO: 695147 - RNA, 22 nt, Human
uuccuaaccucuagcugcauau

SEQ ID NO: 695148 - RNA, 22 nt, Human
acaggcacugucaagucaugaa

SEQ ID NO: 695149 - RNA, 22 nt, Human
gcugcucucucccuaaguuggg

SEQ ID NO: 695150 - RNA, 22 nt, Human
ucagcaucaguauuguuuagga

SEQ ID NO: 695151 - RNA, 22 nt, Human
cuuccuggccauugccauggca

SEQ ID NO: 695152 - RNA, 20 nt, Human
caugagaagggcagugugag

SEQ ID NO: 695153 - RNA, 22 nt, Human
cuggcccccacaccugucaggg

SEQ ID NO: 695154 - RNA, 22 nt, Human
ugugaagguaaggaggggcaag

SEQ ID NO: 695155 - RNA, 22 nt, Human
gagggaugcagaaacagaggcc

SEQ ID NO: 695156 - RNA, 22 nt, Human
acacagaggcaugacaguggcu

SEQ ID NO: 695157 - RNA, 22 nt, Human
auggcagccugagcagaggaau

SEQ ID NO: 695158 - RNA, 22 nt, Human
agagccugagccugaaagcccu

SEQ ID NO: 695159 - RNA, 22 nt, Human
gaaagauauuuauuggcaacag

SEQ ID NO: 695160 - RNA, 22 nt, Human
ggcucccugggugcuccugcuc

SEQ ID NO: 695161 - RNA, 22 nt, Human
uacagcacggugcauuuacuac

SEQ ID NO: 695162 - RNA, 22 nt, Human
aaugcuuaauucaauacugugu

SEQ ID NO: 695163 - RNA, 22 nt, Human
ucauugacaguuguuucaaaua

SEQ ID NO: 695164 - RNA, 22 nt, Human
gaaaacuuggaucucuagaaug

SEQ ID NO: 695165 - RNA, 22 nt, Human
uccuggugcuuguauuugaagu

SEQ ID NO: 695166 - RNA, 22 nt, Human
ggcuggagaagggugguugaca

SEQ ID NO: 695167 - RNA, 22 nt, Human
caggucuguuuccaucagugcu

SEQ ID NO: 695168 - RNA, 22 nt, Human
uggagacucugcaucugugaca

SEQ ID NO: 695169 - RNA, 22 nt, Human
uauauaagauggguaggcuugu

SEQ ID NO: 695170 - RNA, 19 nt, Human
ccuggcugugaagccugca

SEQ ID NO: 695171 - RNA, 22 nt, Human
uacaguauauacuguguguaga

SEQ ID NO: 695172 - RNA, 22 nt, Human
gagcagggccacuucuguaccu

SEQ ID NO: 695173 - RNA, 22 nt, Human
ugaagccagcuuuggaagacac

SEQ ID NO: 695174 - RNA, 22 nt, Human
gcagacacuugaggugggcuuu

SEQ ID NO: 695175 - RNA, 22 nt, Human
uagccgggugugguggaacucc

SEQ ID NO: 695176 - RNA, 22 nt, Human
cgcagagggagccgcgggcugc

SEQ ID NO: 695177 - RNA, 22 nt, Human
ucucacacuaaugcucuaucag

SEQ ID NO: 695178 - RNA, 22 nt, Human
ugguaucagagccaucuguauu

SEQ ID NO: 695179 - RNA, 22 nt, Human
gugcaugaagacucagaaaguc

SEQ ID NO: 695180 - RNA, 22 nt, Human
uuacaguuuaccaagaauauug

SEQ ID NO: 695181 - RNA, 22 nt, Human
uucaaagauggagggauagauu

SEQ ID NO: 695182 - RNA, 22 nt, Human
caguugaugggacucauguggg

SEQ ID NO: 695183 - RNA, 22 nt, Human
aguguaugaacuuaagagagag

SEQ ID NO: 695184 - RNA, 22 nt, Human
ucagcaccaguuauccucaggg

SEQ ID NO: 695185 - RNA, 22 nt, Human
ugcugaggucaccuugcugcua

SEQ ID NO: 695186 - RNA, 22 nt, Human
acagccuucucuucacuguguc

SEQ ID NO: 695187 - RNA, 22 nt, Human
uugcauugugauuacagaggug

SEQ ID NO: 695188 - RNA, 20 nt, Human
aggagaaauucgggacaccu

SEQ ID NO: 695189 - RNA, 19 nt, Human
uaccaaauugcauuauggc

SEQ ID NO: 695190 - RNA, 19 nt, Human
cuccaaguuaagagggagg

SEQ ID NO: 695191 - RNA, 22 nt, Human
cacaauuuuaauacacagucaa

SEQ ID NO: 695192 - RNA, 22 nt, Human
ucugccuagugggacagcagcc

SEQ ID NO: 695193 - RNA, 22 nt, Human
acaauguucuacauauacauaa

SEQ ID NO: 695194 - RNA, 22 nt, Human
ugggaaguaggacagugcaguu

SEQ ID NO: 695195 - RNA, 22 nt, Human
ccugggcuccacuccaagagca

SEQ ID NO: 695196 - RNA, 22 nt, Human
cuccaggugcagaaggacucag

SEQ ID NO: 695197 - RNA, 22 nt, Human
cuucugugcgccucuauucccu

SEQ ID NO: 695198 - RNA, 22 nt, Human
ccauggcaauggucagucuauu

SEQ ID NO: 695199 - RNA, 22 nt, Human
uuguuucaaauauuucagaaua

SEQ ID NO: 695200 - RNA, 22 nt, Human
ccuaggcuaauucaguccagua

SEQ ID NO: 695201 - RNA, 22 nt, Human
agccagcaucccuucagucucc

SEQ ID NO: 695202 - RNA, 22 nt, Human
aaauggcuuugaggguaggaca

SEQ ID NO: 695203 - RNA, 19 nt, Human
uccugcagguggcuugcag

SEQ ID NO: 695204 - RNA, 22 nt, Human
aagauguuaaauugggggcauu

SEQ ID NO: 695205 - RNA, 22 nt, Human
uggcagcuccuggggccagcac

SEQ ID NO: 695206 - RNA, 22 nt, Human
ugccauuuaaaaaugaccaaau

SEQ ID NO: 695207 - RNA, 22 nt, Human
uacaaaguuugggguccucaaa

SEQ ID NO: 695208 - RNA, 22 nt, Human
ugcguguguguauauacacagg

SEQ ID NO: 695209 - RNA, 22 nt, Human
acaugugcagacagcaagcagg

SEQ ID NO: 695210 - RNA, 22 nt, Human
agaaaguuuauuucuugaugga

SEQ ID NO: 695211 - RNA, 22 nt, Human
uguuuucagucauauagcaggu

SEQ ID NO: 695212 - RNA, 22 nt, Human
acucugccccgaguucugggaa

SEQ ID NO: 695213 - RNA, 22 nt, Human
ggagaaggguauguguggcgga

SEQ ID NO: 695214 - RNA, 22 nt, Human
cagucccaaggaggaagcaguc

SEQ ID NO: 695215 - RNA, 22 nt, Human
caguuuuaugucgaauguauac

SEQ ID NO: 695216 - RNA, 22 nt, Human
ggcagggaagcuggcaucacgg

SEQ ID NO: 695217 - RNA, 23 nt, Human
aaugggugcaacuauccaugaca

SEQ ID NO: 695218 - RNA, 22 nt, Human
aaucuguucuacucuauucaga

SEQ ID NO: 695219 - RNA, 22 nt, Human
acagagggggccuuggagugca

SEQ ID NO: 695220 - RNA, 22 nt, Human
ucaggaggucugcugcggggug

SEQ ID NO: 695221 - RNA, 22 nt, Human
cugguccucuccagcaggcauu

SEQ ID NO: 695222 - RNA, 22 nt, Human
caagcugguaucagcuagagcg

SEQ ID NO: 695223 - RNA, 18 nt, Human
aaggcacaggagaacauu

SEQ ID NO: 695224 - RNA, 22 nt, Human
guuccugaaagaugaguaauua

SEQ ID NO: 695225 - RNA, 21 nt, Human
uugauuuagcagaucuagcug

SEQ ID NO: 695226 - RNA, 22 nt, Human
aucauagaacaccuaccuaccu

SEQ ID NO: 695227 - RNA, 22 nt, Human
ucucugucacacaaucuacaca

SEQ ID NO: 695228 - RNA, 22 nt, Human
gagugggcaccgugggcacacu

SEQ ID NO: 695229 - RNA, 22 nt, Human
uccuggcuaguuuugcugaaau

SEQ ID NO: 695230 - RNA, 22 nt, Human
caggggcagucugugugcgugg

SEQ ID NO: 695231 - RNA, 22 nt, Human
aucugggucugaagauaaugau

SEQ ID NO: 695232 - RNA, 22 nt, Human
accucacaagucucugucagcu

SEQ ID NO: 695233 - RNA, 22 nt, Human
agccacagagagggagcugcaa

SEQ ID NO: 695234 - RNA, 22 nt, Human
cauacauacugaguggacugau

SEQ ID NO: 695235 - RNA, 20 nt, Human
ucccaaggaugccugggugu

SEQ ID NO: 695236 - RNA, 22 nt, Human
uuguuguuggagccaauaugca

SEQ ID NO: 695237 - RNA, 22 nt, Human
acaugucuccacccaucuuaaa

SEQ ID NO: 695238 - RNA, 22 nt, Human
uaggucugauuuccauucaguc

SEQ ID NO: 695239 - RNA, 22 nt, Human
gcccucuguguaacaauccaga

SEQ ID NO: 695240 - RNA, 20 nt, Human
gccauccagccucccaggag

SEQ ID NO: 695241 - RNA, 21 nt, Human
cagaggggcuagccuggcugc

SEQ ID NO: 695242 - RNA, 23 nt, Human
ggauggagccacuuugaaaccac

SEQ ID NO: 695243 - RNA, 20 nt, Human
cggacuuucuucucagggca

SEQ ID NO: 695244 - RNA, 22 nt, Human
guggugcaggaagcaucuggcu

SEQ ID NO: 695245 - RNA, 22 nt, Human
gcacuagaaucccuucaagaag

SEQ ID NO: 695246 - RNA, 22 nt, Human
cacaguggcagguguggguugu

SEQ ID NO: 695247 - RNA, 22 nt, Human
cagacagggcccugugauggua

SEQ ID NO: 695248 - RNA, 22 nt, Human
caaugcauuauucucccacuuc

SEQ ID NO: 695249 - RNA, 22 nt, Human
aguguuuauauuauggaaauau

SEQ ID NO: 695250 - RNA, 22 nt, Human
caucauugccuguuucccuugg

SEQ ID NO: 695251 - RNA, 17 nt, Human
uggggaugguucaugag

SEQ ID NO: 695252 - RNA, 22 nt, Human
ccugccuggaucagccauccug

SEQ ID NO: 695253 - RNA, 22 nt, Human
ggagcagacauaaccuuacaga

SEQ ID NO: 695254 - RNA, 22 nt, Human
ggagaaugauucuuugcucacu

SEQ ID NO: 695255 - RNA, 22 nt, Human
ugagaauuuucaguuucacuuu

SEQ ID NO: 695256 - RNA, 22 nt, Human
cguggccuuugagugagcuccc

SEQ ID NO: 695257 - RNA, 22 nt, Human
uuacaguccuuuguauuguuua

SEQ ID NO: 695258 - RNA, 22 nt, Human
guggccagagauuaaauagagu

SEQ ID NO: 695259 - RNA, 22 nt, Human
agcuuguguuuuucuaaguauc

SEQ ID NO: 695260 - RNA, 22 nt, Human
uguuuguagagacagcugaugc

SEQ ID NO: 695261 - RNA, 22 nt, Human
gcagcaggcacggucucgacau

SEQ ID NO: 695262 - RNA, 22 nt, Human
uuuguaaagucuguucugaguu

SEQ ID NO: 695263 - RNA, 22 nt, Human
uuuucguuuauuugacauguaa

SEQ ID NO: 695264 - RNA, 22 nt, Human
auggucacagagcuuaauuaau

SEQ ID NO: 695265 - RNA, 22 nt, Human
aaguuucaugacuugguuauua

SEQ ID NO: 695266 - RNA, 22 nt, Human
auccaggcugcuuucuaugccc

SEQ ID NO: 695267 - RNA, 22 nt, Human
gggcuucaguaccaaaguuuga

SEQ ID NO: 695268 - RNA, 22 nt, Human
ggaggggcagccauggaacucc

SEQ ID NO: 695269 - RNA, 22 nt, Human
agcaggaggguuuuguagaguc

SEQ ID NO: 695270 - RNA, 22 nt, Human
cagaggcuggauggacuugccu

SEQ ID NO: 695271 - RNA, 22 nt, Human
ccugggcagccugcucaaggac

SEQ ID NO: 695272 - RNA, 22 nt, Human
uuggcagaugaacacaacugga

SEQ ID NO: 695273 - RNA, 21 nt, Human
uuugaaagcccuauguuuuca

SEQ ID NO: 695274 - RNA, 22 nt, Human
caggcagacuuugagaaugaug

SEQ ID NO: 695275 - RNA, 22 nt, Human
uguauuuauucaggauguaacu

SEQ ID NO: 695276 - RNA, 22 nt, Human
gacagcaguccuggaguuccca

SEQ ID NO: 695277 - RNA, 22 nt, Human
cuaggaauccuuuuagaguugg

SEQ ID NO: 695278 - RNA, 22 nt, Human
ugaauugugaccccucuguauu

SEQ ID NO: 695279 - RNA, 22 nt, Human
aggagaaaacaguguuuugccu

SEQ ID NO: 695280 - RNA, 22 nt, Human
gacuauugcacacuucucucac

SEQ ID NO: 695281 - RNA, 22 nt, Human
ucaagcaucuuggucuacgauc

SEQ ID NO: 695282 - RNA, 21 nt, Human
uaagagcuauuauugcaaacc

SEQ ID NO: 695283 - RNA, 22 nt, Human
aagguuuuuuuccaguaucucu

SEQ ID NO: 695284 - RNA, 22 nt, Human
gacccaggguauccagagcugc

SEQ ID NO: 695285 - RNA, 22 nt, Human
acauucuggaugucugaugaga

SEQ ID NO: 695286 - RNA, 22 nt, Human
uguuaggguccugugcaggggc

SEQ ID NO: 695287 - RNA, 22 nt, Human
aagauguugacuccuuugaugu

SEQ ID NO: 695288 - RNA, 22 nt, Human
augucuagagcaagagaugcug

SEQ ID NO: 695289 - RNA, 22 nt, Human
ggagcaagagguggugaaaaau

SEQ ID NO: 695290 - RNA, 22 nt, Human
gcuaggcuguguuucagacccu

SEQ ID NO: 695291 - RNA, 22 nt, Human
uucaacuauuaugaauaaaauu

SEQ ID NO: 695292 - RNA, 22 nt, Human
cuuuugcaccuuuuaaguaaug

SEQ ID NO: 695293 - RNA, 22 nt, Human
cugcugggucuaugcaagugga

SEQ ID NO: 695294 - RNA, 22 nt, Human
uggcagugaaccaaggcuccaa

SEQ ID NO: 695295 - RNA, 21 nt, Human
uuagaguugccauuauaugua

SEQ ID NO: 695296 - RNA, 22 nt, Human
acagauauaugauuguguaaau

SEQ ID NO: 695297 - RNA, 22 nt, Human
ugagggaguguggauacaguag

SEQ ID NO: 695298 - RNA, 22 nt, Human
gccccuggcuggccagcuccuc

SEQ ID NO: 695299 - RNA, 22 nt, Human
cacagcaagagcuaaaugacca

SEQ ID NO: 695300 - RNA, 22 nt, Human
caagcccacugcucagagccaa

SEQ ID NO: 695301 - RNA, 22 nt, Human
ugggugcucugcgaccguaggg

SEQ ID NO: 695302 - RNA, 22 nt, Human
auugaaaaugacauuugugccc

SEQ ID NO: 695303 - RNA, 21 nt, Human
uuggaacaagcagcaguuugc

SEQ ID NO: 695304 - RNA, 19 nt, Human
cugcucaggucagucuguc

SEQ ID NO: 695305 - RNA, 22 nt, Human
gucagcuccuagcaccccccaa

SEQ ID NO: 695306 - RNA, 22 nt, Human
uuguaacaguagcugucagcuc

SEQ ID NO: 695307 - RNA, 22 nt, Human
agacauuuuaacaucuggguuu

SEQ ID NO: 695308 - RNA, 22 nt, Human
ggccuguggcaaggugagaaug

SEQ ID NO: 695309 - RNA, 20 nt, Human
cugggcucaagugauccucc

SEQ ID NO: 695310 - RNA, 22 nt, Human
gggaaaggaucagugggaggcu

SEQ ID NO: 695311 - RNA, 22 nt, Human
cuggacagaaguggcugggcag

SEQ ID NO: 695312 - RNA, 22 nt, Human
uucuaaauuuuggaagaugcag

SEQ ID NO: 695313 - RNA, 22 nt, Human
cagaggccaggcugccugacug

SEQ ID NO: 695314 - RNA, 22 nt, Human
uccaggcccauggagcagagcu

SEQ ID NO: 695315 - RNA, 22 nt, Human
gugaacaaggagacuacaacuu

SEQ ID NO: 695316 - RNA, 22 nt, Human
ugcugcuggaucuuacucaucu

SEQ ID NO: 695317 - RNA, 22 nt, Human
ugcagaaauucagaaagcauaa

SEQ ID NO: 695318 - RNA, 22 nt, Human
cagccugcaggaggccgucagc

SEQ ID NO: 695319 - RNA, 22 nt, Human
ucaagaugcauggguggcauaa

SEQ ID NO: 695320 - RNA, 22 nt, Human
ugagauccccaggaaggacaac

SEQ ID NO: 695321 - RNA, 22 nt, Human
uaauacuuugaaugagagcuaa

SEQ ID NO: 695322 - RNA, 22 nt, Human
uuacagaguagugcagaacuca

SEQ ID NO: 695323 - RNA, 22 nt, Human
ugucacauuauaugugaggaua

SEQ ID NO: 695324 - RNA, 22 nt, Human
aguggucugccugccucagccu

SEQ ID NO: 695325 - RNA, 22 nt, Human
gccagcaguccaguccuuagug

SEQ ID NO: 695326 - RNA, 22 nt, Human
cccaggagguggagguugcggu

SEQ ID NO: 695327 - RNA, 23 nt, Human
acugggcuuaugaggaggcuugu

SEQ ID NO: 695328 - RNA, 22 nt, Human
uuauuucuacuauuuugccuga

SEQ ID NO: 695329 - RNA, 22 nt, Human
accacaggguaaaguuagauau

SEQ ID NO: 695330 - RNA, 22 nt, Human
aggaaagcaauggcugagaaca

SEQ ID NO: 695331 - RNA, 20 nt, Human
uuggucagugguucaguuug

SEQ ID NO: 695332 - RNA, 20 nt, Human
uccaggagguuaguguggcu

SEQ ID NO: 695333 - RNA, 23 nt, Human
ccugcucaggcgugugcccugcu

SEQ ID NO: 695334 - RNA, 22 nt, Human
ccaguguuagagacugauacag

SEQ ID NO: 695335 - RNA, 22 nt, Human
ggaccugcauuuuaacaagauc

SEQ ID NO: 695336 - RNA, 22 nt, Human
gaaguuuuagucaaaauguaga

SEQ ID NO: 695337 - RNA, 22 nt, Human
agggcuguuuuuggcaccuggg

SEQ ID NO: 695338 - RNA, 22 nt, Human
gcccagcaggacagagugguuu

SEQ ID NO: 695339 - RNA, 22 nt, Human
gacacagaauuccccuccaagu

SEQ ID NO: 695340 - RNA, 22 nt, Human
uuuucuaaaagaagucacugau

SEQ ID NO: 695341 - RNA, 23 nt, Human
cacggcagccuccgagggugcug

SEQ ID NO: 695342 - RNA, 22 nt, Human
gaaagcugggaaauaaauauua

SEQ ID NO: 695343 - RNA, 22 nt, Human
uggcccugugacugaguucuag

SEQ ID NO: 695344 - RNA, 22 nt, Human
ggggaguguuuucaugggcuug

SEQ ID NO: 695345 - RNA, 21 nt, Human
ggaggaaaaaggaaugacuug

SEQ ID NO: 695346 - RNA, 22 nt, Human
cugggcacugcaggguguugag

SEQ ID NO: 695347 - RNA, 22 nt, Human
aggcugugaggggcccgcaugc

SEQ ID NO: 695348 - RNA, 22 nt, Human
cugggucuggccacaggaagua

SEQ ID NO: 695349 - RNA, 22 nt, Human
uuccugaagucaaagaucuaaa

SEQ ID NO: 695350 - RNA, 22 nt, Human
gggccccaaaaugccaggcucu

SEQ ID NO: 695351 - RNA, 22 nt, Human
cuggcagcauuuuuuucagaag

SEQ ID NO: 695352 - RNA, 22 nt, Human
ucaaacauguuagcagucugug

SEQ ID NO: 695353 - RNA, 22 nt, Human
gcugcagcagcugcaggguugu

SEQ ID NO: 695354 - RNA, 22 nt, Human
cuucuuuugaagggcguugugu

SEQ ID NO: 695355 - RNA, 22 nt, Human
ugcugaggcagaugucugugac

SEQ ID NO: 695356 - RNA, 22 nt, Human
agcuguguagggaaucagagaa

SEQ ID NO: 695357 - RNA, 22 nt, Human
ccagggcugcugugggacucca

SEQ ID NO: 695358 - RNA, 22 nt, Human
ugaugaaaguucaguagugaau

SEQ ID NO: 695359 - RNA, 22 nt, Human
cagcuccucuguuagcccuggg

SEQ ID NO: 695360 - RNA, 22 nt, Human
gaaggcauaaaaccaauuuugu

SEQ ID NO: 695361 - RNA, 22 nt, Human
gagggccucugcugcuccacau

SEQ ID NO: 695362 - RNA, 19 nt, Human
uguacguguggguguuuaa

SEQ ID NO: 695363 - RNA, 22 nt, Human
gcagagcaggaaggaagucagg

SEQ ID NO: 695364 - RNA, 22 nt, Human
ucugggccggagccgacggcag

SEQ ID NO: 695365 - RNA, 22 nt, Human
auugucucuuaaauguggaaau

SEQ ID NO: 695366 - RNA, 22 nt, Human
gggcuaaaugcagaaaugcaga

SEQ ID NO: 695367 - RNA, 22 nt, Human
aaagguuagacagcucugcaua

SEQ ID NO: 695368 - RNA, 22 nt, Human
aggcugccuguuccaaucuccu

SEQ ID NO: 695369 - RNA, 22 nt, Human
gcuggguauuuuaagaaaggaa

SEQ ID NO: 695370 - RNA, 22 nt, Human
uguaaacauauguauguaugua

SEQ ID NO: 695371 - RNA, 22 nt, Human
uuaaugucaacauuucugaaga

SEQ ID NO: 695372 - RNA, 22 nt, Human
ucuauaaaugcagauaugugug

SEQ ID NO: 695373 - RNA, 22 nt, Human
guuucaaaagucaggcuauucu

SEQ ID NO: 695374 - RNA, 22 nt, Human
uggcauguaguaggugcuauaa

SEQ ID NO: 695375 - RNA, 22 nt, Human
acagagcaguaagaacacagcu

SEQ ID NO: 695376 - RNA, 22 nt, Human
agggcugcugaggaagccuugc

SEQ ID NO: 695377 - RNA, 22 nt, Human
uguaugaaguuacugagccucu

SEQ ID NO: 695378 - RNA, 22 nt, Human
uuuaagaucuaucccauuuugu

SEQ ID NO: 695379 - RNA, 22 nt, Human
caaauacuuuauauacuucaaa

SEQ ID NO: 695380 - RNA, 22 nt, Human
aagaugugaacagaaccacagg

SEQ ID NO: 695381 - RNA, 22 nt, Human
aaugccguagacuuuuacuuau

SEQ ID NO: 695382 - RNA, 21 nt, Human
gggcgaggccugauguggcuc

SEQ ID NO: 695383 - RNA, 22 nt, Human
ucagcuggagauccuuguugug

SEQ ID NO: 695384 - RNA, 22 nt, Human
auuugcuuguaaauguaugccu

SEQ ID NO: 695385 - RNA, 22 nt, Human
uggcaaaggcgcucacaugccu

SEQ ID NO: 695386 - RNA, 22 nt, Human
agaaaucagaacccugaaguuc

SEQ ID NO: 695387 - RNA, 22 nt, Human
gcucuuuguauuuuggaaucaa

SEQ ID NO: 695388 - RNA, 22 nt, Human
cucuuaguuuguaaaaauaauu

SEQ ID NO: 695389 - RNA, 20 nt, Human
gccucagucacauggccuac

SEQ ID NO: 695390 - RNA, 22 nt, Human
gcaugcaauuaugguauuagau

SEQ ID NO: 695391 - RNA, 22 nt, Human
ggguuaguugguaguuaauuga

SEQ ID NO: 695392 - RNA, 22 nt, Human
caagaagcccuuccugggugga

SEQ ID NO: 695393 - RNA, 22 nt, Human
uggcaguccccugugccuggaa

SEQ ID NO: 695394 - RNA, 22 nt, Human
uuccaugacugaagcaggggcg

SEQ ID NO: 695395 - RNA, 22 nt, Human
ggcccagcugugcuuccagccc

SEQ ID NO: 695396 - RNA, 22 nt, Human
agcacagcuuagcaccuggcac

SEQ ID NO: 695397 - RNA, 22 nt, Human
agcugaaauucuuuguccucag

SEQ ID NO: 695398 - RNA, 20 nt, Human
gcugagguggaggaaggaga

SEQ ID NO: 695399 - RNA, 22 nt, Human
auugggcuggauuaggacuguu

SEQ ID NO: 695400 - RNA, 22 nt, Human
guggcaguagacagugcaucua

SEQ ID NO: 695401 - RNA, 22 nt, Human
ugcugucaagaaaacaagcaau

SEQ ID NO: 695402 - RNA, 22 nt, Human
aaaggcuggggacugaggaagg

SEQ ID NO: 695403 - RNA, 22 nt, Human
gcagagccccauugcuggcggg

SEQ ID NO: 695404 - RNA, 22 nt, Human
uuuauuguguugaaacugaauu

SEQ ID NO: 695405 - RNA, 22 nt, Human
cagcacuaugacauuuaauucu

SEQ ID NO: 695406 - RNA, 22 nt, Human
uacaucuauacugaucuacauu

SEQ ID NO: 695407 - RNA, 22 nt, Human
auguucuacagauggaaagggg

SEQ ID NO: 695408 - RNA, 22 nt, Human
acuggcagugucguuuacauga

SEQ ID NO: 695409 - RNA, 22 nt, Human
ccuaacuuucauuaggccccag

SEQ ID NO: 695410 - RNA, 22 nt, Human
uaacaaaguaccauagacugga

SEQ ID NO: 695411 - RNA, 22 nt, Human
uacacaggguauggcuugagga

SEQ ID NO: 695412 - RNA, 22 nt, Human
uggucugaacuaagacaguagu

SEQ ID NO: 695413 - RNA, 22 nt, Human
acagcugugaagcaagcacucu

SEQ ID NO: 695414 - RNA, 17 nt, Human
ugaaaucagcacccagg

SEQ ID NO: 695415 - RNA, 22 nt, Human
auuucuuacauaacaaauuguu

SEQ ID NO: 695416 - RNA, 19 nt, Human
aagguggcagcagguauua

SEQ ID NO: 695417 - RNA, 22 nt, Human
ugaagcaggaucguuugcuuca

SEQ ID NO: 695418 - RNA, 22 nt, Human
uggucccuuucuacugagcaca

SEQ ID NO: 695419 - RNA, 22 nt, Human
aaguuuagaacuauaagaguga

SEQ ID NO: 695420 - RNA, 22 nt, Human
uugcauuugacaaauuauuuaa

SEQ ID NO: 695421 - RNA, 22 nt, Human
ucuggcaccacugagucugcag

SEQ ID NO: 695422 - RNA, 22 nt, Human
cuuucacagucauaugaugaau

SEQ ID NO: 695423 - RNA, 22 nt, Human
aaacugaauucaaguauccagu

SEQ ID NO: 695424 - RNA, 22 nt, Human
ccugugcucccuauguaucugg

SEQ ID NO: 695425 - RNA, 22 nt, Human
uccuugaaugaauguucucucc

SEQ ID NO: 695426 - RNA, 22 nt, Human
aaguaugucaaucauacuucaa

SEQ ID NO: 695427 - RNA, 22 nt, Human
gcaaggcugugcacuuugcauu

SEQ ID NO: 695428 - RNA, 22 nt, Human
gccaggcagccacccucugcga

SEQ ID NO: 695429 - RNA, 22 nt, Human
cagcugagaaaggcaggcucac

SEQ ID NO: 695430 - RNA, 18 nt, Human
acacagguuauucucucc

SEQ ID NO: 695431 - RNA, 22 nt, Human
uaccacuacauuugcuaauggc

SEQ ID NO: 695432 - RNA, 22 nt, Human
caggguggggaaauagcgcccu

SEQ ID NO: 695433 - RNA, 22 nt, Human
aagcugccugccacgcuagaua

SEQ ID NO: 695434 - RNA, 22 nt, Human
agccccaguccgcugcgggcgg

SEQ ID NO: 695435 - RNA, 20 nt, Human
caaggggaguaguaugggcc

SEQ ID NO: 695436 - RNA, 22 nt, Human
gagugagugcugggcugaggcu

SEQ ID NO: 695437 - RNA, 22 nt, Human
cagucccagacccagaaggugg

SEQ ID NO: 695438 - RNA, 22 nt, Human
gcaaggcugggagaugaggccu

SEQ ID NO: 695439 - RNA, 22 nt, Human
acugagggugcacaggcaggca

SEQ ID NO: 695440 - RNA, 22 nt, Human
agcaauaaauguaaagguuaag

SEQ ID NO: 695441 - RNA, 22 nt, Human
auugauucuaccagcuacuuug

SEQ ID NO: 695442 - RNA, 22 nt, Human
aaaagucuacaagcuucaacaa

SEQ ID NO: 695443 - RNA, 18 nt, Human
aagcagacagcagacagu

SEQ ID NO: 695444 - RNA, 21 nt, Human
aaguuugggauucaguuucca

SEQ ID NO: 695445 - RNA, 22 nt, Human
cccaggaaaagcagugccagca

SEQ ID NO: 695446 - RNA, 22 nt, Human
uuucuagaggcuccaggggagu

SEQ ID NO: 695447 - RNA, 22 nt, Human
cuguuuaucccuuuggucagca

SEQ ID NO: 695448 - RNA, 22 nt, Human
cagggcagagggaaacuccuuu

SEQ ID NO: 695449 - RNA, 22 nt, Human
gagggccagcagccucagcaug

SEQ ID NO: 695450 - RNA, 22 nt, Human
caagagcugugaccucauucac

SEQ ID NO: 695451 - RNA, 22 nt, Human
ggggcacacuuuugguagauau

SEQ ID NO: 695452 - RNA, 22 nt, Human
uucuuuaugcuucuguuuaggc

SEQ ID NO: 695453 - RNA, 22 nt, Human
gagaugaauguaaacaaaggca

SEQ ID NO: 695454 - RNA, 22 nt, Human
uuagaaaauggaggugggaggg

SEQ ID NO: 695455 - RNA, 22 nt, Human
cccaccaugugcccauuggcuu

SEQ ID NO: 695456 - RNA, 17 nt, Human
gagugcugguggagcuc

SEQ ID NO: 695457 - RNA, 22 nt, Human
uugcuucacugaguuaugccug

SEQ ID NO: 695458 - RNA, 22 nt, Human
aaaaccuucagguuuggaguuu

SEQ ID NO: 695459 - RNA, 22 nt, Human
aaacugggauucuucacaaggu

SEQ ID NO: 695460 - RNA, 22 nt, Human
ugucaugcagguuuguuauaga

SEQ ID NO: 695461 - RNA, 22 nt, Human
cuccauugaacauccucucaga

SEQ ID NO: 695462 - RNA, 22 nt, Human
agcauuuaagcuucugcaaagc

SEQ ID NO: 695463 - RNA, 22 nt, Human
uggggccacacaucucuuucua

SEQ ID NO: 695464 - RNA, 22 nt, Human
cccuagaacacgcagacacuga

SEQ ID NO: 695465 - RNA, 22 nt, Human
agcagugaaacagcugcauaug

SEQ ID NO: 695466 - RNA, 22 nt, Human
aggagccaaauuacuagcucug

SEQ ID NO: 695467 - RNA, 22 nt, Human
ccugcagucuacccaaugugug

SEQ ID NO: 695468 - RNA, 22 nt, Human
ccuggcuuuuguuuauaaauuc

SEQ ID NO: 695469 - RNA, 22 nt, Human
ugcuucagagacauccuacuca

SEQ ID NO: 695470 - RNA, 23 nt, Human
agugcugaauugaaagcuccagg

SEQ ID NO: 695471 - RNA, 22 nt, Human
gccugccugcugugugcaaguu

SEQ ID NO: 695472 - RNA, 22 nt, Human
cuaucuuucgauucuagcuuaa

SEQ ID NO: 695473 - RNA, 22 nt, Human
ugaagcuauauaaguuacagca

SEQ ID NO: 695474 - RNA, 22 nt, Human
uggagaaagcugcauauggaaa

SEQ ID NO: 695475 - RNA, 22 nt, Human
cauggcuggcacacagcaacca

SEQ ID NO: 695476 - RNA, 22 nt, Human
aaguugguguaugagacagaag

SEQ ID NO: 695477 - RNA, 22 nt, Human
ucugcagagauucugggcugag

SEQ ID NO: 695478 - RNA, 22 nt, Human
aggcaggcacuccggaaguguc

SEQ ID NO: 695479 - RNA, 22 nt, Human
uuagcugaaaaaauucaugcaa

SEQ ID NO: 695480 - RNA, 22 nt, Human
gagugagggcagcaggggcugc

SEQ ID NO: 695481 - RNA, 22 nt, Human
ugggaguuuguuagaaaugcag

SEQ ID NO: 695482 - RNA, 22 nt, Human
ccugccugcguccucugagggc

SEQ ID NO: 695483 - RNA, 22 nt, Human
acgaaggaaugugcuugagcau

SEQ ID NO: 695484 - RNA, 20 nt, Human
uccagggcaaacucaucacc

SEQ ID NO: 695485 - RNA, 22 nt, Human
agagccacggcaggccuaggaa

SEQ ID NO: 695486 - RNA, 22 nt, Human
aggagcugucagagugccagag

SEQ ID NO: 695487 - RNA, 22 nt, Human
ugagccagagagguugaggcua

SEQ ID NO: 695488 - RNA, 22 nt, Human
cuguacaucuuaaauggaaaaa

SEQ ID NO: 695489 - RNA, 22 nt, Human
uuuauuugaaucaggggagaau

SEQ ID NO: 695490 - RNA, 22 nt, Human
agccaggcugcaguuggcuggc

SEQ ID NO: 695491 - RNA, 22 nt, Human
cugggccuaggauggaagggcc

SEQ ID NO: 695492 - RNA, 22 nt, Human
gagucccaggaaugagcauagu

SEQ ID NO: 695493 - RNA, 22 nt, Human
caugugcuguagcagagaggaa

SEQ ID NO: 695494 - RNA, 22 nt, Human
gccuggccgcuccgagcuccgc

SEQ ID NO: 695495 - RNA, 18 nt, Human
ugggcuugaaagcaaggu

SEQ ID NO: 695496 - RNA, 22 nt, Human
ggacaggggcguggggauuguu

SEQ ID NO: 695497 - RNA, 22 nt, Human
uuccugggguacuggagaaaau

SEQ ID NO: 695498 - RNA, 15 nt, Human
ucccucagcuaaaga

SEQ ID NO: 695499 - RNA, 22 nt, Human
acuugaauaggugucaaggcca

SEQ ID NO: 695500 - RNA, 22 nt, Human
uguauuaacauuaauaaaaugg

SEQ ID NO: 695501 - RNA, 22 nt, Human
gcugagaggcacuaucuccgga

SEQ ID NO: 695502 - RNA, 22 nt, Human
gcagacuguaccuggaagaggg

SEQ ID NO: 695503 - RNA, 22 nt, Human
ucucuccuaauuucaggugcuu

SEQ ID NO: 695504 - RNA, 22 nt, Human
caagucaaagacuagaacuagu

SEQ ID NO: 695505 - RNA, 22 nt, Human
ccucuauagaugugugcaucua

SEQ ID NO: 695506 - RNA, 22 nt, Human
gggaagugauggagccaggauu

SEQ ID NO: 695507 - RNA, 22 nt, Human
ucccagggcucuagagugcugg

SEQ ID NO: 695508 - RNA, 21 nt, Human
ggcagagcuggggccuccagc

SEQ ID NO: 695509 - RNA, 22 nt, Human
uggccucagauuucaggggugg

SEQ ID NO: 695510 - RNA, 22 nt, Human
ucugauaggugguagaaggagg

SEQ ID NO: 695511 - RNA, 22 nt, Human
cucagagaagucuuugcuaaac

SEQ ID NO: 695512 - RNA, 22 nt, Human
acucaucuucccuccuggaggg

SEQ ID NO: 695513 - RNA, 22 nt, Human
gcaguguuauguuuucuauaau

SEQ ID NO: 695514 - RNA, 22 nt, Human
acuguguauucuaaugacuaaa

SEQ ID NO: 695515 - RNA, 22 nt, Human
ccagggcccacggccagaauag

SEQ ID NO: 695516 - RNA, 22 nt, Human
uuuagcaauaucauaaggaaga

SEQ ID NO: 695517 - RNA, 22 nt, Human
gaaaaguacacagcccaaacau

SEQ ID NO: 695518 - RNA, 22 nt, Human
caaugguggugucagaagagau

SEQ ID NO: 695519 - RNA, 22 nt, Human
ucacaggcccaaaccacgcuua

SEQ ID NO: 695520 - RNA, 22 nt, Human
guucauucugaaaagcagcuug

SEQ ID NO: 695521 - RNA, 22 nt, Human
uauuugcaaagaacuacacuag

SEQ ID NO: 695522 - RNA, 22 nt, Human
aaaugcuuauuagugucacaaa

SEQ ID NO: 695523 - RNA, 22 nt, Human
guacaaaugaaaauagaccacu

SEQ ID NO: 695524 - RNA, 22 nt, Human
cagcagagaccaagugauuuga

SEQ ID NO: 695525 - RNA, 22 nt, Human
cccaguccuaaagcagacgcca

SEQ ID NO: 695526 - RNA, 22 nt, Human
aguggcaaagucuucagaaguu

SEQ ID NO: 695527 - RNA, 22 nt, Human
ucagaaauuuucucaguaguuc

SEQ ID NO: 695528 - RNA, 17 nt, Human
cuggggaugugggacuc

SEQ ID NO: 695529 - RNA, 22 nt, Human
aggaagccugcaggugacugcu

SEQ ID NO: 695530 - RNA, 22 nt, Human
uaaagcagugugguuguguccc

SEQ ID NO: 695531 - RNA, 22 nt, Human
cagguggccaguacucaaggau

SEQ ID NO: 695532 - RNA, 22 nt, Human
ucuccuguaugggacuggcgag

SEQ ID NO: 695533 - RNA, 21 nt, Human
agugaaauugcaucagaggga

SEQ ID NO: 695534 - RNA, 22 nt, Human
ugcuucuguuucauugaucuua

SEQ ID NO: 695535 - RNA, 22 nt, Human
caauugucguugacauccuuca

SEQ ID NO: 695536 - RNA, 22 nt, Human
guaucuuuccacaucuucagua

SEQ ID NO: 695537 - RNA, 22 nt, Human
ugaauaauccacagucauucau

SEQ ID NO: 695538 - RNA, 22 nt, Human
uggcaagaaacugaggccugcu

SEQ ID NO: 695539 - RNA, 22 nt, Human
cugcccugucuuuuucugauga

SEQ ID NO: 695540 - RNA, 22 nt, Human
uaaggaagagcuugguaauagg

SEQ ID NO: 695541 - RNA, 22 nt, Human
agugugaguaauugagucuguc

SEQ ID NO: 695542 - RNA, 22 nt, Human
auuauauaaaauucuggaagcu

SEQ ID NO: 695543 - RNA, 22 nt, Human
auuccacacaguaauacucaau

SEQ ID NO: 695544 - RNA, 22 nt, Human
uaguggaggccuguugugugca

SEQ ID NO: 695545 - RNA, 22 nt, Human
gugacagagauuaauagcuugg

SEQ ID NO: 695546 - RNA, 22 nt, Human
uucuuaguucaacuaaaauuua

SEQ ID NO: 695547 - RNA, 22 nt, Human
gggucuaggagacaugggcaag

SEQ ID NO: 695548 - RNA, 22 nt, Human
ugcucaugcuggggacagaugu

SEQ ID NO: 695549 - RNA, 22 nt, Human
cagaagcaagggccaaagucuu

SEQ ID NO: 695550 - RNA, 22 nt, Human
caguagcacuagauaugugugg

SEQ ID NO: 695551 - RNA, 22 nt, Human
cagagagcaugggaggcccgag

SEQ ID NO: 695552 - RNA, 22 nt, Human
uuguacacacaggaacaaacgu

SEQ ID NO: 695553 - RNA, 22 nt, Human
cagggagggacaauugucaccu

SEQ ID NO: 695554 - RNA, 22 nt, Human
uuggccaaccagaacggagguc

SEQ ID NO: 695555 - RNA, 22 nt, Human
ugcagcauucugguaaaaggca

SEQ ID NO: 695556 - RNA, 22 nt, Human
uaagaggauauuuggccagaag

SEQ ID NO: 695557 - RNA, 22 nt, Human
aagacaugcaguuuguuccauu

SEQ ID NO: 695558 - RNA, 22 nt, Human
ggucacauucugaggaaucagg

SEQ ID NO: 695559 - RNA, 22 nt, Human
gcuucagaaguugggcucugac

SEQ ID NO: 695560 - RNA, 22 nt, Human
ccuuuucuguguggguaauuua

SEQ ID NO: 695561 - RNA, 22 nt, Human
agaugguucagaauuauaaaga

SEQ ID NO: 695562 - RNA, 22 nt, Human
auggacaguacugaguggacua

SEQ ID NO: 695563 - RNA, 22 nt, Human
uggccugaguugucugcaggcc

SEQ ID NO: 695564 - RNA, 22 nt, Human
aaagcuggccucucaggcuuua

SEQ ID NO: 695565 - RNA, 22 nt, Human
cagugcagaacacauggaaaau

SEQ ID NO: 695566 - RNA, 22 nt, Human
cucacacacgaagcccuuggcc

SEQ ID NO: 695567 - RNA, 22 nt, Human
gagcugaaggagaaagcagggg

SEQ ID NO: 695568 - RNA, 22 nt, Human
cuucucuggcauagcaagcagg

SEQ ID NO: 695569 - RNA, 22 nt, Human
uccuuccugcaggccaaguccu

SEQ ID NO: 695570 - RNA, 22 nt, Human
aacaguaacgagauguccuaac

SEQ ID NO: 695571 - RNA, 22 nt, Human
ucagugauugguggacugccua

SEQ ID NO: 695572 - RNA, 22 nt, Human
cugcaggaauucaaagugagcu

SEQ ID NO: 695573 - RNA, 22 nt, Human
ugggccuggaguuuguccagag

SEQ ID NO: 695574 - RNA, 22 nt, Human
uugcagggaaacaguuuaggaa

SEQ ID NO: 695575 - RNA, 22 nt, Human
acagcuggaggccccauugucc

SEQ ID NO: 695576 - RNA, 22 nt, Human
cuuagcuucucugcaucugugu

SEQ ID NO: 695577 - RNA, 20 nt, Human
gcucugggugguaaaugacu

SEQ ID NO: 695578 - RNA, 22 nt, Human
aauguaaacagcaagagaaggg

SEQ ID NO: 695579 - RNA, 22 nt, Human
uaguccucagcugaacugcugc

SEQ ID NO: 695580 - RNA, 22 nt, Human
gagguggcugucagcuucacuu

SEQ ID NO: 695581 - RNA, 20 nt, Human
uggccaaguauccaacugga

SEQ ID NO: 695582 - RNA, 22 nt, Human
uccaguacugaagcuccuucaa

SEQ ID NO: 695583 - RNA, 22 nt, Human
cuggaaauuggagaugauguuu

SEQ ID NO: 695584 - RNA, 22 nt, Human
gaggaaaauaacaacuaagggc

SEQ ID NO: 695585 - RNA, 22 nt, Human
gcaaagguagccaaggagcuca

SEQ ID NO: 695586 - RNA, 22 nt, Human
ccuggccagggucugggcugcu

SEQ ID NO: 695587 - RNA, 22 nt, Human
agccagcaucuugcuucuugag

SEQ ID NO: 695588 - RNA, 22 nt, Human
gguagaaagcccaagucccccu

SEQ ID NO: 695589 - RNA, 22 nt, Human
agggaccuugauggguuuggga

SEQ ID NO: 695590 - RNA, 22 nt, Human
accccagcucugagccacacca

SEQ ID NO: 695591 - RNA, 22 nt, Human
agauacacagagguaaagauga

SEQ ID NO: 695592 - RNA, 22 nt, Human
ugauuacaacagagucauccau

SEQ ID NO: 695593 - RNA, 22 nt, Human
gacaauaagaacagauacugug

SEQ ID NO: 695594 - RNA, 22 nt, Human
uuugaagucaaagauugauucc

SEQ ID NO: 695595 - RNA, 22 nt, Human
gcagcugccuucagcuggaugg

SEQ ID NO: 695596 - RNA, 22 nt, Human
ugaaauuagugaaguuacaguu

SEQ ID NO: 695597 - RNA, 22 nt, Human
agccaggucagcucacccugcu

SEQ ID NO: 695598 - RNA, 22 nt, Human
uccaggggagacuagacccaca

SEQ ID NO: 695599 - RNA, 22 nt, Human
gacagcagaugaagccugcaga

SEQ ID NO: 695600 - RNA, 22 nt, Human
acacuuaacuucugagaauaaa

SEQ ID NO: 695601 - RNA, 21 nt, Human
uuuagggaggauauuuaacuu

SEQ ID NO: 695602 - RNA, 22 nt, Human
aggcugugggaauggcugcuug

SEQ ID NO: 695603 - RNA, 21 nt, Human
aggcaugagcccugcauggac

SEQ ID NO: 695604 - RNA, 22 nt, Human
agccacugugugaccagcuguc

SEQ ID NO: 695605 - RNA, 22 nt, Human
ucauuacacaguucaguggaaa

SEQ ID NO: 695606 - RNA, 22 nt, Human
acugaguuauggguaugccuug

SEQ ID NO: 695607 - RNA, 22 nt, Human
cugucauuguacauguuauaca

SEQ ID NO: 695608 - RNA, 22 nt, Human
uuuccaggugcauagaaaacag

SEQ ID NO: 695609 - RNA, 22 nt, Human
gaaacagccccugugugaagca

SEQ ID NO: 695610 - RNA, 20 nt, Human
acaaauuggcagaaugacaa

SEQ ID NO: 695611 - RNA, 22 nt, Human
gccaggagagcuccuucagguu

SEQ ID NO: 695612 - RNA, 22 nt, Human
cagcacagggacaauagcagau

SEQ ID NO: 695613 - RNA, 22 nt, Human
aggacaggauuccuugccuugc

SEQ ID NO: 695614 - RNA, 22 nt, Human
ucuguuauucugcucaguauag

SEQ ID NO: 695615 - RNA, 22 nt, Human
cacauucuuucacaguucugaa

SEQ ID NO: 695616 - RNA, 22 nt, Human
ugggguggauagaaagugaugu

SEQ ID NO: 695617 - RNA, 22 nt, Human
ccaguguucaucaagaaaaugu

SEQ ID NO: 695618 - RNA, 20 nt, Human
aaaggaauauaugaaguaua

SEQ ID NO: 695619 - RNA, 22 nt, Human
ugucauuaugaggauuacaaua

SEQ ID NO: 695620 - RNA, 22 nt, Human
agcggagcuaguuuuuguccuc

SEQ ID NO: 695621 - RNA, 22 nt, Human
uccagccuuucuacucacugag

SEQ ID NO: 695622 - RNA, 22 nt, Human
ggaugcaggaguugaagaagga

SEQ ID NO: 695623 - RNA, 22 nt, Human
cuugcagccuuaccaaggcauu

SEQ ID NO: 695624 - RNA, 22 nt, Human
ugggccugggcuccuguccucu

SEQ ID NO: 695625 - RNA, 22 nt, Human
gaagagcugugauucaggcuua

SEQ ID NO: 695626 - RNA, 22 nt, Human
uauggguauuuuauacauaacc

SEQ ID NO: 695627 - RNA, 22 nt, Human
agccuggcggucgucggucagg

SEQ ID NO: 695628 - RNA, 22 nt, Human
cuuuaauuaggaaguauaauga

SEQ ID NO: 695629 - RNA, 22 nt, Human
uggcagucuggguuggcaguua

SEQ ID NO: 695630 - RNA, 23 nt, Human
uucuggaagauuuacuugagaca

SEQ ID NO: 695631 - RNA, 22 nt, Human
gggacuguaaauucauauggcc

SEQ ID NO: 695632 - RNA, 22 nt, Human
ggcaguguggcauaacauguag

SEQ ID NO: 695633 - RNA, 22 nt, Human
ugagagaggggacugccugcuu

SEQ ID NO: 695634 - RNA, 22 nt, Human
agaggggcaaguaaagagucuu

SEQ ID NO: 695635 - RNA, 22 nt, Human
gcagugggcaacaagagcugga

SEQ ID NO: 695636 - RNA, 22 nt, Human
uggaggcaacugaagauguagu

SEQ ID NO: 695637 - RNA, 20 nt, Human
uuuacauuuugaaacaguga

SEQ ID NO: 695638 - RNA, 22 nt, Human
ucagcucugcaaggucaccucc

SEQ ID NO: 695639 - RNA, 22 nt, Human
cagcaucuccauggcuuuggag

SEQ ID NO: 695640 - RNA, 22 nt, Human
aagcagcagcaggauuaaagag

SEQ ID NO: 695641 - RNA, 22 nt, Human
gggcugaggaacauauuuuguu

SEQ ID NO: 695642 - RNA, 22 nt, Human
auguguauugagcaccuacugc

SEQ ID NO: 695643 - RNA, 22 nt, Human
agcacugggaacgcauggggcc

SEQ ID NO: 695644 - RNA, 22 nt, Human
acucauuuuuacugcaauugag

SEQ ID NO: 695645 - RNA, 22 nt, Human
ggaucugggcucugccaaucag

SEQ ID NO: 695646 - RNA, 22 nt, Human
acugcacagauuaaguuagauu

SEQ ID NO: 695647 - RNA, 22 nt, Human
auaugcuuugggauuagaucau

SEQ ID NO: 695648 - RNA, 22 nt, Human
gacuucugaauuccuaucaggu

SEQ ID NO: 695649 - RNA, 22 nt, Human
augcccugugacucuccuggac

SEQ ID NO: 695650 - RNA, 22 nt, Human
ucuuuccaaguaauacuuccca

SEQ ID NO: 695651 - RNA, 18 nt, Human
ugauucugugaugugguc

SEQ ID NO: 695652 - RNA, 22 nt, Human
uauguucauagaaaucaugacc

SEQ ID NO: 695653 - RNA, 22 nt, Human
agugacugacaccuguaauccc

SEQ ID NO: 695654 - RNA, 22 nt, Human
ucagccaggcacaauggcagcu

SEQ ID NO: 695655 - RNA, 22 nt, Human
cugaaugccugcagagccagag

SEQ ID NO: 695656 - RNA, 22 nt, Human
ggacuuggggaaggcacaguua

SEQ ID NO: 695657 - RNA, 22 nt, Human
caggucuuuucuacugguggag

SEQ ID NO: 695658 - RNA, 22 nt, Human
guaggccagugugaaaccuggu

SEQ ID NO: 695659 - RNA, 22 nt, Human
ucuguuaugcauaagcaucagu

SEQ ID NO: 695660 - RNA, 22 nt, Human
gcauggagaagugggaacaggu

SEQ ID NO: 695661 - RNA, 22 nt, Human
uagaaagcuugggguguuuaaa

SEQ ID NO: 695662 - RNA, 22 nt, Human
ucuugugcuugcagcuggggag

SEQ ID NO: 695663 - RNA, 20 nt, Human
ggcacuggaagcacacagga

SEQ ID NO: 695664 - RNA, 22 nt, Human
uggcccagaucucugaccuuga

SEQ ID NO: 695665 - RNA, 22 nt, Human
uuguuuccauaauuaaguguga

SEQ ID NO: 695666 - RNA, 22 nt, Human
ugcauacauaaagugcuaucau

SEQ ID NO: 695667 - RNA, 22 nt, Human
aacagaaaucauuuagggcucu

SEQ ID NO: 695668 - RNA, 20 nt, Human
cuguaaacugcgucuguaau

SEQ ID NO: 695669 - RNA, 22 nt, Human
agcagcaggagccgugggguga

SEQ ID NO: 695670 - RNA, 22 nt, Human
aguggcagagcugggauuuggg

SEQ ID NO: 695671 - RNA, 22 nt, Human
guccucugggcagcugccccac

SEQ ID NO: 695672 - RNA, 22 nt, Human
uugucugagagauggcagaggu

SEQ ID NO: 695673 - RNA, 22 nt, Human
caggguggugaauagcuauagu

SEQ ID NO: 695674 - RNA, 22 nt, Human
uauggauggaaagggccaagcu

SEQ ID NO: 695675 - RNA, 22 nt, Human
gugccugugcggacucagggaa

SEQ ID NO: 695676 - RNA, 19 nt, Human
gaaggagagcugaguuagg

SEQ ID NO: 695677 - RNA, 22 nt, Human
auacaaugggugcaaagaugug

SEQ ID NO: 695678 - RNA, 22 nt, Human
ucaccucaccacccuuaugguu

SEQ ID NO: 695679 - RNA, 22 nt, Human
aaaguuuuagaacuaggaagca

SEQ ID NO: 695680 - RNA, 22 nt, Human
uauuuccaaaaaggccauauuc

SEQ ID NO: 695681 - RNA, 20 nt, Human
ucacacaugguaagcuauga

SEQ ID NO: 695682 - RNA, 22 nt, Human
uuaguguguccaguucugaaaa

SEQ ID NO: 695683 - RNA, 22 nt, Human
cauugaaacagauguacccaug

SEQ ID NO: 695684 - RNA, 22 nt, Human
uccguggagauuuugugcaggg

SEQ ID NO: 695685 - RNA, 22 nt, Human
aagugcauaguaauggagucaa

SEQ ID NO: 695686 - RNA, 21 nt, Human
ggccugagcaccuguccaccu

SEQ ID NO: 695687 - RNA, 22 nt, Human
uccugggagcauggugccguga

SEQ ID NO: 695688 - RNA, 22 nt, Human
ugcagggaagucccagcuccug

SEQ ID NO: 695689 - RNA, 21 nt, Human
gccugcacacaguaggugcac

SEQ ID NO: 695690 - RNA, 22 nt, Human
ugccugcucuugagacuuacaa

SEQ ID NO: 695691 - RNA, 23 nt, Human
aggcaggcaguucagcuguuguu

SEQ ID NO: 695692 - RNA, 22 nt, Human
auuugucaguggaagugauuca

SEQ ID NO: 695693 - RNA, 17 nt, Human
agaaugcaaagcaggcu

SEQ ID NO: 695694 - RNA, 22 nt, Human
cagcuauucucugaaaugaaua

SEQ ID NO: 695695 - RNA, 21 nt, Human
ucagagggcccuggaggcuca

SEQ ID NO: 695696 - RNA, 22 nt, Human
ucuuucagaaacuuugucugcg

SEQ ID NO: 695697 - RNA, 22 nt, Human
acaugugaaaucucauaguuag

SEQ ID NO: 695698 - RNA, 22 nt, Human
acacaauacagggcucaaaaua

SEQ ID NO: 695699 - RNA, 23 nt, Human
uguagcaucucuuauuucucagc

SEQ ID NO: 695700 - RNA, 22 nt, Human
caaaacauucucugcagcaggg

SEQ ID NO: 695701 - RNA, 22 nt, Human
auguagcuugucccacaucaua

SEQ ID NO: 695702 - RNA, 22 nt, Human
ucacuucccucuucagcuccca

SEQ ID NO: 695703 - RNA, 22 nt, Human
uagcugguucuccaggagcuag

SEQ ID NO: 695704 - RNA, 22 nt, Human
cucagagauauagucccugcuu

SEQ ID NO: 695705 - RNA, 22 nt, Human
aguccagugucaaggugccauu

SEQ ID NO: 695706 - RNA, 22 nt, Human
cucucuggcacuucauugcugu

SEQ ID NO: 695707 - RNA, 22 nt, Human
gaacaaauucucaucaacuugu

SEQ ID NO: 695708 - RNA, 22 nt, Human
uucagcucagucugugcagcag

SEQ ID NO: 695709 - RNA, 22 nt, Human
cucuuuagucacagggcuucau

SEQ ID NO: 695710 - RNA, 22 nt, Human
gacauaaaccuugagauauuaa

SEQ ID NO: 695711 - RNA, 22 nt, Human
gugugggggcagcucugauaug

SEQ ID NO: 695712 - RNA, 21 nt, Human
aacugcuggucuuuucugucu

SEQ ID NO: 695713 - RNA, 22 nt, Human
auacaaguugcccaaaugauua

SEQ ID NO: 695714 - RNA, 22 nt, Human
agacagagauacuauguuguca

SEQ ID NO: 695715 - RNA, 23 nt, Human
acuggacagaguggacgaggcug

SEQ ID NO: 695716 - RNA, 22 nt, Human
cacuuagucucaccaguucagu

SEQ ID NO: 695717 - RNA, 22 nt, Human
cauuaugugcguacauguaucu

SEQ ID NO: 695718 - RNA, 22 nt, Human
acucugugugaguagagccugu

SEQ ID NO: 695719 - RNA, 22 nt, Human
auuuccaaucucugcauauggg

SEQ ID NO: 695720 - RNA, 22 nt, Human
aggcucugcaguccaucccgug

SEQ ID NO: 695721 - RNA, 22 nt, Human
aagacauguuuuaagaauauuu

SEQ ID NO: 695722 - RNA, 22 nt, Human
uaacacauagauauuuuaacuu

SEQ ID NO: 695723 - RNA, 22 nt, Human
gcuuuaaugaagucacgcaaag

SEQ ID NO: 695724 - RNA, 22 nt, Human
cacugggaaucugggaaagaga

SEQ ID NO: 695725 - RNA, 22 nt, Human
cuggcucaugugaugagggcaa

SEQ ID NO: 695726 - RNA, 22 nt, Human
gggcuggaggccugccugguua

SEQ ID NO: 695727 - RNA, 22 nt, Human
gcugcagcucgccuuccggccu

SEQ ID NO: 695728 - RNA, 23 nt, Human
uuggaacacaguaaaugcacaau

SEQ ID NO: 695729 - RNA, 22 nt, Human
aggaugagauugcuguguugua

SEQ ID NO: 695730 - RNA, 22 nt, Human
cugugcagugugggguaggccu

SEQ ID NO: 695731 - RNA, 22 nt, Human
uuccuucuuccuuuaguaacca

SEQ ID NO: 695732 - RNA, 22 nt, Human
aggaaacuccccuacaucucaa

SEQ ID NO: 695733 - RNA, 22 nt, Human
cagugggagcaaauacacucau

SEQ ID NO: 695734 - RNA, 22 nt, Human
caaauauuccagguacaucccu

SEQ ID NO: 695735 - RNA, 22 nt, Human
aacccgggaggcagagguugug

SEQ ID NO: 695736 - RNA, 22 nt, Human
aaaagauuguuagggagaaugu

SEQ ID NO: 695737 - RNA, 22 nt, Human
aucugaaaguuuagaauucuug

SEQ ID NO: 695738 - RNA, 21 nt, Human
uauggcuuuacuaagcugcac

SEQ ID NO: 695739 - RNA, 22 nt, Human
ugcagggcaucuuugaagugug

SEQ ID NO: 695740 - RNA, 22 nt, Human
uuucacaugcagcagggaagug

SEQ ID NO: 695741 - RNA, 22 nt, Human
auuaucaaguuuacugugugga

SEQ ID NO: 695742 - RNA, 22 nt, Human
ucucauggagucaggagcagaa

SEQ ID NO: 695743 - RNA, 22 nt, Human
cacuugggacaaagcuucugcu

SEQ ID NO: 695744 - RNA, 22 nt, Human
cucacugucuguacuagcugau

SEQ ID NO: 695745 - RNA, 22 nt, Human
acacuuuacucuuacaccauug

SEQ ID NO: 695746 - RNA, 22 nt, Human
gagcuaaguuucuggaggcaga

SEQ ID NO: 695747 - RNA, 22 nt, Human
agcuauaguacuuggcuuuucu

SEQ ID NO: 695748 - RNA, 23 nt, Human
cacaucaguuuaggucagauuuu

SEQ ID NO: 695749 - RNA, 22 nt, Human
gaaggcucuggggauugagaua

SEQ ID NO: 695750 - RNA, 22 nt, Human
aacagcuuuguauacaguaacu

SEQ ID NO: 695751 - RNA, 22 nt, Human
acugggauuacaggugggaguc

SEQ ID NO: 695752 - RNA, 22 nt, Human
ccaccacuucuggcuucuggug

SEQ ID NO: 695753 - RNA, 22 nt, Human
uugugucuuaaagauuaaaugg

SEQ ID NO: 695754 - RNA, 22 nt, Human
ucaguggauuggaugagaucug

SEQ ID NO: 695755 - RNA, 22 nt, Human
gggaugcagacuacagggcuua

SEQ ID NO: 695756 - RNA, 22 nt, Human
acaaacagaguugaaaaauagg

SEQ ID NO: 695757 - RNA, 22 nt, Human
ggcugagaagacaguggggugg

SEQ ID NO: 695758 - RNA, 22 nt, Human
cacuauuuccuggauuuugacg

SEQ ID NO: 695759 - RNA, 22 nt, Human
cacagcuaugagcagccuagcu

SEQ ID NO: 695760 - RNA, 22 nt, Human
agagcugaaaaagcugacccgg

SEQ ID NO: 695761 - RNA, 22 nt, Human
uacagaaugauguguuuaaaua

SEQ ID NO: 695762 - RNA, 22 nt, Human
augagguauucguaauauuucc

SEQ ID NO: 695763 - RNA, 22 nt, Human
cugcuuuagugugguguuagag

SEQ ID NO: 695764 - RNA, 22 nt, Human
agugcugggauuacaggcauaa

SEQ ID NO: 695765 - RNA, 22 nt, Human
agugcugggauugcaggcauga

SEQ ID NO: 695766 - RNA, 22 nt, Human
uucauucuugggaucagagagu

SEQ ID NO: 695767 - RNA, 22 nt, Human
uguagcauguaaauugguuauu

SEQ ID NO: 695768 - RNA, 22 nt, Human
aaauccuugauaguuugcccua

SEQ ID NO: 695769 - RNA, 22 nt, Human
caggugucuaauucucaccccc

SEQ ID NO: 695770 - RNA, 22 nt, Human
uccuucaguuaaagaucucaca

SEQ ID NO: 695771 - RNA, 22 nt, Human
gcagaagcugggagaagggauu

SEQ ID NO: 695772 - RNA, 22 nt, Human
agcagcaacugcuagaguggca

SEQ ID NO: 695773 - RNA, 22 nt, Human
cuauccauuaaagccuuggaaa

SEQ ID NO: 695774 - RNA, 22 nt, Human
ucacagaauaaauguacuggcc

SEQ ID NO: 695775 - RNA, 22 nt, Human
uagcccuggagcagggaaauac

SEQ ID NO: 695776 - RNA, 22 nt, Human
auguguaugucuuauucaaaga

SEQ ID NO: 695777 - RNA, 22 nt, Human
augcuguguggccaccuccaug

SEQ ID NO: 695778 - RNA, 22 nt, Human
aggcaucugaguuugcaagcuu

SEQ ID NO: 695779 - RNA, 22 nt, Human
ggcccagcccgagucagccuuc

SEQ ID NO: 695780 - RNA, 22 nt, Human
uaagaacuuggcagcaagaaau

SEQ ID NO: 695781 - RNA, 22 nt, Human
ccugagugccaugagagcaccc

SEQ ID NO: 695782 - RNA, 22 nt, Human
auucauguggggagccuucugu

SEQ ID NO: 695783 - RNA, 22 nt, Human
aggcuccaggcaauguuucuga

SEQ ID NO: 695784 - RNA, 22 nt, Human
caucaaauaaagaaauuccuug

SEQ ID NO: 695785 - RNA, 22 nt, Human
cucuagaguacgggcuggcaug

SEQ ID NO: 695786 - RNA, 22 nt, Human
acaguuuaugccucugagccug

SEQ ID NO: 695787 - RNA, 22 nt, Human
uccccaccuaagauacccaucu

SEQ ID NO: 695788 - RNA, 22 nt, Human
ucucagugaagaguauaacaaa

SEQ ID NO: 695789 - RNA, 22 nt, Human
uguaugaagacuucuucugugu

SEQ ID NO: 695790 - RNA, 22 nt, Human
uguuaguguaauuccaguuuuc

SEQ ID NO: 695791 - RNA, 21 nt, Human
uucaaagagugggcauuguca

SEQ ID NO: 695792 - RNA, 18 nt, Human
ccauuucaugauuauuac

SEQ ID NO: 695793 - RNA, 22 nt, Human
ugaaagggaaccugcuggacug

SEQ ID NO: 695794 - RNA, 22 nt, Human
aauagcaauuacccuucaacuc

SEQ ID NO: 695795 - RNA, 22 nt, Human
ugagguaggagggugaucagca

SEQ ID NO: 695796 - RNA, 23 nt, Human
gcucccugucccugcacuuaggc

SEQ ID NO: 695797 - RNA, 22 nt, Human
gugggcuuuggccucuuucucc

SEQ ID NO: 695798 - RNA, 22 nt, Human
gugcagcugggcgcugaccuuc

SEQ ID NO: 695799 - RNA, 22 nt, Human
ccaggcuggaguguagucgcau

SEQ ID NO: 695800 - RNA, 22 nt, Human
gcagccuccgcacugcgagucc

SEQ ID NO: 695801 - RNA, 22 nt, Human
cagggccaggcugauggccugg

SEQ ID NO: 695802 - RNA, 22 nt, Human
ugggcagagucauacaggagac

SEQ ID NO: 695803 - RNA, 22 nt, Human
cugcaggucucugugugcauuc

SEQ ID NO: 695804 - RNA, 22 nt, Human
cuuuucuuacucccgcaaggca

SEQ ID NO: 695805 - RNA, 21 nt, Human
agauucauaaucuguaaaaug

SEQ ID NO: 695806 - RNA, 22 nt, Human
cugucuccagggcaggugcagg

SEQ ID NO: 695807 - RNA, 22 nt, Human
cugcuguguugccagugucacc

SEQ ID NO: 695808 - RNA, 22 nt, Human
ugguaaaaacugcaauuacuuu

SEQ ID NO: 695809 - RNA, 22 nt, Human
uuuucccaucuacaaagcaggg

SEQ ID NO: 695810 - RNA, 22 nt, Human
cccaggagguggagcuugcagu

SEQ ID NO: 695811 - RNA, 22 nt, Human
guuuccauggcucuguuaaugg

SEQ ID NO: 695812 - RNA, 22 nt, Human
cugugacugcagcaccaaguaa

SEQ ID NO: 695813 - RNA, 22 nt, Human
aguuucauuucuuaguaccagu

SEQ ID NO: 695814 - RNA, 22 nt, Human
uuagaacacugagaaagugaug

SEQ ID NO: 695815 - RNA, 22 nt, Human
aaaugcuaaaugcagcaaguag

SEQ ID NO: 695816 - RNA, 22 nt, Human
ggcugccacccucggacuuccg

SEQ ID NO: 695817 - RNA, 22 nt, Human
acacuuuaagcauuucacacug

SEQ ID NO: 695818 - RNA, 22 nt, Human
uuucugcaaguguagauaccca

SEQ ID NO: 695819 - RNA, 17 nt, Human
ugcugccaagucccaac

SEQ ID NO: 695820 - RNA, 22 nt, Human
cuggcuuucauucauucaggcc

SEQ ID NO: 695821 - RNA, 16 nt, Human
acccuggguaguccug

SEQ ID NO: 695822 - RNA, 22 nt, Human
agcuguuuguacuuagauagua

SEQ ID NO: 695823 - RNA, 23 nt, Human
agaggcugcaggguauugagaau

SEQ ID NO: 695824 - RNA, 22 nt, Human
cacauugcagcuucuuuuggcu

SEQ ID NO: 695825 - RNA, 22 nt, Human
agacaucaaugaucagagguag

SEQ ID NO: 695826 - RNA, 22 nt, Human
ccuggccugcucggcucuuaag

SEQ ID NO: 695827 - RNA, 22 nt, Human
auacacugaguccuuuucucau

SEQ ID NO: 695828 - RNA, 19 nt, Human
auauauguauacaaugugg

SEQ ID NO: 695829 - RNA, 22 nt, Human
ccaggguguagggauuccagau

SEQ ID NO: 695830 - RNA, 22 nt, Human
ugagaccugccucugcacuagg

SEQ ID NO: 695831 - RNA, 22 nt, Human
caccaggguacaauuucgcaga

SEQ ID NO: 695832 - RNA, 22 nt, Human
ggcugagacuagagugaggcau

SEQ ID NO: 695833 - RNA, 22 nt, Human
aggccuggugugccggaugcag

SEQ ID NO: 695834 - RNA, 18 nt, Human
acugaagaugcaagaccu

SEQ ID NO: 695835 - RNA, 16 nt, Human
ucuuccuuuugauuuu

SEQ ID NO: 695836 - RNA, 21 nt, Human
gugguuauuuucauuagcauc

SEQ ID NO: 695837 - RNA, 22 nt, Human
auaagagcuacagccaguucug

SEQ ID NO: 695838 - RNA, 22 nt, Human
gucaucuuaaggacugcuauag

SEQ ID NO: 695839 - RNA, 19 nt, Human
acaauguuguuggacacuc

SEQ ID NO: 695840 - RNA, 22 nt, Human
gggccaggucggugaaugguca

SEQ ID NO: 695841 - RNA, 22 nt, Human
ucaggaacacaggggcccaugc

SEQ ID NO: 695842 - RNA, 22 nt, Human
uguuaaauguuuugcuaguguc

SEQ ID NO: 695843 - RNA, 22 nt, Human
guagcagagcugagaguggaac

SEQ ID NO: 695844 - RNA, 22 nt, Human
gcuccugcccucuugcaauucc

SEQ ID NO: 695845 - RNA, 22 nt, Human
agcagggacuacgugaaaguga

SEQ ID NO: 695846 - RNA, 22 nt, Human
gcccaggaguugaaugcagcag

SEQ ID NO: 695847 - RNA, 22 nt, Human
aaagauuaaaucaaauugguca

SEQ ID NO: 695848 - RNA, 22 nt, Human
gcucuugauacaucaagaacuu

SEQ ID NO: 695849 - RNA, 22 nt, Human
guauucuugaguggcaacuagg

SEQ ID NO: 695850 - RNA, 22 nt, Human
ccaauguuuauuuuccugcugc

SEQ ID NO: 695851 - RNA, 22 nt, Human
uuucaagggaauaugaaauuca

SEQ ID NO: 695852 - RNA, 22 nt, Human
uaacaucuaagggagagaaagu

SEQ ID NO: 695853 - RNA, 23 nt, Human
auaacugagccgaggcuuaagaa

SEQ ID NO: 695854 - RNA, 22 nt, Human
uaacagaaauuuuaguuagggg

SEQ ID NO: 695855 - RNA, 22 nt, Human
cagcugaguggacccuagaggc

SEQ ID NO: 695856 - RNA, 22 nt, Human
uagagcuauuuaucagccagaa

SEQ ID NO: 695857 - RNA, 22 nt, Human
agcagcugauggggaaggaguu

SEQ ID NO: 695858 - RNA, 18 nt, Human
ucaggcugcccugugucu

SEQ ID NO: 695859 - RNA, 22 nt, Human
caccucuuugauuugaggcaag

SEQ ID NO: 695860 - RNA, 22 nt, Human
agaucucaccucuguguauuau

SEQ ID NO: 695861 - RNA, 22 nt, Human
gagcugcagacuugauacagga

SEQ ID NO: 695862 - RNA, 22 nt, Human
gcagggcugagucaugugugcc

SEQ ID NO: 695863 - RNA, 22 nt, Human
guuugaaaguggcaaguccuug

SEQ ID NO: 695864 - RNA, 22 nt, Human
gcucuggcuacuccacccuguu

SEQ ID NO: 695865 - RNA, 22 nt, Human
ucauugaagcccuugacaagcc

SEQ ID NO: 695866 - RNA, 22 nt, Human
agcacaguggcuucuaugucua

SEQ ID NO: 695867 - RNA, 22 nt, Human
acuuacaaucaaccaccuugga

SEQ ID NO: 695868 - RNA, 22 nt, Human
cugcagaaauauggaugugaua

SEQ ID NO: 695869 - RNA, 22 nt, Human
auguuucaaauauauagaguug

SEQ ID NO: 695870 - RNA, 22 nt, Human
cuuauacauaaaauggguguag

SEQ ID NO: 695871 - RNA, 23 nt, Human
uacaaugcaaacuuggcccaugg

SEQ ID NO: 695872 - RNA, 21 nt, Human
aauaaaacaguuggugucaau

SEQ ID NO: 695873 - RNA, 22 nt, Human
uagaaaucagcaggcauaugua

SEQ ID NO: 695874 - RNA, 22 nt, Human
guggccuggaguuugauguagg

SEQ ID NO: 695875 - RNA, 22 nt, Human
uuacaagaucuuugaaggcaag

SEQ ID NO: 695876 - RNA, 22 nt, Human
caggaaaaugucaauggaaagc

SEQ ID NO: 695877 - RNA, 19 nt, Human
gcagggcucucccagaugc

SEQ ID NO: 695878 - RNA, 22 nt, Human
gcugcagugagccaagaucgug

SEQ ID NO: 695879 - RNA, 17 nt, Human
auucuuugaugucucug

SEQ ID NO: 695880 - RNA, 22 nt, Human
uauucagaaaacugagcgauga

SEQ ID NO: 695881 - RNA, 21 nt, Human
uagagauguuugcuaaguagc

SEQ ID NO: 695882 - RNA, 22 nt, Human
uauugaugcuuggauugggcca

SEQ ID NO: 695883 - RNA, 22 nt, Human
uucacauuaagccuccuccuac

SEQ ID NO: 695884 - RNA, 22 nt, Human
augagcuguaagguggcuuccu

SEQ ID NO: 695885 - RNA, 22 nt, Human
cugagcauggccgguccauggu

SEQ ID NO: 695886 - RNA, 22 nt, Human
agauggaggaaggcugaacuca

SEQ ID NO: 695887 - RNA, 22 nt, Human
aucaucaugcacucucagguuu

SEQ ID NO: 695888 - RNA, 22 nt, Human
uggcugcugcucacucagccuc

SEQ ID NO: 695889 - RNA, 22 nt, Human
uccguugagucagcuucggacc

SEQ ID NO: 695890 - RNA, 22 nt, Human
ugaaggccacuuccugugagcu

SEQ ID NO: 695891 - RNA, 22 nt, Human
ugccucugugugcaggugagca

SEQ ID NO: 695892 - RNA, 18 nt, Human
agcaacaggaucccaggg

SEQ ID NO: 695893 - RNA, 22 nt, Human
aguuuacaucuucaaucucauu

SEQ ID NO: 695894 - RNA, 22 nt, Human
agaggucagcugcaugccacau

SEQ ID NO: 695895 - RNA, 22 nt, Human
aagcacuaauauuuuggcaccu

SEQ ID NO: 695896 - RNA, 22 nt, Human
aagcgccaugguuccugcgcag

SEQ ID NO: 695897 - RNA, 22 nt, Human
uccagcccagcuccucucagaa

SEQ ID NO: 695898 - RNA, 22 nt, Human
gaggccagcuacccaaggguca

SEQ ID NO: 695899 - RNA, 22 nt, Human
cagggcucaggaaaucagacgu

SEQ ID NO: 695900 - RNA, 22 nt, Human
uuggcuuuuaugcagcuuaggu

SEQ ID NO: 695901 - RNA, 22 nt, Human
aguguacauaguuaggaacauc

SEQ ID NO: 695902 - RNA, 22 nt, Human
ucucaugaaaggucucuccugg

SEQ ID NO: 695903 - RNA, 22 nt, Human
uucucuuuuugcaucucaaccu

SEQ ID NO: 695904 - RNA, 22 nt, Human
gggcccagcgugguuccaucug

SEQ ID NO: 695905 - RNA, 22 nt, Human
uccuggagaagaggggcuugga

SEQ ID NO: 695906 - RNA, 22 nt, Human
ucugaaauaggaaagcaaaugg

SEQ ID NO: 695907 - RNA, 22 nt, Human
cguuggagacacuugaggacuu

SEQ ID NO: 695908 - RNA, 19 nt, Human
augagguagcagcuggugc

SEQ ID NO: 695909 - RNA, 22 nt, Human
uagugcaggguuuuaagcacug

SEQ ID NO: 695910 - RNA, 22 nt, Human
uaucucuuucauuuuagaguca

SEQ ID NO: 695911 - RNA, 22 nt, Human
aauuggcuuugugguuucugca

SEQ ID NO: 695912 - RNA, 22 nt, Human
uccagagugcugacgcagaccc

SEQ ID NO: 695913 - RNA, 22 nt, Human
aauaugcagcuuaucuucuagg

SEQ ID NO: 695914 - RNA, 22 nt, Human
acuacagugugauaagaggggc

SEQ ID NO: 695915 - RNA, 18 nt, Human
ucagagagcagcuuuauu

SEQ ID NO: 695916 - RNA, 22 nt, Human
uguacaaucuuggucccuuuau

SEQ ID NO: 695917 - RNA, 22 nt, Human
ucaagcggacugagauacucug

SEQ ID NO: 695918 - RNA, 22 nt, Human
uaacaucuugcaguagcagaac

SEQ ID NO: 695919 - RNA, 22 nt, Human
uagaaguuaggaaauaggaaua

SEQ ID NO: 695920 - RNA, 22 nt, Human
ugucauugguacaaauugauug

SEQ ID NO: 695921 - RNA, 22 nt, Human
cuuugauuaucggugugaaugu

SEQ ID NO: 695922 - RNA, 22 nt, Human
ugggagaauauauuuaaaacuu

SEQ ID NO: 695923 - RNA, 22 nt, Human
auuccacugccgaaugauacau

SEQ ID NO: 695924 - RNA, 22 nt, Human
cuguggcuucugcuugggccuc

SEQ ID NO: 695925 - RNA, 22 nt, Human
gcccaaagccagugugcucucc

SEQ ID NO: 695926 - RNA, 22 nt, Human
caggguggcccuguggucucau

SEQ ID NO: 695927 - RNA, 22 nt, Human
gcuggguggaucggaggcucug

SEQ ID NO: 695928 - RNA, 19 nt, Human
cugagcagcggcagcacuu

SEQ ID NO: 695929 - RNA, 19 nt, Human
cucugccauuugcugccug

SEQ ID NO: 695930 - RNA, 20 nt, Human
ggucagccccaccuggcagc

SEQ ID NO: 695931 - RNA, 22 nt, Human
ggugauuuucgaguuucauguu

SEQ ID NO: 695932 - RNA, 22 nt, Human
agcguguggagaacuaagcaga

SEQ ID NO: 695933 - RNA, 21 nt, Human
ccuccaggagcagagcccuga

SEQ ID NO: 695934 - RNA, 22 nt, Human
ucugucugagggagugacauuu

SEQ ID NO: 695935 - RNA, 22 nt, Human
ccacugcuguuacuuacgcaaa

SEQ ID NO: 695936 - RNA, 22 nt, Human
auccauauaggcagauggcaca

SEQ ID NO: 695937 - RNA, 22 nt, Human
gccucaguggcuuuaggaguuc

SEQ ID NO: 695938 - RNA, 22 nt, Human
gcaggcaccucguggaguggaa

SEQ ID NO: 695939 - RNA, 22 nt, Human
uggcauggcauuuagagaauua

SEQ ID NO: 695940 - RNA, 22 nt, Human
uucccagagaaggaugaaaaag

SEQ ID NO: 695941 - RNA, 22 nt, Human
cagggaugcugcuuaggcaguu

SEQ ID NO: 695942 - RNA, 22 nt, Human
uuuuauguuccucuuuaugcga

SEQ ID NO: 695943 - RNA, 22 nt, Human
ccugccagcccgcguucaugcc

SEQ ID NO: 695944 - RNA, 19 nt, Human
agaagcaccagucauuccu

SEQ ID NO: 695945 - RNA, 22 nt, Human
guuauguaaucuaacacucagu

SEQ ID NO: 695946 - RNA, 22 nt, Human
acaaccaugucaguucaaacca

SEQ ID NO: 695947 - RNA, 22 nt, Human
acugauuucagggaugagaaga

SEQ ID NO: 695948 - RNA, 21 nt, Human
aguguccuugaucuugccuug

SEQ ID NO: 695949 - RNA, 22 nt, Human
ucagcaucucaaccuucucuac

SEQ ID NO: 695950 - RNA, 22 nt, Human
aauuauauugaaguugaauguc

SEQ ID NO: 695951 - RNA, 22 nt, Human
ugaaggaggaauguggccucca

SEQ ID NO: 695952 - RNA, 22 nt, Human
ucuagaaugacaugcaagagua

SEQ ID NO: 695953 - RNA, 17 nt, Human
agauggcaggaggcaga

SEQ ID NO: 695954 - RNA, 22 nt, Human
ccugaggaccagcacccaucug

SEQ ID NO: 695955 - RNA, 23 nt, Human
cuguaugauguuaaguggaaagc

SEQ ID NO: 695956 - RNA, 21 nt, Human
gaguccuggcuaggguggcag

SEQ ID NO: 695957 - RNA, 22 nt, Human
gcugccuucaguucugauucau

SEQ ID NO: 695958 - RNA, 22 nt, Human
auccccuucacacccucugcau

SEQ ID NO: 695959 - RNA, 17 nt, Human
caggcagacauguaagc

SEQ ID NO: 695960 - RNA, 22 nt, Human
uucauguuuguaggacugaggc

SEQ ID NO: 695961 - RNA, 22 nt, Human
uuacaguuacugguacuguuaa

SEQ ID NO: 695962 - RNA, 22 nt, Human
acagagagguaaaauauauagu

SEQ ID NO: 695963 - RNA, 22 nt, Human
ugcugccuaggaaucuguauuu

SEQ ID NO: 695964 - RNA, 22 nt, Human
aguacauuuauuaaugguaaaa

SEQ ID NO: 695965 - RNA, 22 nt, Human
augcuuuacaguuuuccaaaca

SEQ ID NO: 695966 - RNA, 22 nt, Human
agagguguggccaggacucaag

SEQ ID NO: 695967 - RNA, 22 nt, Human
aggccagcuguuacuagagcca

SEQ ID NO: 695968 - RNA, 22 nt, Human
augcucagggcacacucuggac

SEQ ID NO: 695969 - RNA, 22 nt, Human
auucuccacuguaagguuauua

SEQ ID NO: 695970 - RNA, 22 nt, Human
uacacugaagugucuugguaua

SEQ ID NO: 695971 - RNA, 22 nt, Human
gauuucugggcuuuauuucaga

SEQ ID NO: 695972 - RNA, 23 nt, Human
ugggcggggcuuuucacucugcc

SEQ ID NO: 695973 - RNA, 22 nt, Human
aucaaagagcuugacaauccua

SEQ ID NO: 695974 - RNA, 22 nt, Human
aaggcaguucacucacgcagcc

SEQ ID NO: 695975 - RNA, 22 nt, Human
agaaaagguugaaaguaggauu

SEQ ID NO: 695976 - RNA, 22 nt, Human
gcauugaagaucuuagacuagg

SEQ ID NO: 695977 - RNA, 22 nt, Human
cacaaggaccucagauggauga

SEQ ID NO: 695978 - RNA, 17 nt, Human
gaauccuucucuguucu

SEQ ID NO: 695979 - RNA, 22 nt, Human
cacugcacaggugagauguggg

SEQ ID NO: 695980 - RNA, 22 nt, Human
ccugcagguaaggcuaacugcc

SEQ ID NO: 695981 - RNA, 17 nt, Human
uugggagagaaagguau

SEQ ID NO: 695982 - RNA, 22 nt, Human
uuacaguuuaagaggaaacaaa

SEQ ID NO: 695983 - RNA, 22 nt, Human
uucucuggagaguaucuucuua

SEQ ID NO: 695984 - RNA, 22 nt, Human
cccagagaagugaagugacuug

SEQ ID NO: 695985 - RNA, 22 nt, Human
uugcagggauaaaacaagugaa

SEQ ID NO: 695986 - RNA, 22 nt, Human
agggaauguagcaagaugccaa

SEQ ID NO: 695987 - RNA, 22 nt, Human
aaacaacucggcaacugcuuuu

SEQ ID NO: 695988 - RNA, 22 nt, Human
gagcucuguccacacuuggaga

SEQ ID NO: 695989 - RNA, 22 nt, Human
ucaggauguccaaaauccagcc

SEQ ID NO: 695990 - RNA, 22 nt, Human
cgcugggggaacagcgagggug

SEQ ID NO: 695991 - RNA, 22 nt, Human
uguuaaggagacacaugaaaaa

SEQ ID NO: 695992 - RNA, 21 nt, Human
uggcugagccaggugugugga

SEQ ID NO: 695993 - RNA, 22 nt, Human
ucugagguucccucaacuaccu

SEQ ID NO: 695994 - RNA, 22 nt, Human
cuccagcugccaccagauguuu

SEQ ID NO: 695995 - RNA, 20 nt, Human
gagugcuuuggcuugcucuc

SEQ ID NO: 695996 - RNA, 22 nt, Human
aggggugugcauccuggaggau

SEQ ID NO: 695997 - RNA, 22 nt, Human
auaggaugauaaaauuagaaac

SEQ ID NO: 695998 - RNA, 22 nt, Human
uuuaagaucauuuguauuaucc

SEQ ID NO: 695999 - RNA, 22 nt, Human
gcuuccagcaaacacuggcugc

SEQ ID NO: 696000 - RNA, 22 nt, Human
cugggcuagaaggaccaggaug

SEQ ID NO: 696001 - RNA, 22 nt, Human
ugaugcuguguaccucauggga

SEQ ID NO: 696002 - RNA, 22 nt, Human
aauuugcaugaugagaacaaua

SEQ ID NO: 696003 - RNA, 22 nt, Human
gggcacugagggcccacaggau

SEQ ID NO: 696004 - RNA, 22 nt, Human
gggggagagacgagcggcucug

SEQ ID NO: 696005 - RNA, 22 nt, Human
acugggaaggagcaggaucugu

SEQ ID NO: 696006 - RNA, 22 nt, Human
acgugcaggaucugguuggcga

SEQ ID NO: 696007 - RNA, 22 nt, Human
guggauggcccugcacacaggu

SEQ ID NO: 696008 - RNA, 22 nt, Human
ugucuuccucuuggcuugagcu

SEQ ID NO: 696009 - RNA, 22 nt, Human
acaaaauuaccuaguuauuuuc

SEQ ID NO: 696010 - RNA, 22 nt, Human
caggcccauucuaggcuugcua

SEQ ID NO: 696011 - RNA, 22 nt, Human
uggaagaggccagaaaguggga

SEQ ID NO: 696012 - RNA, 22 nt, Human
ucucuuaauccggugcuuucug

SEQ ID NO: 696013 - RNA, 18 nt, Human
uagcacagagcaggaugu

SEQ ID NO: 696014 - RNA, 22 nt, Human
acaugugugacaacagagguga

SEQ ID NO: 696015 - RNA, 22 nt, Human
agguggguaucaugagagauua

SEQ ID NO: 696016 - RNA, 22 nt, Human
acacaguucaggaucaaauagc

SEQ ID NO: 696017 - RNA, 22 nt, Human
ggccuggaagaggacagagaaa

SEQ ID NO: 696018 - RNA, 22 nt, Human
agguuucuuuaugcugcuagaa

SEQ ID NO: 696019 - RNA, 21 nt, Human
uccaggagcacgggacuagga

SEQ ID NO: 696020 - RNA, 19 nt, Human
auucuucagcagugagacc

SEQ ID NO: 696021 - RNA, 19 nt, Human
ugcaagugucuuggacaag

SEQ ID NO: 696022 - RNA, 22 nt, Human
aaacucugaugcuuauugggaa

SEQ ID NO: 696023 - RNA, 22 nt, Human
gguguuaaacaugauccauuac

SEQ ID NO: 696024 - RNA, 23 nt, Human
uaaugagaagcuuuguuuccuga

SEQ ID NO: 696025 - RNA, 22 nt, Human
ggcagagaugugggucagaauc

SEQ ID NO: 696026 - RNA, 22 nt, Human
ugaacacacacaucuuaauaau

SEQ ID NO: 696027 - RNA, 22 nt, Human
uacuuaaaacugauagaaucuc

SEQ ID NO: 696028 - RNA, 17 nt, Human
aauacuuccaacuagug

SEQ ID NO: 696029 - RNA, 22 nt, Human
uacaaauggguuaaaauauagu

SEQ ID NO: 696030 - RNA, 22 nt, Human
uggcucaaguaacaaaaauaua

SEQ ID NO: 696031 - RNA, 22 nt, Human
cauauggacaagaacauuuaug

SEQ ID NO: 696032 - RNA, 19 nt, Human
uagcccagagccuggcuac

SEQ ID NO: 696033 - RNA, 22 nt, Human
acucugagcaucccaagucuua

SEQ ID NO: 696034 - RNA, 22 nt, Human
gcugugggacagguccagccag

SEQ ID NO: 696035 - RNA, 22 nt, Human
uaguacagaauuaauaauugug

SEQ ID NO: 696036 - RNA, 22 nt, Human
cagcagcugauggggaagugau

SEQ ID NO: 696037 - RNA, 22 nt, Human
uaagacaagccucgcauuugua

SEQ ID NO: 696038 - RNA, 22 nt, Human
cucccaggcacagggaggagcc

SEQ ID NO: 696039 - RNA, 22 nt, Human
uaaaggcaguucugauuagguc

SEQ ID NO: 696040 - RNA, 22 nt, Human
uaaacagagagugcaguuauag

SEQ ID NO: 696041 - RNA, 22 nt, Human
acaggcccagcucuucaccaga

SEQ ID NO: 696042 - RNA, 22 nt, Human
aaagcacagggugcuagagagu

SEQ ID NO: 696043 - RNA, 22 nt, Human
uccagugcauucagacacuugg

SEQ ID NO: 696044 - RNA, 22 nt, Human
ugugcaguucaaacccguguug

SEQ ID NO: 696045 - RNA, 18 nt, Human
uggcucugcagccagaug

SEQ ID NO: 696046 - RNA, 22 nt, Human
caggaagaaggguggugagucc

SEQ ID NO: 696047 - RNA, 22 nt, Human
agaggccagaucaucauagaug

SEQ ID NO: 696048 - RNA, 22 nt, Human
acucucucacacacgccuauau

SEQ ID NO: 696049 - RNA, 22 nt, Human
aauuuuguuuaagugaucugcu

SEQ ID NO: 696050 - RNA, 22 nt, Human
auuucuguggcuucauucuccu

SEQ ID NO: 696051 - RNA, 22 nt, Human
aggggucuauccugagaugguc

SEQ ID NO: 696052 - RNA, 17 nt, Human
cucuuuugucuucuucc

SEQ ID NO: 696053 - RNA, 22 nt, Human
gcccaccuaaccugcucaccuu

SEQ ID NO: 696054 - RNA, 22 nt, Human
ucaccagucuuucuuaccauug

SEQ ID NO: 696055 - RNA, 17 nt, Human
ugcacaagagacaauag

SEQ ID NO: 696056 - RNA, 22 nt, Human
aaagucaucagaaccuuccaga

SEQ ID NO: 696057 - RNA, 22 nt, Human
acagcagagacacucaggaggc

SEQ ID NO: 696058 - RNA, 22 nt, Human
auugcauucauugacauaugag

SEQ ID NO: 696059 - RNA, 23 nt, Human
aaccuagacuacuuacuaugugg

SEQ ID NO: 696060 - RNA, 18 nt, Human
acagggagggcgcugggg

SEQ ID NO: 696061 - RNA, 22 nt, Human
uaauucaugggcccagugauau

SEQ ID NO: 696062 - RNA, 22 nt, Human
uuucacagcuggguggcagagu

SEQ ID NO: 696063 - RNA, 22 nt, Human
auggcuucuagcauugucacaa

SEQ ID NO: 696064 - RNA, 22 nt, Human
augugcuuuccaaugcuguagg

SEQ ID NO: 696065 - RNA, 22 nt, Human
uguuuaauuuuucaugagccaa

SEQ ID NO: 696066 - RNA, 22 nt, Human
caugaacaaauucuguuugagg

SEQ ID NO: 696067 - RNA, 21 nt, Human
uuagcaaagcaaacacaugcu

SEQ ID NO: 696068 - RNA, 22 nt, Human
agucuucuuucauuuacucagu

SEQ ID NO: 696069 - RNA, 22 nt, Human
guaucuuuuacaccaggaaauu

SEQ ID NO: 696070 - RNA, 22 nt, Human
aauucuuggaaacauuacugga

SEQ ID NO: 696071 - RNA, 22 nt, Human
cucugagcagaggccguggcua

SEQ ID NO: 696072 - RNA, 21 nt, Human
agcagaggcugccuggugacu

SEQ ID NO: 696073 - RNA, 22 nt, Human
accaaggaagagauucucaguu

SEQ ID NO: 696074 - RNA, 22 nt, Human
ucaggagacuuaugucacagug

SEQ ID NO: 696075 - RNA, 22 nt, Human
gcucucagaugcuccagcagcc

SEQ ID NO: 696076 - RNA, 22 nt, Human
ugguggcaucagugaaguacac

SEQ ID NO: 696077 - RNA, 22 nt, Human
ucugggccucaguuucuucauc

SEQ ID NO: 696078 - RNA, 22 nt, Human
agcauuuauuucuuagaaauug

SEQ ID NO: 696079 - RNA, 23 nt, Human
auuugcauggccggauuauggau

SEQ ID NO: 696080 - RNA, 22 nt, Human
gccagcuguaagcuggggugau

SEQ ID NO: 696081 - RNA, 23 nt, Human
ugcagagugucacuugaaaacca

SEQ ID NO: 696082 - RNA, 22 nt, Human
caaugaaauugagauccagaga

SEQ ID NO: 696083 - RNA, 22 nt, Human
ucuuuagagcucagaaauacag

SEQ ID NO: 696084 - RNA, 22 nt, Human
aaacuuuuuuagguucauaggc

SEQ ID NO: 696085 - RNA, 22 nt, Human
aaagauuucagaagccugugcc

SEQ ID NO: 696086 - RNA, 18 nt, Human
gcagggcugcacacgcau

SEQ ID NO: 696087 - RNA, 22 nt, Human
ccaggcccaggguacugaccaa

SEQ ID NO: 696088 - RNA, 22 nt, Human
agcuugguguugccugcuugag

SEQ ID NO: 696089 - RNA, 22 nt, Human
uaucaguggucacaagauacau

SEQ ID NO: 696090 - RNA, 22 nt, Human
ugaccugcagucaagaggggaa

SEQ ID NO: 696091 - RNA, 22 nt, Human
ggccagguuggguggaaguggc

SEQ ID NO: 696092 - RNA, 16 nt, Human
gcaggaguaccacuug

SEQ ID NO: 696093 - RNA, 22 nt, Human
gccugccuuuguaugacccuga

SEQ ID NO: 696094 - RNA, 21 nt, Human
gugugcugauacauuggagaa

SEQ ID NO: 696095 - RNA, 22 nt, Human
aaauucagcauccugcacugga

SEQ ID NO: 696096 - RNA, 22 nt, Human
uggaccugcguaggugcugggc

SEQ ID NO: 696097 - RNA, 22 nt, Human
acaggcaauuagcaagcuguua

SEQ ID NO: 696098 - RNA, 18 nt, Human
gacaccagccucugcccc

SEQ ID NO: 696099 - RNA, 22 nt, Human
cuggggcauugggagaggccug

SEQ ID NO: 696100 - RNA, 22 nt, Human
gccuuggccuuccuaggccuga

SEQ ID NO: 696101 - RNA, 22 nt, Human
agaagccaauccuugucucucu

SEQ ID NO: 696102 - RNA, 22 nt, Human
ggcuagaauaauugacuucauu

SEQ ID NO: 696103 - RNA, 22 nt, Human
uggggcuccuccuggcaggagg

SEQ ID NO: 696104 - RNA, 20 nt, Human
ugacaguuucauaugguuca

SEQ ID NO: 696105 - RNA, 22 nt, Human
ugcugccuccuuccugccagga

SEQ ID NO: 696106 - RNA, 22 nt, Human
ggugguggucccgacuugggag

SEQ ID NO: 696107 - RNA, 22 nt, Human
acaauguuucucuuuagucauu

SEQ ID NO: 696108 - RNA, 22 nt, Human
gauggguauuggcagaagaggg

SEQ ID NO: 696109 - RNA, 17 nt, Human
uuccucucacauuuuuu

SEQ ID NO: 696110 - RNA, 22 nt, Human
agucucugagguucagaugccu

SEQ ID NO: 696111 - RNA, 22 nt, Human
cccugcaguccuuucuuggcuc

SEQ ID NO: 696112 - RNA, 22 nt, Human
ccagcagagcucaaacuuccug

SEQ ID NO: 696113 - RNA, 22 nt, Human
uucacuguacugacugucuuau

SEQ ID NO: 696114 - RNA, 22 nt, Human
ucagcacuggcgcugggcaggu

SEQ ID NO: 696115 - RNA, 22 nt, Human
gagugcaguaugagaggcugcu

SEQ ID NO: 696116 - RNA, 22 nt, Human
agcaggugagcacagccaggcu

SEQ ID NO: 696117 - RNA, 22 nt, Human
auucauuccaggucagucagac

SEQ ID NO: 696118 - RNA, 22 nt, Human
ggagcuguucaggacugcuuca

SEQ ID NO: 696119 - RNA, 22 nt, Human
uuugagaaaaccagaaagaucu

SEQ ID NO: 696120 - RNA, 22 nt, Human
agagccaaggcugagagcuauu

SEQ ID NO: 696121 - RNA, 22 nt, Human
aaggccaccaccagcgaggggg

SEQ ID NO: 696122 - RNA, 22 nt, Human
aaaauugagagucuugugcaag

SEQ ID NO: 696123 - RNA, 22 nt, Human
acacuucauagcaagguuggag

SEQ ID NO: 696124 - RNA, 22 nt, Human
agugucugccuauuuuucaagc

SEQ ID NO: 696125 - RNA, 22 nt, Human
aauggaaccuaguuauccacau

SEQ ID NO: 696126 - RNA, 22 nt, Human
ugagcagagacgggggccucca

SEQ ID NO: 696127 - RNA, 22 nt, Human
ccaggaaggccuggaugccccc

SEQ ID NO: 696128 - RNA, 22 nt, Human
ucaggcugccuaucagacugug

SEQ ID NO: 696129 - RNA, 22 nt, Human
ggccagcuuugagcugcaggaa

SEQ ID NO: 696130 - RNA, 22 nt, Human
ggcugagcucaggggcagcagg

SEQ ID NO: 696131 - RNA, 22 nt, Human
cccaggaugaucgagaguggga

SEQ ID NO: 696132 - RNA, 22 nt, Human
aggguagggcccggagacagac

SEQ ID NO: 696133 - RNA, 22 nt, Human
ucugaagauaugagcuuuauga

SEQ ID NO: 696134 - RNA, 22 nt, Human
guugcagacacuccacagucga

SEQ ID NO: 696135 - RNA, 22 nt, Human
aggguugcauuuuuagaggcuc

SEQ ID NO: 696136 - RNA, 22 nt, Human
uuauuuaaugugaucugaagag

SEQ ID NO: 696137 - RNA, 22 nt, Human
cuguacaucucugaggacagua

SEQ ID NO: 696138 - RNA, 18 nt, Human
cuucagugacagucuggc

SEQ ID NO: 696139 - RNA, 22 nt, Human
ggagggggacugacacugauuu

SEQ ID NO: 696140 - RNA, 22 nt, Human
uaggaaaagcacaggauguucu

SEQ ID NO: 696141 - RNA, 22 nt, Human
ugcagaacagggccaugucacc

SEQ ID NO: 696142 - RNA, 22 nt, Human
aucuaaagugucauaaguagcu

SEQ ID NO: 696143 - RNA, 22 nt, Human
auggcugggcuuuuagucagau

SEQ ID NO: 696144 - RNA, 22 nt, Human
cauguacacucauguaacuaua

SEQ ID NO: 696145 - RNA, 22 nt, Human
agagccugucugccuuucuacc

SEQ ID NO: 696146 - RNA, 22 nt, Human
uuggccaagauacgagcacaua

SEQ ID NO: 696147 - RNA, 22 nt, Human
gcuuccucaccuucucuugcau

SEQ ID NO: 696148 - RNA, 22 nt, Human
ugucaguuuccugugcccugcu

SEQ ID NO: 696149 - RNA, 22 nt, Human
ucuaagccuguguccucugcag

SEQ ID NO: 696150 - RNA, 22 nt, Human
caggugggccgggguuuguucu

SEQ ID NO: 696151 - RNA, 22 nt, Human
gaauuggggguuuugcaaggca

SEQ ID NO: 696152 - RNA, 22 nt, Human
guggccuccuccguccgccucu

SEQ ID NO: 696153 - RNA, 22 nt, Human
agucagcaucugcacugugcug

SEQ ID NO: 696154 - RNA, 20 nt, Human
ggagaugcagcccaggugcc

SEQ ID NO: 696155 - RNA, 22 nt, Human
gcugggaagugcaagaucaagg

SEQ ID NO: 696156 - RNA, 22 nt, Human
gccccagcccuguggaccaugg

SEQ ID NO: 696157 - RNA, 22 nt, Human
uaacauucuuaacuuagaaaca

SEQ ID NO: 696158 - RNA, 22 nt, Human
cugugucuucuguuuugaaguu

SEQ ID NO: 696159 - RNA, 20 nt, Human
ucugcucagcccucaguggc

SEQ ID NO: 696160 - RNA, 22 nt, Human
ucaggaguaaguuauaaguauu

SEQ ID NO: 696161 - RNA, 17 nt, Human
cccuggcucuaggugga

SEQ ID NO: 696162 - RNA, 22 nt, Human
uggaagagaaaauccacccuua

SEQ ID NO: 696163 - RNA, 22 nt, Human
caugcauauaugcuacaugcaa

SEQ ID NO: 696164 - RNA, 22 nt, Human
uguggguuuguaguuaaguucu

SEQ ID NO: 696165 - RNA, 22 nt, Human
gcucagugugcacgaguacucu

SEQ ID NO: 696166 - RNA, 22 nt, Human
gacaucuggaggagaugaaugg

SEQ ID NO: 696167 - RNA, 22 nt, Human
uuguggaaauacagacuccaag

SEQ ID NO: 696168 - RNA, 22 nt, Human
ucuguugacuccuagcagccau

SEQ ID NO: 696169 - RNA, 22 nt, Human
cagaauuuagcacaauguaugg

SEQ ID NO: 696170 - RNA, 22 nt, Human
ggagcaggcagggccgugucug

SEQ ID NO: 696171 - RNA, 18 nt, Human
cccagaggaaugccugga

SEQ ID NO: 696172 - RNA, 18 nt, Human
auggaggcagagagcuga

SEQ ID NO: 696173 - RNA, 22 nt, Human
ugaguugcuaucuagauccaga

SEQ ID NO: 696174 - RNA, 22 nt, Human
augaagcugguuuuggcuuggg

SEQ ID NO: 696175 - RNA, 22 nt, Human
ugucuuuagaccucucuggccu

SEQ ID NO: 696176 - RNA, 22 nt, Human
cugaggcucugggugucacugu

SEQ ID NO: 696177 - RNA, 22 nt, Human
agucaggauaugccuugugggc

SEQ ID NO: 696178 - RNA, 22 nt, Human
aaugauggucauggcaacuuuu

SEQ ID NO: 696179 - RNA, 22 nt, Human
gaacuuguuguaagaaaauaug

SEQ ID NO: 696180 - RNA, 22 nt, Human
uuagggaaggcugcugucagcu

SEQ ID NO: 696181 - RNA, 15 nt, Human
gcuucuccagaugac

SEQ ID NO: 696182 - RNA, 22 nt, Human
ggccagcagaccucagggacuc

SEQ ID NO: 696183 - RNA, 18 nt, Human
ggacaucaucaggugcuu

SEQ ID NO: 696184 - RNA, 19 nt, Human
agacucugccacucuucuc

SEQ ID NO: 696185 - RNA, 22 nt, Human
ggagucagaauggcaggguggu

SEQ ID NO: 696186 - RNA, 20 nt, Human
ucaauuuucuacaacauuug

SEQ ID NO: 696187 - RNA, 22 nt, Human
cucaggucacggaucugagcug

SEQ ID NO: 696188 - RNA, 22 nt, Human
cagggccagggcuauggugaag

SEQ ID NO: 696189 - RNA, 22 nt, Human
ugucugugauuuaggccagggc

SEQ ID NO: 696190 - RNA, 22 nt, Human
ugucugugcccaaggcucccgg

SEQ ID NO: 696191 - RNA, 22 nt, Human
ugccuuuuauggcuagccucag

SEQ ID NO: 696192 - RNA, 22 nt, Human
acugcagccuuugggcucauaa

SEQ ID NO: 696193 - RNA, 22 nt, Human
ucucagaaggguggugcuggag

SEQ ID NO: 696194 - RNA, 22 nt, Human
aaacuugaggcaaugaaggugu

SEQ ID NO: 696195 - RNA, 20 nt, Human
ucuuaaauccccagggccau

SEQ ID NO: 696196 - RNA, 22 nt, Human
cugggaccaucugugucuacuu

SEQ ID NO: 696197 - RNA, 22 nt, Human
gaugcucaucuguccuuugaug

SEQ ID NO: 696198 - RNA, 22 nt, Human
ccugccugcuuucugcuuugca

SEQ ID NO: 696199 - RNA, 22 nt, Human
ucccagcuacucuagaggcuga

SEQ ID NO: 696200 - RNA, 22 nt, Human
ucucugaauucugaugcaagug

SEQ ID NO: 696201 - RNA, 22 nt, Human
cauggcagaaaccugagcugcu

SEQ ID NO: 696202 - RNA, 22 nt, Human
gacaaccgagcagcugugggaa

SEQ ID NO: 696203 - RNA, 22 nt, Human
uggcaagcuggguuggguagcc

SEQ ID NO: 696204 - RNA, 22 nt, Human
ccccuuccuuccucagacagcc

SEQ ID NO: 696205 - RNA, 22 nt, Human
uuauuugacuucuugcuaugcu

SEQ ID NO: 696206 - RNA, 22 nt, Human
gcuucuaauuuuuuacagaaua

SEQ ID NO: 696207 - RNA, 22 nt, Human
ugcucauuggcgaucugaggga

SEQ ID NO: 696208 - RNA, 21 nt, Human
gaagagaguccucauccugag

SEQ ID NO: 696209 - RNA, 22 nt, Human
uagcaacugccuuuacuauauu

SEQ ID NO: 696210 - RNA, 22 nt, Human
gcaguacuuuaucacauggaau

SEQ ID NO: 696211 - RNA, 22 nt, Human
agcccuucaaccugccuacucc

SEQ ID NO: 696212 - RNA, 21 nt, Human
gcuugguuuugguuacuugcc

SEQ ID NO: 696213 - RNA, 22 nt, Human
cccucagggaccacugacuuca

SEQ ID NO: 696214 - RNA, 22 nt, Human
acccuguaugcuauaucccuaa

SEQ ID NO: 696215 - RNA, 22 nt, Human
ucaaaauucuagggagaauggu

SEQ ID NO: 696216 - RNA, 22 nt, Human
cugugucucguuaaagcauugg

SEQ ID NO: 696217 - RNA, 18 nt, Human
auuuaaugaacugaaagc

SEQ ID NO: 696218 - RNA, 22 nt, Human
ucccucugggcuggagcagggu

SEQ ID NO: 696219 - RNA, 22 nt, Human
ccuuucugguauuuaaccaaag

SEQ ID NO: 696220 - RNA, 22 nt, Human
guggcagucuuuggcaaugaca

SEQ ID NO: 696221 - RNA, 22 nt, Human
gguccccguggaggcuggagcg

SEQ ID NO: 696222 - RNA, 22 nt, Human
uacacauguauuuauguguaca

SEQ ID NO: 696223 - RNA, 18 nt, Human
aguguuuauuuaggugaa

SEQ ID NO: 696224 - RNA, 22 nt, Human
gacagccucaugugcaugaacu

SEQ ID NO: 696225 - RNA, 22 nt, Human
uagaggagaguugcuggaugga

SEQ ID NO: 696226 - RNA, 22 nt, Human
gaugucuuugaggcucacugcu

SEQ ID NO: 696227 - RNA, 22 nt, Human
uaaggccaauuaacaaccaggg

SEQ ID NO: 696228 - RNA, 22 nt, Human
ccaguguucccucggguucaug

SEQ ID NO: 696229 - RNA, 21 nt, Human
uguucuaucagcucagguguc

SEQ ID NO: 696230 - RNA, 22 nt, Human
uuggccaacagcgacagggcca

SEQ ID NO: 696231 - RNA, 22 nt, Human
gcucccacgcaauucuuuucag

SEQ ID NO: 696232 - RNA, 22 nt, Human
accauguuggccaagcuggucu

SEQ ID NO: 696233 - RNA, 22 nt, Human
cuccugggaugacucuuucuuu

SEQ ID NO: 696234 - RNA, 22 nt, Human
cuuaauuggcuuauuuccucaa

SEQ ID NO: 696235 - RNA, 22 nt, Human
gaaagcauaacuaauauuuauu

SEQ ID NO: 696236 - RNA, 22 nt, Human
acuuuacagaugguuuccugac

SEQ ID NO: 696237 - RNA, 22 nt, Human
acagaauucuaguauguggcuu

SEQ ID NO: 696238 - RNA, 22 nt, Human
aucaaauauaauaauuuucgcu

SEQ ID NO: 696239 - RNA, 22 nt, Human
guggcaggggcgggcuguuccg

SEQ ID NO: 696240 - RNA, 22 nt, Human
uuauuugugaaucauuuaucua

SEQ ID NO: 696241 - RNA, 20 nt, Human
aauaaaagaagccuucaccc

SEQ ID NO: 696242 - RNA, 22 nt, Human
augaaaauugacagcggaagua

SEQ ID NO: 696243 - RNA, 22 nt, Human
uuaaagaugcagcuuuagagaa

SEQ ID NO: 696244 - RNA, 22 nt, Human
uggcugagaaaaugguuuuagg

SEQ ID NO: 696245 - RNA, 22 nt, Human
acacagggcagagagcuggcuc

SEQ ID NO: 696246 - RNA, 22 nt, Human
uacuucaugaguuaauaugcag

SEQ ID NO: 696247 - RNA, 22 nt, Human
cugacaaacuuaauuuucugaa

SEQ ID NO: 696248 - RNA, 22 nt, Human
uuggcagauuugucaguaagcu

SEQ ID NO: 696249 - RNA, 22 nt, Human
ucacccagaaaagacagcagau

SEQ ID NO: 696250 - RNA, 22 nt, Human
agucccagcccaguccuguaag

SEQ ID NO: 696251 - RNA, 21 nt, Human
auuuucauuaauucagugugg

SEQ ID NO: 696252 - RNA, 22 nt, Human
cugggagcuuggagccuuuggu

SEQ ID NO: 696253 - RNA, 22 nt, Human
cuucuggguugcaggucuuggc

SEQ ID NO: 696254 - RNA, 22 nt, Human
gaaguauuacucugaauguauu

SEQ ID NO: 696255 - RNA, 22 nt, Human
agagcugucacauagagccaga

SEQ ID NO: 696256 - RNA, 22 nt, Human
ucacaugaagaucccucaauuu

SEQ ID NO: 696257 - RNA, 22 nt, Human
ggagaagaggagcuggaagccu

SEQ ID NO: 696258 - RNA, 22 nt, Human
gcagggcaguaagagcuagagu

SEQ ID NO: 696259 - RNA, 22 nt, Human
acaggcaaacacagaaaguagg

SEQ ID NO: 696260 - RNA, 22 nt, Human
auacagaacucucaguuguaua

SEQ ID NO: 696261 - RNA, 22 nt, Human
ggcagugaaaaaguauguuucc

SEQ ID NO: 696262 - RNA, 22 nt, Human
gaucauuagcuuuucaaaggag

SEQ ID NO: 696263 - RNA, 22 nt, Human
gacuuggguggauugugacucu

SEQ ID NO: 696264 - RNA, 22 nt, Human
cauuaucugccauugacaccau

SEQ ID NO: 696265 - RNA, 22 nt, Human
gcaggcugggguagccccacuu

SEQ ID NO: 696266 - RNA, 20 nt, Human
cugaggggucugacuuggac

SEQ ID NO: 696267 - RNA, 22 nt, Human
augaugaaacuaggaacuagag

SEQ ID NO: 696268 - RNA, 22 nt, Human
agugacuggugugaaguuaaau

SEQ ID NO: 696269 - RNA, 22 nt, Human
uuccaauuguucuuuggaaucu

SEQ ID NO: 696270 - RNA, 18 nt, Human
ucuccuggguaggggccu

SEQ ID NO: 696271 - RNA, 22 nt, Human
ucauauuaacaaugaaacucag

SEQ ID NO: 696272 - RNA, 22 nt, Human
uuaaacauuuauggaggcagca

SEQ ID NO: 696273 - RNA, 22 nt, Human
ggugggggagacuuggucaaga

SEQ ID NO: 696274 - RNA, 22 nt, Human
agaugcugcuccacaggccagg

SEQ ID NO: 696275 - RNA, 21 nt, Human
agcugccuccacuucugaggc

SEQ ID NO: 696276 - RNA, 22 nt, Human
cugagauggaguuuugcucuug

SEQ ID NO: 696277 - RNA, 22 nt, Human
uuagauaauguagagauaugag

SEQ ID NO: 696278 - RNA, 22 nt, Human
aaaggccacugcaagggaaggu

SEQ ID NO: 696279 - RNA, 22 nt, Human
ugaaaguugcacauaagagaau

SEQ ID NO: 696280 - RNA, 22 nt, Human
ucagugauuucuggggugaggg

SEQ ID NO: 696281 - RNA, 22 nt, Human
ucucuucuugauuuucacugga

SEQ ID NO: 696282 - RNA, 22 nt, Human
aggccucaguuugucaucugua

SEQ ID NO: 696283 - RNA, 22 nt, Human
guuagguagaaguuuacuuuga

SEQ ID NO: 696284 - RNA, 22 nt, Human
cagccugcagggcugccuguug

SEQ ID NO: 696285 - RNA, 22 nt, Human
caggccacaaguuggguucaag

SEQ ID NO: 696286 - RNA, 22 nt, Human
cucugagggucuaaggagucac

SEQ ID NO: 696287 - RNA, 22 nt, Human
uaaaccuugguagcaucuugcu

SEQ ID NO: 696288 - RNA, 22 nt, Human
uaacuggcuuaaauuuuaucaa

SEQ ID NO: 696289 - RNA, 22 nt, Human
ccugucucccuggcauggcuca

SEQ ID NO: 696290 - RNA, 22 nt, Human
aaguuauugcagcaauccaagu

SEQ ID NO: 696291 - RNA, 22 nt, Human
caacugccauacagcuccaugg

SEQ ID NO: 696292 - RNA, 22 nt, Human
augucuuucaaauucugccuag

SEQ ID NO: 696293 - RNA, 22 nt, Human
aaucuuaagcugaauucucucc

SEQ ID NO: 696294 - RNA, 22 nt, Human
augaaggauagggcaaaauuuu

SEQ ID NO: 696295 - RNA, 22 nt, Human
ccuuuggggcuuuacuguggaa

SEQ ID NO: 696296 - RNA, 22 nt, Human
aaggcaguggcuggaaaaccug

SEQ ID NO: 696297 - RNA, 22 nt, Human
aaggaugaacauuaauacauca

SEQ ID NO: 696298 - RNA, 22 nt, Human
uggcagauucugguugauacuu

SEQ ID NO: 696299 - RNA, 22 nt, Human
caggaccaggcguucugggcug

SEQ ID NO: 696300 - RNA, 22 nt, Human
ggauggccuucuugcucaggaa

SEQ ID NO: 696301 - RNA, 22 nt, Human
ugaaugcuuggagucauaaaau

SEQ ID NO: 696302 - RNA, 22 nt, Human
gccagagcugagacacgagucc

SEQ ID NO: 696303 - RNA, 22 nt, Human
uccagccuaauguucuucccac

SEQ ID NO: 696304 - RNA, 22 nt, Human
uguccugggaaugggaugcagu

SEQ ID NO: 696305 - RNA, 19 nt, Human
cccaggcuacauggagagg

SEQ ID NO: 696306 - RNA, 22 nt, Human
ccagggcugccgcaucccuggu

SEQ ID NO: 696307 - RNA, 22 nt, Human
uucugggcccaacccuagagug

SEQ ID NO: 696308 - RNA, 22 nt, Human
cacagcugccaugcagucagug

SEQ ID NO: 696309 - RNA, 22 nt, Human
auccuguuugucacuagaaaau

SEQ ID NO: 696310 - RNA, 22 nt, Human
ggcagguguggaguguuauuuu

SEQ ID NO: 696311 - RNA, 22 nt, Human
gggauccauccgugcagcagag

SEQ ID NO: 696312 - RNA, 22 nt, Human
caaauacugagcacgcaaucaa

SEQ ID NO: 696313 - RNA, 22 nt, Human
uaugaaacauucauacaaauaa

SEQ ID NO: 696314 - RNA, 22 nt, Human
aggcaagaaacuuucugggaga

SEQ ID NO: 696315 - RNA, 19 nt, Human
uggagcagggcccuuguuu

SEQ ID NO: 696316 - RNA, 22 nt, Human
ccugggcugcaugauggcauuu

SEQ ID NO: 696317 - RNA, 22 nt, Human
gccagguccccucauggcuccu

SEQ ID NO: 696318 - RNA, 22 nt, Human
acaugaggaaacaaggguauau

SEQ ID NO: 696319 - RNA, 18 nt, Human
aguaaauguuaaauauug

SEQ ID NO: 696320 - RNA, 22 nt, Human
aaggcaacuguaaaacaugcac

SEQ ID NO: 696321 - RNA, 19 nt, Human
aaugguuugaugaaguaua

SEQ ID NO: 696322 - RNA, 22 nt, Human
gccugaggaaugcuccugacuu

SEQ ID NO: 696323 - RNA, 22 nt, Human
aaccauuugcaguuacugagac

SEQ ID NO: 696324 - RNA, 22 nt, Human
aauagcaguuaaaaaucagccc

SEQ ID NO: 696325 - RNA, 22 nt, Human
gcuucugggcaccugaacagga

SEQ ID NO: 696326 - RNA, 23 nt, Human
augggccaagcaagacccaugac

SEQ ID NO: 696327 - RNA, 22 nt, Human
auggcugggucaccaucagggu

SEQ ID NO: 696328 - RNA, 22 nt, Human
gaaaagaacugcaugggauuaa

SEQ ID NO: 696329 - RNA, 22 nt, Human
acuguuauguuauuacccaugu

SEQ ID NO: 696330 - RNA, 22 nt, Human
cugaggccucucuccuuggcuu

SEQ ID NO: 696331 - RNA, 22 nt, Human
ugcauuguugaauauuucauag

SEQ ID NO: 696332 - RNA, 22 nt, Human
uuguccugugauuucagggccu

SEQ ID NO: 696333 - RNA, 20 nt, Human
uugcagcagugaggugaagg

SEQ ID NO: 696334 - RNA, 22 nt, Human
gggguggauuccuacaggucca

SEQ ID NO: 696335 - RNA, 22 nt, Human
auaaacuggguaucaagaggcc

SEQ ID NO: 696336 - RNA, 22 nt, Human
agcugcaggagucgccuaggau

SEQ ID NO: 696337 - RNA, 22 nt, Human
guacacagagugguggaagaaa

SEQ ID NO: 696338 - RNA, 22 nt, Human
aauuucagaugucauaaauaua

SEQ ID NO: 696339 - RNA, 22 nt, Human
gccagcugaggccgugcaggcu

SEQ ID NO: 696340 - RNA, 22 nt, Human
uggcagagguaauucaaauccc

SEQ ID NO: 696341 - RNA, 22 nt, Human
uccucaguaaggaucgucagcu

SEQ ID NO: 696342 - RNA, 23 nt, Human
uggugccucagaagcagugggcu

SEQ ID NO: 696343 - RNA, 22 nt, Human
cugucugcccuggccagagccc

SEQ ID NO: 696344 - RNA, 22 nt, Human
uuccaggaagcucucggccucu

SEQ ID NO: 696345 - RNA, 22 nt, Human
aauucuacauugguucacauuu

SEQ ID NO: 696346 - RNA, 22 nt, Human
ugggcuggcguggagaguuuag

SEQ ID NO: 696347 - RNA, 19 nt, Human
aaaccuguuaguagagcac

SEQ ID NO: 696348 - RNA, 22 nt, Human
uuaaaacagcgugaaucuggca

SEQ ID NO: 696349 - RNA, 23 nt, Human
aggaagagagagugccucuuucu

SEQ ID NO: 696350 - RNA, 21 nt, Human
uggcucaguugcugggcacag

SEQ ID NO: 696351 - RNA, 22 nt, Human
ccuccaggauaagucagggccu

SEQ ID NO: 696352 - RNA, 22 nt, Human
uuuagugauucauuuagaaaaa

SEQ ID NO: 696353 - RNA, 22 nt, Human
uuggcucagcaucuuggugcca

SEQ ID NO: 696354 - RNA, 22 nt, Human
cugccuagaaaaccaggcuccu

SEQ ID NO: 696355 - RNA, 19 nt, Human
cauuuagaaguacauauua

SEQ ID NO: 696356 - RNA, 22 nt, Human
uauucacaggcuggagugaugu

SEQ ID NO: 696357 - RNA, 22 nt, Human
cucuccuuuacugcagagagcg

SEQ ID NO: 696358 - RNA, 22 nt, Human
gugccuggaacuggguaggcug

SEQ ID NO: 696359 - RNA, 22 nt, Human
agaagccauaguaucucagggu

SEQ ID NO: 696360 - RNA, 22 nt, Human
aggcuggagcaagggggcauau

SEQ ID NO: 696361 - RNA, 22 nt, Human
agcaaggaaaguaggcacggaa

SEQ ID NO: 696362 - RNA, 22 nt, Human
accaggguugagucagcugcgu

SEQ ID NO: 696363 - RNA, 22 nt, Human
aagcacagguugaggauuauuc

SEQ ID NO: 696364 - RNA, 22 nt, Human
ccugagcacaagggagcuuuga

SEQ ID NO: 696365 - RNA, 22 nt, Human
ugagguggcacacacuuccugc

SEQ ID NO: 696366 - RNA, 22 nt, Human
aggcauggcacugagcagcuuc

SEQ ID NO: 696367 - RNA, 22 nt, Human
ccuguaaguaguuugccugagc

SEQ ID NO: 696368 - RNA, 22 nt, Human
auggggugaccaugagcauuua

SEQ ID NO: 696369 - RNA, 22 nt, Human
cugucagaggcucucuguugcc

SEQ ID NO: 696370 - RNA, 22 nt, Human
ggguccaggcacuaugcuaagu

SEQ ID NO: 696371 - RNA, 22 nt, Human
ccaguggccaugcacgagcagc

SEQ ID NO: 696372 - RNA, 22 nt, Human
ucugcauuacaugccauagaca

SEQ ID NO: 696373 - RNA, 22 nt, Human
cuauuuucugucucuauagagu

SEQ ID NO: 696374 - RNA, 22 nt, Human
ucauaaaaauagacucuaaagu

SEQ ID NO: 696375 - RNA, 22 nt, Human
aaagucaucuguccuaggcucu

SEQ ID NO: 696376 - RNA, 22 nt, Human
cuuccuggaugagcaggcugau

SEQ ID NO: 696377 - RNA, 22 nt, Human
cuuuacaaccuaaguugaagcu

SEQ ID NO: 696378 - RNA, 23 nt, Human
gggugggccaaauuagguagccu

SEQ ID NO: 696379 - RNA, 22 nt, Human
auuucccuccagggaaagcuua

SEQ ID NO: 696380 - RNA, 22 nt, Human
acaggcagugggccagauuugu

SEQ ID NO: 696381 - RNA, 22 nt, Human
ggaggagcacuugacggggucu

SEQ ID NO: 696382 - RNA, 22 nt, Human
aacaggaaugaggagaaaaggu

SEQ ID NO: 696383 - RNA, 22 nt, Human
auucucucauuuaucuguccua

SEQ ID NO: 696384 - RNA, 22 nt, Human
augauacaucuuguuuauuuca

SEQ ID NO: 696385 - RNA, 22 nt, Human
gagcagcuuaugucaagccaga

SEQ ID NO: 696386 - RNA, 22 nt, Human
gggagucaggcucccucagaga

SEQ ID NO: 696387 - RNA, 22 nt, Human
gagcuguccgccccugggccga

SEQ ID NO: 696388 - RNA, 22 nt, Human
agaccccauaccucagcaggua

SEQ ID NO: 696389 - RNA, 22 nt, Human
ucagagagccucaggcacugcc

SEQ ID NO: 696390 - RNA, 22 nt, Human
ggucuggccaauagacagcccc

SEQ ID NO: 696391 - RNA, 22 nt, Human
uggcucagcugacucggcuucu

SEQ ID NO: 696392 - RNA, 22 nt, Human
gcugucacaucaaggcacuaaa

SEQ ID NO: 696393 - RNA, 19 nt, Human
gagguuucugaagugggcu

SEQ ID NO: 696394 - RNA, 22 nt, Human
guugugauuguagcuaaacuag

SEQ ID NO: 696395 - RNA, 22 nt, Human
cacacugucagguaaauaacac

SEQ ID NO: 696396 - RNA, 22 nt, Human
cugugccuucugccuggaacau

SEQ ID NO: 696397 - RNA, 22 nt, Human
uggaaggcugagaguccugggg

SEQ ID NO: 696398 - RNA, 22 nt, Human
uuguacaaauaggaaccucuga

SEQ ID NO: 696399 - RNA, 22 nt, Human
uaggaaauauugauuucaguca

SEQ ID NO: 696400 - RNA, 22 nt, Human
ggaguggugucacugagaggaa

SEQ ID NO: 696401 - RNA, 22 nt, Human
agucacagaaacccaggugugg

SEQ ID NO: 696402 - RNA, 22 nt, Human
ucuuuuauagugaauuuucuug

SEQ ID NO: 696403 - RNA, 22 nt, Human
ucugagaaugguggauguggug

SEQ ID NO: 696404 - RNA, 17 nt, Human
ggcugcaguccaggagg

SEQ ID NO: 696405 - RNA, 22 nt, Human
ggccaugcuguugccugcuggu

SEQ ID NO: 696406 - RNA, 18 nt, Human
ucugucuguguugucuuu

SEQ ID NO: 696407 - RNA, 22 nt, Human
caggaaagguagucacaaugua

SEQ ID NO: 696408 - RNA, 22 nt, Human
auuaauuuuaccuuuguaaaca

SEQ ID NO: 696409 - RNA, 22 nt, Human
cagaugaacuaggcugcacuug

SEQ ID NO: 696410 - RNA, 22 nt, Human
guaacuuuggauuuaggguacc

SEQ ID NO: 696411 - RNA, 22 nt, Human
ucucacaagcucaaggauuagu

SEQ ID NO: 696412 - RNA, 22 nt, Human
aucuggcugacuuugugggaca

SEQ ID NO: 696413 - RNA, 22 nt, Human
uuacacaaaguuagcucuugca

SEQ ID NO: 696414 - RNA, 22 nt, Human
gccgaggcucugcccagcugcu

SEQ ID NO: 696415 - RNA, 22 nt, Human
uccugagauaaaucucauguga

SEQ ID NO: 696416 - RNA, 19 nt, Human
aaguguguugagccaggau

SEQ ID NO: 696417 - RNA, 23 nt, Human
ccuugucuggcuggcuggacuuu

SEQ ID NO: 696418 - RNA, 22 nt, Human
aaggcuggguuugggaugugau

SEQ ID NO: 696419 - RNA, 22 nt, Human
cuggagcuaauaauccaucuga

SEQ ID NO: 696420 - RNA, 22 nt, Human
cuuucauuugauaagaaugcca

SEQ ID NO: 696421 - RNA, 22 nt, Human
caguuucuucaucaguuaagca

SEQ ID NO: 696422 - RNA, 22 nt, Human
aggcuuggagguucuguagcca

SEQ ID NO: 696423 - RNA, 22 nt, Human
cacagaaaaaggcuugaaaauc

SEQ ID NO: 696424 - RNA, 22 nt, Human
uucuuuucggccugugagaagg

SEQ ID NO: 696425 - RNA, 20 nt, Human
aaugucuugagacauuucag

SEQ ID NO: 696426 - RNA, 22 nt, Human
ucaauuaagaggcuaaguuacu

SEQ ID NO: 696427 - RNA, 17 nt, Human
ucugugauaguguagau

SEQ ID NO: 696428 - RNA, 22 nt, Human
ugagugugaggugggagcuugg

SEQ ID NO: 696429 - RNA, 22 nt, Human
agccacaggaaacagagacagc

SEQ ID NO: 696430 - RNA, 22 nt, Human
auucuucuaauaugaucguguu

SEQ ID NO: 696431 - RNA, 22 nt, Human
aggccaaguagccgcuguccua

SEQ ID NO: 696432 - RNA, 19 nt, Human
acuuguuuuggaggugaug

SEQ ID NO: 696433 - RNA, 22 nt, Human
aacuuuuguccgaucuccugga

SEQ ID NO: 696434 - RNA, 22 nt, Human
uuccacugaaggaucuagggaa

SEQ ID NO: 696435 - RNA, 23 nt, Human
agggguggucaguacccgcagug

SEQ ID NO: 696436 - RNA, 23 nt, Human
aacuuuacuauuuugaauaaugc

SEQ ID NO: 696437 - RNA, 20 nt, Human
uuuaucugugggaguggaga

SEQ ID NO: 696438 - RNA, 22 nt, Human
uucuggaaguggaauuuuugua

SEQ ID NO: 696439 - RNA, 22 nt, Human
ucucacaggugcacguggcugu

SEQ ID NO: 696440 - RNA, 22 nt, Human
uaacagcacuggcaggcacugu

SEQ ID NO: 696441 - RNA, 22 nt, Human
uguaaaguaucugugagcucuc

SEQ ID NO: 696442 - RNA, 18 nt, Human
ugaggcagucagugaugg

SEQ ID NO: 696443 - RNA, 20 nt, Human
guuuuucuugggcgagcuau

SEQ ID NO: 696444 - RNA, 22 nt, Human
cuuccugagcaaggaacuauag

SEQ ID NO: 696445 - RNA, 22 nt, Human
acuguacauguaaacauuguca

SEQ ID NO: 696446 - RNA, 22 nt, Human
uuagauaaauuaagacuuuaca

SEQ ID NO: 696447 - RNA, 22 nt, Human
uggcccaggugcacccagaggc

SEQ ID NO: 696448 - RNA, 21 nt, Human
uccagggaauuucaacuuuua

SEQ ID NO: 696449 - RNA, 18 nt, Human
cagaugagaugcaaucuc

SEQ ID NO: 696450 - RNA, 22 nt, Human
ucuucuuugaaucauagugacc

SEQ ID NO: 696451 - RNA, 22 nt, Human
uguacagcugccuuuuuuacuu

SEQ ID NO: 696452 - RNA, 22 nt, Human
acuuaaagaggcuacuuuuggu

SEQ ID NO: 696453 - RNA, 22 nt, Human
guuuacuuagaugcucaugcag

SEQ ID NO: 696454 - RNA, 21 nt, Human
cugcaucugagucauuaugcc

SEQ ID NO: 696455 - RNA, 22 nt, Human
ccugccaugccagcaugcccgu

SEQ ID NO: 696456 - RNA, 22 nt, Human
cugcccuggcagccuaccaugg

SEQ ID NO: 696457 - RNA, 22 nt, Human
gggguggccuguaggcagcaug

SEQ ID NO: 696458 - RNA, 21 nt, Human
cuuuuacauucagucaugaug

SEQ ID NO: 696459 - RNA, 22 nt, Human
ugcccaggcuggagugcagagg

SEQ ID NO: 696460 - RNA, 22 nt, Human
ucugccuggagaguucuucucu

SEQ ID NO: 696461 - RNA, 22 nt, Human
uuuucauguuccuuguuaagug

SEQ ID NO: 696462 - RNA, 22 nt, Human
agaaaguuuauuccuaucuagc

SEQ ID NO: 696463 - RNA, 22 nt, Human
cucugucuaucccauucugugc

SEQ ID NO: 696464 - RNA, 22 nt, Human
acagcagacagucggcuuccug

SEQ ID NO: 696465 - RNA, 22 nt, Human
caucuuuucagaagccauucug

SEQ ID NO: 696466 - RNA, 22 nt, Human
ugugcaugucugggccuguaag

SEQ ID NO: 696467 - RNA, 22 nt, Human
uaacacugauuuguucucaggg

SEQ ID NO: 696468 - RNA, 22 nt, Human
ucacccagacagcuugcacuga

SEQ ID NO: 696469 - RNA, 21 nt, Human
acacugacaaccauccacgag

SEQ ID NO: 696470 - RNA, 22 nt, Human
aagugugguuuaggcaucuuuu

SEQ ID NO: 696471 - RNA, 22 nt, Human
aguuuagaguucaaauuaguuc

SEQ ID NO: 696472 - RNA, 22 nt, Human
agguagagcuccaguagaaaau

SEQ ID NO: 696473 - RNA, 22 nt, Human
auccucacaauaaaaucagccu

SEQ ID NO: 696474 - RNA, 22 nt, Human
ucuucacaugaccuucaugucu

SEQ ID NO: 696475 - RNA, 22 nt, Human
gaaggcacccuccaucacucac

SEQ ID NO: 696476 - RNA, 22 nt, Human
caguccuucuccauuaaggcuc

SEQ ID NO: 696477 - RNA, 22 nt, Human
cucuggcuccauuucccuaugu

SEQ ID NO: 696478 - RNA, 22 nt, Human
uuccaguuaaggaagcuauucu

SEQ ID NO: 696479 - RNA, 22 nt, Human
augcauugcugcuuucaaaaca

SEQ ID NO: 696480 - RNA, 19 nt, Human
ccagcccauaguccaucac

SEQ ID NO: 696481 - RNA, 22 nt, Human
caggcuggacauuagauacaua

SEQ ID NO: 696482 - RNA, 22 nt, Human
ggcaggaggugaguggcgggug

SEQ ID NO: 696483 - RNA, 22 nt, Human
aagcaggaaggagcccagggca

SEQ ID NO: 696484 - RNA, 22 nt, Human
uugggaaagaaugagaagguga

SEQ ID NO: 696485 - RNA, 22 nt, Human
agcagaagaggucuuguugcug

SEQ ID NO: 696486 - RNA, 22 nt, Human
gaaaaggauugguaaaauaucu

SEQ ID NO: 696487 - RNA, 21 nt, Human
uucaucagccagaaaucaagc

SEQ ID NO: 696488 - RNA, 22 nt, Human
auggcugcccacguuggugcuu

SEQ ID NO: 696489 - RNA, 22 nt, Human
ggacacagauaaucacacagau

SEQ ID NO: 696490 - RNA, 23 nt, Human
gcucuuuguucauguggaugccu

SEQ ID NO: 696491 - RNA, 22 nt, Human
auguuuuucauaccaguguugg

SEQ ID NO: 696492 - RNA, 19 nt, Human
cucugggcugcaucuuggu

SEQ ID NO: 696493 - RNA, 22 nt, Human
ugacagagacagauugaagcuu

SEQ ID NO: 696494 - RNA, 22 nt, Human
aagacgcacccuuugagggcac

SEQ ID NO: 696495 - RNA, 22 nt, Human
ugccuucauccauguuauagug

SEQ ID NO: 696496 - RNA, 22 nt, Human
gaggcagagaccuucaggaccu

SEQ ID NO: 696497 - RNA, 22 nt, Human
ggggcugauggaacucaggccu

SEQ ID NO: 696498 - RNA, 22 nt, Human
aucaguuuggaacauucaggcc

SEQ ID NO: 696499 - RNA, 22 nt, Human
gacuguggauagaacacugcag

SEQ ID NO: 696500 - RNA, 22 nt, Human
gcauggcagugaggauggugcu

SEQ ID NO: 696501 - RNA, 22 nt, Human
uuccagaaaguucuggaacugg

SEQ ID NO: 696502 - RNA, 23 nt, Human
ugauuuccagugagucaguggga

SEQ ID NO: 696503 - RNA, 22 nt, Human
aggcacuuuuugcauuuuagaa

SEQ ID NO: 696504 - RNA, 22 nt, Human
uuaaagcaccuccuuggaugug

SEQ ID NO: 696505 - RNA, 22 nt, Human
ucagaggaagcaucaaguucuc

SEQ ID NO: 696506 - RNA, 22 nt, Human
aguguccuccucugggagccag

SEQ ID NO: 696507 - RNA, 22 nt, Human
ugcaggugauucugaugcaguu

SEQ ID NO: 696508 - RNA, 22 nt, Human
ccugggcucugaggagggaguc

SEQ ID NO: 696509 - RNA, 22 nt, Human
aaaugcuugcucuugauuauuu

SEQ ID NO: 696510 - RNA, 22 nt, Human
uccagagcuguccuacugugag

SEQ ID NO: 696511 - RNA, 22 nt, Human
uggagagucucugagccagggc

SEQ ID NO: 696512 - RNA, 17 nt, Human
ccaggagagaugcuugu

SEQ ID NO: 696513 - RNA, 22 nt, Human
ugauugaaguguucuguuccag

SEQ ID NO: 696514 - RNA, 23 nt, Human
agaggccaacuucuugccccucc

SEQ ID NO: 696515 - RNA, 22 nt, Human
uuggcuugaugacuggcagugu

SEQ ID NO: 696516 - RNA, 22 nt, Human
aguugcugggaaagauuucagu

SEQ ID NO: 696517 - RNA, 19 nt, Human
uucagcaggcugaagcuuc

SEQ ID NO: 696518 - RNA, 22 nt, Human
ccucugccuuuagugaaaguug

SEQ ID NO: 696519 - RNA, 22 nt, Human
ugcuuugcucucacuguaaggu

SEQ ID NO: 696520 - RNA, 22 nt, Human
gccuugaucugcuguguuugag

SEQ ID NO: 696521 - RNA, 22 nt, Human
cuucuuggaagucguccuucca

SEQ ID NO: 696522 - RNA, 22 nt, Human
ugauuucccuguagccucugaa

SEQ ID NO: 696523 - RNA, 22 nt, Human
cugcugccuaguccaagacgug

SEQ ID NO: 696524 - RNA, 22 nt, Human
cagagccaucaugauauggagu

SEQ ID NO: 696525 - RNA, 22 nt, Human
aagggcuguuauguuuuuauac

SEQ ID NO: 696526 - RNA, 18 nt, Human
gacacaggagagaguccc

SEQ ID NO: 696527 - RNA, 22 nt, Human
ucacuguguccuuucugcguag

SEQ ID NO: 696528 - RNA, 22 nt, Human
gaggccagaaugagcugaaugc

SEQ ID NO: 696529 - RNA, 22 nt, Human
cccucugacugggccaguucug

SEQ ID NO: 696530 - RNA, 23 nt, Human
uggcaggaaaugagaauguuccu

SEQ ID NO: 696531 - RNA, 20 nt, Human
ugcugcuuugccacuaguug

SEQ ID NO: 696532 - RNA, 22 nt, Human
agcagcagcucuguugcccuac

SEQ ID NO: 696533 - RNA, 22 nt, Human
aagggcucacccaacucacuuc

SEQ ID NO: 696534 - RNA, 22 nt, Human
guuaagaagcuagagaugaaca

SEQ ID NO: 696535 - RNA, 22 nt, Human
aacuauaaugggguuaggaaau

SEQ ID NO: 696536 - RNA, 22 nt, Human
agcugcaguaugaggcuggugg

SEQ ID NO: 696537 - RNA, 22 nt, Human
cacauuuaucuguucuuucuag

SEQ ID NO: 696538 - RNA, 17 nt, Human
uucaaagcuuaucaagg

SEQ ID NO: 696539 - RNA, 22 nt, Human
aguguuuauggaacccuggugg

SEQ ID NO: 696540 - RNA, 19 nt, Human
ucuuuggcuucuggaucag

SEQ ID NO: 696541 - RNA, 23 nt, Human
caucagccucagucuguggaccc

SEQ ID NO: 696542 - RNA, 22 nt, Human
uuagcauuucuggaaucacaag

SEQ ID NO: 696543 - RNA, 22 nt, Human
ggucugagcuugagcccaugcu

SEQ ID NO: 696544 - RNA, 22 nt, Human
cucagucugucuugucuguguu

SEQ ID NO: 696545 - RNA, 22 nt, Human
agcaaauauuuuguugaagugc

SEQ ID NO: 696546 - RNA, 22 nt, Human
uggaauguuuuccuaaaucaga

SEQ ID NO: 696547 - RNA, 22 nt, Human
gacuggccuggggcugggcaca

SEQ ID NO: 696548 - RNA, 22 nt, Human
uauuuauucauucagcaagcau

SEQ ID NO: 696549 - RNA, 22 nt, Human
aagcagcagccaucccccaagg

SEQ ID NO: 696550 - RNA, 22 nt, Human
gcugcuguccuuagggaguucu

SEQ ID NO: 696551 - RNA, 22 nt, Human
uugaaggaggcuccuuuuuaaa

SEQ ID NO: 696552 - RNA, 22 nt, Human
ugaguccugcucugggcagggu

SEQ ID NO: 696553 - RNA, 20 nt, Human
auguauauuacuggcuguga

SEQ ID NO: 696554 - RNA, 22 nt, Human
gggggaaguaauuauaaaccaa

SEQ ID NO: 696555 - RNA, 22 nt, Human
gcagggcagggcaagaacuggg

SEQ ID NO: 696556 - RNA, 22 nt, Human
guucucucagcgauagugaugg

SEQ ID NO: 696557 - RNA, 22 nt, Human
uuccugugauauuagccacugu

SEQ ID NO: 696558 - RNA, 22 nt, Human
ggagccggagggccacuggcag

SEQ ID NO: 696559 - RNA, 21 nt, Human
cacuguauagcaggagaaaac

SEQ ID NO: 696560 - RNA, 22 nt, Human
accucugccaagaugugcuccc

SEQ ID NO: 696561 - RNA, 22 nt, Human
augucacagucugacucaguga

SEQ ID NO: 696562 - RNA, 22 nt, Human
gcugacugcucagggccagcug

SEQ ID NO: 696563 - RNA, 22 nt, Human
gggagcugagaaacaacauucu

SEQ ID NO: 696564 - RNA, 22 nt, Human
aaggcucccucuucucgagugu

SEQ ID NO: 696565 - RNA, 16 nt, Human
uacuguggagcaaggc

SEQ ID NO: 696566 - RNA, 22 nt, Human
acaguaaaucaacagaauaucu

SEQ ID NO: 696567 - RNA, 22 nt, Human
caguccugagccaaucaugaug

SEQ ID NO: 696568 - RNA, 22 nt, Human
agcccuucaagagcucuguccu

SEQ ID NO: 696569 - RNA, 22 nt, Human
agcuuucuucuaguuguacagu

SEQ ID NO: 696570 - RNA, 22 nt, Human
cagagcaugaauaaaaguuaca

SEQ ID NO: 696571 - RNA, 22 nt, Human
agucucuuuugcgaagaguguu

SEQ ID NO: 696572 - RNA, 22 nt, Human
uaaaguguggauaugauuagua

SEQ ID NO: 696573 - RNA, 22 nt, Human
aaauagcuacaugaucucuagg

SEQ ID NO: 696574 - RNA, 22 nt, Human
cuugccuucuguuccuauagaa

SEQ ID NO: 696575 - RNA, 17 nt, Human
aggcaggagauuggaga

SEQ ID NO: 696576 - RNA, 22 nt, Human
aaauucucuucagaggaaccag

SEQ ID NO: 696577 - RNA, 22 nt, Human
ugugacuucuuuuugaguucaa

SEQ ID NO: 696578 - RNA, 22 nt, Human
augacaaccugugagcugguau

SEQ ID NO: 696579 - RNA, 22 nt, Human
aaguacauggaggauagcugcu

SEQ ID NO: 696580 - RNA, 22 nt, Human
uagcacacuaaagauauuaaca

SEQ ID NO: 696581 - RNA, 22 nt, Human
cuaacuuuuugauucuugggga

SEQ ID NO: 696582 - RNA, 22 nt, Human
accuuuucaucugaaacuuuua

SEQ ID NO: 696583 - RNA, 22 nt, Human
gcugcccuagaaguacagagag

SEQ ID NO: 696584 - RNA, 22 nt, Human
acuggcuuugccucugccucuc

SEQ ID NO: 696585 - RNA, 22 nt, Human
ccugaguggagggauucugcag

SEQ ID NO: 696586 - RNA, 22 nt, Human
gcuuuacaugauuucucacccu

SEQ ID NO: 696587 - RNA, 22 nt, Human
aaucuaacuucauagcugauuu

SEQ ID NO: 696588 - RNA, 22 nt, Human
ccuccuggagcauuggugagga

SEQ ID NO: 696589 - RNA, 22 nt, Human
agggcugcccagugugagagcu

SEQ ID NO: 696590 - RNA, 22 nt, Human
cccuggugcccugggucagccu

SEQ ID NO: 696591 - RNA, 22 nt, Human
uguguguuaucuuaguucaucu

SEQ ID NO: 696592 - RNA, 22 nt, Human
agagggcugcugcacagugcuc

SEQ ID NO: 696593 - RNA, 22 nt, Human
augaaugagaaagcugaaaucu

SEQ ID NO: 696594 - RNA, 22 nt, Human
uuguggcucaucuucagcuccc

SEQ ID NO: 696595 - RNA, 22 nt, Human
cacauucauggaguuugccugu

SEQ ID NO: 696596 - RNA, 22 nt, Human
cagagccagcaguggggacagg

SEQ ID NO: 696597 - RNA, 22 nt, Human
ggcugguguuacagucggcagc

SEQ ID NO: 696598 - RNA, 22 nt, Human
caguuuagcauuuaccgugaug

SEQ ID NO: 696599 - RNA, 22 nt, Human
ugaaaugaucaguuugguuacu

SEQ ID NO: 696600 - RNA, 21 nt, Human
aaauccaaacacuaguccaca

SEQ ID NO: 696601 - RNA, 22 nt, Human
augcuugggacucccuguagca

SEQ ID NO: 696602 - RNA, 22 nt, Human
uacuguauuugauaagugaagu

SEQ ID NO: 696603 - RNA, 22 nt, Human
uguaugcuugaguguguauacu

SEQ ID NO: 696604 - RNA, 22 nt, Human
uuacacucugguugugggccuu

SEQ ID NO: 696605 - RNA, 22 nt, Human
ugauauggaaggaagauguaca

SEQ ID NO: 696606 - RNA, 22 nt, Human
uucacagaugagaaaauugagg

SEQ ID NO: 696607 - RNA, 22 nt, Human
cucagcccagcucaggucuuuc

SEQ ID NO: 696608 - RNA, 22 nt, Human
gggagagaaauuauagcaauga

SEQ ID NO: 696609 - RNA, 22 nt, Human
guggggguuucauuaagacaau

SEQ ID NO: 696610 - RNA, 21 nt, Human
agaggcgggguuuuggaggcc

SEQ ID NO: 696611 - RNA, 22 nt, Human
cucuguuucucagccuauuucc

SEQ ID NO: 696612 - RNA, 22 nt, Human
agauuuagcugugaacagcuug

SEQ ID NO: 696613 - RNA, 18 nt, Human
gcccugguggagcuggug

SEQ ID NO: 696614 - RNA, 22 nt, Human
cugggucugucacuagauaaau

SEQ ID NO: 696615 - RNA, 22 nt, Human
gagacaguguccauccaggggc

SEQ ID NO: 696616 - RNA, 22 nt, Human
ggcacugcccacccucacaggg

SEQ ID NO: 696617 - RNA, 22 nt, Human
acuggccuaucagcaugagucu

SEQ ID NO: 696618 - RNA, 22 nt, Human
aggcaggcaaccaccugggaag

SEQ ID NO: 696619 - RNA, 20 nt, Human
uguucacaguaguugcugcu

SEQ ID NO: 696620 - RNA, 22 nt, Human
aucguaaagcccuauggcuuca

SEQ ID NO: 696621 - RNA, 22 nt, Human
ccagcugcauccuauucacugc

SEQ ID NO: 696622 - RNA, 22 nt, Human
guggcuucaucaacugugcuua

SEQ ID NO: 696623 - RNA, 22 nt, Human
caauaauugcuuuccagaguua

SEQ ID NO: 696624 - RNA, 22 nt, Human
caaccucuguaauguucuagga

SEQ ID NO: 696625 - RNA, 22 nt, Human
ugaaaccucaaccaaagguuac

SEQ ID NO: 696626 - RNA, 22 nt, Human
ucacauuguaggucauuugcaa

SEQ ID NO: 696627 - RNA, 22 nt, Human
cauuugcucugugucaguggca

SEQ ID NO: 696628 - RNA, 22 nt, Human
uucugaagcucccuuuuguagu

SEQ ID NO: 696629 - RNA, 22 nt, Human
uauacaggaacuguuggcuccc

SEQ ID NO: 696630 - RNA, 22 nt, Human
ggcugcaggcuucccuccagca

SEQ ID NO: 696631 - RNA, 22 nt, Human
gcagugggagcuuaggcagugc

SEQ ID NO: 696632 - RNA, 22 nt, Human
uccuggcuccacugagcaggcc

SEQ ID NO: 696633 - RNA, 22 nt, Human
acugaaagauaaaucaguuagc

SEQ ID NO: 696634 - RNA, 22 nt, Human
ugaggaugguuaaagaacauug

SEQ ID NO: 696635 - RNA, 22 nt, Human
uuauuuaauuuucucacucaga

SEQ ID NO: 696636 - RNA, 22 nt, Human
ucauuguauacuuuauuuauga

SEQ ID NO: 696637 - RNA, 22 nt, Human
gauuucagccccgcucccagcu

SEQ ID NO: 696638 - RNA, 22 nt, Human
gcuuggcuggaaauagguugag

SEQ ID NO: 696639 - RNA, 22 nt, Human
caguccucugcaacaccccuuc

SEQ ID NO: 696640 - RNA, 22 nt, Human
aaugauugcaaacauugagaac

SEQ ID NO: 696641 - RNA, 22 nt, Human
guuucacagucugcagaauuuu

SEQ ID NO: 696642 - RNA, 22 nt, Human
augucugcguuauaucaauauc

SEQ ID NO: 696643 - RNA, 22 nt, Human
gcucuccacugaccacggggca

SEQ ID NO: 696644 - RNA, 22 nt, Human
ucccagcucacauaugguaacu

SEQ ID NO: 696645 - RNA, 22 nt, Human
cugggcuuuugagucacaaggg

SEQ ID NO: 696646 - RNA, 22 nt, Human
uugcugccuuccgaauccucuc

SEQ ID NO: 696647 - RNA, 22 nt, Human
cugggccugccaccaucuuagg

SEQ ID NO: 696648 - RNA, 22 nt, Human
ggagcacuauaauagagauuuu

SEQ ID NO: 696649 - RNA, 18 nt, Human
cguuuuuccgggauugca

SEQ ID NO: 696650 - RNA, 21 nt, Human
ugagcaggugcugcuuuuaug

SEQ ID NO: 696651 - RNA, 22 nt, Human
gugcccaggugucccugagaag

SEQ ID NO: 696652 - RNA, 22 nt, Human
uaaauucugaucaaguuccuuc

SEQ ID NO: 696653 - RNA, 22 nt, Human
augucuguggcaauuguugaug

SEQ ID NO: 696654 - RNA, 22 nt, Human
accuuuauaugaaagaugacau

SEQ ID NO: 696655 - RNA, 22 nt, Human
gaagcacauuagaugugucuuc

SEQ ID NO: 696656 - RNA, 22 nt, Human
uucauauauaugcacuacguac

SEQ ID NO: 696657 - RNA, 22 nt, Human
auaaauagugaagggagccggu

SEQ ID NO: 696658 - RNA, 20 nt, Human
ucuggacugucagacaggga

SEQ ID NO: 696659 - RNA, 22 nt, Human
uuauuagguuauucucuguacu

SEQ ID NO: 696660 - RNA, 22 nt, Human
caugugguauugugagauccac

SEQ ID NO: 696661 - RNA, 22 nt, Human
auacugaauuagguaaagcaua

SEQ ID NO: 696662 - RNA, 20 nt, Human
cuugcccagggucuccugcc

SEQ ID NO: 696663 - RNA, 22 nt, Human
ucugccagcaccaugauccuuc

SEQ ID NO: 696664 - RNA, 22 nt, Human
agagcugaggauccagcugagc

SEQ ID NO: 696665 - RNA, 22 nt, Human
uuucauaaucugucaagugggg

SEQ ID NO: 696666 - RNA, 22 nt, Human
agcagagacaugaaauaugcuu

SEQ ID NO: 696667 - RNA, 22 nt, Human
cucaggauuuaaaggggcacuc

SEQ ID NO: 696668 - RNA, 22 nt, Human
cuaguguacaagugguggagau

SEQ ID NO: 696669 - RNA, 22 nt, Human
auaacuucagggcugugacaga

SEQ ID NO: 696670 - RNA, 22 nt, Human
cuugccaguguugcagaagcuc

SEQ ID NO: 696671 - RNA, 22 nt, Human
cagcaugauuggugucugguga

SEQ ID NO: 696672 - RNA, 22 nt, Human
ugacacagaaauuaagcuguca

SEQ ID NO: 696673 - RNA, 22 nt, Human
uccugcuggaaguagggaauga

SEQ ID NO: 696674 - RNA, 22 nt, Human
agggcacaucugcugggaaugg

SEQ ID NO: 696675 - RNA, 22 nt, Human
agcacaggugaaacagucaggu

SEQ ID NO: 696676 - RNA, 22 nt, Human
gucuaaaccucaaaucaguguc

SEQ ID NO: 696677 - RNA, 22 nt, Human
aauuaauucaguuuuuaaggga

SEQ ID NO: 696678 - RNA, 22 nt, Human
uucuccagaccacugccucugu

SEQ ID NO: 696679 - RNA, 22 nt, Human
aggggaggagcuuuucuugccu

SEQ ID NO: 696680 - RNA, 22 nt, Human
cuucacuucacagaugccaaga

SEQ ID NO: 696681 - RNA, 22 nt, Human
gacacagaaugggugcucagua

SEQ ID NO: 696682 - RNA, 22 nt, Human
ugcugguggagaaaguggaggu

SEQ ID NO: 696683 - RNA, 22 nt, Human
auuuccuucaguguuuaauacu

SEQ ID NO: 696684 - RNA, 22 nt, Human
ggugaagggugucauggcauuu

SEQ ID NO: 696685 - RNA, 22 nt, Human
uauacacauguguguauucaua

SEQ ID NO: 696686 - RNA, 22 nt, Human
aaugacaaauauggaagccuga

SEQ ID NO: 696687 - RNA, 20 nt, Human
uucugcuuuugcuuagggac

SEQ ID NO: 696688 - RNA, 22 nt, Human
ugcuuauucuuuccacaauuca

SEQ ID NO: 696689 - RNA, 22 nt, Human
uagagguauuuuugauggucau

SEQ ID NO: 696690 - RNA, 22 nt, Human
auggcccaggcaggcugguacu

SEQ ID NO: 696691 - RNA, 22 nt, Human
ugaaggaaagagggaacauccc

SEQ ID NO: 696692 - RNA, 22 nt, Human
agacaauggagggaaauacuuc

SEQ ID NO: 696693 - RNA, 23 nt, Human
agggcccaagccuggacagcagg

SEQ ID NO: 696694 - RNA, 19 nt, Human
uuacacuccugggcagugg

SEQ ID NO: 696695 - RNA, 22 nt, Human
gaauuuaaggaccaagcauuuu

SEQ ID NO: 696696 - RNA, 22 nt, Human
uccagagccugcgcacuggcug

SEQ ID NO: 696697 - RNA, 22 nt, Human
caaguuuuagaaauaucuggau

SEQ ID NO: 696698 - RNA, 22 nt, Human
auuucucaguguacauuauguu

SEQ ID NO: 696699 - RNA, 20 nt, Human
ucagagaagggacugagauu

SEQ ID NO: 696700 - RNA, 22 nt, Human
uuggcccuggcacacccccacg

SEQ ID NO: 696701 - RNA, 17 nt, Human
auggcuuugucacacag

SEQ ID NO: 696702 - RNA, 22 nt, Human
cacgggagacgugaucuuggac

SEQ ID NO: 696703 - RNA, 22 nt, Human
ucaucaguuuagaaaaaauaug

SEQ ID NO: 696704 - RNA, 22 nt, Human
ggcagccaugugggcagcgagu

SEQ ID NO: 696705 - RNA, 21 nt, Human
cucagacagggaggcucuggg

SEQ ID NO: 696706 - RNA, 22 nt, Human
aaaaguaauugcgguuuuugcc

SEQ ID NO: 696707 - RNA, 22 nt, Human
aggcuucauauuuaggcauaug

SEQ ID NO: 696708 - RNA, 22 nt, Human
ggagcugaggcugaggccucac

SEQ ID NO: 696709 - RNA, 22 nt, Human
gucuagaauaucuagaaagauc

SEQ ID NO: 696710 - RNA, 22 nt, Human
uuaggaauuuaucacagacugg

SEQ ID NO: 696711 - RNA, 23 nt, Human
gccucuggagccccagugcucag

SEQ ID NO: 696712 - RNA, 22 nt, Human
ugaggcuuggaggcuccagugg

SEQ ID NO: 696713 - RNA, 22 nt, Human
ccaggccagccuggagcauggc

SEQ ID NO: 696714 - RNA, 21 nt, Human
gcaaggcuuuuguguuuccca

SEQ ID NO: 696715 - RNA, 22 nt, Human
aggcauaggacaucuaugucau

SEQ ID NO: 696716 - RNA, 22 nt, Human
ccacaugaaauugcuuauauuu

SEQ ID NO: 696717 - RNA, 22 nt, Human
ccugccagauccccugagcuga

SEQ ID NO: 696718 - RNA, 22 nt, Human
aggcuggcggugacugcucuga

SEQ ID NO: 696719 - RNA, 22 nt, Human
ugggagcaggaagcaggaagua

SEQ ID NO: 696720 - RNA, 22 nt, Human
cauugcuugauagcugaaaauu

SEQ ID NO: 696721 - RNA, 22 nt, Human
ggucugaguagagggcuggcga

SEQ ID NO: 696722 - RNA, 22 nt, Human
ccauguggugggaaggagaaug

SEQ ID NO: 696723 - RNA, 19 nt, Human
acccaggguugauguccag

SEQ ID NO: 696724 - RNA, 22 nt, Human
agcugcacugugaaguucauag

SEQ ID NO: 696725 - RNA, 22 nt, Human
gucacacucagaaugacuagag

SEQ ID NO: 696726 - RNA, 22 nt, Human
agcuggguggagggcccacggu

SEQ ID NO: 696727 - RNA, 22 nt, Human
cagcccuggugccaagguuccc

SEQ ID NO: 696728 - RNA, 22 nt, Human
gcucuauguugaccuucagugg

SEQ ID NO: 696729 - RNA, 22 nt, Human
ucugggaagauguuucaaaggu

SEQ ID NO: 696730 - RNA, 22 nt, Human
gagugggggguccgucucagug

SEQ ID NO: 696731 - RNA, 22 nt, Human
ggcucugggguuggcccaucuc

SEQ ID NO: 696732 - RNA, 22 nt, Human
guuuaauaauguugaauuacua

SEQ ID NO: 696733 - RNA, 22 nt, Human
uacauugacuuggauuguuaga

SEQ ID NO: 696734 - RNA, 22 nt, Human
aaaauaucagcaaagggugaca

SEQ ID NO: 696735 - RNA, 22 nt, Human
guggcuucaccccaguugucuc

SEQ ID NO: 696736 - RNA, 22 nt, Human
caacuacauccacacuuuguua

SEQ ID NO: 696737 - RNA, 23 nt, Human
agccucuuuucuccugcccugca

SEQ ID NO: 696738 - RNA, 22 nt, Human
ugcugcugcuucuguacagccu

SEQ ID NO: 696739 - RNA, 22 nt, Human
cuuaaaaucuggcaguuagcua

SEQ ID NO: 696740 - RNA, 22 nt, Human
ccagccagaugauaagcucuau

SEQ ID NO: 696741 - RNA, 22 nt, Human
cuacagagaacucagcugcccu

SEQ ID NO: 696742 - RNA, 22 nt, Human
gccuccugaaaggaagagcucc

SEQ ID NO: 696743 - RNA, 22 nt, Human
gcaagcaggguuccuuagggca

SEQ ID NO: 696744 - RNA, 22 nt, Human
acauuuaggauguuuugagaga

SEQ ID NO: 696745 - RNA, 22 nt, Human
ugaugacaaacuuuccugaugc

SEQ ID NO: 696746 - RNA, 17 nt, Human
gagugcagacacaagca

SEQ ID NO: 696747 - RNA, 22 nt, Human
aaaacaguuuaggcaucacagu

SEQ ID NO: 696748 - RNA, 22 nt, Human
aaauugcauugagcugcuuauu

SEQ ID NO: 696749 - RNA, 22 nt, Human
uucugcuucacuggccuggagg

SEQ ID NO: 696750 - RNA, 22 nt, Human
caggaagaccagggcuguggcu

SEQ ID NO: 696751 - RNA, 22 nt, Human
caucuccaggaguucuacucau

SEQ ID NO: 696752 - RNA, 22 nt, Human
gggcuggcuaagacuuuucugu

SEQ ID NO: 696753 - RNA, 22 nt, Human
aagagcaggcugcuguggagua

SEQ ID NO: 696754 - RNA, 22 nt, Human
uggggaucauaaauugauggag

SEQ ID NO: 696755 - RNA, 22 nt, Human
acucuuggccacucuugguguc

SEQ ID NO: 696756 - RNA, 22 nt, Human
uucaaagauaauuaccaaacau

SEQ ID NO: 696757 - RNA, 22 nt, Human
gggcgcagccaauccuggcccu

SEQ ID NO: 696758 - RNA, 18 nt, Human
cacaggaaggggaauauc

SEQ ID NO: 696759 - RNA, 22 nt, Human
acaaugcugcagggaaauuagg

SEQ ID NO: 696760 - RNA, 22 nt, Human
uucagugugccuaagucaguug

SEQ ID NO: 696761 - RNA, 20 nt, Human
ggcagagggccugggagaag

SEQ ID NO: 696762 - RNA, 22 nt, Human
cccagccucagcuuuacuucca

SEQ ID NO: 696763 - RNA, 22 nt, Human
gggaguccaaauugguacaaua

SEQ ID NO: 696764 - RNA, 22 nt, Human
gucccauaaguagugcaacuug

SEQ ID NO: 696765 - RNA, 17 nt, Human
aguuaaggcucuuugcu

SEQ ID NO: 696766 - RNA, 22 nt, Human
ucugcugaacuugcugcccaga

SEQ ID NO: 696767 - RNA, 22 nt, Human
agaguguaccaaauauccuaca

SEQ ID NO: 696768 - RNA, 22 nt, Human
cagacaggcaggugagagcucc

SEQ ID NO: 696769 - RNA, 22 nt, Human
ugugauuacugaauagaaaaua

SEQ ID NO: 696770 - RNA, 22 nt, Human
uugcaggggagaggaacaaaca

SEQ ID NO: 696771 - RNA, 22 nt, Human
gcccagcugcacccuggugggu

SEQ ID NO: 696772 - RNA, 22 nt, Human
ugauuuccaauaaggagaaugu

SEQ ID NO: 696773 - RNA, 22 nt, Human
gaaggccacaagagaaguuaag

SEQ ID NO: 696774 - RNA, 22 nt, Human
cagaggugcauacaggucauua

SEQ ID NO: 696775 - RNA, 22 nt, Human
uauguguggcagcugggagugu

SEQ ID NO: 696776 - RNA, 22 nt, Human
cuaaaauuaccuaccaguuuag

SEQ ID NO: 696777 - RNA, 22 nt, Human
uuugagaaugguaaguggaucg

SEQ ID NO: 696778 - RNA, 22 nt, Human
ucugcuguacuuuuggucuguu

SEQ ID NO: 696779 - RNA, 22 nt, Human
gugagcuuugugguaaugaagu

SEQ ID NO: 696780 - RNA, 22 nt, Human
gggauggaggguagagcaagug

SEQ ID NO: 696781 - RNA, 22 nt, Human
ugaacuuucacaagaauaugcu

SEQ ID NO: 696782 - RNA, 22 nt, Human
uuuauuaaaacuguuggcucug

SEQ ID NO: 696783 - RNA, 22 nt, Human
aaguguuaaaagauuaaaugcu

SEQ ID NO: 696784 - RNA, 22 nt, Human
ugcugccagccaggccauggag

SEQ ID NO: 696785 - RNA, 23 nt, Human
cagcucagaguguguccuguuuc

SEQ ID NO: 696786 - RNA, 22 nt, Human
cugucugucaccaaaacagacu

SEQ ID NO: 696787 - RNA, 22 nt, Human
ugcugcugauggaugccuggac

SEQ ID NO: 696788 - RNA, 22 nt, Human
ggggaagaggcgugauggaucc

SEQ ID NO: 696789 - RNA, 23 nt, Human
gcagagcugcccuauugccuugg

SEQ ID NO: 696790 - RNA, 22 nt, Human
agggggcucagcaggcucugga

SEQ ID NO: 696791 - RNA, 22 nt, Human
aggcucagggacucccucccuc

SEQ ID NO: 696792 - RNA, 22 nt, Human
ucuuaacauauuauuuuagcac

SEQ ID NO: 696793 - RNA, 22 nt, Human
aaucgguugaacccaggaagug

SEQ ID NO: 696794 - RNA, 22 nt, Human
aacacuucccgaccauauggcu

SEQ ID NO: 696795 - RNA, 22 nt, Human
aaagguuugcauggaauuuacc

SEQ ID NO: 696796 - RNA, 22 nt, Human
uggcacccugaaguuggucacu

SEQ ID NO: 696797 - RNA, 22 nt, Human
ccuucaaucuuaagucagccca

SEQ ID NO: 696798 - RNA, 17 nt, Human
uugacuguuaauggguu

SEQ ID NO: 696799 - RNA, 23 nt, Human
ggcucugugcuaauugcugaaaa

SEQ ID NO: 696800 - RNA, 22 nt, Human
cuggguggaaagugcugagaau

SEQ ID NO: 696801 - RNA, 22 nt, Human
auuguacaugcagugagucauc

SEQ ID NO: 696802 - RNA, 22 nt, Human
uuggcuucuuuagucaguuugg

SEQ ID NO: 696803 - RNA, 22 nt, Human
agcugcucugauaaaccuacuu

SEQ ID NO: 696804 - RNA, 22 nt, Human
gcagcaagagguuucuguugac

SEQ ID NO: 696805 - RNA, 22 nt, Human
ucuuagaugaauaaaaaguuau

SEQ ID NO: 696806 - RNA, 22 nt, Human
acauggguuauugugagguuaa

SEQ ID NO: 696807 - RNA, 22 nt, Human
gcucugcugcuuacuagauggu

SEQ ID NO: 696808 - RNA, 22 nt, Human
gccacagucacugcugcagggg

SEQ ID NO: 696809 - RNA, 22 nt, Human
uguguuccugccuggcucuggu

SEQ ID NO: 696810 - RNA, 22 nt, Human
aaaguuguaauggaagaaaugc

SEQ ID NO: 696811 - RNA, 22 nt, Human
ccugugagucaaccccuccuug

SEQ ID NO: 696812 - RNA, 22 nt, Human
aggggccucagccuccugguca

SEQ ID NO: 696813 - RNA, 22 nt, Human
cagaggcucagauggcccuggc

SEQ ID NO: 696814 - RNA, 20 nt, Human
gcugaagauucccaugcaag

SEQ ID NO: 696815 - RNA, 22 nt, Human
aagagcuggauggaaucuggga

SEQ ID NO: 696816 - RNA, 22 nt, Human
gcaguguuucccagagauggaa

SEQ ID NO: 696817 - RNA, 21 nt, Human
uuguaaauggcuuuuuccuuc

SEQ ID NO: 696818 - RNA, 22 nt, Human
acauguuuugugccuugacuag

SEQ ID NO: 696819 - RNA, 22 nt, Human
uggggagguaacaauuucaggc

SEQ ID NO: 696820 - RNA, 22 nt, Human
ggagcuggucagccuugagcau

SEQ ID NO: 696821 - RNA, 21 nt, Human
gguuaaaagacacaucuguuu

SEQ ID NO: 696822 - RNA, 22 nt, Human
cuguccuguagcuccaucaguc

SEQ ID NO: 696823 - RNA, 22 nt, Human
uugcaggguccuguggcucucc

SEQ ID NO: 696824 - RNA, 22 nt, Human
guuuauuccagcaaucugcuua

SEQ ID NO: 696825 - RNA, 17 nt, Human
cauucuguaaucuuucu

SEQ ID NO: 696826 - RNA, 22 nt, Human
agacagcaggggagucugguuu

SEQ ID NO: 696827 - RNA, 22 nt, Human
cagcacaggcaggggaacuaua

SEQ ID NO: 696828 - RNA, 21 nt, Human
agugaagagugaaacacaugg

SEQ ID NO: 696829 - RNA, 22 nt, Human
agagucugccuuuuucuccugc

SEQ ID NO: 696830 - RNA, 22 nt, Human
acccaggaaaacauggugcaga

SEQ ID NO: 696831 - RNA, 22 nt, Human
ucuaagacacuguacuuucagu

SEQ ID NO: 696832 - RNA, 22 nt, Human
gcugggcuccacccucaacugu

SEQ ID NO: 696833 - RNA, 22 nt, Human
aaugagacacgugaagcagaug

SEQ ID NO: 696834 - RNA, 22 nt, Human
uaacacauuuuaagccauuuua

SEQ ID NO: 696835 - RNA, 22 nt, Human
gggguggcccuacccucuggaa

SEQ ID NO: 696836 - RNA, 22 nt, Human
accaggcucugccaguguuuac

SEQ ID NO: 696837 - RNA, 22 nt, Human
gcaagcugcucuuauguggagg

SEQ ID NO: 696838 - RNA, 22 nt, Human
gacuggauauugaguacugcaa

SEQ ID NO: 696839 - RNA, 22 nt, Human
ucuuuggauauguauggauaga

SEQ ID NO: 696840 - RNA, 22 nt, Human
acacuuuuguguauauccaguu

SEQ ID NO: 696841 - RNA, 22 nt, Human
uuuccucugacugcuccccugc

SEQ ID NO: 696842 - RNA, 22 nt, Human
acaaggcuaauuuggaagauac

SEQ ID NO: 696843 - RNA, 22 nt, Human
caggacgggcaaacaggauggu

SEQ ID NO: 696844 - RNA, 22 nt, Human
ccucaaaucuuuagaguuauuu

SEQ ID NO: 696845 - RNA, 22 nt, Human
guaaaggcucugauaaguacug

SEQ ID NO: 696846 - RNA, 22 nt, Human
aggcugaggcagguggaucacc

SEQ ID NO: 696847 - RNA, 18 nt, Human
caauagaaacaguaggaa

SEQ ID NO: 696848 - RNA, 22 nt, Human
cacugcucgcugcagcauggcc

SEQ ID NO: 696849 - RNA, 22 nt, Human
ugaggcucauucugcaugccaa

SEQ ID NO: 696850 - RNA, 19 nt, Human
agucuguggauuugugggu

SEQ ID NO: 696851 - RNA, 22 nt, Human
acagugugggacauuaggaaau

SEQ ID NO: 696852 - RNA, 22 nt, Human
uuaaaguaaucugugugaauuu

SEQ ID NO: 696853 - RNA, 22 nt, Human
aagcacagagagguaaaguaac

SEQ ID NO: 696854 - RNA, 22 nt, Human
agaaggcacucacacuggcacg

SEQ ID NO: 696855 - RNA, 22 nt, Human
cugccuuuucaucugagcugga

SEQ ID NO: 696856 - RNA, 22 nt, Human
ugcuuagacgucaaguacagcc

SEQ ID NO: 696857 - RNA, 22 nt, Human
uagaaucagaagauuugacugu

SEQ ID NO: 696858 - RNA, 22 nt, Human
aagugaccucaugguuucuccu

SEQ ID NO: 696859 - RNA, 22 nt, Human
caugcacuuaccugaaauucaa

SEQ ID NO: 696860 - RNA, 22 nt, Human
cucugagagugcucagagggua

SEQ ID NO: 696861 - RNA, 22 nt, Human
ccugagaauguuuaacagagaa

SEQ ID NO: 696862 - RNA, 22 nt, Human
auuuguauauuuaagaggguag

SEQ ID NO: 696863 - RNA, 22 nt, Human
gagacagaugcugcuggagcau

SEQ ID NO: 696864 - RNA, 22 nt, Human
gauaaaagaggaaauuuguuca

SEQ ID NO: 696865 - RNA, 19 nt, Human
ccugugucccacguagaug

SEQ ID NO: 696866 - RNA, 23 nt, Human
ucucugguuaggggagauuggug

SEQ ID NO: 696867 - RNA, 16 nt, Human
ggagagugucugcaaa

SEQ ID NO: 696868 - RNA, 22 nt, Human
ugugugaacauguuuucauuuc

SEQ ID NO: 696869 - RNA, 22 nt, Human
acccugagaaugagugucuccu

SEQ ID NO: 696870 - RNA, 22 nt, Human
cucuaaauccaaauaagugucc

SEQ ID NO: 696871 - RNA, 22 nt, Human
guucaauuuagaaagcacaguu

SEQ ID NO: 696872 - RNA, 22 nt, Human
ugcuguauuacuuuuacaaacu

SEQ ID NO: 696873 - RNA, 22 nt, Human
cacaguaaccccaggacuggga

SEQ ID NO: 696874 - RNA, 22 nt, Human
ugguccagaugccuuggcuuua

SEQ ID NO: 696875 - RNA, 22 nt, Human
cuucugggauuuuugaagacuc

SEQ ID NO: 696876 - RNA, 22 nt, Human
gcugugcagccaagugccucug

SEQ ID NO: 696877 - RNA, 22 nt, Human
gaugaugagauaaggauaacuu

SEQ ID NO: 696878 - RNA, 22 nt, Human
uggcagauaaaauaauagggaa

SEQ ID NO: 696879 - RNA, 22 nt, Human
uuuggcuugcacuggcaccaac

SEQ ID NO: 696880 - RNA, 22 nt, Human
acagucuacuugagcuuguaua

SEQ ID NO: 696881 - RNA, 22 nt, Human
ggcagcuucucccaggcuguuu

SEQ ID NO: 696882 - RNA, 22 nt, Human
gaauacauggcagggagucauc

SEQ ID NO: 696883 - RNA, 22 nt, Human
gucuucaguggcaaauggaucu

SEQ ID NO: 696884 - RNA, 22 nt, Human
auuucaggauagccuaguuuug

SEQ ID NO: 696885 - RNA, 22 nt, Human
acagaggacaacuaggcgcuca

SEQ ID NO: 696886 - RNA, 20 nt, Human
ucccucaguccuggcuuugu

SEQ ID NO: 696887 - RNA, 22 nt, Human
uuauacagggaguuucccugca

SEQ ID NO: 696888 - RNA, 22 nt, Human
agucagucaaaauauaaauugu

SEQ ID NO: 696889 - RNA, 22 nt, Human
aggcuacagccucaagagugca

SEQ ID NO: 696890 - RNA, 21 nt, Human
acuuucuguggguucaagcau

SEQ ID NO: 696891 - RNA, 22 nt, Human
uucugauaauaccacaucgcag

SEQ ID NO: 696892 - RNA, 22 nt, Human
agucuguguaccuuuggccuuc

SEQ ID NO: 696893 - RNA, 22 nt, Human
uaaauuacucaaugcacauaaa

SEQ ID NO: 696894 - RNA, 22 nt, Human
ugggcugcacugcucuuuaucg

SEQ ID NO: 696895 - RNA, 22 nt, Human
uccugggucugggugucugagg

SEQ ID NO: 696896 - RNA, 22 nt, Human
gagguauuuuugcaugccugau

SEQ ID NO: 696897 - RNA, 22 nt, Human
ucaugcaucugggcuggcuggu

SEQ ID NO: 696898 - RNA, 22 nt, Human
ggcucugccacuucuuggcugu

SEQ ID NO: 696899 - RNA, 22 nt, Human
uacaucaaggaacaccugguau

SEQ ID NO: 696900 - RNA, 22 nt, Human
uuuuauugggaguccucuacug

SEQ ID NO: 696901 - RNA, 22 nt, Human
ugcagcugugaaagggaaccaa

SEQ ID NO: 696902 - RNA, 23 nt, Human
uuucacagcuuuuauucugcauc

SEQ ID NO: 696903 - RNA, 22 nt, Human
gacuguggcugcguguaaggaa

SEQ ID NO: 696904 - RNA, 22 nt, Human
caguuuuauacacugcagcucc

SEQ ID NO: 696905 - RNA, 22 nt, Human
cuuuauguccaccagacugcaa

SEQ ID NO: 696906 - RNA, 22 nt, Human
guuuuacaaaugacggcauuca

SEQ ID NO: 696907 - RNA, 22 nt, Human
agcaggaaggggccuagccugg

SEQ ID NO: 696908 - RNA, 21 nt, Human
ugcagcagaagucucuguguc

SEQ ID NO: 696909 - RNA, 17 nt, Human
caggaaaauaugaguga

SEQ ID NO: 696910 - RNA, 22 nt, Human
cugcccuggccacugugcccag

SEQ ID NO: 696911 - RNA, 22 nt, Human
guuaugaagucauucacaaaua

SEQ ID NO: 696912 - RNA, 22 nt, Human
agugggagcggcagucggggac

SEQ ID NO: 696913 - RNA, 22 nt, Human
auucaguuucaaucauuguagu

SEQ ID NO: 696914 - RNA, 22 nt, Human
uaugaagauugcggucuggaau

SEQ ID NO: 696915 - RNA, 22 nt, Human
gucaagcagaagauaauuuaaa

SEQ ID NO: 696916 - RNA, 22 nt, Human
ucaaagacuauauauuuuauuu

SEQ ID NO: 696917 - RNA, 22 nt, Human
uggcuggacagugggcagugga

SEQ ID NO: 696918 - RNA, 22 nt, Human
cuuggcugucuauaggaaagag

SEQ ID NO: 696919 - RNA, 22 nt, Human
ugagagcugggaaauguuagcu

SEQ ID NO: 696920 - RNA, 22 nt, Human
uuggcaguaaaagaaaaugcuu

SEQ ID NO: 696921 - RNA, 21 nt, Human
ucccacugccacagcuucagg

SEQ ID NO: 696922 - RNA, 22 nt, Human
cuagguggugguggguugacau

SEQ ID NO: 696923 - RNA, 22 nt, Human
guccuuaaagagagcaucauuc

SEQ ID NO: 696924 - RNA, 22 nt, Human
aagacacacacauaugcugagu

SEQ ID NO: 696925 - RNA, 22 nt, Human
cauuuguauguuccuccuuagg

SEQ ID NO: 696926 - RNA, 22 nt, Human
cuuccucuguguccugggcuuc

SEQ ID NO: 696927 - RNA, 22 nt, Human
uggacagguuugggugccuguu

SEQ ID NO: 696928 - RNA, 22 nt, Human
aaacacugguaugauguauagu

SEQ ID NO: 696929 - RNA, 22 nt, Human
uuuaaagaaauuccucaucuuu

SEQ ID NO: 696930 - RNA, 22 nt, Human
uuguuuguaugcugagaagaau

SEQ ID NO: 696931 - RNA, 22 nt, Human
augugguugaagaauuacaucu

SEQ ID NO: 696932 - RNA, 22 nt, Human
uuuaaugugagucccuuucaag

SEQ ID NO: 696933 - RNA, 22 nt, Human
uggcuuccugcauggauccucu

SEQ ID NO: 696934 - RNA, 22 nt, Human
caggccagcggcccgcgcguuc

SEQ ID NO: 696935 - RNA, 22 nt, Human
ggcacagcgacuaccaucgaaa

SEQ ID NO: 696936 - RNA, 22 nt, Human
uucuaagagaguacaagcaauu

SEQ ID NO: 696937 - RNA, 22 nt, Human
gagugcugcuugggauagugag

SEQ ID NO: 696938 - RNA, 22 nt, Human
gagaaaagcgaaggaccuggag

SEQ ID NO: 696939 - RNA, 22 nt, Human
auguggcugccaccugccugaa

SEQ ID NO: 696940 - RNA, 22 nt, Human
uggcugugucccuguccagagu

SEQ ID NO: 696941 - RNA, 22 nt, Human
cacuugggagcauugcacaugu

SEQ ID NO: 696942 - RNA, 22 nt, Human
agagagguuugcuggaagauuc

SEQ ID NO: 696943 - RNA, 22 nt, Human
caaauagugucacauugugagg

SEQ ID NO: 696944 - RNA, 22 nt, Human
uagaucaagaauguccacuugu

SEQ ID NO: 696945 - RNA, 22 nt, Human
gaugcaaaaguaucauuuuaau

SEQ ID NO: 696946 - RNA, 22 nt, Human
gcagcuuuaaucugaauaagua

SEQ ID NO: 696947 - RNA, 22 nt, Human
cucuucuuuccaucccuagcca

SEQ ID NO: 696948 - RNA, 22 nt, Human
aaguuuggaaugauagagaccu

SEQ ID NO: 696949 - RNA, 22 nt, Human
uuuugauaucaugaugaacaga

SEQ ID NO: 696950 - RNA, 22 nt, Human
uccucugcuggaagggcaagag

SEQ ID NO: 696951 - RNA, 22 nt, Human
agcccuccuuuguucaugcugc

SEQ ID NO: 696952 - RNA, 22 nt, Human
ugugccugucacccucagagag

SEQ ID NO: 696953 - RNA, 22 nt, Human
guccucuuagccacuuaauuau

SEQ ID NO: 696954 - RNA, 22 nt, Human
ugagcugggcugggcugagcug

SEQ ID NO: 696955 - RNA, 22 nt, Human
uuuccaaagguggcaggaacaa

SEQ ID NO: 696956 - RNA, 22 nt, Human
aagaauguggcauuuauuuaua

SEQ ID NO: 696957 - RNA, 22 nt, Human
uaaugcauguaaugggcugaua

SEQ ID NO: 696958 - RNA, 22 nt, Human
agccuaggagguuggggcugca

SEQ ID NO: 696959 - RNA, 18 nt, Human
cauuguacaaugcuuuau

SEQ ID NO: 696960 - RNA, 22 nt, Human
gggacaucuuucuagucagggu

SEQ ID NO: 696961 - RNA, 22 nt, Human
ugagcaauaugugaauuuucuu

SEQ ID NO: 696962 - RNA, 22 nt, Human
aagugguguguuggaagaaauc

SEQ ID NO: 696963 - RNA, 22 nt, Human
cccagguggguuggccucuguc

SEQ ID NO: 696964 - RNA, 22 nt, Human
ugcagggcuauaacuccauucu

SEQ ID NO: 696965 - RNA, 22 nt, Human
uuugauucuaaguucugucaac

SEQ ID NO: 696966 - RNA, 22 nt, Human
uaauaucuggcauucaaacaug

SEQ ID NO: 696967 - RNA, 18 nt, Human
cccagcuccacuucccuc

SEQ ID NO: 696968 - RNA, 22 nt, Human
uccucccugggagcuucugagu

SEQ ID NO: 696969 - RNA, 22 nt, Human
ggagggcugagacuggggucug

SEQ ID NO: 696970 - RNA, 22 nt, Human
ccuggcagacagcacugaagcu

SEQ ID NO: 696971 - RNA, 22 nt, Human
uuuacagcuacuguccuauuuc

SEQ ID NO: 696972 - RNA, 22 nt, Human
agcaguuauauugaaauaaaaa

SEQ ID NO: 696973 - RNA, 22 nt, Human
gagacaaaaguuggagugcaag

SEQ ID NO: 696974 - RNA, 22 nt, Human
aaucuguuugaugcuugugaua

SEQ ID NO: 696975 - RNA, 22 nt, Human
cccuggcacuagcgacggccau

SEQ ID NO: 696976 - RNA, 19 nt, Human
aagggucacaagcagcaga

SEQ ID NO: 696977 - RNA, 22 nt, Human
ucugacuuuucucacuguugug

SEQ ID NO: 696978 - RNA, 22 nt, Human
aaaagguaguugccaaauaagg

SEQ ID NO: 696979 - RNA, 22 nt, Human
ucacagagaacuauaauccauc

SEQ ID NO: 696980 - RNA, 22 nt, Human
uggcaagagggaugcaagguuu

SEQ ID NO: 696981 - RNA, 22 nt, Human
cagggagaggccucuguugccc

SEQ ID NO: 696982 - RNA, 22 nt, Human
guccacucccagugccugaggc

SEQ ID NO: 696983 - RNA, 22 nt, Human
uucugggcagagcuggagcugc

SEQ ID NO: 696984 - RNA, 22 nt, Human
cagcagagcugggcuuugaauu

SEQ ID NO: 696985 - RNA, 22 nt, Human
acauguaaacauuuacaguauu

SEQ ID NO: 696986 - RNA, 22 nt, Human
ugucccucauugacgcugugcc

SEQ ID NO: 696987 - RNA, 22 nt, Human
uggcccuguggcuucagaacag

SEQ ID NO: 696988 - RNA, 22 nt, Human
guguauaacuaucuaucuagua

SEQ ID NO: 696989 - RNA, 22 nt, Human
agagccugggcagcuccucugg

SEQ ID NO: 696990 - RNA, 20 nt, Human
cugagagucugugcuuaguc

SEQ ID NO: 696991 - RNA, 22 nt, Human
uacauugugauguuucaauaca

SEQ ID NO: 696992 - RNA, 22 nt, Human
uccagggaugguaaugagcagu

SEQ ID NO: 696993 - RNA, 22 nt, Human
uaugacaagaaauacagaggua

SEQ ID NO: 696994 - RNA, 22 nt, Human
gugacugugaucuuauuugcaa

SEQ ID NO: 696995 - RNA, 22 nt, Human
ccauauuugcuucuugcugaua

SEQ ID NO: 696996 - RNA, 22 nt, Human
cuccagcuuuagcucuccaggg

SEQ ID NO: 696997 - RNA, 23 nt, Human
cauuucugggagauuuauaaaau

SEQ ID NO: 696998 - RNA, 22 nt, Human
aaucaagagcugacuauauuuu

SEQ ID NO: 696999 - RNA, 22 nt, Human
uccagggcugacuugggagagg

SEQ ID NO: 697000 - RNA, 22 nt, Human
augcauaagugcagcagauuug

SEQ ID NO: 697001 - RNA, 22 nt, Human
auuauuuuaugugcggccugau

SEQ ID NO: 697002 - RNA, 22 nt, Human
uaccauuuacuugaaaauaaaa

SEQ ID NO: 697003 - RNA, 22 nt, Human
acucucuugggggagagcagag

SEQ ID NO: 697004 - RNA, 22 nt, Human
uuuaucuauuguauuguugaug

SEQ ID NO: 697005 - RNA, 22 nt, Human
gcaggcaggcuuccuugaacug

SEQ ID NO: 697006 - RNA, 22 nt, Human
ucucauguauugcccuggugug

SEQ ID NO: 697007 - RNA, 22 nt, Human
agggaagcagcagccgccuguc

SEQ ID NO: 697008 - RNA, 22 nt, Human
gaggcucccucaacucugggug

SEQ ID NO: 697009 - RNA, 22 nt, Human
agaauuuguaaaagauaagaca

SEQ ID NO: 697010 - RNA, 22 nt, Human
uaaguucagaguucucauuugu

SEQ ID NO: 697011 - RNA, 22 nt, Human
gcacugcagccucagauggugg

SEQ ID NO: 697012 - RNA, 17 nt, Human
gcuuuggaaggguagac

SEQ ID NO: 697013 - RNA, 22 nt, Human
uuuccuaacacaaugcaugaga

SEQ ID NO: 697014 - RNA, 22 nt, Human
ggccucaguuucuccauggguu

SEQ ID NO: 697015 - RNA, 22 nt, Human
cacagugaauuacauagacgug

SEQ ID NO: 697016 - RNA, 22 nt, Human
acagucauagcagccuuuguua

SEQ ID NO: 697017 - RNA, 22 nt, Human
uaugagaacaagaacaaucucc

SEQ ID NO: 697018 - RNA, 22 nt, Human
uuagacaucaagaagccaaugu

SEQ ID NO: 697019 - RNA, 22 nt, Human
gcccaggauucuuucuuccuua

SEQ ID NO: 697020 - RNA, 22 nt, Human
auggaggugccaggugugaggg

SEQ ID NO: 697021 - RNA, 22 nt, Human
ccucacugaagaggugacauuu

SEQ ID NO: 697022 - RNA, 22 nt, Human
uuccaaggcccagcagagagga

SEQ ID NO: 697023 - RNA, 22 nt, Human
agucaacacauuaaaccuaggg

SEQ ID NO: 697024 - RNA, 22 nt, Human
ucaagagacaggacguguuuca

SEQ ID NO: 697025 - RNA, 22 nt, Human
augcuuccaacaguucugugaa

SEQ ID NO: 697026 - RNA, 22 nt, Human
ggaagcugugcucucaggccuc

SEQ ID NO: 697027 - RNA, 22 nt, Human
auucaguguuugcagcaacuuu

SEQ ID NO: 697028 - RNA, 22 nt, Human
cagcauggcuugaguguuuccu

SEQ ID NO: 697029 - RNA, 22 nt, Human
uguaaaguccaagaucaaagag

SEQ ID NO: 697030 - RNA, 22 nt, Human
agaagagaacugccaaacacuu

SEQ ID NO: 697031 - RNA, 22 nt, Human
uggccuuggcagugagaagagu

SEQ ID NO: 697032 - RNA, 22 nt, Human
caguggaauauauaggggauuu

SEQ ID NO: 697033 - RNA, 16 nt, Human
gugcaaaagugaggag

SEQ ID NO: 697034 - RNA, 22 nt, Human
cccuggccuccaggcaguccug

SEQ ID NO: 697035 - RNA, 22 nt, Human
guugucuuagucagaaauaugc

SEQ ID NO: 697036 - RNA, 22 nt, Human
ucaggacacccugugcuuccuu

SEQ ID NO: 697037 - RNA, 22 nt, Human
gggagcucucccugaggccugg

SEQ ID NO: 697038 - RNA, 22 nt, Human
acccugccaaggauggccccga

SEQ ID NO: 697039 - RNA, 22 nt, Human
ggcuauccauggaucugaacuc

SEQ ID NO: 697040 - RNA, 22 nt, Human
uucuaauacacgguaugacuuu

SEQ ID NO: 697041 - RNA, 23 nt, Human
uuuuccuuuggacaggcuguauu

SEQ ID NO: 697042 - RNA, 22 nt, Human
cuggguuccauguagccaagag

SEQ ID NO: 697043 - RNA, 22 nt, Human
uggucugagcggggccauucag

SEQ ID NO: 697044 - RNA, 22 nt, Human
gaaagggaguggacaacaggca

SEQ ID NO: 697045 - RNA, 22 nt, Human
ucagugcagaauagugaugcau

SEQ ID NO: 697046 - RNA, 22 nt, Human
uuauacauguguuuugagauga

SEQ ID NO: 697047 - RNA, 22 nt, Human
cuuaucugagaaagaugcuaca

SEQ ID NO: 697048 - RNA, 22 nt, Human
auauggagaacucaaaaaguga

SEQ ID NO: 697049 - RNA, 22 nt, Human
caugagugaguaucucaagaua

SEQ ID NO: 697050 - RNA, 22 nt, Human
agaagcuugaaggagcagugac

SEQ ID NO: 697051 - RNA, 22 nt, Human
cauaauccugguguagcccucu

SEQ ID NO: 697052 - RNA, 22 nt, Human
gagcucaggagcaucagaagaa

SEQ ID NO: 697053 - RNA, 22 nt, Human
uccugggauuaagguggugauu

SEQ ID NO: 697054 - RNA, 19 nt, Human
caggaaggggcgaaucugg

SEQ ID NO: 697055 - RNA, 22 nt, Human
ugcaggccuaugguggggcccc

SEQ ID NO: 697056 - RNA, 22 nt, Human
uuccaugaagggcagccucuca

SEQ ID NO: 697057 - RNA, 22 nt, Human
uacuuuaucagcgucaaaggua

SEQ ID NO: 697058 - RNA, 22 nt, Human
aaugucaaagugcuuugcaaac

SEQ ID NO: 697059 - RNA, 22 nt, Human
uauucucuccccaaucuugcuu

SEQ ID NO: 697060 - RNA, 22 nt, Human
guugaggagguucagggugguu

SEQ ID NO: 697061 - RNA, 22 nt, Human
guuuccuuuuggaauuagagcu

SEQ ID NO: 697062 - RNA, 22 nt, Human
gagaaagaugaagaguggcguu

SEQ ID NO: 697063 - RNA, 22 nt, Human
ucugagagguuaagcaauuuga

SEQ ID NO: 697064 - RNA, 22 nt, Human
ccggcucggcgaccaggcugaa

SEQ ID NO: 697065 - RNA, 22 nt, Human
gcccugcuucuggcaugcagaa

SEQ ID NO: 697066 - RNA, 17 nt, Human
acacagccagguucucc

SEQ ID NO: 697067 - RNA, 22 nt, Human
ucaguaucaugcgguagccaug

SEQ ID NO: 697068 - RNA, 22 nt, Human
gggcugcguguggaggauguaa

SEQ ID NO: 697069 - RNA, 22 nt, Human
ugguggcaaaagaggcaaagug

SEQ ID NO: 697070 - RNA, 22 nt, Human
gcaaagucugcaucuggaucag

SEQ ID NO: 697071 - RNA, 17 nt, Human
auggcucaccugugggc

SEQ ID NO: 697072 - RNA, 22 nt, Human
acagcucauuuguaaaacggag

SEQ ID NO: 697073 - RNA, 18 nt, Human
ggaaaccacaggguucug

SEQ ID NO: 697074 - RNA, 22 nt, Human
cucugagaggugagaagcagca

SEQ ID NO: 697075 - RNA, 22 nt, Human
aaagggaaguugcacauguucc

SEQ ID NO: 697076 - RNA, 22 nt, Human
cgaugggggcaguguuacauug

SEQ ID NO: 697077 - RNA, 22 nt, Human
ccugagcuugauccuucugucu

SEQ ID NO: 697078 - RNA, 19 nt, Human
uccagaugauauggauuac

SEQ ID NO: 697079 - RNA, 19 nt, Human
ccuguguugggagugugag

SEQ ID NO: 697080 - RNA, 22 nt, Human
gaaacuuucaugaauauaagau

SEQ ID NO: 697081 - RNA, 22 nt, Human
augcacaggaccacacauaaug

SEQ ID NO: 697082 - RNA, 22 nt, Human
ggcaguuucaucaggagaaaag

SEQ ID NO: 697083 - RNA, 22 nt, Human
aaaguacagauggugagguugg

SEQ ID NO: 697084 - RNA, 19 nt, Human
cccuggagaauacccugga

SEQ ID NO: 697085 - RNA, 22 nt, Human
uucuguaggcauggaacaggga

SEQ ID NO: 697086 - RNA, 22 nt, Human
cccuguggugacaggccugucu

SEQ ID NO: 697087 - RNA, 22 nt, Human
gcacaggcaauagauacagcua

SEQ ID NO: 697088 - RNA, 22 nt, Human
aggcacugugcugaugucuuau

SEQ ID NO: 697089 - RNA, 22 nt, Human
gaagugggcuuuguggucagcu

SEQ ID NO: 697090 - RNA, 22 nt, Human
cagcacaguuugcuuggcagag

SEQ ID NO: 697091 - RNA, 22 nt, Human
aauucacaaaaccagauugcuu

SEQ ID NO: 697092 - RNA, 22 nt, Human
ggugugggagagauucuuuccu

SEQ ID NO: 697093 - RNA, 17 nt, Human
gucugggcuuuagagac

SEQ ID NO: 697094 - RNA, 22 nt, Human
uuccuucuggaagcuucagggg

SEQ ID NO: 697095 - RNA, 19 nt, Human
uggcagaggcaguuuguac

SEQ ID NO: 697096 - RNA, 22 nt, Human
gggccagagcuuggcagcuggg

SEQ ID NO: 697097 - RNA, 22 nt, Human
ugcagcaucuccuuaaaucuug

SEQ ID NO: 697098 - RNA, 22 nt, Human
ggaaaggagauauuggagagug

SEQ ID NO: 697099 - RNA, 21 nt, Human
aagaacuauugagguacacag

SEQ ID NO: 697100 - RNA, 22 nt, Human
cuggaagguuccucccagcucc

SEQ ID NO: 697101 - RNA, 22 nt, Human
cacauggguggauggaugcaug

SEQ ID NO: 697102 - RNA, 22 nt, Human
ggagguucucucuuugcagagc

SEQ ID NO: 697103 - RNA, 22 nt, Human
ugugacuggcagaggugucugg

SEQ ID NO: 697104 - RNA, 20 nt, Human
ucauauuuuugcccugggcc

SEQ ID NO: 697105 - RNA, 23 nt, Human
accaugaugggagugcaaauaag

SEQ ID NO: 697106 - RNA, 22 nt, Human
agcuccugcaccaggggccccu

SEQ ID NO: 697107 - RNA, 22 nt, Human
cuguuuccauacagguuuuugg

SEQ ID NO: 697108 - RNA, 21 nt, Human
ugaggcuguuguaccagggag

SEQ ID NO: 697109 - RNA, 22 nt, Human
gucuuauuuaaagagaucauac

SEQ ID NO: 697110 - RNA, 22 nt, Human
agaucacuuugaugcuaccugg

SEQ ID NO: 697111 - RNA, 22 nt, Human
gauacacuggccaaguggagga

SEQ ID NO: 697112 - RNA, 22 nt, Human
gacugagaaucauagaaggcaa

SEQ ID NO: 697113 - RNA, 22 nt, Human
uucacaggaauguaggggucuu

SEQ ID NO: 697114 - RNA, 22 nt, Human
cagcagccugccuugggagcuu

SEQ ID NO: 697115 - RNA, 22 nt, Human
gagcccagcuguccuuggcaaa

SEQ ID NO: 697116 - RNA, 22 nt, Human
ugaaaauuuccaucaguuauau

SEQ ID NO: 697117 - RNA, 22 nt, Human
augugucuaauuccaggagcac

SEQ ID NO: 697118 - RNA, 18 nt, Human
gcagccccucuuccuucc

SEQ ID NO: 697119 - RNA, 22 nt, Human
uaaaugucuuugucacguuggg

SEQ ID NO: 697120 - RNA, 22 nt, Human
uggccagaguccagugagccuu

SEQ ID NO: 697121 - RNA, 22 nt, Human
ugaguacucggagugcuuugga

SEQ ID NO: 697122 - RNA, 20 nt, Human
gucuacacgggcaguguaga

SEQ ID NO: 697123 - RNA, 22 nt, Human
uacagccuguuaccuauauuug

SEQ ID NO: 697124 - RNA, 22 nt, Human
ucagcuuuccugcagcuaaggg

SEQ ID NO: 697125 - RNA, 22 nt, Human
caaagcuauaaauucagacaga

SEQ ID NO: 697126 - RNA, 22 nt, Human
ugagggguugugagaaauguag

SEQ ID NO: 697127 - RNA, 22 nt, Human
gcagcagccacuauucuggcau

SEQ ID NO: 697128 - RNA, 22 nt, Human
gcagcccucgcuagcucucccc

SEQ ID NO: 697129 - RNA, 22 nt, Human
aaaugccuauuuguuccuucag

SEQ ID NO: 697130 - RNA, 22 nt, Human
ccugaaacaucuucuguaaaua

SEQ ID NO: 697131 - RNA, 22 nt, Human
uugcccagaguccacagcguac

SEQ ID NO: 697132 - RNA, 20 nt, Human
aaagugcacagauacagcuc

SEQ ID NO: 697133 - RNA, 22 nt, Human
cagucucagaggugggaguggg

SEQ ID NO: 697134 - RNA, 22 nt, Human
ucucagaaaugacaggagguac

SEQ ID NO: 697135 - RNA, 22 nt, Human
ugucucaguauacgaaacacuu

SEQ ID NO: 697136 - RNA, 22 nt, Human
uccaggagucagacagauggug

SEQ ID NO: 697137 - RNA, 22 nt, Human
cuucuucuggacaggcagcucc

SEQ ID NO: 697138 - RNA, 20 nt, Human
auguuuuauaaaagaacggg

SEQ ID NO: 697139 - RNA, 23 nt, Human
ccucaaauguagccuuuuuccca

SEQ ID NO: 697140 - RNA, 21 nt, Human
gggucugaauaucuggugcug

SEQ ID NO: 697141 - RNA, 22 nt, Human
cucuugcagauaccuugaagga

SEQ ID NO: 697142 - RNA, 22 nt, Human
cccagccuggugcacugugggg

SEQ ID NO: 697143 - RNA, 21 nt, Human
caggcucugcuagaggagccu

SEQ ID NO: 697144 - RNA, 22 nt, Human
cagguagggauaugauggugau

SEQ ID NO: 697145 - RNA, 22 nt, Human
ccagguggacggcgaguacagg

SEQ ID NO: 697146 - RNA, 20 nt, Human
ucccaaaauucuacuuuauc

SEQ ID NO: 697147 - RNA, 22 nt, Human
uguguugugucaccuaucaugc

SEQ ID NO: 697148 - RNA, 22 nt, Human
ugacaguguuugcacuucaggu

SEQ ID NO: 697149 - RNA, 22 nt, Human
agagcccuuucuccaggcaccu

SEQ ID NO: 697150 - RNA, 22 nt, Human
ugggagcagccaacauggccuu

SEQ ID NO: 697151 - RNA, 20 nt, Human
gaaaucaguuaaugaugguu

SEQ ID NO: 697152 - RNA, 22 nt, Human
aucuaaaaggagcucuuuaucu

SEQ ID NO: 697153 - RNA, 17 nt, Human
aagagguaacuguacua

SEQ ID NO: 697154 - RNA, 22 nt, Human
ucacagugcaccccucacaggg

SEQ ID NO: 697155 - RNA, 22 nt, Human
cagggcuugccuugccccggcg

SEQ ID NO: 697156 - RNA, 22 nt, Human
ccugaagggacuccagagagca

SEQ ID NO: 697157 - RNA, 22 nt, Human
caguggcuucuuccuagagcca

SEQ ID NO: 697158 - RNA, 22 nt, Human
auaagguaugaaaaguaaaugg

SEQ ID NO: 697159 - RNA, 22 nt, Human
gagagcuggguucaaguagcug

SEQ ID NO: 697160 - RNA, 22 nt, Human
ucagugcauucauggguggcug

SEQ ID NO: 697161 - RNA, 22 nt, Human
ucaaaggcgguccaggaauaaa

SEQ ID NO: 697162 - RNA, 22 nt, Human
cuggguucucugcuuagggccu

SEQ ID NO: 697163 - RNA, 22 nt, Human
uagcuauuuggaaaauuccaau

SEQ ID NO: 697164 - RNA, 22 nt, Human
uagaaauggggaaguaguuagg

SEQ ID NO: 697165 - RNA, 17 nt, Human
gcaggcacugcugccug

SEQ ID NO: 697166 - RNA, 22 nt, Human
auuuggauaucacugaauacau

SEQ ID NO: 697167 - RNA, 23 nt, Human
acagacauuccauaauguacacc

SEQ ID NO: 697168 - RNA, 22 nt, Human
acuuccugcagcuucucagccc

SEQ ID NO: 697169 - RNA, 19 nt, Human
aagcccaguguaugcucuu

SEQ ID NO: 697170 - RNA, 22 nt, Human
agccugcugggaagggaggcuu

SEQ ID NO: 697171 - RNA, 22 nt, Human
cuggcuucagcugccaucaaug

SEQ ID NO: 697172 - RNA, 22 nt, Human
uucacccaauauaacuagagga

SEQ ID NO: 697173 - RNA, 22 nt, Human
gaguucauauucagagaucgcu

SEQ ID NO: 697174 - RNA, 17 nt, Human
ggaaaaggaugauacag

SEQ ID NO: 697175 - RNA, 22 nt, Human
acuuuguugaagaauauguuag

SEQ ID NO: 697176 - RNA, 22 nt, Human
guucccacgccuccucuccagc

SEQ ID NO: 697177 - RNA, 22 nt, Human
gaucuguuucauucacagucug

SEQ ID NO: 697178 - RNA, 22 nt, Human
aaagcugucaaggcaggaggcu

SEQ ID NO: 697179 - RNA, 22 nt, Human
cuggucccuggaccucccugga

SEQ ID NO: 697180 - RNA, 22 nt, Human
cugaauuaagcauuacauacau

SEQ ID NO: 697181 - RNA, 19 nt, Human
ugcaagcuuuuucuuguua

SEQ ID NO: 697182 - RNA, 22 nt, Human
aaggucauugguucugaauucu

SEQ ID NO: 697183 - RNA, 22 nt, Human
uggcccaggggcucuugguguu

SEQ ID NO: 697184 - RNA, 22 nt, Human
gcugcugagaauugcaggcaag

SEQ ID NO: 697185 - RNA, 22 nt, Human
uuuauacuucauaaugucuauu

SEQ ID NO: 697186 - RNA, 22 nt, Human
gaggaagggacuuuauuaucug

SEQ ID NO: 697187 - RNA, 22 nt, Human
ggucaaaguugaagaagggcau

SEQ ID NO: 697188 - RNA, 22 nt, Human
uacagcaaugcuacaagaugac

SEQ ID NO: 697189 - RNA, 22 nt, Human
caguggcagagaacagagaccu

SEQ ID NO: 697190 - RNA, 22 nt, Human
agcuucugcccguguuugcucu

SEQ ID NO: 697191 - RNA, 18 nt, Human
agcuccaucugucagcau

SEQ ID NO: 697192 - RNA, 22 nt, Human
uguuugcuaggguugguauuua

SEQ ID NO: 697193 - RNA, 22 nt, Human
uacuccagacauucuguccucg

SEQ ID NO: 697194 - RNA, 22 nt, Human
ugugguuuuucaguugcuggag

SEQ ID NO: 697195 - RNA, 22 nt, Human
uugucugaaccaucucccuggc

SEQ ID NO: 697196 - RNA, 22 nt, Human
cucugggcaggaccaguggacc

SEQ ID NO: 697197 - RNA, 22 nt, Human
uuucugauauucauuuagaaga

SEQ ID NO: 697198 - RNA, 22 nt, Human
gucacaugccagugcacacagg

SEQ ID NO: 697199 - RNA, 22 nt, Human
ucuuuccaaggacucuguagca

SEQ ID NO: 697200 - RNA, 22 nt, Human
aggagaguaccauugggccgca

SEQ ID NO: 697201 - RNA, 20 nt, Human
acaucaacuagucacagaca

SEQ ID NO: 697202 - RNA, 22 nt, Human
ggcugccucugaugugcagacg

SEQ ID NO: 697203 - RNA, 22 nt, Human
gccaaaguccuccagccaugca

SEQ ID NO: 697204 - RNA, 22 nt, Human
augugcuucaggaugucagugu

SEQ ID NO: 697205 - RNA, 21 nt, Human
ugaguuaaaaugucagugcca

SEQ ID NO: 697206 - RNA, 22 nt, Human
acucagcugaugaagcacaagu

SEQ ID NO: 697207 - RNA, 22 nt, Human
uaagaaauuuaguuauagaaug

SEQ ID NO: 697208 - RNA, 22 nt, Human
ucaaaugcaccucucauuuguu

SEQ ID NO: 697209 - RNA, 23 nt, Human
cugaggggaaaagggcuucaggc

SEQ ID NO: 697210 - RNA, 22 nt, Human
cuugggcucugugggccuuagu

SEQ ID NO: 697211 - RNA, 22 nt, Human
uacagugauuucuacugguguu

SEQ ID NO: 697212 - RNA, 17 nt, Human
aggcagcucagaacauc

SEQ ID NO: 697213 - RNA, 22 nt, Human
uucuucuuuccaauuacauggu

SEQ ID NO: 697214 - RNA, 22 nt, Human
caugaaaaugucaaguucugcu

SEQ ID NO: 697215 - RNA, 22 nt, Human
aagcccugauaggaaaaugcug

SEQ ID NO: 697216 - RNA, 22 nt, Human
acaggcaggagcuccccauucc

SEQ ID NO: 697217 - RNA, 19 nt, Human
guggccagggcaggggcug

SEQ ID NO: 697218 - RNA, 22 nt, Human
acaaugaagauaauguugcagu

SEQ ID NO: 697219 - RNA, 22 nt, Human
aggcugggaaaccugaaguugu

SEQ ID NO: 697220 - RNA, 21 nt, Human
acacagaggcaucaucacuuu

SEQ ID NO: 697221 - RNA, 22 nt, Human
gaggacugcagaugggugcauc

SEQ ID NO: 697222 - RNA, 22 nt, Human
aaaaccacaauuauuuuugcac

SEQ ID NO: 697223 - RNA, 22 nt, Human
ccuggccagaggcgugccugug

SEQ ID NO: 697224 - RNA, 22 nt, Human
ucauuuuuagcgcgcaaaaguu

SEQ ID NO: 697225 - RNA, 22 nt, Human
agagcuguuuggacaucugagu

SEQ ID NO: 697226 - RNA, 18 nt, Human
uucacaagggcuugguuu

SEQ ID NO: 697227 - RNA, 22 nt, Human
uaaauguagucaaaggagccuc

SEQ ID NO: 697228 - RNA, 22 nt, Human
aaauacaauuucaggcuguaau

SEQ ID NO: 697229 - RNA, 22 nt, Human
uggagcagaaauggccucuugu

SEQ ID NO: 697230 - RNA, 22 nt, Human
uaauugucagguuuuaguauca

SEQ ID NO: 697231 - RNA, 22 nt, Human
gcuuagaaguacacaugccuuu

SEQ ID NO: 697232 - RNA, 22 nt, Human
gcuccugcagagauguuccaug

SEQ ID NO: 697233 - RNA, 22 nt, Human
aagcuguguauuacagaauauu

SEQ ID NO: 697234 - RNA, 22 nt, Human
gguuuuaacuacagaauugcaa

SEQ ID NO: 697235 - RNA, 22 nt, Human
ucacacuuuccauggcuguuaa

SEQ ID NO: 697236 - RNA, 22 nt, Human
gaggcacagagcccuaggagcu

SEQ ID NO: 697237 - RNA, 22 nt, Human
ucuauguagugccagcuaguau

SEQ ID NO: 697238 - RNA, 21 nt, Human
aacaaagggaugcucaucuuu

SEQ ID NO: 697239 - RNA, 22 nt, Human
uauggcuuuuuauucaucuuac

SEQ ID NO: 697240 - RNA, 20 nt, Human
agucauuggguguccuucgg

SEQ ID NO: 697241 - RNA, 22 nt, Human
caggugacccucaguguggacu

SEQ ID NO: 697242 - RNA, 17 nt, Human
acacaucuuggcuuugc

SEQ ID NO: 697243 - RNA, 21 nt, Human
ucacacuugauuggcuuagac

SEQ ID NO: 697244 - RNA, 22 nt, Human
ccuguacacaauuccgaggaua

SEQ ID NO: 697245 - RNA, 22 nt, Human
uucauucagcacauauuuauug

SEQ ID NO: 697246 - RNA, 22 nt, Human
cucucuguuaugcuuucaugaa

SEQ ID NO: 697247 - RNA, 22 nt, Human
uugugaauagugccgcuauaaa

SEQ ID NO: 697248 - RNA, 22 nt, Human
aggcagguuucccggcugucaa

SEQ ID NO: 697249 - RNA, 22 nt, Human
gucccucucaaauuuauaugcu

SEQ ID NO: 697250 - RNA, 22 nt, Human
agggcuuugcaaugcacagugg

SEQ ID NO: 697251 - RNA, 22 nt, Human
agcugcaguuagccccagauga

SEQ ID NO: 697252 - RNA, 22 nt, Human
ggcaguguucugguugucagga

SEQ ID NO: 697253 - RNA, 22 nt, Human
cugccugcaucccacagugggg

SEQ ID NO: 697254 - RNA, 21 nt, Human
ugcugccauagaccugaggga

SEQ ID NO: 697255 - RNA, 22 nt, Human
ucugggaaggagccugagaauu

SEQ ID NO: 697256 - RNA, 22 nt, Human
uaaacaucugucauguguuuau

SEQ ID NO: 697257 - RNA, 22 nt, Human
cucucaguccugcgcgccucug

SEQ ID NO: 697258 - RNA, 22 nt, Human
aagauuguuuugggggaagugg

SEQ ID NO: 697259 - RNA, 22 nt, Human
gcagggcuaauggggcaaguag

SEQ ID NO: 697260 - RNA, 22 nt, Human
augaaagcaaauuauaggccau

SEQ ID NO: 697261 - RNA, 22 nt, Human
ggagcccucaccggcgagugcc

SEQ ID NO: 697262 - RNA, 22 nt, Human
aaguggagccagggaaacugaa

SEQ ID NO: 697263 - RNA, 22 nt, Human
ggugaggcuaagugacacaggg

SEQ ID NO: 697264 - RNA, 23 nt, Human
uggccuggagagaaaagaugagu

SEQ ID NO: 697265 - RNA, 22 nt, Human
aauccauuuacucuuuacaaga

SEQ ID NO: 697266 - RNA, 22 nt, Human
gaccuuccuucuuugcuccggg

SEQ ID NO: 697267 - RNA, 22 nt, Human
caugaguucaaaaugccugccu

SEQ ID NO: 697268 - RNA, 22 nt, Human
aguaaaguaccaaagugugagu

SEQ ID NO: 697269 - RNA, 22 nt, Human
guccagggaaauagcgacaggg

SEQ ID NO: 697270 - RNA, 22 nt, Human
aacaaauguguuuuguaauuaa

SEQ ID NO: 697271 - RNA, 22 nt, Human
uggcaccauguuggcaaauguu

SEQ ID NO: 697272 - RNA, 22 nt, Human
caugcucuagauucucucuaau

SEQ ID NO: 697273 - RNA, 22 nt, Human
uuacucagucucccauacauug

SEQ ID NO: 697274 - RNA, 22 nt, Human
uagaagcagcaggaguaaaggc

SEQ ID NO: 697275 - RNA, 22 nt, Human
auugcuucaacuguucaauggg

SEQ ID NO: 697276 - RNA, 22 nt, Human
ggacaguugguugggcucuugu

SEQ ID NO: 697277 - RNA, 22 nt, Human
ugagcuggcuugucaaccaggg

SEQ ID NO: 697278 - RNA, 22 nt, Human
guguuuauacagcaaagagcau

SEQ ID NO: 697279 - RNA, 22 nt, Human
ucagugugaggggcuggguccu

SEQ ID NO: 697280 - RNA, 22 nt, Human
aggauccugcgcuuugggggag

SEQ ID NO: 697281 - RNA, 21 nt, Human
uggcucuggguaggagagugc

SEQ ID NO: 697282 - RNA, 22 nt, Human
aggugcuuggcucgugcacaca

SEQ ID NO: 697283 - RNA, 21 nt, Human
aggucaaaggcauccaugagg

SEQ ID NO: 697284 - RNA, 22 nt, Human
acucauuuuauaacacuguagu

SEQ ID NO: 697285 - RNA, 22 nt, Human
uuggcacuuugaaugagcucag

SEQ ID NO: 697286 - RNA, 19 nt, Human
uuacuuggcaaagucaguc

SEQ ID NO: 697287 - RNA, 22 nt, Human
caggggcgguggcucacgccug

SEQ ID NO: 697288 - RNA, 22 nt, Human
cacaucugcucugggcagcacu

SEQ ID NO: 697289 - RNA, 22 nt, Human
aaauauuugucugaggcgguug

SEQ ID NO: 697290 - RNA, 22 nt, Human
aggcuggugauuagaagcagcc

SEQ ID NO: 697291 - RNA, 22 nt, Human
aagaugaugcagacuuugaugu

SEQ ID NO: 697292 - RNA, 21 nt, Human
uagcaucucuacugucauaga

SEQ ID NO: 697293 - RNA, 22 nt, Human
cagugguuuuauaucuaagcuu

SEQ ID NO: 697294 - RNA, 22 nt, Human
uaguuucuaaagcuuccuaggu

SEQ ID NO: 697295 - RNA, 22 nt, Human
ccauccauguggcagggcuggc

SEQ ID NO: 697296 - RNA, 22 nt, Human
ggagacaauggaggccaaaaga

SEQ ID NO: 697297 - RNA, 22 nt, Human
acauguggaggaggcgagggua

SEQ ID NO: 697298 - RNA, 22 nt, Human
cuugccucccucagcucacagc

SEQ ID NO: 697299 - RNA, 22 nt, Human
gagagcugcaagguagggcggg

SEQ ID NO: 697300 - RNA, 22 nt, Human
guaccugggggauccacuucuu

SEQ ID NO: 697301 - RNA, 22 nt, Human
ugaugaggaccuggucucugcu

SEQ ID NO: 697302 - RNA, 22 nt, Human
cuugauucucagaaugcuugcu

SEQ ID NO: 697303 - RNA, 22 nt, Human
gcucuguuaacaguccagcuuu

SEQ ID NO: 697304 - RNA, 21 nt, Human
uccaggaguggcugggcaggg

SEQ ID NO: 697305 - RNA, 19 nt, Human
aggcuuggaacagccuuau

SEQ ID NO: 697306 - RNA, 22 nt, Human
ggcugaggguuaagaucagaca

SEQ ID NO: 697307 - RNA, 22 nt, Human
ucucaggggcagugauccuaag

SEQ ID NO: 697308 - RNA, 23 nt, Human
cugcaauugccugaucucauugg

SEQ ID NO: 697309 - RNA, 22 nt, Human
aguggcagccgagcaggagaug

SEQ ID NO: 697310 - RNA, 18 nt, Human
ggcuccaggaccuaccca

SEQ ID NO: 697311 - RNA, 22 nt, Human
cuggcuuuagguuggagagcug

SEQ ID NO: 697312 - RNA, 22 nt, Human
uuuucuaacaucuaguaauuug

SEQ ID NO: 697313 - RNA, 22 nt, Human
uaagaaacaugauuaauggcag

SEQ ID NO: 697314 - RNA, 22 nt, Human
aggccagcauucucucuccagg

SEQ ID NO: 697315 - RNA, 22 nt, Human
uuuggccaugcucaaggguaua

SEQ ID NO: 697316 - RNA, 22 nt, Human
uugaaagugccaaguccuagug

SEQ ID NO: 697317 - RNA, 22 nt, Human
gcccaagagagcgaagguuggc

SEQ ID NO: 697318 - RNA, 22 nt, Human
aaggagacauuugcagagcacc

SEQ ID NO: 697319 - RNA, 22 nt, Human
gcguguaugcaggucugugcag

SEQ ID NO: 697320 - RNA, 22 nt, Human
gcagggcaaauguggaaaggag

SEQ ID NO: 697321 - RNA, 22 nt, Human
agucacugggcugcuuccuaua

SEQ ID NO: 697322 - RNA, 22 nt, Human
acugccuguagcucuucaucuc

SEQ ID NO: 697323 - RNA, 22 nt, Human
agagggguuaagugcuaguccg

SEQ ID NO: 697324 - RNA, 22 nt, Human
uuucaauugacuuuggaagaaa

SEQ ID NO: 697325 - RNA, 22 nt, Human
gcccuucaguuacuccuugaug

SEQ ID NO: 697326 - RNA, 22 nt, Human
uaucuguauccccaucuagcua

SEQ ID NO: 697327 - RNA, 22 nt, Human
uuuagccaaucagcuugggagc

SEQ ID NO: 697328 - RNA, 20 nt, Human
ucacagaaugccugaagaag

SEQ ID NO: 697329 - RNA, 19 nt, Human
uuucugcagcucagagaag

SEQ ID NO: 697330 - RNA, 22 nt, Human
uacauguauugauuucucuucu

SEQ ID NO: 697331 - RNA, 22 nt, Human
gcacauaacugaccacaucuaa

SEQ ID NO: 697332 - RNA, 22 nt, Human
cucugcaucagcuucauucugu

SEQ ID NO: 697333 - RNA, 23 nt, Human
ugagucuugagcuuuggauucug

SEQ ID NO: 697334 - RNA, 22 nt, Human
cuucuuuagggaucucuugcug

SEQ ID NO: 697335 - RNA, 22 nt, Human
uguguguaauguuucucucuuc

SEQ ID NO: 697336 - RNA, 22 nt, Human
gugcaguggcagauccuagcuc

SEQ ID NO: 697337 - RNA, 22 nt, Human
aaacacuucaaggacuucuguc

SEQ ID NO: 697338 - RNA, 22 nt, Human
uggcaugcacagcccuguucgg

SEQ ID NO: 697339 - RNA, 18 nt, Human
gaggaaacaaggcagagg

SEQ ID NO: 697340 - RNA, 22 nt, Human
uucaagcagagauauuucaaga

SEQ ID NO: 697341 - RNA, 22 nt, Human
ccugagggaggguauaggcugu

SEQ ID NO: 697342 - RNA, 23 nt, Human
uucagcaugaagagugaaggcug

SEQ ID NO: 697343 - RNA, 22 nt, Human
acucacugcacuuugaaaugug

SEQ ID NO: 697344 - RNA, 22 nt, Human
gggggagaagauucugcugcuu

SEQ ID NO: 697345 - RNA, 22 nt, Human
gagucugagucuaauggcccca

SEQ ID NO: 697346 - RNA, 22 nt, Human
ucucaucauuccuucaaagccc

SEQ ID NO: 697347 - RNA, 22 nt, Human
auacuuaugauaaauaauugcu

SEQ ID NO: 697348 - RNA, 22 nt, Human
cucuggaggcagcaccagccag

SEQ ID NO: 697349 - RNA, 22 nt, Human
agauuucugggcuucaccaccu

SEQ ID NO: 697350 - RNA, 22 nt, Human
uaaaugaagaaauggagauugu

SEQ ID NO: 697351 - RNA, 19 nt, Human
caugaugagcauccugcag

SEQ ID NO: 697352 - RNA, 22 nt, Human
acuugguggaacguguauuuua

SEQ ID NO: 697353 - RNA, 22 nt, Human
gagggccacguucagggcucuc

SEQ ID NO: 697354 - RNA, 22 nt, Human
cauaacaccugauggcaaugau

SEQ ID NO: 697355 - RNA, 22 nt, Human
ugaagaugucagcagggguggu

SEQ ID NO: 697356 - RNA, 22 nt, Human
gacauuggguguacaauuggca

SEQ ID NO: 697357 - RNA, 22 nt, Human
ccuggcagcuccuccccggcgg

SEQ ID NO: 697358 - RNA, 22 nt, Human
uaccaaagaauauuuuaaauag

SEQ ID NO: 697359 - RNA, 19 nt, Human
agccuggcuuugcucugcu

SEQ ID NO: 697360 - RNA, 22 nt, Human
aaggaggaauucugaguucaug

SEQ ID NO: 697361 - RNA, 22 nt, Human
agauguaccagguauuacagga

SEQ ID NO: 697362 - RNA, 22 nt, Human
aucuuugugaaucucaacuugg

SEQ ID NO: 697363 - RNA, 22 nt, Human
uaauccuggugaguuugaaaaa

SEQ ID NO: 697364 - RNA, 22 nt, Human
cacugugucaguuugguuagac

SEQ ID NO: 697365 - RNA, 22 nt, Human
ugccaccaggagaaccagugca

SEQ ID NO: 697366 - RNA, 22 nt, Human
ucccagcugagauugagcaagg

SEQ ID NO: 697367 - RNA, 22 nt, Human
cagcuauuuguaggaaaacugu

SEQ ID NO: 697368 - RNA, 22 nt, Human
ccugaccagagugagggcuuag

SEQ ID NO: 697369 - RNA, 22 nt, Human
ggcucgagcagcuguguaggau

SEQ ID NO: 697370 - RNA, 22 nt, Human
auaguauuuaauaguuagcuca

SEQ ID NO: 697371 - RNA, 17 nt, Human
caaggccagcaucuuca

SEQ ID NO: 697372 - RNA, 22 nt, Human
caggcuugagggcaggcccagu

SEQ ID NO: 697373 - RNA, 22 nt, Human
acaggcaccuccagggguaugu

SEQ ID NO: 697374 - RNA, 22 nt, Human
gguggcugcaauggcuaacuuc

SEQ ID NO: 697375 - RNA, 21 nt, Human
ggcagccugacccccagagag

SEQ ID NO: 697376 - RNA, 22 nt, Human
uuuccagugagcaaauguagaa

SEQ ID NO: 697377 - RNA, 22 nt, Human
cagggagcuggugccagccgac

SEQ ID NO: 697378 - RNA, 21 nt, Human
cagcccagcccauugacagug

SEQ ID NO: 697379 - RNA, 22 nt, Human
ugaugaccgccaacguuuaggu

SEQ ID NO: 697380 - RNA, 21 nt, Human
uggucugaaaguauuuguggc

SEQ ID NO: 697381 - RNA, 22 nt, Human
ugcagaggagcuggaaggcugg

SEQ ID NO: 697382 - RNA, 23 nt, Human
acaacuuuacagauacauuuugu

SEQ ID NO: 697383 - RNA, 22 nt, Human
cuggcuggucaugucaugagcc

SEQ ID NO: 697384 - RNA, 22 nt, Human
ggagcuggccgccuaugugcag

SEQ ID NO: 697385 - RNA, 22 nt, Human
ggccugcacagagguggcucua

SEQ ID NO: 697386 - RNA, 22 nt, Human
cagcaccauuugcagccucuuu

SEQ ID NO: 697387 - RNA, 22 nt, Human
caagggcaggagaggauggaug

SEQ ID NO: 697388 - RNA, 22 nt, Human
uacaguaggauuuucagggucu

SEQ ID NO: 697389 - RNA, 21 nt, Human
uccaggcuggaaggggcguug

SEQ ID NO: 697390 - RNA, 22 nt, Human
uccauguguuuuccuguccaca

SEQ ID NO: 697391 - RNA, 19 nt, Human
uacacuuguaaugagcaga

SEQ ID NO: 697392 - RNA, 22 nt, Human
auucuggauuaucaguccacca

SEQ ID NO: 697393 - RNA, 22 nt, Human
guguaucaaagcacagacuuca

SEQ ID NO: 697394 - RNA, 22 nt, Human
ucacagugaugacgugggagca

SEQ ID NO: 697395 - RNA, 22 nt, Human
acaggcagcccucucccugguu

SEQ ID NO: 697396 - RNA, 21 nt, Human
aggcucucauccagggaccca

SEQ ID NO: 697397 - RNA, 22 nt, Human
uuugcuauaaaagggucacacg

SEQ ID NO: 697398 - RNA, 22 nt, Human
agugcgugguuuacagcuaguu

SEQ ID NO: 697399 - RNA, 22 nt, Human
agucagauuuagauguagcaag

SEQ ID NO: 697400 - RNA, 22 nt, Human
ccagaggggugggccugguuua

SEQ ID NO: 697401 - RNA, 22 nt, Human
ugcauuguuuagaacucuuugg

SEQ ID NO: 697402 - RNA, 22 nt, Human
aagcaauguguuugaaaggcca

SEQ ID NO: 697403 - RNA, 22 nt, Human
acuugaauuuaguuuuuccuaa

SEQ ID NO: 697404 - RNA, 22 nt, Human
gagcagaacaggccggguggga

SEQ ID NO: 697405 - RNA, 22 nt, Human
acaguaaugauucugagucucu

SEQ ID NO: 697406 - RNA, 22 nt, Human
uaguuucuaaacugaacuguca

SEQ ID NO: 697407 - RNA, 22 nt, Human
cugugugccuagaggguggccg

SEQ ID NO: 697408 - RNA, 22 nt, Human
agcugggaggcuccucugugac

SEQ ID NO: 697409 - RNA, 22 nt, Human
cugggcugcgggcgccccucca

SEQ ID NO: 697410 - RNA, 18 nt, Human
gaagggcuuugaaguaga

SEQ ID NO: 697411 - RNA, 22 nt, Human
cacagggccuggggcagcugcu

SEQ ID NO: 697412 - RNA, 22 nt, Human
uucccacacaauuaagucauuu

SEQ ID NO: 697413 - RNA, 22 nt, Human
cccaucucagucgugcuaaggg

SEQ ID NO: 697414 - RNA, 21 nt, Human
cagcaaggaagucgaguaggu

SEQ ID NO: 697415 - RNA, 22 nt, Human
gaaagcacgauaguagcaaaag

SEQ ID NO: 697416 - RNA, 22 nt, Human
agcagagcauggugggaagggc

SEQ ID NO: 697417 - RNA, 22 nt, Human
agaggcggagcuugcagugagc

SEQ ID NO: 697418 - RNA, 22 nt, Human
aaacccugcccuucccaagaug

SEQ ID NO: 697419 - RNA, 22 nt, Human
ugacaaacccugcaaauagcuc

SEQ ID NO: 697420 - RNA, 21 nt, Human
uugccccugaguuuuucugag

SEQ ID NO: 697421 - RNA, 22 nt, Human
aauagacuccagggucuauuuu

SEQ ID NO: 697422 - RNA, 22 nt, Human
auggcuccagcuuggcuucacc

SEQ ID NO: 697423 - RNA, 22 nt, Human
gaaaauagcagauagaccaaug

SEQ ID NO: 697424 - RNA, 20 nt, Human
uucuuaaagaccucacuuug

SEQ ID NO: 697425 - RNA, 22 nt, Human
uuccaagugaaaguagcuuugu

SEQ ID NO: 697426 - RNA, 22 nt, Human
aacaugaaaguugcuaagugca

SEQ ID NO: 697427 - RNA, 22 nt, Human
auguuuauguugggcuauauuu

SEQ ID NO: 697428 - RNA, 22 nt, Human
gagccugaaauacaggucacug

SEQ ID NO: 697429 - RNA, 22 nt, Human
agcugcaggcccaugcucaguc

SEQ ID NO: 697430 - RNA, 22 nt, Human
ccagcuaguaagcaccugcauc

SEQ ID NO: 697431 - RNA, 22 nt, Human
aaaaagagaaaugcucuagucc

SEQ ID NO: 697432 - RNA, 22 nt, Human
ugcaaagaagccacagucccag

SEQ ID NO: 697433 - RNA, 22 nt, Human
auagauucauucuauuucuccg

SEQ ID NO: 697434 - RNA, 22 nt, Human
uuugagaacuuugguauuuucc

SEQ ID NO: 697435 - RNA, 22 nt, Human
agggcucagccuccuccucagc

SEQ ID NO: 697436 - RNA, 22 nt, Human
auguccagagaacauuugcuuu

SEQ ID NO: 697437 - RNA, 22 nt, Human
ccuggcugcuuccucugccaug

SEQ ID NO: 697438 - RNA, 22 nt, Human
ccagccucacuggcaucaccua

SEQ ID NO: 697439 - RNA, 22 nt, Human
ugcacccugccugccugcgggu

SEQ ID NO: 697440 - RNA, 22 nt, Human
cuguuuaaccagaucucauauc

SEQ ID NO: 697441 - RNA, 22 nt, Human
accagagaggcugcagugugug

SEQ ID NO: 697442 - RNA, 22 nt, Human
uucaauguuucuuaucaaguug

SEQ ID NO: 697443 - RNA, 22 nt, Human
caugagcauaaaucagucacga

SEQ ID NO: 697444 - RNA, 22 nt, Human
cagcaggaaaaucaauucugug

SEQ ID NO: 697445 - RNA, 22 nt, Human
aggcuucugauaccaugagaga

SEQ ID NO: 697446 - RNA, 21 nt, Human
uuaaugcuaugcagaaaaucu

SEQ ID NO: 697447 - RNA, 22 nt, Human
aaacugaugcucagagaggggc

SEQ ID NO: 697448 - RNA, 22 nt, Human
cugcugggaaggucugcucagu

SEQ ID NO: 697449 - RNA, 22 nt, Human
ucaguagcccuugaguucaugu

SEQ ID NO: 697450 - RNA, 21 nt, Human
acagccugucaucucaugguc

SEQ ID NO: 697451 - RNA, 23 nt, Human
uggaagaaaaugguuuggcugug

SEQ ID NO: 697452 - RNA, 22 nt, Human
acuuugcagggcuugauaucca

SEQ ID NO: 697453 - RNA, 22 nt, Human
gauuaaguaacugaacacuuug

SEQ ID NO: 697454 - RNA, 22 nt, Human
gucccaggcuuauguggagcuu

SEQ ID NO: 697455 - RNA, 22 nt, Human
gucucuuuuauggugaguugau

SEQ ID NO: 697456 - RNA, 22 nt, Human
ucugcaaacuggcucuuacugc

SEQ ID NO: 697457 - RNA, 22 nt, Human
uucauugugaacacauucugcc

SEQ ID NO: 697458 - RNA, 22 nt, Human
ccaguucugagaugaauaucca

SEQ ID NO: 697459 - RNA, 18 nt, Human
agaguccagggugaggug

SEQ ID NO: 697460 - RNA, 22 nt, Human
caagaaguugacagccagguga

SEQ ID NO: 697461 - RNA, 22 nt, Human
uucuuauucuugaaauguggga

SEQ ID NO: 697462 - RNA, 22 nt, Human
uuguugggcaugcaguggcugu

SEQ ID NO: 697463 - RNA, 22 nt, Human
auugcacaaacacagucagacu

SEQ ID NO: 697464 - RNA, 22 nt, Human
cuccagagaguccagcucuggg

SEQ ID NO: 697465 - RNA, 22 nt, Human
ucccguugaugacggugcaucc

SEQ ID NO: 697466 - RNA, 22 nt, Human
cugagguggggccugggcauca

SEQ ID NO: 697467 - RNA, 22 nt, Human
cuagucucuggaggucagggcu

SEQ ID NO: 697468 - RNA, 22 nt, Human
auauauaugcugauggcugcca

SEQ ID NO: 697469 - RNA, 22 nt, Human
uuuacugagugaccuagaauaa

SEQ ID NO: 697470 - RNA, 22 nt, Human
uugcuuccaguccaagucuguu

SEQ ID NO: 697471 - RNA, 22 nt, Human
cacugaaaggcaaugcugacag

SEQ ID NO: 697472 - RNA, 22 nt, Human
auugugcaauguuuuacaauuu

SEQ ID NO: 697473 - RNA, 22 nt, Human
acaugucaauuuaguacucuua

SEQ ID NO: 697474 - RNA, 22 nt, Human
acagugucucacugcugaaauc

SEQ ID NO: 697475 - RNA, 22 nt, Human
ggggccagcacugugccuuugu

SEQ ID NO: 697476 - RNA, 22 nt, Human
auucugcauguagguuugcuca

SEQ ID NO: 697477 - RNA, 22 nt, Human
ugccccagaccuacugaauggg

SEQ ID NO: 697478 - RNA, 23 nt, Human
gggggccguccuggggauuauag

SEQ ID NO: 697479 - RNA, 22 nt, Human
cagggccucauugucaguccug

SEQ ID NO: 697480 - RNA, 22 nt, Human
guucaaauugauuuugguaaag

SEQ ID NO: 697481 - RNA, 22 nt, Human
gagcgcgccacaaggagcggcg

SEQ ID NO: 697482 - RNA, 22 nt, Human
gaaaauguuuguccggagcuga

SEQ ID NO: 697483 - RNA, 22 nt, Human
ugcugcugacauuuggggcuug

SEQ ID NO: 697484 - RNA, 22 nt, Human
auggcuuccaaggcccuccgug

SEQ ID NO: 697485 - RNA, 22 nt, Human
gggagcugagcuggaagagaau

SEQ ID NO: 697486 - RNA, 22 nt, Human
cccugcugucaggugcugggag

SEQ ID NO: 697487 - RNA, 22 nt, Human
uccugugacggagcgccagagg

SEQ ID NO: 697488 - RNA, 22 nt, Human
auggcuccaagauggagagcca

SEQ ID NO: 697489 - RNA, 22 nt, Human
aauggaacuuguaauuaugucc

SEQ ID NO: 697490 - RNA, 22 nt, Human
aagagcagaaguccuuggaucc

SEQ ID NO: 697491 - RNA, 19 nt, Human
cuuauuagagugagagcuu

SEQ ID NO: 697492 - RNA, 22 nt, Human
uuuaaagagaaugugaaggagu

SEQ ID NO: 697493 - RNA, 22 nt, Human
agcaggugcguuacuucacucu

SEQ ID NO: 697494 - RNA, 22 nt, Human
aagcugaagacacagcuccagu

SEQ ID NO: 697495 - RNA, 22 nt, Human
uaaugagacucaauugugugug

SEQ ID NO: 697496 - RNA, 22 nt, Human
uauaggaaggcagauuuuagcu

SEQ ID NO: 697497 - RNA, 22 nt, Human
agcuggccuguuagagcugagu

SEQ ID NO: 697498 - RNA, 22 nt, Human
ggcagacaccuuuaugucuaau

SEQ ID NO: 697499 - RNA, 22 nt, Human
uagcagaggaaaagagaacauu

SEQ ID NO: 697500 - RNA, 22 nt, Human
cagccugcuagggcaaugccuu

SEQ ID NO: 697501 - RNA, 22 nt, Human
caacuacaggaaaagucauuca

SEQ ID NO: 697502 - RNA, 22 nt, Human
ggcgugggaaguggggcuucug

SEQ ID NO: 697503 - RNA, 22 nt, Human
aacuucaccuuuuugccacacu

SEQ ID NO: 697504 - RNA, 22 nt, Human
cacugguagagagaagacaagg

SEQ ID NO: 697505 - RNA, 22 nt, Human
uaccaggaauuauuuuacauuu

SEQ ID NO: 697506 - RNA, 22 nt, Human
uggcugguuuuggugagcuccg

SEQ ID NO: 697507 - RNA, 22 nt, Human
ggccagcuuucugucuucuagg

SEQ ID NO: 697508 - RNA, 21 nt, Human
acagaugugauaugcagucuu

SEQ ID NO: 697509 - RNA, 22 nt, Human
ugccaggguccugagggccuug

SEQ ID NO: 697510 - RNA, 22 nt, Human
agccacagcccacaggacucuu

SEQ ID NO: 697511 - RNA, 22 nt, Human
gaagauaauuccuacuuauaac

SEQ ID NO: 697512 - RNA, 22 nt, Human
uacauucuacuuuuucacuccc

SEQ ID NO: 697513 - RNA, 22 nt, Human
ugcccucugccuccucugcaga

SEQ ID NO: 697514 - RNA, 22 nt, Human
cuguacaaguccuucaucaggg

SEQ ID NO: 697515 - RNA, 22 nt, Human
accugagaaugggggcaugugu

SEQ ID NO: 697516 - RNA, 23 nt, Human
ucauuucauccagccuugagagu

SEQ ID NO: 697517 - RNA, 22 nt, Human
agggccaccagagcagggcagu

SEQ ID NO: 697518 - RNA, 21 nt, Human
uacgugugugcauguuuauau

SEQ ID NO: 697519 - RNA, 22 nt, Human
gaaaaaugagcugaugucaggg

SEQ ID NO: 697520 - RNA, 22 nt, Human
ggguaccaagcugcuugggggc

SEQ ID NO: 697521 - RNA, 22 nt, Human
uacugaggguaugaagccaagg

SEQ ID NO: 697522 - RNA, 22 nt, Human
gaagcaguucgaaagcaguugg

SEQ ID NO: 697523 - RNA, 22 nt, Human
agcuugauuucucugcagugug

SEQ ID NO: 697524 - RNA, 22 nt, Human
caguauauucugcagagccuua

SEQ ID NO: 697525 - RNA, 22 nt, Human
cuggugcccuguguggcaggag

SEQ ID NO: 697526 - RNA, 22 nt, Human
cagauacagcuagcuccguggc

SEQ ID NO: 697527 - RNA, 22 nt, Human
gcuuacaagccagcuguaccac

SEQ ID NO: 697528 - RNA, 22 nt, Human
cucccugguguccccuccagga

SEQ ID NO: 697529 - RNA, 22 nt, Human
ugaggcucaagaaucugcauuu

SEQ ID NO: 697530 - RNA, 19 nt, Human
aggguggcaaaggagggug

SEQ ID NO: 697531 - RNA, 22 nt, Human
uuauucuucuucucuugccagg

SEQ ID NO: 697532 - RNA, 22 nt, Human
ccaccagcuucagcagccgcgg

SEQ ID NO: 697533 - RNA, 22 nt, Human
uguaggaaaaacaaugaucugc

SEQ ID NO: 697534 - RNA, 22 nt, Human
acuauacauaaaacauuugggu

SEQ ID NO: 697535 - RNA, 22 nt, Human
ccaguguuccauggagugauua

SEQ ID NO: 697536 - RNA, 22 nt, Human
uguaaaaagcccagccgcugag

SEQ ID NO: 697537 - RNA, 22 nt, Human
gaggacagcuuagggcuuccug

SEQ ID NO: 697538 - RNA, 22 nt, Human
cuucagagugcagaagauuggg

SEQ ID NO: 697539 - RNA, 18 nt, Human
gcuccuggagucugacuc

SEQ ID NO: 697540 - RNA, 22 nt, Human
ucugggcucugggaauuaggga

SEQ ID NO: 697541 - RNA, 22 nt, Human
aagcugggagggagcccagagu

SEQ ID NO: 697542 - RNA, 22 nt, Human
ggaagcuggacaggcuuugagu

SEQ ID NO: 697543 - RNA, 22 nt, Human
ccugugucagccccugccucca

SEQ ID NO: 697544 - RNA, 22 nt, Human
ugcuguuaucacauuuuguaaa

SEQ ID NO: 697545 - RNA, 22 nt, Human
cuguuucaagugaagucagaca

SEQ ID NO: 697546 - RNA, 22 nt, Human
cuguaacagcugucagagcagg

SEQ ID NO: 697547 - RNA, 22 nt, Human
cauuuccugucuggaggucaaa

SEQ ID NO: 697548 - RNA, 22 nt, Human
uccaggcuagccugguagagaa

SEQ ID NO: 697549 - RNA, 22 nt, Human
cuccaaauacaauauuguuguu

SEQ ID NO: 697550 - RNA, 22 nt, Human
auuucucagcacuuccuaucuc

SEQ ID NO: 697551 - RNA, 22 nt, Human
agcccagguucuaaagccaaac

SEQ ID NO: 697552 - RNA, 22 nt, Human
agaaagcacccugcacuuucug

SEQ ID NO: 697553 - RNA, 22 nt, Human
ugagucacacauuucuucauac

SEQ ID NO: 697554 - RNA, 22 nt, Human
cuacauucaacagcagaguuuu

SEQ ID NO: 697555 - RNA, 22 nt, Human
aguuucaugagacagauuuuca

SEQ ID NO: 697556 - RNA, 22 nt, Human
cacugagaguagggcacaagug

SEQ ID NO: 697557 - RNA, 22 nt, Human
aggccagugcagcuggaacaga

SEQ ID NO: 697558 - RNA, 20 nt, Human
agcuuugguuaagccagugg

SEQ ID NO: 697559 - RNA, 22 nt, Human
cucaagugugaguuuuaaaguc

SEQ ID NO: 697560 - RNA, 22 nt, Human
acuuguuuggucucauguuuaa

SEQ ID NO: 697561 - RNA, 22 nt, Human
gguccugaguaccuauguuuau

SEQ ID NO: 697562 - RNA, 21 nt, Human
ugaucauuuguguaaaggaga

SEQ ID NO: 697563 - RNA, 22 nt, Human
uuauguacccacucauauuccc

SEQ ID NO: 697564 - RNA, 22 nt, Human
uuucagaucauuuuuuaaguac

SEQ ID NO: 697565 - RNA, 22 nt, Human
uagccggguguugugucaugca

SEQ ID NO: 697566 - RNA, 22 nt, Human
cugaggagcagcuggcccgcua

SEQ ID NO: 697567 - RNA, 22 nt, Human
gccugcugaaccucaugcaguc

SEQ ID NO: 697568 - RNA, 22 nt, Human
uuacccagggaccaagagaaac

SEQ ID NO: 697569 - RNA, 22 nt, Human
uggaacacaucucgcugcaggg

SEQ ID NO: 697570 - RNA, 22 nt, Human
agauucauuaucuucuuuguac

SEQ ID NO: 697571 - RNA, 22 nt, Human
ucagagaucuucaggaugggac

SEQ ID NO: 697572 - RNA, 22 nt, Human
uuccuucuauucagcuccaaga

SEQ ID NO: 697573 - RNA, 22 nt, Human
ggagcaggcucugugguuucca

SEQ ID NO: 697574 - RNA, 22 nt, Human
uggagcccaggagaggauaaac

SEQ ID NO: 697575 - RNA, 22 nt, Human
cauacaaauguguccaggcucu

SEQ ID NO: 697576 - RNA, 23 nt, Human
uaaagucacauauuagagugagc

SEQ ID NO: 697577 - RNA, 21 nt, Human
uguccuggucacugcucuccc

SEQ ID NO: 697578 - RNA, 22 nt, Human
uaggggugaggccaggcaucag

SEQ ID NO: 697579 - RNA, 21 nt, Human
acacaggaguuucuucuuucu

SEQ ID NO: 697580 - RNA, 22 nt, Human
aggaaggacugcagcauuuggu

SEQ ID NO: 697581 - RNA, 22 nt, Human
ccagaggcauguucaaagcaau

SEQ ID NO: 697582 - RNA, 22 nt, Human
ccagggcacuuaggcccagccc

SEQ ID NO: 697583 - RNA, 22 nt, Human
ccugggcccucaccgccggugg

SEQ ID NO: 697584 - RNA, 22 nt, Human
auucucaaagccagagucaacg

SEQ ID NO: 697585 - RNA, 22 nt, Human
gggagccacagugaggugcaug

SEQ ID NO: 697586 - RNA, 22 nt, Human
cagcucuuugaguauuccauuu

SEQ ID NO: 697587 - RNA, 21 nt, Human
uuacaacauuuguguucuaug

SEQ ID NO: 697588 - RNA, 22 nt, Human
ccagcuggaaacaaauagagug

SEQ ID NO: 697589 - RNA, 22 nt, Human
acagguccuuauaagagcacuc

SEQ ID NO: 697590 - RNA, 23 nt, Human
ugucacauuuaguuggcauuguu

SEQ ID NO: 697591 - RNA, 22 nt, Human
uacaaguaaauuguagauacca

SEQ ID NO: 697592 - RNA, 22 nt, Human
gcaucuaaaucacuuuaaugua

SEQ ID NO: 697593 - RNA, 22 nt, Human
gcugugagaaacagggaguguc

SEQ ID NO: 697594 - RNA, 22 nt, Human
caaggcugcuggcuucugagcu

SEQ ID NO: 697595 - RNA, 22 nt, Human
ucagugcuaaaagagcuggugu

SEQ ID NO: 697596 - RNA, 22 nt, Human
acucuggcugccuugugagcau

SEQ ID NO: 697597 - RNA, 20 nt, Human
uucugggcagccauguacuu

SEQ ID NO: 697598 - RNA, 20 nt, Human
ccugcugugcuuuccaugga

SEQ ID NO: 697599 - RNA, 22 nt, Human
aacuacagugggcagaggcaau

SEQ ID NO: 697600 - RNA, 22 nt, Human
gaggaucauuugagccuaggag

SEQ ID NO: 697601 - RNA, 22 nt, Human
uaaaucucacuggguauauugg

SEQ ID NO: 697602 - RNA, 22 nt, Human
ccaggaucuguacaccucugag

SEQ ID NO: 697603 - RNA, 22 nt, Human
cugggcuucucccccuggcaga

SEQ ID NO: 697604 - RNA, 22 nt, Human
ugucuuuauauauuuggaaaau

SEQ ID NO: 697605 - RNA, 20 nt, Human
uugagcaaucaguaaaggau

SEQ ID NO: 697606 - RNA, 22 nt, Human
ugugagaaaaugauugcacagu

SEQ ID NO: 697607 - RNA, 22 nt, Human
cuucccuuuagcauauaguagu

SEQ ID NO: 697608 - RNA, 19 nt, Human
gccuggcugggaugagccc

SEQ ID NO: 697609 - RNA, 22 nt, Human
uuaagugagcuugaauaaucuu

SEQ ID NO: 697610 - RNA, 22 nt, Human
aguacaaaugcagccagaguag

SEQ ID NO: 697611 - RNA, 22 nt, Human
gugccaccuucaaaucacauug

SEQ ID NO: 697612 - RNA, 22 nt, Human
aagcugugagcuggaugcucca

SEQ ID NO: 697613 - RNA, 22 nt, Human
guauaucucuuacauacacaca

SEQ ID NO: 697614 - RNA, 22 nt, Human
ucccucugcuagugcuugagcu

SEQ ID NO: 697615 - RNA, 22 nt, Human
aagacagugugucaggcaggug

SEQ ID NO: 697616 - RNA, 22 nt, Human
ucagaagaguaauagggugaga

SEQ ID NO: 697617 - RNA, 22 nt, Human
ucagucuuugcuuaugacaaua

SEQ ID NO: 697618 - RNA, 22 nt, Human
ugggaccugcucuuggaaugag

SEQ ID NO: 697619 - RNA, 22 nt, Human
gcuggagagugaggggagcaag

SEQ ID NO: 697620 - RNA, 22 nt, Human
aguauguugacuuauucuugga

SEQ ID NO: 697621 - RNA, 17 nt, Human
agauggccucuaagauu

SEQ ID NO: 697622 - RNA, 22 nt, Human
aucugccaaugccaugagaaga

SEQ ID NO: 697623 - RNA, 22 nt, Human
cucuggagaugguucucaauug

SEQ ID NO: 697624 - RNA, 21 nt, Human
uccaggcugaugaugucaacu

SEQ ID NO: 697625 - RNA, 22 nt, Human
gcagguggauauugcuacuuga

SEQ ID NO: 697626 - RNA, 23 nt, Human
cuccucguaacucuguggugggu

SEQ ID NO: 697627 - RNA, 22 nt, Human
uccaccagagccuucccaugcu

SEQ ID NO: 697628 - RNA, 22 nt, Human
agaggcagaaguguucaaaccc

SEQ ID NO: 697629 - RNA, 22 nt, Human
auauaguuuaagaaaguacagu

SEQ ID NO: 697630 - RNA, 22 nt, Human
gucuccagcccacucuagauau

SEQ ID NO: 697631 - RNA, 22 nt, Human
caggaugggauguagugggccc

SEQ ID NO: 697632 - RNA, 22 nt, Human
acauaaauagauuauugggagg

SEQ ID NO: 697633 - RNA, 22 nt, Human
acuuuagagaaauguagaagua

SEQ ID NO: 697634 - RNA, 22 nt, Human
cacccaggcagguggcugagaa

SEQ ID NO: 697635 - RNA, 22 nt, Human
accugucugggcuacauuugca

SEQ ID NO: 697636 - RNA, 22 nt, Human
uacauauagacaguuacucuag

SEQ ID NO: 697637 - RNA, 22 nt, Human
cuccucccaauugccaagugcu

SEQ ID NO: 697638 - RNA, 22 nt, Human
cuggggacuuugguucuccaug

SEQ ID NO: 697639 - RNA, 22 nt, Human
acaguuagguccuaaaauucug

SEQ ID NO: 697640 - RNA, 22 nt, Human
ucaaucauaaugaagugaagaa

SEQ ID NO: 697641 - RNA, 22 nt, Human
aggcagcuggaaaacuccaggc

SEQ ID NO: 697642 - RNA, 23 nt, Human
uguaaaagcauuugucagccugg

SEQ ID NO: 697643 - RNA, 22 nt, Human
ucugggaaugaggcuugggcaa

SEQ ID NO: 697644 - RNA, 22 nt, Human
agucccuugagggaguacuguu

SEQ ID NO: 697645 - RNA, 22 nt, Human
ggcaagagggcagauggagugc

SEQ ID NO: 697646 - RNA, 22 nt, Human
ugucagcagcugguuugcuguu

SEQ ID NO: 697647 - RNA, 22 nt, Human
ggguucagguuggccugagcac

SEQ ID NO: 697648 - RNA, 22 nt, Human
aaauaugagggugaugcccaga

SEQ ID NO: 697649 - RNA, 21 nt, Human
gcacagcaugaguguuggcau

SEQ ID NO: 697650 - RNA, 22 nt, Human
aagugucuucugauggggugug

SEQ ID NO: 697651 - RNA, 22 nt, Human
ugucuuuaaaauuaaacacauc

SEQ ID NO: 697652 - RNA, 20 nt, Human
ggccucggacuucaucguag

SEQ ID NO: 697653 - RNA, 22 nt, Human
cacacuagucuauccauuagcu

SEQ ID NO: 697654 - RNA, 22 nt, Human
agcuggcuaugcccugugaacc

SEQ ID NO: 697655 - RNA, 22 nt, Human
acucuggggcgcuacuccaacu

SEQ ID NO: 697656 - RNA, 22 nt, Human
ugaaauguguucuaguguuuug

SEQ ID NO: 697657 - RNA, 22 nt, Human
cagguuuagguggacgugcagg

SEQ ID NO: 697658 - RNA, 22 nt, Human
aaagugcagcuugugaucccua

SEQ ID NO: 697659 - RNA, 22 nt, Human
ucucaggcugacauugggacuc

SEQ ID NO: 697660 - RNA, 22 nt, Human
uaggcagaguuuaaugguuaag

SEQ ID NO: 697661 - RNA, 22 nt, Human
ggcagcuccucaaaaaauuaaa

SEQ ID NO: 697662 - RNA, 22 nt, Human
cuuccucaggcauuagcuggac

SEQ ID NO: 697663 - RNA, 20 nt, Human
ugucuuccagcagguguuua

SEQ ID NO: 697664 - RNA, 17 nt, Human
ugguggcuggagucagg

SEQ ID NO: 697665 - RNA, 22 nt, Human
ucagugcugcuuuaugacaguu

SEQ ID NO: 697666 - RNA, 22 nt, Human
ggauggagaugaccauggugac

SEQ ID NO: 697667 - RNA, 22 nt, Human
cagacuuucugacucccuugcc

SEQ ID NO: 697668 - RNA, 22 nt, Human
cauggcuuuccaguccuccacu

SEQ ID NO: 697669 - RNA, 22 nt, Human
agcccugggcuguagauaagca

SEQ ID NO: 697670 - RNA, 22 nt, Human
gucuucaauagagccucaauuu

SEQ ID NO: 697671 - RNA, 21 nt, Human
uccaggccucaggaagggaug

SEQ ID NO: 697672 - RNA, 22 nt, Human
gugacauuuauuagaugcuuac

SEQ ID NO: 697673 - RNA, 17 nt, Human
aaggccauuuccaccca

SEQ ID NO: 697674 - RNA, 22 nt, Human
uagauucuucuaggucuuuagc

SEQ ID NO: 697675 - RNA, 22 nt, Human
uuauggaaaauacaauuauaag

SEQ ID NO: 697676 - RNA, 22 nt, Human
ucaguguuugaacccaggguua

SEQ ID NO: 697677 - RNA, 22 nt, Human
agcccaggcagagggaugcuug

SEQ ID NO: 697678 - RNA, 22 nt, Human
uguccagguuagcuucaaacac

SEQ ID NO: 697679 - RNA, 22 nt, Human
auuguacaacugaggguggaau

SEQ ID NO: 697680 - RNA, 22 nt, Human
ucauggcuucaaggaagcaggc

SEQ ID NO: 697681 - RNA, 21 nt, Human
ucaggcaggucccacugaaca

SEQ ID NO: 697682 - RNA, 22 nt, Human
gguggguauaguuagggccucu

SEQ ID NO: 697683 - RNA, 22 nt, Human
gauuucagggugucuuccagcu

SEQ ID NO: 697684 - RNA, 22 nt, Human
ugcauucaucauuugaaagccc

SEQ ID NO: 697685 - RNA, 22 nt, Human
cauuucuaagaaggcugcacau

SEQ ID NO: 697686 - RNA, 22 nt, Human
gagaauuacuguuuuuauaaca

SEQ ID NO: 697687 - RNA, 22 nt, Human
ccugggucuucagucugcuggu

SEQ ID NO: 697688 - RNA, 22 nt, Human
gaaggaagucauuagugcagac

SEQ ID NO: 697689 - RNA, 22 nt, Human
ccugugcuucagcuggaggagg

SEQ ID NO: 697690 - RNA, 22 nt, Human
ccuccugguccagcaucucuuu

SEQ ID NO: 697691 - RNA, 22 nt, Human
auugcugaaaguauuuuaugac

SEQ ID NO: 697692 - RNA, 23 nt, Human
agcaggcaucuguggcacaaggc

SEQ ID NO: 697693 - RNA, 22 nt, Human
uuaaauuauugagggauuguca

SEQ ID NO: 697694 - RNA, 22 nt, Human
caugagcugcugggagccuguc

SEQ ID NO: 697695 - RNA, 22 nt, Human
gaucuugaaauaucuuuuccua

SEQ ID NO: 697696 - RNA, 22 nt, Human
acagggaauggagggaucagua

SEQ ID NO: 697697 - RNA, 22 nt, Human
ggcuaaagauguguucuuugga

SEQ ID NO: 697698 - RNA, 22 nt, Human
agccagagggaaucuuugggga

SEQ ID NO: 697699 - RNA, 22 nt, Human
uagguucacuuagcugugggaa

SEQ ID NO: 697700 - RNA, 22 nt, Human
aaguugagaugucauaggagac

SEQ ID NO: 697701 - RNA, 22 nt, Human
uguuuacuccugauauauuuuu

SEQ ID NO: 697702 - RNA, 22 nt, Human
ggagcuggagagcuagccuagg

SEQ ID NO: 697703 - RNA, 22 nt, Human
caggaggacauacuggcucaca

SEQ ID NO: 697704 - RNA, 22 nt, Human
cuuaauuuaaaauaguucaggc

SEQ ID NO: 697705 - RNA, 22 nt, Human
cuggugagacucagggaugcuu

SEQ ID NO: 697706 - RNA, 22 nt, Human
ugaggccacaggaaagggcccg

SEQ ID NO: 697707 - RNA, 22 nt, Human
agcuuccugaugcaagagggcu

SEQ ID NO: 697708 - RNA, 22 nt, Human
gggcucuggaaaugggagcucc

SEQ ID NO: 697709 - RNA, 22 nt, Human
uauugucuaucgcugcuuucau

SEQ ID NO: 697710 - RNA, 22 nt, Human
ugcagagaaaccaguggaggac

SEQ ID NO: 697711 - RNA, 22 nt, Human
uauuguccaauaggauguuccu

SEQ ID NO: 697712 - RNA, 22 nt, Human
cagaguuuugugaacaacuugg

SEQ ID NO: 697713 - RNA, 17 nt, Human
gaggagcuccaguaggu

SEQ ID NO: 697714 - RNA, 19 nt, Human
agggcggggcccaggcaca

SEQ ID NO: 697715 - RNA, 22 nt, Human
ugguggggcuuuccuucugcuu

SEQ ID NO: 697716 - RNA, 22 nt, Human
aaacaaacaauuaguugugugg

SEQ ID NO: 697717 - RNA, 22 nt, Human
agaaaauuacuccagagacaag

SEQ ID NO: 697718 - RNA, 22 nt, Human
acaguguguucugggaccucca

SEQ ID NO: 697719 - RNA, 22 nt, Human
acuguaauguuuuaaagcagag

SEQ ID NO: 697720 - RNA, 22 nt, Human
ugucuuuaugcacacugacuug

SEQ ID NO: 697721 - RNA, 22 nt, Human
gcagugaauuuaacacucagau

SEQ ID NO: 697722 - RNA, 22 nt, Human
cugggcucaccuguggcuggca

SEQ ID NO: 697723 - RNA, 22 nt, Human
cuccaggacagauucagggcca

SEQ ID NO: 697724 - RNA, 22 nt, Human
augcuuuuuaaacuuaauugga

SEQ ID NO: 697725 - RNA, 22 nt, Human
ucuucugugaucuauguguuuu

SEQ ID NO: 697726 - RNA, 22 nt, Human
ucugauguugcuucugcagaac

SEQ ID NO: 697727 - RNA, 22 nt, Human
uucaggauccccuugaugggcu

SEQ ID NO: 697728 - RNA, 22 nt, Human
ccucagaagaaguggaauugau

SEQ ID NO: 697729 - RNA, 22 nt, Human
gucaccucgcugucuuccugag

SEQ ID NO: 697730 - RNA, 22 nt, Human
gauucagugagggugagaagaa

SEQ ID NO: 697731 - RNA, 22 nt, Human
agaaaucaggaacaguaaggag

SEQ ID NO: 697732 - RNA, 22 nt, Human
uuuuguauagucaaagacaaga

SEQ ID NO: 697733 - RNA, 22 nt, Human
aaugcucucugccauagcuaac

SEQ ID NO: 697734 - RNA, 22 nt, Human
cugccacuagcuuucacaucuu

SEQ ID NO: 697735 - RNA, 22 nt, Human
uaagacaauucuucagucacaa

SEQ ID NO: 697736 - RNA, 22 nt, Human
ucacccuugauaauguucuucu

SEQ ID NO: 697737 - RNA, 21 nt, Human
gcagaugggaagagacgaggc

SEQ ID NO: 697738 - RNA, 22 nt, Human
cuaaacuucuuggcaauuuuau

SEQ ID NO: 697739 - RNA, 22 nt, Human
cuauauauaucaucuuccaguu

SEQ ID NO: 697740 - RNA, 22 nt, Human
cagauaugauaggauuagcaca

SEQ ID NO: 697741 - RNA, 22 nt, Human
agcaaacuaauugcaguucugg

SEQ ID NO: 697742 - RNA, 21 nt, Human
cugcaggugcugccaucaggg

SEQ ID NO: 697743 - RNA, 22 nt, Human
ucuccuuuaagauuuccucagg

SEQ ID NO: 697744 - RNA, 21 nt, Human
ucucugggaggacuugugaga

SEQ ID NO: 697745 - RNA, 22 nt, Human
ugugaguuauuuucaggaguuu

SEQ ID NO: 697746 - RNA, 22 nt, Human
uucuccaguuucucccuucagu

SEQ ID NO: 697747 - RNA, 22 nt, Human
gccccaagggagcccagcacac

SEQ ID NO: 697748 - RNA, 22 nt, Human
ggagucugaguccucauagaca

SEQ ID NO: 697749 - RNA, 22 nt, Human
acuucuguccuccaagccacgu

SEQ ID NO: 697750 - RNA, 22 nt, Human
uagaacaugugaaaauauagcc

SEQ ID NO: 697751 - RNA, 22 nt, Human
uccagggccaugaaguugcaca

SEQ ID NO: 697752 - RNA, 22 nt, Human
auggaaaugauggaacauuaaa

SEQ ID NO: 697753 - RNA, 22 nt, Human
uuaugauuugccacagauuggu

SEQ ID NO: 697754 - RNA, 22 nt, Human
caguggccugagccaggcuucc

SEQ ID NO: 697755 - RNA, 22 nt, Human
ucagccucagguguucagauuu

SEQ ID NO: 697756 - RNA, 22 nt, Human
uuaaaugugauuucauuuaugu

SEQ ID NO: 697757 - RNA, 22 nt, Human
ucugcagaaguggcugggccac

SEQ ID NO: 697758 - RNA, 22 nt, Human
ucccacugagcauaugcagaug

SEQ ID NO: 697759 - RNA, 22 nt, Human
gguggaguaauucgcagagguu

SEQ ID NO: 697760 - RNA, 22 nt, Human
ucugaagcacagcaggaagggu

SEQ ID NO: 697761 - RNA, 22 nt, Human
cccagcagcuugcacagugcug

SEQ ID NO: 697762 - RNA, 22 nt, Human
gugacuguuuuuaggaggagua

SEQ ID NO: 697763 - RNA, 22 nt, Human
caguauuugguaauuggcuacc

SEQ ID NO: 697764 - RNA, 20 nt, Human
uuauuucucauucuccuacu

SEQ ID NO: 697765 - RNA, 22 nt, Human
uugcuuuaaaauggcuaagucu

SEQ ID NO: 697766 - RNA, 22 nt, Human
uaaugugugucaucaguagagu

SEQ ID NO: 697767 - RNA, 23 nt, Human
gggaccaggcccuuccugguuug

SEQ ID NO: 697768 - RNA, 22 nt, Human
gaauacaaacuuaaggcuuuac

SEQ ID NO: 697769 - RNA, 22 nt, Human
uccuugaaaggggcugcagggc

SEQ ID NO: 697770 - RNA, 22 nt, Human
aggaggucagagccccaugcug

SEQ ID NO: 697771 - RNA, 22 nt, Human
gaagccccaaacccucgccauc

SEQ ID NO: 697772 - RNA, 19 nt, Human
augcagagaauggcaguag

SEQ ID NO: 697773 - RNA, 22 nt, Human
gcccaaagagcuuugaucucag

SEQ ID NO: 697774 - RNA, 22 nt, Human
uggcuucuucauaugugaucuu

SEQ ID NO: 697775 - RNA, 23 nt, Human
gcucuggagcugggccuggcagg

SEQ ID NO: 697776 - RNA, 22 nt, Human
aauguacacugaaagccuauca

SEQ ID NO: 697777 - RNA, 22 nt, Human
guggcuuuguuuccaaaugaaa

SEQ ID NO: 697778 - RNA, 22 nt, Human
aaagcagcugcucuggccuuga

SEQ ID NO: 697779 - RNA, 22 nt, Human
ucuucagauugcacugagcaag

SEQ ID NO: 697780 - RNA, 22 nt, Human
agaguguuuuucugucaaggac

SEQ ID NO: 697781 - RNA, 22 nt, Human
cugagcugcucccgcugcagcg

SEQ ID NO: 697782 - RNA, 22 nt, Human
cagguggcuucucugcagccuu

SEQ ID NO: 697783 - RNA, 22 nt, Human
uugcuuuauauucaagagagga

SEQ ID NO: 697784 - RNA, 22 nt, Human
uaauuguaaaguaguaguacag

SEQ ID NO: 697785 - RNA, 22 nt, Human
gauuuccaggucauuaauaaag

SEQ ID NO: 697786 - RNA, 22 nt, Human
cagggagaagucuggucagucc

SEQ ID NO: 697787 - RNA, 22 nt, Human
uaacacaguguccucagaaaca

SEQ ID NO: 697788 - RNA, 22 nt, Human
guaugucaaaaucugcaugaua

SEQ ID NO: 697789 - RNA, 22 nt, Human
aaccggagugauucccaccucu

SEQ ID NO: 697790 - RNA, 22 nt, Human
acuaguauaauugcccuaaccu

SEQ ID NO: 697791 - RNA, 22 nt, Human
gaugauggguugaugugaaggg

SEQ ID NO: 697792 - RNA, 22 nt, Human
uugcauuuguuugaguagaaug

SEQ ID NO: 697793 - RNA, 22 nt, Human
guccaagagucaagaagggggc

SEQ ID NO: 697794 - RNA, 22 nt, Human
uuuccagagcaugucugcucag

SEQ ID NO: 697795 - RNA, 22 nt, Human
cuucucauucaagcaaaacaga

SEQ ID NO: 697796 - RNA, 22 nt, Human
aaaacauugaauugcacacuau

SEQ ID NO: 697797 - RNA, 22 nt, Human
ugugucugcccuuaguacaucu

SEQ ID NO: 697798 - RNA, 22 nt, Human
uuugggcaggcuuuucccuaga

SEQ ID NO: 697799 - RNA, 22 nt, Human
ugggaccugcuccuggaaugag

SEQ ID NO: 697800 - RNA, 22 nt, Human
gccucucuccuuggcuugcagu

SEQ ID NO: 697801 - RNA, 22 nt, Human
agcggcuggaccagcguucaag

SEQ ID NO: 697802 - RNA, 22 nt, Human
agcuaggaaauugaggcugaga

SEQ ID NO: 697803 - RNA, 22 nt, Human
gagaaacaacacuugaugccuu

SEQ ID NO: 697804 - RNA, 22 nt, Human
ccuuuucuaggaugcuuuauag

SEQ ID NO: 697805 - RNA, 22 nt, Human
aguguuuggggugauuguaacc

SEQ ID NO: 697806 - RNA, 18 nt, Human
ugcccaccagaagaggga

SEQ ID NO: 697807 - RNA, 19 nt, Human
ucucuggcauagacucaau

SEQ ID NO: 697808 - RNA, 22 nt, Human
gcuuuggaugugugccugaggu

SEQ ID NO: 697809 - RNA, 22 nt, Human
ugaccaaagaguugcuuguauu

SEQ ID NO: 697810 - RNA, 22 nt, Human
uuguaaauaguaguaagaugcc

SEQ ID NO: 697811 - RNA, 21 nt, Human
acaauagaauagaguguggug

SEQ ID NO: 697812 - RNA, 22 nt, Human
uacaugcaugauacaaaguugc

SEQ ID NO: 697813 - RNA, 22 nt, Human
aauggccagcugggagaguuga

SEQ ID NO: 697814 - RNA, 20 nt, Human
uucugccuaggguuagccug

SEQ ID NO: 697815 - RNA, 22 nt, Human
aggaugagccgcgcaagcugac

SEQ ID NO: 697816 - RNA, 22 nt, Human
augcucugggcaggagcccugg

SEQ ID NO: 697817 - RNA, 22 nt, Human
accucugcucaagaccccuccg

SEQ ID NO: 697818 - RNA, 22 nt, Human
agcuggaggggccagcaggugu

SEQ ID NO: 697819 - RNA, 22 nt, Human
ugggugaggaugaugaggcagc

SEQ ID NO: 697820 - RNA, 22 nt, Human
gcucugaggcugugaggugcug

SEQ ID NO: 697821 - RNA, 22 nt, Human
auugucuuuggugcuuccagga

SEQ ID NO: 697822 - RNA, 22 nt, Human
uauuuagaugcauuuggauugc

SEQ ID NO: 697823 - RNA, 22 nt, Human
uuacaguuuauccaggaagagc

SEQ ID NO: 697824 - RNA, 22 nt, Human
cugagaaaccaggugcucugau

SEQ ID NO: 697825 - RNA, 22 nt, Human
cccucucucgguugcugugguu

SEQ ID NO: 697826 - RNA, 22 nt, Human
agcuggcagucauccuagugag

SEQ ID NO: 697827 - RNA, 22 nt, Human
aaugacucugcugcagagacac

SEQ ID NO: 697828 - RNA, 22 nt, Human
ggaaaacaagagaaugauguuu

SEQ ID NO: 697829 - RNA, 22 nt, Human
acacccaggaauaaggacuggg

SEQ ID NO: 697830 - RNA, 22 nt, Human
gccagagaggcaaauccuagca

SEQ ID NO: 697831 - RNA, 23 nt, Human
agcagcuguggaguuuugcauuu

SEQ ID NO: 697832 - RNA, 22 nt, Human
uggcccugggcagaggcaacau

SEQ ID NO: 697833 - RNA, 22 nt, Human
ggcaggcaaugaggaugggaag

SEQ ID NO: 697834 - RNA, 22 nt, Human
acauauauguaaaguacuuugu

SEQ ID NO: 697835 - RNA, 22 nt, Human
ucugcccuuggcucucuuguug

SEQ ID NO: 697836 - RNA, 22 nt, Human
gugaagaugccucaggugaccc

SEQ ID NO: 697837 - RNA, 22 nt, Human
ccagggugugagaaggaaguag

SEQ ID NO: 697838 - RNA, 22 nt, Human
uuguauuuauauugaauagcuu

SEQ ID NO: 697839 - RNA, 22 nt, Human
guggaagggacugccuagagga

SEQ ID NO: 697840 - RNA, 22 nt, Human
gcagggucuugagaggcagcca

SEQ ID NO: 697841 - RNA, 22 nt, Human
uugcccugcguuaccaucucuu

SEQ ID NO: 697842 - RNA, 22 nt, Human
uccucuggauauaagccucacc

SEQ ID NO: 697843 - RNA, 22 nt, Human
auaauauuuggauaggacagua

SEQ ID NO: 697844 - RNA, 22 nt, Human
auaccucuggcacucaagacuu

SEQ ID NO: 697845 - RNA, 23 nt, Human
agggccuggcguggagugugugc

SEQ ID NO: 697846 - RNA, 22 nt, Human
cugaggagugggugggcaguga

SEQ ID NO: 697847 - RNA, 22 nt, Human
ccagagaaagugaagcaaaugu

SEQ ID NO: 697848 - RNA, 22 nt, Human
uuuagagucauuuuauauugac

SEQ ID NO: 697849 - RNA, 22 nt, Human
uucucagaaaagcaagcuuucu

SEQ ID NO: 697850 - RNA, 22 nt, Human
aguucuuuguaaaaggucucua

SEQ ID NO: 697851 - RNA, 20 nt, Human
cucuuauugcauuaguuucu

SEQ ID NO: 697852 - RNA, 22 nt, Human
ugucucaucucuuaaccccacu

SEQ ID NO: 697853 - RNA, 22 nt, Human
uggagcuggcagcggaaaaggg

SEQ ID NO: 697854 - RNA, 22 nt, Human
cauuuguauagugcuuagacca

SEQ ID NO: 697855 - RNA, 22 nt, Human
uucacauuauaaucaguucugc

SEQ ID NO: 697856 - RNA, 22 nt, Human
agaaugucuaaguguucagccc

SEQ ID NO: 697857 - RNA, 21 nt, Human
caaccugagcugaacccgugc

SEQ ID NO: 697858 - RNA, 22 nt, Human
gccucaggccuauagcugcugu

SEQ ID NO: 697859 - RNA, 22 nt, Human
cagagacagaaaauggaucuag

SEQ ID NO: 697860 - RNA, 22 nt, Human
uguauacauguguucaugcaug

SEQ ID NO: 697861 - RNA, 22 nt, Human
caggugcuguccugcacauguc

SEQ ID NO: 697862 - RNA, 22 nt, Human
aaguaacacggaacuugaagca

SEQ ID NO: 697863 - RNA, 22 nt, Human
cuuacaaaggagaggagauagg

SEQ ID NO: 697864 - RNA, 22 nt, Human
accagaguuuuauuaguucuaa

SEQ ID NO: 697865 - RNA, 23 nt, Human
cugcauguccacugguguaaaug

SEQ ID NO: 697866 - RNA, 22 nt, Human
aaaugcacucugcuucugugac

SEQ ID NO: 697867 - RNA, 22 nt, Human
auuucagguaccugugggaucc

SEQ ID NO: 697868 - RNA, 22 nt, Human
cucagguagagucugcaugggg

SEQ ID NO: 697869 - RNA, 23 nt, Human
guggccuccccggaaugccucgc

SEQ ID NO: 697870 - RNA, 22 nt, Human
caguggaggcucaagugugcuu

SEQ ID NO: 697871 - RNA, 22 nt, Human
ucuucagacuccaaauguuuua

SEQ ID NO: 697872 - RNA, 22 nt, Human
guccucagagugggcagguccu

SEQ ID NO: 697873 - RNA, 22 nt, Human
cagcagacuuacuagaauguaa

SEQ ID NO: 697874 - RNA, 22 nt, Human
cagauggcacagauuuagagug

SEQ ID NO: 697875 - RNA, 22 nt, Human
uaucuguuguccaugcagaaag

SEQ ID NO: 697876 - RNA, 22 nt, Human
uccugaacagcuccugagcaug

SEQ ID NO: 697877 - RNA, 22 nt, Human
ucugucacugagcucaggauuc

SEQ ID NO: 697878 - RNA, 22 nt, Human
gaggggucacaugggcuggcuu

SEQ ID NO: 697879 - RNA, 22 nt, Human
ccucaaauugcucagcgucuag

SEQ ID NO: 697880 - RNA, 22 nt, Human
aauuaaaagauaacccaugagu

SEQ ID NO: 697881 - RNA, 22 nt, Human
uuuccuuuuggcuaggugugaa

SEQ ID NO: 697882 - RNA, 22 nt, Human
auguuuucaaaguaaacuugua

SEQ ID NO: 697883 - RNA, 22 nt, Human
aggcccugcauuguacugaggg

SEQ ID NO: 697884 - RNA, 22 nt, Human
agcaggaaucuguucuguauaa

SEQ ID NO: 697885 - RNA, 22 nt, Human
cagucucucuccuugcaggcgu

SEQ ID NO: 697886 - RNA, 22 nt, Human
cagaaauacccagcauuuggag

SEQ ID NO: 697887 - RNA, 18 nt, Human
ggcagggaaaagauaggg

SEQ ID NO: 697888 - RNA, 22 nt, Human
cacaauuuccauugagcagcag

SEQ ID NO: 697889 - RNA, 22 nt, Human
cuucuuaaucccuuauauauuu

SEQ ID NO: 697890 - RNA, 22 nt, Human
gccagaucugacauaguggaag

SEQ ID NO: 697891 - RNA, 22 nt, Human
ucagaaagguucuauguuuuac

SEQ ID NO: 697892 - RNA, 22 nt, Human
ugaugcaauguuuacaucuuga

SEQ ID NO: 697893 - RNA, 22 nt, Human
uguggggacugaguggaggcuu

SEQ ID NO: 697894 - RNA, 22 nt, Human
gcuggugucuaaccuggcucuu

SEQ ID NO: 697895 - RNA, 22 nt, Human
acacuucuauucccugcacaaa

SEQ ID NO: 697896 - RNA, 22 nt, Human
augcaugugugagagcaagagg

SEQ ID NO: 697897 - RNA, 22 nt, Human
aagaguuuccaugcucugugcu

SEQ ID NO: 697898 - RNA, 22 nt, Human
cagcucaggaaggaaggccggc

SEQ ID NO: 697899 - RNA, 23 nt, Human
uugaggucggcucucugagccug

SEQ ID NO: 697900 - RNA, 22 nt, Human
gaagccacuauagauauucuaa

SEQ ID NO: 697901 - RNA, 22 nt, Human
augucuguuuauccuucaagau

SEQ ID NO: 697902 - RNA, 22 nt, Human
gcccagaagugacucagcacug

SEQ ID NO: 697903 - RNA, 22 nt, Human
cuucucaguugcaagugucaga

SEQ ID NO: 697904 - RNA, 22 nt, Human
ggcugugagcaggcagaaugcu

SEQ ID NO: 697905 - RNA, 22 nt, Human
uaguuuuauaauguuaacaucu

SEQ ID NO: 697906 - RNA, 22 nt, Human
uggaguggacuucaugaggcca

SEQ ID NO: 697907 - RNA, 22 nt, Human
guaauuaggaauaaaaugggaa

SEQ ID NO: 697908 - RNA, 22 nt, Human
agcauuuaauuacaguuuaauu

SEQ ID NO: 697909 - RNA, 22 nt, Human
ugcucuaagaacucuaggaauu

SEQ ID NO: 697910 - RNA, 22 nt, Human
uuuuaaaucuccaguugacccc

SEQ ID NO: 697911 - RNA, 22 nt, Human
aggaugacuggaacccaaguga

SEQ ID NO: 697912 - RNA, 17 nt, Human
uuucagauucacuuucu

SEQ ID NO: 697913 - RNA, 22 nt, Human
augcagaagacugaaaagcuga

SEQ ID NO: 697914 - RNA, 22 nt, Human
cagcuucuucaguccuggagcu

SEQ ID NO: 697915 - RNA, 22 nt, Human
ccaggagguggcaggacuugcc

SEQ ID NO: 697916 - RNA, 22 nt, Human
gggucugaggaguaccauuguc

SEQ ID NO: 697917 - RNA, 22 nt, Human
uuagaaagaauagccuggcugc

SEQ ID NO: 697918 - RNA, 22 nt, Human
aggacaguccgggguccuccac

SEQ ID NO: 697919 - RNA, 22 nt, Human
ucugagcuccaugcaggaggcu

SEQ ID NO: 697920 - RNA, 22 nt, Human
cagugagaauucaguagguacu

SEQ ID NO: 697921 - RNA, 22 nt, Human
accgcagugacgugggacuucc

SEQ ID NO: 697922 - RNA, 22 nt, Human
ucuuccaguguagacaucugcc

SEQ ID NO: 697923 - RNA, 22 nt, Human
uccaggccccacugaagccccu

SEQ ID NO: 697924 - RNA, 22 nt, Human
auuuacagugugccuacuauau

SEQ ID NO: 697925 - RNA, 22 nt, Human
uucuggggcuaauacagagguc

SEQ ID NO: 697926 - RNA, 22 nt, Human
auaauggcuugugguguuauuc

SEQ ID NO: 697927 - RNA, 22 nt, Human
aacauugaacuuggcacaccca

SEQ ID NO: 697928 - RNA, 22 nt, Human
ggacaaaauccaaacuucuuag

SEQ ID NO: 697929 - RNA, 18 nt, Human
cagcaucuucauuaggcc

SEQ ID NO: 697930 - RNA, 17 nt, Human
cacaggugugguuugag

SEQ ID NO: 697931 - RNA, 22 nt, Human
cagucaggaaugccuccuuccu

SEQ ID NO: 697932 - RNA, 22 nt, Human
ugggacagugaccccagagguc

SEQ ID NO: 697933 - RNA, 22 nt, Human
gggcccugcgacucgcggcgga

SEQ ID NO: 697934 - RNA, 22 nt, Human
acaaucaguauuuagacccagg

SEQ ID NO: 697935 - RNA, 22 nt, Human
augucuguccccuagcccugau

SEQ ID NO: 697936 - RNA, 22 nt, Human
gagucuggugauggucauuguc

SEQ ID NO: 697937 - RNA, 22 nt, Human
gcauucauucauucauuaggua

SEQ ID NO: 697938 - RNA, 22 nt, Human
uguaggaguccaaucaggagac

SEQ ID NO: 697939 - RNA, 22 nt, Human
uacaagugcuagcagauauugu

SEQ ID NO: 697940 - RNA, 22 nt, Human
agagaagggccuguauguaauc

SEQ ID NO: 697941 - RNA, 22 nt, Human
cccaggagacagaaacagaggu

SEQ ID NO: 697942 - RNA, 22 nt, Human
gaagguuugaaauagguauaga

SEQ ID NO: 697943 - RNA, 22 nt, Human
accagaagcuggagcacaagga

SEQ ID NO: 697944 - RNA, 22 nt, Human
gacuuugugccaaacgccagaa

SEQ ID NO: 697945 - RNA, 22 nt, Human
uagucacacaauuguguacauu

SEQ ID NO: 697946 - RNA, 22 nt, Human
uaaaugacccaugcugaccuca

SEQ ID NO: 697947 - RNA, 22 nt, Human
cgcagaagagguugucuagucc

SEQ ID NO: 697948 - RNA, 22 nt, Human
cugcuuccaugcaauggcaguc

SEQ ID NO: 697949 - RNA, 22 nt, Human
gggcagcugccccucucugggc

SEQ ID NO: 697950 - RNA, 22 nt, Human
ugauuaacguuuuaggcauacu

SEQ ID NO: 697951 - RNA, 22 nt, Human
gagguucaguaaggaauacuga

SEQ ID NO: 697952 - RNA, 22 nt, Human
uucauucccuuauauuagcauu

SEQ ID NO: 697953 - RNA, 22 nt, Human
caguguuuguauagaauaugca

SEQ ID NO: 697954 - RNA, 22 nt, Human
acugucaucagaagaugaaaau

SEQ ID NO: 697955 - RNA, 22 nt, Human
aacaaguguauuaauggaaaua

SEQ ID NO: 697956 - RNA, 22 nt, Human
gaauuagacaugcuuugcuuuu

SEQ ID NO: 697957 - RNA, 22 nt, Human
agguggaguuggcuguaguuca

SEQ ID NO: 697958 - RNA, 22 nt, Human
cuucaagguggcuaaauggggc

SEQ ID NO: 697959 - RNA, 22 nt, Human
gcucagcucuauggacacaaag

SEQ ID NO: 697960 - RNA, 22 nt, Human
accaucuuaguggccagcucuc

SEQ ID NO: 697961 - RNA, 22 nt, Human
cugcacagggauauggggagcu

SEQ ID NO: 697962 - RNA, 22 nt, Human
gaaguauaggagacaaacaaga

SEQ ID NO: 697963 - RNA, 22 nt, Human
cuacagagugaaugcagaaaau

SEQ ID NO: 697964 - RNA, 22 nt, Human
gacuucuucaugucuuuuccac

SEQ ID NO: 697965 - RNA, 22 nt, Human
uguaccaaacccaucauaacua

SEQ ID NO: 697966 - RNA, 22 nt, Human
acuguuauuuguaauccauuau

SEQ ID NO: 697967 - RNA, 22 nt, Human
cccucccuuccaaguugaggac

SEQ ID NO: 697968 - RNA, 22 nt, Human
ggagcugugggacgcuguccca

SEQ ID NO: 697969 - RNA, 21 nt, Human
ugcaggcaggcagagaugcug

SEQ ID NO: 697970 - RNA, 22 nt, Human
uuuagcaagaugcccuggcuuu

SEQ ID NO: 697971 - RNA, 22 nt, Human
gccagcagggaagccuugggcu

SEQ ID NO: 697972 - RNA, 22 nt, Human
guuaacuuuuuacagaaaugaa

SEQ ID NO: 697973 - RNA, 22 nt, Human
caugacaguccugaagagaacg

SEQ ID NO: 697974 - RNA, 22 nt, Human
cuauuuggccaagcugcccaca

SEQ ID NO: 697975 - RNA, 22 nt, Human
cuaguauuuaaaggcuaugauu

SEQ ID NO: 697976 - RNA, 17 nt, Human
gagagcugcugcuuccg

SEQ ID NO: 697977 - RNA, 22 nt, Human
ugugugugggcggaacggcccc

SEQ ID NO: 697978 - RNA, 22 nt, Human
aguggcagagccaggguuggga

SEQ ID NO: 697979 - RNA, 22 nt, Human
acaugcucuccuaaggcccugu

SEQ ID NO: 697980 - RNA, 22 nt, Human
aaacugauaaaauaaguacauu

SEQ ID NO: 697981 - RNA, 22 nt, Human
aagcauuuuaguaaugaacuug

SEQ ID NO: 697982 - RNA, 22 nt, Human
augcauauuucaugaaucuuug

SEQ ID NO: 697983 - RNA, 22 nt, Human
uucauucacccaggaaacaucu

SEQ ID NO: 697984 - RNA, 21 nt, Human
gaaagcacagaaaggacucuu

SEQ ID NO: 697985 - RNA, 23 nt, Human
uaaagugcugauggugagggagc

SEQ ID NO: 697986 - RNA, 22 nt, Human
ggcuggcuggcugguagacaag

SEQ ID NO: 697987 - RNA, 22 nt, Human
gagcaucgcugagaucccagac

SEQ ID NO: 697988 - RNA, 22 nt, Human
uuucagaagucacaguugacug

SEQ ID NO: 697989 - RNA, 22 nt, Human
uggcugcugcagacagacagga

SEQ ID NO: 697990 - RNA, 22 nt, Human
ggcuggcacgaagcccugcugg

SEQ ID NO: 697991 - RNA, 22 nt, Human
aggcaaaauuacaaaguuauua

SEQ ID NO: 697992 - RNA, 22 nt, Human
ccaggacagggagacgggagcc

SEQ ID NO: 697993 - RNA, 22 nt, Human
uucagaaugcuauuucugaaau

SEQ ID NO: 697994 - RNA, 22 nt, Human
cauaauuugauaugcuugaugg

SEQ ID NO: 697995 - RNA, 22 nt, Human
uuucagaccuggaugugggggc

SEQ ID NO: 697996 - RNA, 22 nt, Human
acaugcagugaggaucuuagaa

SEQ ID NO: 697997 - RNA, 22 nt, Human
gagggcugcugccagauaugcc

SEQ ID NO: 697998 - RNA, 22 nt, Human
agagccucugucauggagagaa

SEQ ID NO: 697999 - RNA, 22 nt, Human
ucuacugcacuggugucucauc

SEQ ID NO: 698000 - RNA, 22 nt, Human
ccuuguguuuacaccugucuuu

SEQ ID NO: 698001 - RNA, 22 nt, Human
cugggagaugacucagagcagg

SEQ ID NO: 698002 - RNA, 23 nt, Human
ugcuggcugaaacagccaaagga

SEQ ID NO: 698003 - RNA, 22 nt, Human
uagcuguucaaguuccuggaaa

SEQ ID NO: 698004 - RNA, 22 nt, Human
uucacauaaauagaucacauca

SEQ ID NO: 698005 - RNA, 22 nt, Human
auugauauauuauuucuaacug

SEQ ID NO: 698006 - RNA, 22 nt, Human
uguugccuggggaagcucugau

SEQ ID NO: 698007 - RNA, 22 nt, Human
ccuucugagcuucaauuucagu

SEQ ID NO: 698008 - RNA, 22 nt, Human
uucacuaugcuuggaaacuucu

SEQ ID NO: 698009 - RNA, 21 nt, Human
aggugcuggcgccccaggaga

SEQ ID NO: 698010 - RNA, 22 nt, Human
cauaauauacuacauugaugaa

SEQ ID NO: 698011 - RNA, 22 nt, Human
ggccuggcugguucaguacccu

SEQ ID NO: 698012 - RNA, 22 nt, Human
cugccaggcagcagagggagaa

SEQ ID NO: 698013 - RNA, 22 nt, Human
uauagcaagcuuugagcuuuca

SEQ ID NO: 698014 - RNA, 20 nt, Human
uccaggcuccuccacuuagu

SEQ ID NO: 698015 - RNA, 22 nt, Human
aggugggcgcugcucccgcugg

SEQ ID NO: 698016 - RNA, 22 nt, Human
aaaagcucuuucugcuguagau

SEQ ID NO: 698017 - RNA, 22 nt, Human
accugucaugucaauguucagu

SEQ ID NO: 698018 - RNA, 22 nt, Human
agccugggcaacaacacagcga

SEQ ID NO: 698019 - RNA, 22 nt, Human
ugccagaguuacaugaggguca

SEQ ID NO: 698020 - RNA, 19 nt, Human
ucugggguguggccuggca

SEQ ID NO: 698021 - RNA, 22 nt, Human
cccacuuugguugcacucugcc

SEQ ID NO: 698022 - RNA, 22 nt, Human
uuacucauugcuggaucuagaa

SEQ ID NO: 698023 - RNA, 22 nt, Human
gagacacucaacaaagauauga

SEQ ID NO: 698024 - RNA, 22 nt, Human
gcaaaugaagguggugcuacag

SEQ ID NO: 698025 - RNA, 22 nt, Human
auuuccauuaucaugacaaauu

SEQ ID NO: 698026 - RNA, 22 nt, Human
augagacaugacuucaggccuu

SEQ ID NO: 698027 - RNA, 22 nt, Human
cagaagaggacuggguagcuca

SEQ ID NO: 698028 - RNA, 22 nt, Human
aacccuggagaaggcuuuggau

SEQ ID NO: 698029 - RNA, 22 nt, Human
uagaagauucuaaaguggagag

SEQ ID NO: 698030 - RNA, 22 nt, Human
aaucuguuuuugaaacuuugua

SEQ ID NO: 698031 - RNA, 22 nt, Human
aggaagggcuguuucuccaaga

SEQ ID NO: 698032 - RNA, 22 nt, Human
uugccagauaggcaugaaaagu

SEQ ID NO: 698033 - RNA, 22 nt, Human
auuauugucaucuuaaucuuaa

SEQ ID NO: 698034 - RNA, 22 nt, Human
auggccuggccagagcucugcu

SEQ ID NO: 698035 - RNA, 22 nt, Human
uaacacaugguucugucaggaa

SEQ ID NO: 698036 - RNA, 22 nt, Human
augcaccacagauaucugcgua

SEQ ID NO: 698037 - RNA, 22 nt, Human
uccuguggcuuccacgaccuaa

SEQ ID NO: 698038 - RNA, 22 nt, Human
guuacacaggaaaacauuagca

SEQ ID NO: 698039 - RNA, 22 nt, Human
gcaauaaaguagcagcucauca

SEQ ID NO: 698040 - RNA, 22 nt, Human
gagcuaagcccuggagaggucg

SEQ ID NO: 698041 - RNA, 22 nt, Human
aaguuaggaugaaugccuuagc

SEQ ID NO: 698042 - RNA, 22 nt, Human
auaaucuguggaugguuuugag

SEQ ID NO: 698043 - RNA, 22 nt, Human
agccacuggccugggcagcucu

SEQ ID NO: 698044 - RNA, 22 nt, Human
caacaugccagacauuaguuug

SEQ ID NO: 698045 - RNA, 22 nt, Human
cucugcuuuuaugugccggcgc

SEQ ID NO: 698046 - RNA, 18 nt, Human
uggcuucugaacaacugc

SEQ ID NO: 698047 - RNA, 22 nt, Human
auccaaaguagauuaagucaca

SEQ ID NO: 698048 - RNA, 22 nt, Human
cagagccaacgccaccugccca

SEQ ID NO: 698049 - RNA, 22 nt, Human
acagauaauuagcauaaaugcu

SEQ ID NO: 698050 - RNA, 22 nt, Human
aguccugguucugauucugaca

SEQ ID NO: 698051 - RNA, 22 nt, Human
guaugcaugcauguguauguac

SEQ ID NO: 698052 - RNA, 22 nt, Human
uuaagagcaacauauggugaca

SEQ ID NO: 698053 - RNA, 22 nt, Human
cccugcagggaggauucugaag

SEQ ID NO: 698054 - RNA, 22 nt, Human
augcacauacauaugcucuaua

SEQ ID NO: 698055 - RNA, 22 nt, Human
ccugaggucaugcauuuccaac

SEQ ID NO: 698056 - RNA, 22 nt, Human
uggcuagcccuuguggggagag

SEQ ID NO: 698057 - RNA, 22 nt, Human
acugggaagacuggaauugcuc

SEQ ID NO: 698058 - RNA, 22 nt, Human
aauguucagaggacaauauaaa

SEQ ID NO: 698059 - RNA, 22 nt, Human
auagugucuuucuucacaggca

SEQ ID NO: 698060 - RNA, 22 nt, Human
uauucacaguugauuuacaguu

SEQ ID NO: 698061 - RNA, 22 nt, Human
aucuguguguuauuguuuauca

SEQ ID NO: 698062 - RNA, 21 nt, Human
ccucugcucgggcaugcguuu

SEQ ID NO: 698063 - RNA, 22 nt, Human
ggcagaguugguggagucaguu

SEQ ID NO: 698064 - RNA, 22 nt, Human
guucuucaggcugugcucuaga

SEQ ID NO: 698065 - RNA, 22 nt, Human
uccuaauugcuucauguguugu

SEQ ID NO: 698066 - RNA, 22 nt, Human
augggggcggcugaagcccagg

SEQ ID NO: 698067 - RNA, 22 nt, Human
aggagucagauaugggaaaguu

SEQ ID NO: 698068 - RNA, 22 nt, Human
cucuggacagcaggugcugugg

SEQ ID NO: 698069 - RNA, 21 nt, Human
auggagggaccagggaagcag

SEQ ID NO: 698070 - RNA, 22 nt, Human
uaacacacugaaggugagaugg

SEQ ID NO: 698071 - RNA, 22 nt, Human
gaggccagaugucaugucuuau

SEQ ID NO: 698072 - RNA, 22 nt, Human
aggugacaucccggcagcagag

SEQ ID NO: 698073 - RNA, 18 nt, Human
aagaggcuguucuguggg

SEQ ID NO: 698074 - RNA, 22 nt, Human
cuguauaauucaugcucuuauu

SEQ ID NO: 698075 - RNA, 22 nt, Human
cagcuggcuggucagugcacaa

SEQ ID NO: 698076 - RNA, 22 nt, Human
uauugcuuucucagacguuuag

SEQ ID NO: 698077 - RNA, 22 nt, Human
aguucucaagacaauuaccugu

SEQ ID NO: 698078 - RNA, 22 nt, Human
ucagauuuguccuacuaggcac

SEQ ID NO: 698079 - RNA, 22 nt, Human
ucaggagcagccuuggagagcg

SEQ ID NO: 698080 - RNA, 18 nt, Human
cuugcaguguguggagaa

SEQ ID NO: 698081 - RNA, 22 nt, Human
agcaccugccugcauuggcuau

SEQ ID NO: 698082 - RNA, 22 nt, Human
cuugggaguagaggcaggagca

SEQ ID NO: 698083 - RNA, 22 nt, Human
aguaaaucagaccucauuaugu

SEQ ID NO: 698084 - RNA, 22 nt, Human
uauuaugaucccagcccuggag

SEQ ID NO: 698085 - RNA, 22 nt, Human
ggaacuuuuuaacaagcugcug

SEQ ID NO: 698086 - RNA, 22 nt, Human
gcuggcuuaauagggaugggcu

SEQ ID NO: 698087 - RNA, 22 nt, Human
aaguggagcuauaggcucagau

SEQ ID NO: 698088 - RNA, 22 nt, Human
cacuggaauggauagagcagag

SEQ ID NO: 698089 - RNA, 22 nt, Human
uaagaacaagcuggggguucca

SEQ ID NO: 698090 - RNA, 22 nt, Human
uaauacugaaaggaguaucagc

SEQ ID NO: 698091 - RNA, 22 nt, Human
agggguuggauuuggccuagag

SEQ ID NO: 698092 - RNA, 22 nt, Human
uguaugaggcauacaucaggca

SEQ ID NO: 698093 - RNA, 18 nt, Human
cuacauucauaggaaagg

SEQ ID NO: 698094 - RNA, 22 nt, Human
uuuauuaugauggacaccuucg

SEQ ID NO: 698095 - RNA, 22 nt, Human
ggaaagaaucaagugauccugu

SEQ ID NO: 698096 - RNA, 22 nt, Human
uucagcacaguucaagauggua

SEQ ID NO: 698097 - RNA, 20 nt, Human
aguguuucucaacauggggc

SEQ ID NO: 698098 - RNA, 22 nt, Human
cugcccacaguucucugccaug

SEQ ID NO: 698099 - RNA, 22 nt, Human
gucagccugcacucagggagcg

SEQ ID NO: 698100 - RNA, 22 nt, Human
augcugaauugaugcgagggag

SEQ ID NO: 698101 - RNA, 22 nt, Human
aggggcuccuggccuggagagc

SEQ ID NO: 698102 - RNA, 22 nt, Human
cagcuggcagaaccugcaucca

SEQ ID NO: 698103 - RNA, 22 nt, Human
ucccugggaccggcagcucaca

SEQ ID NO: 698104 - RNA, 22 nt, Human
cuuguuuaagccgcuguuaagc

SEQ ID NO: 698105 - RNA, 22 nt, Human
ugagaauauuguuuuagugagg

SEQ ID NO: 698106 - RNA, 22 nt, Human
ugaguuauugcagcuuccuccu

SEQ ID NO: 698107 - RNA, 22 nt, Human
aggccaggguagggcccauugu

SEQ ID NO: 698108 - RNA, 17 nt, Human
gcucugccccagccucu

SEQ ID NO: 698109 - RNA, 22 nt, Human
caggugggcguggcgagaaggc

SEQ ID NO: 698110 - RNA, 22 nt, Human
caucagaagaaagacaaaugau

SEQ ID NO: 698111 - RNA, 22 nt, Human
uccugcaguuacaucccagcca

SEQ ID NO: 698112 - RNA, 23 nt, Human
uuggaagggaagagcauuugaga

SEQ ID NO: 698113 - RNA, 22 nt, Human
acaaaugaaucauacauaaugu

SEQ ID NO: 698114 - RNA, 22 nt, Human
caggcuccagcuuccugcucag

SEQ ID NO: 698115 - RNA, 22 nt, Human
auagacaaacacgaagaugaca

SEQ ID NO: 698116 - RNA, 21 nt, Human
auaagcaugcugauuacauuu

SEQ ID NO: 698117 - RNA, 22 nt, Human
gggcucaggccuggccucucac

SEQ ID NO: 698118 - RNA, 22 nt, Human
uuaaggcugguccccucugcgu

SEQ ID NO: 698119 - RNA, 22 nt, Human
ggaagcugggaucucucucccg

SEQ ID NO: 698120 - RNA, 22 nt, Human
uaccaguaauguaacuuugcaa

SEQ ID NO: 698121 - RNA, 21 nt, Human
cuucaucccggagauucuggu

SEQ ID NO: 698122 - RNA, 22 nt, Human
uguguggaugcagcgugggucu

SEQ ID NO: 698123 - RNA, 22 nt, Human
aggaagcacuggaagggguugg

SEQ ID NO: 698124 - RNA, 22 nt, Human
aaaccucuuuccauuagaggaa

SEQ ID NO: 698125 - RNA, 22 nt, Human
ugucauaugcugucauagccau

SEQ ID NO: 698126 - RNA, 22 nt, Human
ucacuguagagucuguuuccac

SEQ ID NO: 698127 - RNA, 22 nt, Human
caccuggcuggaagugcuccgg

SEQ ID NO: 698128 - RNA, 22 nt, Human
aggagaucagccucccugcaac

SEQ ID NO: 698129 - RNA, 22 nt, Human
cuucucuucccagggacacagg

SEQ ID NO: 698130 - RNA, 22 nt, Human
acaaagucugaaaccugaggca

SEQ ID NO: 698131 - RNA, 22 nt, Human
auuugucugcuugcugccuucc

SEQ ID NO: 698132 - RNA, 22 nt, Human
uugaguucagggguugauugga

SEQ ID NO: 698133 - RNA, 22 nt, Human
uaaguuuggggaaaauguuaag

SEQ ID NO: 698134 - RNA, 22 nt, Human
aaauggcauagaggugaaggua

SEQ ID NO: 698135 - RNA, 22 nt, Human
uuugacaaauaggggaauaagg

SEQ ID NO: 698136 - RNA, 19 nt, Human
agucuuucccacucgucuu

SEQ ID NO: 698137 - RNA, 22 nt, Human
gggcucagggacacaugugugu

SEQ ID NO: 698138 - RNA, 22 nt, Human
aggcaaagcgauaccagagcua

SEQ ID NO: 698139 - RNA, 22 nt, Human
auggaaauggagggugcuagaa

SEQ ID NO: 698140 - RNA, 23 nt, Human
acacauauauucagauacagaug

SEQ ID NO: 698141 - RNA, 22 nt, Human
ugcucugugguccaagauggcu

SEQ ID NO: 698142 - RNA, 22 nt, Human
uacagaaucuaugcuucacagu

SEQ ID NO: 698143 - RNA, 22 nt, Human
uauuuccuguggauacuuuuag

SEQ ID NO: 698144 - RNA, 22 nt, Human
aauggagacuucaaaauggauu

SEQ ID NO: 698145 - RNA, 22 nt, Human
acacacaaaucuauuagugaau

SEQ ID NO: 698146 - RNA, 22 nt, Human
acagaggaaggcugagcugccc

SEQ ID NO: 698147 - RNA, 22 nt, Human
guuccuaagcacugugcauucu

SEQ ID NO: 698148 - RNA, 22 nt, Human
uagaagcaguaauagaaauagg

SEQ ID NO: 698149 - RNA, 22 nt, Human
gagagagaaggccugugggugu

SEQ ID NO: 698150 - RNA, 20 nt, Human
aggcaguguagagaugagua

SEQ ID NO: 698151 - RNA, 22 nt, Human
gggccaggaguggagauauggg

SEQ ID NO: 698152 - RNA, 22 nt, Human
aggcuguguggauaauauuggg

SEQ ID NO: 698153 - RNA, 22 nt, Human
uucuuaagcaccuaaaaagugg

SEQ ID NO: 698154 - RNA, 22 nt, Human
cuccugggagcagggauggaug

SEQ ID NO: 698155 - RNA, 22 nt, Human
gggcagcagaggaucccuuaau

SEQ ID NO: 698156 - RNA, 22 nt, Human
gauggagucugaagcugggaac

SEQ ID NO: 698157 - RNA, 22 nt, Human
gcuugguuucuaacuuuucaua

SEQ ID NO: 698158 - RNA, 22 nt, Human
ugaaaaacuuuaauccauaaag

SEQ ID NO: 698159 - RNA, 22 nt, Human
acaguauagggcuuauauugua

SEQ ID NO: 698160 - RNA, 22 nt, Human
accccagcccugcuucugggag

SEQ ID NO: 698161 - RNA, 22 nt, Human
agagccugaggcccugagaggg

SEQ ID NO: 698162 - RNA, 22 nt, Human
cugagguuuguccauccuuggu

SEQ ID NO: 698163 - RNA, 22 nt, Human
cacagcuuagaaaagaagccau

SEQ ID NO: 698164 - RNA, 22 nt, Human
uucucucuguggucccauuuug

SEQ ID NO: 698165 - RNA, 22 nt, Human
cugagcagcaacccagagccuc

SEQ ID NO: 698166 - RNA, 22 nt, Human
gggaaauuguaacaagucuguu

SEQ ID NO: 698167 - RNA, 22 nt, Human
uauguaaaguagauggcaggua

SEQ ID NO: 698168 - RNA, 22 nt, Human
gcugcccagcaggccccagggg

SEQ ID NO: 698169 - RNA, 22 nt, Human
gaggacaaagcccaggugcugg

SEQ ID NO: 698170 - RNA, 22 nt, Human
auauguguauggauuucuaucu

SEQ ID NO: 698171 - RNA, 22 nt, Human
uaagacacauucauaucugucu

SEQ ID NO: 698172 - RNA, 22 nt, Human
cagcucuguucauagauggugc

SEQ ID NO: 698173 - RNA, 22 nt, Human
gccuggggucccuuguuggcac

SEQ ID NO: 698174 - RNA, 22 nt, Human
acauacuuauguguauaugugu

SEQ ID NO: 698175 - RNA, 23 nt, Human
ugugacagugacaauacugacuu

SEQ ID NO: 698176 - RNA, 22 nt, Human
augaagucucuuuuucaugaga

SEQ ID NO: 698177 - RNA, 22 nt, Human
augcugccuccucuucagccgc

SEQ ID NO: 698178 - RNA, 22 nt, Human
agagggaucacccuguuucugg

SEQ ID NO: 698179 - RNA, 20 nt, Human
acauugauuauguuuguaga

SEQ ID NO: 698180 - RNA, 22 nt, Human
ucuacuuccgcaaaaggcacau

SEQ ID NO: 698181 - RNA, 22 nt, Human
uugaagauggaucgccacucuc

SEQ ID NO: 698182 - RNA, 22 nt, Human
auguguaugagugugcuucuuu

SEQ ID NO: 698183 - RNA, 22 nt, Human
caaggagaguaauugaaugaga

SEQ ID NO: 698184 - RNA, 22 nt, Human
aacaaauuaguugcaagacugg

SEQ ID NO: 698185 - RNA, 22 nt, Human
uucggucuuguguaaacacugu

SEQ ID NO: 698186 - RNA, 22 nt, Human
aacauguaaccagcauucaucu

SEQ ID NO: 698187 - RNA, 22 nt, Human
ugagcuguguccugggggcagu

SEQ ID NO: 698188 - RNA, 22 nt, Human
ggguggccuuaggcaagucacu

SEQ ID NO: 698189 - RNA, 22 nt, Human
gccauggggcucagcugcacua

SEQ ID NO: 698190 - RNA, 22 nt, Human
ugcugagaugaauagagaccuc

SEQ ID NO: 698191 - RNA, 22 nt, Human
uccaaggcuccggcccuggcgu

SEQ ID NO: 698192 - RNA, 22 nt, Human
agcacagauuugucaacauaga

SEQ ID NO: 698193 - RNA, 22 nt, Human
uuagaaacucaacucugggaau

SEQ ID NO: 698194 - RNA, 22 nt, Human
ugcuuucacaccaugccuauaa

SEQ ID NO: 698195 - RNA, 22 nt, Human
ccaugagcuuccuauauagggu

SEQ ID NO: 698196 - RNA, 22 nt, Human
auacacauuugcuagagauggg

SEQ ID NO: 698197 - RNA, 22 nt, Human
caaauguguagagcuuuugggg

SEQ ID NO: 698198 - RNA, 17 nt, Human
caggcuccuuccagauu

SEQ ID NO: 698199 - RNA, 22 nt, Human
ugauucuauggaaggcauaagg

SEQ ID NO: 698200 - RNA, 22 nt, Human
ucuauuugcugguugcuucugu

SEQ ID NO: 698201 - RNA, 22 nt, Human
aucugggccaauccuaguacca

SEQ ID NO: 698202 - RNA, 22 nt, Human
uggaggccagugaaaguagauu

SEQ ID NO: 698203 - RNA, 22 nt, Human
caaacauuugacuucucucagg

SEQ ID NO: 698204 - RNA, 22 nt, Human
uucuagaggggagauacuagua

SEQ ID NO: 698205 - RNA, 22 nt, Human
ucagcuguguaucccagggccu

SEQ ID NO: 698206 - RNA, 22 nt, Human
cuggaagggucuacuuagcaga

SEQ ID NO: 698207 - RNA, 22 nt, Human
cugcuuugcauagcugccagag

SEQ ID NO: 698208 - RNA, 22 nt, Human
aguuuucugauguguagugaga

SEQ ID NO: 698209 - RNA, 22 nt, Human
uaaugaaugagaauauaacaga

SEQ ID NO: 698210 - RNA, 22 nt, Human
uuaguaguaagagucauaugua

SEQ ID NO: 698211 - RNA, 22 nt, Human
ggcugaaguguaguggcucacu

SEQ ID NO: 698212 - RNA, 22 nt, Human
gaagugugcacaucuuacaagu

SEQ ID NO: 698213 - RNA, 22 nt, Human
uuucacagguaagcaauacagg

SEQ ID NO: 698214 - RNA, 22 nt, Human
ccagugugcauuaucauguguc

SEQ ID NO: 698215 - RNA, 22 nt, Human
ucuggcuucgcagcucccagcc

SEQ ID NO: 698216 - RNA, 22 nt, Human
aagacacugauacucugugauu

SEQ ID NO: 698217 - RNA, 22 nt, Human
uguguuuuggaaggaacaugca

SEQ ID NO: 698218 - RNA, 22 nt, Human
cuccagagagaaaggaggccgc

SEQ ID NO: 698219 - RNA, 22 nt, Human
agaguuaagacguacaugagug

SEQ ID NO: 698220 - RNA, 22 nt, Human
auaaaugccucagaaucauccc

SEQ ID NO: 698221 - RNA, 22 nt, Human
ggucccaggagaauaggugcaa

SEQ ID NO: 698222 - RNA, 22 nt, Human
cccugagcaacaaacugaauac

SEQ ID NO: 698223 - RNA, 22 nt, Human
cuccagcuucugcccagagacu

SEQ ID NO: 698224 - RNA, 22 nt, Human
ugccauuugccccagcacuguc

SEQ ID NO: 698225 - RNA, 22 nt, Human
gcagugaagauuugggcucugg

SEQ ID NO: 698226 - RNA, 22 nt, Human
uaaagguugaaaacugacugcc

SEQ ID NO: 698227 - RNA, 22 nt, Human
cugcaugcugagccaacaguga

SEQ ID NO: 698228 - RNA, 22 nt, Human
auugucuuaaacaaauguguuu

SEQ ID NO: 698229 - RNA, 22 nt, Human
augucuguuugcugagcccggc

SEQ ID NO: 698230 - RNA, 22 nt, Human
uacaaugcaaaauacugucugc

SEQ ID NO: 698231 - RNA, 22 nt, Human
auccaggcuggguguggcuacu

SEQ ID NO: 698232 - RNA, 22 nt, Human
uauguguaggaggaggacaggg

SEQ ID NO: 698233 - RNA, 21 nt, Human
uccugugaggaccugucagug

SEQ ID NO: 698234 - RNA, 22 nt, Human
ugaauaguccuuggaauaacug

SEQ ID NO: 698235 - RNA, 22 nt, Human
gaaacuucuugucucacaguuc

SEQ ID NO: 698236 - RNA, 22 nt, Human
guggugaguucaggcuggggug

SEQ ID NO: 698237 - RNA, 22 nt, Human
cccagagggcugaggauaugaa

SEQ ID NO: 698238 - RNA, 16 nt, Human
ugaggccagccauuuc

SEQ ID NO: 698239 - RNA, 22 nt, Human
cagaggcuucaagucauucucc

SEQ ID NO: 698240 - RNA, 22 nt, Human
ugauuuccaguugcugggugcu

SEQ ID NO: 698241 - RNA, 22 nt, Human
aacaggggauuagauagcaggc

SEQ ID NO: 698242 - RNA, 22 nt, Human
caugaacauucagaaauacagc

SEQ ID NO: 698243 - RNA, 22 nt, Human
cuauggaaaccuaaucaggaga

SEQ ID NO: 698244 - RNA, 22 nt, Human
agcucagaacugcagacaugug

SEQ ID NO: 698245 - RNA, 20 nt, Human
acaguguuuuugaguagagc

SEQ ID NO: 698246 - RNA, 22 nt, Human
aagauuuccuucaguagagcua

SEQ ID NO: 698247 - RNA, 22 nt, Human
uauucucauuagucuguauucc

SEQ ID NO: 698248 - RNA, 22 nt, Human
gucuccuuguggaucucaagga

SEQ ID NO: 698249 - RNA, 22 nt, Human
acugauuacacgaguucugacu

SEQ ID NO: 698250 - RNA, 22 nt, Human
agaaaguuugagaacuguagau

SEQ ID NO: 698251 - RNA, 22 nt, Human
uacaaccagauccucuaaguca

SEQ ID NO: 698252 - RNA, 22 nt, Human
ccuugcugaccaucaccuuuga

SEQ ID NO: 698253 - RNA, 22 nt, Human
ggccacugccuccgccauggcu

SEQ ID NO: 698254 - RNA, 22 nt, Human
caucaucaaaacaaauggaguc

SEQ ID NO: 698255 - RNA, 22 nt, Human
uucugcugcugcugcacccaau

SEQ ID NO: 698256 - RNA, 17 nt, Human
gaauuucuuggucaaaa

SEQ ID NO: 698257 - RNA, 22 nt, Human
acaggagcccaggaugggcgga

SEQ ID NO: 698258 - RNA, 21 nt, Human
aacaguucucuuugaaggugu

SEQ ID NO: 698259 - RNA, 18 nt, Human
uccagagcagucuuuggc

SEQ ID NO: 698260 - RNA, 22 nt, Human
aaagcugcccagcugccuguuu

SEQ ID NO: 698261 - RNA, 22 nt, Human
uggcuccuaucaaggagugggu

SEQ ID NO: 698262 - RNA, 22 nt, Human
aagccauggcaugccaggauca

SEQ ID NO: 698263 - RNA, 22 nt, Human
uaaugccgucucuacaagacuc

SEQ ID NO: 698264 - RNA, 19 nt, Human
aagauugccuuguuccauu

SEQ ID NO: 698265 - RNA, 22 nt, Human
cuucaaaucccccugaguuuga

SEQ ID NO: 698266 - RNA, 22 nt, Human
ccucagcagacacgcuucucac

SEQ ID NO: 698267 - RNA, 22 nt, Human
augaggcagauguugcaugagg

SEQ ID NO: 698268 - RNA, 22 nt, Human
uuguuaaaaugaggucauucug

SEQ ID NO: 698269 - RNA, 22 nt, Human
acagaugaugugcacagauaga

SEQ ID NO: 698270 - RNA, 22 nt, Human
uuuccuaagggaugcggcucaa

SEQ ID NO: 698271 - RNA, 22 nt, Human
ggagccugugcccaagcccaga

SEQ ID NO: 698272 - RNA, 22 nt, Human
aggcuguugagccccagcaagu

SEQ ID NO: 698273 - RNA, 22 nt, Human
uagcagcaauucaggugugaug

SEQ ID NO: 698274 - RNA, 18 nt, Human
uaggagagaauuuauuua

SEQ ID NO: 698275 - RNA, 22 nt, Human
uuacagauggcaguuucuugag

SEQ ID NO: 698276 - RNA, 23 nt, Human
cagugcugguucugccugugggg

SEQ ID NO: 698277 - RNA, 22 nt, Human
cucauacauaugccauuccugc

SEQ ID NO: 698278 - RNA, 22 nt, Human
ccuguucagagcuaagcaucau

SEQ ID NO: 698279 - RNA, 22 nt, Human
ugccaggcacgugagaguggcc

SEQ ID NO: 698280 - RNA, 22 nt, Human
ggccugcucaaacagauuccug

SEQ ID NO: 698281 - RNA, 22 nt, Human
uaugcacugguacuauucgugu

SEQ ID NO: 698282 - RNA, 17 nt, Human
ugcugcuaauuaaaaua

SEQ ID NO: 698283 - RNA, 22 nt, Human
cggaggggauacauuuucugaa

SEQ ID NO: 698284 - RNA, 22 nt, Human
uuguggcucgugagauguuagg

SEQ ID NO: 698285 - RNA, 22 nt, Human
agccacagucuguagccagcuu

SEQ ID NO: 698286 - RNA, 22 nt, Human
augagguaauacuuucaguccu

SEQ ID NO: 698287 - RNA, 22 nt, Human
acacuuuagauauucccuucug

SEQ ID NO: 698288 - RNA, 22 nt, Human
uugggagcuuggccgagaugua

SEQ ID NO: 698289 - RNA, 22 nt, Human
gugaacugcugaguuuuaucau

SEQ ID NO: 698290 - RNA, 22 nt, Human
gcccaagaucuggagcugcagg

SEQ ID NO: 698291 - RNA, 22 nt, Human
agcuuuauagaaaggaucagug

SEQ ID NO: 698292 - RNA, 22 nt, Human
cacagaggaaugcaucagcaga

SEQ ID NO: 698293 - RNA, 21 nt, Human
uucugcauuaagguggagaua

SEQ ID NO: 698294 - RNA, 22 nt, Human
ucucuuaauuguaaugguuccu

SEQ ID NO: 698295 - RNA, 22 nt, Human
cuuucucuucagcacccagccc

SEQ ID NO: 698296 - RNA, 22 nt, Human
ugaauuaucuuguaauuuugaa

SEQ ID NO: 698297 - RNA, 22 nt, Human
aagauucuguauuucuaacaau

SEQ ID NO: 698298 - RNA, 22 nt, Human
cuguuauuuuccucugaacucu

SEQ ID NO: 698299 - RNA, 22 nt, Human
auuuaagacugacuucaccagu

SEQ ID NO: 698300 - RNA, 22 nt, Human
uguuuauugcagugcugggcug

SEQ ID NO: 698301 - RNA, 22 nt, Human
uccucuggucuucgguguggac

SEQ ID NO: 698302 - RNA, 22 nt, Human
auguguaugcaugcacuaagau

SEQ ID NO: 698303 - RNA, 22 nt, Human
acuuggcugggagaguugaaga

SEQ ID NO: 698304 - RNA, 22 nt, Human
aagacaugcaauuagcaaggaa

SEQ ID NO: 698305 - RNA, 22 nt, Human
ucagguccaagauggccaucca

SEQ ID NO: 698306 - RNA, 22 nt, Human
aauugugcccgugacauuucau

SEQ ID NO: 698307 - RNA, 22 nt, Human
aggucacagcuuucucgugagg

SEQ ID NO: 698308 - RNA, 22 nt, Human
ugauucuguucuccuugagaau

SEQ ID NO: 698309 - RNA, 22 nt, Human
ugauucagucucuucaggagaa

SEQ ID NO: 698310 - RNA, 22 nt, Human
aaugcauaccaugucaucuuug

SEQ ID NO: 698311 - RNA, 22 nt, Human
agaauguguuauuagagaagga

SEQ ID NO: 698312 - RNA, 16 nt, Human
gacacaugggggaaaa

SEQ ID NO: 698313 - RNA, 22 nt, Human
accuuuggauaaucuuuguguu

SEQ ID NO: 698314 - RNA, 22 nt, Human
ugugggaggucuggaaggcucc

SEQ ID NO: 698315 - RNA, 18 nt, Human
uauucuguccuaugaagc

SEQ ID NO: 698316 - RNA, 18 nt, Human
gggcaucauucacaaagu

SEQ ID NO: 698317 - RNA, 21 nt, Human
cugcccuagauggcucuggaa

SEQ ID NO: 698318 - RNA, 21 nt, Human
aggggacagaguagcuccagg

SEQ ID NO: 698319 - RNA, 18 nt, Human
cugcccagagcauuucau

SEQ ID NO: 698320 - RNA, 22 nt, Human
ggccucugguucacagggagga

SEQ ID NO: 698321 - RNA, 22 nt, Human
aucugaagaaugaauggaauua

SEQ ID NO: 698322 - RNA, 22 nt, Human
uggcuggauaucagaggaagug

SEQ ID NO: 698323 - RNA, 22 nt, Human
agcuggcccacuguguggucca

SEQ ID NO: 698324 - RNA, 22 nt, Human
aucuuugaagaggacuugaagu

SEQ ID NO: 698325 - RNA, 17 nt, Human
gacuucaacuucugcug

SEQ ID NO: 698326 - RNA, 21 nt, Human
aggcugcuggcucaggguccu

SEQ ID NO: 698327 - RNA, 20 nt, Human
uucccuggaaggagaagcag

SEQ ID NO: 698328 - RNA, 22 nt, Human
uauggguaggguuugauaagau

SEQ ID NO: 698329 - RNA, 21 nt, Human
cuucuuggggagcagcuagac

SEQ ID NO: 698330 - RNA, 22 nt, Human
uauagcaagcaggacagucuca

SEQ ID NO: 698331 - RNA, 22 nt, Human
cugauuccagagucuguguucu

SEQ ID NO: 698332 - RNA, 22 nt, Human
ucucuggaauuggcugaggcaa

SEQ ID NO: 698333 - RNA, 22 nt, Human
ggucugaguggugcugacucag

SEQ ID NO: 698334 - RNA, 22 nt, Human
gcucuguguccacagcuggaaa

SEQ ID NO: 698335 - RNA, 22 nt, Human
ggugaggcccagugaucugugu

SEQ ID NO: 698336 - RNA, 18 nt, Human
ggcaggggugaaccacag

SEQ ID NO: 698337 - RNA, 22 nt, Human
caaaugaaguccaaagggcuua

SEQ ID NO: 698338 - RNA, 22 nt, Human
aacuguaauuuuuacauaguaa

SEQ ID NO: 698339 - RNA, 22 nt, Human
cuggcucugaguggcucuaauu

SEQ ID NO: 698340 - RNA, 22 nt, Human
ugagcaggcaaacaaugguuau

SEQ ID NO: 698341 - RNA, 22 nt, Human
ggauggcuguaaaaggugggaa

SEQ ID NO: 698342 - RNA, 22 nt, Human
acagugaaaaguagcuaacaca

SEQ ID NO: 698343 - RNA, 22 nt, Human
aaauaucuuaggaguauaugag

SEQ ID NO: 698344 - RNA, 22 nt, Human
uugcccugaagaacgucccaga

SEQ ID NO: 698345 - RNA, 21 nt, Human
ucuuuucucagcuuugugguu

SEQ ID NO: 698346 - RNA, 22 nt, Human
cacugcuugauugacaugcacg

SEQ ID NO: 698347 - RNA, 22 nt, Human
cagugguauuugagagaaugga

SEQ ID NO: 698348 - RNA, 22 nt, Human
auacaugugggucuaaacauau

SEQ ID NO: 698349 - RNA, 22 nt, Human
gcagcgagugcggcugccacag

SEQ ID NO: 698350 - RNA, 22 nt, Human
ucucauaauuagguaagucaga

SEQ ID NO: 698351 - RNA, 22 nt, Human
uguccaggcuaaagugcagugg

SEQ ID NO: 698352 - RNA, 22 nt, Human
cagggagcuggcuggcgugagu

SEQ ID NO: 698353 - RNA, 22 nt, Human
ugugcucugcaaucaguucuuu

SEQ ID NO: 698354 - RNA, 22 nt, Human
ugguuacccagucgcuggaguu

SEQ ID NO: 698355 - RNA, 22 nt, Human
ucaaguauuuauuucugcuggc

SEQ ID NO: 698356 - RNA, 22 nt, Human
ucuggggaugagugaugucgua

SEQ ID NO: 698357 - RNA, 22 nt, Human
aggggaaggccagccuguagag

SEQ ID NO: 698358 - RNA, 21 nt, Human
gcccagcaaggugagaaggcc

SEQ ID NO: 698359 - RNA, 20 nt, Human
uacugggucuggguccugga

SEQ ID NO: 698360 - RNA, 22 nt, Human
agucugaaggcaaucugcugac

SEQ ID NO: 698361 - RNA, 19 nt, Human
uggcucugucgaaggcaca

SEQ ID NO: 698362 - RNA, 22 nt, Human
cugugccuucuacuucacucua

SEQ ID NO: 698363 - RNA, 22 nt, Human
ucagcuguagguauggaugucc

SEQ ID NO: 698364 - RNA, 22 nt, Human
caggcagagaggagcauuuaau

SEQ ID NO: 698365 - RNA, 22 nt, Human
uccuuaggaaaaugaugagggg

SEQ ID NO: 698366 - RNA, 22 nt, Human
ucuaaugaguuagauaauuuug

SEQ ID NO: 698367 - RNA, 22 nt, Human
agagauuuacacaugccuuuuc

SEQ ID NO: 698368 - RNA, 22 nt, Human
caguauuuguucccuaucaaug

SEQ ID NO: 698369 - RNA, 22 nt, Human
gcuggcuggaaugggagaagaa

SEQ ID NO: 698370 - RNA, 22 nt, Human
cuggaggagcauggacuggagu

SEQ ID NO: 698371 - RNA, 22 nt, Human
uuagcaaauuuccaggugaugc

SEQ ID NO: 698372 - RNA, 22 nt, Human
gaggagagaagcuaacggugcu

SEQ ID NO: 698373 - RNA, 22 nt, Human
ugccccucuugagaagcucagc

SEQ ID NO: 698374 - RNA, 22 nt, Human
ccccaggccuguuggauggcgc

SEQ ID NO: 698375 - RNA, 21 nt, Human
uucuccccagcgaauccucgg

SEQ ID NO: 698376 - RNA, 22 nt, Human
auauucuggguuagauauguuu

SEQ ID NO: 698377 - RNA, 22 nt, Human
ugccugaugcaggaguaucaga

SEQ ID NO: 698378 - RNA, 22 nt, Human
cauugcacucuggcuggaacgg

SEQ ID NO: 698379 - RNA, 22 nt, Human
cuguuuccccaugcccugacuc

SEQ ID NO: 698380 - RNA, 22 nt, Human
ucaggacagagaucagaacuuc

SEQ ID NO: 698381 - RNA, 22 nt, Human
uugauucauauagauaugcgug

SEQ ID NO: 698382 - RNA, 22 nt, Human
uuagcuuuuaagugugcuacau

SEQ ID NO: 698383 - RNA, 22 nt, Human
cugaacugacagacugccugcu

SEQ ID NO: 698384 - RNA, 22 nt, Human
ugcuuggccuacuuguccuuug

SEQ ID NO: 698385 - RNA, 22 nt, Human
gugccuccaucagugccuccaa

SEQ ID NO: 698386 - RNA, 22 nt, Human
uggaaggcaggaccugccuugg

SEQ ID NO: 698387 - RNA, 22 nt, Human
aucauacacucacauaaacaga

SEQ ID NO: 698388 - RNA, 22 nt, Human
cagugcagguuuagggcugggg

SEQ ID NO: 698389 - RNA, 22 nt, Human
uccagaggggcagcccugugcu

SEQ ID NO: 698390 - RNA, 22 nt, Human
gggugaagcuccugcaggggcc

SEQ ID NO: 698391 - RNA, 22 nt, Human
gucugcccucacgccagcuggg

SEQ ID NO: 698392 - RNA, 22 nt, Human
gauuucuacuugaacuugcuaa

SEQ ID NO: 698393 - RNA, 22 nt, Human
gcuuccagggugggggauguuu

SEQ ID NO: 698394 - RNA, 22 nt, Human
cuguggcuaggaagcuguggga

SEQ ID NO: 698395 - RNA, 22 nt, Human
agcaauaauuuaggccuuuccu

SEQ ID NO: 698396 - RNA, 22 nt, Human
gcaguauacacugauacaugag

SEQ ID NO: 698397 - RNA, 20 nt, Human
acacauagauaagaagcuga

SEQ ID NO: 698398 - RNA, 22 nt, Human
gugggaagucucucggaggaag

SEQ ID NO: 698399 - RNA, 22 nt, Human
ccaaagucuggagcagcagagc

SEQ ID NO: 698400 - RNA, 22 nt, Human
ugaauaauuccuuuuugucaag

SEQ ID NO: 698401 - RNA, 22 nt, Human
ugccagcuuuugacuaucuuag

SEQ ID NO: 698402 - RNA, 22 nt, Human
uugcuucaucagaguaaacaag

SEQ ID NO: 698403 - RNA, 22 nt, Human
agcugagguugaagagugaacg

SEQ ID NO: 698404 - RNA, 22 nt, Human
uggaaugagcuggcuaauaacc

SEQ ID NO: 698405 - RNA, 22 nt, Human
caaugcuugcugacucccuguc

SEQ ID NO: 698406 - RNA, 22 nt, Human
cacauuugaaggaauuagcauu

SEQ ID NO: 698407 - RNA, 22 nt, Human
gccagggcaggggagcaucugc

SEQ ID NO: 698408 - RNA, 21 nt, Human
cugucuggccgcgggcuccgc

SEQ ID NO: 698409 - RNA, 22 nt, Human
aagggcucccaacucaucuuuu

SEQ ID NO: 698410 - RNA, 22 nt, Human
cugucauuuuuuuagaacaccu

SEQ ID NO: 698411 - RNA, 22 nt, Human
cuguauguuccguuuugucacu

SEQ ID NO: 698412 - RNA, 22 nt, Human
gguggacaaaugaaugacugaa

SEQ ID NO: 698413 - RNA, 22 nt, Human
ccaccuggggcuguggccccuu

SEQ ID NO: 698414 - RNA, 19 nt, Human
acuguagcacugcaguaua

SEQ ID NO: 698415 - RNA, 22 nt, Human
aucugccuguauuuaccaucau

SEQ ID NO: 698416 - RNA, 22 nt, Human
aacagcauaaguauuuauuuca

SEQ ID NO: 698417 - RNA, 22 nt, Human
agcauucaugaugacaacagga

SEQ ID NO: 698418 - RNA, 22 nt, Human
gaaaugugaccuacuuccuugu

SEQ ID NO: 698419 - RNA, 22 nt, Human
cagcuguuucaguagcguuacu

SEQ ID NO: 698420 - RNA, 18 nt, Human
caggagcaggaguugaac

SEQ ID NO: 698421 - RNA, 22 nt, Human
uuacuugguguucugcccagga

SEQ ID NO: 698422 - RNA, 22 nt, Human
ugcuucugcaacuugaauguac

SEQ ID NO: 698423 - RNA, 22 nt, Human
aaugaacuguguuaacugaaua

SEQ ID NO: 698424 - RNA, 19 nt, Human
uguggccaugguucagcug

SEQ ID NO: 698425 - RNA, 22 nt, Human
guggauuacaagacaguugaga

SEQ ID NO: 698426 - RNA, 22 nt, Human
uccuuggcagcagggagcauga

SEQ ID NO: 698427 - RNA, 22 nt, Human
uggcaggagagcgucagaucag

SEQ ID NO: 698428 - RNA, 22 nt, Human
cuccccagcucgcgggugacgg

SEQ ID NO: 698429 - RNA, 22 nt, Human
ucugggagcacacgcagugauc

SEQ ID NO: 698430 - RNA, 22 nt, Human
uugucauugggguuauuuguua

SEQ ID NO: 698431 - RNA, 22 nt, Human
auuucuggacugaaaaggaagu

SEQ ID NO: 698432 - RNA, 22 nt, Human
uuccucucaacaugccugccgg

SEQ ID NO: 698433 - RNA, 22 nt, Human
aagcugaggcuccccugaggga

SEQ ID NO: 698434 - RNA, 22 nt, Human
acaugaacauuauaucagcaag

SEQ ID NO: 698435 - RNA, 23 nt, Human
agcuucauuauuuuccaugaucu

SEQ ID NO: 698436 - RNA, 22 nt, Human
uggcuccugcauuugugcuaac

SEQ ID NO: 698437 - RNA, 22 nt, Human
agucuccacacuggcagaugcc

SEQ ID NO: 698438 - RNA, 22 nt, Human
augcacaacaguggcugccuug

SEQ ID NO: 698439 - RNA, 22 nt, Human
aaauugcagaugcuaaaugacu

SEQ ID NO: 698440 - RNA, 21 nt, Human
gcuggcuuccugagggcugag

SEQ ID NO: 698441 - RNA, 22 nt, Human
cuuuacacaugagaccugcaau

SEQ ID NO: 698442 - RNA, 22 nt, Human
aauguggcauugucauuauugg

SEQ ID NO: 698443 - RNA, 22 nt, Human
ucaggucuguacuauugucuug

SEQ ID NO: 698444 - RNA, 22 nt, Human
uccaggcauuccagccauucca

SEQ ID NO: 698445 - RNA, 22 nt, Human
uggcaggcgggagccauagagg

SEQ ID NO: 698446 - RNA, 22 nt, Human
augcuaaaaacuugaucauuau

SEQ ID NO: 698447 - RNA, 22 nt, Human
auuuuccagccuuucuagaacu

SEQ ID NO: 698448 - RNA, 22 nt, Human
gcccucuggcacagagaugcag

SEQ ID NO: 698449 - RNA, 22 nt, Human
cauuuguaggaugcuucuuguu

SEQ ID NO: 698450 - RNA, 22 nt, Human
cucccugggccucaguuucucu

SEQ ID NO: 698451 - RNA, 22 nt, Human
ucuauuucgcauauaaguuuug

SEQ ID NO: 698452 - RNA, 22 nt, Human
uuuucaguugugcucucuaguu

SEQ ID NO: 698453 - RNA, 22 nt, Human
ugagaguuccuccucuuuccac

SEQ ID NO: 698454 - RNA, 22 nt, Human
uucaaugccuagaacuuagcau

SEQ ID NO: 698455 - RNA, 22 nt, Human
aacagcagaaacugcaagcuac

SEQ ID NO: 698456 - RNA, 22 nt, Human
ggccagagagcagccaggauuc

SEQ ID NO: 698457 - RNA, 22 nt, Human
ccuccuggcuuuucccauugaa

SEQ ID NO: 698458 - RNA, 22 nt, Human
ugcuuggcuuucugagcuucug

SEQ ID NO: 698459 - RNA, 23 nt, Human
uggccagcagaagcaaggggagc

SEQ ID NO: 698460 - RNA, 17 nt, Human
ucuuuccugccaugcuc

SEQ ID NO: 698461 - RNA, 22 nt, Human
acuguggccaaagccucuggga

SEQ ID NO: 698462 - RNA, 22 nt, Human
caggacacagaauaaggcaguu

SEQ ID NO: 698463 - RNA, 22 nt, Human
cccaggaauuggaggcugcagu

SEQ ID NO: 698464 - RNA, 22 nt, Human
agaagcacagguaaagugauuu

SEQ ID NO: 698465 - RNA, 22 nt, Human
ucauuauuugcuuuaguuaugu

SEQ ID NO: 698466 - RNA, 22 nt, Human
ucuuagcacagcuauauaaguu

SEQ ID NO: 698467 - RNA, 22 nt, Human
cuuacauuaaguaagagauuga

SEQ ID NO: 698468 - RNA, 22 nt, Human
acugcugauuaugaaagugaca

SEQ ID NO: 698469 - RNA, 22 nt, Human
uagcaacaauggaaguaacuuc

SEQ ID NO: 698470 - RNA, 22 nt, Human
uaguucuggacacacguuccca

SEQ ID NO: 698471 - RNA, 17 nt, Human
ugcuucuguauugcugg

SEQ ID NO: 698472 - RNA, 22 nt, Human
cuuggggaugcaaagccagugu

SEQ ID NO: 698473 - RNA, 22 nt, Human
uccuuuccagccucaccucagc

SEQ ID NO: 698474 - RNA, 22 nt, Human
gacaaagucaacaguacucuca

SEQ ID NO: 698475 - RNA, 22 nt, Human
cauccguugugcuguugcucuc

SEQ ID NO: 698476 - RNA, 22 nt, Human
gcagugcugagaggugaucgga

SEQ ID NO: 698477 - RNA, 22 nt, Human
uaagaguuacugguuuagaacc

SEQ ID NO: 698478 - RNA, 22 nt, Human
gaagcagccacggggagacaga

SEQ ID NO: 698479 - RNA, 22 nt, Human
uucugaaaccuucaguaugaag

SEQ ID NO: 698480 - RNA, 22 nt, Human
cuuuacagugcugcuaauggcu

SEQ ID NO: 698481 - RNA, 22 nt, Human
gaauuguagagggaacagaagc

SEQ ID NO: 698482 - RNA, 22 nt, Human
cccaggcacaccccgaacggaa

SEQ ID NO: 698483 - RNA, 22 nt, Human
auucucuuuguauaacaucuug

SEQ ID NO: 698484 - RNA, 22 nt, Human
acccggagucggagguugcagu

SEQ ID NO: 698485 - RNA, 22 nt, Human
ccuguuccauucauauccuauu

SEQ ID NO: 698486 - RNA, 22 nt, Human
aauauauagaaguacccguugu

SEQ ID NO: 698487 - RNA, 20 nt, Human
agaguagagguagauuuaug

SEQ ID NO: 698488 - RNA, 22 nt, Human
uuuccuaaucccaaugacauuu

SEQ ID NO: 698489 - RNA, 17 nt, Human
gguucaguucugcauuc

SEQ ID NO: 698490 - RNA, 22 nt, Human
uagccagugaauguuuccagug

SEQ ID NO: 698491 - RNA, 22 nt, Human
uccccuuggcuuggucaagagg

SEQ ID NO: 698492 - RNA, 22 nt, Human
cugggagucuggccucuggucc

SEQ ID NO: 698493 - RNA, 22 nt, Human
uggcacugaaaaaggagagguu

SEQ ID NO: 698494 - RNA, 22 nt, Human
cugugcccuggccaggccucuc

SEQ ID NO: 698495 - RNA, 22 nt, Human
acucuggggugaugucucugag

SEQ ID NO: 698496 - RNA, 22 nt, Human
aggccagcuaugacucugcucc

SEQ ID NO: 698497 - RNA, 22 nt, Human
auauguguaaaugcauuuguuu

SEQ ID NO: 698498 - RNA, 22 nt, Human
agaagugucucaucaggcaaua

SEQ ID NO: 698499 - RNA, 22 nt, Human
agcuggggcauuuauccacuaa

SEQ ID NO: 698500 - RNA, 22 nt, Human
guaacaaacgguuccaagaugc

SEQ ID NO: 698501 - RNA, 22 nt, Human
gcacagccacguaaugugguca

SEQ ID NO: 698502 - RNA, 22 nt, Human
aaggggaaguagcaccagaggu

SEQ ID NO: 698503 - RNA, 22 nt, Human
gacaauuagaucauuccuuuga

SEQ ID NO: 698504 - RNA, 22 nt, Human
agacuucuaaauagcagcuucu

SEQ ID NO: 698505 - RNA, 22 nt, Human
cgccugcucuguuuccaugugg

SEQ ID NO: 698506 - RNA, 22 nt, Human
uggcuucuuucuuuccaugugu

SEQ ID NO: 698507 - RNA, 22 nt, Human
ugcuuuuuccccuucuggcgag

SEQ ID NO: 698508 - RNA, 22 nt, Human
aauguucauuagcauuguugac

SEQ ID NO: 698509 - RNA, 22 nt, Human
uauucugguuuccggaucucua

SEQ ID NO: 698510 - RNA, 22 nt, Human
uuggaagaccagaggccuuguc

SEQ ID NO: 698511 - RNA, 22 nt, Human
uccaggugagugcaggugcaga

SEQ ID NO: 698512 - RNA, 22 nt, Human
ugcaaggcccagacaagagcuc

SEQ ID NO: 698513 - RNA, 22 nt, Human
ggugcagaagaaagcagucauu

SEQ ID NO: 698514 - RNA, 22 nt, Human
auggaagaacgcucaggguuac

SEQ ID NO: 698515 - RNA, 22 nt, Human
guucuucaccaaggucagaggc

SEQ ID NO: 698516 - RNA, 22 nt, Human
agcuauuucaaaguuugagaca

SEQ ID NO: 698517 - RNA, 22 nt, Human
ucagugcauucuaccaaaaggc

SEQ ID NO: 698518 - RNA, 22 nt, Human
guuaaacugaaaggcucguuca

SEQ ID NO: 698519 - RNA, 22 nt, Human
uauugaucuggauauuuagaca

SEQ ID NO: 698520 - RNA, 22 nt, Human
ugaaaucaauaauuggugauug

SEQ ID NO: 698521 - RNA, 22 nt, Human
uucagagagaaaccagugggaa

SEQ ID NO: 698522 - RNA, 22 nt, Human
acaaaaguaguugcgguuuuug

SEQ ID NO: 698523 - RNA, 22 nt, Human
gagggcacuggguuucaauguc

SEQ ID NO: 698524 - RNA, 22 nt, Human
auugcuuuugagcuagaauuuu

SEQ ID NO: 698525 - RNA, 18 nt, Human
gccucaguuuccucaccu

SEQ ID NO: 698526 - RNA, 22 nt, Human
uuucauguuauuaauagugcug

SEQ ID NO: 698527 - RNA, 20 nt, Human
augcauauauguggugucug

SEQ ID NO: 698528 - RNA, 22 nt, Human
ugagacuugugaguccuucuag

SEQ ID NO: 698529 - RNA, 22 nt, Human
aucagcugaugaauggaugaau

SEQ ID NO: 698530 - RNA, 23 nt, Human
ccaaagucgaagucuaguccaga

SEQ ID NO: 698531 - RNA, 22 nt, Human
ggcaggcucuuggccuuaugag

SEQ ID NO: 698532 - RNA, 22 nt, Human
agccagugggauuagagccucu

SEQ ID NO: 698533 - RNA, 22 nt, Human
cugugggagaggugccuggauu

SEQ ID NO: 698534 - RNA, 22 nt, Human
gagguggaggggaaaaauagau

SEQ ID NO: 698535 - RNA, 22 nt, Human
ccuuuugagacuuccacugugu

SEQ ID NO: 698536 - RNA, 20 nt, Human
uuuacauccccaccagcaau

SEQ ID NO: 698537 - RNA, 22 nt, Human
auagauuauuugcucauuacuu

SEQ ID NO: 698538 - RNA, 22 nt, Human
gaguggcaggcacugugacgga

SEQ ID NO: 698539 - RNA, 22 nt, Human
guuccuauauagccuuaaggau

SEQ ID NO: 698540 - RNA, 22 nt, Human
cagagccucaucauccacucca

SEQ ID NO: 698541 - RNA, 22 nt, Human
acagguggccccgagggagugg

SEQ ID NO: 698542 - RNA, 22 nt, Human
gugcccagugcaggcccgcagg

SEQ ID NO: 698543 - RNA, 23 nt, Human
ucagagaggcccccugcagagau

SEQ ID NO: 698544 - RNA, 22 nt, Human
acagcuguggucuccuuagugu

SEQ ID NO: 698545 - RNA, 22 nt, Human
uagacuggugaauuagggggaa

SEQ ID NO: 698546 - RNA, 22 nt, Human
uguguauagaaaguaggaaagg

SEQ ID NO: 698547 - RNA, 22 nt, Human
ucagaggagaaguugggaaaau

SEQ ID NO: 698548 - RNA, 22 nt, Human
gaggaaccaaucugugauauuc

SEQ ID NO: 698549 - RNA, 22 nt, Human
agcaguuguagucauggaaaau

SEQ ID NO: 698550 - RNA, 19 nt, Human
ucaaaacacaaaugguuga

SEQ ID NO: 698551 - RNA, 22 nt, Human
cuucagagaacuugaucgcugc

SEQ ID NO: 698552 - RNA, 22 nt, Human
aguucaguaguccuucauugua

SEQ ID NO: 698553 - RNA, 22 nt, Human
uaaaguguggacaguaucuaua

SEQ ID NO: 698554 - RNA, 22 nt, Human
agaguggcagcaagucagguag

SEQ ID NO: 698555 - RNA, 22 nt, Human
acagggccauuaucuguucuag

SEQ ID NO: 698556 - RNA, 22 nt, Human
aagggugcugcuaucaggaagc

SEQ ID NO: 698557 - RNA, 22 nt, Human
uuugcuugauuaggauauggaa

SEQ ID NO: 698558 - RNA, 22 nt, Human
aguggcagagccaaguagagcc

SEQ ID NO: 698559 - RNA, 21 nt, Human
gcuggcugucucuuacacggu

SEQ ID NO: 698560 - RNA, 22 nt, Human
ccugagaccaaguugcagccau

SEQ ID NO: 698561 - RNA, 18 nt, Human
cuucaguggcugcucugc

SEQ ID NO: 698562 - RNA, 22 nt, Human
ugggauauuuugagcuuuccuc

SEQ ID NO: 698563 - RNA, 20 nt, Human
agcuggcccccgguggccug

SEQ ID NO: 698564 - RNA, 22 nt, Human
guguuaaugguagaaucugagu

SEQ ID NO: 698565 - RNA, 22 nt, Human
uggaaugaaaaguacuucagaa

SEQ ID NO: 698566 - RNA, 22 nt, Human
cuaaauacuagccuucagauuu

SEQ ID NO: 698567 - RNA, 22 nt, Human
aggcaguuucugggacagcaua

SEQ ID NO: 698568 - RNA, 22 nt, Human
aaggugcucacgggcucaggga

SEQ ID NO: 698569 - RNA, 22 nt, Human
aggcuccagggcugugugggag

SEQ ID NO: 698570 - RNA, 22 nt, Human
cuugauggaggggccaggcuuu

SEQ ID NO: 698571 - RNA, 22 nt, Human
uuuuucugagaauaugagagga

SEQ ID NO: 698572 - RNA, 22 nt, Human
aagcagcuuccccaaagugccu

SEQ ID NO: 698573 - RNA, 22 nt, Human
aaacuuuuuauucuaaugucua

SEQ ID NO: 698574 - RNA, 22 nt, Human
agguggaacguucaggugcuag

SEQ ID NO: 698575 - RNA, 22 nt, Human
agcuggugauggccuaagaagg

SEQ ID NO: 698576 - RNA, 22 nt, Human
uaaaagauuuuauaggaacaag

SEQ ID NO: 698577 - RNA, 22 nt, Human
auuuaauuugugucuuuagcug

SEQ ID NO: 698578 - RNA, 22 nt, Human
uuugaagaccuuaucucuaaau

SEQ ID NO: 698579 - RNA, 22 nt, Human
caaaugaauuucccugcaaaug

SEQ ID NO: 698580 - RNA, 22 nt, Human
caucccugucugccacucugaa

SEQ ID NO: 698581 - RNA, 22 nt, Human
ccugccagcgcuuaucucucgg

SEQ ID NO: 698582 - RNA, 22 nt, Human
ucuucagaaaauuaucacuugu

SEQ ID NO: 698583 - RNA, 22 nt, Human
uacaggagcacaaaagaguuga

SEQ ID NO: 698584 - RNA, 22 nt, Human
aucucaggaggacccugaugcu

SEQ ID NO: 698585 - RNA, 21 nt, Human
ccaccaggucuucugcucggg

SEQ ID NO: 698586 - RNA, 22 nt, Human
ucauugcaccccagucccagcu

SEQ ID NO: 698587 - RNA, 22 nt, Human
accugagaccuaaucugacugu

SEQ ID NO: 698588 - RNA, 22 nt, Human
aacaugcauguuauuuaucagu

SEQ ID NO: 698589 - RNA, 22 nt, Human
cauggcagcaauuuuccugacu

SEQ ID NO: 698590 - RNA, 23 nt, Human
cagcccuuccugcauguuuuugu

SEQ ID NO: 698591 - RNA, 22 nt, Human
gagagcugugguuugaccaggc

SEQ ID NO: 698592 - RNA, 22 nt, Human
ugagccuguccugugcauguga

SEQ ID NO: 698593 - RNA, 22 nt, Human
cagucccacaagaucuccacaa

SEQ ID NO: 698594 - RNA, 22 nt, Human
ggauggcagacagugaguggcu

SEQ ID NO: 698595 - RNA, 22 nt, Human
cagugucugccuuucuguuugg

SEQ ID NO: 698596 - RNA, 22 nt, Human
augggcugaggugggauagaag

SEQ ID NO: 698597 - RNA, 22 nt, Human
gcuucuguggugaggucaccuu

SEQ ID NO: 698598 - RNA, 18 nt, Human
aauuuccauaugaauugc

SEQ ID NO: 698599 - RNA, 22 nt, Human
accuaauaaagguaaauucugu

SEQ ID NO: 698600 - RNA, 22 nt, Human
ucagcaggcagugggucacaau

SEQ ID NO: 698601 - RNA, 22 nt, Human
auauaaaguguuuagaaagcug

SEQ ID NO: 698602 - RNA, 22 nt, Human
ucaauguuuguucaugaaaaua

SEQ ID NO: 698603 - RNA, 22 nt, Human
uacacagauuuaaaagcaggga

SEQ ID NO: 698604 - RNA, 22 nt, Human
cccuggaggcggagcuugcagu

SEQ ID NO: 698605 - RNA, 22 nt, Human
uugacaguauagcuuuaccuau

SEQ ID NO: 698606 - RNA, 22 nt, Human
aucaggaucagggcuagcagag

SEQ ID NO: 698607 - RNA, 22 nt, Human
uccaggaggcaccuuuggacca

SEQ ID NO: 698608 - RNA, 22 nt, Human
ucuguucagacacuuuacaugu

SEQ ID NO: 698609 - RNA, 22 nt, Human
ucugggcccuaaaccagcucua

SEQ ID NO: 698610 - RNA, 22 nt, Human
agcuggguuucuggcaggcuua

SEQ ID NO: 698611 - RNA, 22 nt, Human
ugcaucauauaaugucuaugga

SEQ ID NO: 698612 - RNA, 22 nt, Human
uugagguauugauauuuuauga

SEQ ID NO: 698613 - RNA, 22 nt, Human
guauuauuggguaguaugguaa

SEQ ID NO: 698614 - RNA, 22 nt, Human
uggcccaggccaaagcccugga

SEQ ID NO: 698615 - RNA, 22 nt, Human
ggccugagcucuggggaggcaa

SEQ ID NO: 698616 - RNA, 22 nt, Human
uuggucacuugcuaugugccaa

SEQ ID NO: 698617 - RNA, 22 nt, Human
ucuuuggacuuuccaauuuguu

SEQ ID NO: 698618 - RNA, 22 nt, Human
uuuuccucuguaugcgugagau

SEQ ID NO: 698619 - RNA, 22 nt, Human
uggcccucagcacugagaccuu

SEQ ID NO: 698620 - RNA, 22 nt, Human
ccuuucaaaacagaacacuagc

SEQ ID NO: 698621 - RNA, 22 nt, Human
cagcaucguguggaaaguggua

SEQ ID NO: 698622 - RNA, 22 nt, Human
agccugggcccugccucuucuc

SEQ ID NO: 698623 - RNA, 22 nt, Human
uuucacauggaagcucucgaga

SEQ ID NO: 698624 - RNA, 22 nt, Human
uucucagaugauucagauaaac

SEQ ID NO: 698625 - RNA, 23 nt, Human
uuaguguaaggcaggcacaguug

SEQ ID NO: 698626 - RNA, 21 nt, Human
ugauucuguuuuaucaucagc

SEQ ID NO: 698627 - RNA, 22 nt, Human
uaggccacaaauaagauccugu

SEQ ID NO: 698628 - RNA, 21 nt, Human
uuauugaauguuuaccgugug

SEQ ID NO: 698629 - RNA, 23 nt, Human
agcagcagugagaggugucuuac

SEQ ID NO: 698630 - RNA, 22 nt, Human
ucucaggaucuaauacauggua

SEQ ID NO: 698631 - RNA, 22 nt, Human
ggcaccagcacuugggauggcu

SEQ ID NO: 698632 - RNA, 22 nt, Human
ugcuggggauccguaccaaccc

SEQ ID NO: 698633 - RNA, 22 nt, Human
agcaauauuucagcuagcaggu

SEQ ID NO: 698634 - RNA, 22 nt, Human
aacgucuucucuccaaguaaau

SEQ ID NO: 698635 - RNA, 20 nt, Human
ccugggcuccaggagccccg

SEQ ID NO: 698636 - RNA, 22 nt, Human
cccauggagugccugagggcca

SEQ ID NO: 698637 - RNA, 22 nt, Human
ucugggaguuagaauacauggg

SEQ ID NO: 698638 - RNA, 22 nt, Human
uacaaguauauucuagugauau

SEQ ID NO: 698639 - RNA, 22 nt, Human
ucucaggcucuuggaaccuguu

SEQ ID NO: 698640 - RNA, 22 nt, Human
agacacuguucucacaugcuug

SEQ ID NO: 698641 - RNA, 22 nt, Human
ugcaaaaagagcgaggagcccu

SEQ ID NO: 698642 - RNA, 22 nt, Human
uuaaaagagcagcccagcauau

SEQ ID NO: 698643 - RNA, 21 nt, Human
gccuggcuucacaggcacuga

SEQ ID NO: 698644 - RNA, 22 nt, Human
agcuuucucucagccaggcugc

SEQ ID NO: 698645 - RNA, 22 nt, Human
ggcagaaggcaauuagagacug

SEQ ID NO: 698646 - RNA, 22 nt, Human
acuaggaaguggcaaaacugga

SEQ ID NO: 698647 - RNA, 22 nt, Human
ucuggccuuaucuguccaagcc

SEQ ID NO: 698648 - RNA, 22 nt, Human
uuuucugugugucccucgacag

SEQ ID NO: 698649 - RNA, 22 nt, Human
uauaaagaaggcacagcaagac

SEQ ID NO: 698650 - RNA, 22 nt, Human
uugacaaaaauaacacagcaua

SEQ ID NO: 698651 - RNA, 22 nt, Human
gcggcgccuaagccccgaccuc

SEQ ID NO: 698652 - RNA, 22 nt, Human
ugcuucugauucaugguuauug

SEQ ID NO: 698653 - RNA, 22 nt, Human
cacugagccaggagcaauauca

SEQ ID NO: 698654 - RNA, 22 nt, Human
aaucaaagaaugggcuaguugg

SEQ ID NO: 698655 - RNA, 22 nt, Human
uggaagccucaguuugccuucu

SEQ ID NO: 698656 - RNA, 22 nt, Human
acuggcaucuguggguagaggc

SEQ ID NO: 698657 - RNA, 22 nt, Human
ugggccuccaauuccagcggga

SEQ ID NO: 698658 - RNA, 22 nt, Human
aucucuucucccaacaccuggc

SEQ ID NO: 698659 - RNA, 20 nt, Human
gccagcacagggagcaguuc

SEQ ID NO: 698660 - RNA, 22 nt, Human
agcuuuuaguacguuaaaauug

SEQ ID NO: 698661 - RNA, 22 nt, Human
cugguuuagcuguaagguuccc

SEQ ID NO: 698662 - RNA, 22 nt, Human
auucugauaucuuauucuagcu

SEQ ID NO: 698663 - RNA, 22 nt, Human
uggcagugaagcugucuuuagg

SEQ ID NO: 698664 - RNA, 22 nt, Human
ggccauggucaugggugagcuu

SEQ ID NO: 698665 - RNA, 22 nt, Human
cugggccuucauugcucuccca

SEQ ID NO: 698666 - RNA, 22 nt, Human
guccugugaugaguaccaggug

SEQ ID NO: 698667 - RNA, 22 nt, Human
aacaccuaaaaaucauuguuga

SEQ ID NO: 698668 - RNA, 22 nt, Human
auuuuccuuguggguuagcgaa

SEQ ID NO: 698669 - RNA, 22 nt, Human
uacagugugacauuucuacaaa

SEQ ID NO: 698670 - RNA, 22 nt, Human
accaugaucugcucugguguuu

SEQ ID NO: 698671 - RNA, 22 nt, Human
uaggggcuuguaauuuaauaga

SEQ ID NO: 698672 - RNA, 22 nt, Human
ugucuuuagaaagaagcagaca

SEQ ID NO: 698673 - RNA, 22 nt, Human
uaugagguagguauuauacuua

SEQ ID NO: 698674 - RNA, 22 nt, Human
agucacaucgauuauaaaauuu

SEQ ID NO: 698675 - RNA, 18 nt, Human
caauguuuuagaucucua

SEQ ID NO: 698676 - RNA, 22 nt, Human
ugugccaagacuauauugugcu

SEQ ID NO: 698677 - RNA, 22 nt, Human
ucaggaguaaagacagaguucc

SEQ ID NO: 698678 - RNA, 22 nt, Human
auucagugugagguuuucaagu

SEQ ID NO: 698679 - RNA, 22 nt, Human
agugggagagaagcaaguagua

SEQ ID NO: 698680 - RNA, 22 nt, Human
agugugucaguugaaagagauu

SEQ ID NO: 698681 - RNA, 22 nt, Human
gugacucucacuuuaccugacu

SEQ ID NO: 698682 - RNA, 22 nt, Human
aaacacugucucugguauugaa

SEQ ID NO: 698683 - RNA, 22 nt, Human
ucagcccaacccugcacaagga

SEQ ID NO: 698684 - RNA, 22 nt, Human
ucuguuuuggucaccuuuauau

SEQ ID NO: 698685 - RNA, 22 nt, Human
aagcacaaugaacaucuuagau

SEQ ID NO: 698686 - RNA, 22 nt, Human
gcugucugucuucacaucucgc

SEQ ID NO: 698687 - RNA, 22 nt, Human
accaggcccuccagcugcgugg

SEQ ID NO: 698688 - RNA, 22 nt, Human
caucauuuuauuaaccaagaaa

SEQ ID NO: 698689 - RNA, 22 nt, Human
ucugauuagcaguuuagggaaa

SEQ ID NO: 698690 - RNA, 22 nt, Human
ugaggagcuucuggaaagugca

SEQ ID NO: 698691 - RNA, 22 nt, Human
ugaaagcugaggacaggagggu

SEQ ID NO: 698692 - RNA, 22 nt, Human
uuucuuugagucucaguuugcu

SEQ ID NO: 698693 - RNA, 22 nt, Human
aacauccccuucaugucaugau

SEQ ID NO: 698694 - RNA, 22 nt, Human
uaaggucauggugaauaauaag

SEQ ID NO: 698695 - RNA, 22 nt, Human
aggcuuggcuggcagcccuggg

SEQ ID NO: 698696 - RNA, 21 nt, Human
agcugcccagaguagggaagg

SEQ ID NO: 698697 - RNA, 22 nt, Human
uggcagauguauaucacagcuu

SEQ ID NO: 698698 - RNA, 20 nt, Human
ugucauuuauuuaucaaaug

SEQ ID NO: 698699 - RNA, 22 nt, Human
ugugcucacucuaaauuaagau

SEQ ID NO: 698700 - RNA, 22 nt, Human
guauaucaccccaagcagcuga

SEQ ID NO: 698701 - RNA, 22 nt, Human
uuuccagggcucuguagaagaa

SEQ ID NO: 698702 - RNA, 22 nt, Human
uagaaaugcaguguacuguguc

SEQ ID NO: 698703 - RNA, 22 nt, Human
ucauagaaguaguauccacauu

SEQ ID NO: 698704 - RNA, 22 nt, Human
ugcaugugugacaaggacaguu

SEQ ID NO: 698705 - RNA, 22 nt, Human
cuggggcucacuccagcccugg

SEQ ID NO: 698706 - RNA, 22 nt, Human
aaagaacucagagaggauuuua

SEQ ID NO: 698707 - RNA, 18 nt, Human
gguguguaacguguuuuc

SEQ ID NO: 698708 - RNA, 22 nt, Human
auuuucaucauggguuuaacau

SEQ ID NO: 698709 - RNA, 21 nt, Human
cagagccuguguugacaguug

SEQ ID NO: 698710 - RNA, 19 nt, Human
accaggaacuucccuaggc

SEQ ID NO: 698711 - RNA, 22 nt, Human
caauaauuuacauuggauacca

SEQ ID NO: 698712 - RNA, 22 nt, Human
acaggaguuucugacagagaca

SEQ ID NO: 698713 - RNA, 22 nt, Human
ucugggcccacucaacuucacu

SEQ ID NO: 698714 - RNA, 22 nt, Human
gcagggcugacucagccacccu

SEQ ID NO: 698715 - RNA, 22 nt, Human
auggaaaggcuguggaaacuua

SEQ ID NO: 698716 - RNA, 22 nt, Human
aauggcuuagcucagcgcucag

SEQ ID NO: 698717 - RNA, 22 nt, Human
cacaccuguaauccuagcacuu

SEQ ID NO: 698718 - RNA, 22 nt, Human
ggcaggguggcccuccagugag

SEQ ID NO: 698719 - RNA, 22 nt, Human
aacuguaagugguuggaagaag

SEQ ID NO: 698720 - RNA, 19 nt, Human
ucagcccaucagacucaca

SEQ ID NO: 698721 - RNA, 22 nt, Human
caggcagcucugcuuuuccuaa

SEQ ID NO: 698722 - RNA, 22 nt, Human
uccuggccuagcucacccugga

SEQ ID NO: 698723 - RNA, 22 nt, Human
ucugaaauaagggagaagggaa

SEQ ID NO: 698724 - RNA, 22 nt, Human
accagaggcucugccaccucca

SEQ ID NO: 698725 - RNA, 22 nt, Human
auuagcaaucacgcagucauuu

SEQ ID NO: 698726 - RNA, 19 nt, Human
aagcuguccuguuggcccu

SEQ ID NO: 698727 - RNA, 22 nt, Human
gcugucuuccuugcuccaaggg

SEQ ID NO: 698728 - RNA, 22 nt, Human
cagagccucccuccucugccau

SEQ ID NO: 698729 - RNA, 22 nt, Human
gaacaauagugguaacaaagcc

SEQ ID NO: 698730 - RNA, 22 nt, Human
gaauuauagguuugcaugcuaa

SEQ ID NO: 698731 - RNA, 22 nt, Human
ggcaguggcuguagucucuugg

SEQ ID NO: 698732 - RNA, 22 nt, Human
cuguugcucugaacaggucuug

SEQ ID NO: 698733 - RNA, 22 nt, Human
cugagcugggaguggauagugg

SEQ ID NO: 698734 - RNA, 22 nt, Human
agugucuguuguucagaacucu

SEQ ID NO: 698735 - RNA, 22 nt, Human
gggcucaggaguuugaggcugc

SEQ ID NO: 698736 - RNA, 22 nt, Human
gcucacaggcaguguugggaga

SEQ ID NO: 698737 - RNA, 22 nt, Human
ccugagcugaacuaagcaguuu

SEQ ID NO: 698738 - RNA, 22 nt, Human
acagcagugcacagagaacccu

SEQ ID NO: 698739 - RNA, 22 nt, Human
uagcagagugauuggccaugag

SEQ ID NO: 698740 - RNA, 22 nt, Human
caucagaaucugagucucugcc

SEQ ID NO: 698741 - RNA, 22 nt, Human
aaacucuaagacacuguacaau

SEQ ID NO: 698742 - RNA, 22 nt, Human
ugcuuuaucugugagaaccuga

SEQ ID NO: 698743 - RNA, 22 nt, Human
guuuagaaugaaacuuuugagc

SEQ ID NO: 698744 - RNA, 22 nt, Human
cucagugcaaccaaagugaucu

SEQ ID NO: 698745 - RNA, 22 nt, Human
cuuggcagagggcugggcucag

SEQ ID NO: 698746 - RNA, 22 nt, Human
ucugucugggugccucgaguac

SEQ ID NO: 698747 - RNA, 22 nt, Human
ugugcugacaagaucagaaggu

SEQ ID NO: 698748 - RNA, 22 nt, Human
agccauuggcugccuggugcgu

SEQ ID NO: 698749 - RNA, 22 nt, Human
agaguguaauaagggcaagggc

SEQ ID NO: 698750 - RNA, 22 nt, Human
uaaggcacccgugagcugccag

SEQ ID NO: 698751 - RNA, 22 nt, Human
cagcuuccauaagagauggaga

SEQ ID NO: 698752 - RNA, 22 nt, Human
uccgcagaggaggaguugcugu

SEQ ID NO: 698753 - RNA, 22 nt, Human
cagcugugcuguauuaagcucu

SEQ ID NO: 698754 - RNA, 22 nt, Human
guguaaauuuguacuuguaaau

SEQ ID NO: 698755 - RNA, 20 nt, Human
gcucagguuugggcuuugug

SEQ ID NO: 698756 - RNA, 22 nt, Human
ucccugggccacagcugugagc

SEQ ID NO: 698757 - RNA, 22 nt, Human
uaugugcaguuugcucuuaaca

SEQ ID NO: 698758 - RNA, 23 nt, Human
agcaaaguuguugcuaaccucau

SEQ ID NO: 698759 - RNA, 22 nt, Human
ucaguguuggcuacaucugccu

SEQ ID NO: 698760 - RNA, 22 nt, Human
gagaaggagcuccuuggggucu

SEQ ID NO: 698761 - RNA, 22 nt, Human
aguucccaggugaugcugaugu

SEQ ID NO: 698762 - RNA, 22 nt, Human
accuguuuaccugcaccuguuu

SEQ ID NO: 698763 - RNA, 20 nt, Human
ucugugcuacacuccagauu

SEQ ID NO: 698764 - RNA, 22 nt, Human
gaugacagcagcuguggcucac

SEQ ID NO: 698765 - RNA, 22 nt, Human
gugggaugcuuaggaucuugcc

SEQ ID NO: 698766 - RNA, 23 nt, Human
uacauuguggauggaguccuggg

SEQ ID NO: 698767 - RNA, 22 nt, Human
gaggcucacuaggcauccuggg

SEQ ID NO: 698768 - RNA, 22 nt, Human
cagaggcagacccuccagggcg

SEQ ID NO: 698769 - RNA, 22 nt, Human
uagcaucuuuuucugucuucua

SEQ ID NO: 698770 - RNA, 22 nt, Human
ggaacacagaagggcugaaaaa

SEQ ID NO: 698771 - RNA, 22 nt, Human
auugcaaagcguagacucuaaa

SEQ ID NO: 698772 - RNA, 22 nt, Human
gccuggagcuacuggacacuga

SEQ ID NO: 698773 - RNA, 22 nt, Human
auuacaguuaauuuaccuucuu

SEQ ID NO: 698774 - RNA, 22 nt, Human
uagauguugaagucauauuugg

SEQ ID NO: 698775 - RNA, 22 nt, Human
gccuugggauucuuggaugcuc

SEQ ID NO: 698776 - RNA, 20 nt, Human
gccacaguuuucucacugca

SEQ ID NO: 698777 - RNA, 22 nt, Human
ucaaacauaggcacacauucag

SEQ ID NO: 698778 - RNA, 22 nt, Human
cugcaucacucuuacuggcuuu

SEQ ID NO: 698779 - RNA, 22 nt, Human
uuuauauuguaaaaaugguucu

SEQ ID NO: 698780 - RNA, 22 nt, Human
uuggaacaggauucaauuaaag

SEQ ID NO: 698781 - RNA, 23 nt, Human
auuguuuuuggcucucagggaau

SEQ ID NO: 698782 - RNA, 22 nt, Human
cugcagaaagcugagaugauua

SEQ ID NO: 698783 - RNA, 22 nt, Human
uugcuguaguguucugauguca

SEQ ID NO: 698784 - RNA, 21 nt, Human
uggccaaaaccauauuauuaa

SEQ ID NO: 698785 - RNA, 22 nt, Human
acaugcuuguuuuucacaaccu

SEQ ID NO: 698786 - RNA, 22 nt, Human
aggguggcugugaagugcuugg

SEQ ID NO: 698787 - RNA, 22 nt, Human
acauggcuaaagcaagucuaga

SEQ ID NO: 698788 - RNA, 22 nt, Human
ucuccaggcuuaaucucagcuu

SEQ ID NO: 698789 - RNA, 20 nt, Human
ccugucuccucuuaccuggc

SEQ ID NO: 698790 - RNA, 22 nt, Human
auuccugcauuggucaacccau

SEQ ID NO: 698791 - RNA, 18 nt, Human
gauguaaaauaguagcuu

SEQ ID NO: 698792 - RNA, 19 nt, Human
gucccugggcagaggcacc

SEQ ID NO: 698793 - RNA, 22 nt, Human
gcagguggggcugcuaccagaa

SEQ ID NO: 698794 - RNA, 22 nt, Human
ccagaggacuugggggcugaau

SEQ ID NO: 698795 - RNA, 22 nt, Human
ugggccacugcuccaaguagcu

SEQ ID NO: 698796 - RNA, 22 nt, Human
cugccagcucaccggcucagac

SEQ ID NO: 698797 - RNA, 22 nt, Human
agaacaauugccccaaagcuug

SEQ ID NO: 698798 - RNA, 22 nt, Human
auaguuguguggggauucuggu

SEQ ID NO: 698799 - RNA, 22 nt, Human
gagaggcugauccugcagagaa

SEQ ID NO: 698800 - RNA, 22 nt, Human
uauuaugaggacugguguaagg

SEQ ID NO: 698801 - RNA, 22 nt, Human
agucagcagccuggccaggaga

SEQ ID NO: 698802 - RNA, 22 nt, Human
uagucuuuugagaaguauaucu

SEQ ID NO: 698803 - RNA, 22 nt, Human
gauagcagcucuggggucagac

SEQ ID NO: 698804 - RNA, 22 nt, Human
gagauucuaauauaaggauggg

SEQ ID NO: 698805 - RNA, 22 nt, Human
ccacuguguccaccaggaaugc

SEQ ID NO: 698806 - RNA, 22 nt, Human
ucagcuuuugucagaaauugua

SEQ ID NO: 698807 - RNA, 22 nt, Human
gcugccuccgccggcuccacag

SEQ ID NO: 698808 - RNA, 22 nt, Human
aucaguuuugggggacauacug

SEQ ID NO: 698809 - RNA, 22 nt, Human
uacaguuuagaaccauagaugg

SEQ ID NO: 698810 - RNA, 22 nt, Human
ugccuggcagcuugaaagaaau

SEQ ID NO: 698811 - RNA, 18 nt, Human
uuccauaauguauguaac

SEQ ID NO: 698812 - RNA, 22 nt, Human
aguguuugcaucucauugauuu

SEQ ID NO: 698813 - RNA, 22 nt, Human
ggugcagaaggaagggagcugg

SEQ ID NO: 698814 - RNA, 22 nt, Human
auggaucuucccucauuucuga

SEQ ID NO: 698815 - RNA, 22 nt, Human
acugucaccuaaauuuucauug

SEQ ID NO: 698816 - RNA, 22 nt, Human
ggagacauauuccagagcuggg

SEQ ID NO: 698817 - RNA, 22 nt, Human
ugugaagcuggauccuggagcu

SEQ ID NO: 698818 - RNA, 22 nt, Human
aucagcuggaacaagugucuga

SEQ ID NO: 698819 - RNA, 22 nt, Human
uaacacauaucuacaacaugug

SEQ ID NO: 698820 - RNA, 22 nt, Human
caggagagauaugaguccccac

SEQ ID NO: 698821 - RNA, 20 nt, Human
ccagucccugagcaccaggg

SEQ ID NO: 698822 - RNA, 22 nt, Human
uaggccacagagaggagauuuc

SEQ ID NO: 698823 - RNA, 23 nt, Human
aggcuuccuaucuuagagcuggg

SEQ ID NO: 698824 - RNA, 22 nt, Human
ucaguguguuauucuacuuuca

SEQ ID NO: 698825 - RNA, 22 nt, Human
uggcacugaccccaggccugug

SEQ ID NO: 698826 - RNA, 22 nt, Human
auuguauaauuguauugccaaa

SEQ ID NO: 698827 - RNA, 22 nt, Human
uuuacagacaacuuaauagggg

SEQ ID NO: 698828 - RNA, 22 nt, Human
agggagcagggcuccuuugggu

SEQ ID NO: 698829 - RNA, 22 nt, Human
agccauccuacuaccucagcau

SEQ ID NO: 698830 - RNA, 22 nt, Human
ggcccugagucuagcugcucuu

SEQ ID NO: 698831 - RNA, 22 nt, Human
gagcugugcuuauaccaauuca

SEQ ID NO: 698832 - RNA, 22 nt, Human
cucagaaucugccaaguucagg

SEQ ID NO: 698833 - RNA, 19 nt, Human
gucuuggcucucaaccauc

SEQ ID NO: 698834 - RNA, 22 nt, Human
cacauucagguggcauguuaga

SEQ ID NO: 698835 - RNA, 22 nt, Human
gugagcugggugaaugguaggg

SEQ ID NO: 698836 - RNA, 22 nt, Human
cuucagcaucuuuuucuugggg

SEQ ID NO: 698837 - RNA, 22 nt, Human
uacagcauauacagaaugaaca

SEQ ID NO: 698838 - RNA, 22 nt, Human
cagggugggcacccagccucca

SEQ ID NO: 698839 - RNA, 22 nt, Human
uguaugugcaauguuuauaugu

SEQ ID NO: 698840 - RNA, 22 nt, Human
ggggcagaaagcccacagagug

SEQ ID NO: 698841 - RNA, 22 nt, Human
agugcccucgugcccagggccu

SEQ ID NO: 698842 - RNA, 22 nt, Human
cucacaguuuucuguaguccaa

SEQ ID NO: 698843 - RNA, 22 nt, Human
gaauagauagcuuggaugguug

SEQ ID NO: 698844 - RNA, 22 nt, Human
gagccaagcaauauacccaacc

SEQ ID NO: 698845 - RNA, 22 nt, Human
gccaggcucaguagcgauuccu

SEQ ID NO: 698846 - RNA, 22 nt, Human
ccaaagucugcauuuuaacaug

SEQ ID NO: 698847 - RNA, 22 nt, Human
aaacaugagcacuugcuucaua

SEQ ID NO: 698848 - RNA, 22 nt, Human
gccucugcaugcucagcaccca

SEQ ID NO: 698849 - RNA, 22 nt, Human
cagagaaagaagcccauucauu

SEQ ID NO: 698850 - RNA, 17 nt, Human
aggucugagaguaucug

SEQ ID NO: 698851 - RNA, 22 nt, Human
ugcccugguagacacagacugu

SEQ ID NO: 698852 - RNA, 22 nt, Human
ucccaggguuacagccagggca

SEQ ID NO: 698853 - RNA, 22 nt, Human
aggggagcgacauuccgugccg

SEQ ID NO: 698854 - RNA, 22 nt, Human
agcuuuaugaggagaccuuagu

SEQ ID NO: 698855 - RNA, 22 nt, Human
ugaggguagcuggaucacggag

SEQ ID NO: 698856 - RNA, 22 nt, Human
cugacucccaaagaggacgcgu

SEQ ID NO: 698857 - RNA, 22 nt, Human
cuguccauuuucgugccuccuu

SEQ ID NO: 698858 - RNA, 22 nt, Human
ucacaggcucuccaccaugagg

SEQ ID NO: 698859 - RNA, 22 nt, Human
uaaucuguauuccuacuuugca

SEQ ID NO: 698860 - RNA, 22 nt, Human
gugcaggggccuccccuugcug

SEQ ID NO: 698861 - RNA, 22 nt, Human
cucuccagaauaugccgccgug

SEQ ID NO: 698862 - RNA, 22 nt, Human
guccugggcccaggggcugccu

SEQ ID NO: 698863 - RNA, 23 nt, Human
augcagagaauaacaaaugccau

SEQ ID NO: 698864 - RNA, 22 nt, Human
acugucaugcauuauggcaugu

SEQ ID NO: 698865 - RNA, 22 nt, Human
guguuuuaagaaagaagcucag

SEQ ID NO: 698866 - RNA, 22 nt, Human
uuugacuuugggcucuaacuca

SEQ ID NO: 698867 - RNA, 22 nt, Human
uuuugccuaggguugacccguu

SEQ ID NO: 698868 - RNA, 22 nt, Human
cucagagucugcauuucuguca

SEQ ID NO: 698869 - RNA, 22 nt, Human
aauacaagauuuauaguuguuu

SEQ ID NO: 698870 - RNA, 22 nt, Human
ugcaacaggcugugacauggaa

SEQ ID NO: 698871 - RNA, 22 nt, Human
ggcuucacugacugguucuagg

SEQ ID NO: 698872 - RNA, 22 nt, Human
aaagaugaucuacaaguucauu

SEQ ID NO: 698873 - RNA, 22 nt, Human
gcaguuguaauaugaugugagg

SEQ ID NO: 698874 - RNA, 22 nt, Human
auucuucacuguuucagaauga

SEQ ID NO: 698875 - RNA, 22 nt, Human
uuuucauuagaaugacugagaa

SEQ ID NO: 698876 - RNA, 22 nt, Human
uaaaugcucagaccuuauucca

SEQ ID NO: 698877 - RNA, 22 nt, Human
ucaggcuuuuccugccuccuac

SEQ ID NO: 698878 - RNA, 22 nt, Human
gcaugagggggguuaggaaguu

SEQ ID NO: 698879 - RNA, 22 nt, Human
cacagagcaacucaaaucagcu

SEQ ID NO: 698880 - RNA, 22 nt, Human
cugccucugguuuuggucccug

SEQ ID NO: 698881 - RNA, 22 nt, Human
gauggagugccaggguggaacu

SEQ ID NO: 698882 - RNA, 22 nt, Human
agcacuuugugcauuucugaag

SEQ ID NO: 698883 - RNA, 22 nt, Human
cccaggucugccagccuguggg

SEQ ID NO: 698884 - RNA, 22 nt, Human
aaccguuuuaccauuuguaacu

SEQ ID NO: 698885 - RNA, 18 nt, Human
gucuuuucucccuuccuc

SEQ ID NO: 698886 - RNA, 22 nt, Human
auuuuucucucacacuuaccag

SEQ ID NO: 698887 - RNA, 22 nt, Human
agcugccugcauuuauauccug

SEQ ID NO: 698888 - RNA, 22 nt, Human
ugguggcagugagaaggagagg

SEQ ID NO: 698889 - RNA, 22 nt, Human
gguuuuauagcaguacuaucag

SEQ ID NO: 698890 - RNA, 21 nt, Human
ucagaacaauuccaugccucc

SEQ ID NO: 698891 - RNA, 22 nt, Human
uacuuuauauuguggcuggcca

SEQ ID NO: 698892 - RNA, 23 nt, Human
uucuacagcuucuucaguuaagg

SEQ ID NO: 698893 - RNA, 22 nt, Human
cacugcaggucugagauggggg

SEQ ID NO: 698894 - RNA, 22 nt, Human
agcuccaguuuccugacugagc

SEQ ID NO: 698895 - RNA, 22 nt, Human
acuguaauauuuuaagaugucu

SEQ ID NO: 698896 - RNA, 22 nt, Human
ucugggggcgaccagggacugc

SEQ ID NO: 698897 - RNA, 20 nt, Human
aguaugauccacucugcucu

SEQ ID NO: 698898 - RNA, 18 nt, Human
ccugaagccugugucuuu

SEQ ID NO: 698899 - RNA, 22 nt, Human
uagacauuugaaugugaaauga

SEQ ID NO: 698900 - RNA, 22 nt, Human
cagcccagcugggaucacacuc

SEQ ID NO: 698901 - RNA, 22 nt, Human
ugugugcucgauggcccugcag

SEQ ID NO: 698902 - RNA, 18 nt, Human
accaggaagcuucuuguc

SEQ ID NO: 698903 - RNA, 21 nt, Human
ggucagggggugccuccaggu

SEQ ID NO: 698904 - RNA, 22 nt, Human
guggccuuuccugaagaaauga

SEQ ID NO: 698905 - RNA, 22 nt, Human
uggcuucucauuugcauuaaac

SEQ ID NO: 698906 - RNA, 22 nt, Human
gagccagguuugaaucucaguc

SEQ ID NO: 698907 - RNA, 22 nt, Human
ggaggcaaagcacuuugcuugg

SEQ ID NO: 698908 - RNA, 22 nt, Human
gaagcccauuuguacagcacau

SEQ ID NO: 698909 - RNA, 22 nt, Human
ugcagggagcucuggggugcag

SEQ ID NO: 698910 - RNA, 22 nt, Human
ugcucuguugugcaugugggau

SEQ ID NO: 698911 - RNA, 22 nt, Human
guaaaauagaauaacguggcua

SEQ ID NO: 698912 - RNA, 18 nt, Human
agcaguguggcaagcaga

SEQ ID NO: 698913 - RNA, 22 nt, Human
guuugaaaaaagcaguauguaa

SEQ ID NO: 698914 - RNA, 22 nt, Human
auucaaguucuucugucuuugc

SEQ ID NO: 698915 - RNA, 22 nt, Human
cucuggcuugguaaaaacuucu

SEQ ID NO: 698916 - RNA, 21 nt, Human
auuuccaaggguaccuaagau

SEQ ID NO: 698917 - RNA, 22 nt, Human
gaacuguaguuaauacuacaca

SEQ ID NO: 698918 - RNA, 22 nt, Human
agccacagcauguguguaugua

SEQ ID NO: 698919 - RNA, 22 nt, Human
gucugagggucaugggucucac

SEQ ID NO: 698920 - RNA, 22 nt, Human
auccugggcaagucaauguccc

SEQ ID NO: 698921 - RNA, 22 nt, Human
acacugcuaaacaguaaagaug

SEQ ID NO: 698922 - RNA, 22 nt, Human
caccucucauuucuacagauuc

SEQ ID NO: 698923 - RNA, 22 nt, Human
uuucucauggaacaucguuuag

SEQ ID NO: 698924 - RNA, 22 nt, Human
ggggugugaguagagcugggga

SEQ ID NO: 698925 - RNA, 22 nt, Human
gggucugaccugggcacaccau

SEQ ID NO: 698926 - RNA, 22 nt, Human
gaggacagcucuaacuaaaguc

SEQ ID NO: 698927 - RNA, 22 nt, Human
uagaggcauaagagggaagcag

SEQ ID NO: 698928 - RNA, 22 nt, Human
ggcagcaaguggugggagacuu

SEQ ID NO: 698929 - RNA, 22 nt, Human
agccaggggagucagcugcugg

SEQ ID NO: 698930 - RNA, 23 nt, Human
aggauaaacuaaacucauuuugg

SEQ ID NO: 698931 - RNA, 22 nt, Human
uuauuguggacuacuguucugg

SEQ ID NO: 698932 - RNA, 22 nt, Human
cugggaggcaccgcgucgugcu

SEQ ID NO: 698933 - RNA, 22 nt, Human
agcugugucauccuggaaaaug

SEQ ID NO: 698934 - RNA, 22 nt, Human
ccagagcugcagguaaaaugcu

SEQ ID NO: 698935 - RNA, 22 nt, Human
ugugcgugauggaccgggccug

SEQ ID NO: 698936 - RNA, 22 nt, Human
ugagagggcccagagcacacca

SEQ ID NO: 698937 - RNA, 22 nt, Human
acagccaggaauucuggagaag

SEQ ID NO: 698938 - RNA, 22 nt, Human
ccagagagagaggucaauggca

SEQ ID NO: 698939 - RNA, 22 nt, Human
gggccuggggugacguaccccu

SEQ ID NO: 698940 - RNA, 22 nt, Human
aaaugaugauuaaaaugaggua

SEQ ID NO: 698941 - RNA, 22 nt, Human
aagggggccacaccugguguga

SEQ ID NO: 698942 - RNA, 20 nt, Human
uuuauucacagagaagaguu

SEQ ID NO: 698943 - RNA, 20 nt, Human
gugcagccaagcugagccgc

SEQ ID NO: 698944 - RNA, 22 nt, Human
ggcagguguggugaccagagau

SEQ ID NO: 698945 - RNA, 22 nt, Human
caguccagcccccugcuaaaag

SEQ ID NO: 698946 - RNA, 22 nt, Human
cuugcuugauuaugaucauaaa

SEQ ID NO: 698947 - RNA, 22 nt, Human
agggaccucuucuugcagcuga

SEQ ID NO: 698948 - RNA, 22 nt, Human
aaauauguauggaguucaugaa

SEQ ID NO: 698949 - RNA, 22 nt, Human
ccugaggucacaacuugcuuau

SEQ ID NO: 698950 - RNA, 22 nt, Human
aaugcauguuuccucucagcag

SEQ ID NO: 698951 - RNA, 20 nt, Human
agaaggcuccuuuugccaag

SEQ ID NO: 698952 - RNA, 22 nt, Human
cagguggcuucucccuaggcca

SEQ ID NO: 698953 - RNA, 22 nt, Human
agacaguguguguauauauggu

SEQ ID NO: 698954 - RNA, 22 nt, Human
uuuccucuuauacaguguuuau

SEQ ID NO: 698955 - RNA, 21 nt, Human
ugcugccaucaugcagagaug

SEQ ID NO: 698956 - RNA, 22 nt, Human
gccagaaacauacacaucacuu

SEQ ID NO: 698957 - RNA, 22 nt, Human
acccucagaguaggcacugcug

SEQ ID NO: 698958 - RNA, 22 nt, Human
ugugggcuguacugagggcagg

SEQ ID NO: 698959 - RNA, 22 nt, Human
gggcugcugccaccagguggau

SEQ ID NO: 698960 - RNA, 22 nt, Human
gccagaggaacgcugcgcgccc

SEQ ID NO: 698961 - RNA, 22 nt, Human
auucuuuaauucaauugaagga

SEQ ID NO: 698962 - RNA, 22 nt, Human
ugaagcaucuggucugagaauu

SEQ ID NO: 698963 - RNA, 22 nt, Human
cagucuccaaaucaaucugaau

SEQ ID NO: 698964 - RNA, 22 nt, Human
aaggggaguuagugauaaaacc

SEQ ID NO: 698965 - RNA, 22 nt, Human
ccuuugugguggcccagugugg

SEQ ID NO: 698966 - RNA, 22 nt, Human
auguguauacuugugcuuacuc

SEQ ID NO: 698967 - RNA, 22 nt, Human
ucuccacaccagaaggagcuga

SEQ ID NO: 698968 - RNA, 22 nt, Human
caggccuccacuccacgcagac

SEQ ID NO: 698969 - RNA, 22 nt, Human
ccugcugucagcauccucgcga

SEQ ID NO: 698970 - RNA, 22 nt, Human
uucaggaucauuuguuuuaucu

SEQ ID NO: 698971 - RNA, 22 nt, Human
uguaugcaccauuguauuaccu

SEQ ID NO: 698972 - RNA, 22 nt, Human
gugguaaucggauucuuaccgg

SEQ ID NO: 698973 - RNA, 22 nt, Human
ugauggaagugacugucaguuc

SEQ ID NO: 698974 - RNA, 22 nt, Human
uccuggggccagcacuggugga

SEQ ID NO: 698975 - RNA, 22 nt, Human
acuaaagucaucaaagaacuuu

SEQ ID NO: 698976 - RNA, 22 nt, Human
gccaggaggggagaguguguca

SEQ ID NO: 698977 - RNA, 22 nt, Human
augucacaguugcaacaugaau

SEQ ID NO: 698978 - RNA, 22 nt, Human
uaucauuguguuauuucuucca

SEQ ID NO: 698979 - RNA, 22 nt, Human
ccuaacuuuaaugggaccagga

SEQ ID NO: 698980 - RNA, 22 nt, Human
cuuggagaaugacaguggauua

SEQ ID NO: 698981 - RNA, 22 nt, Human
gccaggcagcuagcaaccccug

SEQ ID NO: 698982 - RNA, 22 nt, Human
auguuuacaauucaguauuaca

SEQ ID NO: 698983 - RNA, 22 nt, Human
ucauauuuugcaaggucagcua

SEQ ID NO: 698984 - RNA, 22 nt, Human
gcucccaggcauggagguaauu

SEQ ID NO: 698985 - RNA, 22 nt, Human
ggcugagggucccagacccuaa

SEQ ID NO: 698986 - RNA, 22 nt, Human
cccugcuuugcacccaggcugg

SEQ ID NO: 698987 - RNA, 22 nt, Human
ugguggaaauaaacauccaauu

SEQ ID NO: 698988 - RNA, 22 nt, Human
aagauacuucacuugccgaaau

SEQ ID NO: 698989 - RNA, 22 nt, Human
auccaguaugagguagggcuug

SEQ ID NO: 698990 - RNA, 19 nt, Human
cucuggccucuggaugcug

SEQ ID NO: 698991 - RNA, 22 nt, Human
gaaacuguuucuggcuuuggug

SEQ ID NO: 698992 - RNA, 20 nt, Human
ugauuucucuucuauuccuu

SEQ ID NO: 698993 - RNA, 22 nt, Human
ugcuuccgcuaaaaauuaaucc

SEQ ID NO: 698994 - RNA, 22 nt, Human
auuucaaggcuauuaauauaaa

SEQ ID NO: 698995 - RNA, 22 nt, Human
uucccucuuucacugugauuuu

SEQ ID NO: 698996 - RNA, 22 nt, Human
cccugcccaucggggcggccug

SEQ ID NO: 698997 - RNA, 22 nt, Human
acuguuggucagggauauugug

SEQ ID NO: 698998 - RNA, 22 nt, Human
guuccucacguggacagaugau

SEQ ID NO: 698999 - RNA, 22 nt, Human
uaucaguauggauucauggauu

SEQ ID NO: 699000 - RNA, 22 nt, Human
uagaagcacagccugauggaca

SEQ ID NO: 699001 - RNA, 19 nt, Human
agagucggggggacauagg

SEQ ID NO: 699002 - RNA, 22 nt, Human
uuuacaaguacaccuaacagcu

SEQ ID NO: 699003 - RNA, 22 nt, Human
auuuagacaacaagccuucucc

SEQ ID NO: 699004 - RNA, 22 nt, Human
acacagagguggccacucuuuu

SEQ ID NO: 699005 - RNA, 22 nt, Human
ugcucugggaccgucauuaaaa

SEQ ID NO: 699006 - RNA, 22 nt, Human
auucucuggucauugaguauaa

SEQ ID NO: 699007 - RNA, 22 nt, Human
ggcccugggacacaacaccgaa

SEQ ID NO: 699008 - RNA, 22 nt, Human
ugggcgaggcccagggcugcgu

SEQ ID NO: 699009 - RNA, 22 nt, Human
uauauuagugagauuuauccau

SEQ ID NO: 699010 - RNA, 22 nt, Human
ucagugaaccuucuguggcagg

SEQ ID NO: 699011 - RNA, 22 nt, Human
uaaugcuuuuccuucaaauaag

SEQ ID NO: 699012 - RNA, 22 nt, Human
uuccuuaguugacugucuuagu

SEQ ID NO: 699013 - RNA, 23 nt, Human
acucaaaauuuggcauuugagga

SEQ ID NO: 699014 - RNA, 22 nt, Human
gcuuccagacgaucauguaaga

SEQ ID NO: 699015 - RNA, 22 nt, Human
ucauggcaguuuaauaaguggu

SEQ ID NO: 699016 - RNA, 18 nt, Human
gggcucugauccuucacc

SEQ ID NO: 699017 - RNA, 22 nt, Human
cuucuggaggacacuggcccca

SEQ ID NO: 699018 - RNA, 22 nt, Human
uagggcuguuaguaauucucag

SEQ ID NO: 699019 - RNA, 22 nt, Human
auacaucauuucccaucaaucg

SEQ ID NO: 699020 - RNA, 22 nt, Human
gaauguuuuucauuggugacuc

SEQ ID NO: 699021 - RNA, 22 nt, Human
uugcaaaaccauccuaaguaaa

SEQ ID NO: 699022 - RNA, 22 nt, Human
cugagggcccugaagcuuggca

SEQ ID NO: 699023 - RNA, 22 nt, Human
uuugaaugauuaucuuucggca

SEQ ID NO: 699024 - RNA, 22 nt, Human
ccugaguguaauaaugaaggca

SEQ ID NO: 699025 - RNA, 22 nt, Human
ucuguuaaccuggucuuggcuu

SEQ ID NO: 699026 - RNA, 22 nt, Human
uguucucuucucauugaacaug

SEQ ID NO: 699027 - RNA, 22 nt, Human
aauuuacacuucauuuggaggg

SEQ ID NO: 699028 - RNA, 22 nt, Human
aggcaccagguugugguuuguc

SEQ ID NO: 699029 - RNA, 22 nt, Human
gaaguccagaauacugcucuga

SEQ ID NO: 699030 - RNA, 22 nt, Human
aagauucuuaaauuuguuucuc

SEQ ID NO: 699031 - RNA, 22 nt, Human
uacagugcuugguaucuaguaa

SEQ ID NO: 699032 - RNA, 22 nt, Human
acaggugguaaaauggacuguc

SEQ ID NO: 699033 - RNA, 22 nt, Human
gucaacuuaucucuuuaucugu

SEQ ID NO: 699034 - RNA, 22 nt, Human
gcagguagugaucgagggugac

SEQ ID NO: 699035 - RNA, 22 nt, Human
agagugugaagaaagugcaaug

SEQ ID NO: 699036 - RNA, 22 nt, Human
cccagcagccuggauguucuuu

SEQ ID NO: 699037 - RNA, 22 nt, Human
aauaguauuuauuuggaaaaag

SEQ ID NO: 699038 - RNA, 22 nt, Human
acaagagucugcauuucuaaca

SEQ ID NO: 699039 - RNA, 21 nt, Human
uggccaaggaauagaagcucu

SEQ ID NO: 699040 - RNA, 22 nt, Human
aaugaauggguuuaauauuuua

SEQ ID NO: 699041 - RNA, 22 nt, Human
ucuuccugaaacccuguuccag

SEQ ID NO: 699042 - RNA, 22 nt, Human
auacaucuuccuuuuaaaaugc

SEQ ID NO: 699043 - RNA, 22 nt, Human
cugggugucaggagacaugaug

SEQ ID NO: 699044 - RNA, 22 nt, Human
cucuccagggaagcaguguacu

SEQ ID NO: 699045 - RNA, 22 nt, Human
uuagccauugucagcacauggc

SEQ ID NO: 699046 - RNA, 21 nt, Human
agguuucugugagcagagcag

SEQ ID NO: 699047 - RNA, 22 nt, Human
guguauggacacaugucauguu

SEQ ID NO: 699048 - RNA, 22 nt, Human
auuguuuccccggaauuauuca

SEQ ID NO: 699049 - RNA, 22 nt, Human
agccuucucugauucuccuagu

SEQ ID NO: 699050 - RNA, 22 nt, Human
ugcgucuggaguggaguuugaa

SEQ ID NO: 699051 - RNA, 22 nt, Human
gccagccacguuagacuggccc

SEQ ID NO: 699052 - RNA, 22 nt, Human
uaagguuugcuuaucuucgccu

SEQ ID NO: 699053 - RNA, 22 nt, Human
aucagugcuaaagcaaaugccc

SEQ ID NO: 699054 - RNA, 22 nt, Human
ugcccugucgcucacucccacc

SEQ ID NO: 699055 - RNA, 22 nt, Human
gggagcugaauggcaauggaga

SEQ ID NO: 699056 - RNA, 22 nt, Human
uuaagagauuuaggaacauuau

SEQ ID NO: 699057 - RNA, 19 nt, Human
aggcacagguugucuggac

SEQ ID NO: 699058 - RNA, 22 nt, Human
cucaggcucuggccauccaagg

SEQ ID NO: 699059 - RNA, 22 nt, Human
uugcagagagguuaggaacuca

SEQ ID NO: 699060 - RNA, 22 nt, Human
guucacagguucucuuucuaag

SEQ ID NO: 699061 - RNA, 22 nt, Human
ggguccagagccucagcccaga

SEQ ID NO: 699062 - RNA, 22 nt, Human
uaaauuauggcuggcagagcag

SEQ ID NO: 699063 - RNA, 22 nt, Human
cgaaaauagaucuguuucccag

SEQ ID NO: 699064 - RNA, 22 nt, Human
uggacaggugcacacagcagcc

SEQ ID NO: 699065 - RNA, 19 nt, Human
gcaugcagaguaagaaggu

SEQ ID NO: 699066 - RNA, 22 nt, Human
acacugcuucucuggcagagcc

SEQ ID NO: 699067 - RNA, 22 nt, Human
cauuguaagcuguugaauccuc

SEQ ID NO: 699068 - RNA, 22 nt, Human
uuccacggggcuccccgcucuu

SEQ ID NO: 699069 - RNA, 22 nt, Human
auacaguaauuuguaacucauc

SEQ ID NO: 699070 - RNA, 23 nt, Human
uccugccagaugacuccuuucuu

SEQ ID NO: 699071 - RNA, 22 nt, Human
ucaaaugcucuuugcagagagg

SEQ ID NO: 699072 - RNA, 23 nt, Human
ugguggggucuuggagacagcac

SEQ ID NO: 699073 - RNA, 22 nt, Human
augacagacccucuaaagacaa

SEQ ID NO: 699074 - RNA, 22 nt, Human
cccugagcagucugcagagagc

SEQ ID NO: 699075 - RNA, 22 nt, Human
uaugaacuguacuguacuaagc

SEQ ID NO: 699076 - RNA, 22 nt, Human
ugggauggcauccugggccuug

SEQ ID NO: 699077 - RNA, 22 nt, Human
ucuggcagaggaaggaggccug

SEQ ID NO: 699078 - RNA, 22 nt, Human
acugggaagagagaauucuguc

SEQ ID NO: 699079 - RNA, 22 nt, Human
ucuggcugaaaggggcugugcc

SEQ ID NO: 699080 - RNA, 22 nt, Human
uccagccacguauuaucucacu

SEQ ID NO: 699081 - RNA, 22 nt, Human
ucuuugcaaaauacaacaaugg

SEQ ID NO: 699082 - RNA, 22 nt, Human
ggaaggugcucccuggacagag

SEQ ID NO: 699083 - RNA, 22 nt, Human
guuuaacaucugugaagcugcu

SEQ ID NO: 699084 - RNA, 22 nt, Human
cagcccagcagggucuggcccu

SEQ ID NO: 699085 - RNA, 22 nt, Human
uuauuaagugcguacuguaugc

SEQ ID NO: 699086 - RNA, 22 nt, Human
uugcugccagcgcccugcaggg

SEQ ID NO: 699087 - RNA, 22 nt, Human
uuggccaauuccagaggaucau

SEQ ID NO: 699088 - RNA, 17 nt, Human
acagcagggaaguguug

SEQ ID NO: 699089 - RNA, 22 nt, Human
uuuguagagaauaaaacaaauu

SEQ ID NO: 699090 - RNA, 19 nt, Human
aggcuucaggccacaugcu

SEQ ID NO: 699091 - RNA, 22 nt, Human
ucccagagauuuccucuccuuc

SEQ ID NO: 699092 - RNA, 22 nt, Human
cccuguccuggaugggagcacu

SEQ ID NO: 699093 - RNA, 19 nt, Human
uggcagaggacaaggacuu

SEQ ID NO: 699094 - RNA, 22 nt, Human
uaaagcaaggcaaauuguuggu

SEQ ID NO: 699095 - RNA, 22 nt, Human
cugggcugaaaguguuccuuga

SEQ ID NO: 699096 - RNA, 22 nt, Human
ucacaaacaaugcuuuggaauu

SEQ ID NO: 699097 - RNA, 22 nt, Human
caggaacauuguagaauugaaa

SEQ ID NO: 699098 - RNA, 22 nt, Human
uuagauuuauaugugagaaugg

SEQ ID NO: 699099 - RNA, 22 nt, Human
uucucaggacuccugccugcuu

SEQ ID NO: 699100 - RNA, 17 nt, Human
agcagcuggguugaucu

SEQ ID NO: 699101 - RNA, 22 nt, Human
guaaagaaguuuuugaaugcau

SEQ ID NO: 699102 - RNA, 22 nt, Human
gaggccucugucccaccaggga

SEQ ID NO: 699103 - RNA, 22 nt, Human
gggagccacucagcugagaguu

SEQ ID NO: 699104 - RNA, 23 nt, Human
agcagguagguugaaauuuuccu

SEQ ID NO: 699105 - RNA, 22 nt, Human
uucuaaacuucaauucuaaauu

SEQ ID NO: 699106 - RNA, 22 nt, Human
guuugccuuuuagauaggaaug

SEQ ID NO: 699107 - RNA, 22 nt, Human
cugcugguaccaguggccguca

SEQ ID NO: 699108 - RNA, 22 nt, Human
cagagccacugcauuuuacagc

SEQ ID NO: 699109 - RNA, 21 nt, Human
uuucgcauguguuaacuguga

SEQ ID NO: 699110 - RNA, 22 nt, Human
cagggcucuucaucacacagua

SEQ ID NO: 699111 - RNA, 22 nt, Human
gucugucucucuccagagugca

SEQ ID NO: 699112 - RNA, 22 nt, Human
gagcaacaaauuagggggauuu

SEQ ID NO: 699113 - RNA, 17 nt, Human
ccagaucccaguccuua

SEQ ID NO: 699114 - RNA, 22 nt, Human
gaaugugggcugugaagaggag

SEQ ID NO: 699115 - RNA, 22 nt, Human
uucaaggaaaccagcauuuggu

SEQ ID NO: 699116 - RNA, 22 nt, Human
uagcaggaggcaguuccucgcu

SEQ ID NO: 699117 - RNA, 22 nt, Human
aucugaaacucugacauugucu

SEQ ID NO: 699118 - RNA, 22 nt, Human
aguaaauaacagagaaaauggg

SEQ ID NO: 699119 - RNA, 18 nt, Human
gaauaucuagcacauagu

SEQ ID NO: 699120 - RNA, 22 nt, Human
uuguguuuucuuauggcauaaa

SEQ ID NO: 699121 - RNA, 22 nt, Human
uucucccugguauuuacuuagu

SEQ ID NO: 699122 - RNA, 23 nt, Human
uggcucugagcuuccugguggcc

SEQ ID NO: 699123 - RNA, 22 nt, Human
auugcuggcagcuggaucugca

SEQ ID NO: 699124 - RNA, 22 nt, Human
ugagcaggucaggaaguacauu

SEQ ID NO: 699125 - RNA, 22 nt, Human
gaugugggugucuucagcuggu

SEQ ID NO: 699126 - RNA, 19 nt, Human
aguuggggcagggaagaga

SEQ ID NO: 699127 - RNA, 22 nt, Human
gauaugaaguggcauugugaag

SEQ ID NO: 699128 - RNA, 22 nt, Human
gccuguccacuaaacagccaag

SEQ ID NO: 699129 - RNA, 22 nt, Human
ucugggaaauggcuacuuguca

SEQ ID NO: 699130 - RNA, 22 nt, Human
ucauaaaacacaccagguaguu

SEQ ID NO: 699131 - RNA, 22 nt, Human
acagaaauugcuaauagcucau

SEQ ID NO: 699132 - RNA, 22 nt, Human
uuaaaaugcagauuaugacuca

SEQ ID NO: 699133 - RNA, 22 nt, Human
gcagggcaaugaucccgagagg

SEQ ID NO: 699134 - RNA, 22 nt, Human
ucccagaacccugccagguccu

SEQ ID NO: 699135 - RNA, 22 nt, Human
uuuaggaucucucuuguuacau

SEQ ID NO: 699136 - RNA, 22 nt, Human
gcccacugagugacucccucag

SEQ ID NO: 699137 - RNA, 23 nt, Human
uugaggacaauuuacaugguguu

SEQ ID NO: 699138 - RNA, 22 nt, Human
gagugugggggugcugaggaca

SEQ ID NO: 699139 - RNA, 20 nt, Human
uuucuauggggccagcacau

SEQ ID NO: 699140 - RNA, 22 nt, Human
gugagauuugaguggggauaca

SEQ ID NO: 699141 - RNA, 22 nt, Human
gguauuuauaugucugaagcug

SEQ ID NO: 699142 - RNA, 22 nt, Human
cuguggcagggaagaggccaug

SEQ ID NO: 699143 - RNA, 22 nt, Human
aagaggccucaccucacugccc

SEQ ID NO: 699144 - RNA, 21 nt, Human
agcaaggcagccucucagccu

SEQ ID NO: 699145 - RNA, 22 nt, Human
agccuuguuggucugaguuugg

SEQ ID NO: 699146 - RNA, 22 nt, Human
uugggagcuggaagcaaggccu

SEQ ID NO: 699147 - RNA, 21 nt, Human
aguuaaaccuuuagagaacua

SEQ ID NO: 699148 - RNA, 22 nt, Human
acaaagauucauuugcauuauu

SEQ ID NO: 699149 - RNA, 18 nt, Human
agccaaggaggaggagga

SEQ ID NO: 699150 - RNA, 22 nt, Human
gcagugcaggacaaaucagugc

SEQ ID NO: 699151 - RNA, 22 nt, Human
uccuucaggguugaggccgacu

SEQ ID NO: 699152 - RNA, 19 nt, Human
uuuaccuucuugagagcag

SEQ ID NO: 699153 - RNA, 23 nt, Human
ccauucaucucagucauugcuuu

SEQ ID NO: 699154 - RNA, 22 nt, Human
uucaaagugugaccugacaagc

SEQ ID NO: 699155 - RNA, 18 nt, Human
ucugagguggacgaggag

SEQ ID NO: 699156 - RNA, 22 nt, Human
guuucacauaauuuuaaauugu

SEQ ID NO: 699157 - RNA, 22 nt, Human
aaauagauuuaacauccauccc

SEQ ID NO: 699158 - RNA, 22 nt, Human
ucucugcccauccucaguccac

SEQ ID NO: 699159 - RNA, 22 nt, Human
gaggcauuaaagggaaucuucu

SEQ ID NO: 699160 - RNA, 22 nt, Human
acauugauacugagauacaaag

SEQ ID NO: 699161 - RNA, 22 nt, Human
cagcuguugacugguacaugaa

SEQ ID NO: 699162 - RNA, 22 nt, Human
caggaggcuccuagggcucugu

SEQ ID NO: 699163 - RNA, 22 nt, Human
aguuugaaauguuggcaauauu

SEQ ID NO: 699164 - RNA, 22 nt, Human
uuguccuguuuagggauaagga

SEQ ID NO: 699165 - RNA, 22 nt, Human
agcaggguauguuagagcugua

SEQ ID NO: 699166 - RNA, 22 nt, Human
acaaugaaagcaagaagacggc

SEQ ID NO: 699167 - RNA, 21 nt, Human
uccugcugcuccugucguguu

SEQ ID NO: 699168 - RNA, 22 nt, Human
ucaggcuaacccuaggcagaag

SEQ ID NO: 699169 - RNA, 22 nt, Human
agcuggguggccucuccucggg

SEQ ID NO: 699170 - RNA, 20 nt, Human
gcacagagaugagcaaagua

SEQ ID NO: 699171 - RNA, 22 nt, Human
ugucagcuggagauggcauggg

SEQ ID NO: 699172 - RNA, 22 nt, Human
cauuguuauagcauuacacacc

SEQ ID NO: 699173 - RNA, 22 nt, Human
aguggcugccaagagcaaugcu

SEQ ID NO: 699174 - RNA, 22 nt, Human
uucacagaauggcaaguuaugg

SEQ ID NO: 699175 - RNA, 22 nt, Human
gcuuucugcucuguaaaauggg

SEQ ID NO: 699176 - RNA, 22 nt, Human
gagcaaggauggccggggccgu

SEQ ID NO: 699177 - RNA, 22 nt, Human
ucacuugacuccaguuucuucu

SEQ ID NO: 699178 - RNA, 22 nt, Human
gaaaccugggauauauaaguuu

SEQ ID NO: 699179 - RNA, 22 nt, Human
aggcucugugacaaucaagcug

SEQ ID NO: 699180 - RNA, 22 nt, Human
aaaagcuagucaaugauguauu

SEQ ID NO: 699181 - RNA, 22 nt, Human
aauauuuuaggcuuuccaggcu

SEQ ID NO: 699182 - RNA, 22 nt, Human
gggaacuauuuuaagcacuuga

SEQ ID NO: 699183 - RNA, 22 nt, Human
ugggggagaguuuagaugauuu

SEQ ID NO: 699184 - RNA, 22 nt, Human
guccucaguaagagggccucug

SEQ ID NO: 699185 - RNA, 22 nt, Human
ugagaagcccacacucuuuccu

SEQ ID NO: 699186 - RNA, 22 nt, Human
acauuucucagggaguuuugcu

SEQ ID NO: 699187 - RNA, 22 nt, Human
aggaggugcguggugauccccu

SEQ ID NO: 699188 - RNA, 22 nt, Human
aagacaggaacauagcaaaucc

SEQ ID NO: 699189 - RNA, 22 nt, Human
ggcuucccagcagagggcgcac

SEQ ID NO: 699190 - RNA, 22 nt, Human
cugagcagcaccuucaagaaac

SEQ ID NO: 699191 - RNA, 22 nt, Human
cacugaaucucaaggggagggu

SEQ ID NO: 699192 - RNA, 22 nt, Human
cuguggcugugaaacuucucag

SEQ ID NO: 699193 - RNA, 22 nt, Human
cguugugagcuugguagacacu

SEQ ID NO: 699194 - RNA, 21 nt, Human
agccaggcaagcacccccacu

SEQ ID NO: 699195 - RNA, 22 nt, Human
cauggccucaaaggacugcaga

SEQ ID NO: 699196 - RNA, 22 nt, Human
acaggcaggcgggacagcccga

SEQ ID NO: 699197 - RNA, 22 nt, Human
cuggcuccuccaaggccuggag

SEQ ID NO: 699198 - RNA, 22 nt, Human
ugcugaggcccaggagcacuuu

SEQ ID NO: 699199 - RNA, 22 nt, Human
gagcuuggccucuugaacgugg

SEQ ID NO: 699200 - RNA, 22 nt, Human
cugugcccuuucgcugcacugu

SEQ ID NO: 699201 - RNA, 22 nt, Human
uaauccaaaacugaaucugugg

SEQ ID NO: 699202 - RNA, 22 nt, Human
caugauacuugaauuuggaagg

SEQ ID NO: 699203 - RNA, 22 nt, Human
aaaugucuaucuggcauauucc

SEQ ID NO: 699204 - RNA, 22 nt, Human
ucauacaucuuguauaucuauc

SEQ ID NO: 699205 - RNA, 22 nt, Human
cuguccugaaguuuucaugaga

SEQ ID NO: 699206 - RNA, 22 nt, Human
gcugagcagguguaaggaaggc

SEQ ID NO: 699207 - RNA, 22 nt, Human
gcugccuggauuugcaauccuc

SEQ ID NO: 699208 - RNA, 22 nt, Human
acguuuucagugacugugcuuc

SEQ ID NO: 699209 - RNA, 22 nt, Human
aagcacaccucccuggcaggag

SEQ ID NO: 699210 - RNA, 22 nt, Human
acucagcuuccuacagcuagaa

SEQ ID NO: 699211 - RNA, 22 nt, Human
uaguagaauccaaaccaacagu

SEQ ID NO: 699212 - RNA, 22 nt, Human
gggcacuggaggccaaggagcu

SEQ ID NO: 699213 - RNA, 22 nt, Human
ggagccagugcccucuggugga

SEQ ID NO: 699214 - RNA, 22 nt, Human
ggaggagcugcugugggggccc

SEQ ID NO: 699215 - RNA, 22 nt, Human
cucuuuaguggugaugaugcua

SEQ ID NO: 699216 - RNA, 22 nt, Human
agguuccaggucuggguuaugu

SEQ ID NO: 699217 - RNA, 22 nt, Human
ucccaggcugggggccugaagu

SEQ ID NO: 699218 - RNA, 22 nt, Human
acaucuaagccaauuuugauuu

SEQ ID NO: 699219 - RNA, 22 nt, Human
aaagaacaaaugauauaugguu

SEQ ID NO: 699220 - RNA, 22 nt, Human
uugcauuuuugagcacgaaguu

SEQ ID NO: 699221 - RNA, 17 nt, Human
auaaaggcaaguauuau

SEQ ID NO: 699222 - RNA, 22 nt, Human
ucuuuauaaaagucauuauguc

SEQ ID NO: 699223 - RNA, 22 nt, Human
uggcucauucuuuagaauauac

SEQ ID NO: 699224 - RNA, 22 nt, Human
uaugcauauagaugcacacaca

SEQ ID NO: 699225 - RNA, 22 nt, Human
uuacacaaguucuuuaaccuau

SEQ ID NO: 699226 - RNA, 22 nt, Human
aagaauguucauuaaacuguug

SEQ ID NO: 699227 - RNA, 22 nt, Human
gauuaagauuacauauuuaagu

SEQ ID NO: 699228 - RNA, 22 nt, Human
cagggagcaggcucuguccauc

SEQ ID NO: 699229 - RNA, 22 nt, Human
cuucaguauccuccacauguua

SEQ ID NO: 699230 - RNA, 22 nt, Human
gcguggcuuagagugggguacc

SEQ ID NO: 699231 - RNA, 22 nt, Human
gcuguagguaaggauggcaaag

SEQ ID NO: 699232 - RNA, 22 nt, Human
uaaguacaaauguauacauaag

SEQ ID NO: 699233 - RNA, 22 nt, Human
aggucacauggauaaugaucag

SEQ ID NO: 699234 - RNA, 18 nt, Human
ccuucagcucugccagua

SEQ ID NO: 699235 - RNA, 22 nt, Human
uccccagcauugagggucucuc

SEQ ID NO: 699236 - RNA, 22 nt, Human
agagcugggugaagugccauca

SEQ ID NO: 699237 - RNA, 22 nt, Human
cugugggcucccagcuucucuc

SEQ ID NO: 699238 - RNA, 22 nt, Human
cuguuucucccaacgcccuagu

SEQ ID NO: 699239 - RNA, 20 nt, Human
ugugugcacacaugacauuc

SEQ ID NO: 699240 - RNA, 22 nt, Human
caugcuauauaggaagagcacu

SEQ ID NO: 699241 - RNA, 22 nt, Human
aacucagcauccugcacagaga

SEQ ID NO: 699242 - RNA, 22 nt, Human
ggagcacagccuugccaguacc

SEQ ID NO: 699243 - RNA, 22 nt, Human
gcaaggcagcauccuuuugagg

SEQ ID NO: 699244 - RNA, 22 nt, Human
gaugguuuaugauagaugggaa

SEQ ID NO: 699245 - RNA, 22 nt, Human
gcccagagagaugaagugaugg

SEQ ID NO: 699246 - RNA, 22 nt, Human
caggacaaucucgucggguccu

SEQ ID NO: 699247 - RNA, 22 nt, Human
aaauacuguuuuauuccaugau

SEQ ID NO: 699248 - RNA, 22 nt, Human
uuuguacaggugcaggcauuug

SEQ ID NO: 699249 - RNA, 22 nt, Human
ggcuucuguccucuggaucugu

SEQ ID NO: 699250 - RNA, 22 nt, Human
gaucaggaauauuggaaaguac

SEQ ID NO: 699251 - RNA, 22 nt, Human
augucauuaaaauugugcugca

SEQ ID NO: 699252 - RNA, 22 nt, Human
uaaaaucauucuggugucagua

SEQ ID NO: 699253 - RNA, 22 nt, Human
aaauucuaaggucacaauguug

SEQ ID NO: 699254 - RNA, 22 nt, Human
uacaaacuuguuuuaaguaagu

SEQ ID NO: 699255 - RNA, 22 nt, Human
aaagcugcugccaaucaggcuu

SEQ ID NO: 699256 - RNA, 22 nt, Human
ucacaguaguuguucucuguuu

SEQ ID NO: 699257 - RNA, 22 nt, Human
cagaguaaggagcugucaaacg

SEQ ID NO: 699258 - RNA, 21 nt, Human
gaggaaugguuugcaaagcac

SEQ ID NO: 699259 - RNA, 22 nt, Human
ugaugaggagacuguggcuugg

SEQ ID NO: 699260 - RNA, 21 nt, Human
ugcucagucugucuccagcuu

SEQ ID NO: 699261 - RNA, 22 nt, Human
ggagagugggagcaacuguugc

SEQ ID NO: 699262 - RNA, 20 nt, Human
cacaggcuuacaguuuagau

SEQ ID NO: 699263 - RNA, 22 nt, Human
caugaaggaauaauuguuuaga

SEQ ID NO: 699264 - RNA, 22 nt, Human
guggcagaggcugugaggaugc

SEQ ID NO: 699265 - RNA, 22 nt, Human
ucuuucuacauuuuauaugcuu

SEQ ID NO: 699266 - RNA, 22 nt, Human
cacagcagaaaguguaggagga

SEQ ID NO: 699267 - RNA, 22 nt, Human
gugccugcaggugccggcuuca

SEQ ID NO: 699268 - RNA, 22 nt, Human
ucuccacacuuucucucccagg

SEQ ID NO: 699269 - RNA, 22 nt, Human
gcacauguugcuaguuacuugc

SEQ ID NO: 699270 - RNA, 22 nt, Human
aauuucaaguggcaucuuugau

SEQ ID NO: 699271 - RNA, 22 nt, Human
uacuguacauuccguuuguugc

SEQ ID NO: 699272 - RNA, 22 nt, Human
gccuggagaaaggaagguggga

SEQ ID NO: 699273 - RNA, 22 nt, Human
gucuggggaagucagggcauca

SEQ ID NO: 699274 - RNA, 22 nt, Human
agggccacaguaaugcugagua

SEQ ID NO: 699275 - RNA, 22 nt, Human
ggcagcuguaagaugagugaau

SEQ ID NO: 699276 - RNA, 22 nt, Human
aguauuuagagacacaagacgg

SEQ ID NO: 699277 - RNA, 22 nt, Human
gaggagcucugcuccauccuuc

SEQ ID NO: 699278 - RNA, 22 nt, Human
uaacauuccauggaucugcaga

SEQ ID NO: 699279 - RNA, 22 nt, Human
aaaucaaggagggauuauauuu

SEQ ID NO: 699280 - RNA, 22 nt, Human
agcuggcagucggccuugaugc

SEQ ID NO: 699281 - RNA, 22 nt, Human
cagcugagucugagguucuuug

SEQ ID NO: 699282 - RNA, 22 nt, Human
ccacagcaccugcagccaguug

SEQ ID NO: 699283 - RNA, 22 nt, Human
gagcuaguagaacaagugagga

SEQ ID NO: 699284 - RNA, 22 nt, Human
acauggggcccaaagagagguc

SEQ ID NO: 699285 - RNA, 22 nt, Human
gggacagacccaugggccaggu

SEQ ID NO: 699286 - RNA, 22 nt, Human
aacuuaaugauuucaugcaugu

SEQ ID NO: 699287 - RNA, 22 nt, Human
aauuauauguuaaucuucaauu

SEQ ID NO: 699288 - RNA, 22 nt, Human
cauguaucuuaauugcuuugga

SEQ ID NO: 699289 - RNA, 22 nt, Human
ccaaggcuggagggcuuaugua

SEQ ID NO: 699290 - RNA, 22 nt, Human
gauauauguaaaaguagacaga

SEQ ID NO: 699291 - RNA, 22 nt, Human
auguguuuugguggaucauuca

SEQ ID NO: 699292 - RNA, 22 nt, Human
ggcuggucuccaacccccgauc

SEQ ID NO: 699293 - RNA, 23 nt, Human
aaagaccuaggaugagggagacg

SEQ ID NO: 699294 - RNA, 22 nt, Human
aaaucugggucaagguggagug

SEQ ID NO: 699295 - RNA, 22 nt, Human
auuggaaauacugagagauaaa

SEQ ID NO: 699296 - RNA, 22 nt, Human
ccagccuggagggcaguggugg

SEQ ID NO: 699297 - RNA, 22 nt, Human
aaaaaccucaauuacuuuugca

SEQ ID NO: 699298 - RNA, 22 nt, Human
gaacagaauuaccgaagaucug

SEQ ID NO: 699299 - RNA, 22 nt, Human
acaggccuagcuaaugcuuucc

SEQ ID NO: 699300 - RNA, 22 nt, Human
aagagagaacacagcuugggca

SEQ ID NO: 699301 - RNA, 22 nt, Human
guccagagggucaaguuucuug

SEQ ID NO: 699302 - RNA, 22 nt, Human
uuauuaaaaugcggauuuggcu

SEQ ID NO: 699303 - RNA, 22 nt, Human
ggacauuucauaagaccauucu

SEQ ID NO: 699304 - RNA, 22 nt, Human
uguuguaaaauuugagauguca

SEQ ID NO: 699305 - RNA, 22 nt, Human
cuggccaccaagagcuugcuca

SEQ ID NO: 699306 - RNA, 22 nt, Human
aguggcuuggcugcacuacagg

SEQ ID NO: 699307 - RNA, 21 nt, Human
gagcccaggcaucucauuaau

SEQ ID NO: 699308 - RNA, 22 nt, Human
guauacaauacacaaugcucug

SEQ ID NO: 699309 - RNA, 22 nt, Human
cuggcucccgucugguggccau

SEQ ID NO: 699310 - RNA, 22 nt, Human
gaucaguguuuugugcauucuu

SEQ ID NO: 699311 - RNA, 22 nt, Human
cccaauggcuggauggagggau

SEQ ID NO: 699312 - RNA, 22 nt, Human
ugaugaggggcucagaggucag

SEQ ID NO: 699313 - RNA, 23 nt, Human
cuggcuccgaagacuccaggauc

SEQ ID NO: 699314 - RNA, 22 nt, Human
cucuuacauucuuuuacuagca

SEQ ID NO: 699315 - RNA, 21 nt, Human
uaagacaguaugaauacuuuc

SEQ ID NO: 699316 - RNA, 22 nt, Human
ccacuuuugggaacagugagua

SEQ ID NO: 699317 - RNA, 22 nt, Human
ugcagaagaaaacagcugugug

SEQ ID NO: 699318 - RNA, 22 nt, Human
aaaagucucucugaguaaaagu

SEQ ID NO: 699319 - RNA, 22 nt, Human
guuuucugauuagcaaaucuga

SEQ ID NO: 699320 - RNA, 23 nt, Human
ggagggcuucaucagacccccag

SEQ ID NO: 699321 - RNA, 22 nt, Human
aauauguugagucuaucuuuau

SEQ ID NO: 699322 - RNA, 22 nt, Human
aggcugccaaagcuucugucuc

SEQ ID NO: 699323 - RNA, 22 nt, Human
uguuacuuggugucucuggcug

SEQ ID NO: 699324 - RNA, 22 nt, Human
uauauguguggauucuuguaga

SEQ ID NO: 699325 - RNA, 22 nt, Human
uauuucuguaugcauaaaagga

SEQ ID NO: 699326 - RNA, 22 nt, Human
caaauugcuugucuguagugga

SEQ ID NO: 699327 - RNA, 21 nt, Human
uuggaauuugggagcuaugug

SEQ ID NO: 699328 - RNA, 22 nt, Human
aaauugucagaauucagaaagu

SEQ ID NO: 699329 - RNA, 20 nt, Human
uagauuucauacuucucuuu

SEQ ID NO: 699330 - RNA, 22 nt, Human
ucagaggcuugaagcccaagcc

SEQ ID NO: 699331 - RNA, 22 nt, Human
caagcugccaccagaagagcau

SEQ ID NO: 699332 - RNA, 22 nt, Human
cuuccagguucugguugggaag

SEQ ID NO: 699333 - RNA, 22 nt, Human
ccaguccugggagcuugcacug

SEQ ID NO: 699334 - RNA, 22 nt, Human
uugaggucuucagcugacaccu

SEQ ID NO: 699335 - RNA, 22 nt, Human
ugggauagggcuauugcucaca

SEQ ID NO: 699336 - RNA, 22 nt, Human
uucaagucaauuuuugaaugac

SEQ ID NO: 699337 - RNA, 22 nt, Human
aaguuuagugaaacucuagggg

SEQ ID NO: 699338 - RNA, 22 nt, Human
ucuguucuauuggucuaugugu

SEQ ID NO: 699339 - RNA, 22 nt, Human
cucugcagauucaucccuucac

SEQ ID NO: 699340 - RNA, 22 nt, Human
uggaagggaaaguuuggggucc

SEQ ID NO: 699341 - RNA, 22 nt, Human
ccuuuggagcaacugagagcua

SEQ ID NO: 699342 - RNA, 20 nt, Human
uggaaguucuguugcauugg

SEQ ID NO: 699343 - RNA, 22 nt, Human
uguccaggacccuauucucacu

SEQ ID NO: 699344 - RNA, 18 nt, Human
cuuccugacuagcucugg

SEQ ID NO: 699345 - RNA, 22 nt, Human
ucuugcuaggagcuauggaaga

SEQ ID NO: 699346 - RNA, 22 nt, Human
aauugcuucccaagggaggucu

SEQ ID NO: 699347 - RNA, 22 nt, Human
ugcauguuuauaacagaugagg

SEQ ID NO: 699348 - RNA, 22 nt, Human
cacccaguugacuacaaagggg

SEQ ID NO: 699349 - RNA, 22 nt, Human
auacacacugcuauccuuuuuu

SEQ ID NO: 699350 - RNA, 22 nt, Human
gaggagcuguucccucaccucu

SEQ ID NO: 699351 - RNA, 22 nt, Human
aaucucucugggguucaguccu

SEQ ID NO: 699352 - RNA, 22 nt, Human
acacaaugucaucauaauguca

SEQ ID NO: 699353 - RNA, 22 nt, Human
uguauucucucaauauuucaua

SEQ ID NO: 699354 - RNA, 23 nt, Human
uggccacaguccaugcaugccca

SEQ ID NO: 699355 - RNA, 22 nt, Human
aaagauuucacaucccaagccu

SEQ ID NO: 699356 - RNA, 22 nt, Human
ccaggaaaccugcgccauccag

SEQ ID NO: 699357 - RNA, 22 nt, Human
ugagguccugcauguugagguc

SEQ ID NO: 699358 - RNA, 22 nt, Human
gagggagaauugcagccagcgu

SEQ ID NO: 699359 - RNA, 22 nt, Human
guuauuaaaguauuugauguua

SEQ ID NO: 699360 - RNA, 18 nt, Human
gcugagguggugucagag

SEQ ID NO: 699361 - RNA, 22 nt, Human
uacaggaagcacucaagaaaug

SEQ ID NO: 699362 - RNA, 22 nt, Human
ucacacagugagaaagugcgga

SEQ ID NO: 699363 - RNA, 22 nt, Human
uuauuugcccauguuuagcaga

SEQ ID NO: 699364 - RNA, 22 nt, Human
gugcaauaaauaaauagauugu

SEQ ID NO: 699365 - RNA, 22 nt, Human
guucaugcuacccuuuccuaau

SEQ ID NO: 699366 - RNA, 23 nt, Human
acacagaagaagacccaaggaag

SEQ ID NO: 699367 - RNA, 22 nt, Human
aucagaaggggagguaaagaag

SEQ ID NO: 699368 - RNA, 22 nt, Human
ucacauuuauuucaaaguuacu

SEQ ID NO: 699369 - RNA, 22 nt, Human
caacaucaguccucaugagaca

SEQ ID NO: 699370 - RNA, 22 nt, Human
uuuauaucuggaguugcuagga

SEQ ID NO: 699371 - RNA, 22 nt, Human
gagguccaggguggggccugag

SEQ ID NO: 699372 - RNA, 22 nt, Human
cagagcuuuggcuagaugguug

SEQ ID NO: 699373 - RNA, 22 nt, Human
uccaggggugauuuuugacuug

SEQ ID NO: 699374 - RNA, 22 nt, Human
uuuguuuucaaugugucauuca

SEQ ID NO: 699375 - RNA, 22 nt, Human
augccaggccccacgcugggca

SEQ ID NO: 699376 - RNA, 22 nt, Human
gaaguuauuuccugguguugga

SEQ ID NO: 699377 - RNA, 22 nt, Human
cagaggucuccaucacccuccu

SEQ ID NO: 699378 - RNA, 22 nt, Human
cagacagaaggaaggccaacau

SEQ ID NO: 699379 - RNA, 22 nt, Human
cugugcugaggaugcaguuucu

SEQ ID NO: 699380 - RNA, 22 nt, Human
cacauuuagguuccuauagcca

SEQ ID NO: 699381 - RNA, 22 nt, Human
uauuuuacaaaugggaaugcug

SEQ ID NO: 699382 - RNA, 22 nt, Human
acucugggaugagaaaaggguu

SEQ ID NO: 699383 - RNA, 22 nt, Human
gcugggagccccgagccagcgc

SEQ ID NO: 699384 - RNA, 22 nt, Human
uuuucuuauggugaagcacaaa

SEQ ID NO: 699385 - RNA, 22 nt, Human
ucuuugauuugacaauaucuug

SEQ ID NO: 699386 - RNA, 22 nt, Human
uuaacagauguuuauggagcau

SEQ ID NO: 699387 - RNA, 22 nt, Human
uaugaacugugagugugauggg

SEQ ID NO: 699388 - RNA, 22 nt, Human
ugcagggcagcuagggagcuuu

SEQ ID NO: 699389 - RNA, 22 nt, Human
uucagagguaagggucucagaa

SEQ ID NO: 699390 - RNA, 22 nt, Human
gaaggcagggaauguggugcua

SEQ ID NO: 699391 - RNA, 22 nt, Human
ugaggggauacgguacacauug

SEQ ID NO: 699392 - RNA, 22 nt, Human
agcugucucugguauuauguga

SEQ ID NO: 699393 - RNA, 22 nt, Human
cugccacuuacuaggcauggug

SEQ ID NO: 699394 - RNA, 17 nt, Human
aauaccugccaauucua

SEQ ID NO: 699395 - RNA, 22 nt, Human
cucagagcucagcuuuguuagu

SEQ ID NO: 699396 - RNA, 20 nt, Human
gcuguggccgugccagacuc

SEQ ID NO: 699397 - RNA, 19 nt, Human
ucugggagagugaaucuga

SEQ ID NO: 699398 - RNA, 22 nt, Human
guggccugccagcagauggcgc

SEQ ID NO: 699399 - RNA, 22 nt, Human
cugggugauuccuguccaggca

SEQ ID NO: 699400 - RNA, 22 nt, Human
caguccuuagauuuuacugcca

SEQ ID NO: 699401 - RNA, 22 nt, Human
ucugcguggcugcugugagcgu

SEQ ID NO: 699402 - RNA, 22 nt, Human
gggcugacuccuauuggaugaa

SEQ ID NO: 699403 - RNA, 22 nt, Human
aagucaugaguccucuucugug

SEQ ID NO: 699404 - RNA, 22 nt, Human
gauacauuccauuucuacuuaa

SEQ ID NO: 699405 - RNA, 22 nt, Human
uagcacaagaaguacacauaga

SEQ ID NO: 699406 - RNA, 22 nt, Human
agguguggcuggggcagaggcc

SEQ ID NO: 699407 - RNA, 22 nt, Human
ucuuggcugcguccuggcugug

SEQ ID NO: 699408 - RNA, 22 nt, Human
aucuggacuagagcagaauggg

SEQ ID NO: 699409 - RNA, 22 nt, Human
auguggccuaguauagaaauga

SEQ ID NO: 699410 - RNA, 22 nt, Human
uucccagaccuguaggaucaga

SEQ ID NO: 699411 - RNA, 22 nt, Human
gcccucaggacaagguuacgcu

SEQ ID NO: 699412 - RNA, 22 nt, Human
auucucagcuuucaaauagaca

SEQ ID NO: 699413 - RNA, 20 nt, Human
cagcuuuagaucuuugauua

SEQ ID NO: 699414 - RNA, 22 nt, Human
uggccuggugcucaggcaguag

SEQ ID NO: 699415 - RNA, 22 nt, Human
ggcugagguguggggaacuaua

SEQ ID NO: 699416 - RNA, 20 nt, Human
ggcauccuucugacccagag

SEQ ID NO: 699417 - RNA, 22 nt, Human
acacaacagaagagcaauugca

SEQ ID NO: 699418 - RNA, 22 nt, Human
uugaaacuuagaaauugagcug

SEQ ID NO: 699419 - RNA, 20 nt, Human
uuguuagaggaaugccauag

SEQ ID NO: 699420 - RNA, 15 nt, Human
uguggcuggcuccug

SEQ ID NO: 699421 - RNA, 22 nt, Human
ucuccaaggagcuccugugccg

SEQ ID NO: 699422 - RNA, 22 nt, Human
uacagcuaugucuugguguucu

SEQ ID NO: 699423 - RNA, 22 nt, Human
acuaaagaugucuaaauauauu

SEQ ID NO: 699424 - RNA, 22 nt, Human
ugguuugacaaugaggacuggu

SEQ ID NO: 699425 - RNA, 22 nt, Human
agcagggggcauccuugcccuu

SEQ ID NO: 699426 - RNA, 22 nt, Human
gcuccuggauguucaagucggc

SEQ ID NO: 699427 - RNA, 22 nt, Human
augcuuuagugucaaguuuggg

SEQ ID NO: 699428 - RNA, 22 nt, Human
cuguaaaacacuguaguaucug

SEQ ID NO: 699429 - RNA, 22 nt, Human
aacugagacacgaacuaugauu

SEQ ID NO: 699430 - RNA, 22 nt, Human
auugaaaauauaauucuaggag

SEQ ID NO: 699431 - RNA, 22 nt, Human
ucucacuggguauaaaugagua

SEQ ID NO: 699432 - RNA, 22 nt, Human
guuaucuucccuuugaugauuu

SEQ ID NO: 699433 - RNA, 22 nt, Human
augcgugugugcaaaccauugc

SEQ ID NO: 699434 - RNA, 22 nt, Human
aaccagagugacacucuacaga

SEQ ID NO: 699435 - RNA, 22 nt, Human
cuggcagugcccagucacuguu

SEQ ID NO: 699436 - RNA, 19 nt, Human
ggaaggagagaaaugcaug

SEQ ID NO: 699437 - RNA, 22 nt, Human
agguacugaaaaaauguuugca

SEQ ID NO: 699438 - RNA, 22 nt, Human
gccaccuuccaaaauaaucaca

SEQ ID NO: 699439 - RNA, 22 nt, Human
gaaauucacuguauuucuuggg

SEQ ID NO: 699440 - RNA, 22 nt, Human
uuggcaggaauauugcagaggu

SEQ ID NO: 699441 - RNA, 22 nt, Human
cucaggcugucuaauggauuag

SEQ ID NO: 699442 - RNA, 22 nt, Human
uauuucagcaagaagaaugugg

SEQ ID NO: 699443 - RNA, 22 nt, Human
cagcugccccauaaaucacagu

SEQ ID NO: 699444 - RNA, 22 nt, Human
ugaguagacgugaucuaguaac

SEQ ID NO: 699445 - RNA, 22 nt, Human
augggcugugagguccggcagg

SEQ ID NO: 699446 - RNA, 22 nt, Human
acacaugaaauaauauuaugca

SEQ ID NO: 699447 - RNA, 22 nt, Human
uguuuccuucugucucuuugga

SEQ ID NO: 699448 - RNA, 22 nt, Human
aucacagggugaggauuagacc

SEQ ID NO: 699449 - RNA, 22 nt, Human
gacuguggcagaaauguuguug

SEQ ID NO: 699450 - RNA, 20 nt, Human
ucccucccuccagcucuggg

SEQ ID NO: 699451 - RNA, 22 nt, Human
cuuccgugucaguuccaggugg

SEQ ID NO: 699452 - RNA, 22 nt, Human
ugcauuucacagacugagaaau

SEQ ID NO: 699453 - RNA, 22 nt, Human
ugaaugaugaggggagaauaau

SEQ ID NO: 699454 - RNA, 22 nt, Human
ggugaggggcgccucugcccgg

SEQ ID NO: 699455 - RNA, 22 nt, Human
acagaaagaugauuugaaaugg

SEQ ID NO: 699456 - RNA, 23 nt, Human
acugggcugaaauuaaagguguc

SEQ ID NO: 699457 - RNA, 22 nt, Human
auuucagauucagaaauguagg

SEQ ID NO: 699458 - RNA, 22 nt, Human
aucuggcuggauucuuagcguu

SEQ ID NO: 699459 - RNA, 22 nt, Human
aaggaggaauguagccagcucc

SEQ ID NO: 699460 - RNA, 22 nt, Human
aacaaugugaagugcuguucag

SEQ ID NO: 699461 - RNA, 22 nt, Human
aauggccagcaacaggagugaa

SEQ ID NO: 699462 - RNA, 22 nt, Human
ccaguccuggccaguaacauga

SEQ ID NO: 699463 - RNA, 22 nt, Human
uuuauugucaaucuauucccag

SEQ ID NO: 699464 - RNA, 22 nt, Human
uggucccuagcacagcuguccu

SEQ ID NO: 699465 - RNA, 18 nt, Human
uccuguggcccagaguuu

SEQ ID NO: 699466 - RNA, 21 nt, Human
uaagcauaucagauagacucu

SEQ ID NO: 699467 - RNA, 19 nt, Human
cucuuggguggcagaggcc

SEQ ID NO: 699468 - RNA, 22 nt, Human
caugugugggacccuuagguug

SEQ ID NO: 699469 - RNA, 22 nt, Human
guuccauaucacagcagacgaa

SEQ ID NO: 699470 - RNA, 22 nt, Human
uggauuaguuuaacaauguggc

SEQ ID NO: 699471 - RNA, 22 nt, Human
ugugacuuaauccuuggguggg

SEQ ID NO: 699472 - RNA, 22 nt, Human
ggcugcugagucacgacaguga

SEQ ID NO: 699473 - RNA, 22 nt, Human
ccucugagaacaccuggcgucc

SEQ ID NO: 699474 - RNA, 22 nt, Human
ggcucugcuuccuggaauugug

SEQ ID NO: 699475 - RNA, 22 nt, Human
gcagacgucaccgagucgaugg

SEQ ID NO: 699476 - RNA, 22 nt, Human
acagugcuaaacacuucuugaa

SEQ ID NO: 699477 - RNA, 22 nt, Human
ugccagcaagaauagacaguaa

SEQ ID NO: 699478 - RNA, 21 nt, Human
ucccacuggcccagggcucca

SEQ ID NO: 699479 - RNA, 22 nt, Human
ggaggcaggaaagacagguuca

SEQ ID NO: 699480 - RNA, 22 nt, Human
auuauguauuugguauaguuug

SEQ ID NO: 699481 - RNA, 22 nt, Human
agggucaacauucuaaaaucug

SEQ ID NO: 699482 - RNA, 22 nt, Human
ugggcucagucugcaccugcgg

SEQ ID NO: 699483 - RNA, 22 nt, Human
guggcuucugcggugugcgcag

SEQ ID NO: 699484 - RNA, 22 nt, Human
cuagcagcaucacaggaagacu

SEQ ID NO: 699485 - RNA, 22 nt, Human
gcauucaggaaccggaagggua

SEQ ID NO: 699486 - RNA, 22 nt, Human
ucacaggcuugugaacauugca

SEQ ID NO: 699487 - RNA, 22 nt, Human
ucaucuaagagucuuacauuua

SEQ ID NO: 699488 - RNA, 22 nt, Human
ggcauacaagagaaauauaaga

SEQ ID NO: 699489 - RNA, 22 nt, Human
uuuuuuauaucaacugaagucu

SEQ ID NO: 699490 - RNA, 22 nt, Human
uuguuuugcuaaagggucauca

SEQ ID NO: 699491 - RNA, 22 nt, Human
gcacacauucggauucuuaacc

SEQ ID NO: 699492 - RNA, 22 nt, Human
cagaagacagagcacuucucuu

SEQ ID NO: 699493 - RNA, 22 nt, Human
aguggcagagguugacugcagu

SEQ ID NO: 699494 - RNA, 22 nt, Human
aggcuggagugcaguggcguga

SEQ ID NO: 699495 - RNA, 19 nt, Human
aguuucccuggagacauca

SEQ ID NO: 699496 - RNA, 22 nt, Human
aacaguuuggguagguauguag

SEQ ID NO: 699497 - RNA, 22 nt, Human
gugccuuugagaaguuucucug

SEQ ID NO: 699498 - RNA, 22 nt, Human
ugggacacaaaccagaccagga

SEQ ID NO: 699499 - RNA, 22 nt, Human
ucugcagguagagcucaggaau

SEQ ID NO: 699500 - RNA, 22 nt, Human
uaaaugcagauuccugagccua

SEQ ID NO: 699501 - RNA, 22 nt, Human
gucaggaugggcagccaaacua

SEQ ID NO: 699502 - RNA, 22 nt, Human
aagcauauauuuuauauguugu

SEQ ID NO: 699503 - RNA, 22 nt, Human
cucagcuccagcccucagcagc

SEQ ID NO: 699504 - RNA, 21 nt, Human
agcuguggcgaggggaacaug

SEQ ID NO: 699505 - RNA, 18 nt, Human
ucuaggagaguaccuacc

SEQ ID NO: 699506 - RNA, 22 nt, Human
cauaaucagauguguacauaag

SEQ ID NO: 699507 - RNA, 22 nt, Human
uccaucaccacagaggacagag

SEQ ID NO: 699508 - RNA, 22 nt, Human
aggcucagucccggcccgcgcc

SEQ ID NO: 699509 - RNA, 22 nt, Human
caggcgagggcccugaggagcc

SEQ ID NO: 699510 - RNA, 22 nt, Human
ucagaaaggaguuagaggucuc

SEQ ID NO: 699511 - RNA, 22 nt, Human
ucacaggacccugaggguggcg

SEQ ID NO: 699512 - RNA, 22 nt, Human
uugugcaagaagccagcaccaa

SEQ ID NO: 699513 - RNA, 19 nt, Human
uucuaugauuaacaugaga

SEQ ID NO: 699514 - RNA, 22 nt, Human
aauuaauggaaaguaaggaagg

SEQ ID NO: 699515 - RNA, 22 nt, Human
uccucacagucaacacuuugag

SEQ ID NO: 699516 - RNA, 22 nt, Human
cugucuggccggcccagcuucc

SEQ ID NO: 699517 - RNA, 22 nt, Human
gguggggccugcuccagcggcc

SEQ ID NO: 699518 - RNA, 22 nt, Human
augacaauauagcuuugauuuu

SEQ ID NO: 699519 - RNA, 22 nt, Human
uuucaugugcaauuagcaauau

SEQ ID NO: 699520 - RNA, 23 nt, Human
agcuucgccuuccuuucucugca

SEQ ID NO: 699521 - RNA, 22 nt, Human
gacugaggcuccccuaggcuca

SEQ ID NO: 699522 - RNA, 22 nt, Human
ccuggcacagauccuucauaca

SEQ ID NO: 699523 - RNA, 21 nt, Human
auaucacaaacauauggucug

SEQ ID NO: 699524 - RNA, 22 nt, Human
gcuucuggagucuucagaggaa

SEQ ID NO: 699525 - RNA, 22 nt, Human
auccuuggauccuguguuccug

SEQ ID NO: 699526 - RNA, 22 nt, Human
aagaaaggauauaugggaggua

SEQ ID NO: 699527 - RNA, 22 nt, Human
aagcacacagcaaaggggagcu

SEQ ID NO: 699528 - RNA, 22 nt, Human
guggccuggcuggcaccaccuc

SEQ ID NO: 699529 - RNA, 22 nt, Human
aucuguaaagauaaucauaugu

SEQ ID NO: 699530 - RNA, 22 nt, Human
auacagcuuacaguucuaaugc

SEQ ID NO: 699531 - RNA, 22 nt, Human
gaggaaacauuguagaagcagu

SEQ ID NO: 699532 - RNA, 22 nt, Human
caauuucuuguuaauucucagg

SEQ ID NO: 699533 - RNA, 22 nt, Human
cagagcugggaucccaugggcg

SEQ ID NO: 699534 - RNA, 23 nt, Human
gcugagguacauuuacaggaaga

SEQ ID NO: 699535 - RNA, 22 nt, Human
acccaggcuggagugcaguagc

SEQ ID NO: 699536 - RNA, 19 nt, Human
gcaggcuugggucucccca

SEQ ID NO: 699537 - RNA, 22 nt, Human
auucaaagcccaguaaacauug

SEQ ID NO: 699538 - RNA, 22 nt, Human
ugcugggcaucguaggagguac

SEQ ID NO: 699539 - RNA, 22 nt, Human
gcucaggggaaugggcugccgu

SEQ ID NO: 699540 - RNA, 22 nt, Human
gacuauuuuuaucuaacugggu

SEQ ID NO: 699541 - RNA, 22 nt, Human
aucauaaagugcuaucugauug

SEQ ID NO: 699542 - RNA, 22 nt, Human
ucacagaaggcaucacagaaga

SEQ ID NO: 699543 - RNA, 22 nt, Human
ggcugucaauucauaggucaga

SEQ ID NO: 699544 - RNA, 22 nt, Human
ugcccugggaggcuuuccuguu

SEQ ID NO: 699545 - RNA, 22 nt, Human
ucaaagaagugcaaaccucauc

SEQ ID NO: 699546 - RNA, 22 nt, Human
uauagccauuuccaguggcauc

SEQ ID NO: 699547 - RNA, 22 nt, Human
gcuggccucgcaggcaggaugu

SEQ ID NO: 699548 - RNA, 22 nt, Human
aaucagaaaauucaguggaauu

SEQ ID NO: 699549 - RNA, 22 nt, Human
gcagggcacagacagugccaag

SEQ ID NO: 699550 - RNA, 22 nt, Human
gaaguuaucaaagauguauucu

SEQ ID NO: 699551 - RNA, 22 nt, Human
guaauugacucagcucuguuca

SEQ ID NO: 699552 - RNA, 22 nt, Human
gccuuuggagaauccagucaug

SEQ ID NO: 699553 - RNA, 22 nt, Human
gaaggccauuuuuagguagaau

SEQ ID NO: 699554 - RNA, 22 nt, Human
auugacuuaaaggcucugguua

SEQ ID NO: 699555 - RNA, 22 nt, Human
aucaggcuaguguguguguuca

SEQ ID NO: 699556 - RNA, 22 nt, Human
ccacucugauuucaagggagau

SEQ ID NO: 699557 - RNA, 22 nt, Human
ugaagccauaggacagaggaua

SEQ ID NO: 699558 - RNA, 22 nt, Human
caggccagagcgcgugguuggg

SEQ ID NO: 699559 - RNA, 22 nt, Human
uggagaugaggacauggacguc

SEQ ID NO: 699560 - RNA, 22 nt, Human
caggaauguagcagcgauggaa

SEQ ID NO: 699561 - RNA, 22 nt, Human
uucuuggaaacugauuccuugu

SEQ ID NO: 699562 - RNA, 22 nt, Human
ucucuuccuugaccuauuguaa

SEQ ID NO: 699563 - RNA, 22 nt, Human
uaguuaaugcuaauuaacaaau

SEQ ID NO: 699564 - RNA, 17 nt, Human
ggaagaaaaggaucauc

SEQ ID NO: 699565 - RNA, 22 nt, Human
gggcccuggacguggcggcaga

SEQ ID NO: 699566 - RNA, 22 nt, Human
aaaugcauuaagucagaacaau

SEQ ID NO: 699567 - RNA, 16 nt, Human
gagccaggugccuuga

SEQ ID NO: 699568 - RNA, 22 nt, Human
cugggcauuuuucucuguuaca

SEQ ID NO: 699569 - RNA, 22 nt, Human
agucaaaugaguaaauauauaa

SEQ ID NO: 699570 - RNA, 22 nt, Human
cauuucucacuccagcaacuuu

SEQ ID NO: 699571 - RNA, 22 nt, Human
aggguggccaccaaguauguca

SEQ ID NO: 699572 - RNA, 22 nt, Human
uuaaguaagaccuuaugucuug

SEQ ID NO: 699573 - RNA, 22 nt, Human
ggcugguggggaaagaggacca

SEQ ID NO: 699574 - RNA, 22 nt, Human
ggaggagacggagugauuagug

SEQ ID NO: 699575 - RNA, 22 nt, Human
gcuucagacuggagcagaggaa

SEQ ID NO: 699576 - RNA, 22 nt, Human
cugaaggacuuggugauaguug

SEQ ID NO: 699577 - RNA, 22 nt, Human
gaggcucaguuaugucaucagg

SEQ ID NO: 699578 - RNA, 22 nt, Human
uuuccuuucuagaagccuaaau

SEQ ID NO: 699579 - RNA, 22 nt, Human
cacaaaguuggacaacgcaccc

SEQ ID NO: 699580 - RNA, 22 nt, Human
acuuucaauucacugagauaua

SEQ ID NO: 699581 - RNA, 22 nt, Human
aaagccaguucuuuuauauugg

SEQ ID NO: 699582 - RNA, 22 nt, Human
gggcacaggagaaggaucuggc

SEQ ID NO: 699583 - RNA, 22 nt, Human
ugagaacuugugcuauugcaca

SEQ ID NO: 699584 - RNA, 22 nt, Human
gagcagagcuucucaaaguaaa

SEQ ID NO: 699585 - RNA, 22 nt, Human
cuggaaaggguccucauucugu

SEQ ID NO: 699586 - RNA, 22 nt, Human
auuuaauuuauagauguggaua

SEQ ID NO: 699587 - RNA, 22 nt, Human
cucugcugcuuugccaguggaa

SEQ ID NO: 699588 - RNA, 22 nt, Human
gacagacaggugugguaggcac

SEQ ID NO: 699589 - RNA, 20 nt, Human
aaguuggcuccuccuagcaa

SEQ ID NO: 699590 - RNA, 22 nt, Human
ggccuucacgugaccuggcgug

SEQ ID NO: 699591 - RNA, 22 nt, Human
acccagcuaacccuacccugga

SEQ ID NO: 699592 - RNA, 22 nt, Human
ugcauaaagugccauaguauua

SEQ ID NO: 699593 - RNA, 22 nt, Human
auuucucagugaaaugacaggc

SEQ ID NO: 699594 - RNA, 22 nt, Human
aagcaauguguuaaugaaugag

SEQ ID NO: 699595 - RNA, 20 nt, Human
gccaggcacuguucucaaua

SEQ ID NO: 699596 - RNA, 22 nt, Human
cuggcccuggagggcugugcga

SEQ ID NO: 699597 - RNA, 20 nt, Human
ugagccaggcuaggaagggc

SEQ ID NO: 699598 - RNA, 22 nt, Human
aggcugugacagggucauggag

SEQ ID NO: 699599 - RNA, 22 nt, Human
agaguuggcccacguguaggcg

SEQ ID NO: 699600 - RNA, 22 nt, Human
cucuuagaaacuauagagauua

SEQ ID NO: 699601 - RNA, 22 nt, Human
agugcagaggcugggaaaugcu

SEQ ID NO: 699602 - RNA, 22 nt, Human
acacauuauaggcaaucaaaag

SEQ ID NO: 699603 - RNA, 22 nt, Human
ggccugcuguguacugauguca

SEQ ID NO: 699604 - RNA, 22 nt, Human
aaagacuuucaccuagcaaaga

SEQ ID NO: 699605 - RNA, 22 nt, Human
auuuuguugaugguggaguagc

SEQ ID NO: 699606 - RNA, 22 nt, Human
guauuuuuagguaaggaaagua

SEQ ID NO: 699607 - RNA, 22 nt, Human
uguagaugagucagggugcaug

SEQ ID NO: 699608 - RNA, 22 nt, Human
ccccaggagauuugggagcaca

SEQ ID NO: 699609 - RNA, 23 nt, Human
ugugaaauuugaggucagugcuu

SEQ ID NO: 699610 - RNA, 22 nt, Human
cugagccaguagucagggacaa

SEQ ID NO: 699611 - RNA, 22 nt, Human
gguuugcaugugauguugggca

SEQ ID NO: 699612 - RNA, 22 nt, Human
ccagggaugcuuucccaggacu

SEQ ID NO: 699613 - RNA, 22 nt, Human
agaaagcacucugucuuuuacc

SEQ ID NO: 699614 - RNA, 22 nt, Human
caguauguuugggagacaugac

SEQ ID NO: 699615 - RNA, 22 nt, Human
aagcuguugcccugcucuuucu

SEQ ID NO: 699616 - RNA, 21 nt, Human
uggcuaaacccuaguaaauua

SEQ ID NO: 699617 - RNA, 22 nt, Human
ucacacuuaucccacucaguca

SEQ ID NO: 699618 - RNA, 22 nt, Human
uuacagagaggugauugugaag

SEQ ID NO: 699619 - RNA, 22 nt, Human
aucagagaaauggagggcgcuu

SEQ ID NO: 699620 - RNA, 22 nt, Human
cuugagaaucuugaugucuacc

SEQ ID NO: 699621 - RNA, 22 nt, Human
cacaggagggagcgggcagcca

SEQ ID NO: 699622 - RNA, 22 nt, Human
gccaguggugagauucccuggg

SEQ ID NO: 699623 - RNA, 22 nt, Human
aaaauuggacguagcuacucca

SEQ ID NO: 699624 - RNA, 22 nt, Human
auguauuucuauguagugaaga

SEQ ID NO: 699625 - RNA, 22 nt, Human
uucacauucucacaagaggaaa

SEQ ID NO: 699626 - RNA, 22 nt, Human
uggaagaaggcagagaggcauu

SEQ ID NO: 699627 - RNA, 22 nt, Human
uaccaugaucaggcucauccuu

SEQ ID NO: 699628 - RNA, 22 nt, Human
cgcugugugcagacugaaaaug

SEQ ID NO: 699629 - RNA, 22 nt, Human
uuaagacauuuuuggagauuau

SEQ ID NO: 699630 - RNA, 22 nt, Human
aagaagcacuuuccuacauguu

SEQ ID NO: 699631 - RNA, 22 nt, Human
uuggccagaucugaggauacug

SEQ ID NO: 699632 - RNA, 22 nt, Human
ugaaaucugcaugcaaaguccu

SEQ ID NO: 699633 - RNA, 22 nt, Human
ucuggggcaguuacuggggccu

SEQ ID NO: 699634 - RNA, 22 nt, Human
uuuaaugggauccaucugguua

SEQ ID NO: 699635 - RNA, 22 nt, Human
aaggcucuggguuucauaggug

SEQ ID NO: 699636 - RNA, 22 nt, Human
ucagaagccaccuuuuguuggg

SEQ ID NO: 699637 - RNA, 22 nt, Human
cuuggggcugucacucuggcau

SEQ ID NO: 699638 - RNA, 22 nt, Human
ucuuuccucugagcuccuguag

SEQ ID NO: 699639 - RNA, 22 nt, Human
agugcugucccgacaacugagg

SEQ ID NO: 699640 - RNA, 22 nt, Human
ucauuuuugaccauggguagga

SEQ ID NO: 699641 - RNA, 20 nt, Human
ucucccugcccaucucagau

SEQ ID NO: 699642 - RNA, 22 nt, Human
ccuccugggcuccugucugcac

SEQ ID NO: 699643 - RNA, 22 nt, Human
ugaacucucucaagugacagaa

SEQ ID NO: 699644 - RNA, 22 nt, Human
ugagucucgguuuccccuccaa

SEQ ID NO: 699645 - RNA, 22 nt, Human
cuggaaggugacugucuugaau

SEQ ID NO: 699646 - RNA, 19 nt, Human
aggucugcagcugcaguuu

SEQ ID NO: 699647 - RNA, 16 nt, Human
caguuuuaaggcccaa

SEQ ID NO: 699648 - RNA, 20 nt, Human
accauaauguuaauuacaaa

SEQ ID NO: 699649 - RNA, 20 nt, Human
aguguuccggaagacuggca

SEQ ID NO: 699650 - RNA, 22 nt, Human
ggaggaugagcuacgaggagcu

SEQ ID NO: 699651 - RNA, 22 nt, Human
gcucugagccgggggccugucc

SEQ ID NO: 699652 - RNA, 22 nt, Human
uaagacacaugcguacaagaua

SEQ ID NO: 699653 - RNA, 22 nt, Human
auugaguauuguaaauaaaaca

SEQ ID NO: 699654 - RNA, 22 nt, Human
gcaucuuucuguccauucagca

SEQ ID NO: 699655 - RNA, 22 nt, Human
acccacuguagccacucugggu

SEQ ID NO: 699656 - RNA, 22 nt, Human
gugugcagaacagggagugggu

SEQ ID NO: 699657 - RNA, 22 nt, Human
ugcaaauagccuauauuuauag

SEQ ID NO: 699658 - RNA, 22 nt, Human
augaaccauaggcaagacaaua

SEQ ID NO: 699659 - RNA, 22 nt, Human
ugaaugaggauccuugaccuua

SEQ ID NO: 699660 - RNA, 22 nt, Human
aaagaaucagaagucucaaaca

SEQ ID NO: 699661 - RNA, 22 nt, Human
aacugagggcccugcugaagca

SEQ ID NO: 699662 - RNA, 22 nt, Human
acugacuuuggaauauuucuag

SEQ ID NO: 699663 - RNA, 22 nt, Human
agggcuuugauggcauucucau

SEQ ID NO: 699664 - RNA, 22 nt, Human
uuucuugucuuuaguaucuggc

SEQ ID NO: 699665 - RNA, 22 nt, Human
acgaguauguuuguauuuucuu

SEQ ID NO: 699666 - RNA, 22 nt, Human
acuacuuugggccauuuguuua

SEQ ID NO: 699667 - RNA, 22 nt, Human
agggcuggaggguacuaguuua

SEQ ID NO: 699668 - RNA, 22 nt, Human
acacaaguucuaaagauugcgc

SEQ ID NO: 699669 - RNA, 22 nt, Human
ugauguaagagauacacuugau

SEQ ID NO: 699670 - RNA, 22 nt, Human
aggaaacugggccucagguuag

SEQ ID NO: 699671 - RNA, 22 nt, Human
ucauuuacauagaaacaauaua

SEQ ID NO: 699672 - RNA, 22 nt, Human
agggcagcacaaggcauggacu

SEQ ID NO: 699673 - RNA, 22 nt, Human
aagagaauaucgauagcacucu

SEQ ID NO: 699674 - RNA, 22 nt, Human
ucuucaccaucaacagaaugaa

SEQ ID NO: 699675 - RNA, 22 nt, Human
agggucuugaggaucugaacug

SEQ ID NO: 699676 - RNA, 22 nt, Human
cuuccugggucuggagacugga

SEQ ID NO: 699677 - RNA, 22 nt, Human
cauuacaugguccaggauauau

SEQ ID NO: 699678 - RNA, 22 nt, Human
caaaguaauuuggagauauaua

SEQ ID NO: 699679 - RNA, 22 nt, Human
ucccagccuuaucuccccuggc

SEQ ID NO: 699680 - RNA, 22 nt, Human
ccuggagcgcgggucaagcugg

SEQ ID NO: 699681 - RNA, 22 nt, Human
caugacacccaggcauagcacc

SEQ ID NO: 699682 - RNA, 22 nt, Human
uuggaauuccuguuguuucguc

SEQ ID NO: 699683 - RNA, 22 nt, Human
caaauucaaugaacauguuuaa

SEQ ID NO: 699684 - RNA, 21 nt, Human
uggcagaguugaguaguuaug

SEQ ID NO: 699685 - RNA, 22 nt, Human
aggcagcaaugaaugaaaugga

SEQ ID NO: 699686 - RNA, 22 nt, Human
aucugcuauguuauuucccacu

SEQ ID NO: 699687 - RNA, 22 nt, Human
agcuacucugcagugcccaugg

SEQ ID NO: 699688 - RNA, 22 nt, Human
aaacugugcuucccaaaugccc

SEQ ID NO: 699689 - RNA, 22 nt, Human
cuggccacuggagguggcaccc

SEQ ID NO: 699690 - RNA, 22 nt, Human
ugcugaauaauaagauuacuca

SEQ ID NO: 699691 - RNA, 22 nt, Human
augugucuuugagacucugcua

SEQ ID NO: 699692 - RNA, 22 nt, Human
uguagcagaguaucucuguuuu

SEQ ID NO: 699693 - RNA, 23 nt, Human
uucucaguccugcccagggaggc

SEQ ID NO: 699694 - RNA, 22 nt, Human
agugaacaaguuaagaacacua

SEQ ID NO: 699695 - RNA, 22 nt, Human
cucuuuagucuguguggagaag

SEQ ID NO: 699696 - RNA, 22 nt, Human
agccauuguugucuucaucuuc

SEQ ID NO: 699697 - RNA, 23 nt, Human
ucagagaaguuguaggcugggga

SEQ ID NO: 699698 - RNA, 22 nt, Human
ucucauaauagcauuucucacc

SEQ ID NO: 699699 - RNA, 19 nt, Human
ucuaacagaagugucgucc

SEQ ID NO: 699700 - RNA, 22 nt, Human
uauuugugagacugacugaagu

SEQ ID NO: 699701 - RNA, 22 nt, Human
cuuguuaaaaugcagauuccaa

SEQ ID NO: 699702 - RNA, 22 nt, Human
ccugcagacacuuguccagcaa

SEQ ID NO: 699703 - RNA, 22 nt, Human
ugguccuggucaucugggcugg

SEQ ID NO: 699704 - RNA, 22 nt, Human
uggcaggguacaccuuaacacc

SEQ ID NO: 699705 - RNA, 22 nt, Human
uuaagaaugugccuuuugguug

SEQ ID NO: 699706 - RNA, 22 nt, Human
gcacaggcuccggaggagagcu

SEQ ID NO: 699707 - RNA, 18 nt, Human
gcuuuauuucuuggggaa

SEQ ID NO: 699708 - RNA, 22 nt, Human
aauugucuuuaucacaguucaa

SEQ ID NO: 699709 - RNA, 17 nt, Human
ucaggauguagcaguag

SEQ ID NO: 699710 - RNA, 22 nt, Human
agggugguauuuaacaacugga

SEQ ID NO: 699711 - RNA, 22 nt, Human
uacauuuccugucagagauaua

SEQ ID NO: 699712 - RNA, 22 nt, Human
gcggguggaucaugaggucagg

SEQ ID NO: 699713 - RNA, 22 nt, Human
cggagcugccugccaagccugc

SEQ ID NO: 699714 - RNA, 22 nt, Human
guagagcaggacuugagauguu

SEQ ID NO: 699715 - RNA, 22 nt, Human
uccuggauuuagaagagccucc

SEQ ID NO: 699716 - RNA, 22 nt, Human
gaaggcacccggcgugcggcgg

SEQ ID NO: 699717 - RNA, 22 nt, Human
aauuagaagggaguuauugaua

SEQ ID NO: 699718 - RNA, 22 nt, Human
ggccugcuuuccgagccugcag

SEQ ID NO: 699719 - RNA, 22 nt, Human
uuucuagucagccauaucuagu

SEQ ID NO: 699720 - RNA, 22 nt, Human
gcccucugcacagcucugagca

SEQ ID NO: 699721 - RNA, 22 nt, Human
ggaggacacuggcucugccuuc

SEQ ID NO: 699722 - RNA, 22 nt, Human
acauuucauguuuuccagagca

SEQ ID NO: 699723 - RNA, 22 nt, Human
agagcugaauuuggguggugga

SEQ ID NO: 699724 - RNA, 22 nt, Human
ccaucacaguccccaucgugau

SEQ ID NO: 699725 - RNA, 22 nt, Human
auaaggaaccugggcuuaagag

SEQ ID NO: 699726 - RNA, 22 nt, Human
ucuugacauugcaaucuucaga

SEQ ID NO: 699727 - RNA, 22 nt, Human
agauauuaccagcagucuaugc

SEQ ID NO: 699728 - RNA, 22 nt, Human
gaucuugagcaaguuguguaac

SEQ ID NO: 699729 - RNA, 23 nt, Human
uuaaaauguggucucucccuagu

SEQ ID NO: 699730 - RNA, 22 nt, Human
ccucuggguuaguuuagggagc

SEQ ID NO: 699731 - RNA, 22 nt, Human
cccucucucuaucgggccccag

SEQ ID NO: 699732 - RNA, 22 nt, Human
ggcugagucugugacccaugcg

SEQ ID NO: 699733 - RNA, 19 nt, Human
gguuggagaagagcggccc

SEQ ID NO: 699734 - RNA, 22 nt, Human
ggggaagaaccgggauucccau

SEQ ID NO: 699735 - RNA, 22 nt, Human
gcugcuggagagcgagacuguu

SEQ ID NO: 699736 - RNA, 22 nt, Human
cuuuccaaugcauuuccaaugu

SEQ ID NO: 699737 - RNA, 22 nt, Human
cagggagaggcugguggaguaa

SEQ ID NO: 699738 - RNA, 22 nt, Human
ugaaggagaaauggaaaguggg

SEQ ID NO: 699739 - RNA, 18 nt, Human
cccagcccaccauuucuc

SEQ ID NO: 699740 - RNA, 22 nt, Human
auaauuacauuauacuguuaga

SEQ ID NO: 699741 - RNA, 22 nt, Human
uauccauauucagacugugaau

SEQ ID NO: 699742 - RNA, 22 nt, Human
ugcugcacgauaaauaauuucu

SEQ ID NO: 699743 - RNA, 22 nt, Human
gcauuucauguaagucagacca

SEQ ID NO: 699744 - RNA, 22 nt, Human
cagcccagagccaguucccgcu

SEQ ID NO: 699745 - RNA, 22 nt, Human
cagcacacagugacucgcaccu

SEQ ID NO: 699746 - RNA, 22 nt, Human
caucagaccugccagacuaggu

SEQ ID NO: 699747 - RNA, 22 nt, Human
gacaggaggcagagcucaggug

SEQ ID NO: 699748 - RNA, 22 nt, Human
uucuggagcuaaaguccacucu

SEQ ID NO: 699749 - RNA, 22 nt, Human
aguucuggugguuuggagaucu

SEQ ID NO: 699750 - RNA, 22 nt, Human
ggcucaggacacagugguuuag

SEQ ID NO: 699751 - RNA, 22 nt, Human
aagcacaguucuuagaguuaca

SEQ ID NO: 699752 - RNA, 22 nt, Human
gggccagcaguaucggaggcau

SEQ ID NO: 699753 - RNA, 22 nt, Human
acuggcagagguuggacaccau

SEQ ID NO: 699754 - RNA, 22 nt, Human
ugggccuccuggaagaaugugg

SEQ ID NO: 699755 - RNA, 22 nt, Human
gagaggcuugugugaagaacaa

SEQ ID NO: 699756 - RNA, 22 nt, Human
ccccacucucggccagauaggc

SEQ ID NO: 699757 - RNA, 22 nt, Human
aaagucuuuauuuuguaucuuu

SEQ ID NO: 699758 - RNA, 22 nt, Human
cuuaauuacuguccaauaugca

SEQ ID NO: 699759 - RNA, 22 nt, Human
ucauggcuugcagauggccacc

SEQ ID NO: 699760 - RNA, 22 nt, Human
ugucuccuacugccuguggauc

SEQ ID NO: 699761 - RNA, 22 nt, Human
cucugguuucgcaggaaauaga

SEQ ID NO: 699762 - RNA, 21 nt, Human
acaauagacauaagcagagca

SEQ ID NO: 699763 - RNA, 22 nt, Human
uccugagguauaugcuuugcag

SEQ ID NO: 699764 - RNA, 22 nt, Human
gggcuccaaaaucuaugucuuc

SEQ ID NO: 699765 - RNA, 22 nt, Human
aaggcacugaacuuaaauucug

SEQ ID NO: 699766 - RNA, 22 nt, Human
aauauaaauuccugggcccagc

SEQ ID NO: 699767 - RNA, 22 nt, Human
cauuaacacuuuggauuuagac

SEQ ID NO: 699768 - RNA, 22 nt, Human
cuacccuuaaguuucugugggg

SEQ ID NO: 699769 - RNA, 20 nt, Human
ggaaaaaugcaugcucaaga

SEQ ID NO: 699770 - RNA, 22 nt, Human
cugcuuuguaaaauagacauaa

SEQ ID NO: 699771 - RNA, 22 nt, Human
ucacaaaagcuuuugaauuugg

SEQ ID NO: 699772 - RNA, 22 nt, Human
uuacaguacagaaaauaacaga

SEQ ID NO: 699773 - RNA, 22 nt, Human
cuuuucaugagucuguuauggg

SEQ ID NO: 699774 - RNA, 22 nt, Human
uggaccugagccuggcccugcc

SEQ ID NO: 699775 - RNA, 22 nt, Human
uaguuuagugaaugguuaaaga

SEQ ID NO: 699776 - RNA, 22 nt, Human
uccaagaucaagguguuggcag

SEQ ID NO: 699777 - RNA, 19 nt, Human
acacaugcuccuggagccu

SEQ ID NO: 699778 - RNA, 22 nt, Human
ugacagugcggguacaucauag

SEQ ID NO: 699779 - RNA, 22 nt, Human
aaucuguuuccaauacuugcua

SEQ ID NO: 699780 - RNA, 22 nt, Human
cuggggagugaagguaauuaca

SEQ ID NO: 699781 - RNA, 22 nt, Human
agaaaucaugacuaagagcagu

SEQ ID NO: 699782 - RNA, 22 nt, Human
acccugaagaaacuucuaagug

SEQ ID NO: 699783 - RNA, 22 nt, Human
agaggccuaaccaagauguccu

SEQ ID NO: 699784 - RNA, 22 nt, Human
cacagguuugacaaggauaaaa

SEQ ID NO: 699785 - RNA, 18 nt, Human
gaggauggaaggagaugc

SEQ ID NO: 699786 - RNA, 22 nt, Human
agcaugcugggucauuuuugcc

SEQ ID NO: 699787 - RNA, 22 nt, Human
ccagcaucuaugugcuguugau

SEQ ID NO: 699788 - RNA, 22 nt, Human
aucuuggauugacuggcucugc

SEQ ID NO: 699789 - RNA, 22 nt, Human
ucccagggacuggaugaugcag

SEQ ID NO: 699790 - RNA, 22 nt, Human
uacuugcuggguguaauuuucu

SEQ ID NO: 699791 - RNA, 22 nt, Human
agcaggcaguguagagccuuca

SEQ ID NO: 699792 - RNA, 21 nt, Human
uuucccagcugaaaauaaaug

SEQ ID NO: 699793 - RNA, 23 nt, Human
ucugggccacuugucugcacuuc

SEQ ID NO: 699794 - RNA, 22 nt, Human
agagccagaccauugccgugca

SEQ ID NO: 699795 - RNA, 22 nt, Human
uaccuugggagacgccaggccc

SEQ ID NO: 699796 - RNA, 23 nt, Human
ugcaaaauuugcagaguucgaug

SEQ ID NO: 699797 - RNA, 22 nt, Human
ucuuacaagaaggaaaagggag

SEQ ID NO: 699798 - RNA, 22 nt, Human
auguguuaaugucaaccagaaa

SEQ ID NO: 699799 - RNA, 22 nt, Human
augagaaaauucauuccaucca

SEQ ID NO: 699800 - RNA, 22 nt, Human
augaaaugucuggaucuuuuuc

SEQ ID NO: 699801 - RNA, 22 nt, Human
gugccagccgcaccccaggaga

SEQ ID NO: 699802 - RNA, 22 nt, Human
uuuugucagugagaacagaguu

SEQ ID NO: 699803 - RNA, 22 nt, Human
gaugcugagagauuggagacua

SEQ ID NO: 699804 - RNA, 22 nt, Human
gaugcagaaaguagacaccauc

SEQ ID NO: 699805 - RNA, 20 nt, Human
gcacugaaauucaauguuug

SEQ ID NO: 699806 - RNA, 22 nt, Human
agggccagccccacccucucug

SEQ ID NO: 699807 - RNA, 22 nt, Human
ggagcagggcagugaauucugg

SEQ ID NO: 699808 - RNA, 22 nt, Human
aagcccuggcaaugucagauga

SEQ ID NO: 699809 - RNA, 22 nt, Human
cagucacauagguauacacaua

SEQ ID NO: 699810 - RNA, 22 nt, Human
uggcccuuguccugggagaguu

SEQ ID NO: 699811 - RNA, 22 nt, Human
uacccaguuccacacacugaug

SEQ ID NO: 699812 - RNA, 22 nt, Human
uggcccuguucuguaccucaua

SEQ ID NO: 699813 - RNA, 22 nt, Human
auuucucacugagcagauaaaa

SEQ ID NO: 699814 - RNA, 22 nt, Human
ugacuuuuggaccucacugucc

SEQ ID NO: 699815 - RNA, 22 nt, Human
uaguuuagcacuaagaaaaaca

SEQ ID NO: 699816 - RNA, 20 nt, Human
aggcucugcauuucugagug

SEQ ID NO: 699817 - RNA, 22 nt, Human
uccuggggcucugagcgagaca

SEQ ID NO: 699818 - RNA, 22 nt, Human
ccaguguucaauacauauuugu

SEQ ID NO: 699819 - RNA, 21 nt, Human
ucagaguggaagacaguuuga

SEQ ID NO: 699820 - RNA, 22 nt, Human
uggguuaaaaugauaccuugca

SEQ ID NO: 699821 - RNA, 22 nt, Human
ugacucugggguugaccagaug

SEQ ID NO: 699822 - RNA, 22 nt, Human
gcugaggauauagcaggaacaa

SEQ ID NO: 699823 - RNA, 22 nt, Human
uuuacgacugcuaaaugccugc

SEQ ID NO: 699824 - RNA, 22 nt, Human
ugaccacuguagccacuuaaga

SEQ ID NO: 699825 - RNA, 22 nt, Human
auguuuccagauaugucacccu

SEQ ID NO: 699826 - RNA, 22 nt, Human
cguccauauuccugagggcuca

SEQ ID NO: 699827 - RNA, 22 nt, Human
ggccagcauggcaagaccaacu

SEQ ID NO: 699828 - RNA, 22 nt, Human
uucaaaugauggcaguccuggc

SEQ ID NO: 699829 - RNA, 22 nt, Human
aguggcuagaucaugagugagc

SEQ ID NO: 699830 - RNA, 22 nt, Human
guucuggaguggugccaggccu

SEQ ID NO: 699831 - RNA, 20 nt, Human
ugccagggccagcagaggcu

SEQ ID NO: 699832 - RNA, 22 nt, Human
gacucagugauuugacaugccu

SEQ ID NO: 699833 - RNA, 22 nt, Human
uucugcuaccuuucuguaccuu

SEQ ID NO: 699834 - RNA, 22 nt, Human
cugaaauaguuucauagaacuu

SEQ ID NO: 699835 - RNA, 22 nt, Human
aguuucacuaaggucugugugu

SEQ ID NO: 699836 - RNA, 22 nt, Human
uucuuuucccaauauuuugcug

SEQ ID NO: 699837 - RNA, 22 nt, Human
ggugggaucaaagagucauucg

SEQ ID NO: 699838 - RNA, 22 nt, Human
ugauucaagauugguuagcugu

SEQ ID NO: 699839 - RNA, 22 nt, Human
uggcucacaggacucucugggc

SEQ ID NO: 699840 - RNA, 22 nt, Human
gcucaggaaauaguuuaguguu

SEQ ID NO: 699841 - RNA, 22 nt, Human
aaguacauuauaugagcagaau

SEQ ID NO: 699842 - RNA, 22 nt, Human
gcagaggugcucaguggcagaa

SEQ ID NO: 699843 - RNA, 22 nt, Human
uccagguccuacuggcccauag

SEQ ID NO: 699844 - RNA, 22 nt, Human
uauggcagaggagaggcacuag

SEQ ID NO: 699845 - RNA, 22 nt, Human
ggggugggcgugcagggacacc

SEQ ID NO: 699846 - RNA, 22 nt, Human
auacaagacucagcacagacgg

SEQ ID NO: 699847 - RNA, 22 nt, Human
auguggcacagcacaguaagag

SEQ ID NO: 699848 - RNA, 22 nt, Human
uggcauccucccucaagcugaa

SEQ ID NO: 699849 - RNA, 22 nt, Human
cuguggaguggggaguacuggu

SEQ ID NO: 699850 - RNA, 22 nt, Human
caguuucuacgacuuaagcaca

SEQ ID NO: 699851 - RNA, 18 nt, Human
guggccagccuggucuug

SEQ ID NO: 699852 - RNA, 22 nt, Human
gauccugucuccgcaccguguu

SEQ ID NO: 699853 - RNA, 22 nt, Human
ugcuggccaacaaggcuccaag

SEQ ID NO: 699854 - RNA, 22 nt, Human
auuugucuucaguagguucuuc

SEQ ID NO: 699855 - RNA, 22 nt, Human
uguggcuguugaggaccccaag

SEQ ID NO: 699856 - RNA, 22 nt, Human
uuuauguaaguggaaugaugcc

SEQ ID NO: 699857 - RNA, 22 nt, Human
uacauacagagaugcuaguuaa

SEQ ID NO: 699858 - RNA, 23 nt, Human
ccauggagcauggcucacuaggc

SEQ ID NO: 699859 - RNA, 19 nt, Human
cauuuucucauugugcccc

SEQ ID NO: 699860 - RNA, 22 nt, Human
cugaggucuagacaccccaggg

SEQ ID NO: 699861 - RNA, 22 nt, Human
gcagcuuuggagguggaacucu

SEQ ID NO: 699862 - RNA, 22 nt, Human
cugccaggcugucccagguccg

SEQ ID NO: 699863 - RNA, 22 nt, Human
cugcucuagagagcauuaguca

SEQ ID NO: 699864 - RNA, 18 nt, Human
ugagcaggggcugaccuu

SEQ ID NO: 699865 - RNA, 22 nt, Human
agucacaugaguuucucuuuau

SEQ ID NO: 699866 - RNA, 22 nt, Human
uuuacuaaguacuuguaucccu

SEQ ID NO: 699867 - RNA, 23 nt, Human
agucugaauugagaugugcugug

SEQ ID NO: 699868 - RNA, 22 nt, Human
acaguaugaaugcagaauguag

SEQ ID NO: 699869 - RNA, 21 nt, Human
gggaaauuaggauugcucauc

SEQ ID NO: 699870 - RNA, 22 nt, Human
uuauccugcauccuggaacuca

SEQ ID NO: 699871 - RNA, 22 nt, Human
ggcccugaucuccuggauucuu

SEQ ID NO: 699872 - RNA, 22 nt, Human
ggaggccaauuuucuaacugca

SEQ ID NO: 699873 - RNA, 22 nt, Human
uucuuacauuagucugugcuuu

SEQ ID NO: 699874 - RNA, 22 nt, Human
agaaauuauuagugaauagucu

SEQ ID NO: 699875 - RNA, 22 nt, Human
uauuacacuuucuucuucaagc

SEQ ID NO: 699876 - RNA, 21 nt, Human
ugguggaccagugcugggaga

SEQ ID NO: 699877 - RNA, 22 nt, Human
cugugccugccuuguucacuga

SEQ ID NO: 699878 - RNA, 22 nt, Human
ucugcuggccuuagcaggucua

SEQ ID NO: 699879 - RNA, 22 nt, Human
agcuucuucugauuugucaguc

SEQ ID NO: 699880 - RNA, 22 nt, Human
ucuuggccagguguggugccuc

SEQ ID NO: 699881 - RNA, 22 nt, Human
ucugagaaaucaguggugaaua

SEQ ID NO: 699882 - RNA, 22 nt, Human
uggccugggugcugcugacauc

SEQ ID NO: 699883 - RNA, 22 nt, Human
uccuggccgccgcguggggccg

SEQ ID NO: 699884 - RNA, 22 nt, Human
ggaguguggagaggacaugggu

SEQ ID NO: 699885 - RNA, 22 nt, Human
augacuuuguuguuuuccagcg

SEQ ID NO: 699886 - RNA, 22 nt, Human
augcugaagaguucaugauuau

SEQ ID NO: 699887 - RNA, 20 nt, Human
ugucauuguuucuaggaccu

SEQ ID NO: 699888 - RNA, 22 nt, Human
auugaacuguuggagagguuuu

SEQ ID NO: 699889 - RNA, 22 nt, Human
ugaaccuuguuccugcccuccu

SEQ ID NO: 699890 - RNA, 22 nt, Human
agagggcuucccuaggagugag

SEQ ID NO: 699891 - RNA, 22 nt, Human
caagcccuguuaggggucucua

SEQ ID NO: 699892 - RNA, 22 nt, Human
agcccucauggaacagcuccua

SEQ ID NO: 699893 - RNA, 22 nt, Human
ccaggcuccgcauagaccccac

SEQ ID NO: 699894 - RNA, 22 nt, Human
gagucucuggaggggucagacc

SEQ ID NO: 699895 - RNA, 22 nt, Human
agggccaguggguugaaaggca

SEQ ID NO: 699896 - RNA, 22 nt, Human
ggauuucuuccuuccucagaag

SEQ ID NO: 699897 - RNA, 22 nt, Human
aauucuuaaucccauaaaguga

SEQ ID NO: 699898 - RNA, 21 nt, Human
agagcaaguuaaggcauuaau

SEQ ID NO: 699899 - RNA, 21 nt, Human
cauccguuuauaucucugugg

SEQ ID NO: 699900 - RNA, 22 nt, Human
uggaacaaucccgguuuagcuc

SEQ ID NO: 699901 - RNA, 22 nt, Human
guggcugcagcucugaacggac

SEQ ID NO: 699902 - RNA, 22 nt, Human
ucuuuccuagaggcugaugagu

SEQ ID NO: 699903 - RNA, 18 nt, Human
ucagcccagagcccaguu

SEQ ID NO: 699904 - RNA, 22 nt, Human
gugcauuaguuuccuauugcug

SEQ ID NO: 699905 - RNA, 22 nt, Human
guguccuuauaagaagagaugc

SEQ ID NO: 699906 - RNA, 22 nt, Human
ggaggcucugcuccguguguuc

SEQ ID NO: 699907 - RNA, 22 nt, Human
caaacauagugaagcaaugaca

SEQ ID NO: 699908 - RNA, 22 nt, Human
ugaucuggaauucccuguggua

SEQ ID NO: 699909 - RNA, 22 nt, Human
caacagcugaucuuugaugaag

SEQ ID NO: 699910 - RNA, 22 nt, Human
uguggaaaauuggaacguuccu

SEQ ID NO: 699911 - RNA, 22 nt, Human
gccucuguggcucagccuugcu

SEQ ID NO: 699912 - RNA, 22 nt, Human
uucuuucuguccauaaugagac

SEQ ID NO: 699913 - RNA, 22 nt, Human
cagggcucaggcucugggauuc

SEQ ID NO: 699914 - RNA, 21 nt, Human
ggguggccgcaugggugcgug

SEQ ID NO: 699915 - RNA, 22 nt, Human
cugcuccacaccuccauuuccu

SEQ ID NO: 699916 - RNA, 22 nt, Human
ucaguguuuccuagagcauaua

SEQ ID NO: 699917 - RNA, 22 nt, Human
auuuucauggcuucugcucagu

SEQ ID NO: 699918 - RNA, 22 nt, Human
aacucuacuugggacuccucug

SEQ ID NO: 699919 - RNA, 22 nt, Human
ucaucuuuaccccuugcuucaa

SEQ ID NO: 699920 - RNA, 22 nt, Human
cugucauucuuacauaauguga

SEQ ID NO: 699921 - RNA, 22 nt, Human
cagaagaaaucauuaucuggac

SEQ ID NO: 699922 - RNA, 22 nt, Human
uaacaucuuauuggcaaagaua

SEQ ID NO: 699923 - RNA, 22 nt, Human
cuuccagagauccaugaauacc

SEQ ID NO: 699924 - RNA, 22 nt, Human
aguccguuucuccuugaaggca

SEQ ID NO: 699925 - RNA, 22 nt, Human
gcucugucuucagcacacagua

SEQ ID NO: 699926 - RNA, 22 nt, Human
guuaacauaggcuuagggguuu

SEQ ID NO: 699927 - RNA, 22 nt, Human
guuuggcaguguuauguagguu

SEQ ID NO: 699928 - RNA, 22 nt, Human
ggagacaugcagacugagauac

SEQ ID NO: 699929 - RNA, 23 nt, Human
uccuaacugauucugcagucucu

SEQ ID NO: 699930 - RNA, 22 nt, Human
agccaggcagacucucuuucuu

SEQ ID NO: 699931 - RNA, 22 nt, Human
cacucacuuauuucuaacagaa

SEQ ID NO: 699932 - RNA, 22 nt, Human
uggagaaugauauuccaucauu

SEQ ID NO: 699933 - RNA, 22 nt, Human
gccccuguuguggcuuugucua

SEQ ID NO: 699934 - RNA, 22 nt, Human
acaguagugccaugaccuacag

SEQ ID NO: 699935 - RNA, 22 nt, Human
uuagcuuucagccuuucucacc

SEQ ID NO: 699936 - RNA, 22 nt, Human
ugauuuccucuacuagcaauua

SEQ ID NO: 699937 - RNA, 22 nt, Human
aggcucagugcaaaucauucug

SEQ ID NO: 699938 - RNA, 22 nt, Human
gucauuuucuagaauuauuuga

SEQ ID NO: 699939 - RNA, 18 nt, Human
aggaagcaggaggaaggc

SEQ ID NO: 699940 - RNA, 22 nt, Human
ucccacagaguggcucaccuag

SEQ ID NO: 699941 - RNA, 22 nt, Human
cagaaguaagauuacugugaga

SEQ ID NO: 699942 - RNA, 22 nt, Human
uuccauuuggcacuucacugag

SEQ ID NO: 699943 - RNA, 23 nt, Human
augcaagaguuucucaaacugga

SEQ ID NO: 699944 - RNA, 22 nt, Human
gagagcuguuuaucuucuucaa

SEQ ID NO: 699945 - RNA, 22 nt, Human
ugccaggcaggacccuagaacc

SEQ ID NO: 699946 - RNA, 22 nt, Human
ccugcccaggagucucucugug

SEQ ID NO: 699947 - RNA, 22 nt, Human
cugauuccugauucaugcucuu

SEQ ID NO: 699948 - RNA, 22 nt, Human
gcugaggauugaagaguugcca

SEQ ID NO: 699949 - RNA, 22 nt, Human
ucccugucuaauaugccaugaa

SEQ ID NO: 699950 - RNA, 22 nt, Human
uggagggcuaagcugagggaua

SEQ ID NO: 699951 - RNA, 22 nt, Human
cccaaagggugucagcagcaag

SEQ ID NO: 699952 - RNA, 22 nt, Human
guuugccugugauguacauuuc

SEQ ID NO: 699953 - RNA, 22 nt, Human
auauacuuccccauuauggggg

SEQ ID NO: 699954 - RNA, 22 nt, Human
agacgagggcccccaggacagc

SEQ ID NO: 699955 - RNA, 22 nt, Human
aaaaaccuuucauugcaaaugu

SEQ ID NO: 699956 - RNA, 22 nt, Human
ucagaaaggccacauggugcag

SEQ ID NO: 699957 - RNA, 22 nt, Human
ugcagaagaaugagcuuggagu

SEQ ID NO: 699958 - RNA, 22 nt, Human
ucugcagaaaguggcucagugg

SEQ ID NO: 699959 - RNA, 22 nt, Human
ugcaggcuggauuugcuuuugu

SEQ ID NO: 699960 - RNA, 20 nt, Human
ccacuccgcccccagagggc

SEQ ID NO: 699961 - RNA, 22 nt, Human
acaguuauauacauguagcugu

SEQ ID NO: 699962 - RNA, 22 nt, Human
ugcccucagccaccuccaaguu

SEQ ID NO: 699963 - RNA, 22 nt, Human
uuugagguuagcuagcagauca

SEQ ID NO: 699964 - RNA, 22 nt, Human
ugagagauugcuguauguuuug

SEQ ID NO: 699965 - RNA, 22 nt, Human
aaauugccaaauuguuuuccag

SEQ ID NO: 699966 - RNA, 22 nt, Human
guggucagggagcagagccaug

SEQ ID NO: 699967 - RNA, 22 nt, Human
uugaggagucaggggcacggaa

SEQ ID NO: 699968 - RNA, 22 nt, Human
ugcauccuagggaaggcacuga

SEQ ID NO: 699969 - RNA, 22 nt, Human
uguguguauguuuacuuuuccu

SEQ ID NO: 699970 - RNA, 22 nt, Human
uacauuaucuuguuaucuuuca

SEQ ID NO: 699971 - RNA, 22 nt, Human
auaaaaggaaagccuguuguga

SEQ ID NO: 699972 - RNA, 22 nt, Human
cggggcugcucguccuccugug

SEQ ID NO: 699973 - RNA, 22 nt, Human
cauugcuguuaauugucucuag

SEQ ID NO: 699974 - RNA, 22 nt, Human
cccuucucuuucacucacuauu

SEQ ID NO: 699975 - RNA, 22 nt, Human
agagucccagggacacuccaga

SEQ ID NO: 699976 - RNA, 22 nt, Human
gcucaggcucucccaggggaau

SEQ ID NO: 699977 - RNA, 22 nt, Human
uuaaguugugaauaauccaguc

SEQ ID NO: 699978 - RNA, 22 nt, Human
uuuugugacacuucuugagaca

SEQ ID NO: 699979 - RNA, 22 nt, Human
cagcacagugaccagacccacu

SEQ ID NO: 699980 - RNA, 22 nt, Human
aaggguuggggaagagcaaauu

SEQ ID NO: 699981 - RNA, 23 nt, Human
gcugucgccagagccccaccuac

SEQ ID NO: 699982 - RNA, 22 nt, Human
ucaauacauguguguggauggu

SEQ ID NO: 699983 - RNA, 22 nt, Human
ugcccugcaugcagggagcugu

SEQ ID NO: 699984 - RNA, 22 nt, Human
aaagaguucuguuugagcugaa

SEQ ID NO: 699985 - RNA, 22 nt, Human
ugagagcuguccaccuguggga

SEQ ID NO: 699986 - RNA, 22 nt, Human
acugaaguucauacaacagacu

SEQ ID NO: 699987 - RNA, 22 nt, Human
ggugcuggacacguggcacucc

SEQ ID NO: 699988 - RNA, 22 nt, Human
cuucuuuccuuccuccaguggc

SEQ ID NO: 699989 - RNA, 22 nt, Human
gcuccagggaguacauuuauca

SEQ ID NO: 699990 - RNA, 22 nt, Human
gucagaggggcagcugccaggc

SEQ ID NO: 699991 - RNA, 22 nt, Human
ucagagguggccccugcccuca

SEQ ID NO: 699992 - RNA, 22 nt, Human
auaaaaguaggaccaacuuaca

SEQ ID NO: 699993 - RNA, 22 nt, Human
cuuguuuuggaacagagugaau

SEQ ID NO: 699994 - RNA, 22 nt, Human
cagcagagggagccauugaaau

SEQ ID NO: 699995 - RNA, 22 nt, Human
ccuggcuuccauauggcacaua

SEQ ID NO: 699996 - RNA, 18 nt, Human
ugggauggagaguaacug

SEQ ID NO: 699997 - RNA, 22 nt, Human
gcuuucucuucacugauguuca

SEQ ID NO: 699998 - RNA, 22 nt, Human
cccuccagagcuugaccugcug

SEQ ID NO: 699999 - RNA, 22 nt, Human
gaugugagugguagcugggauu

SEQ ID NO: 700000 - RNA, 22 nt, Human
cucauagauuuagauagaucga

SEQ ID NO: 700001 - RNA, 22 nt, Human
ugcuggcuuccugugcacagca

SEQ ID NO: 700002 - RNA, 22 nt, Human
gccccuucuucuggagauucaa

SEQ ID NO: 700003 - RNA, 22 nt, Human
ugucagaccugugauuucagca

SEQ ID NO: 700004 - RNA, 22 nt, Human
uugcuuuaaugagauuuugcca

SEQ ID NO: 700005 - RNA, 22 nt, Human
auucagacucuugagcaguccc

SEQ ID NO: 700006 - RNA, 22 nt, Human
ucucaucuucauaucugaaaga

SEQ ID NO: 700007 - RNA, 22 nt, Human
ugauaaacuggagagguggagg

SEQ ID NO: 700008 - RNA, 22 nt, Human
guguuccuggacagcaagugag

SEQ ID NO: 700009 - RNA, 22 nt, Human
gcagcuggagcaucuucucauc

SEQ ID NO: 700010 - RNA, 22 nt, Human
uuuauucuauaggcauuaagca

SEQ ID NO: 700011 - RNA, 22 nt, Human
uagcagagagguuucagcuaau

SEQ ID NO: 700012 - RNA, 22 nt, Human
gcacucuguuucuccugucagc

SEQ ID NO: 700013 - RNA, 22 nt, Human
uguacaaaguuaaaccuauaua

SEQ ID NO: 700014 - RNA, 22 nt, Human
uaguggagaguuguuuugugca

SEQ ID NO: 700015 - RNA, 22 nt, Human
uugccucccagcaugggcagcu

SEQ ID NO: 700016 - RNA, 22 nt, Human
acaagucuguuaugcaccugga

SEQ ID NO: 700017 - RNA, 22 nt, Human
acaaugucuuugucuccuucag

SEQ ID NO: 700018 - RNA, 22 nt, Human
agggucagggagugaguauuua

SEQ ID NO: 700019 - RNA, 22 nt, Human
ccugcuggacguggaggagggg

SEQ ID NO: 700020 - RNA, 22 nt, Human
ucagcauuguggcagagaaugg

SEQ ID NO: 700021 - RNA, 22 nt, Human
aggccagguuccucaaucuuga

SEQ ID NO: 700022 - RNA, 22 nt, Human
gcaaagacggacucaggagugc

SEQ ID NO: 700023 - RNA, 22 nt, Human
gggucccaggucuggaaaagca

SEQ ID NO: 700024 - RNA, 22 nt, Human
uccagaccaaggaaggcugggc

SEQ ID NO: 700025 - RNA, 22 nt, Human
aacuacauagaaauuaguauuu

SEQ ID NO: 700026 - RNA, 22 nt, Human
auuuaauuuacauuugacagag

SEQ ID NO: 700027 - RNA, 22 nt, Human
caauccaucaauuacacaggcu

SEQ ID NO: 700028 - RNA, 22 nt, Human
ugcugugggcaguacauaagcu

SEQ ID NO: 700029 - RNA, 19 nt, Human
ucacaugaagccuagagaa

SEQ ID NO: 700030 - RNA, 22 nt, Human
augauugaccaucugcugggcu

SEQ ID NO: 700031 - RNA, 18 nt, Human
uagaguuacuacaugauu

SEQ ID NO: 700032 - RNA, 22 nt, Human
ucugacuuuggacaguggcgaa

SEQ ID NO: 700033 - RNA, 22 nt, Human
ggaccugaacauaaaacgaggc

SEQ ID NO: 700034 - RNA, 22 nt, Human
uccugacucugguguccucuac

SEQ ID NO: 700035 - RNA, 22 nt, Human
gcagggugugucucauacaguu

SEQ ID NO: 700036 - RNA, 22 nt, Human
agggcucagccagccugugugc

SEQ ID NO: 700037 - RNA, 22 nt, Human
gcugaggaaaccaaugcucaga

SEQ ID NO: 700038 - RNA, 22 nt, Human
cuggccauguugccucugagac

SEQ ID NO: 700039 - RNA, 22 nt, Human
uauacagauuaacagauuuaaa

SEQ ID NO: 700040 - RNA, 22 nt, Human
auaggaaagaaaauuauguagg

SEQ ID NO: 700041 - RNA, 22 nt, Human
ugcuuucucucuaccccacuuu

SEQ ID NO: 700042 - RNA, 22 nt, Human
uaguauuugcagauuuguguca

SEQ ID NO: 700043 - RNA, 22 nt, Human
cagcccuugcgacacccuggcu

SEQ ID NO: 700044 - RNA, 22 nt, Human
cagcagcaugaauucgagccac

SEQ ID NO: 700045 - RNA, 22 nt, Human
aguagaauagauggauacuauu

SEQ ID NO: 700046 - RNA, 22 nt, Human
cagagccucuaaaauuucuauc

SEQ ID NO: 700047 - RNA, 21 nt, Human
uucuccagggggagcucucuc

SEQ ID NO: 700048 - RNA, 22 nt, Human
uuagaggugucaggagcacagg

SEQ ID NO: 700049 - RNA, 22 nt, Human
cacaggaaggccuucucacaau

SEQ ID NO: 700050 - RNA, 23 nt, Human
ugcauuauccucucugaagacca

SEQ ID NO: 700051 - RNA, 22 nt, Human
guuauucaauggcuuauaagga

SEQ ID NO: 700052 - RNA, 22 nt, Human
cauacuauuacuaggagcagga

SEQ ID NO: 700053 - RNA, 22 nt, Human
gggacuggcacagggcugggag

SEQ ID NO: 700054 - RNA, 22 nt, Human
uuggccuucccuaccugggcca

SEQ ID NO: 700055 - RNA, 22 nt, Human
uugauuaaacaggcauauucaa

SEQ ID NO: 700056 - RNA, 22 nt, Human
agugacucacuagcucucagug

SEQ ID NO: 700057 - RNA, 22 nt, Human
ucugaacauccagcaaugcaca

SEQ ID NO: 700058 - RNA, 22 nt, Human
ugagagcagaggugggcagccu

SEQ ID NO: 700059 - RNA, 22 nt, Human
uaggagagcugaacuauugucu

SEQ ID NO: 700060 - RNA, 22 nt, Human
agugucuuugucaaauuacagg

SEQ ID NO: 700061 - RNA, 22 nt, Human
uugcacaguuugaagaugacuc

SEQ ID NO: 700062 - RNA, 22 nt, Human
ucucagaaaagagcuucagaaa

SEQ ID NO: 700063 - RNA, 22 nt, Human
cucagaguggggcucccugagg

SEQ ID NO: 700064 - RNA, 22 nt, Human
uuucaugaggggcaaaaucuca

SEQ ID NO: 700065 - RNA, 22 nt, Human
uucaugucugccuuuucaagug

SEQ ID NO: 700066 - RNA, 22 nt, Human
uccucaguauuguggagcagau

SEQ ID NO: 700067 - RNA, 22 nt, Human
acugcacagaauuaugguuggu

SEQ ID NO: 700068 - RNA, 22 nt, Human
aaacaacaugguggguguguag

SEQ ID NO: 700069 - RNA, 22 nt, Human
ggcacugaaguggguguugggu

SEQ ID NO: 700070 - RNA, 22 nt, Human
agcucagagcucgggaggaugg

SEQ ID NO: 700071 - RNA, 22 nt, Human
uggccagcagaguucacucucu

SEQ ID NO: 700072 - RNA, 22 nt, Human
agcagggccuggcacuccuggg

SEQ ID NO: 700073 - RNA, 22 nt, Human
ugagaagcauuaggaagaacau

SEQ ID NO: 700074 - RNA, 21 nt, Human
cucuggaggcaagggagagug

SEQ ID NO: 700075 - RNA, 22 nt, Human
aaauuacagaucaccaaugcau

SEQ ID NO: 700076 - RNA, 22 nt, Human
uuuggaagggaaccaaaacaug

SEQ ID NO: 700077 - RNA, 22 nt, Human
uaauuucuucaucucugcagcu

SEQ ID NO: 700078 - RNA, 22 nt, Human
gggagcugcacacgccccggaa

SEQ ID NO: 700079 - RNA, 22 nt, Human
uagauguguugccuggaguugu

SEQ ID NO: 700080 - RNA, 18 nt, Human
aaauguacuguccauggc

SEQ ID NO: 700081 - RNA, 22 nt, Human
agacuguacuuucugcagcucu

SEQ ID NO: 700082 - RNA, 22 nt, Human
ugguuuuagaugccuuuacugc

SEQ ID NO: 700083 - RNA, 22 nt, Human
uacauugaauuuuuuagcaugu

SEQ ID NO: 700084 - RNA, 22 nt, Human
aagaagcauggcuguagauucc

SEQ ID NO: 700085 - RNA, 22 nt, Human
ucccucagcaggaauguggcag

SEQ ID NO: 700086 - RNA, 22 nt, Human
guggcccacacagacagcaucu

SEQ ID NO: 700087 - RNA, 22 nt, Human
gaaguuauuuuaccuguuaaag

SEQ ID NO: 700088 - RNA, 22 nt, Human
caggcaccagugagaagggccu

SEQ ID NO: 700089 - RNA, 22 nt, Human
ccugggaggcugugggucugcu

SEQ ID NO: 700090 - RNA, 22 nt, Human
ggcugcugacuucauccagcuu

SEQ ID NO: 700091 - RNA, 22 nt, Human
caugggccauggugaagccagg

SEQ ID NO: 700092 - RNA, 22 nt, Human
uccagcacagaauuuccuagcu

SEQ ID NO: 700093 - RNA, 22 nt, Human
augcauucuggaaaguagcaau

SEQ ID NO: 700094 - RNA, 22 nt, Human
ugcugggcccagggagccucug

SEQ ID NO: 700095 - RNA, 22 nt, Human
cugccuggcauggagaagagaa

SEQ ID NO: 700096 - RNA, 22 nt, Human
ccauuacuuuccaauauaucag

SEQ ID NO: 700097 - RNA, 22 nt, Human
uggcagugugugagcuguuauu

SEQ ID NO: 700098 - RNA, 22 nt, Human
aucugaagggaaguggaaggca

SEQ ID NO: 700099 - RNA, 22 nt, Human
ccagguggaaggucugugcucu

SEQ ID NO: 700100 - RNA, 22 nt, Human
guagggacaugccauuaucuca

SEQ ID NO: 700101 - RNA, 22 nt, Human
agagaacuucuccuaaaucuca

SEQ ID NO: 700102 - RNA, 22 nt, Human
ggcuucucuaaagaucaugcgu

SEQ ID NO: 700103 - RNA, 22 nt, Human
cagcaguggccaucuguguggu

SEQ ID NO: 700104 - RNA, 22 nt, Human
gcaggaguguggugggacaucc

SEQ ID NO: 700105 - RNA, 22 nt, Human
gcagggcacaaggacgcacagg

SEQ ID NO: 700106 - RNA, 22 nt, Human
aacagugagaagguggacagga

SEQ ID NO: 700107 - RNA, 23 nt, Human
uuucaacaggcagagaagacuua

SEQ ID NO: 700108 - RNA, 22 nt, Human
ugacaggauugguugcuucuga

SEQ ID NO: 700109 - RNA, 22 nt, Human
uagagguagcaacaggacuaga

SEQ ID NO: 700110 - RNA, 22 nt, Human
uagcuuuaauaagcugcugaau

SEQ ID NO: 700111 - RNA, 22 nt, Human
uccauuuucuugcucuagguaa

SEQ ID NO: 700112 - RNA, 22 nt, Human
auauuagguuggugcaaaagua

SEQ ID NO: 700113 - RNA, 22 nt, Human
ugcagaaagcauugacucuucc

SEQ ID NO: 700114 - RNA, 22 nt, Human
acacaguauuacaauaggugcu

SEQ ID NO: 700115 - RNA, 22 nt, Human
acugucacugacagaaucaaca

SEQ ID NO: 700116 - RNA, 22 nt, Human
ggcaagugauccuggagcaccg

SEQ ID NO: 700117 - RNA, 22 nt, Human
caggguggcacucagcgcaucu

SEQ ID NO: 700118 - RNA, 22 nt, Human
gaccuggaaugaagggucccuc

SEQ ID NO: 700119 - RNA, 22 nt, Human
ugccaaaaugggcuuuauaccg

SEQ ID NO: 700120 - RNA, 22 nt, Human
ggccugugguuucuaguagguu

SEQ ID NO: 700121 - RNA, 22 nt, Human
guguuugcuggagcucuggguc

SEQ ID NO: 700122 - RNA, 22 nt, Human
ugcuggagaucauuaauguuca

SEQ ID NO: 700123 - RNA, 22 nt, Human
aagagcugugggugguaguccu

SEQ ID NO: 700124 - RNA, 22 nt, Human
ggacaggaugcugaagaugaag

SEQ ID NO: 700125 - RNA, 23 nt, Human
uccuucaggcucuuccccuggac

SEQ ID NO: 700126 - RNA, 17 nt, Human
gccuuuauacaugcugc

SEQ ID NO: 700127 - RNA, 22 nt, Human
cuggggaccgagcaagcucugg

SEQ ID NO: 700128 - RNA, 22 nt, Human
aagauuuucagcuaauggugca

SEQ ID NO: 700129 - RNA, 22 nt, Human
ucuucuguccuaagucaaagca

SEQ ID NO: 700130 - RNA, 22 nt, Human
gugaacuaaggauucaaacuuc

SEQ ID NO: 700131 - RNA, 22 nt, Human
uugaagcagcucaggaggcuua

SEQ ID NO: 700132 - RNA, 22 nt, Human
ugagcugugcuacgcccuggga

SEQ ID NO: 700133 - RNA, 22 nt, Human
gugugcuguuguucagguagaa

SEQ ID NO: 700134 - RNA, 22 nt, Human
gaggcaguggucugaugcaagg

SEQ ID NO: 700135 - RNA, 22 nt, Human
caucauuuuguauccaagggga

SEQ ID NO: 700136 - RNA, 20 nt, Human
ggagucacauucuuuacugc

SEQ ID NO: 700137 - RNA, 19 nt, Human
gccugagccagccaugcaa

SEQ ID NO: 700138 - RNA, 19 nt, Human
ggccuuggggucccaaagu

SEQ ID NO: 700139 - RNA, 22 nt, Human
gcuggaaggcuaggcucaguug

SEQ ID NO: 700140 - RNA, 22 nt, Human
gguagacugucaaacacuagcc

SEQ ID NO: 700141 - RNA, 22 nt, Human
cagcuguuaugagguguacaug

SEQ ID NO: 700142 - RNA, 22 nt, Human
acauacuuuuuaaaagauugcu

SEQ ID NO: 700143 - RNA, 22 nt, Human
cagcagagguuuugcuccauga

SEQ ID NO: 700144 - RNA, 22 nt, Human
aguggcuguacuauuuuuucau

SEQ ID NO: 700145 - RNA, 23 nt, Human
ucuuuagaagaacaucagaaaug

SEQ ID NO: 700146 - RNA, 22 nt, Human
ggcucuggugaggguaggagau

SEQ ID NO: 700147 - RNA, 22 nt, Human
augcuggugguugauggcagga

SEQ ID NO: 700148 - RNA, 22 nt, Human
uagaaacccugccuuaguagcu

SEQ ID NO: 700149 - RNA, 22 nt, Human
uaaacaucugaauccugcuucc

SEQ ID NO: 700150 - RNA, 22 nt, Human
uaugaguacugugaacgagaau

SEQ ID NO: 700151 - RNA, 22 nt, Human
ugcaugaacggaggguaagcug

SEQ ID NO: 700152 - RNA, 21 nt, Human
uguguaaaguugaaauccugu

SEQ ID NO: 700153 - RNA, 23 nt, Human
uuacaugugugcacacauucugg

SEQ ID NO: 700154 - RNA, 22 nt, Human
auuucacaucuaucucagauuu

SEQ ID NO: 700155 - RNA, 22 nt, Human
aacacuuuuuaguaaagauuga

SEQ ID NO: 700156 - RNA, 22 nt, Human
cagcaugcaaguccagaugugg

SEQ ID NO: 700157 - RNA, 22 nt, Human
agauauucugccuaacagguuu

SEQ ID NO: 700158 - RNA, 22 nt, Human
accaugaugggaagcucagggc

SEQ ID NO: 700159 - RNA, 22 nt, Human
agauauguuuguauauauuugu

SEQ ID NO: 700160 - RNA, 22 nt, Human
uacauuagcaaacaucuuggug

SEQ ID NO: 700161 - RNA, 22 nt, Human
ccucucccacguggcagaggcu

SEQ ID NO: 700162 - RNA, 22 nt, Human
gagguauugacuaugggauggc

SEQ ID NO: 700163 - RNA, 17 nt, Human
aaaucacugucaguuca

SEQ ID NO: 700164 - RNA, 22 nt, Human
guaggucagacauaagaggaca

SEQ ID NO: 700165 - RNA, 15 nt, Human
aaucagaaguguggc

SEQ ID NO: 700166 - RNA, 22 nt, Human
aaacauuccauuucuauguaag

SEQ ID NO: 700167 - RNA, 22 nt, Human
guuuggcaguuuuagagugcaa

SEQ ID NO: 700168 - RNA, 21 nt, Human
ugcuugcagaacuuucaggcu

SEQ ID NO: 700169 - RNA, 22 nt, Human
aaguucaauggaaaagcuuuag

SEQ ID NO: 700170 - RNA, 22 nt, Human
agggguggagaguguugccagu

SEQ ID NO: 700171 - RNA, 22 nt, Human
cucuucaggauggcuugugaug

SEQ ID NO: 700172 - RNA, 22 nt, Human
guucugccuguggcuucugugg

SEQ ID NO: 700173 - RNA, 22 nt, Human
ugcagacagagaaaugaggccc

SEQ ID NO: 700174 - RNA, 22 nt, Human
agcacaaaaacauucccagagu

SEQ ID NO: 700175 - RNA, 22 nt, Human
caguuucuucaauucagacacu

SEQ ID NO: 700176 - RNA, 22 nt, Human
cauuuguucugauuucaaaagg

SEQ ID NO: 700177 - RNA, 18 nt, Human
gaugaggcugucugagaa

SEQ ID NO: 700178 - RNA, 22 nt, Human
ugacaaaccaguagcaauaaag

SEQ ID NO: 700179 - RNA, 22 nt, Human
cuguguaucucugugggacaga

SEQ ID NO: 700180 - RNA, 22 nt, Human
uuaaaaccaucagcuguaagau

SEQ ID NO: 700181 - RNA, 22 nt, Human
aucauggaaagguucagcaagc

SEQ ID NO: 700182 - RNA, 22 nt, Human
guggggagcagccuuagccccu

SEQ ID NO: 700183 - RNA, 22 nt, Human
acccagagaacugugccuugag

SEQ ID NO: 700184 - RNA, 22 nt, Human
aagcccugacuaugaagacaua

SEQ ID NO: 700185 - RNA, 18 nt, Human
ugagagccugcuuguccc

SEQ ID NO: 700186 - RNA, 22 nt, Human
aucugacaaggccacauauucu

SEQ ID NO: 700187 - RNA, 22 nt, Human
uugaaugcaugguucacucugu

SEQ ID NO: 700188 - RNA, 22 nt, Human
auggcugugugcuucuccccau

SEQ ID NO: 700189 - RNA, 22 nt, Human
auuccacaggagcugguuuucu

SEQ ID NO: 700190 - RNA, 22 nt, Human
acuauagcucggguuauaaugu

SEQ ID NO: 700191 - RNA, 22 nt, Human
gugugcagucugcuaggcaggg

SEQ ID NO: 700192 - RNA, 21 nt, Human
gggagcugacagcagcacggc

SEQ ID NO: 700193 - RNA, 23 nt, Human
ccaccuggacucugggcaggugc

SEQ ID NO: 700194 - RNA, 22 nt, Human
ucugcagacacuggggucugga

SEQ ID NO: 700195 - RNA, 22 nt, Human
aggcagcauuucugcuuaucca

SEQ ID NO: 700196 - RNA, 22 nt, Human
ggagcuccuggcagugacagag

SEQ ID NO: 700197 - RNA, 22 nt, Human
ucaucaaagcgcuuggaguagg

SEQ ID NO: 700198 - RNA, 22 nt, Human
cagucacauugcccugcauuua

SEQ ID NO: 700199 - RNA, 22 nt, Human
uguaugcagcaaaacaauuagu

SEQ ID NO: 700200 - RNA, 22 nt, Human
ucuggagagcagaugccucugg

SEQ ID NO: 700201 - RNA, 22 nt, Human
ugcugccuccaacuccugggcu

SEQ ID NO: 700202 - RNA, 22 nt, Human
ugguccaguuuagcauugagug

SEQ ID NO: 700203 - RNA, 22 nt, Human
gugaaaaaugauuuguuaacug

SEQ ID NO: 700204 - RNA, 22 nt, Human
acagcucucccucagagaaaug

SEQ ID NO: 700205 - RNA, 22 nt, Human
auauauuuacucuccuguugca

SEQ ID NO: 700206 - RNA, 22 nt, Human
uccucugccccagaugaaauuu

SEQ ID NO: 700207 - RNA, 22 nt, Human
ucucugugucuuagugaaggga

SEQ ID NO: 700208 - RNA, 22 nt, Human
uaucucuuuauugacaauaaaa

SEQ ID NO: 700209 - RNA, 22 nt, Human
ucagccagaaagugauuuucag

SEQ ID NO: 700210 - RNA, 22 nt, Human
agcuuucacgauuuggaacagg

SEQ ID NO: 700211 - RNA, 22 nt, Human
uacuacaguauguguguuauac

SEQ ID NO: 700212 - RNA, 22 nt, Human
ccuggauucaagucuuucuuuc

SEQ ID NO: 700213 - RNA, 22 nt, Human
gagcugccugaacaagcagcag

SEQ ID NO: 700214 - RNA, 22 nt, Human
uagggggcuuugcugcuugaca

SEQ ID NO: 700215 - RNA, 22 nt, Human
uaagaguaagugauuaagaaga

SEQ ID NO: 700216 - RNA, 23 nt, Human
uucagggccucagaggugaagcu

SEQ ID NO: 700217 - RNA, 22 nt, Human
uuugcauugccucugacuuaug

SEQ ID NO: 700218 - RNA, 22 nt, Human
cuugcaggcagggacacugucu

SEQ ID NO: 700219 - RNA, 22 nt, Human
uccugagaaggcacagcuugca

SEQ ID NO: 700220 - RNA, 22 nt, Human
uagcagggauacaaggucgccu

SEQ ID NO: 700221 - RNA, 22 nt, Human
gagcacagcgcaguuuguaauu

SEQ ID NO: 700222 - RNA, 22 nt, Human
uucucagauuccccuuuuaaua

SEQ ID NO: 700223 - RNA, 22 nt, Human
uagcucugugcucuggaucugu

SEQ ID NO: 700224 - RNA, 22 nt, Human
ugucuugauuagaaugaugggc

SEQ ID NO: 700225 - RNA, 22 nt, Human
uuuauucaucaucuguucauau

SEQ ID NO: 700226 - RNA, 22 nt, Human
acagugcucaugugacauggug

SEQ ID NO: 700227 - RNA, 22 nt, Human
gugugucuuucauuucaugagg

SEQ ID NO: 700228 - RNA, 22 nt, Human
aacuaauacauuaauacaugug

SEQ ID NO: 700229 - RNA, 22 nt, Human
ccugcugucugcuguguuaagc

SEQ ID NO: 700230 - RNA, 22 nt, Human
uuucuacagaagauacacugcu

SEQ ID NO: 700231 - RNA, 22 nt, Human
gcuuuauuuugugagggauuac

SEQ ID NO: 700232 - RNA, 22 nt, Human
agaacaaaauuagaggagugca

SEQ ID NO: 700233 - RNA, 22 nt, Human
ccuuuggcauuuugaggaugcg

SEQ ID NO: 700234 - RNA, 22 nt, Human
aaaucagugcucauuugaaagg

SEQ ID NO: 700235 - RNA, 22 nt, Human
uaaaccuguaguugauguaauu

SEQ ID NO: 700236 - RNA, 22 nt, Human
uccaggccccccacgcuaaugg

SEQ ID NO: 700237 - RNA, 22 nt, Human
ucucuggcagacuggcugggcu

SEQ ID NO: 700238 - RNA, 22 nt, Human
gacuugggggaagauguggcug

SEQ ID NO: 700239 - RNA, 22 nt, Human
gcauccaugcaugcagggugug

SEQ ID NO: 700240 - RNA, 22 nt, Human
guccucugaaguugugcaaugc

SEQ ID NO: 700241 - RNA, 22 nt, Human
ucaguuuugaaaacauugaaug

SEQ ID NO: 700242 - RNA, 20 nt, Human
gcugacuguuuggguggcgg

SEQ ID NO: 700243 - RNA, 22 nt, Human
acaugcacugguugagggguuu

SEQ ID NO: 700244 - RNA, 22 nt, Human
aagaacauuuaugauggcauuu

SEQ ID NO: 700245 - RNA, 22 nt, Human
cauuaggguaauugaacacuua

SEQ ID NO: 700246 - RNA, 22 nt, Human
uuugguccauuauaugcuguca

SEQ ID NO: 700247 - RNA, 21 nt, Human
cuuauucacuguuauuuauca

SEQ ID NO: 700248 - RNA, 18 nt, Human
gagagcccagcagguggu

SEQ ID NO: 700249 - RNA, 22 nt, Human
cuggccaggccccuugcagggc

SEQ ID NO: 700250 - RNA, 22 nt, Human
cucugaaagcaaaacuagagaa

SEQ ID NO: 700251 - RNA, 22 nt, Human
guuaaugugucugacacaaugg

SEQ ID NO: 700252 - RNA, 22 nt, Human
cuacaggcucagggagcccucu

SEQ ID NO: 700253 - RNA, 22 nt, Human
cacagccugcugcacucaagaa

SEQ ID NO: 700254 - RNA, 22 nt, Human
uucugauugcugaugaggccca

SEQ ID NO: 700255 - RNA, 22 nt, Human
uugaaguugcacauuauaauuu

SEQ ID NO: 700256 - RNA, 22 nt, Human
cuggcuuccucaggagcagugg

SEQ ID NO: 700257 - RNA, 22 nt, Human
acacauauauuauuuguggcuc

SEQ ID NO: 700258 - RNA, 22 nt, Human
cugugaauuaaguauuguuauc

SEQ ID NO: 700259 - RNA, 22 nt, Human
cagcccugugcuaagcacccuc

SEQ ID NO: 700260 - RNA, 22 nt, Human
uacauugagcacguacuaugug

SEQ ID NO: 700261 - RNA, 22 nt, Human
gugggccaguuccucacaggua

SEQ ID NO: 700262 - RNA, 22 nt, Human
cucuguccuccaccugcuuuca

SEQ ID NO: 700263 - RNA, 22 nt, Human
ucagcaaugagaacuggcauuu

SEQ ID NO: 700264 - RNA, 22 nt, Human
cccagguguuuguggcagaggu

SEQ ID NO: 700265 - RNA, 22 nt, Human
uguguuugaguccucacagugc

SEQ ID NO: 700266 - RNA, 22 nt, Human
cugagccacugcuuguucagug

SEQ ID NO: 700267 - RNA, 22 nt, Human
guggguggauuccagcaacgcu

SEQ ID NO: 700268 - RNA, 21 nt, Human
ggcaacagauauuuugcuuag

SEQ ID NO: 700269 - RNA, 22 nt, Human
cgacagcagaagaagcaagcca

SEQ ID NO: 700270 - RNA, 22 nt, Human
auauagucaaacauauaugugu

SEQ ID NO: 700271 - RNA, 22 nt, Human
uuacuguaugagugugguaguc

SEQ ID NO: 700272 - RNA, 22 nt, Human
uaguaacagauuuauacagucu

SEQ ID NO: 700273 - RNA, 22 nt, Human
acauuaacaccgugaguuuggu

SEQ ID NO: 700274 - RNA, 21 nt, Human
auucagaaagggaauaaacuc

SEQ ID NO: 700275 - RNA, 22 nt, Human
aacaugauuggaaaaugcuguc

SEQ ID NO: 700276 - RNA, 22 nt, Human
gcugggucucucccugguccug

SEQ ID NO: 700277 - RNA, 22 nt, Human
agacacauuuuacauuaacugu

SEQ ID NO: 700278 - RNA, 22 nt, Human
gcuuuuuugcuauugaaguggu

SEQ ID NO: 700279 - RNA, 20 nt, Human
uucuuucaucuacacguugu

SEQ ID NO: 700280 - RNA, 22 nt, Human
ccuuucucuggcagcaggacag

SEQ ID NO: 700281 - RNA, 22 nt, Human
auguggcuaguggcuaugaucu

SEQ ID NO: 700282 - RNA, 22 nt, Human
acagcugcucuauaucucagcc

SEQ ID NO: 700283 - RNA, 22 nt, Human
ugaaacaaaccaguaauuuugu

SEQ ID NO: 700284 - RNA, 22 nt, Human
ucccaggacccaggcauucaca

SEQ ID NO: 700285 - RNA, 18 nt, Human
ucacuggguguauguggc

SEQ ID NO: 700286 - RNA, 22 nt, Human
cuggugucugauucuccccuga

SEQ ID NO: 700287 - RNA, 22 nt, Human
uucagaggguuuuagggucaga

SEQ ID NO: 700288 - RNA, 22 nt, Human
agcaccuugcucuuggccuucc

SEQ ID NO: 700289 - RNA, 22 nt, Human
auauucacugagcauaaagcca

SEQ ID NO: 700290 - RNA, 22 nt, Human
gagcagcaguuguuacaaugau

SEQ ID NO: 700291 - RNA, 22 nt, Human
cugaguccuugggcuuagagug

SEQ ID NO: 700292 - RNA, 22 nt, Human
auaucauaaaucggugcaugaa

SEQ ID NO: 700293 - RNA, 21 nt, Human
uccucagggccccagagcacu

SEQ ID NO: 700294 - RNA, 22 nt, Human
guaacugaggcagcuuuuaaga

SEQ ID NO: 700295 - RNA, 22 nt, Human
guuuuuccugcugacuuggguc

SEQ ID NO: 700296 - RNA, 22 nt, Human
aggccucacauugggcuucaag

SEQ ID NO: 700297 - RNA, 22 nt, Human
aauuuguacaaaauguuuauaa

SEQ ID NO: 700298 - RNA, 22 nt, Human
aggcaaaugauccugcuccuug

SEQ ID NO: 700299 - RNA, 22 nt, Human
gaccuggcuuugggccccggca

SEQ ID NO: 700300 - RNA, 22 nt, Human
ucccucagggugcaguugcuuu

SEQ ID NO: 700301 - RNA, 22 nt, Human
cagccccauggugugcuccagc

SEQ ID NO: 700302 - RNA, 22 nt, Human
uuauuaguguugauauuaggau

SEQ ID NO: 700303 - RNA, 22 nt, Human
ccucuggccuaggccgggagag

SEQ ID NO: 700304 - RNA, 22 nt, Human
gaggcuggugguuaguuccauu

SEQ ID NO: 700305 - RNA, 22 nt, Human
uuucaaaccuacuuguauguuu

SEQ ID NO: 700306 - RNA, 22 nt, Human
augaaacaguguguauagcaaa

SEQ ID NO: 700307 - RNA, 22 nt, Human
ucugcucuguacugcacuggcc

SEQ ID NO: 700308 - RNA, 22 nt, Human
aaggaggaaaauauuguugcug

SEQ ID NO: 700309 - RNA, 22 nt, Human
ucaacuuuaguguagcuauuua

SEQ ID NO: 700310 - RNA, 22 nt, Human
uuucagacugcugugugaaacu

SEQ ID NO: 700311 - RNA, 22 nt, Human
cggcagggcuccaugcauuucu

SEQ ID NO: 700312 - RNA, 22 nt, Human
auuagaaaaucuggaggugggg

SEQ ID NO: 700313 - RNA, 22 nt, Human
accuuucaaaguggcuaucacu

SEQ ID NO: 700314 - RNA, 22 nt, Human
aauguaaaguugggcacaaaug

SEQ ID NO: 700315 - RNA, 22 nt, Human
aacaggcuggccuugaagcagu

SEQ ID NO: 700316 - RNA, 22 nt, Human
cugagaaaguuuauguuuauuu

SEQ ID NO: 700317 - RNA, 22 nt, Human
cugcugucccagccuccucaca

SEQ ID NO: 700318 - RNA, 22 nt, Human
uuugucauaucacacaauuuug

SEQ ID NO: 700319 - RNA, 22 nt, Human
aagaauguuaguuucugauaca

SEQ ID NO: 700320 - RNA, 22 nt, Human
caggcagauauguucgcuuuaa

SEQ ID NO: 700321 - RNA, 22 nt, Human
agaaaacuugucacagcucuca

SEQ ID NO: 700322 - RNA, 22 nt, Human
gucuaugauauuuuguuauagc

SEQ ID NO: 700323 - RNA, 22 nt, Human
cccucaggaugcaguggaagug

SEQ ID NO: 700324 - RNA, 19 nt, Human
ccccaaaguuuagauguug

SEQ ID NO: 700325 - RNA, 22 nt, Human
auuguauuagcacaauacaauu

SEQ ID NO: 700326 - RNA, 22 nt, Human
aaugcuagugugauauguaagg

SEQ ID NO: 700327 - RNA, 22 nt, Human
agcauuuaugacuaauguaaaa

SEQ ID NO: 700328 - RNA, 22 nt, Human
uuuguguaccuuguacauuugu

SEQ ID NO: 700329 - RNA, 22 nt, Human
acucugccugaaccuccugcaa

SEQ ID NO: 700330 - RNA, 22 nt, Human
cccugcuagaaccuccaacaug

SEQ ID NO: 700331 - RNA, 22 nt, Human
aaggcugaggagggccugcagg

SEQ ID NO: 700332 - RNA, 22 nt, Human
agaggaggcagcuuaacucagu

SEQ ID NO: 700333 - RNA, 22 nt, Human
uauugccugaguguuucauaau

SEQ ID NO: 700334 - RNA, 22 nt, Human
ugcugcucuucaccauggccuc

SEQ ID NO: 700335 - RNA, 22 nt, Human
ucccugggcuucuccagacuug

SEQ ID NO: 700336 - RNA, 22 nt, Human
ugccagcaguagcaguaggcca

SEQ ID NO: 700337 - RNA, 22 nt, Human
ucagugcaucacagaacuuugu

SEQ ID NO: 700338 - RNA, 22 nt, Human
uccuggacuggcucagcacccu

SEQ ID NO: 700339 - RNA, 22 nt, Human
ucccuguccaaagucuuccuau

SEQ ID NO: 700340 - RNA, 22 nt, Human
ugagauguaagguaugcuuacu

SEQ ID NO: 700341 - RNA, 22 nt, Human
acagcuaagcucccacaaccug

SEQ ID NO: 700342 - RNA, 22 nt, Human
uaguuaggguucugcagagaca

SEQ ID NO: 700343 - RNA, 22 nt, Human
ggcugagcaauuuugaugacau

SEQ ID NO: 700344 - RNA, 22 nt, Human
caugaaagcaggaaugguuuua

SEQ ID NO: 700345 - RNA, 22 nt, Human
gaauugcugaugaaucugauug

SEQ ID NO: 700346 - RNA, 22 nt, Human
aaugcuuucaaaaaugugcagu

SEQ ID NO: 700347 - RNA, 22 nt, Human
aaauccuaaugacaaguuuagu

SEQ ID NO: 700348 - RNA, 22 nt, Human
cagcuauuguucuguauaauga

SEQ ID NO: 700349 - RNA, 22 nt, Human
cuguggcuggcucaucauaggu

SEQ ID NO: 700350 - RNA, 22 nt, Human
agguggcugaagagugggugag

SEQ ID NO: 700351 - RNA, 22 nt, Human
gagggcgcuucagagagaugaa

SEQ ID NO: 700352 - RNA, 22 nt, Human
ugcagaaccaguccucagaccc

SEQ ID NO: 700353 - RNA, 22 nt, Human
caauuucuggaacuaauucuga

SEQ ID NO: 700354 - RNA, 22 nt, Human
ggcaagagguccaagaggucuc

SEQ ID NO: 700355 - RNA, 22 nt, Human
uggagcaggcaucuuucucucu

SEQ ID NO: 700356 - RNA, 22 nt, Human
caacaguuuauaguguuaucuu

SEQ ID NO: 700357 - RNA, 22 nt, Human
cugucacugaugcuccugccac

SEQ ID NO: 700358 - RNA, 22 nt, Human
caggaaauauaggaaaaggaac

SEQ ID NO: 700359 - RNA, 22 nt, Human
acuuaucaguugucucuaaugu

SEQ ID NO: 700360 - RNA, 22 nt, Human
auauggcauuuuaauguaugag

SEQ ID NO: 700361 - RNA, 22 nt, Human
guaaucucagcuacuugggagg

SEQ ID NO: 700362 - RNA, 19 nt, Human
ucugagggagcacgaaggc

SEQ ID NO: 700363 - RNA, 22 nt, Human
aaacugaagagcuuuuugacac

SEQ ID NO: 700364 - RNA, 22 nt, Human
uugauagguuuuauguauaguu

SEQ ID NO: 700365 - RNA, 22 nt, Human
aauggacaggagagcauaguca

SEQ ID NO: 700366 - RNA, 22 nt, Human
auugguggugaggacaugccag

SEQ ID NO: 700367 - RNA, 22 nt, Human
agggaguuccgaucugugcacc

SEQ ID NO: 700368 - RNA, 22 nt, Human
aagccucaccuuuuagaagcua

SEQ ID NO: 700369 - RNA, 22 nt, Human
ccaguguguuuuucucugacuc

SEQ ID NO: 700370 - RNA, 18 nt, Human
aguccuggcucuaccacc

SEQ ID NO: 700371 - RNA, 22 nt, Human
gagcagcaagcacucaaaggcu

SEQ ID NO: 700372 - RNA, 22 nt, Human
ggcagagcucuggacugagaac

SEQ ID NO: 700373 - RNA, 22 nt, Human
ucagaacauuugggacuuuggg

SEQ ID NO: 700374 - RNA, 22 nt, Human
uagaggagcggcgagcugagcu

SEQ ID NO: 700375 - RNA, 22 nt, Human
agggcugcugcuccgggcccag

SEQ ID NO: 700376 - RNA, 22 nt, Human
agcagcagaaaguugauggcag

SEQ ID NO: 700377 - RNA, 22 nt, Human
acccuggguucccgcagcacca

SEQ ID NO: 700378 - RNA, 22 nt, Human
uagaagagacauagccuguggu

SEQ ID NO: 700379 - RNA, 23 nt, Human
agguggccaccagaauguuaagg

SEQ ID NO: 700380 - RNA, 22 nt, Human
uuagcaagauaacaguaauuuu

SEQ ID NO: 700381 - RNA, 22 nt, Human
gccugugacccagggcccagga

SEQ ID NO: 700382 - RNA, 21 nt, Human
ggccccagcccauggguucuc

SEQ ID NO: 700383 - RNA, 22 nt, Human
accugcagguguuuccacacuu

SEQ ID NO: 700384 - RNA, 21 nt, Human
gcuccagaacucuaugcuaac

SEQ ID NO: 700385 - RNA, 22 nt, Human
agucaacagaguggccgcagcg

SEQ ID NO: 700386 - RNA, 22 nt, Human
ggcaugagagguccuggggauu

SEQ ID NO: 700387 - RNA, 22 nt, Human
augucuucuaagcucuaagcug

SEQ ID NO: 700388 - RNA, 22 nt, Human
ucccugagcuucucugaaaugg

SEQ ID NO: 700389 - RNA, 22 nt, Human
cugggucucaggaguucugagg

SEQ ID NO: 700390 - RNA, 19 nt, Human
cuggucugucaugcucccc

SEQ ID NO: 700391 - RNA, 22 nt, Human
acaggcuugcacuaggguggca

SEQ ID NO: 700392 - RNA, 22 nt, Human
aacaugcaaugucugaaaaucc

SEQ ID NO: 700393 - RNA, 22 nt, Human
uaguuuaggaacaaguagugga

SEQ ID NO: 700394 - RNA, 22 nt, Human
agcaaacagugugcuaagaaau

SEQ ID NO: 700395 - RNA, 22 nt, Human
gagaguggauggagcugcgaag

SEQ ID NO: 700396 - RNA, 22 nt, Human
acuaaaguccuguuguagcaua

SEQ ID NO: 700397 - RNA, 22 nt, Human
aguuccagcugugaccagaaaa

SEQ ID NO: 700398 - RNA, 20 nt, Human
acaguguuaguuaucaucuc

SEQ ID NO: 700399 - RNA, 22 nt, Human
aaguuccuuagccuuagggcuu

SEQ ID NO: 700400 - RNA, 22 nt, Human
uuugaauaaucacugggcauua

SEQ ID NO: 700401 - RNA, 22 nt, Human
aguucaggcauaaggcaugaac

SEQ ID NO: 700402 - RNA, 22 nt, Human
cugaaacuccaugagaaauugc

SEQ ID NO: 700403 - RNA, 22 nt, Human
cugagaggcacaaggcauuucg

SEQ ID NO: 700404 - RNA, 22 nt, Human
aacugugggaugcauuaauuca

SEQ ID NO: 700405 - RNA, 22 nt, Human
agucugaguaucucugagccag

SEQ ID NO: 700406 - RNA, 22 nt, Human
ugcaagcacucaaugcaaacag

SEQ ID NO: 700407 - RNA, 22 nt, Human
ugcaggaggccccauggaaccg

SEQ ID NO: 700408 - RNA, 22 nt, Human
uuagugcaaaccucagagacac

SEQ ID NO: 700409 - RNA, 22 nt, Human
uuggaauugaggauuuacauag

SEQ ID NO: 700410 - RNA, 22 nt, Human
aaagcaguauaaguaacggaag

SEQ ID NO: 700411 - RNA, 22 nt, Human
ccuuggcuaggcagcggcuguc

SEQ ID NO: 700412 - RNA, 22 nt, Human
ugggggcagaggauucaggaau

SEQ ID NO: 700413 - RNA, 22 nt, Human
ccuggagguggagguugcagug

SEQ ID NO: 700414 - RNA, 22 nt, Human
uagcagcaccuuucuaaucuga

SEQ ID NO: 700415 - RNA, 22 nt, Human
cuuuacauccuguuucccguuu

SEQ ID NO: 700416 - RNA, 22 nt, Human
cuugccugggacugaggcauuu

SEQ ID NO: 700417 - RNA, 22 nt, Human
acccugagaaagucacaugcau

SEQ ID NO: 700418 - RNA, 22 nt, Human
uauuaaauguuauuuggguugu

SEQ ID NO: 700419 - RNA, 22 nt, Human
uucaggaaucaaccaagucauu

SEQ ID NO: 700420 - RNA, 22 nt, Human
auccugggccucagaggugugu

SEQ ID NO: 700421 - RNA, 22 nt, Human
ccaccagcuuugccacccugcu

SEQ ID NO: 700422 - RNA, 22 nt, Human
aguuucacauagcucagugcuc

SEQ ID NO: 700423 - RNA, 22 nt, Human
acaguagucuuaauuucaugua

SEQ ID NO: 700424 - RNA, 22 nt, Human
aggagagucuugagucacuggu

SEQ ID NO: 700425 - RNA, 22 nt, Human
aaaucucaaaggcuuagcaucu

SEQ ID NO: 700426 - RNA, 22 nt, Human
gggcuucugcucuuuuggugcu

SEQ ID NO: 700427 - RNA, 22 nt, Human
cucuugggagugcucuggagaa

SEQ ID NO: 700428 - RNA, 22 nt, Human
uaguuuagccccacgugugcuu

SEQ ID NO: 700429 - RNA, 22 nt, Human
auuuggucauguucaguguaga

SEQ ID NO: 700430 - RNA, 22 nt, Human
accagagcuggcagaguaucaa

SEQ ID NO: 700431 - RNA, 22 nt, Human
caaucacugggauauuggugug

SEQ ID NO: 700432 - RNA, 22 nt, Human
ugagcccagagcccuuguaggg

SEQ ID NO: 700433 - RNA, 22 nt, Human
aauuuuacaaaauaccuccgau

SEQ ID NO: 700434 - RNA, 22 nt, Human
gcccagcaggggauggcagcuc

SEQ ID NO: 700435 - RNA, 22 nt, Human
cugggcacaggggagcagaguc

SEQ ID NO: 700436 - RNA, 22 nt, Human
ggcugccuucagacuccagcuu

SEQ ID NO: 700437 - RNA, 22 nt, Human
aaaaagacuagucgagugcagu

SEQ ID NO: 700438 - RNA, 22 nt, Human
auguacauuauucgagugaugg

SEQ ID NO: 700439 - RNA, 22 nt, Human
ccauuaaagcaccacuguaaua

SEQ ID NO: 700440 - RNA, 22 nt, Human
aauaauuuuagcucagaguugu

SEQ ID NO: 700441 - RNA, 22 nt, Human
auagucuuagucuauaguuuug

SEQ ID NO: 700442 - RNA, 22 nt, Human
augcacaguacaaacuggaaac

SEQ ID NO: 700443 - RNA, 20 nt, Human
gcauggcuaaucuguacuga

SEQ ID NO: 700444 - RNA, 21 nt, Human
uuaagagcuuagcaguaggcc

SEQ ID NO: 700445 - RNA, 22 nt, Human
uaauggcuaaaauucagaagaa

SEQ ID NO: 700446 - RNA, 22 nt, Human
gccaggcucucagugacugccc

SEQ ID NO: 700447 - RNA, 22 nt, Human
cccuuuggguuccccaagccug

SEQ ID NO: 700448 - RNA, 22 nt, Human
uuguuuuggaagaacuuacucu

SEQ ID NO: 700449 - RNA, 21 nt, Human
uuucugaaggcaacaucuauc

SEQ ID NO: 700450 - RNA, 19 nt, Human
uagucuuuauucuuaauuu

SEQ ID NO: 700451 - RNA, 22 nt, Human
gcccuggagagggauauggcau

SEQ ID NO: 700452 - RNA, 22 nt, Human
cugggugaguauaggaaaggga

SEQ ID NO: 700453 - RNA, 22 nt, Human
auaauugaugaggcuuuggaca

SEQ ID NO: 700454 - RNA, 22 nt, Human
ucauauaacuggauauuuucaa

SEQ ID NO: 700455 - RNA, 22 nt, Human
uagcagugcccuguggaauaag

SEQ ID NO: 700456 - RNA, 22 nt, Human
gagagcaggaggcagcgggacg

SEQ ID NO: 700457 - RNA, 22 nt, Human
aucugcaucagacuuugcauga

SEQ ID NO: 700458 - RNA, 22 nt, Human
augccaaagggagcacuuuggg

SEQ ID NO: 700459 - RNA, 22 nt, Human
ugcugucccccgugucugggcu

SEQ ID NO: 700460 - RNA, 22 nt, Human
ggcaggaagcauuaaaacgauu

SEQ ID NO: 700461 - RNA, 22 nt, Human
uuggagauaucacaccuucaca

SEQ ID NO: 700462 - RNA, 22 nt, Human
gagcuggcuccgccaugcugcu

SEQ ID NO: 700463 - RNA, 19 nt, Human
gccuuugggcguuguuggg

SEQ ID NO: 700464 - RNA, 22 nt, Human
ggggccgaccgcgguucaggcc

SEQ ID NO: 700465 - RNA, 22 nt, Human
aacaaauguaaaaugcagaugc

SEQ ID NO: 700466 - RNA, 22 nt, Human
gccuggcuuuugccucauguuc

SEQ ID NO: 700467 - RNA, 22 nt, Human
ugaggaaguuguuucucuucua

SEQ ID NO: 700468 - RNA, 22 nt, Human
augcacagcugaacacucuaaa

SEQ ID NO: 700469 - RNA, 23 nt, Human
uccagggcuggccagaccucggu

SEQ ID NO: 700470 - RNA, 22 nt, Human
auuucagggagucauuuacaca

SEQ ID NO: 700471 - RNA, 22 nt, Human
uuuuuaucuacagauucucagc

SEQ ID NO: 700472 - RNA, 22 nt, Human
cagaucaugaaugacugacaga

SEQ ID NO: 700473 - RNA, 22 nt, Human
agguggggugagcugcagacua

SEQ ID NO: 700474 - RNA, 22 nt, Human
ugcugagggcuguuaaggaagc

SEQ ID NO: 700475 - RNA, 22 nt, Human
accagagcccaucugcuccuag

SEQ ID NO: 700476 - RNA, 22 nt, Human
ucacucuguuuuacucacuguu

SEQ ID NO: 700477 - RNA, 23 nt, Human
ugggcagcuucugcaugcccacc

SEQ ID NO: 700478 - RNA, 22 nt, Human
uaauauguguuacugacuuuuu

SEQ ID NO: 700479 - RNA, 22 nt, Human
gcugcagcccugcggaucacuu

SEQ ID NO: 700480 - RNA, 22 nt, Human
cauuugaauggcauuucacuuu

SEQ ID NO: 700481 - RNA, 19 nt, Human
cagcacaugcuucucugag

SEQ ID NO: 700482 - RNA, 22 nt, Human
augcugaaggccauccugcauc

SEQ ID NO: 700483 - RNA, 22 nt, Human
gccuggagugguccugcugccc

SEQ ID NO: 700484 - RNA, 22 nt, Human
ugggcucucacacauguucuga

SEQ ID NO: 700485 - RNA, 22 nt, Human
agcaaggccgagaggaugcuau

SEQ ID NO: 700486 - RNA, 22 nt, Human
ggcccacuugaaauggagcuca

SEQ ID NO: 700487 - RNA, 22 nt, Human
cugcugugagcacuccagccug

SEQ ID NO: 700488 - RNA, 22 nt, Human
agcuuuggcuguguugcucugu

SEQ ID NO: 700489 - RNA, 22 nt, Human
agugguaagggcauaggcacug

SEQ ID NO: 700490 - RNA, 23 nt, Human
ucaaacagguuucagagcaucuu

SEQ ID NO: 700491 - RNA, 22 nt, Human
guaguucuuucucaauguucaa

SEQ ID NO: 700492 - RNA, 22 nt, Human
gagcuuccuuuuucugcaugac

SEQ ID NO: 700493 - RNA, 22 nt, Human
aagauuacuacggaacaugacc

SEQ ID NO: 700494 - RNA, 22 nt, Human
ugacagaggcugaguuagucug

SEQ ID NO: 700495 - RNA, 22 nt, Human
ggagcgugcagcaugagcucau

SEQ ID NO: 700496 - RNA, 22 nt, Human
cagagacccuucucaguggcca

SEQ ID NO: 700497 - RNA, 22 nt, Human
gggagccacaguuuauagugau

SEQ ID NO: 700498 - RNA, 22 nt, Human
ugugcccaucccucuggagugu

SEQ ID NO: 700499 - RNA, 22 nt, Human
cuacacugagagcucuucaggg

SEQ ID NO: 700500 - RNA, 16 nt, Human
agugggaggagaaaga

SEQ ID NO: 700501 - RNA, 22 nt, Human
ggcaggguggcagaggcucaga

SEQ ID NO: 700502 - RNA, 22 nt, Human
uucugaaaggcagguuguuugc

SEQ ID NO: 700503 - RNA, 22 nt, Human
aguuuuuccguggcuacgauaa

SEQ ID NO: 700504 - RNA, 22 nt, Human
gaacauuuggcaugagaauuug

SEQ ID NO: 700505 - RNA, 22 nt, Human
cugucacacugauaucaggcuu

SEQ ID NO: 700506 - RNA, 22 nt, Human
acccagcucuuugauggucuug

SEQ ID NO: 700507 - RNA, 22 nt, Human
uagaagauucauuuccucugaa

SEQ ID NO: 700508 - RNA, 22 nt, Human
ucuauacaugugcacacacauc

SEQ ID NO: 700509 - RNA, 22 nt, Human
cugccugcugccuguggagggu

SEQ ID NO: 700510 - RNA, 22 nt, Human
uuagaaccaccuggagagcuuu

SEQ ID NO: 700511 - RNA, 22 nt, Human
ugucaaaaauaagagagauugu

SEQ ID NO: 700512 - RNA, 22 nt, Human
auuuucaugacuaccuuaaaua

SEQ ID NO: 700513 - RNA, 22 nt, Human
ugggaagggaguuucuuggagu

SEQ ID NO: 700514 - RNA, 22 nt, Human
uccuagugcaaauuggagcaug

SEQ ID NO: 700515 - RNA, 22 nt, Human
gcagaggagcaaguugcuacag

SEQ ID NO: 700516 - RNA, 22 nt, Human
uuauguuuuaaguguguaucuu

SEQ ID NO: 700517 - RNA, 22 nt, Human
acacauaugguugcugcaguga

SEQ ID NO: 700518 - RNA, 22 nt, Human
auucuacaggacuggcaauccc

SEQ ID NO: 700519 - RNA, 22 nt, Human
aggacaaaggaccagaucugga

SEQ ID NO: 700520 - RNA, 22 nt, Human
gauuuauaguaugugcuuucag

SEQ ID NO: 700521 - RNA, 22 nt, Human
uaucuagaaacagaguuuuacu

SEQ ID NO: 700522 - RNA, 22 nt, Human
gucugagggguuucccaggaca

SEQ ID NO: 700523 - RNA, 22 nt, Human
gagcuggacuuucagauacauc

SEQ ID NO: 700524 - RNA, 22 nt, Human
gugcacaggugggaaaaugagu

SEQ ID NO: 700525 - RNA, 22 nt, Human
uuccaagaguaaauucaaauug

SEQ ID NO: 700526 - RNA, 22 nt, Human
uaaggccauuauggugggcccg

SEQ ID NO: 700527 - RNA, 22 nt, Human
guauuagggccaaaggcaggaa

SEQ ID NO: 700528 - RNA, 22 nt, Human
ccacagagacucugcaggacug

SEQ ID NO: 700529 - RNA, 23 nt, Human
caguauaauguauggauggggca

SEQ ID NO: 700530 - RNA, 22 nt, Human
ucuuggaacuuauuauuguaga

SEQ ID NO: 700531 - RNA, 22 nt, Human
gcagugcagugggacagggcgc

SEQ ID NO: 700532 - RNA, 22 nt, Human
cugccugugccaccgccucauu

SEQ ID NO: 700533 - RNA, 22 nt, Human
ccuuggcugugcugcccuuugc

SEQ ID NO: 700534 - RNA, 22 nt, Human
uagugaaaccugacagaucaug

SEQ ID NO: 700535 - RNA, 22 nt, Human
uuagugucuggcuauauuuaaa

SEQ ID NO: 700536 - RNA, 22 nt, Human
gaaggcccagcuugaaugcugc

SEQ ID NO: 700537 - RNA, 22 nt, Human
caccuguuagcucuaauuuucu

SEQ ID NO: 700538 - RNA, 22 nt, Human
aaagguaaaguaucugcccaag

SEQ ID NO: 700539 - RNA, 22 nt, Human
uucugucuguaaacuucucaau

SEQ ID NO: 700540 - RNA, 22 nt, Human
uggcagucggacuucuaucuca

SEQ ID NO: 700541 - RNA, 18 nt, Human
cggaucaugcgcugaggc

SEQ ID NO: 700542 - RNA, 22 nt, Human
uacuguauacuacugcuguucu

SEQ ID NO: 700543 - RNA, 22 nt, Human
uccugggguuuuggccgcagcu

SEQ ID NO: 700544 - RNA, 22 nt, Human
caugcauuucuaccaaggaaua

SEQ ID NO: 700545 - RNA, 22 nt, Human
uagaauauacacuacagcuuaa

SEQ ID NO: 700546 - RNA, 22 nt, Human
aacacaaaaauucucaggggca

SEQ ID NO: 700547 - RNA, 22 nt, Human
cagccaggagccucugcaacua

SEQ ID NO: 700548 - RNA, 22 nt, Human
uggcgcaguuucucugcugccu

SEQ ID NO: 700549 - RNA, 22 nt, Human
acuguccauucacucauauuca

SEQ ID NO: 700550 - RNA, 19 nt, Human
cccaggggacccagcccua

SEQ ID NO: 700551 - RNA, 20 nt, Human
acagagaucagcugaugggc

SEQ ID NO: 700552 - RNA, 22 nt, Human
cauugaaaauguugcaggcugu

SEQ ID NO: 700553 - RNA, 22 nt, Human
uggcagaaagaaccaugugcaa

SEQ ID NO: 700554 - RNA, 22 nt, Human
aguguucacucuguggagccca

SEQ ID NO: 700555 - RNA, 22 nt, Human
uuccugccuacaugccuuaugc

SEQ ID NO: 700556 - RNA, 22 nt, Human
gcagcuccuucaaucucaccau

SEQ ID NO: 700557 - RNA, 22 nt, Human
agccccuguccucucugaugac

SEQ ID NO: 700558 - RNA, 22 nt, Human
uugcucuguaauaaucuggggu

SEQ ID NO: 700559 - RNA, 22 nt, Human
ugaugaaaauguucagcaauua

SEQ ID NO: 700560 - RNA, 22 nt, Human
ggaggggaacuaaucccgugac

SEQ ID NO: 700561 - RNA, 22 nt, Human
agguauauguucauguaugugu

SEQ ID NO: 700562 - RNA, 22 nt, Human
acuuaaaaacagauccagcagg

SEQ ID NO: 700563 - RNA, 22 nt, Human
ggucugaggcuccaaggaggug

SEQ ID NO: 700564 - RNA, 22 nt, Human
ugaaacaagggccaugggaaac

SEQ ID NO: 700565 - RNA, 22 nt, Human
gauguguuuguuucuggaggag

SEQ ID NO: 700566 - RNA, 22 nt, Human
guggucagagaugacagugggu

SEQ ID NO: 700567 - RNA, 22 nt, Human
uagaauguuaagaauauguaua

SEQ ID NO: 700568 - RNA, 21 nt, Human
cagugcucaaucugacagugg

SEQ ID NO: 700569 - RNA, 22 nt, Human
cucagcagugacaagagaguau

SEQ ID NO: 700570 - RNA, 19 nt, Human
ggugugaagugaggaguua

SEQ ID NO: 700571 - RNA, 22 nt, Human
uucuccuuauucauaguugucu

SEQ ID NO: 700572 - RNA, 22 nt, Human
uuuuauaaagagagucaguugg

SEQ ID NO: 700573 - RNA, 22 nt, Human
cagagaaaaaauccugcucuca

SEQ ID NO: 700574 - RNA, 22 nt, Human
gacacagaauuuacucccgaua

SEQ ID NO: 700575 - RNA, 22 nt, Human
auuguucuguagugacauguag

SEQ ID NO: 700576 - RNA, 22 nt, Human
caggccuggcugcagcucgccu

SEQ ID NO: 700577 - RNA, 22 nt, Human
agcaacaggaccauggagccca

SEQ ID NO: 700578 - RNA, 22 nt, Human
cuggagggcuucugcagguuac

SEQ ID NO: 700579 - RNA, 22 nt, Human
cugaggucucuuuccauaguga

SEQ ID NO: 700580 - RNA, 22 nt, Human
uaaaucuucuacaucaucauaa

SEQ ID NO: 700581 - RNA, 22 nt, Human
ugcuucauuaaaacaauauuuu

SEQ ID NO: 700582 - RNA, 22 nt, Human
aauggguugaacaucaaggucu

SEQ ID NO: 700583 - RNA, 20 nt, Human
gcuuucuaugagauggacug

SEQ ID NO: 700584 - RNA, 22 nt, Human
auacaucuggauguaugcauuu

SEQ ID NO: 700585 - RNA, 22 nt, Human
ucccagagcagaugugcuaaag

SEQ ID NO: 700586 - RNA, 22 nt, Human
ccuggcuccaaagcugugacuc

SEQ ID NO: 700587 - RNA, 22 nt, Human
gugaccagccagugcugucugu

SEQ ID NO: 700588 - RNA, 22 nt, Human
uucucacagaagcacgaagccu

SEQ ID NO: 700589 - RNA, 22 nt, Human
agggcacaagacucugagcccc

SEQ ID NO: 700590 - RNA, 22 nt, Human
cugagccaugagccugcgccca

SEQ ID NO: 700591 - RNA, 22 nt, Human
uacuuacauuagcaaacaaggu

SEQ ID NO: 700592 - RNA, 22 nt, Human
agcaggagcccuuaucaccagg

SEQ ID NO: 700593 - RNA, 22 nt, Human
auacaaaaauuagccgggagua

SEQ ID NO: 700594 - RNA, 22 nt, Human
gcacccagugggaugcuuagca

SEQ ID NO: 700595 - RNA, 22 nt, Human
gcuuucuguagguaguuacugu

SEQ ID NO: 700596 - RNA, 22 nt, Human
ggcaagagugaggagugucucu

SEQ ID NO: 700597 - RNA, 22 nt, Human
ucaugaguggauuaauauggcu

SEQ ID NO: 700598 - RNA, 22 nt, Human
aggcagcauuugaauccagguc

SEQ ID NO: 700599 - RNA, 22 nt, Human
gauggcuuccuucucacugugu

SEQ ID NO: 700600 - RNA, 22 nt, Human
cugggcucagcaggccaaggcc

SEQ ID NO: 700601 - RNA, 22 nt, Human
cugagagucagcuucuccuccu

SEQ ID NO: 700602 - RNA, 22 nt, Human
acugugugggccgcucacuggg

SEQ ID NO: 700603 - RNA, 22 nt, Human
caucacuacaaauuuaagaaau

SEQ ID NO: 700604 - RNA, 22 nt, Human
uguauacaugucugugugcaca

SEQ ID NO: 700605 - RNA, 22 nt, Human
ucuuccucuagaucugaggccc

SEQ ID NO: 700606 - RNA, 22 nt, Human
cccugaggcugaggauaggugg

SEQ ID NO: 700607 - RNA, 22 nt, Human
cgcggcgcgcccccgggugugu

SEQ ID NO: 700608 - RNA, 22 nt, Human
auacacacgugcacgugggaaa

SEQ ID NO: 700609 - RNA, 22 nt, Human
uauucauuaugaccaaaucuag

SEQ ID NO: 700610 - RNA, 22 nt, Human
cagcuaauccucucuauccaag

SEQ ID NO: 700611 - RNA, 22 nt, Human
gcagggcuugcagcagcuagac

SEQ ID NO: 700612 - RNA, 22 nt, Human
gucuuccuaauuugcuauuagg

SEQ ID NO: 700613 - RNA, 22 nt, Human
uggccaagaugcgaccucucag

SEQ ID NO: 700614 - RNA, 22 nt, Human
gcagggaccaaaagaggcagua

SEQ ID NO: 700615 - RNA, 22 nt, Human
acagcuuuaguguggguggugc

SEQ ID NO: 700616 - RNA, 22 nt, Human
gacuuuccagguccugggcuau

SEQ ID NO: 700617 - RNA, 22 nt, Human
cuggccuaaaauugcuucugca

SEQ ID NO: 700618 - RNA, 22 nt, Human
cugaaaaacgggauuuggcugg

SEQ ID NO: 700619 - RNA, 22 nt, Human
agagggaaauccaggagugcuu

SEQ ID NO: 700620 - RNA, 22 nt, Human
gcugugagggucuagugaggug

SEQ ID NO: 700621 - RNA, 22 nt, Human
ccugaagcacccggagcuggca

SEQ ID NO: 700622 - RNA, 22 nt, Human
ggagaaggaagaaagcuacuau

SEQ ID NO: 700623 - RNA, 21 nt, Human
aacuuguauuucuccuuauuc

SEQ ID NO: 700624 - RNA, 22 nt, Human
aaagguuuuguucaucgauuuu

SEQ ID NO: 700625 - RNA, 23 nt, Human
uggccugcagaguuucugcuggg

SEQ ID NO: 700626 - RNA, 17 nt, Human
gucauucucagaaaaug

SEQ ID NO: 700627 - RNA, 22 nt, Human
aaccucaggcucucuggacaau

SEQ ID NO: 700628 - RNA, 19 nt, Human
ugcuucuggggcuucucca

SEQ ID NO: 700629 - RNA, 22 nt, Human
uccucacacuauagaugaggau

SEQ ID NO: 700630 - RNA, 23 nt, Human
augcacaagccagcaggggacag

SEQ ID NO: 700631 - RNA, 22 nt, Human
auaucacaggaaaggaagauac

SEQ ID NO: 700632 - RNA, 22 nt, Human
aguguuucucagaagggccuau

SEQ ID NO: 700633 - RNA, 22 nt, Human
aggauaaauucuccaaagugug

SEQ ID NO: 700634 - RNA, 22 nt, Human
gaaugugucacccugucccaug

SEQ ID NO: 700635 - RNA, 22 nt, Human
aggcagccacaugagcuccuga

SEQ ID NO: 700636 - RNA, 23 nt, Human
agguagguuauugcugcuaccug

SEQ ID NO: 700637 - RNA, 22 nt, Human
uucuuugugcauccaauuuucu

SEQ ID NO: 700638 - RNA, 21 nt, Human
cacagcaggguuccugggcuc

SEQ ID NO: 700639 - RNA, 17 nt, Human
uguggccuucugagcuu

SEQ ID NO: 700640 - RNA, 22 nt, Human
cugcaguaacgaucauggugcc

SEQ ID NO: 700641 - RNA, 22 nt, Human
uugcugggucagaagccaggag

SEQ ID NO: 700642 - RNA, 22 nt, Human
aaguuuaggccaaauuagauuu

SEQ ID NO: 700643 - RNA, 22 nt, Human
ugaauaaacuaugaggaggaau

SEQ ID NO: 700644 - RNA, 22 nt, Human
ucucagucagccuugauguccc

SEQ ID NO: 700645 - RNA, 19 nt, Human
cucugccucccuccugggu

SEQ ID NO: 700646 - RNA, 22 nt, Human
uccuggguaaacacugaccuuu

SEQ ID NO: 700647 - RNA, 22 nt, Human
ucugaggcaaacagaggagugu

SEQ ID NO: 700648 - RNA, 22 nt, Human
auacaucguuuauuuuaguuca

SEQ ID NO: 700649 - RNA, 22 nt, Human
cugcugucauagccaucccucc

SEQ ID NO: 700650 - RNA, 21 nt, Human
uggugccuucagcugucuuuu

SEQ ID NO: 700651 - RNA, 22 nt, Human
ucuugugugguggaagauaugg

SEQ ID NO: 700652 - RNA, 22 nt, Human
ugcaaacuagcaucaacuagua

SEQ ID NO: 700653 - RNA, 22 nt, Human
auguuacuuagaauaauucugg

SEQ ID NO: 700654 - RNA, 22 nt, Human
gaugcacagugacccugccagu

SEQ ID NO: 700655 - RNA, 19 nt, Human
uuuggcucuggucagagag

SEQ ID NO: 700656 - RNA, 22 nt, Human
gugggggcuggaaaucuugcca

SEQ ID NO: 700657 - RNA, 21 nt, Human
ggccucugucauccugggaag

SEQ ID NO: 700658 - RNA, 22 nt, Human
gucagaucuuuggggaugcugu

SEQ ID NO: 700659 - RNA, 22 nt, Human
agauaaugucaaauucugucug

SEQ ID NO: 700660 - RNA, 22 nt, Human
augucaugaaaugcuacuaacu

SEQ ID NO: 700661 - RNA, 22 nt, Human
uuccuucuaauauucugccugu

SEQ ID NO: 700662 - RNA, 22 nt, Human
uggaaagaaaaacaggccauga

SEQ ID NO: 700663 - RNA, 22 nt, Human
cugaauaucauuuaucauuggc

SEQ ID NO: 700664 - RNA, 22 nt, Human
aguuaucaucccuuacacuuug

SEQ ID NO: 700665 - RNA, 22 nt, Human
gucacauucaugcagaaucaaa

SEQ ID NO: 700666 - RNA, 22 nt, Human
cagcuguguagaugcaggguca

SEQ ID NO: 700667 - RNA, 22 nt, Human
gugcugaggagagggggugguc

SEQ ID NO: 700668 - RNA, 22 nt, Human
acauuucuuccacaugcugcug

SEQ ID NO: 700669 - RNA, 22 nt, Human
ucaucucaaaacccaaggggca

SEQ ID NO: 700670 - RNA, 22 nt, Human
ggcuggcuaucugugguugccu

SEQ ID NO: 700671 - RNA, 22 nt, Human
agggccugugcugaguagacga

SEQ ID NO: 700672 - RNA, 22 nt, Human
uacccagcccaugccuaccuca

SEQ ID NO: 700673 - RNA, 18 nt, Human
ucugcccugccauucacu

SEQ ID NO: 700674 - RNA, 17 nt, Human
cagaccucugugaagcc

SEQ ID NO: 700675 - RNA, 22 nt, Human
gcagagugaggaagagcuucca

SEQ ID NO: 700676 - RNA, 22 nt, Human
gucuggaggaaaagguuaaaug

SEQ ID NO: 700677 - RNA, 22 nt, Human
uuccuucuccagaacuucuagg

SEQ ID NO: 700678 - RNA, 22 nt, Human
uucacaauagcuggcaucaucu

SEQ ID NO: 700679 - RNA, 22 nt, Human
aacaguauggaagccauuagga

SEQ ID NO: 700680 - RNA, 22 nt, Human
accaggagguguuugcucaagu

SEQ ID NO: 700681 - RNA, 22 nt, Human
uccaacuuucuccuccggcuug

SEQ ID NO: 700682 - RNA, 20 nt, Human
gcuucaaagccauccuuuua

SEQ ID NO: 700683 - RNA, 22 nt, Human
ugugaaaagcguguguucuagg

SEQ ID NO: 700684 - RNA, 22 nt, Human
auguuaugacaagcaugacaga

SEQ ID NO: 700685 - RNA, 22 nt, Human
cauucugugauucuaaaucccu

SEQ ID NO: 700686 - RNA, 22 nt, Human
acuucacaacuguacauggcag

SEQ ID NO: 700687 - RNA, 22 nt, Human
ucaggagcugcacugggcccac

SEQ ID NO: 700688 - RNA, 22 nt, Human
auuguacuuuuauuacauguag

SEQ ID NO: 700689 - RNA, 22 nt, Human
acaguccuaagauaauugucuc

SEQ ID NO: 700690 - RNA, 22 nt, Human
caucucuucauuagcauuauug

SEQ ID NO: 700691 - RNA, 22 nt, Human
uucaucuguagcaucuuccaau

SEQ ID NO: 700692 - RNA, 22 nt, Human
acacugugugacuucugagacu

SEQ ID NO: 700693 - RNA, 22 nt, Human
auguuucagggugauagaaggu

SEQ ID NO: 700694 - RNA, 20 nt, Human
uggcggggaugagggaguua

SEQ ID NO: 700695 - RNA, 22 nt, Human
uaggcacugggcuaggacaggu

SEQ ID NO: 700696 - RNA, 22 nt, Human
aagugucugcuggcucuacccu

SEQ ID NO: 700697 - RNA, 22 nt, Human
ugaaacauuauagaauauuuau

SEQ ID NO: 700698 - RNA, 22 nt, Human
ccagcaugagacgaugaugaag

SEQ ID NO: 700699 - RNA, 22 nt, Human
ccugugaggucaucugugguaa

SEQ ID NO: 700700 - RNA, 22 nt, Human
acacagcagaaggcccgugucu

SEQ ID NO: 700701 - RNA, 22 nt, Human
gugcauauaugcacauaugugu

SEQ ID NO: 700702 - RNA, 22 nt, Human
gaaugaacaaaugugguggaga

SEQ ID NO: 700703 - RNA, 22 nt, Human
gcagaaggauccgcaggugcaa

SEQ ID NO: 700704 - RNA, 22 nt, Human
uccagcagaaaagagguaggga

SEQ ID NO: 700705 - RNA, 22 nt, Human
aacucucuuuagagagggacaa

SEQ ID NO: 700706 - RNA, 22 nt, Human
uacaaucacccaaagagccaga

SEQ ID NO: 700707 - RNA, 22 nt, Human
gggaucugauuuaggaugggag

SEQ ID NO: 700708 - RNA, 22 nt, Human
caguggguaguggggauuagca

SEQ ID NO: 700709 - RNA, 22 nt, Human
auacaaugauaauaguacuuua

SEQ ID NO: 700710 - RNA, 22 nt, Human
agcuaggacagguagagauggg

SEQ ID NO: 700711 - RNA, 22 nt, Human
ugugagagcagaagacacauag

SEQ ID NO: 700712 - RNA, 22 nt, Human
ugccagggagcccugcugacca

SEQ ID NO: 700713 - RNA, 22 nt, Human
cuguguccucccgcugcaccca

SEQ ID NO: 700714 - RNA, 22 nt, Human
ucccacugucugucuugcugca

SEQ ID NO: 700715 - RNA, 22 nt, Human
cagucacauuucgacauaacua

SEQ ID NO: 700716 - RNA, 22 nt, Human
ugagagccaggaucugcucuau

SEQ ID NO: 700717 - RNA, 22 nt, Human
uagcuuaaggaguaccagauca

SEQ ID NO: 700718 - RNA, 18 nt, Human
aggagccuuugcacugga

SEQ ID NO: 700719 - RNA, 22 nt, Human
gcaggcacuccuaggaccauca

SEQ ID NO: 700720 - RNA, 22 nt, Human
ggccagcugccaccagcccuau

SEQ ID NO: 700721 - RNA, 22 nt, Human
gagaggcuccgccacugcucag

SEQ ID NO: 700722 - RNA, 22 nt, Human
cagaugaagaucauagaauagu

SEQ ID NO: 700723 - RNA, 22 nt, Human
ugcuggcaguggcagugauggu

SEQ ID NO: 700724 - RNA, 22 nt, Human
gaugagcauuguuucauguguu

SEQ ID NO: 700725 - RNA, 22 nt, Human
uucucacaauucuuguauuugc

SEQ ID NO: 700726 - RNA, 22 nt, Human
uuucacaaagcauagcacuuua

SEQ ID NO: 700727 - RNA, 22 nt, Human
uguaucuguaaucccagaucaa

SEQ ID NO: 700728 - RNA, 22 nt, Human
ggcagccaggaggguguaguuu

SEQ ID NO: 700729 - RNA, 22 nt, Human
gaaacauuuguugaguacuugc

SEQ ID NO: 700730 - RNA, 22 nt, Human
uuucgagggccuuaaguauucc

SEQ ID NO: 700731 - RNA, 22 nt, Human
cugggagacaagagagggcuga

SEQ ID NO: 700732 - RNA, 21 nt, Human
gcucuuggaaggggcucagcu

SEQ ID NO: 700733 - RNA, 22 nt, Human
agcagcaguacauauaagacua

SEQ ID NO: 700734 - RNA, 22 nt, Human
gcacuaaaccaacauguaauaa

SEQ ID NO: 700735 - RNA, 22 nt, Human
cagaagcagaacacuagauuua

SEQ ID NO: 700736 - RNA, 22 nt, Human
ugucugagcaccugugcugaac

SEQ ID NO: 700737 - RNA, 22 nt, Human
ugacccuuagugaacauuagaa

SEQ ID NO: 700738 - RNA, 17 nt, Human
gggcuuuagguggugua

SEQ ID NO: 700739 - RNA, 22 nt, Human
gcauacauugcacccugguagu

SEQ ID NO: 700740 - RNA, 22 nt, Human
aguccaugguucugacucaucu

SEQ ID NO: 700741 - RNA, 22 nt, Human
uuuuguaagaaacugccaagcc

SEQ ID NO: 700742 - RNA, 22 nt, Human
gucugggccaggcgagccgagg

SEQ ID NO: 700743 - RNA, 22 nt, Human
uggucugauggucccaccaccg

SEQ ID NO: 700744 - RNA, 22 nt, Human
acaggguugaagagcauaaagu

SEQ ID NO: 700745 - RNA, 22 nt, Human
gggcacaugcuuagggaggaaa

SEQ ID NO: 700746 - RNA, 22 nt, Human
ccucacccacuacacucaaggg

SEQ ID NO: 700747 - RNA, 22 nt, Human
cuucacauuaguuuggaucaaa

SEQ ID NO: 700748 - RNA, 22 nt, Human
uccucaggaugugggguagaau

SEQ ID NO: 700749 - RNA, 22 nt, Human
uggcuucugggacuugugagca

SEQ ID NO: 700750 - RNA, 22 nt, Human
ucuagguuagaacccagaaaag

SEQ ID NO: 700751 - RNA, 22 nt, Human
agagcaggcauaaagcuuugaa

SEQ ID NO: 700752 - RNA, 22 nt, Human
cagggccucugugggcucucuc

SEQ ID NO: 700753 - RNA, 22 nt, Human
uauugguguacuuauagcagag

SEQ ID NO: 700754 - RNA, 22 nt, Human
uuuauuaauguagcauccaugg

SEQ ID NO: 700755 - RNA, 19 nt, Human
guccaguguuuuccaguca

SEQ ID NO: 700756 - RNA, 22 nt, Human
cugagcugggcaacucuuagau

SEQ ID NO: 700757 - RNA, 22 nt, Human
acaugcuaugagagauuacuuc

SEQ ID NO: 700758 - RNA, 22 nt, Human
gagugccaagagaagaggcugg

SEQ ID NO: 700759 - RNA, 22 nt, Human
gcccuucacgaugguaucuuag

SEQ ID NO: 700760 - RNA, 22 nt, Human
acauuucuaauuuaauguaaca

SEQ ID NO: 700761 - RNA, 22 nt, Human
aaauucuggccuaucacaguga

SEQ ID NO: 700762 - RNA, 22 nt, Human
caagcauacucauuccagacuc

SEQ ID NO: 700763 - RNA, 22 nt, Human
aggcuggcgacaucuggcgggc

SEQ ID NO: 700764 - RNA, 22 nt, Human
uugaaguucugcauuucuaaua

SEQ ID NO: 700765 - RNA, 22 nt, Human
uagcagcuggggcuauucauca

SEQ ID NO: 700766 - RNA, 22 nt, Human
uuuugcagccacaucugaccug

SEQ ID NO: 700767 - RNA, 22 nt, Human
caggaagcacagugaggagacc

SEQ ID NO: 700768 - RNA, 22 nt, Human
ucagacuugccuuuuuauaaaa

SEQ ID NO: 700769 - RNA, 22 nt, Human
cgcaggcaagagaguacaguua

SEQ ID NO: 700770 - RNA, 22 nt, Human
gugaacaguucauuuuaucaug

SEQ ID NO: 700771 - RNA, 22 nt, Human
aagagcuuggacuuucaaguca

SEQ ID NO: 700772 - RNA, 22 nt, Human
gauauuuaacucucacaggucc

SEQ ID NO: 700773 - RNA, 22 nt, Human
caacuccuggcuguuaggcaca

SEQ ID NO: 700774 - RNA, 22 nt, Human
ugugcgcuccggcgagucagcg

SEQ ID NO: 700775 - RNA, 19 nt, Human
aaugccucaaauugggaga

SEQ ID NO: 700776 - RNA, 16 nt, Human
ggcagcagcuccgugc

SEQ ID NO: 700777 - RNA, 22 nt, Human
guggccucaugucuauaaagag

SEQ ID NO: 700778 - RNA, 21 nt, Human
uaauauagguucacaacuagu

SEQ ID NO: 700779 - RNA, 22 nt, Human
cuugcaugcauuugaagaucau

SEQ ID NO: 700780 - RNA, 22 nt, Human
aaggcacuuuuccugagaugau

SEQ ID NO: 700781 - RNA, 22 nt, Human
gcagggcugcugaaacuuguuu

SEQ ID NO: 700782 - RNA, 22 nt, Human
ucuucagcaacuccccaaucug

SEQ ID NO: 700783 - RNA, 22 nt, Human
ggaggaguguggggcacucugc

SEQ ID NO: 700784 - RNA, 22 nt, Human
auuuacagaugaugcuauuuga

SEQ ID NO: 700785 - RNA, 20 nt, Human
uguauucuuugcucuccacu

SEQ ID NO: 700786 - RNA, 22 nt, Human
ggcugagccuggagcaucuggu

SEQ ID NO: 700787 - RNA, 22 nt, Human
uuuaggauaacuccaguuuucc

SEQ ID NO: 700788 - RNA, 22 nt, Human
acaguucugaagacuagagccu

SEQ ID NO: 700789 - RNA, 19 nt, Human
cuuggcaucugugaaguga

SEQ ID NO: 700790 - RNA, 22 nt, Human
aacuguagaagggacacaaaag

SEQ ID NO: 700791 - RNA, 22 nt, Human
ggucccaaggaggaugaggcua

SEQ ID NO: 700792 - RNA, 22 nt, Human
gcugugagccgcugcugagcau

SEQ ID NO: 700793 - RNA, 22 nt, Human
uuucuguaauuaaaagggcagg

SEQ ID NO: 700794 - RNA, 22 nt, Human
gcuggggacuccccaccauagc

SEQ ID NO: 700795 - RNA, 22 nt, Human
cugcuccaagccagcccugcag

SEQ ID NO: 700796 - RNA, 22 nt, Human
cuucaugguaaaucugccuuua

SEQ ID NO: 700797 - RNA, 22 nt, Human
agcugggugcgguggcucaugc

SEQ ID NO: 700798 - RNA, 22 nt, Human
ucaggucuugagccaucaggau

SEQ ID NO: 700799 - RNA, 18 nt, Human
ucagggaagagaauauga

SEQ ID NO: 700800 - RNA, 22 nt, Human
ucagaggaacacuguuucaugc

SEQ ID NO: 700801 - RNA, 22 nt, Human
aggcaaagaggauauuuugggg

SEQ ID NO: 700802 - RNA, 22 nt, Human
guccucuggagguuuuuaggug

SEQ ID NO: 700803 - RNA, 23 nt, Human
gcacugccaugugcucugcaggc

SEQ ID NO: 700804 - RNA, 22 nt, Human
ucucucuucaugcuuuuagaau

SEQ ID NO: 700805 - RNA, 19 nt, Human
uuuagcuuacguuucauug

SEQ ID NO: 700806 - RNA, 22 nt, Human
ucucugugaagcucccguuagg

SEQ ID NO: 700807 - RNA, 22 nt, Human
gggaacacagacuugaugauga

SEQ ID NO: 700808 - RNA, 22 nt, Human
agccagcuggugggucagcugg

SEQ ID NO: 700809 - RNA, 22 nt, Human
auguuauucaauuugaauccaa

SEQ ID NO: 700810 - RNA, 22 nt, Human
accagcucuggacaggcauuuc

SEQ ID NO: 700811 - RNA, 22 nt, Human
auggcagggcagccucucagag

SEQ ID NO: 700812 - RNA, 22 nt, Human
gaggaggggacaguacuugugc

SEQ ID NO: 700813 - RNA, 22 nt, Human
uugauguugcucuuaacaguau

SEQ ID NO: 700814 - RNA, 22 nt, Human
gcuggccauggggagugaggag

SEQ ID NO: 700815 - RNA, 22 nt, Human
agcagcagggcaugucuuacuc

SEQ ID NO: 700816 - RNA, 22 nt, Human
cuuauuuacugauccacagaug

SEQ ID NO: 700817 - RNA, 21 nt, Human
ucuuuccaauauucaugucuc

SEQ ID NO: 700818 - RNA, 22 nt, Human
cuaguugaagaggcugucauca

SEQ ID NO: 700819 - RNA, 22 nt, Human
acaaagucaaauugcagccgcc

SEQ ID NO: 700820 - RNA, 22 nt, Human
guguguucagcaagagguaagg

SEQ ID NO: 700821 - RNA, 22 nt, Human
gccagauuuacagauuugcccu

SEQ ID NO: 700822 - RNA, 22 nt, Human
cacagggcuuugauggcugagu

SEQ ID NO: 700823 - RNA, 22 nt, Human
gaccucucaggaaucucacaug

SEQ ID NO: 700824 - RNA, 22 nt, Human
agugguaacuaaguccugcuua

SEQ ID NO: 700825 - RNA, 22 nt, Human
gaccagucauuacucaugcccu

SEQ ID NO: 700826 - RNA, 22 nt, Human
aggagcccugcgggaggcagag

SEQ ID NO: 700827 - RNA, 22 nt, Human
cccacaggcaggggcagagaca

SEQ ID NO: 700828 - RNA, 22 nt, Human
uuaugucaaaaugguugagauu

SEQ ID NO: 700829 - RNA, 21 nt, Human
cauuugaucccucaucaggau

SEQ ID NO: 700830 - RNA, 22 nt, Human
ugcccugcuguggcucugccca

SEQ ID NO: 700831 - RNA, 22 nt, Human
cagcugggccuccugagcccug

SEQ ID NO: 700832 - RNA, 22 nt, Human
uaucuuuagaggaagagaaucu

SEQ ID NO: 700833 - RNA, 22 nt, Human
gaguaauuuauccagugaagua

SEQ ID NO: 700834 - RNA, 22 nt, Human
agccuggccugggcaggcacau

SEQ ID NO: 700835 - RNA, 22 nt, Human
guggggggacguuggucacuuu

SEQ ID NO: 700836 - RNA, 22 nt, Human
aguccccucucgcuuggcugag

SEQ ID NO: 700837 - RNA, 22 nt, Human
cacacagaaccgcucgccacuu

SEQ ID NO: 700838 - RNA, 22 nt, Human
uguugugacccagaccaagaag

SEQ ID NO: 700839 - RNA, 22 nt, Human
guggccuugggcacugaccuug

SEQ ID NO: 700840 - RNA, 22 nt, Human
ucugcagacaggaagcugaggc

SEQ ID NO: 700841 - RNA, 22 nt, Human
aaagcuguagaaucaucuuaau

SEQ ID NO: 700842 - RNA, 22 nt, Human
agugugagaacggacuaauaaa

SEQ ID NO: 700843 - RNA, 22 nt, Human
gcugaaauucagauuccuaggc

SEQ ID NO: 700844 - RNA, 22 nt, Human
gucucaguuguaucaccugguu

SEQ ID NO: 700845 - RNA, 22 nt, Human
ggcuggucccggguccuccggc

SEQ ID NO: 700846 - RNA, 22 nt, Human
uucugcaucugaauuuaaguac

SEQ ID NO: 700847 - RNA, 22 nt, Human
uucuuuuaaugucuggcuuuca

SEQ ID NO: 700848 - RNA, 17 nt, Human
uuauugucaagguucca

SEQ ID NO: 700849 - RNA, 22 nt, Human
cacuggaagagcaucugagcca

SEQ ID NO: 700850 - RNA, 22 nt, Human
ucucugaaggggagcuguuuaa

SEQ ID NO: 700851 - RNA, 22 nt, Human
cugcccacuauguugucauggg

SEQ ID NO: 700852 - RNA, 22 nt, Human
uuugcauucuagaaaaauuucu

SEQ ID NO: 700853 - RNA, 22 nt, Human
uggcccugucccuggagccugg

SEQ ID NO: 700854 - RNA, 23 nt, Human
cugggcacccaguaccuaggccc

SEQ ID NO: 700855 - RNA, 22 nt, Human
ucagcagagcgagaccaaguca

SEQ ID NO: 700856 - RNA, 19 nt, Human
aggauggagcaggcgguga

SEQ ID NO: 700857 - RNA, 22 nt, Human
cuguuaaucugcuugcaugaug

SEQ ID NO: 700858 - RNA, 22 nt, Human
gugcuguucuggcugccaccac

SEQ ID NO: 700859 - RNA, 22 nt, Human
aggcaggaggaucauggaugca

SEQ ID NO: 700860 - RNA, 22 nt, Human
cauugacaucaggcuuggccaa

SEQ ID NO: 700861 - RNA, 22 nt, Human
aaucaagaaaaugaggauucuu

SEQ ID NO: 700862 - RNA, 18 nt, Human
uuccaguagcuguaucac

SEQ ID NO: 700863 - RNA, 22 nt, Human
gagggcuccacacgggcccagc

SEQ ID NO: 700864 - RNA, 22 nt, Human
uuugucuuuccccuccucauug

SEQ ID NO: 700865 - RNA, 22 nt, Human
aacugcuugaugaagcucccac

SEQ ID NO: 700866 - RNA, 22 nt, Human
caagcucugcgggcuccaagau

SEQ ID NO: 700867 - RNA, 21 nt, Human
agugucauucccaagcuguga

SEQ ID NO: 700868 - RNA, 22 nt, Human
agcuuuauauaaaagaguacau

SEQ ID NO: 700869 - RNA, 22 nt, Human
caagccugucucaccagugcua

SEQ ID NO: 700870 - RNA, 22 nt, Human
uuucuuuugcugagaggggcac

SEQ ID NO: 700871 - RNA, 22 nt, Human
uuaaauuuuagaaacagacucu

SEQ ID NO: 700872 - RNA, 22 nt, Human
ugacucaggaggaaagacucca

SEQ ID NO: 700873 - RNA, 22 nt, Human
ccuggacuaaaaucuuuucuua

SEQ ID NO: 700874 - RNA, 22 nt, Human
gugaggagcucuuugacucacg

SEQ ID NO: 700875 - RNA, 22 nt, Human
uuucaaagacagccauauuugu

SEQ ID NO: 700876 - RNA, 22 nt, Human
ccugagagccagugccugccca

SEQ ID NO: 700877 - RNA, 22 nt, Human
aacaugagcauucuugugcuug

SEQ ID NO: 700878 - RNA, 22 nt, Human
uguggcaggcaagauguacaga

SEQ ID NO: 700879 - RNA, 22 nt, Human
caggcagaugcugacaagaguu

SEQ ID NO: 700880 - RNA, 22 nt, Human
uauuuacuuuuaaauugagaac

SEQ ID NO: 700881 - RNA, 22 nt, Human
cugaggccgucugggucugcag

SEQ ID NO: 700882 - RNA, 22 nt, Human
caggccggccggccccagcucu

SEQ ID NO: 700883 - RNA, 22 nt, Human
uugaaugaauucuacuuccaga

SEQ ID NO: 700884 - RNA, 22 nt, Human
auggcccugaccuugaugaccu

SEQ ID NO: 700885 - RNA, 20 nt, Human
agugucuggugcagggccuc

SEQ ID NO: 700886 - RNA, 22 nt, Human
auggcuucucgcuggcaccugu

SEQ ID NO: 700887 - RNA, 22 nt, Human
uccugggcuuuguuucucuccu

SEQ ID NO: 700888 - RNA, 22 nt, Human
guguaaacaaugaaaacagagc

SEQ ID NO: 700889 - RNA, 21 nt, Human
cagcagaguaaugcauucgua

SEQ ID NO: 700890 - RNA, 22 nt, Human
gaggaggcuaagugggcucugg

SEQ ID NO: 700891 - RNA, 22 nt, Human
agguauagaauugaaaggguuu

SEQ ID NO: 700892 - RNA, 22 nt, Human
gcuggggccugaacagucagcu

SEQ ID NO: 700893 - RNA, 22 nt, Human
uuaacagagaacauagaaguag

SEQ ID NO: 700894 - RNA, 22 nt, Human
gggaucuggaauuuugguaugu

SEQ ID NO: 700895 - RNA, 19 nt, Human
ggaguuuccaauggguaaa

SEQ ID NO: 700896 - RNA, 22 nt, Human
aucagaaaauacccaguguuua

SEQ ID NO: 700897 - RNA, 22 nt, Human
aaauuuaaaaagcagcauugca

SEQ ID NO: 700898 - RNA, 22 nt, Human
aaaguacaauauugagauugau

SEQ ID NO: 700899 - RNA, 20 nt, Human
gugaagggagucaggugugc

SEQ ID NO: 700900 - RNA, 22 nt, Human
cuguuuaucucuaaccuguuua

SEQ ID NO: 700901 - RNA, 22 nt, Human
uuacaugguaaacacucuuuua

SEQ ID NO: 700902 - RNA, 22 nt, Human
cugacagucucauugauuugcu

SEQ ID NO: 700903 - RNA, 22 nt, Human
aggaaagggguagguguggacg

SEQ ID NO: 700904 - RNA, 22 nt, Human
acucuguaauucuauaugcagu

SEQ ID NO: 700905 - RNA, 22 nt, Human
ggucuggccuggcauucuaugg

SEQ ID NO: 700906 - RNA, 22 nt, Human
ggcacagagcaggccacuaauc

SEQ ID NO: 700907 - RNA, 22 nt, Human
ugaggguaaccuggagcugcug

SEQ ID NO: 700908 - RNA, 22 nt, Human
gaagcacacugauuuuauuucu

SEQ ID NO: 700909 - RNA, 22 nt, Human
cagugggaaugaaguggaggcc

SEQ ID NO: 700910 - RNA, 22 nt, Human
uaaagaauagauggguagggag

SEQ ID NO: 700911 - RNA, 22 nt, Human
gcugcugccgcggccgcuggga

SEQ ID NO: 700912 - RNA, 22 nt, Human
ucagccagugccuugaucuugc

SEQ ID NO: 700913 - RNA, 22 nt, Human
caugugugagugagcagucuuc

SEQ ID NO: 700914 - RNA, 22 nt, Human
uuggaaucauucuuaaaggucu

SEQ ID NO: 700915 - RNA, 22 nt, Human
uguaaacuguagaaaauacuuu

SEQ ID NO: 700916 - RNA, 22 nt, Human
aaggcuaugaucuuuuucauga

SEQ ID NO: 700917 - RNA, 22 nt, Human
cugccuggagcauucugaaggu

SEQ ID NO: 700918 - RNA, 22 nt, Human
uccugcuggacucugaguacaa

SEQ ID NO: 700919 - RNA, 22 nt, Human
gcugagcugcuguucauccugc

SEQ ID NO: 700920 - RNA, 22 nt, Human
gauuuuuauauaaagugagaaa

SEQ ID NO: 700921 - RNA, 21 nt, Human
cagugcugccuaauagggagu

SEQ ID NO: 700922 - RNA, 22 nt, Human
cacugccuggaaggagagacau

SEQ ID NO: 700923 - RNA, 22 nt, Human
ccagagcccagggucaugcagg

SEQ ID NO: 700924 - RNA, 22 nt, Human
gccaugccugugucuccaggcc

SEQ ID NO: 700925 - RNA, 22 nt, Human
ggcagccagcaaugagaaguuu

SEQ ID NO: 700926 - RNA, 22 nt, Human
ugcagcugcaggagggugggag

SEQ ID NO: 700927 - RNA, 19 nt, Human
cugucaggggcuggauguu

SEQ ID NO: 700928 - RNA, 20 nt, Human
cuuguacaugauaaagauuu

SEQ ID NO: 700929 - RNA, 22 nt, Human
ucucaucuuguucaucuacccu

SEQ ID NO: 700930 - RNA, 22 nt, Human
auaaacagaguaguugcuacug

SEQ ID NO: 700931 - RNA, 22 nt, Human
ugaaugaugguguguucuugcc

SEQ ID NO: 700932 - RNA, 22 nt, Human
ccugucuguaucgguucagagu

SEQ ID NO: 700933 - RNA, 22 nt, Human
ggaaggggagcuggaaagggua

SEQ ID NO: 700934 - RNA, 22 nt, Human
auguggccagucauguaguaac

SEQ ID NO: 700935 - RNA, 21 nt, Human
gcuccuggugcugcguggcgc

SEQ ID NO: 700936 - RNA, 22 nt, Human
cuuggagagugguuaucccugu

SEQ ID NO: 700937 - RNA, 22 nt, Human
aaauuuuaguaaggaaguugag

SEQ ID NO: 700938 - RNA, 22 nt, Human
aauacuugucagaugaauaaga

SEQ ID NO: 700939 - RNA, 22 nt, Human
gugaaggacugaaugaaaaugu

SEQ ID NO: 700940 - RNA, 22 nt, Human
acugaaauauuuagaagugaag

SEQ ID NO: 700941 - RNA, 22 nt, Human
gcaacugugauuuguuaucuug

SEQ ID NO: 700942 - RNA, 22 nt, Human
accuaaaucuaccucauguuuu

SEQ ID NO: 700943 - RNA, 22 nt, Human
aagcuggccucaaacuccuagc

SEQ ID NO: 700944 - RNA, 22 nt, Human
ccuccagaggguuucccaugaa

SEQ ID NO: 700945 - RNA, 22 nt, Human
gggcucugugcaccccagcacc

SEQ ID NO: 700946 - RNA, 22 nt, Human
auguggcuaguccucugcggca

SEQ ID NO: 700947 - RNA, 21 nt, Human
uaacaaagacuucuggucagg

SEQ ID NO: 700948 - RNA, 22 nt, Human
gugcuuuaccuuauuggucucg

SEQ ID NO: 700949 - RNA, 22 nt, Human
cggcagagcggcgagccccucc

SEQ ID NO: 700950 - RNA, 22 nt, Human
gcacaugacaguaaguagagca

SEQ ID NO: 700951 - RNA, 22 nt, Human
cagagacauuaagugccaugau

SEQ ID NO: 700952 - RNA, 16 nt, Human
ugguggggaggacagc

SEQ ID NO: 700953 - RNA, 18 nt, Human
agcuggugaaauccagua

SEQ ID NO: 700954 - RNA, 22 nt, Human
aagagguaaccauagcaaccac

SEQ ID NO: 700955 - RNA, 22 nt, Human
ccagagccggcucccucagcuu

SEQ ID NO: 700956 - RNA, 19 nt, Human
uccccaagaguucuagcuc

SEQ ID NO: 700957 - RNA, 22 nt, Human
aguggcagacacaaugugggca

SEQ ID NO: 700958 - RNA, 23 nt, Human
ggagcccugagcuguccccaugc

SEQ ID NO: 700959 - RNA, 22 nt, Human
cugucuguggucucaguaggcc

SEQ ID NO: 700960 - RNA, 19 nt, Human
cugaggugaggggcaucau

SEQ ID NO: 700961 - RNA, 22 nt, Human
agugcaaaauucagaagcaauu

SEQ ID NO: 700962 - RNA, 22 nt, Human
guacaggcagcaaacaccauaa

SEQ ID NO: 700963 - RNA, 22 nt, Human
cuccagaggcccuaucccacua

SEQ ID NO: 700964 - RNA, 23 nt, Human
cccagcugcagacaagggagggu

SEQ ID NO: 700965 - RNA, 19 nt, Human
aucugccuuagugcugcug

SEQ ID NO: 700966 - RNA, 22 nt, Human
acagaugaauuuuaauuguguu

SEQ ID NO: 700967 - RNA, 22 nt, Human
gugcuggcccuguccucgagcu

SEQ ID NO: 700968 - RNA, 22 nt, Human
gcaaagcaagauucagauguag

SEQ ID NO: 700969 - RNA, 22 nt, Human
uguuuuauauaagcagagcggu

SEQ ID NO: 700970 - RNA, 22 nt, Human
aaagaaguguugaauuugcaag

SEQ ID NO: 700971 - RNA, 22 nt, Human
uucagugucaauuuuuaaauau

SEQ ID NO: 700972 - RNA, 22 nt, Human
ccuuccuggcuguccgccugau

SEQ ID NO: 700973 - RNA, 22 nt, Human
uucacagguugaagccuaaucc

SEQ ID NO: 700974 - RNA, 22 nt, Human
uugugauaaaacauuagacauu

SEQ ID NO: 700975 - RNA, 22 nt, Human
ucuaugucagcaucuuucuacc

SEQ ID NO: 700976 - RNA, 22 nt, Human
uuacaagauaacggagaaagca

SEQ ID NO: 700977 - RNA, 22 nt, Human
gguggcacacuggggagcucgg

SEQ ID NO: 700978 - RNA, 22 nt, Human
acccagggcucaagcguaggca

SEQ ID NO: 700979 - RNA, 22 nt, Human
cggcagugggcgccaggucucc

SEQ ID NO: 700980 - RNA, 19 nt, Human
uaaaaacugaaggaagcag

SEQ ID NO: 700981 - RNA, 22 nt, Human
auggcugggaggagaguaugau

SEQ ID NO: 700982 - RNA, 22 nt, Human
uuuccagggaggaauguggggu

SEQ ID NO: 700983 - RNA, 19 nt, Human
uuuuaaguccucucuauuc

SEQ ID NO: 700984 - RNA, 22 nt, Human
gggaaggcauaccugagggaga

SEQ ID NO: 700985 - RNA, 22 nt, Human
cugucccuucauuauucacuac

SEQ ID NO: 700986 - RNA, 22 nt, Human
uucccucccccagccuggcagg

SEQ ID NO: 700987 - RNA, 22 nt, Human
acacauaugguugguaggaguu

SEQ ID NO: 700988 - RNA, 22 nt, Human
ucagccugcgucauggugacac

SEQ ID NO: 700989 - RNA, 22 nt, Human
ugcuccagccccuggugcacag

SEQ ID NO: 700990 - RNA, 22 nt, Human
gagcuucucaacaguuaucucu

SEQ ID NO: 700991 - RNA, 22 nt, Human
ccaccaggcacucacagggaag

SEQ ID NO: 700992 - RNA, 22 nt, Human
ccaggcagccugcuccauucug

SEQ ID NO: 700993 - RNA, 22 nt, Human
ggcggggguccaggagccugca

SEQ ID NO: 700994 - RNA, 22 nt, Human
uuucaguuuaugucuugaauua

SEQ ID NO: 700995 - RNA, 22 nt, Human
cccugagucaucauugcggaag

SEQ ID NO: 700996 - RNA, 15 nt, Human
uccaggcauucauuc

SEQ ID NO: 700997 - RNA, 22 nt, Human
ggugucucagcugcuggcaggg

SEQ ID NO: 700998 - RNA, 22 nt, Human
acugaaggaagcgggcaggggu

SEQ ID NO: 700999 - RNA, 22 nt, Human
ccacacuggcaugggauggagg

SEQ ID NO: 701000 - RNA, 22 nt, Human
gcagauggugccaugucuugug

SEQ ID NO: 701001 - RNA, 22 nt, Human
uuauuuggaaauauggcuucug

SEQ ID NO: 701002 - RNA, 22 nt, Human
gcugggagaggcagcuuucgga

SEQ ID NO: 701003 - RNA, 22 nt, Human
uauggcuucugcuuucuugacu

SEQ ID NO: 701004 - RNA, 22 nt, Human
uggcccugacugauguggaggg

SEQ ID NO: 701005 - RNA, 19 nt, Human
cagaggugauauaugccca

SEQ ID NO: 701006 - RNA, 22 nt, Human
aucuggaagccagauacucagu

SEQ ID NO: 701007 - RNA, 22 nt, Human
caguucagcuagaagaaacaaa

SEQ ID NO: 701008 - RNA, 22 nt, Human
cagggagcagcgcuggggccuc

SEQ ID NO: 701009 - RNA, 23 nt, Human
aaaguugauuugcaguuuaagag

SEQ ID NO: 701010 - RNA, 22 nt, Human
acucuucacacaugcugcccuc

SEQ ID NO: 701011 - RNA, 22 nt, Human
uuccagucuaguaccuggaugc

SEQ ID NO: 701012 - RNA, 22 nt, Human
ucucaggcccacuguguugaaa

SEQ ID NO: 701013 - RNA, 22 nt, Human
uucugcuccaccacuuccagca

SEQ ID NO: 701014 - RNA, 22 nt, Human
uccugccugagcguggaggagg

SEQ ID NO: 701015 - RNA, 22 nt, Human
ugccucgugucugagucuguuc

SEQ ID NO: 701016 - RNA, 22 nt, Human
aagagccaagcagucaucaaua

SEQ ID NO: 701017 - RNA, 22 nt, Human
aaguauucauaaggacauaugu

SEQ ID NO: 701018 - RNA, 22 nt, Human
gacagacacaauugauccauga

SEQ ID NO: 701019 - RNA, 22 nt, Human
caggccuugucaagaaaaugcc

SEQ ID NO: 701020 - RNA, 22 nt, Human
uuauuuggauuuagcuuaucaa

SEQ ID NO: 701021 - RNA, 22 nt, Human
ucagaacauccugguuuaaaau

SEQ ID NO: 701022 - RNA, 22 nt, Human
ugggaagggccugcccuuccuc

SEQ ID NO: 701023 - RNA, 22 nt, Human
aggaagacaaucugugugcugu

SEQ ID NO: 701024 - RNA, 22 nt, Human
gaguuuguaaacuauucacuaa

SEQ ID NO: 701025 - RNA, 22 nt, Human
ugcaugcuccacagcccauuca

SEQ ID NO: 701026 - RNA, 22 nt, Human
guugggcugggagcugcccuga

SEQ ID NO: 701027 - RNA, 22 nt, Human
uugaggagcacuagucagguau

SEQ ID NO: 701028 - RNA, 22 nt, Human
ugcugcaggaauucucaaggga

SEQ ID NO: 701029 - RNA, 20 nt, Human
cucacagucaaugcagaggu

SEQ ID NO: 701030 - RNA, 22 nt, Human
uaucaaaggcuaugugauuuuu

SEQ ID NO: 701031 - RNA, 22 nt, Human
acuggcagccacaacuggcagg

SEQ ID NO: 701032 - RNA, 22 nt, Human
ccccaacccugguuccguggcg

SEQ ID NO: 701033 - RNA, 22 nt, Human
cugcagaugguauuguucuggu

SEQ ID NO: 701034 - RNA, 22 nt, Human
uugacacaauguauauuuucaa

SEQ ID NO: 701035 - RNA, 22 nt, Human
auuuuccuucuaagaggaaggu

SEQ ID NO: 701036 - RNA, 22 nt, Human
uccugcagugugucuccugcac

SEQ ID NO: 701037 - RNA, 22 nt, Human
cugagucucccggcaguggagg

SEQ ID NO: 701038 - RNA, 22 nt, Human
ucuggugucaguauucuuugaa

SEQ ID NO: 701039 - RNA, 22 nt, Human
ucagaggaaucuguacuugaaa

SEQ ID NO: 701040 - RNA, 22 nt, Human
ugggcuuugagcucggucaccu

SEQ ID NO: 701041 - RNA, 22 nt, Human
acacaauguaccauaucuccaa

SEQ ID NO: 701042 - RNA, 22 nt, Human
ccaagggcugcugaggugucca

SEQ ID NO: 701043 - RNA, 22 nt, Human
ccuugguccaacccugcacagc

SEQ ID NO: 701044 - RNA, 22 nt, Human
uggcugugguuuaucccaguuc

SEQ ID NO: 701045 - RNA, 22 nt, Human
uuauucagauuggcuacaggau

SEQ ID NO: 701046 - RNA, 22 nt, Human
auguuauuuauugaaacacuuu

SEQ ID NO: 701047 - RNA, 22 nt, Human
cauaauccuugauucaaauaau

SEQ ID NO: 701048 - RNA, 22 nt, Human
acuugauuuugaaccuuucuac

SEQ ID NO: 701049 - RNA, 22 nt, Human
gucagcacuuuuccgaggcaga

SEQ ID NO: 701050 - RNA, 22 nt, Human
ucauauuuaguucacgcucaau

SEQ ID NO: 701051 - RNA, 22 nt, Human
gcucuaaagaacccagaggagu

SEQ ID NO: 701052 - RNA, 22 nt, Human
guccucuguuuccaucugacuu

SEQ ID NO: 701053 - RNA, 22 nt, Human
gcuccagagcagagacuagguu

SEQ ID NO: 701054 - RNA, 22 nt, Human
gaagagcauaugaagagcauau

SEQ ID NO: 701055 - RNA, 22 nt, Human
gcagugggaagguuggcacaug

SEQ ID NO: 701056 - RNA, 22 nt, Human
cugcugacagcccugcuucagg

SEQ ID NO: 701057 - RNA, 22 nt, Human
uucagugccuguccacagcuuc

SEQ ID NO: 701058 - RNA, 22 nt, Human
gagcuggcugugguugagugca

SEQ ID NO: 701059 - RNA, 22 nt, Human
gcccaugguccaggaagacaga

SEQ ID NO: 701060 - RNA, 18 nt, Human
ucugucucuguccuugcu

SEQ ID NO: 701061 - RNA, 22 nt, Human
gggcucuguccauuccuucaua

SEQ ID NO: 701062 - RNA, 22 nt, Human
uggacacaauguugccuuaggg

SEQ ID NO: 701063 - RNA, 22 nt, Human
cugugagaugaccaacugacug

SEQ ID NO: 701064 - RNA, 22 nt, Human
auuagugucugugaauaauucu

SEQ ID NO: 701065 - RNA, 22 nt, Human
acaaugucucauauucguguuc

SEQ ID NO: 701066 - RNA, 22 nt, Human
agggagaaaauuggaugcacaa

SEQ ID NO: 701067 - RNA, 22 nt, Human
uccugcagcauccgucgucugu

SEQ ID NO: 701068 - RNA, 22 nt, Human
cugugagucuucagcaaguguu

SEQ ID NO: 701069 - RNA, 22 nt, Human
ccagcuucaugggcaugcacca

SEQ ID NO: 701070 - RNA, 22 nt, Human
aaggcacagccacuugaucauc

SEQ ID NO: 701071 - RNA, 22 nt, Human
aaaauccucuaauucuagaaua

SEQ ID NO: 701072 - RNA, 23 nt, Human
gucccucaccccuaggcaaugcc

SEQ ID NO: 701073 - RNA, 22 nt, Human
gggcuucuugccauggggacgg

SEQ ID NO: 701074 - RNA, 22 nt, Human
aguugacaauaaauuuaauugg

SEQ ID NO: 701075 - RNA, 22 nt, Human
aaggaaagauucucucucuaga

SEQ ID NO: 701076 - RNA, 22 nt, Human
gguguggcaguggaccugugaa

SEQ ID NO: 701077 - RNA, 22 nt, Human
acaagcgggccacagugcuggu

SEQ ID NO: 701078 - RNA, 22 nt, Human
gccuucccuggcuaggcaagca

SEQ ID NO: 701079 - RNA, 22 nt, Human
uuugucaccaguggcuuuggua

SEQ ID NO: 701080 - RNA, 18 nt, Human
ggcuucucacugaccuca

SEQ ID NO: 701081 - RNA, 22 nt, Human
aacuagaacgagaaagcugaac

SEQ ID NO: 701082 - RNA, 23 nt, Human
gcccagggacugggaaucagugg

SEQ ID NO: 701083 - RNA, 22 nt, Human
gcauuccuacaggcugcuauga

SEQ ID NO: 701084 - RNA, 21 nt, Human
acaguucugccggcaucuuuc

SEQ ID NO: 701085 - RNA, 22 nt, Human
uugcagggaccugcagaaagcu

SEQ ID NO: 701086 - RNA, 22 nt, Human
guguccagagaaacucacagcu

SEQ ID NO: 701087 - RNA, 22 nt, Human
ggggugcuagaguggggccacu

SEQ ID NO: 701088 - RNA, 22 nt, Human
ucagccaguuaaggcuuagaca

SEQ ID NO: 701089 - RNA, 22 nt, Human
gccacaggucggcuagaggguc

SEQ ID NO: 701090 - RNA, 22 nt, Human
caguacuuaguucucaugguuu

SEQ ID NO: 701091 - RNA, 22 nt, Human
cagauuucagcucauauauuau

SEQ ID NO: 701092 - RNA, 22 nt, Human
augagcaauuaggaagaaaaca

SEQ ID NO: 701093 - RNA, 22 nt, Human
aggcccuucuugguggcucagg

SEQ ID NO: 701094 - RNA, 22 nt, Human
uauuuggagccuauccauagau

SEQ ID NO: 701095 - RNA, 22 nt, Human
uggaaucccgcaauggaggauu

SEQ ID NO: 701096 - RNA, 22 nt, Human
ccaggcucuguuccccgaggag

SEQ ID NO: 701097 - RNA, 22 nt, Human
ggcggcuacuccuccuggugag

SEQ ID NO: 701098 - RNA, 22 nt, Human
uucucaaagggugguuugcaaa

SEQ ID NO: 701099 - RNA, 22 nt, Human
aaauugugagcuauagaucuag

SEQ ID NO: 701100 - RNA, 22 nt, Human
aaggcccucaugcgucagagcc

SEQ ID NO: 701101 - RNA, 22 nt, Human
cagcccugagaaggaggaucuc

SEQ ID NO: 701102 - RNA, 22 nt, Human
guacuuccguggacuaauuguu

SEQ ID NO: 701103 - RNA, 22 nt, Human
uuuagagcccaugugaguguga

SEQ ID NO: 701104 - RNA, 22 nt, Human
gaguguuccagaaacuggcccu

SEQ ID NO: 701105 - RNA, 22 nt, Human
uucagugcacaguacugagacu

SEQ ID NO: 701106 - RNA, 22 nt, Human
auacuucuuugauguucacagg

SEQ ID NO: 701107 - RNA, 22 nt, Human
gcccucuaccuuggcuauagaa

SEQ ID NO: 701108 - RNA, 22 nt, Human
aggcauccaugguggucgcuga

SEQ ID NO: 701109 - RNA, 22 nt, Human
caggcauggagaggcagagacu

SEQ ID NO: 701110 - RNA, 20 nt, Human
gcugugccuccagcuggugg

SEQ ID NO: 701111 - RNA, 22 nt, Human
agaugaagacucaggagcaggu

SEQ ID NO: 701112 - RNA, 22 nt, Human
agcuaguucacugaagccuaug

SEQ ID NO: 701113 - RNA, 22 nt, Human
auacugaugaugugaagaaaca

SEQ ID NO: 701114 - RNA, 18 nt, Human
ucagcuuuugaaaaccaa

SEQ ID NO: 701115 - RNA, 22 nt, Human
gacuggucuuuugugauggaug

SEQ ID NO: 701116 - RNA, 22 nt, Human
ugcaggcugcagucucaggugg

SEQ ID NO: 701117 - RNA, 22 nt, Human
ucucagagaugucaagagucua

SEQ ID NO: 701118 - RNA, 17 nt, Human
cacaugucuacauggau

SEQ ID NO: 701119 - RNA, 22 nt, Human
acaaugcucauauuuaugccaa

SEQ ID NO: 701120 - RNA, 22 nt, Human
aucaggauuacacggggaugcu

SEQ ID NO: 701121 - RNA, 22 nt, Human
ggugggcacccgagacuggauc

SEQ ID NO: 701122 - RNA, 22 nt, Human
ccugagagugagugccaccuua

SEQ ID NO: 701123 - RNA, 20 nt, Human
uucugcuugcaaauaucaag

SEQ ID NO: 701124 - RNA, 22 nt, Human
ucucuuagucuuauauguaaaa

SEQ ID NO: 701125 - RNA, 22 nt, Human
uacagcuugaugagagcgcgag

SEQ ID NO: 701126 - RNA, 22 nt, Human
agggcucugagugggaaagagg

SEQ ID NO: 701127 - RNA, 22 nt, Human
accugaauugucauaucuuauu

SEQ ID NO: 701128 - RNA, 22 nt, Human
ugaaggagcucaaugaugaugc

SEQ ID NO: 701129 - RNA, 22 nt, Human
aguggcugcuggaguggagaug

SEQ ID NO: 701130 - RNA, 22 nt, Human
uuguauuaauugaaaugaaugc

SEQ ID NO: 701131 - RNA, 22 nt, Human
caugugguucaaguacuccaca

SEQ ID NO: 701132 - RNA, 22 nt, Human
ucagaacauuuaaaaagugguu

SEQ ID NO: 701133 - RNA, 22 nt, Human
gugccuguaaguuguaugggcu

SEQ ID NO: 701134 - RNA, 22 nt, Human
ugcauuugaguugggagcaggc

SEQ ID NO: 701135 - RNA, 22 nt, Human
aggacacagguaagccagugga

SEQ ID NO: 701136 - RNA, 22 nt, Human
cacuguugagcaauguacagug

SEQ ID NO: 701137 - RNA, 23 nt, Human
aggagccaggugcagcccuugug

SEQ ID NO: 701138 - RNA, 22 nt, Human
ucaggaguccugccugcagccu

SEQ ID NO: 701139 - RNA, 22 nt, Human
ucugaaaugcaaauuugacuga

SEQ ID NO: 701140 - RNA, 22 nt, Human
gaguggguaccggagcaggugc

SEQ ID NO: 701141 - RNA, 22 nt, Human
cagaggcugccagccaugugca

SEQ ID NO: 701142 - RNA, 22 nt, Human
gugcagaccuuccagaaagaac

SEQ ID NO: 701143 - RNA, 22 nt, Human
aggaauguaauaguguggcuca

SEQ ID NO: 701144 - RNA, 22 nt, Human
guguugaugacauuuuagaaac

SEQ ID NO: 701145 - RNA, 22 nt, Human
auuugcugauggcauuugagcu

SEQ ID NO: 701146 - RNA, 23 nt, Human
ggggaaguggcagugagugaggc

SEQ ID NO: 701147 - RNA, 20 nt, Human
ugcagguguuggagaaggua

SEQ ID NO: 701148 - RNA, 22 nt, Human
gucccaggggagcucucugauu

SEQ ID NO: 701149 - RNA, 22 nt, Human
ggcacacauggugguuggugaa

SEQ ID NO: 701150 - RNA, 22 nt, Human
ucacuguugaccuggaaguggg

SEQ ID NO: 701151 - RNA, 22 nt, Human
ucaggcucuacacuugacacac

SEQ ID NO: 701152 - RNA, 22 nt, Human
ggcagcaugugugguccgcugg

SEQ ID NO: 701153 - RNA, 23 nt, Human
uggacgccgacuuuggaggcgcu

SEQ ID NO: 701154 - RNA, 22 nt, Human
gcaugcagaaaaugaacaacga

SEQ ID NO: 701155 - RNA, 22 nt, Human
uggcacuauggaugagacugau

SEQ ID NO: 701156 - RNA, 22 nt, Human
gaggagugccagccguggaguc

SEQ ID NO: 701157 - RNA, 22 nt, Human
uaagagcucccuucuccuugca

SEQ ID NO: 701158 - RNA, 22 nt, Human
aagcaguuuuucaacuguuuag

SEQ ID NO: 701159 - RNA, 22 nt, Human
auguccuuugcuucucuggucc

SEQ ID NO: 701160 - RNA, 22 nt, Human
auucacagggacaaugggagag

SEQ ID NO: 701161 - RNA, 22 nt, Human
gcugaaggcccggaggacaggg

SEQ ID NO: 701162 - RNA, 22 nt, Human
ucaaaggcccauugucccguug

SEQ ID NO: 701163 - RNA, 22 nt, Human
ucuuuggauaucgcuagaccgu

SEQ ID NO: 701164 - RNA, 20 nt, Human
caggacagcgcaaucggagg

SEQ ID NO: 701165 - RNA, 22 nt, Human
cugaggccuaagacaugaauga

SEQ ID NO: 701166 - RNA, 22 nt, Human
cccaggcuuuuaaguuagacag

SEQ ID NO: 701167 - RNA, 22 nt, Human
gaugcauguauggagugagggu

SEQ ID NO: 701168 - RNA, 23 nt, Human
agugugacuuuuuugacugucac

SEQ ID NO: 701169 - RNA, 21 nt, Human
ugggaccuagcuuugcacagg

SEQ ID NO: 701170 - RNA, 22 nt, Human
ggugcggagacuccaugaggcc

SEQ ID NO: 701171 - RNA, 19 nt, Human
augcaucugcauugacagg

SEQ ID NO: 701172 - RNA, 22 nt, Human
cacuuguugguggugaaaucac

SEQ ID NO: 701173 - RNA, 22 nt, Human
uggaaacacccacgcaugcaua

SEQ ID NO: 701174 - RNA, 18 nt, Human
ggguccccagcugcaggg

SEQ ID NO: 701175 - RNA, 18 nt, Human
ucugagggugcgggagcu

SEQ ID NO: 701176 - RNA, 22 nt, Human
uuuguucaccuagcaaacuuuu

SEQ ID NO: 701177 - RNA, 22 nt, Human
cauugcuuugugcauauuuaaa

SEQ ID NO: 701178 - RNA, 22 nt, Human
ugcucccaaaccugacaggcuc

SEQ ID NO: 701179 - RNA, 22 nt, Human
gcugucugcugggucgcucagg

SEQ ID NO: 701180 - RNA, 22 nt, Human
agggcucagaaagcagguuuuc

SEQ ID NO: 701181 - RNA, 22 nt, Human
aggcucagugauguaaaauaua

SEQ ID NO: 701182 - RNA, 22 nt, Human
cuccagagagaaaggaggccgc

SEQ ID NO: 701183 - RNA, 22 nt, Human
caaggcuaagcuuuggcuuucu

SEQ ID NO: 701184 - RNA, 22 nt, Human
gcuguauuuauaugaaggcaug

SEQ ID NO: 701185 - RNA, 22 nt, Human
ccucccugccggcuggacuagu

SEQ ID NO: 701186 - RNA, 22 nt, Human
guccagaguagucgaguauucu

SEQ ID NO: 701187 - RNA, 22 nt, Human
caggcacaaugagcgccaucuu

SEQ ID NO: 701188 - RNA, 22 nt, Human
cugcuuuaaaacugauacauga

SEQ ID NO: 701189 - RNA, 22 nt, Human
ggucccagucccuuuccaccgu

SEQ ID NO: 701190 - RNA, 22 nt, Human
gucccagaggacagggucacau

SEQ ID NO: 701191 - RNA, 22 nt, Human
uuguaacaguagcugucagcuc

SEQ ID NO: 701192 - RNA, 22 nt, Human
auggaguugagcucuguugucc

SEQ ID NO: 701193 - RNA, 22 nt, Human
cuucauguacaguuauuggaga

SEQ ID NO: 701194 - RNA, 22 nt, Human
cuggcuccucaggacugcggga

SEQ ID NO: 701195 - RNA, 22 nt, Human
ccuggaaaaugccacuuucaca

SEQ ID NO: 701196 - RNA, 22 nt, Human
gucaucaucaggcagaugcugc

SEQ ID NO: 701197 - RNA, 22 nt, Human
cugaggcucugagaaagccaaa

SEQ ID NO: 701198 - RNA, 22 nt, Human
uuguauuaaaauguguuucugu

SEQ ID NO: 701199 - RNA, 22 nt, Human
uuuacuuuugguaaggucauuu

SEQ ID NO: 701200 - RNA, 22 nt, Human
cugagcugguucucuugugaaa

SEQ ID NO: 701201 - RNA, 16 nt, Human
aggagcuggguaggag

SEQ ID NO: 701202 - RNA, 22 nt, Human
uggcucaggccuacgacgccuu

SEQ ID NO: 701203 - RNA, 22 nt, Human
guuguuuuugaacggugguggc

SEQ ID NO: 701204 - RNA, 22 nt, Human
cugggagggguagccaauccua

SEQ ID NO: 701205 - RNA, 22 nt, Human
uccuuucugucuuuacucugga

SEQ ID NO: 701206 - RNA, 22 nt, Human
ugccaggcugcccuccagucug

SEQ ID NO: 701207 - RNA, 22 nt, Human
cuuccugcaacaccuguguugc

SEQ ID NO: 701208 - RNA, 18 nt, Human
cuggucucccuucgcuuu

SEQ ID NO: 701209 - RNA, 22 nt, Human
cucacaggguucuaucgaagag

SEQ ID NO: 701210 - RNA, 22 nt, Human
cuuucuuucgaagacgugauua

SEQ ID NO: 701211 - RNA, 22 nt, Human
ugucuuacagcaaucuguucug

SEQ ID NO: 701212 - RNA, 22 nt, Human
uuaccacagugccugucuaaug

SEQ ID NO: 701213 - RNA, 22 nt, Human
aggcucaguauagcuggcaagu

SEQ ID NO: 701214 - RNA, 22 nt, Human
uguauuucugcuuucucuagua

SEQ ID NO: 701215 - RNA, 22 nt, Human
gggagcuggagcuggaagacuc

SEQ ID NO: 701216 - RNA, 22 nt, Human
augaaacaacagacuuggucaa

SEQ ID NO: 701217 - RNA, 22 nt, Human
guuuauuggguauuguggagcc

SEQ ID NO: 701218 - RNA, 22 nt, Human
cuucuaauucuuauguaagcuu

SEQ ID NO: 701219 - RNA, 22 nt, Human
uaucugucgggagucuuccgga

SEQ ID NO: 701220 - RNA, 22 nt, Human
ucucaggcuuccuggugcugug

SEQ ID NO: 701221 - RNA, 22 nt, Human
uuucuacacuucgugguguuuu

SEQ ID NO: 701222 - RNA, 20 nt, Human
augucaggaagggagucagg

SEQ ID NO: 701223 - RNA, 22 nt, Human
cccacucccugcacgccugccg

SEQ ID NO: 701224 - RNA, 22 nt, Human
cucccagggucuaggcugcugg

SEQ ID NO: 701225 - RNA, 22 nt, Human
agcccugugugcuuguguuccu

SEQ ID NO: 701226 - RNA, 22 nt, Human
gcaugcaggaagggcuugggga

SEQ ID NO: 701227 - RNA, 22 nt, Human
uaucuguuuuuacagugucuuu

SEQ ID NO: 701228 - RNA, 22 nt, Human
uacaagcuuuuguguauaaaug

SEQ ID NO: 701229 - RNA, 22 nt, Human
agacugugagaagauggcugcg

SEQ ID NO: 701230 - RNA, 22 nt, Human
ugugcuugucguggagccaggc

SEQ ID NO: 701231 - RNA, 22 nt, Human
ucugcuguuuacugugugauau

SEQ ID NO: 701232 - RNA, 22 nt, Human
ucugcuugugucuguccagccu

SEQ ID NO: 701233 - RNA, 22 nt, Human
gcugcuccgcagagugugugug

SEQ ID NO: 701234 - RNA, 22 nt, Human
gcagcugcgcugguguggggca

SEQ ID NO: 701235 - RNA, 22 nt, Human
caggccacacggcggcucccug

SEQ ID NO: 701236 - RNA, 22 nt, Human
agauaucuuacacuuugaaguu

SEQ ID NO: 701237 - RNA, 22 nt, Human
gucuuuuuuacaccuuacauca

SEQ ID NO: 701238 - RNA, 22 nt, Human
uuguuuguaaggcucuuagaau

SEQ ID NO: 701239 - RNA, 22 nt, Human
ucuguccauucagaauggcccu

SEQ ID NO: 701240 - RNA, 22 nt, Human
ucuauuaaugauucaauagugu

SEQ ID NO: 701241 - RNA, 22 nt, Human
ugucuucuaccuugacagcauu

SEQ ID NO: 701242 - RNA, 22 nt, Human
caguuuuucaaaauuacaugau

SEQ ID NO: 701243 - RNA, 22 nt, Human
auuuccuauacaguuguccaua

SEQ ID NO: 701244 - RNA, 22 nt, Human
cagcaguguacaaggugucaga

SEQ ID NO: 701245 - RNA, 20 nt, Human
ucucuggcaagaagcugcag

SEQ ID NO: 701246 - RNA, 22 nt, Human
uccuuucuucuucugcccaugg

SEQ ID NO: 701247 - RNA, 22 nt, Human
uacauguuauuucacuauuggu

SEQ ID NO: 701248 - RNA, 22 nt, Human
ucauugaggaaagguaguggcu

SEQ ID NO: 701249 - RNA, 22 nt, Human
cccagccuuugcuuccugguuc

SEQ ID NO: 701250 - RNA, 22 nt, Human
cuggcuccauccuugagcucug

SEQ ID NO: 701251 - RNA, 22 nt, Human
gggagcugaaggagccggcggg

SEQ ID NO: 701252 - RNA, 22 nt, Human
ccagcugcgggcaucgagaguu

SEQ ID NO: 701253 - RNA, 22 nt, Human
cuggagcucuccagagccccgu

SEQ ID NO: 701254 - RNA, 18 nt, Human
gaggcacauaguuggggc

SEQ ID NO: 701255 - RNA, 17 nt, Human
ucuccuggcucuaucag

SEQ ID NO: 701256 - RNA, 19 nt, Human
ugcagcuguaugagcuuaa

SEQ ID NO: 701257 - RNA, 22 nt, Human
ucugcacccugugguccucuag

SEQ ID NO: 701258 - RNA, 22 nt, Human
ucuccaggcuuaaucucagcuu

SEQ ID NO: 701259 - RNA, 22 nt, Human
agcucugcuucuugggaagaug

SEQ ID NO: 701260 - RNA, 22 nt, Human
ugcuccaggcugcugaagaucu

SEQ ID NO: 701261 - RNA, 22 nt, Human
uauaugcagauuuucaucaucg

SEQ ID NO: 701262 - RNA, 19 nt, Human
aacuacagcgcacuguccu

SEQ ID NO: 701263 - RNA, 22 nt, Human
cauaacuugguguuggaaacug

SEQ ID NO: 701264 - RNA, 22 nt, Human
gagcugcuggccuccugcggga

SEQ ID NO: 701265 - RNA, 22 nt, Human
uuccaauaaaauguuauuugca

SEQ ID NO: 701266 - RNA, 22 nt, Human
ggccacuguuuccugggcaguu

SEQ ID NO: 701267 - RNA, 23 nt, Human
cagcugguugugggaguggcugc

SEQ ID NO: 701268 - RNA, 22 nt, Human
gagggcucaacuacuacuaggc

SEQ ID NO: 701269 - RNA, 22 nt, Human
caggagcucaagaccacccugg

SEQ ID NO: 701270 - RNA, 22 nt, Human
uacagcagcccaccuucuucug

SEQ ID NO: 701271 - RNA, 22 nt, Human
cuccagcucgcgagcucugcuc

SEQ ID NO: 701272 - RNA, 22 nt, Human
cagcagcucaggcuccuuccca

SEQ ID NO: 701273 - RNA, 22 nt, Human
uuuauucucuaguuggucagau

SEQ ID NO: 701274 - RNA, 22 nt, Human
uuccuuucucuggacugcagcc

SEQ ID NO: 701275 - RNA, 22 nt, Human
cagcugcuguucaguuuuguuu

SEQ ID NO: 701276 - RNA, 22 nt, Human
aucuguucuucaaaauauuaca

SEQ ID NO: 701277 - RNA, 22 nt, Human
uuuucuuggaguggcuguccuu

SEQ ID NO: 701278 - RNA, 22 nt, Human
uagcuguucucuguaaauugga

SEQ ID NO: 701279 - RNA, 22 nt, Human
ucccacugcuuugcucugcuca

SEQ ID NO: 701280 - RNA, 22 nt, Human
uuucucuuucaaucugcaguac

SEQ ID NO: 701281 - RNA, 22 nt, Human
gcugcugcuugaaggcucggag

SEQ ID NO: 701282 - RNA, 22 nt, Human
agagcuccaggguuuuguagug

SEQ ID NO: 701283 - RNA, 22 nt, Human
guucucugccggcaccuacccg

SEQ ID NO: 701284 - RNA, 22 nt, Human
uccagagaacgaugaaagcugg

SEQ ID NO: 701285 - RNA, 22 nt, Human
uugcuauuuugagagucauagu

SEQ ID NO: 701286 - RNA, 22 nt, Human
cugggaggcccacguugggaag

SEQ ID NO: 701287 - RNA, 22 nt, Human
aaggcucccucuucucgagugu

SEQ ID NO: 701288 - RNA, 22 nt, Human
cccuggaacccauggccagugu

SEQ ID NO: 701289 - RNA, 22 nt, Human
ggcucagaaaccucuggugucu

SEQ ID NO: 701290 - RNA, 22 nt, Human
cuucucuuggguguggugucuu

SEQ ID NO: 701291 - RNA, 22 nt, Human
uuccagagaguuauuccccugg

SEQ ID NO: 701292 - RNA, 22 nt, Human
aucugucccuccucacagccuc

SEQ ID NO: 701293 - RNA, 22 nt, Human
accucccuaacccuuuuggcuc

SEQ ID NO: 701294 - RNA, 22 nt, Human
uuauugagcacauaguaugugg

SEQ ID NO: 701295 - RNA, 22 nt, Human
auggcucugcugggcaaagcaa

SEQ ID NO: 701296 - RNA, 22 nt, Human
accauccaaacugcuuucugug

SEQ ID NO: 701297 - RNA, 22 nt, Human
ucccacugucuucucgugcucg

SEQ ID NO: 701298 - RNA, 22 nt, Human
aaauucuguccugaaugccauu

SEQ ID NO: 701299 - RNA, 22 nt, Human
uacuguauacuacugcuguucu

SEQ ID NO: 701300 - RNA, 22 nt, Human
cugccuuggcccuaguucaugg

SEQ ID NO: 701301 - RNA, 22 nt, Human
uggagcugguucuggggaagcu

SEQ ID NO: 701302 - RNA, 22 nt, Human
agcacauucccaccuguacuuc

SEQ ID NO: 701303 - RNA, 20 nt, Human
cagagcagugcccaggcggc

SEQ ID NO: 701304 - RNA, 22 nt, Human
ucauugagcgguucuuaaccca

SEQ ID NO: 701305 - RNA, 22 nt, Human
cucuccaggcgagguccuacug

SEQ ID NO: 701306 - RNA, 22 nt, Human
uuuccacacucacugcacucau

SEQ ID NO: 701307 - RNA, 22 nt, Human
gcagcagugugggcugaaccua

SEQ ID NO: 701308 - RNA, 22 nt, Human
uuucuucucacccaggacagag

SEQ ID NO: 701309 - RNA, 22 nt, Human
uucuccacccacucuuuuguug

SEQ ID NO: 701310 - RNA, 22 nt, Human
cccagccucuggguucugccgg

SEQ ID NO: 701311 - RNA, 22 nt, Human
agcuuuauuugucauucacggc

SEQ ID NO: 701312 - RNA, 22 nt, Human
ucauuguuucugcuuuucauga

SEQ ID NO: 701313 - RNA, 22 nt, Human
aggcuuaacuacaauuuuugcc

SEQ ID NO: 701314 - RNA, 22 nt, Human
cagggcuccccagagagccucu

SEQ ID NO: 701315 - RNA, 22 nt, Human
cccuggcucaggcagcuuuguu

SEQ ID NO: 701316 - RNA, 22 nt, Human
ucugccaucaagaugcucuggc

SEQ ID NO: 701317 - RNA, 22 nt, Human
cucucuuuuucgugugccgaag

SEQ ID NO: 701318 - RNA, 22 nt, Human
ucccagaacccugccagguccu

SEQ ID NO: 701319 - RNA, 22 nt, Human
cccucucccugcagaauguggc

SEQ ID NO: 701320 - RNA, 20 nt, Human
ugugcccaauguccagguuc

SEQ ID NO: 701321 - RNA, 22 nt, Human
ccaggcccugcuccucacacca

SEQ ID NO: 701322 - RNA, 22 nt, Human
uuuuguguugccauguuaagca

SEQ ID NO: 701323 - RNA, 22 nt, Human
uuccuucuucauuguguuacag

SEQ ID NO: 701324 - RNA, 22 nt, Human
cugggaggcagucucucuagaa

SEQ ID NO: 701325 - RNA, 22 nt, Human
aacuuucuuugcaucuaaguuu

SEQ ID NO: 701326 - RNA, 22 nt, Human
gaugucuggcuaccacucgcac

SEQ ID NO: 701327 - RNA, 22 nt, Human
cuaguucugccauucaguguca

SEQ ID NO: 701328 - RNA, 18 nt, Human
agcucacagaucuguuuu

SEQ ID NO: 701329 - RNA, 22 nt, Human
cuacuucuguggcucuaagaga

SEQ ID NO: 701330 - RNA, 22 nt, Human
ucuaugucucuggaaggagugu

SEQ ID NO: 701331 - RNA, 22 nt, Human
auguaacauaugugaucgcauu

SEQ ID NO: 701332 - RNA, 22 nt, Human
acucacagggccucaguuuucc

SEQ ID NO: 701333 - RNA, 22 nt, Human
cagugcagccaaggacaggcac

SEQ ID NO: 701334 - RNA, 22 nt, Human
cauuuugugcuagacacuaugg

SEQ ID NO: 701335 - RNA, 22 nt, Human
gacuacaggugugugccaccau

SEQ ID NO: 701336 - RNA, 22 nt, Human
accuuuaugaaacagcugucgu

SEQ ID NO: 701337 - RNA, 22 nt, Human
aucuaaagugucauaaguagcu

SEQ ID NO: 701338 - RNA, 22 nt, Human
caauaauugcuuuccagaguua

SEQ ID NO: 701339 - RNA, 22 nt, Human
ugcugcucuucaccauggccuc

SEQ ID NO: 701340 - RNA, 21 nt, Human
ucugugcuuuuuuggcuccua

SEQ ID NO: 701341 - RNA, 22 nt, Human
aaugugcugguaacugcuuugc

SEQ ID NO: 701342 - RNA, 22 nt, Human
uugaagcauuugcuauagcauu

SEQ ID NO: 701343 - RNA, 22 nt, Human
ccaggagagcucucguucagug

SEQ ID NO: 701344 - RNA, 22 nt, Human
gucccaggggagcucucugauu

SEQ ID NO: 701345 - RNA, 22 nt, Human
uucuuucugggguccuucggcu

SEQ ID NO: 701346 - RNA, 22 nt, Human
ucaugcagaguagaaagggcaa

SEQ ID NO: 701347 - RNA, 21 nt, Human
gucuuuuuaauugcgauuucc

SEQ ID NO: 701348 - RNA, 22 nt, Human
ggcuagcuuagagucaugcuag

SEQ ID NO: 701349 - RNA, 22 nt, Human
ugcuuuauucgacaucugguag

SEQ ID NO: 701350 - RNA, 22 nt, Human
caggcacaagaucggcuagaua

SEQ ID NO: 701351 - RNA, 22 nt, Human
cagcuccccucuguggggcagu

SEQ ID NO: 701352 - RNA, 17 nt, Human
agcagcuggguugaucu

SEQ ID NO: 701353 - RNA, 22 nt, Human
aacagauuguaaccugauagcc

SEQ ID NO: 701354 - RNA, 22 nt, Human
cucucuguuaugcuuucaugaa

SEQ ID NO: 701355 - RNA, 22 nt, Human
cucccagccuucgccagucuga

SEQ ID NO: 701356 - RNA, 22 nt, Human
acuagugcacauuguuucucaa

SEQ ID NO: 701357 - RNA, 22 nt, Human
ucucuguaagcugccuucucgu

SEQ ID NO: 701358 - RNA, 22 nt, Human
caggcuacauuugcucugagaa

SEQ ID NO: 701359 - RNA, 20 nt, Human
ucugccacuuuuucugucac

SEQ ID NO: 701360 - RNA, 22 nt, Human
agcugucuaccugcagaguccu

SEQ ID NO: 701361 - RNA, 22 nt, Human
gcagcugccgugagcucacgcc

SEQ ID NO: 701362 - RNA, 22 nt, Human
uucucucaguuaaacuuuguga

SEQ ID NO: 701363 - RNA, 20 nt, Human
auuugcuuaccuuguuucua

SEQ ID NO: 701364 - RNA, 22 nt, Human
uacuacauacagaauuuagaga

SEQ ID NO: 701365 - RNA, 22 nt, Human
ucuggcccaucuucugccacca

SEQ ID NO: 701366 - RNA, 21 nt, Human
uuggaacaagcagcaguuugc

SEQ ID NO: 701367 - RNA, 18 nt, Human
cuuuagcugucaucuuug

SEQ ID NO: 701368 - RNA, 21 nt, Human
auccauccaucuuggccuaac

SEQ ID NO: 701369 - RNA, 22 nt, Human
cggagcagagccacucgggccg

SEQ ID NO: 701370 - RNA, 22 nt, Human
guaguucuuucucaauguucaa

SEQ ID NO: 701371 - RNA, 22 nt, Human
gcuguagguaaggauggcaaag

SEQ ID NO: 701372 - RNA, 22 nt, Human
cucucuccuuagcugcagacca

SEQ ID NO: 701373 - RNA, 18 nt, Human
uagcucuuguugguccau

SEQ ID NO: 701374 - RNA, 22 nt, Human
cucccugggccucaguuucucu

SEQ ID NO: 701375 - RNA, 18 nt, Human
agguguguuucuaggagc

SEQ ID NO: 701376 - RNA, 22 nt, Human
agccagggacgcugcaggcuac

SEQ ID NO: 701377 - RNA, 19 nt, Human
acugcagggaggaggugug

SEQ ID NO: 701378 - RNA, 23 nt, Human
ggucccaguggagaggccucacc

SEQ ID NO: 701379 - RNA, 22 nt, Human
cuccacagccccuccaguggca

SEQ ID NO: 701380 - RNA, 22 nt, Human
ugcugaggagguggcugugcuu

SEQ ID NO: 701381 - RNA, 22 nt, Human
cuuccucuguggccagagugua

SEQ ID NO: 701382 - RNA, 22 nt, Human
cuggagcucuguguguuccuga

SEQ ID NO: 701383 - RNA, 22 nt, Human
aaggcacauauuuuagagucac

SEQ ID NO: 701384 - RNA, 20 nt, Human
caauaauuuacuucccuauu

SEQ ID NO: 701385 - RNA, 22 nt, Human
auguacauuauucgagugaugg

SEQ ID NO: 701386 - RNA, 22 nt, Human
auuguuacuggguuaauuugga

SEQ ID NO: 701387 - RNA, 22 nt, Human
aggucacguccugugaugucau

SEQ ID NO: 701388 - RNA, 22 nt, Human
cugguuuuccaauguuuugacu

SEQ ID NO: 701389 - RNA, 22 nt, Human
ccaggcagccaagugugugugu

SEQ ID NO: 701390 - RNA, 22 nt, Human
uuccuuuucuucuaccacaugu

SEQ ID NO: 701391 - RNA, 22 nt, Human
ggcuuccuccuuccugcuguca

SEQ ID NO: 701392 - RNA, 22 nt, Human
uccaggcuccccugcgugcucc

SEQ ID NO: 701393 - RNA, 22 nt, Human
cagcugcucugguggucucucc

SEQ ID NO: 701394 - RNA, 22 nt, Human
cuggcuaaagagcaagaagaug

SEQ ID NO: 701395 - RNA, 22 nt, Human
guauuucuuuacauaugcucau

SEQ ID NO: 701396 - RNA, 22 nt, Human
gaucuguccuggcaguuaacac

SEQ ID NO: 701397 - RNA, 22 nt, Human
guuaacaacacugugagugcug

SEQ ID NO: 701398 - RNA, 22 nt, Human
uuuuuugucuugaagaaauggu

SEQ ID NO: 701399 - RNA, 22 nt, Human
ucucuccuccacaccgggugcu

SEQ ID NO: 701400 - RNA, 22 nt, Human
cugcauaucaaauuacuccugg

SEQ ID NO: 701401 - RNA, 22 nt, Human
ccaggcuccccaggaggcccuu

SEQ ID NO: 701402 - RNA, 22 nt, Human
cagggcucgcucgcucgcucgc

SEQ ID NO: 701403 - RNA, 22 nt, Human
uaauccaaaacugaaucugugg

SEQ ID NO: 701404 - RNA, 22 nt, Human
guuuuguucaugaacauugggu

SEQ ID NO: 701405 - RNA, 21 nt, Human
acugaacuuguguucuagagg

SEQ ID NO: 701406 - RNA, 22 nt, Human
ugucauuggugaucugaugccu

SEQ ID NO: 701407 - RNA, 22 nt, Human
uacaggcucuugucagacguau

SEQ ID NO: 701408 - RNA, 22 nt, Human
acagccaggaauucuggagaag

SEQ ID NO: 701409 - RNA, 22 nt, Human
cucuauucuaauggauucuggg

SEQ ID NO: 701410 - RNA, 22 nt, Human
uagcugcuugaccaggcagugg

SEQ ID NO: 701411 - RNA, 22 nt, Human
acuggaaaguauucuuucacug

SEQ ID NO: 701412 - RNA, 22 nt, Human
uguucugcaaugcugccuccuu

SEQ ID NO: 701413 - RNA, 22 nt, Human
agcaggugucacuuucacucca

SEQ ID NO: 701414 - RNA, 22 nt, Human
ugcuuguauucauaucacagcu

SEQ ID NO: 701415 - RNA, 22 nt, Human
ucaauuuauguggcuauucauu

SEQ ID NO: 701416 - RNA, 22 nt, Human
cuccccuagcccguugggaggu

SEQ ID NO: 701417 - RNA, 22 nt, Human
gggagcugagcuggaagagaau

SEQ ID NO: 701418 - RNA, 22 nt, Human
cuucacugcagucauggcucug

SEQ ID NO: 701419 - RNA, 22 nt, Human
gagauuuccauauuuuguaaca

SEQ ID NO: 701420 - RNA, 22 nt, Human
cuaguauuaagugugaguaaaa

SEQ ID NO: 701421 - RNA, 22 nt, Human
auucugcugccuaguuuaugaa

SEQ ID NO: 701422 - RNA, 22 nt, Human
guucucucagcgauagugaugg

SEQ ID NO: 701423 - RNA, 22 nt, Human
uggcuacauuuauacucucauu

SEQ ID NO: 701424 - RNA, 19 nt, Human
ugcucucuggugcuucaug

SEQ ID NO: 701425 - RNA, 22 nt, Human
uccccaguaagccugcacugug

SEQ ID NO: 701426 - RNA, 22 nt, Human
uuuccagaaauaccauuuggug

SEQ ID NO: 701427 - RNA, 22 nt, Human
aggucccugcagcagacugcca

SEQ ID NO: 701428 - RNA, 22 nt, Human
uucuuuccucccagccuuugga

SEQ ID NO: 701429 - RNA, 22 nt, Human
cauuguccucugaugccuuccc

SEQ ID NO: 701430 - RNA, 19 nt, Human
auucuucucuuccugcugu

SEQ ID NO: 701431 - RNA, 22 nt, Human
ucugcccaggaggucccauggg

SEQ ID NO: 701432 - RNA, 22 nt, Human
uuuguugguugcacuggugggu

SEQ ID NO: 701433 - RNA, 22 nt, Human
guucuccaggggcuguucaucu

SEQ ID NO: 701434 - RNA, 22 nt, Human
ucuaguuagugguugauacugu

SEQ ID NO: 701435 - RNA, 22 nt, Human
ucuuuuccuugaugguuaaaua

SEQ ID NO: 701436 - RNA, 22 nt, Human
gcuucauagcauucauugccug

SEQ ID NO: 701437 - RNA, 22 nt, Human
aucaucaucuaaauugugucgc

SEQ ID NO: 701438 - RNA, 22 nt, Human
agacauauuggcuugcuuuaau

SEQ ID NO: 701439 - RNA, 22 nt, Human
uuggaaagggauaucuguacuu

SEQ ID NO: 701440 - RNA, 18 nt, Human
accugauuggcgcagccc

SEQ ID NO: 701441 - RNA, 23 nt, Human
agcccagcagagaaccuaggucc

SEQ ID NO: 701442 - RNA, 22 nt, Human
uuucauguuggauacuguuuca

SEQ ID NO: 701443 - RNA, 18 nt, Human
uggcagccagcugcuccu

SEQ ID NO: 701444 - RNA, 22 nt, Human
ugcacccacuuagcugaaguuc

SEQ ID NO: 701445 - RNA, 22 nt, Human
cugagggccuucuaugcugagc

SEQ ID NO: 701446 - RNA, 22 nt, Human
gagucucugaccagggugccaa

SEQ ID NO: 701447 - RNA, 22 nt, Human
uucuuuuaauuucugucugcag

SEQ ID NO: 701448 - RNA, 22 nt, Human
ucucugucucccguguguccgg

SEQ ID NO: 701449 - RNA, 20 nt, Human
uggccucugagaugccacgg

SEQ ID NO: 701450 - RNA, 19 nt, Human
agcaguggagccaugccug

SEQ ID NO: 701451 - RNA, 21 nt, Human
uugcuguuuucccaaugcagu

SEQ ID NO: 701452 - RNA, 22 nt, Human
aucauccuagaaggaagcuagg

SEQ ID NO: 701453 - RNA, 22 nt, Human
guuucuccucugugucuuguuu

SEQ ID NO: 701454 - RNA, 21 nt, Human
ugcuggguuugcccaucaggc

SEQ ID NO: 701455 - RNA, 22 nt, Human
ccagcuggcccagcugugcucc

SEQ ID NO: 701456 - RNA, 22 nt, Human
acauuucuccuacuuguuauuu

SEQ ID NO: 701457 - RNA, 22 nt, Human
cugcucucuguuccccuggauc

SEQ ID NO: 701458 - RNA, 22 nt, Human
uugcugccuuuguacucugaug

SEQ ID NO: 701459 - RNA, 22 nt, Human
cugcugucuuuauuucacugcu

SEQ ID NO: 701460 - RNA, 22 nt, Human
uccuucccaggugucgccgccu

SEQ ID NO: 701461 - RNA, 22 nt, Human
cauuguguauuucuguaguacu

SEQ ID NO: 701462 - RNA, 22 nt, Human
acauauuuugaaagcuuucuaa

SEQ ID NO: 701463 - RNA, 22 nt, Human
uguucuggugaggccauggggu

SEQ ID NO: 701464 - RNA, 22 nt, Human
cugggagaugacucagagcagg

SEQ ID NO: 701465 - RNA, 22 nt, Human
ccugcagacacuuguccagcaa

SEQ ID NO: 701466 - RNA, 22 nt, Human
uggagcagccuuuucuaagcaa

SEQ ID NO: 701467 - RNA, 22 nt, Human
gcaguccuguagcgacuuuuuu

SEQ ID NO: 701468 - RNA, 22 nt, Human
ucuuccuggauggggguugaug

SEQ ID NO: 701469 - RNA, 22 nt, Human
cagucucuugcuucauuaguug

SEQ ID NO: 701470 - RNA, 22 nt, Human
gcugggugauucauuuccauaa

SEQ ID NO: 701471 - RNA, 22 nt, Human
augauugaaaaugacauugcca

SEQ ID NO: 701472 - RNA, 22 nt, Human
cuuggcugaacuccaggaugca

SEQ ID NO: 701473 - RNA, 22 nt, Human
cugcccugcagcuccacggacu

SEQ ID NO: 701474 - RNA, 20 nt, Human
cucuuuucacucucaguggu

SEQ ID NO: 701475 - RNA, 22 nt, Human
gggcucaucaagccucuccgcc

SEQ ID NO: 701476 - RNA, 22 nt, Human
agugagaguauuaaugugaacu

SEQ ID NO: 701477 - RNA, 22 nt, Human
uuuucuaacaucuaguaauuug

SEQ ID NO: 701478 - RNA, 22 nt, Human
cuggagaggcugggaacagguu

SEQ ID NO: 701479 - RNA, 22 nt, Human
uagggcucugagaguucagccu

SEQ ID NO: 701480 - RNA, 22 nt, Human
uugucucuacagagaguaguag

SEQ ID NO: 701481 - RNA, 22 nt, Human
gucuggaggaggaagaaggcac

SEQ ID NO: 701482 - RNA, 22 nt, Human
cagucucuggugaguugacagu

SEQ ID NO: 701483 - RNA, 22 nt, Human
ccucuucuaggacguccuugug

SEQ ID NO: 701484 - RNA, 22 nt, Human
agagggcgcccaggcccacgcc

SEQ ID NO: 701485 - RNA, 22 nt, Human
gcuucuggugaggccucaggaa

SEQ ID NO: 701486 - RNA, 22 nt, Human
uuguugcugcucaaccucuaua

SEQ ID NO: 701487 - RNA, 22 nt, Human
ucccugccuccuggcagugcca

SEQ ID NO: 701488 - RNA, 19 nt, Human
cucugccauuugcugccug

SEQ ID NO: 701489 - RNA, 22 nt, Human
aauucauacucuauauugcuuu

SEQ ID NO: 701490 - RNA, 22 nt, Human
ucaucuccauacggucucgcag

SEQ ID NO: 701491 - RNA, 22 nt, Human
cagcuuuugcagacuucuugcc

SEQ ID NO: 701492 - RNA, 22 nt, Human
uccucccugcacucagugaagu

SEQ ID NO: 701493 - RNA, 22 nt, Human
cuucucugucacaggguuacgu

SEQ ID NO: 701494 - RNA, 23 nt, Human
acugccugugccgaucucucuca

SEQ ID NO: 701495 - RNA, 22 nt, Human
cugcaucaguggauaugauggu

SEQ ID NO: 701496 - RNA, 23 nt, Human
cugagggcuggucugaagucugc

SEQ ID NO: 701497 - RNA, 22 nt, Human
cuauacagcagcuuacuaguua

SEQ ID NO: 701498 - RNA, 22 nt, Human
aguucugggaggugcacgucca

SEQ ID NO: 701499 - RNA, 22 nt, Human
auacagaagaccccuccgucau

SEQ ID NO: 701500 - RNA, 22 nt, Human
uacugcugagcuggguagaagg

SEQ ID NO: 701501 - RNA, 22 nt, Human
uucuaguuacagaagccuugcu

SEQ ID NO: 701502 - RNA, 22 nt, Human
gcugucccgaaccccugguaau

SEQ ID NO: 701503 - RNA, 21 nt, Human
acccugcuuuaugccguccuc

SEQ ID NO: 701504 - RNA, 20 nt, Human
uccuccuugcagagcccaga

SEQ ID NO: 701505 - RNA, 22 nt, Human
gcucccugguauugcugccacu

SEQ ID NO: 701506 - RNA, 22 nt, Human
aggguccugggugcaguugcuu

SEQ ID NO: 701507 - RNA, 22 nt, Human
aucauccauggcugaucauaaa

SEQ ID NO: 701508 - RNA, 22 nt, Human
gcagagucagguccaaggacug

SEQ ID NO: 701509 - RNA, 22 nt, Human
uaggugcaggucacaagggaug

SEQ ID NO: 701510 - RNA, 22 nt, Human
cuccagcagaaagggcgagugg

SEQ ID NO: 701511 - RNA, 22 nt, Human
aucagaaaaaugagaagagcug

SEQ ID NO: 701512 - RNA, 22 nt, Human
agcuucuuugugggcuccagaa

SEQ ID NO: 701513 - RNA, 22 nt, Human
ugacuugucucuuugggagaca

SEQ ID NO: 701514 - RNA, 22 nt, Human
caggcaaggaggcacugaggga

SEQ ID NO: 701515 - RNA, 22 nt, Human
ucaggagugcagcaguuuggag

SEQ ID NO: 701516 - RNA, 22 nt, Human
aaaguuugaaugauauauuagu

SEQ ID NO: 701517 - RNA, 22 nt, Human
ugugcuucugcagagacuauuu

SEQ ID NO: 701518 - RNA, 22 nt, Human
cugaguccagggacagaggcgu

SEQ ID NO: 701519 - RNA, 22 nt, Human
ucauggauggccgggaggugau

SEQ ID NO: 701520 - RNA, 22 nt, Human
ggaccugccagaacucaggcua

SEQ ID NO: 701521 - RNA, 22 nt, Human
uccuggaguugugcagugcaca

SEQ ID NO: 701522 - RNA, 22 nt, Human
uucuaacuccacuucccacucc

SEQ ID NO: 701523 - RNA, 22 nt, Human
ucagaagagcuggugcugccug

SEQ ID NO: 701524 - RNA, 22 nt, Human
uuugagaaggugacaaauucua

SEQ ID NO: 701525 - RNA, 22 nt, Human
uccaggaggguuuucugccuuc

SEQ ID NO: 701526 - RNA, 21 nt, Human
ucucuguauccauggguucca

SEQ ID NO: 701527 - RNA, 22 nt, Human
gugcaaaaggcauugugguuuu

SEQ ID NO: 701528 - RNA, 22 nt, Human
auggagcaaauggggcugcagg

SEQ ID NO: 701529 - RNA, 22 nt, Human
aagaugauaggacuugcuuaag

SEQ ID NO: 701530 - RNA, 22 nt, Human
aguuuuauugucccagagguga

SEQ ID NO: 701531 - RNA, 22 nt, Human
ucugcuggaaaaccagggaauu

SEQ ID NO: 701532 - RNA, 22 nt, Human
ucagaggcuuucaauguguuuu

SEQ ID NO: 701533 - RNA, 22 nt, Human
acaugucucuucugaaagacaa

SEQ ID NO: 701534 - RNA, 22 nt, Human
ggagggacccacucuagaggug

SEQ ID NO: 701535 - RNA, 22 nt, Human
aaguugaaucaguaacacaguu

SEQ ID NO: 701536 - RNA, 22 nt, Human
gaggucaauaauaugugcuuua

SEQ ID NO: 701537 - RNA, 22 nt, Human
cucugcaggcacccaggguggg

SEQ ID NO: 701538 - RNA, 22 nt, Human
gacccagcuaaccaggugggga

SEQ ID NO: 701539 - RNA, 22 nt, Human
cagcuucugucugauuagcaag

SEQ ID NO: 701540 - RNA, 22 nt, Human
ugucugugauuuaggccagggc

SEQ ID NO: 701541 - RNA, 22 nt, Human
aguauauggggaauugcauaau

SEQ ID NO: 701542 - RNA, 22 nt, Human
ccaggugcucuugccagggcug

SEQ ID NO: 701543 - RNA, 23 nt, Human
gcccagggacugggaaucagugg

SEQ ID NO: 701544 - RNA, 19 nt, Human
ccucucccaugcuuaccuc

SEQ ID NO: 701545 - RNA, 22 nt, Human
uucugggcccaacccuagagug

SEQ ID NO: 701546 - RNA, 21 nt, Human
agauuauaaagaaccuucuua

SEQ ID NO: 701547 - RNA, 22 nt, Human
ucucuguaaaauguggaugaua

SEQ ID NO: 701548 - RNA, 22 nt, Human
uuacagagcuggguggagagag

SEQ ID NO: 701549 - RNA, 22 nt, Human
gccuggaguggacuuggccccu

SEQ ID NO: 701550 - RNA, 22 nt, Human
ugcccagccccuaucccuggga

SEQ ID NO: 701551 - RNA, 22 nt, Human
aagcaauacaaguggucauuga

SEQ ID NO: 701552 - RNA, 22 nt, Human
augcuuccaugaacguucuugu

SEQ ID NO: 701553 - RNA, 22 nt, Human
cagcuggguuuaguggggugug

SEQ ID NO: 701554 - RNA, 22 nt, Human
gcccagcaggggauggcagcuc

SEQ ID NO: 701555 - RNA, 22 nt, Human
uggauuuaacagaauaccaggu

SEQ ID NO: 701556 - RNA, 19 nt, Human
acaauagaaaagucuuuug

SEQ ID NO: 701557 - RNA, 22 nt, Human
uggguccuuuuuggacuucuuc

SEQ ID NO: 701558 - RNA, 22 nt, Human
uggcagccuucucugagaaggu

SEQ ID NO: 701559 - RNA, 22 nt, Human
cugggcuucucccccuggcaga

SEQ ID NO: 701560 - RNA, 22 nt, Human
agaucuuuagugaagcuaaauc

SEQ ID NO: 701561 - RNA, 22 nt, Human
ucauuucaaugauacuacuaag

SEQ ID NO: 701562 - RNA, 18 nt, Human
gaggccugagaaccaggu

SEQ ID NO: 701563 - RNA, 22 nt, Human
ucuucauguauuugacaaccau

SEQ ID NO: 701564 - RNA, 22 nt, Human
gcuggcugggucccugagaggc

SEQ ID NO: 701565 - RNA, 22 nt, Human
acguuuucagugacugugcuuc

SEQ ID NO: 701566 - RNA, 22 nt, Human
gcugagcugggacaguccuggg

SEQ ID NO: 701567 - RNA, 22 nt, Human
gaaccucagugaaacuggaggu

SEQ ID NO: 701568 - RNA, 22 nt, Human
cuggccuuuagccccagugucu

SEQ ID NO: 701569 - RNA, 22 nt, Human
uuuacuucugcauuuccccuag

SEQ ID NO: 701570 - RNA, 22 nt, Human
uaagaaucaguagauauagauu

SEQ ID NO: 701571 - RNA, 22 nt, Human
ccugcugucugcuguguuaagc

SEQ ID NO: 701572 - RNA, 22 nt, Human
aggaggugagcggucauguggu

SEQ ID NO: 701573 - RNA, 22 nt, Human
gaucaaaagcuggguucuaaaa

SEQ ID NO: 701574 - RNA, 22 nt, Human
agccuucaguaaauccacugug

SEQ ID NO: 701575 - RNA, 22 nt, Human
uucuguuagaauuuugaaaaua

SEQ ID NO: 701576 - RNA, 22 nt, Human
gugauuucagguuuuucauacu

SEQ ID NO: 701577 - RNA, 22 nt, Human
acagcaacuccugcuucugagu

SEQ ID NO: 701578 - RNA, 22 nt, Human
gccuucccacccugcgaggcug

SEQ ID NO: 701579 - RNA, 22 nt, Human
ucagaggaugcuguucuuuaau

SEQ ID NO: 701580 - RNA, 22 nt, Human
cccucccagaugggcuugaggu

SEQ ID NO: 701581 - RNA, 22 nt, Human
ucugccaucuuaauucucuuuu

SEQ ID NO: 701582 - RNA, 22 nt, Human
ugucacuucaggaaugcaggga

SEQ ID NO: 701583 - RNA, 22 nt, Human
ucuggauuuguggaaaaucugc

SEQ ID NO: 701584 - RNA, 22 nt, Human
agccagcuaccggggcuccugg

SEQ ID NO: 701585 - RNA, 22 nt, Human
uauucacaggcacgaaauauug

SEQ ID NO: 701586 - RNA, 20 nt, Human
acaugaaaggaaacaggaaa

SEQ ID NO: 701587 - RNA, 22 nt, Human
cgugucuguaugucaaucagcu

SEQ ID NO: 701588 - RNA, 22 nt, Human
uguucuuagguauuugacaguc

SEQ ID NO: 701589 - RNA, 22 nt, Human
uuucuaagugaacauucaaguu

SEQ ID NO: 701590 - RNA, 22 nt, Human
ucagcuuugccaccagcuguaa

SEQ ID NO: 701591 - RNA, 22 nt, Human
ugaggaagccaaacagcuacac

SEQ ID NO: 701592 - RNA, 22 nt, Human
ugaacagaucaauagaacugac

SEQ ID NO: 701593 - RNA, 22 nt, Human
ucagcuuuuaaaaacaagaagu

SEQ ID NO: 701594 - RNA, 22 nt, Human
ugcuagaauaccuaccuggagg

SEQ ID NO: 701595 - RNA, 20 nt, Human
agagcugggaagcucccuau

SEQ ID NO: 701596 - RNA, 22 nt, Human
uuauguugggaaaagucagauu

SEQ ID NO: 701597 - RNA, 22 nt, Human
augcugggaaacugaaaggaau

SEQ ID NO: 701598 - RNA, 20 nt, Human
gggugagauguaggagaggg

SEQ ID NO: 701599 - RNA, 22 nt, Human
ccagcagaguugguuucuggua

SEQ ID NO: 701600 - RNA, 22 nt, Human
cagcagcacucugcgggucccc

SEQ ID NO: 701601 - RNA, 22 nt, Human
ccuuuagaaagucaguaguugc

SEQ ID NO: 701602 - RNA, 22 nt, Human
uguuuacuggcuccugugguuc

SEQ ID NO: 701603 - RNA, 22 nt, Human
ugcacacacaggagucuccucc

SEQ ID NO: 701604 - RNA, 22 nt, Human
cagaagcaagggccaaagucuu

SEQ ID NO: 701605 - RNA, 22 nt, Human
uggcagagacaaggccgggccu

SEQ ID NO: 701606 - RNA, 22 nt, Human
agaugaaaauacgugacuuuaa

SEQ ID NO: 701607 - RNA, 21 nt, Human
ugagagaguagcaggacauau

SEQ ID NO: 701608 - RNA, 22 nt, Human
cccugccuucuuggccuuuaaa

SEQ ID NO: 701609 - RNA, 22 nt, Human
aggggcucaguuacuuuggcag

SEQ ID NO: 701610 - RNA, 22 nt, Human
uggcagauguauaucacagcuu

SEQ ID NO: 701611 - RNA, 22 nt, Human
uaaacauuuguuauucuuguuu

SEQ ID NO: 701612 - RNA, 22 nt, Human
cuuuguaagucuuucuccaaga

SEQ ID NO: 701613 - RNA, 22 nt, Human
uucagcuccuuauuucugagca

SEQ ID NO: 701614 - RNA, 22 nt, Human
acuuucauuuguaauaaacuuc

SEQ ID NO: 701615 - RNA, 22 nt, Human
cugggacccacaccuggaaucu

SEQ ID NO: 701616 - RNA, 22 nt, Human
agcaaggcagcuuucacugcuu

SEQ ID NO: 701617 - RNA, 22 nt, Human
auacaugcacauuuuuauacau

SEQ ID NO: 701618 - RNA, 22 nt, Human
uuaauuugaccauaaauaucuu

SEQ ID NO: 701619 - RNA, 22 nt, Human
gaagcugagcugaggcauguug

SEQ ID NO: 701620 - RNA, 23 nt, Human
uguguacauacauauguacacac

SEQ ID NO: 701621 - RNA, 22 nt, Human
ugcugucugauucagggugauu

SEQ ID NO: 701622 - RNA, 19 nt, Human
ucuaaacacagggacaagc

SEQ ID NO: 701623 - RNA, 22 nt, Human
uucauacucacuccaauaacug

SEQ ID NO: 701624 - RNA, 22 nt, Human
cagaauuuagcacaauguaugg

SEQ ID NO: 701625 - RNA, 22 nt, Human
ucucagagauuuuguuucccuu

SEQ ID NO: 701626 - RNA, 22 nt, Human
caaaagucuuccuauucucuua

SEQ ID NO: 701627 - RNA, 22 nt, Human
guagcaauguugaacacugcgu

SEQ ID NO: 701628 - RNA, 22 nt, Human
gaacagcagcuuccugggaauu

SEQ ID NO: 701629 - RNA, 22 nt, Human
caguccugagccaaucaugaug

SEQ ID NO: 701630 - RNA, 22 nt, Human
ugagguaugguaagguaaaauc

SEQ ID NO: 701631 - RNA, 22 nt, Human
uaauccagcgggugauugcaca

SEQ ID NO: 701632 - RNA, 22 nt, Human
uugcaaaugaccauugccacau

SEQ ID NO: 701633 - RNA, 22 nt, Human
aggauucuguaaucugugaaau

SEQ ID NO: 701634 - RNA, 22 nt, Human
aauaggaagcaccaaauucucc

SEQ ID NO: 701635 - RNA, 22 nt, Human
uagguucacugucuugaggagc

SEQ ID NO: 701636 - RNA, 22 nt, Human
guacagaauuaugccaugaggg

SEQ ID NO: 701637 - RNA, 22 nt, Human
caguuuaccuauauguaaauuu

SEQ ID NO: 701638 - RNA, 22 nt, Human
acagaaauucaaacuggaauuu

SEQ ID NO: 701639 - RNA, 22 nt, Human
ugagugggauuaaaugagguga

SEQ ID NO: 701640 - RNA, 22 nt, Human
auucugugauaguugauccuua

SEQ ID NO: 701641 - RNA, 22 nt, Human
cugcagggaacugaggcccaga

SEQ ID NO: 701642 - RNA, 22 nt, Human
aaugggagagaacacaaagucc

SEQ ID NO: 701643 - RNA, 22 nt, Human
ccaccccugggugcagggagcg

SEQ ID NO: 701644 - RNA, 22 nt, Human
aguauuuagagacacaagaugg

SEQ ID NO: 701645 - RNA, 22 nt, Human
caucuccaggaguucuacucau

SEQ ID NO: 701646 - RNA, 22 nt, Human
ucagcagggagaggagaaugca

SEQ ID NO: 701647 - RNA, 22 nt, Human
ugguauguaaauuguaacucaa

SEQ ID NO: 701648 - RNA, 16 nt, Human
gaucuguucuauuuca

SEQ ID NO: 701649 - RNA, 22 nt, Human
ugcaugaacggaggguaagcug

SEQ ID NO: 701650 - RNA, 23 nt, Human
aggaagcuaccaauuuuguaggc

SEQ ID NO: 701651 - RNA, 22 nt, Human
cugagagguaaucacacaaaau

SEQ ID NO: 701652 - RNA, 22 nt, Human
cuaacuuuuugauucuugggga

SEQ ID NO: 701653 - RNA, 22 nt, Human
aggagacagccaggggccugag

SEQ ID NO: 701654 - RNA, 22 nt, Human
aacaucuuguacugcacauuuu

SEQ ID NO: 701655 - RNA, 22 nt, Human
ccucuguccccagugcaggccu

SEQ ID NO: 701656 - RNA, 22 nt, Human
gagugugggggugcugaggaca

SEQ ID NO: 701657 - RNA, 22 nt, Human
ugggagcaagcuggugcuggag

SEQ ID NO: 701658 - RNA, 23 nt, Human
caguucccacugucugucacaag

SEQ ID NO: 701659 - RNA, 22 nt, Human
caugcagggacuagagaacagg

SEQ ID NO: 701660 - RNA, 22 nt, Human
acugggcucccaggcuugucau

SEQ ID NO: 701661 - RNA, 22 nt, Human
cagcaacuccuauauugaaagc

SEQ ID NO: 701662 - RNA, 19 nt, Human
uguguggguuuagaguagu

SEQ ID NO: 701663 - RNA, 22 nt, Human
cagaagacagagcacuucucuu

SEQ ID NO: 701664 - RNA, 22 nt, Human
agcuugccucuuaaucaccuca

SEQ ID NO: 701665 - RNA, 22 nt, Human
ccuugagccagggagcuggcag

SEQ ID NO: 701666 - RNA, 22 nt, Human
cuggcucaccuccgcuccagca

SEQ ID NO: 701667 - RNA, 18 nt, Human
cuccuuggagaagaggcc

SEQ ID NO: 701668 - RNA, 18 nt, Human
ggagagugagaucaaaca

SEQ ID NO: 701669 - RNA, 22 nt, Human
cagcugcagaaagcaagcaggu

SEQ ID NO: 701670 - RNA, 22 nt, Human
aggccucacucucagagcuucu

SEQ ID NO: 701671 - RNA, 20 nt, Human
gccacugggcaccagcaggg

SEQ ID NO: 701672 - RNA, 22 nt, Human
cuguauuugaaagaaaagauuu

SEQ ID NO: 701673 - RNA, 22 nt, Human
aguagaaucagccucuugaugg

SEQ ID NO: 701674 - RNA, 22 nt, Human
gcuuggcuccuggcucacaggu

SEQ ID NO: 701675 - RNA, 22 nt, Human
acuuagaaagggauucuagauu

SEQ ID NO: 701676 - RNA, 22 nt, Human
ccacugaguacccgauggcugc

SEQ ID NO: 701677 - RNA, 22 nt, Human
uauacagauaaugaagaccaag

SEQ ID NO: 701678 - RNA, 22 nt, Human
uguguaaauuauuuuuaaugau

SEQ ID NO: 701679 - RNA, 22 nt, Human
ccagggcuugguggcuuguauc

SEQ ID NO: 701680 - RNA, 22 nt, Human
ugcuuaaacauccagacaguau

SEQ ID NO: 701681 - RNA, 22 nt, Human
cucuuugucacucauacaguca

SEQ ID NO: 701682 - RNA, 22 nt, Human
cacaggagggagcgggcagcca

SEQ ID NO: 701683 - RNA, 22 nt, Human
uuuuuuaucuaugguaguacca

SEQ ID NO: 701684 - RNA, 23 nt, Human
aucaaacuggugagaaugucagu

SEQ ID NO: 701685 - RNA, 22 nt, Human
ugcguggcuggucccugugacc

SEQ ID NO: 701686 - RNA, 22 nt, Human
agcuccuggcuuuccucucacc

SEQ ID NO: 701687 - RNA, 22 nt, Human
ugguaagggguggaaccagagc

SEQ ID NO: 701688 - RNA, 22 nt, Human
uacagaaagggaugauugaucu

SEQ ID NO: 701689 - RNA, 18 nt, Human
gggcuguguucaugccca

SEQ ID NO: 701690 - RNA, 22 nt, Human
ugagaaauggcagcauuacugg

SEQ ID NO: 701691 - RNA, 22 nt, Human
acacagauauuguacuugaucc

SEQ ID NO: 701692 - RNA, 23 nt, Human
uugauuucaaaugcagagaacac

SEQ ID NO: 701693 - RNA, 22 nt, Human
cugggcagugcagcuauagaac

SEQ ID NO: 701694 - RNA, 22 nt, Human
ucuccgaucacagguuuucaau

SEQ ID NO: 701695 - RNA, 22 nt, Human
uagguagggaccaccuugggga

SEQ ID NO: 701696 - RNA, 22 nt, Human
ggcuugaagggaggaaagcagg

SEQ ID NO: 701697 - RNA, 22 nt, Human
aaguauucuggcagucauucag

SEQ ID NO: 701698 - RNA, 22 nt, Human
uaucuuguaauagguccacuug

SEQ ID NO: 701699 - RNA, 22 nt, Human
ugcaaaaacagccuugaggccu

SEQ ID NO: 701700 - RNA, 22 nt, Human
uguaugaaagaacaagggcuua

SEQ ID NO: 701701 - RNA, 22 nt, Human
cccacccugggcuacacaucca

SEQ ID NO: 701702 - RNA, 19 nt, Human
ccuuugguuuccaugacau

SEQ ID NO: 701703 - RNA, 22 nt, Human
ucuccaggugcuaagugugccu

SEQ ID NO: 701704 - RNA, 22 nt, Human
gagcaggugccuguagcucucu

SEQ ID NO: 701705 - RNA, 22 nt, Human
uccagaggcagcugcggucagg

SEQ ID NO: 701706 - RNA, 22 nt, Human
uguucagagacagaaauucuaa

SEQ ID NO: 701707 - RNA, 22 nt, Human
aaucuggaguuaauguuuucgc

SEQ ID NO: 701708 - RNA, 20 nt, Human
ugucuucauuauggugcccu

SEQ ID NO: 701709 - RNA, 21 nt, Human
ucuaugcaagacccuaguccu

SEQ ID NO: 701710 - RNA, 22 nt, Human
uugagaaaccuggcaguagaga

SEQ ID NO: 701711 - RNA, 22 nt, Human
cagggccucucaucccacgggc

SEQ ID NO: 701712 - RNA, 22 nt, Human
aggcuuccgaguagcugggacu

SEQ ID NO: 701713 - RNA, 22 nt, Human
ucuuuuggguucuuaugauuua

SEQ ID NO: 701714 - RNA, 22 nt, Human
agcagggggccacagucacagc

SEQ ID NO: 701715 - RNA, 22 nt, Human
auguggcagugggaggugaauu

SEQ ID NO: 701716 - RNA, 22 nt, Human
uauuuauguauguggauguguu

SEQ ID NO: 701717 - RNA, 18 nt, Human
uucugugcaucuuucuau

SEQ ID NO: 701718 - RNA, 22 nt, Human
agacaggacacaagcugcauaa

SEQ ID NO: 701719 - RNA, 22 nt, Human
aagggcucugggcuacgcacug

SEQ ID NO: 701720 - RNA, 22 nt, Human
uagcaaaaacugcaguuacuuu

SEQ ID NO: 701721 - RNA, 22 nt, Human
ccucgcggcacucgggccggau

SEQ ID NO: 701722 - RNA, 22 nt, Human
guugagcaaggccagagaagcc

SEQ ID NO: 701723 - RNA, 22 nt, Human
caugagaucugcagggaugggc

SEQ ID NO: 701724 - RNA, 22 nt, Human
aggucugggcaccacuggcugc

SEQ ID NO: 701725 - RNA, 19 nt, Human
uaguacacacucuaauucc

SEQ ID NO: 701726 - RNA, 22 nt, Human
auuugcuucuugcuuccagcac

SEQ ID NO: 701727 - RNA, 22 nt, Human
aagagaugaagguccugacugu

SEQ ID NO: 701728 - RNA, 22 nt, Human
agaucacaguggcaacucccuu

SEQ ID NO: 701729 - RNA, 22 nt, Human
cagcugggcuaagaguagaggc

SEQ ID NO: 701730 - RNA, 22 nt, Human
cuguuauuucugccaggugagu

SEQ ID NO: 701731 - RNA, 22 nt, Human
uauaggcuuuugccugaagcua

SEQ ID NO: 701732 - RNA, 18 nt, Human
uggcagagugucuguucu

SEQ ID NO: 701733 - RNA, 19 nt, Human
cugcugaauuagcucugga

SEQ ID NO: 701734 - RNA, 20 nt, Human
uguccuaauagacaagcaga

SEQ ID NO: 701735 - RNA, 22 nt, Human
uauuucuugaguggucaguuuc

SEQ ID NO: 701736 - RNA, 22 nt, Human
uacagcuguugguguuuccucu

SEQ ID NO: 701737 - RNA, 22 nt, Human
ggcucuggagauguccgaccug

SEQ ID NO: 701738 - RNA, 22 nt, Human
ucuugaaaguaucuuauuuugu

SEQ ID NO: 701739 - RNA, 23 nt, Human
cagcuuucagggcuuuagggaag

SEQ ID NO: 701740 - RNA, 22 nt, Human
gggcuucaguucugaccaucuu

SEQ ID NO: 701741 - RNA, 22 nt, Human
ucugggccuuggaguggggaga

SEQ ID NO: 701742 - RNA, 22 nt, Human
gaaguuacucucguuaaauaug

SEQ ID NO: 701743 - RNA, 22 nt, Human
uuacuuuggcaaacuccugccc

SEQ ID NO: 701744 - RNA, 19 nt, Human
uggaggccucaggaaaaga

SEQ ID NO: 701745 - RNA, 22 nt, Human
uuccacaggacuaaaugucauc

SEQ ID NO: 701746 - RNA, 22 nt, Human
cucugcaccuuguaggaggcaa

SEQ ID NO: 701747 - RNA, 22 nt, Human
ugcuaggaauacacagagcaau

SEQ ID NO: 701748 - RNA, 22 nt, Human
caugcggcucuuuccaaaccgg

SEQ ID NO: 701749 - RNA, 22 nt, Human
cagcaggaggugagaugugacc

SEQ ID NO: 701750 - RNA, 22 nt, Human
aucggggaaaagggaggcugug

SEQ ID NO: 701751 - RNA, 22 nt, Human
cugcuuccucccuguaaaggca

SEQ ID NO: 701752 - RNA, 22 nt, Human
ugcaauuaauuuacaugcuuaa

SEQ ID NO: 701753 - RNA, 22 nt, Human
accuucaggugagcacacagau

SEQ ID NO: 701754 - RNA, 22 nt, Human
uagggcugcagaacaauggccu

SEQ ID NO: 701755 - RNA, 22 nt, Human
gagucuccaauccaugccuguc

SEQ ID NO: 701756 - RNA, 22 nt, Human
agauuuagugguggaauuuugg

SEQ ID NO: 701757 - RNA, 21 nt, Human
uggccucccacacuuccaugg

SEQ ID NO: 701758 - RNA, 22 nt, Human
ccacagaguuacaaaacaguca

SEQ ID NO: 701759 - RNA, 22 nt, Human
uucagaaagugaaucuuguuau

SEQ ID NO: 701760 - RNA, 22 nt, Human
ggccacugcccuggcuacaccg

SEQ ID NO: 701761 - RNA, 22 nt, Human
ccaaugagacagaaagagccuc

SEQ ID NO: 701762 - RNA, 22 nt, Human
cugccugcuaccugaaaugcca

SEQ ID NO: 701763 - RNA, 22 nt, Human
agaccugggugcccugugcuuu

SEQ ID NO: 701764 - RNA, 17 nt, Human
uuguguguaguucugau

SEQ ID NO: 701765 - RNA, 22 nt, Human
caggacacuuguucuucucugc

SEQ ID NO: 701766 - RNA, 22 nt, Human
uacccagauucacaagccaagg

SEQ ID NO: 701767 - RNA, 22 nt, Human
ccugaggccccugaggauagca

SEQ ID NO: 701768 - RNA, 22 nt, Human
agacagcauggagcugauaaca

SEQ ID NO: 701769 - RNA, 22 nt, Human
gggaggguguucucccaagaac

SEQ ID NO: 701770 - RNA, 22 nt, Human
gcucccagacugaccagaggug

SEQ ID NO: 701771 - RNA, 23 nt, Human
ggcuuugcucuggguucuagggu

SEQ ID NO: 701772 - RNA, 22 nt, Human
ugggggcauggaccagccuggc

SEQ ID NO: 701773 - RNA, 22 nt, Human
caggggcaagaaugcugucagc

SEQ ID NO: 701774 - RNA, 22 nt, Human
cuggcucacaggugagaugcau

SEQ ID NO: 701775 - RNA, 22 nt, Human
agcaccaggcuguuggaagccc

SEQ ID NO: 701776 - RNA, 22 nt, Human
cacaggaaagucagccagaaga

SEQ ID NO: 701777 - RNA, 22 nt, Human
ccagcuggagccaagguggacu

SEQ ID NO: 701778 - RNA, 22 nt, Human
guuuauaugaacuucauaccca

SEQ ID NO: 701779 - RNA, 20 nt, Human
cagcagagacccauggggag

SEQ ID NO: 701780 - RNA, 22 nt, Human
cagaaagaccugauuggcaguu

SEQ ID NO: 701781 - RNA, 22 nt, Human
uagcccagagucccaauuccag

SEQ ID NO: 701782 - RNA, 22 nt, Human
uuugcauuacuugacuuuaguu

SEQ ID NO: 701783 - RNA, 19 nt, Human
ucugaaguccagggcauac

SEQ ID NO: 701784 - RNA, 22 nt, Human
uuguaugcugaugacaccaccu

SEQ ID NO: 701785 - RNA, 22 nt, Human
agcuaacaugacuagaagcuuc

SEQ ID NO: 701786 - RNA, 23 nt, Human
uuugaaguugacugccuuccaga

SEQ ID NO: 701787 - RNA, 22 nt, Human
ugacaucugggcccucagcuaa

SEQ ID NO: 701788 - RNA, 22 nt, Human
ggccagagucuauaugcagaca

SEQ ID NO: 701789 - RNA, 22 nt, Human
ugcaaucucggcacuuugggag

SEQ ID NO: 701790 - RNA, 19 nt, Human
gcuuuuuguugucaaaggu

SEQ ID NO: 701791 - RNA, 22 nt, Human
ugagaaagacagacauuccuaa

SEQ ID NO: 701792 - RNA, 23 nt, Human
uuuaugcugugauucacccagcc

SEQ ID NO: 701793 - RNA, 21 nt, Human
aaauugccacacauuucuucc

SEQ ID NO: 701794 - RNA, 22 nt, Human
augcaguaaauguuaagaaaaa

SEQ ID NO: 701795 - RNA, 22 nt, Human
ugaaugaucuaguuuuguagac

SEQ ID NO: 701796 - RNA, 22 nt, Human
uagcugccuagacagcuauagc

SEQ ID NO: 701797 - RNA, 22 nt, Human
gacagcuggcaguggaaaggug

SEQ ID NO: 701798 - RNA, 22 nt, Human
ggcuggaccaugcugccccuuc

SEQ ID NO: 701799 - RNA, 22 nt, Human
aguggcugcuucugguugcucc

SEQ ID NO: 701800 - RNA, 22 nt, Human
aaucaguuucuuggcaaguuua

SEQ ID NO: 701801 - RNA, 22 nt, Human
cuucuuccaguuauaagagcuu

SEQ ID NO: 701802 - RNA, 22 nt, Human
ugcuuuuagcuaguaacuagua

SEQ ID NO: 701803 - RNA, 22 nt, Human
uccugcaggggcugaggaacca

SEQ ID NO: 701804 - RNA, 22 nt, Human
gacagcugugcaggagaagggg

SEQ ID NO: 701805 - RNA, 22 nt, Human
cagguccucgggggaggccggc

SEQ ID NO: 701806 - RNA, 22 nt, Human
auuguucauguaugaauaaaua

SEQ ID NO: 701807 - RNA, 22 nt, Human
uugaaacauuaccuguauuucc

SEQ ID NO: 701808 - RNA, 22 nt, Human
gagcagcacuugaggcauguca

SEQ ID NO: 701809 - RNA, 22 nt, Human
uccaggcaggguuaaggguccu

SEQ ID NO: 701810 - RNA, 22 nt, Human
uccuggagagaggccuggaaga

SEQ ID NO: 701811 - RNA, 22 nt, Human
aguccaugcugucuacagaauc

SEQ ID NO: 701812 - RNA, 22 nt, Human
aggugcagaaaaaaguccuuua

SEQ ID NO: 701813 - RNA, 22 nt, Human
ugauuuccugugcgcccuuagg

SEQ ID NO: 701814 - RNA, 22 nt, Human
cugagguccuugacugcuugcc

SEQ ID NO: 701815 - RNA, 22 nt, Human
cauccugacuguaacuaagaga

SEQ ID NO: 701816 - RNA, 22 nt, Human
acauguaaaagauaaauuaaca

SEQ ID NO: 701817 - RNA, 22 nt, Human
accccagcgcauauggucugcg

SEQ ID NO: 701818 - RNA, 22 nt, Human
auuugucaaaacacagagaaca

SEQ ID NO: 701819 - RNA, 22 nt, Human
uugccaggcucugguuccagcc

SEQ ID NO: 701820 - RNA, 22 nt, Human
aauaaugagcuugucuaauugu

SEQ ID NO: 701821 - RNA, 22 nt, Human
ccagcuuucauaucaugaggua

SEQ ID NO: 701822 - RNA, 22 nt, Human
gccagggggucagcaggcacuu

SEQ ID NO: 701823 - RNA, 22 nt, Human
ggcucagaaaccucuggugucu

SEQ ID NO: 701824 - RNA, 22 nt, Human
guauaaaguauaagcuuguuuu

SEQ ID NO: 701825 - RNA, 22 nt, Human
gaauugcuaaccaauucaaaau

SEQ ID NO: 701826 - RNA, 22 nt, Human
ggacaaauucccuauuugcaug

SEQ ID NO: 701827 - RNA, 23 nt, Human
agaggcacuaauuauucagagau

SEQ ID NO: 701828 - RNA, 22 nt, Human
gucaaagaaacgcaccuuacau

SEQ ID NO: 701829 - RNA, 22 nt, Human
aagccacucacaauaacugucc

SEQ ID NO: 701830 - RNA, 22 nt, Human
aguggcagaagucacuggguag

SEQ ID NO: 701831 - RNA, 22 nt, Human
ucucugggaguugagcagcagc

SEQ ID NO: 701832 - RNA, 22 nt, Human
ucccugcacagccgagccaugc

SEQ ID NO: 701833 - RNA, 22 nt, Human
cuuaaauuggaugaguuaaguu

SEQ ID NO: 701834 - RNA, 22 nt, Human
augcauguuuauagggugcuuc

SEQ ID NO: 701835 - RNA, 18 nt, Human
aaugcauuuauggagaug

SEQ ID NO: 701836 - RNA, 20 nt, Human
acaggcuuucugaggcuggc

SEQ ID NO: 701837 - RNA, 22 nt, Human
ccaauucaccuccuaugcacau

SEQ ID NO: 701838 - RNA, 22 nt, Human
agugcuggguacuguucccauu

SEQ ID NO: 701839 - RNA, 18 nt, Human
ggccucuggacuggcagc

SEQ ID NO: 701840 - RNA, 22 nt, Human
ucuucucccaucggccgcaggg

SEQ ID NO: 701841 - RNA, 22 nt, Human
aauaacuucaguucuuacauua

SEQ ID NO: 701842 - RNA, 22 nt, Human
aauuggcaagcaaguuauccag

SEQ ID NO: 701843 - RNA, 22 nt, Human
guuuccagccuagagaugguga

SEQ ID NO: 701844 - RNA, 22 nt, Human
acugggcuguuccuuauuucua

SEQ ID NO: 701845 - RNA, 22 nt, Human
aggaggccuacgcacaugucua

SEQ ID NO: 701846 - RNA, 22 nt, Human
aucugaaaagcuuuaaugagcu

SEQ ID NO: 701847 - RNA, 22 nt, Human
ggaggagcacuugacggggucu

SEQ ID NO: 701848 - RNA, 23 nt, Human
ugggccucuccacccuuuucugu

SEQ ID NO: 701849 - RNA, 22 nt, Human
acauucuguuuccccaaagaga

SEQ ID NO: 701850 - RNA, 22 nt, Human
ugcagaacgggucuucuagcac

SEQ ID NO: 701851 - RNA, 22 nt, Human
ccagggcagugggagaaggugc

SEQ ID NO: 701852 - RNA, 22 nt, Human
agggcccuaaggaaggcacaca

SEQ ID NO: 701853 - RNA, 22 nt, Human
aauaacagagucuucaagauag

SEQ ID NO: 701854 - RNA, 22 nt, Human
uuagauguggacuuauguuauu

SEQ ID NO: 701855 - RNA, 22 nt, Human
caggucagaggcgcagccccca

SEQ ID NO: 701856 - RNA, 22 nt, Human
gggcugcacagaucuucaaggg

SEQ ID NO: 701857 - RNA, 22 nt, Human
ugccacuggcucaauggugcag

SEQ ID NO: 701858 - RNA, 19 nt, Human
ucucuauauuuguuucuga

SEQ ID NO: 701859 - RNA, 23 nt, Human
ucuucauggccaucugguucuuc

SEQ ID NO: 701860 - RNA, 22 nt, Human
agcucagggcaaagacucaaau

SEQ ID NO: 701861 - RNA, 22 nt, Human
gagcccuccauggagccaggca

SEQ ID NO: 701862 - RNA, 22 nt, Human
gagggucccgagcccugucaga

SEQ ID NO: 701863 - RNA, 22 nt, Human
ugccauugggcagucauugaag

SEQ ID NO: 701864 - RNA, 22 nt, Human
uaugcauuuuauagugcaaagc

SEQ ID NO: 701865 - RNA, 22 nt, Human
gcaggcagagucaauuugaucc

SEQ ID NO: 701866 - RNA, 22 nt, Human
uccuugaauggacauuacacug

SEQ ID NO: 701867 - RNA, 23 nt, Human
gcuuuuaaaccugugacugccgc

SEQ ID NO: 701868 - RNA, 18 nt, Human
uuggaggauguccaugaa

SEQ ID NO: 701869 - RNA, 22 nt, Human
cugacucccuccccaaagcugg

SEQ ID NO: 701870 - RNA, 22 nt, Human
auguccagagaacauuugcuuu

SEQ ID NO: 701871 - RNA, 22 nt, Human
cugggcugagccugggcugugu

SEQ ID NO: 701872 - RNA, 22 nt, Human
caguuuaaguagaacugagaau

SEQ ID NO: 701873 - RNA, 22 nt, Human
agggcaauccagccagcugauc

SEQ ID NO: 701874 - RNA, 22 nt, Human
uugaaugcaucuuugagcuccu

SEQ ID NO: 701875 - RNA, 22 nt, Human
uaguuuaggauccaaucuaaga

SEQ ID NO: 701876 - RNA, 22 nt, Human
agacucugauaagcaacucuug

SEQ ID NO: 701877 - RNA, 22 nt, Human
ucugagggaauagcuauuguag

SEQ ID NO: 701878 - RNA, 22 nt, Human
gcgggcgcucaggcugcagcug

SEQ ID NO: 701879 - RNA, 20 nt, Human
ugaguggccacugggucgca

SEQ ID NO: 701880 - RNA, 22 nt, Human
ggggccuuggaucugugccccg

SEQ ID NO: 701881 - RNA, 22 nt, Human
ucuucaaaaacugcaccuugcu

SEQ ID NO: 701882 - RNA, 23 nt, Human
uuucacauuaauguuuagcagga

SEQ ID NO: 701883 - RNA, 22 nt, Human
ugcacagaauaauauauguucu

SEQ ID NO: 701884 - RNA, 22 nt, Human
aagauuucagaguuugggggaa

SEQ ID NO: 701885 - RNA, 22 nt, Human
acuuucuccagaaaaccaagga

SEQ ID NO: 701886 - RNA, 22 nt, Human
uucucauggugucuuuauacau

SEQ ID NO: 701887 - RNA, 22 nt, Human
uguccuggccuccagaaagucg

SEQ ID NO: 701888 - RNA, 22 nt, Human
cuuguuuuggaacagagugaau

SEQ ID NO: 701889 - RNA, 22 nt, Human
ugggaagaagcagagaacugga

SEQ ID NO: 701890 - RNA, 22 nt, Human
aacaguuuauguaaauguccag

SEQ ID NO: 701891 - RNA, 22 nt, Human
ugggcugagaguaccuuauaaa

SEQ ID NO: 701892 - RNA, 22 nt, Human
agaguuugaaguuaucuuugac

SEQ ID NO: 701893 - RNA, 22 nt, Human
agugaugguuuccagucacuga

SEQ ID NO: 701894 - RNA, 22 nt, Human
aaagcaugugaauagaauaugg

SEQ ID NO: 701895 - RNA, 22 nt, Human
ugcaugcucaaguuaguuguga

SEQ ID NO: 701896 - RNA, 22 nt, Human
uguacaaaguuaaaccuauaua

SEQ ID NO: 701897 - RNA, 22 nt, Human
ucugccugccgagaacaccuac

SEQ ID NO: 701898 - RNA, 22 nt, Human
ggcggguguaaguaggacagcg

SEQ ID NO: 701899 - RNA, 19 nt, Human
gggagagccaggcucaccc

SEQ ID NO: 701900 - RNA, 23 nt, Human
cccuguagcccaggacaggcuuu

SEQ ID NO: 701901 - RNA, 17 nt, Human
gcagacacuucuauuga

SEQ ID NO: 701902 - RNA, 22 nt, Human
gcacuggaggguguaguugcug

SEQ ID NO: 701903 - RNA, 22 nt, Human
uccagagcaugcagaucaucaa

SEQ ID NO: 701904 - RNA, 22 nt, Human
agcugggccugagcuggaagcu

SEQ ID NO: 701905 - RNA, 22 nt, Human
cugucccuucauuauucacuac

SEQ ID NO: 701906 - RNA, 22 nt, Human
uucuggaaccaacaugccaguu

SEQ ID NO: 701907 - RNA, 22 nt, Human
uuauucugaacuagacucucau

SEQ ID NO: 701908 - RNA, 22 nt, Human
gagggcugauguugccaccuca

SEQ ID NO: 701909 - RNA, 22 nt, Human
acagaaaugauguuuggcaaua

SEQ ID NO: 701910 - RNA, 22 nt, Human
accagcuguuaucuguaguauc

SEQ ID NO: 701911 - RNA, 23 nt, Human
aaacuugcuauggcugaaaucau

SEQ ID NO: 701912 - RNA, 20 nt, Human
aggcacuggauuucuuauau

SEQ ID NO: 701913 - RNA, 22 nt, Human
uuagacauagaauauugucuag

SEQ ID NO: 701914 - RNA, 22 nt, Human
ucccuggcacaagaaggcuguc

SEQ ID NO: 701915 - RNA, 22 nt, Human
gugauccgaugucagucgcaga

SEQ ID NO: 701916 - RNA, 22 nt, Human
uuuugugacacuucuugagaca

SEQ ID NO: 701917 - RNA, 22 nt, Human
uauagcaagcaggacagucuca

SEQ ID NO: 701918 - RNA, 22 nt, Human
ucugaggacagugcugugccug

SEQ ID NO: 701919 - RNA, 22 nt, Human
uuagaggugucaggagcacagg

SEQ ID NO: 701920 - RNA, 22 nt, Human
uggagcugggaguccugggcug

SEQ ID NO: 701921 - RNA, 22 nt, Human
uuuguguuuguacaaugcacua

SEQ ID NO: 701922 - RNA, 22 nt, Human
aauagcaaaugcucauuugaaa

SEQ ID NO: 701923 - RNA, 18 nt, Human
gcugcgugggaugugacc

SEQ ID NO: 701924 - RNA, 22 nt, Human
cgcuaggauuaggauuaauccu

SEQ ID NO: 701925 - RNA, 22 nt, Human
aagaacuguaucaagauguagu

SEQ ID NO: 701926 - RNA, 22 nt, Human
ucagagguggccccugcccuca

SEQ ID NO: 701927 - RNA, 22 nt, Human
cuccuggaugcaggcugucugc

SEQ ID NO: 701928 - RNA, 22 nt, Human
ugcucuggagggugaagcuuuu

SEQ ID NO: 701929 - RNA, 22 nt, Human
cuaguucuagaucccugaggaa

SEQ ID NO: 701930 - RNA, 17 nt, Human
gacuucaacuucugcug

SEQ ID NO: 701931 - RNA, 22 nt, Human
cuggcccccacaccugucaggg

SEQ ID NO: 701932 - RNA, 22 nt, Human
cuuggagauucauugccugaaa

SEQ ID NO: 701933 - RNA, 22 nt, Human
ugaggcagguggauuacaaggu

SEQ ID NO: 701934 - RNA, 22 nt, Human
ccuggcauguccuccuggcaug

SEQ ID NO: 701935 - RNA, 22 nt, Human
ggggcugguggugguuucucca

SEQ ID NO: 701936 - RNA, 22 nt, Human
uccauguggccagacacuggca

SEQ ID NO: 701937 - RNA, 22 nt, Human
ccugcagucuacccaaugugug

SEQ ID NO: 701938 - RNA, 22 nt, Human
uacucucaggguuaguacagga

SEQ ID NO: 701939 - RNA, 22 nt, Human
uauuccaugccagaguuuauug

SEQ ID NO: 701940 - RNA, 22 nt, Human
ucaggcugggcuccucucccca

SEQ ID NO: 701941 - RNA, 22 nt, Human
gagcagaacaggccggguggga

SEQ ID NO: 701942 - RNA, 22 nt, Human
cucugcuuuccucuuacacacu

SEQ ID NO: 701943 - RNA, 22 nt, Human
auucucuggguuccaguaaaug

SEQ ID NO: 701944 - RNA, 22 nt, Human
gguguuaaacaugauccauuac

SEQ ID NO: 701945 - RNA, 22 nt, Human
cuucagagugcagaagauuggg

SEQ ID NO: 701946 - RNA, 17 nt, Human
agcccccacucccaagu

SEQ ID NO: 701947 - RNA, 22 nt, Human
ugaagacagggucuuuaacgag

SEQ ID NO: 701948 - RNA, 22 nt, Human
cagagccucugcccugggcacu

SEQ ID NO: 701949 - RNA, 22 nt, Human
acacaguauugugacuauaacu

SEQ ID NO: 701950 - RNA, 22 nt, Human
ggucuugaaggacauccagucc

SEQ ID NO: 701951 - RNA, 19 nt, Human
ccucccacggauuccuucc

SEQ ID NO: 701952 - RNA, 22 nt, Human
cuguugucuccucucagauuau

SEQ ID NO: 701953 - RNA, 22 nt, Human
caauacaucaggucaaaaugug

SEQ ID NO: 701954 - RNA, 22 nt, Human
uuugaucaugaagaggauaaac

SEQ ID NO: 701955 - RNA, 22 nt, Human
ucagcauuucagaaguggcaua

SEQ ID NO: 701956 - RNA, 22 nt, Human
gugggagcuucaucaagcaguu

SEQ ID NO: 701957 - RNA, 22 nt, Human
uauuugcucaauaauaguuuua

SEQ ID NO: 701958 - RNA, 22 nt, Human
augcaaauucuuugcuucuucu

SEQ ID NO: 701959 - RNA, 22 nt, Human
cagccagcuggugcggcagagc

SEQ ID NO: 701960 - RNA, 22 nt, Human
auguuucuaaaacuugcauggc

SEQ ID NO: 701961 - RNA, 22 nt, Human
ggugcugacauucagagucugg

SEQ ID NO: 701962 - RNA, 22 nt, Human
aagcacagcuggaacagcagga

SEQ ID NO: 701963 - RNA, 22 nt, Human
aaacugcacacgaugugccuga

SEQ ID NO: 701964 - RNA, 22 nt, Human
cagcugcccugccuugcccuua

SEQ ID NO: 701965 - RNA, 22 nt, Human
cuguucauggaaaaauaguugg

SEQ ID NO: 701966 - RNA, 22 nt, Human
ugacaaugacauggacagugau

SEQ ID NO: 701967 - RNA, 22 nt, Human
ccugggcugggcgucucauggg

SEQ ID NO: 701968 - RNA, 22 nt, Human
ucuccagggcagagaauagcaa

SEQ ID NO: 701969 - RNA, 22 nt, Human
gcaguggcaccgcuggcucugg

SEQ ID NO: 701970 - RNA, 22 nt, Human
ucagccacuacccaccuuaaca

SEQ ID NO: 701971 - RNA, 22 nt, Human
aggaauugguucaagguuuauc

SEQ ID NO: 701972 - RNA, 22 nt, Human
gggccuccggggugagcugugg

SEQ ID NO: 701973 - RNA, 22 nt, Human
acugggcccauauacucagucu

SEQ ID NO: 701974 - RNA, 22 nt, Human
gcuccuguuuucuuccagaaau

SEQ ID NO: 701975 - RNA, 23 nt, Human
uggagaauucuuccuuccacugu

SEQ ID NO: 701976 - RNA, 22 nt, Human
uccauccacccugcauuauauu

SEQ ID NO: 701977 - RNA, 21 nt, Human
gaaaagcaagggaguagaaca

SEQ ID NO: 701978 - RNA, 22 nt, Human
gcaggccaagcccucgcagaga

SEQ ID NO: 701979 - RNA, 22 nt, Human
ggauggagaugaccauggugac

SEQ ID NO: 701980 - RNA, 22 nt, Human
agugacuggugugaaguuaaau

SEQ ID NO: 701981 - RNA, 22 nt, Human
uccaggccuuugcacauguugu

SEQ ID NO: 701982 - RNA, 19 nt, Human
uguucagauaugucagcuu

SEQ ID NO: 701983 - RNA, 22 nt, Human
cuucaaaugugauuuuaauaac

SEQ ID NO: 701984 - RNA, 22 nt, Human
cuggccaggagguaaccagaug

SEQ ID NO: 701985 - RNA, 22 nt, Human
gguuucaaauuaaagucuuaag

SEQ ID NO: 701986 - RNA, 22 nt, Human
agacuucacucccagagauucu

SEQ ID NO: 701987 - RNA, 22 nt, Human
ggcucacacaugacugggcucu

SEQ ID NO: 701988 - RNA, 22 nt, Human
uggccuggggaagaccaugggc

SEQ ID NO: 701989 - RNA, 22 nt, Human
gacagaauuuuccaucaugugg

SEQ ID NO: 701990 - RNA, 22 nt, Human
cucugagggcucgagggacgcg

SEQ ID NO: 701991 - RNA, 22 nt, Human
aguguccuggcaaggguuucag

SEQ ID NO: 701992 - RNA, 19 nt, Human
agauuuaccucauauaguu

SEQ ID NO: 701993 - RNA, 22 nt, Human
gcuucucuggcuggucugccac

SEQ ID NO: 701994 - RNA, 22 nt, Human
cugccuugguucccagccagca

SEQ ID NO: 701995 - RNA, 22 nt, Human
uggggacugacagccaggccuc

SEQ ID NO: 701996 - RNA, 22 nt, Human
ugcucagagcucuggugcaggu

SEQ ID NO: 701997 - RNA, 22 nt, Human
uuagaaccaggguuacgauucu

SEQ ID NO: 701998 - RNA, 22 nt, Human
gaguagacauuaaauuacacug

SEQ ID NO: 701999 - RNA, 22 nt, Human
gaggccaacuuuggagaacagg

SEQ ID NO: 702000 - RNA, 22 nt, Human
cacaugaucgucaugugaaagu

SEQ ID NO: 702001 - RNA, 22 nt, Human
gagguugggaugagggauacag

SEQ ID NO: 702002 - RNA, 22 nt, Human
uuauacaggagauuccuuacuu

SEQ ID NO: 702003 - RNA, 22 nt, Human
cucccugugucuucacuuggcc

SEQ ID NO: 702004 - RNA, 22 nt, Human
guccuccauggucuugaaguaa

SEQ ID NO: 702005 - RNA, 22 nt, Human
aggcuuggcuggcagcccuggg

SEQ ID NO: 702006 - RNA, 22 nt, Human
gccucucuccuuggcuugcagu

SEQ ID NO: 702007 - RNA, 22 nt, Human
cagcucagcuuccugggugugu

SEQ ID NO: 702008 - RNA, 22 nt, Human
cucugcagaauuugagcugcuc

SEQ ID NO: 702009 - RNA, 19 nt, Human
cagaggcaccagguauaga

SEQ ID NO: 702010 - RNA, 22 nt, Human
agcuggguguucuugggccuaa

SEQ ID NO: 702011 - RNA, 22 nt, Human
cuggaggaauaaucuccuaccc

SEQ ID NO: 702012 - RNA, 22 nt, Human
aggaaacuggguaugguuauac

SEQ ID NO: 702013 - RNA, 22 nt, Human
ggccaagguguucugauaugcc

SEQ ID NO: 702014 - RNA, 22 nt, Human
uggcaggcaaguucagcuccac

SEQ ID NO: 702015 - RNA, 20 nt, Human
cugaaaggagucgggauguc

SEQ ID NO: 702016 - RNA, 22 nt, Human
uggcuaugaggagcgcaggugu

SEQ ID NO: 702017 - RNA, 22 nt, Human
cagaaacacuguauuuagggaa

SEQ ID NO: 702018 - RNA, 22 nt, Human
auuuauugagccuuuccuaugu

SEQ ID NO: 702019 - RNA, 22 nt, Human
ugaugcaauguuuacaucuuga

SEQ ID NO: 702020 - RNA, 22 nt, Human
uucuuccucuguaaaaggugac

SEQ ID NO: 702021 - RNA, 22 nt, Human
ucugcccuuggcucucuuguug

SEQ ID NO: 702022 - RNA, 22 nt, Human
uggcugucagucgccugcauuc

SEQ ID NO: 702023 - RNA, 22 nt, Human
ugagagagggaugcacccuccu

SEQ ID NO: 702024 - RNA, 22 nt, Human
ucugagaguacgggcugcgcgc

SEQ ID NO: 702025 - RNA, 22 nt, Human
acccagguggcucugacggggg

SEQ ID NO: 702026 - RNA, 22 nt, Human
acugggcaucccauggcagagc

SEQ ID NO: 702027 - RNA, 22 nt, Human
caccuuguggcccagucagguu

SEQ ID NO: 702028 - RNA, 22 nt, Human
ugugcacaggaagcuauucucu

SEQ ID NO: 702029 - RNA, 22 nt, Human
ucaccaauaauaacuugagaau

SEQ ID NO: 702030 - RNA, 21 nt, Human
ucacauuucucauggguaaau

SEQ ID NO: 702031 - RNA, 22 nt, Human
ugcugcauuuaucuucucaaac

SEQ ID NO: 702032 - RNA, 22 nt, Human
uugagggauuuacagagguggg

SEQ ID NO: 702033 - RNA, 22 nt, Human
uuccucuauucuaacaaaagua

SEQ ID NO: 702034 - RNA, 22 nt, Human
cuuguuaucuccguguccuugu

SEQ ID NO: 702035 - RNA, 22 nt, Human
caggcacuagcagaaugaggcu

SEQ ID NO: 702036 - RNA, 22 nt, Human
agucaguggauuuaccaugcgu

SEQ ID NO: 702037 - RNA, 22 nt, Human
gaaacauuguguucuacagauu

SEQ ID NO: 702038 - RNA, 20 nt, Human
uuggcucagauuuuuauggg

SEQ ID NO: 702039 - RNA, 22 nt, Human
ugaguuaaucucuacgauagaa

SEQ ID NO: 702040 - RNA, 22 nt, Human
uccagguccagagguucaacug

SEQ ID NO: 702041 - RNA, 22 nt, Human
uaauaguuaugguugguucuca

SEQ ID NO: 702042 - RNA, 21 nt, Human
gcacaugagggagggcaugcc

SEQ ID NO: 702043 - RNA, 22 nt, Human
uuugacagugaugauauauaca

SEQ ID NO: 702044 - RNA, 22 nt, Human
agagccaggaaguggcgugggg

SEQ ID NO: 702045 - RNA, 22 nt, Human
agcacuguggggaacucacaga

SEQ ID NO: 702046 - RNA, 22 nt, Human
ggccccagcagacccuccucug

SEQ ID NO: 702047 - RNA, 22 nt, Human
gccuuuggagaugucauaggau

SEQ ID NO: 702048 - RNA, 22 nt, Human
ugcuucaggagaugucaccaug

SEQ ID NO: 702049 - RNA, 22 nt, Human
ucucucuccuaguuuuuagugg

SEQ ID NO: 702050 - RNA, 22 nt, Human
uuauucuuuaaacauauauguu

SEQ ID NO: 702051 - RNA, 22 nt, Human
ucuuagcacagcuauauaaguu

SEQ ID NO: 702052 - RNA, 22 nt, Human
cccugagcgugaggaggaagua

SEQ ID NO: 702053 - RNA, 22 nt, Human
agagcaccccgggaagagcaag

SEQ ID NO: 702054 - RNA, 22 nt, Human
ucuggcaucuguuuucauauuu

SEQ ID NO: 702055 - RNA, 22 nt, Human
uggaaaacaugcacauuggauu

SEQ ID NO: 702056 - RNA, 22 nt, Human
cugggaaguagaaucagaugag

SEQ ID NO: 702057 - RNA, 22 nt, Human
gcucugccuggucgcgugcugg

SEQ ID NO: 702058 - RNA, 22 nt, Human
ucaccuaauugaagucaggagu

SEQ ID NO: 702059 - RNA, 23 nt, Human
cagcugaagcagccugggcugga

SEQ ID NO: 702060 - RNA, 22 nt, Human
ccucagagccuccagaaggaau

SEQ ID NO: 702061 - RNA, 22 nt, Human
ugccuguggaaaggcuggugcu

SEQ ID NO: 702062 - RNA, 22 nt, Human
agguguggcuugaagucucuau

SEQ ID NO: 702063 - RNA, 22 nt, Human
gaguggggcgaagucggcgagu

SEQ ID NO: 702064 - RNA, 22 nt, Human
cgguccuggcacuugcggcucc

SEQ ID NO: 702065 - RNA, 22 nt, Human
cugggucccggcuucuauccac

SEQ ID NO: 702066 - RNA, 22 nt, Human
ccagaagagaucacaguucuug

SEQ ID NO: 702067 - RNA, 22 nt, Human
acuccucagccagcaucaggga

SEQ ID NO: 702068 - RNA, 22 nt, Human
guaagcacaugugugugcaugg

SEQ ID NO: 702069 - RNA, 22 nt, Human
gcggcgccuaagccccgaccuc

SEQ ID NO: 702070 - RNA, 22 nt, Human
cugaggagucaguuccacucag

SEQ ID NO: 702071 - RNA, 22 nt, Human
uugagcaaugcugcaaagagau

SEQ ID NO: 702072 - RNA, 19 nt, Human
gcagccaccgcggcggccg

SEQ ID NO: 702073 - RNA, 22 nt, Human
aggaaagcuuggcaaacuaaau

SEQ ID NO: 702074 - RNA, 22 nt, Human
ggucuggaagcgcaguaggcug

SEQ ID NO: 702075 - RNA, 22 nt, Human
ucugggcuggcuuuaugcugac

SEQ ID NO: 702076 - RNA, 22 nt, Human
agaggcucuaauaccagcaugg

SEQ ID NO: 702077 - RNA, 22 nt, Human
cacaauuuggggugcccacugu

SEQ ID NO: 702078 - RNA, 22 nt, Human
auugucgcuuauuuaggugcuu

SEQ ID NO: 702079 - RNA, 22 nt, Human
caugcuuuucaaucuaucuuaa

SEQ ID NO: 702080 - RNA, 23 nt, Human
ucucauuucccuugaucuaucuu

SEQ ID NO: 702081 - RNA, 22 nt, Human
gcuggacccggccccucaccuc

SEQ ID NO: 702082 - RNA, 22 nt, Human
uuccugaugcacacagucauuu

SEQ ID NO: 702083 - RNA, 22 nt, Human
ugucucuuggcucuaucacuua

SEQ ID NO: 702084 - RNA, 22 nt, Human
agaaaguuuugugcuauauaug

SEQ ID NO: 702085 - RNA, 22 nt, Human
uuuagcauguuccuuucauaga

SEQ ID NO: 702086 - RNA, 22 nt, Human
uucugaaauaggagauagcugu

SEQ ID NO: 702087 - RNA, 22 nt, Human
ccauccuaucugaccuacuugu

SEQ ID NO: 702088 - RNA, 22 nt, Human
gccccagcccuguggaccaugg

SEQ ID NO: 702089 - RNA, 22 nt, Human
aguuucccccuucacagcuuaa

SEQ ID NO: 702090 - RNA, 22 nt, Human
gaaaauuauugaaaauggcucu

SEQ ID NO: 702091 - RNA, 22 nt, Human
agcacacagucuuccuuccucc

SEQ ID NO: 702092 - RNA, 22 nt, Human
cugugucucccaaggaggguca

SEQ ID NO: 702093 - RNA, 22 nt, Human
gcugcagggagcuggaaggcuc

SEQ ID NO: 702094 - RNA, 22 nt, Human
agggcugccugcucugcauuga

SEQ ID NO: 702095 - RNA, 22 nt, Human
ggugagugucaaugguuagagu

SEQ ID NO: 702096 - RNA, 22 nt, Human
gaagcagcuagcccacuaguca

SEQ ID NO: 702097 - RNA, 22 nt, Human
ugugcagagcccacaggcagcu

SEQ ID NO: 702098 - RNA, 22 nt, Human
uccaugcucuugucuagccucc

SEQ ID NO: 702099 - RNA, 22 nt, Human
auguggcuaguggacacaguau

SEQ ID NO: 702100 - RNA, 22 nt, Human
gcauuuguguucuuccuagagc

SEQ ID NO: 702101 - RNA, 22 nt, Human
uuagauaaauugcaacuugauu

SEQ ID NO: 702102 - RNA, 22 nt, Human
uuagacaggauguaugaaagcu

SEQ ID NO: 702103 - RNA, 23 nt, Human
ggccuccuggucuaggcuagacu

SEQ ID NO: 702104 - RNA, 22 nt, Human
gccagggcaggggagcaucugc

SEQ ID NO: 702105 - RNA, 22 nt, Human
uugugugcugagggccugcugu

SEQ ID NO: 702106 - RNA, 22 nt, Human
uauuuuacuauuuggcaaaguc

SEQ ID NO: 702107 - RNA, 22 nt, Human
gccucugcaauuacauugugcc

SEQ ID NO: 702108 - RNA, 22 nt, Human
uuuagacaucuauaauugcuaa

SEQ ID NO: 702109 - RNA, 22 nt, Human
ugaggcagcaauuguauuguau

SEQ ID NO: 702110 - RNA, 22 nt, Human
cagaauaauauuggucucauag

SEQ ID NO: 702111 - RNA, 17 nt, Human
ggacugggcggggcagg

SEQ ID NO: 702112 - RNA, 22 nt, Human
agcuucucagaagaguccugua

SEQ ID NO: 702113 - RNA, 22 nt, Human
ugguuucacggagugccuugcu

SEQ ID NO: 702114 - RNA, 21 nt, Human
aggucagcccagcucuggaag

SEQ ID NO: 702115 - RNA, 22 nt, Human
gcugggaagagaugcacaugau

SEQ ID NO: 702116 - RNA, 19 nt, Human
ucagugugacuuggucagu

SEQ ID NO: 702117 - RNA, 22 nt, Human
cagcaugauuggugucugguga

SEQ ID NO: 702118 - RNA, 22 nt, Human
ugguggcagugagaaggagagg

SEQ ID NO: 702119 - RNA, 22 nt, Human
cacaggcuuccaguccccagcu

SEQ ID NO: 702120 - RNA, 22 nt, Human
cugugagugacccuggucagca

SEQ ID NO: 702121 - RNA, 22 nt, Human
caaguuuuagaaauaucuggau

SEQ ID NO: 702122 - RNA, 19 nt, Human
cagcaaacacuguaaaugg

SEQ ID NO: 702123 - RNA, 22 nt, Human
aaacuuuuucuuagguaugucu

SEQ ID NO: 702124 - RNA, 22 nt, Human
acaugaaaaauguuugcaguuu

SEQ ID NO: 702125 - RNA, 22 nt, Human
cagauucuucuguauuuuugcu

SEQ ID NO: 702126 - RNA, 22 nt, Human
ggcagugaacagaaaugcagaa

SEQ ID NO: 702127 - RNA, 23 nt, Human
ugccucugccucccuagucugca

SEQ ID NO: 702128 - RNA, 22 nt, Human
uuucagaaauggcacugaaauc

SEQ ID NO: 702129 - RNA, 22 nt, Human
agacaacaugaucagcaguccu

SEQ ID NO: 702130 - RNA, 22 nt, Human
gucguggagcucacagugugcc

SEQ ID NO: 702131 - RNA, 22 nt, Human
ucagugugcacaugguagcagu

SEQ ID NO: 702132 - RNA, 22 nt, Human
caguacauaaugcgcaaaaccg

SEQ ID NO: 702133 - RNA, 22 nt, Human
ggagggcuguagaggagaccug

SEQ ID NO: 702134 - RNA, 22 nt, Human
ugggcugccggcaggcucugcc

SEQ ID NO: 702135 - RNA, 22 nt, Human
aaggaaaugaagcugauguugg

SEQ ID NO: 702136 - RNA, 22 nt, Human
aaagaucaauagauaaagcuac

SEQ ID NO: 702137 - RNA, 18 nt, Human
ugucugcuucuccaacuc

SEQ ID NO: 702138 - RNA, 22 nt, Human
ccuagccuucggccuacccauc

SEQ ID NO: 702139 - RNA, 22 nt, Human
uagcagugccaggauuuugcug

SEQ ID NO: 702140 - RNA, 22 nt, Human
augggugugaaaauggucaucu

SEQ ID NO: 702141 - RNA, 22 nt, Human
gcaaauugggaaauuucucuag

SEQ ID NO: 702142 - RNA, 22 nt, Human
agucacauuugggggugucaaa

SEQ ID NO: 702143 - RNA, 22 nt, Human
aucuucucaagcagcauccugu

SEQ ID NO: 702144 - RNA, 22 nt, Human
uugcuuuagguauagaauccau

SEQ ID NO: 702145 - RNA, 22 nt, Human
aucuuuggugcaugauacuuug

SEQ ID NO: 702146 - RNA, 19 nt, Human
uucuaccuuacuguaggcu

SEQ ID NO: 702147 - RNA, 22 nt, Human
uuggcugugagggguugcacag

SEQ ID NO: 702148 - RNA, 22 nt, Human
ggcagcccaccagcccacgucu

SEQ ID NO: 702149 - RNA, 22 nt, Human
gugcugcagagucucgugccgc

SEQ ID NO: 702150 - RNA, 22 nt, Human
ggauacaagguguucuaucacu

SEQ ID NO: 702151 - RNA, 22 nt, Human
uagcaaggcuuccaaugaacag

SEQ ID NO: 702152 - RNA, 22 nt, Human
cacaagggagcuuagaaaacau

SEQ ID NO: 702153 - RNA, 22 nt, Human
ugucuuuuauaacugacauaua

SEQ ID NO: 702154 - RNA, 22 nt, Human
auguuucaaauauauagaguug

SEQ ID NO: 702155 - RNA, 22 nt, Human
ucagaaguuucaaucccagcug

SEQ ID NO: 702156 - RNA, 22 nt, Human
gagggcaccuucaguaauagcu

SEQ ID NO: 702157 - RNA, 22 nt, Human
aauuugauuuucuuaaaccaua

SEQ ID NO: 702158 - RNA, 22 nt, Human
gagcagugaugggaggacguca

SEQ ID NO: 702159 - RNA, 22 nt, Human
caugauuuacuaaaauuuguuu

SEQ ID NO: 702160 - RNA, 22 nt, Human
uuauucacucugaagccauccu

SEQ ID NO: 702161 - RNA, 22 nt, Human
auggcugggcuuuuagucagau

SEQ ID NO: 702162 - RNA, 22 nt, Human
ggugcccagagccaggaaugag

SEQ ID NO: 702163 - RNA, 22 nt, Human
ccagucccaggcagaaauccag

SEQ ID NO: 702164 - RNA, 22 nt, Human
gaagcagcugccagagaugucu

SEQ ID NO: 702165 - RNA, 19 nt, Human
gggcuucugggaucaagag

SEQ ID NO: 702166 - RNA, 22 nt, Human
ccucacacaguuaucucuucau

SEQ ID NO: 702167 - RNA, 23 nt, Human
ggagggcuucaucagacccccag

SEQ ID NO: 702168 - RNA, 22 nt, Human
uaucagcaacucagagcagucu

SEQ ID NO: 702169 - RNA, 22 nt, Human
gaggaaccaaucugugauauuc

SEQ ID NO: 702170 - RNA, 20 nt, Human
guugaaaguaauaugaugcu

SEQ ID NO: 702171 - RNA, 22 nt, Human
ccuuguguuuacaccugucuuu

SEQ ID NO: 702172 - RNA, 22 nt, Human
augcaacauccaauuccuuuug

SEQ ID NO: 702173 - RNA, 22 nt, Human
guaaaguucuauuugaauuuag

SEQ ID NO: 702174 - RNA, 22 nt, Human
uuuagcaacgaagcacucgaca

SEQ ID NO: 702175 - RNA, 22 nt, Human
aaacauguaauucugcuuaaga

SEQ ID NO: 702176 - RNA, 22 nt, Human
agcaaggggcagugaaagugug

SEQ ID NO: 702177 - RNA, 22 nt, Human
guauccuuugcggaaauuucua

SEQ ID NO: 702178 - RNA, 17 nt, Human
uaugcuuuucuucucca

SEQ ID NO: 702179 - RNA, 22 nt, Human
uacaguaaucuggacaugauuu

SEQ ID NO: 702180 - RNA, 23 nt, Human
uauggcuuacagugcuuuaggua

SEQ ID NO: 702181 - RNA, 22 nt, Human
cucagagcucagcuuuguuagu

SEQ ID NO: 702182 - RNA, 22 nt, Human
ggaaggcagaggugucgugggg

SEQ ID NO: 702183 - RNA, 22 nt, Human
gcaaauugcuagcuuucucugc

SEQ ID NO: 702184 - RNA, 22 nt, Human
guguaauuauauaaagaucuac

SEQ ID NO: 702185 - RNA, 22 nt, Human
cugugccucaguguccucgagu

SEQ ID NO: 702186 - RNA, 23 nt, Human
cucugcaggagagugggcagggc

SEQ ID NO: 702187 - RNA, 22 nt, Human
aguuuuugagaauuuacuaugu

SEQ ID NO: 702188 - RNA, 22 nt, Human
cuccagguauuacuguuuuccc

SEQ ID NO: 702189 - RNA, 22 nt, Human
gugcccugcaugccccggguau

SEQ ID NO: 702190 - RNA, 22 nt, Human
uuugaaaggagcuuuauccaga

SEQ ID NO: 702191 - RNA, 22 nt, Human
aagggcugaucucacuuucuuu

SEQ ID NO: 702192 - RNA, 22 nt, Human
ccacagucuaugcaacaagguc

SEQ ID NO: 702193 - RNA, 22 nt, Human
ccagagagcuacaaggcauaaa

SEQ ID NO: 702194 - RNA, 22 nt, Human
guguggcuagaagugucuuguu

SEQ ID NO: 702195 - RNA, 22 nt, Human
cucugggauagagccucggucu

SEQ ID NO: 702196 - RNA, 21 nt, Human
augacagaugcugcagaucgu

SEQ ID NO: 702197 - RNA, 18 nt, Human
gggcauggaugcagcauc

SEQ ID NO: 702198 - RNA, 22 nt, Human
cuggaauaaacgaucuucagca

SEQ ID NO: 702199 - RNA, 22 nt, Human
ggacccugcagccacccgacau

SEQ ID NO: 702200 - RNA, 21 nt, Human
aucuuuauuacgcagagaaga

SEQ ID NO: 702201 - RNA, 22 nt, Human
caagcagggauacugcagggag

SEQ ID NO: 702202 - RNA, 22 nt, Human
ugggagaugguucugagacuuu

SEQ ID NO: 702203 - RNA, 22 nt, Human
gcagugcugagaggugaucgga

SEQ ID NO: 702204 - RNA, 22 nt, Human
ugaggcagcccacuuuccuuag

SEQ ID NO: 702205 - RNA, 22 nt, Human
ugcuggaaauuccuaggaggua

SEQ ID NO: 702206 - RNA, 22 nt, Human
agucacugcuuugucccugugu

SEQ ID NO: 702207 - RNA, 22 nt, Human
agcaacagcccuguuucauuag

SEQ ID NO: 702208 - RNA, 22 nt, Human
ccagacuguggaguuccuggug

SEQ ID NO: 702209 - RNA, 22 nt, Human
aguauauuuguuaagauuauuc

SEQ ID NO: 702210 - RNA, 22 nt, Human
aagccuaggccuacucugguuu

SEQ ID NO: 702211 - RNA, 22 nt, Human
gugcugaauugugcucuuuaca

SEQ ID NO: 702212 - RNA, 22 nt, Human
uucugagacaauugagagucua

SEQ ID NO: 702213 - RNA, 22 nt, Human
agucucaucaggcauguaguca

SEQ ID NO: 702214 - RNA, 20 nt, Human
cuguggcaucuugaaggagg

SEQ ID NO: 702215 - RNA, 22 nt, Human
ggcaaauugcugcaauuacuua

SEQ ID NO: 702216 - RNA, 22 nt, Human
agcaaagcuaucucuauggaga

SEQ ID NO: 702217 - RNA, 22 nt, Human
uuucacauucuucugaaucuac

SEQ ID NO: 702218 - RNA, 20 nt, Human
uggcccuguuuucuccaggc

SEQ ID NO: 702219 - RNA, 22 nt, Human
gguaccaccaauucagcugcca

SEQ ID NO: 702220 - RNA, 22 nt, Human
gugcaaaaguaacugugguuuu

SEQ ID NO: 702221 - RNA, 22 nt, Human
uggcagcacuugaacuugagcc

SEQ ID NO: 702222 - RNA, 22 nt, Human
cugggaguacugggggauguca

SEQ ID NO: 702223 - RNA, 22 nt, Human
aaucacaaacgaauugauggaa

SEQ ID NO: 702224 - RNA, 22 nt, Human
aacugcaauuacuuuugcgcca

SEQ ID NO: 702225 - RNA, 22 nt, Human
aaaaggaucagauuuugagcag

SEQ ID NO: 702226 - RNA, 22 nt, Human
uugcaacaucugaacauuuauc

SEQ ID NO: 702227 - RNA, 22 nt, Human
caggaacauguuggaaagaaau

SEQ ID NO: 702228 - RNA, 22 nt, Human
gugugcagugagcaaaagaucu

SEQ ID NO: 702229 - RNA, 22 nt, Human
auaaagcaugcuuguuuggaga

SEQ ID NO: 702230 - RNA, 22 nt, Human
caggacagcucaacaccuccuc

SEQ ID NO: 702231 - RNA, 22 nt, Human
uugucugaaccaucucccuggc

SEQ ID NO: 702232 - RNA, 22 nt, Human
gucugucaucugagauggagug

SEQ ID NO: 702233 - RNA, 22 nt, Human
ugauacagaauugauaucugag

SEQ ID NO: 702234 - RNA, 22 nt, Human
agcaccaggcaccaaagggccu

SEQ ID NO: 702235 - RNA, 22 nt, Human
ugcuucugcuuuacuugguuca

SEQ ID NO: 702236 - RNA, 22 nt, Human
agcagggcagugcuucagcucu

SEQ ID NO: 702237 - RNA, 23 nt, Human
ugguaauagggagcagaagguag

SEQ ID NO: 702238 - RNA, 22 nt, Human
uccugaauuguugagaagcagc

SEQ ID NO: 702239 - RNA, 22 nt, Human
ugcccagggauaagccuagaga

SEQ ID NO: 702240 - RNA, 22 nt, Human
uugguuaaaaucaaauuaauca

SEQ ID NO: 702241 - RNA, 22 nt, Human
ucagugaaaugcauauucuucg

SEQ ID NO: 702242 - RNA, 22 nt, Human
aaguuuuauuggcuauagcacu

SEQ ID NO: 702243 - RNA, 22 nt, Human
uacaaugagcuguacaucucca

SEQ ID NO: 702244 - RNA, 16 nt, Human
uggaaggggucuccgg

SEQ ID NO: 702245 - RNA, 22 nt, Human
guggcagaagaguaggaugggc

SEQ ID NO: 702246 - RNA, 23 nt, Human
acaucagaguuaguucaaucagg

SEQ ID NO: 702247 - RNA, 22 nt, Human
cacagagauuagaauuagacua

SEQ ID NO: 702248 - RNA, 22 nt, Human
cugagggcuggagcugaggccu

SEQ ID NO: 702249 - RNA, 22 nt, Human
acucaagucauaggcuucuuuc

SEQ ID NO: 702250 - RNA, 22 nt, Human
acugcagggcauccuggccaag

SEQ ID NO: 702251 - RNA, 22 nt, Human
caguucagcuagaagaaacaaa

SEQ ID NO: 702252 - RNA, 22 nt, Human
cgcccagggcaggaggccgcuc

SEQ ID NO: 702253 - RNA, 19 nt, Human
agggccugagcagauguug

SEQ ID NO: 702254 - RNA, 22 nt, Human
auguucauuugacaaguaguga

SEQ ID NO: 702255 - RNA, 22 nt, Human
auuguuuuaauuccauugugaa

SEQ ID NO: 702256 - RNA, 22 nt, Human
agacagcagcagaggggcuccc

SEQ ID NO: 702257 - RNA, 22 nt, Human
uggcaucauagccaaggugcuu

SEQ ID NO: 702258 - RNA, 22 nt, Human
ccucuuccucaccaucuacaac

SEQ ID NO: 702259 - RNA, 22 nt, Human
aauaauuuugagagccuggaaa

SEQ ID NO: 702260 - RNA, 23 nt, Human
uuguccagcugguuugggccaca

SEQ ID NO: 702261 - RNA, 22 nt, Human
ugcuuauaauguuacugacaac

SEQ ID NO: 702262 - RNA, 22 nt, Human
ccaguguuuccccagaagagag

SEQ ID NO: 702263 - RNA, 22 nt, Human
cccagaggucugaaaagguuga

SEQ ID NO: 702264 - RNA, 22 nt, Human
caaugugucaggaaaagggcca

SEQ ID NO: 702265 - RNA, 22 nt, Human
auucaguuccuugaggguauag

SEQ ID NO: 702266 - RNA, 22 nt, Human
ccagcaggagaugccugugucu

SEQ ID NO: 702267 - RNA, 22 nt, Human
uuugaacaggaguaucuauagu

SEQ ID NO: 702268 - RNA, 22 nt, Human
cuggccccagaguuucacuugg

SEQ ID NO: 702269 - RNA, 22 nt, Human
gcuguguccucacacagccuuu

SEQ ID NO: 702270 - RNA, 22 nt, Human
ggauuugggcuugcagcagagc

SEQ ID NO: 702271 - RNA, 17 nt, Human
cauccgugagcucggca

SEQ ID NO: 702272 - RNA, 22 nt, Human
ccaggugccuccagucacagug

SEQ ID NO: 702273 - RNA, 22 nt, Human
aaaguagaggcauugaucaggu

SEQ ID NO: 702274 - RNA, 22 nt, Human
cugggaagggagucaagauacu

SEQ ID NO: 702275 - RNA, 16 nt, Human
caauacauggcauuuc

SEQ ID NO: 702276 - RNA, 22 nt, Human
gacauuuacugaauacugauua

SEQ ID NO: 702277 - RNA, 22 nt, Human
ccuggccuggcacucccucugc

SEQ ID NO: 702278 - RNA, 22 nt, Human
ucugucuuugucaggaccagag

SEQ ID NO: 702279 - RNA, 22 nt, Human
ggcacugggugagggucacugg

SEQ ID NO: 702280 - RNA, 22 nt, Human
auaaccaugauuaaucuaagaa

SEQ ID NO: 702281 - RNA, 22 nt, Human
auauuuuuccaugugggacucu

SEQ ID NO: 702282 - RNA, 22 nt, Human
ccaguguucugguguucauuuc

SEQ ID NO: 702283 - RNA, 22 nt, Human
aaugguuuaguuaagacugagu

SEQ ID NO: 702284 - RNA, 22 nt, Human
cauuucuguucucuuccuguac

SEQ ID NO: 702285 - RNA, 22 nt, Human
acagagcugggugcccccugga

SEQ ID NO: 702286 - RNA, 22 nt, Human
ucagacauggggagagagaccu

SEQ ID NO: 702287 - RNA, 22 nt, Human
gcuuugauucuuggcuuaucag

SEQ ID NO: 702288 - RNA, 22 nt, Human
auuccacaggagcugguuuucu

SEQ ID NO: 702289 - RNA, 22 nt, Human
uuacagaaugugccauuugguc

SEQ ID NO: 702290 - RNA, 22 nt, Human
gaaagggcaugggcaugacaac

SEQ ID NO: 702291 - RNA, 22 nt, Human
acauugaugaucccacuuacag

SEQ ID NO: 702292 - RNA, 22 nt, Human
uacuguaugauuucauguauau

SEQ ID NO: 702293 - RNA, 22 nt, Human
ccccuguguuguucaaggguca

SEQ ID NO: 702294 - RNA, 22 nt, Human
ccugccugauuccaggauggcu

SEQ ID NO: 702295 - RNA, 22 nt, Human
agucagagacccuagaucuaau

SEQ ID NO: 702296 - RNA, 22 nt, Human
cacagggccacuuucccaguaa

SEQ ID NO: 702297 - RNA, 22 nt, Human
cacagugacuggcacauaguaa

SEQ ID NO: 702298 - RNA, 22 nt, Human
ggcugugcuugguguccuugga

SEQ ID NO: 702299 - RNA, 22 nt, Human
aaaggcucacgcaguuagugau

SEQ ID NO: 702300 - RNA, 22 nt, Human
aagauguuauugucuuccuugc

SEQ ID NO: 702301 - RNA, 22 nt, Human
ugauauuugcugacugcauugu

SEQ ID NO: 702302 - RNA, 22 nt, Human
cccaaggccucuccuuggcuug

SEQ ID NO: 702303 - RNA, 18 nt, Human
uaaaccugagaagcgugu

SEQ ID NO: 702304 - RNA, 20 nt, Human
uaaauuagccuugaagauua

SEQ ID NO: 702305 - RNA, 22 nt, Human
cugcagugccugccacugagcc

SEQ ID NO: 702306 - RNA, 18 nt, Human
agcuggugaaauccagua

SEQ ID NO: 702307 - RNA, 19 nt, Human
uucuuagucucaugcauga

SEQ ID NO: 702308 - RNA, 22 nt, Human
acauccacuauccuugcuuguu

SEQ ID NO: 702309 - RNA, 22 nt, Human
cuacucuuuugagucuucagau

SEQ ID NO: 702310 - RNA, 22 nt, Human
agagcggggauaguuaauauuc

SEQ ID NO: 702311 - RNA, 22 nt, Human
gcccuggccuucaucucagaca

SEQ ID NO: 702312 - RNA, 22 nt, Human
uccagcugagguggccucugug

SEQ ID NO: 702313 - RNA, 22 nt, Human
cagaaacuguuuguuaauauuu

SEQ ID NO: 702314 - RNA, 22 nt, Human
cuggguagaagauuccucagga

SEQ ID NO: 702315 - RNA, 22 nt, Human
gaaugaauucagcacauggaau

SEQ ID NO: 702316 - RNA, 22 nt, Human
gcagagcaggaaggaagucagg

SEQ ID NO: 702317 - RNA, 22 nt, Human
auuuuagagaaacaaacguagg

SEQ ID NO: 702318 - RNA, 22 nt, Human
uugagaaauguuuuuuaagcug

SEQ ID NO: 702319 - RNA, 19 nt, Human
cagauguuuucaguucauu

SEQ ID NO: 702320 - RNA, 22 nt, Human
uuuauuguugggucuuaagcug

SEQ ID NO: 702321 - RNA, 22 nt, Human
uccaggccgcauaguuacucug

SEQ ID NO: 702322 - RNA, 22 nt, Human
ccagggcuggaccagugcuugg

SEQ ID NO: 702323 - RNA, 22 nt, Human
uaauuuacuugcaaauaacaau

SEQ ID NO: 702324 - RNA, 22 nt, Human
gcagggugaaggucacauagaa

SEQ ID NO: 702325 - RNA, 22 nt, Human
uggcuucagagacagaaucuau

SEQ ID NO: 702326 - RNA, 22 nt, Human
accacacuggcuagugaagaag

SEQ ID NO: 702327 - RNA, 22 nt, Human
uggcagcucuguucaacaugag

SEQ ID NO: 702328 - RNA, 22 nt, Human
agcuguggggcaggcagcgagg

SEQ ID NO: 702329 - RNA, 18 nt, Human
gcuuccugaaagcugccc

SEQ ID NO: 702330 - RNA, 22 nt, Human
ugaaauguuugaagaccacuga

SEQ ID NO: 702331 - RNA, 22 nt, Human
cugccuggggaaugugaggauu

SEQ ID NO: 702332 - RNA, 17 nt, Human
caggucccagggucucu

SEQ ID NO: 702333 - RNA, 22 nt, Human
caucuuuaaaaugggaacaaca

SEQ ID NO: 702334 - RNA, 22 nt, Human
uacaguauuugaagaauaugag

SEQ ID NO: 702335 - RNA, 22 nt, Human
aaagaaucagaagucucaaaca

SEQ ID NO: 702336 - RNA, 22 nt, Human
uuuagguuuuuucacguggcua

SEQ ID NO: 702337 - RNA, 22 nt, Human
gagccaggucgggccgcggcga

SEQ ID NO: 702338 - RNA, 22 nt, Human
aaaaagacagaggaugaggcag

SEQ ID NO: 702339 - RNA, 17 nt, Human
uacagaaggcaccacaa

SEQ ID NO: 702340 - RNA, 22 nt, Human
cuguccuggccgcccuugugag

SEQ ID NO: 702341 - RNA, 22 nt, Human
caggucagcuggugccccaggu

SEQ ID NO: 702342 - RNA, 22 nt, Human
ugcaugaacacaugugcaugua

SEQ ID NO: 702343 - RNA, 22 nt, Human
guagugggugaggaaggaagga

SEQ ID NO: 702344 - RNA, 22 nt, Human
uagacauuauguauuaaguucu

SEQ ID NO: 702345 - RNA, 22 nt, Human
uuuccagugaauuagucuguuu

SEQ ID NO: 702346 - RNA, 22 nt, Human
ugugucuaggcucaugcuugcu

SEQ ID NO: 702347 - RNA, 22 nt, Human
auuauucaacacuugagaaauu

SEQ ID NO: 702348 - RNA, 22 nt, Human
ugauacauaaaccaucauuuug

SEQ ID NO: 702349 - RNA, 22 nt, Human
acacauauaugucgaaguccuc

SEQ ID NO: 702350 - RNA, 22 nt, Human
uuccuacaucaccagggggagu

SEQ ID NO: 702351 - RNA, 22 nt, Human
uggggugaaucuuuguuguccg

SEQ ID NO: 702352 - RNA, 18 nt, Human
auacaagaucaaguguuc

SEQ ID NO: 702353 - RNA, 22 nt, Human
cuucugcugcuguucaugguug

SEQ ID NO: 702354 - RNA, 22 nt, Human
acauuuugcccuuauuugcuga

SEQ ID NO: 702355 - RNA, 22 nt, Human
uugacuguuaagacuuggcucu

SEQ ID NO: 702356 - RNA, 22 nt, Human
uaggaaguagauagguuguucu

SEQ ID NO: 702357 - RNA, 22 nt, Human
ggcccuuccucuugugcuggca

SEQ ID NO: 702358 - RNA, 22 nt, Human
ggugugccuggggcuuagcugc

SEQ ID NO: 702359 - RNA, 22 nt, Human
ugaaaucugucccacuuuagcu

SEQ ID NO: 702360 - RNA, 22 nt, Human
aaaauucauagaacuguacgcu

SEQ ID NO: 702361 - RNA, 22 nt, Human
aguuuuaugcaguguucugaua

SEQ ID NO: 702362 - RNA, 22 nt, Human
agcuauguuccucgaugcucag

SEQ ID NO: 702363 - RNA, 23 nt, Human
acuuuagauaaauuaugugcaca

SEQ ID NO: 702364 - RNA, 22 nt, Human
uuucuuccuauguaucuugcug

SEQ ID NO: 702365 - RNA, 22 nt, Human
uuccuggccccaccccuggaga

SEQ ID NO: 702366 - RNA, 22 nt, Human
uagaaggaggacuggcaguguu

SEQ ID NO: 702367 - RNA, 22 nt, Human
uucauaaucaccaaaaacugga

SEQ ID NO: 702368 - RNA, 22 nt, Human
agguaaagaaagguguaacauu

SEQ ID NO: 702369 - RNA, 22 nt, Human
aguggcaaugggaguggagaca

SEQ ID NO: 702370 - RNA, 22 nt, Human
uaaaauagcaugugcagugaaa

SEQ ID NO: 702371 - RNA, 22 nt, Human
cugcagaggccucgccuccucu

SEQ ID NO: 702372 - RNA, 22 nt, Human
ccagcagagggcgcuucacacc

SEQ ID NO: 702373 - RNA, 22 nt, Human
gaugaagucauuauccuuuugg

SEQ ID NO: 702374 - RNA, 22 nt, Human
uggcagccucagacaaggaccu

SEQ ID NO: 702375 - RNA, 23 nt, Human
ucacauuuaaccccucagaccuc

SEQ ID NO: 702376 - RNA, 22 nt, Human
gcacaguugugacaaccaucgc

SEQ ID NO: 702377 - RNA, 22 nt, Human
agaggucagaacaggaaagugu

SEQ ID NO: 702378 - RNA, 22 nt, Human
agaggccaccagagguggugcc

SEQ ID NO: 702379 - RNA, 22 nt, Human
ggucccagcuggucacugucag

SEQ ID NO: 702380 - RNA, 22 nt, Human
ugggccuccuccgacagccggg

SEQ ID NO: 702381 - RNA, 22 nt, Human
ggaagcugaacuuagcaaggaa

SEQ ID NO: 702382 - RNA, 22 nt, Human
ggucuggccuggcauucuaugg

SEQ ID NO: 702383 - RNA, 22 nt, Human
ugcacacauuaaggauacacag

SEQ ID NO: 702384 - RNA, 18 nt, Human
ucaaagucuggcuccacu

SEQ ID NO: 702385 - RNA, 22 nt, Human
ucacaggcccaaaccacgcuua

SEQ ID NO: 702386 - RNA, 22 nt, Human
uuaaggaaccacagcauguuag

SEQ ID NO: 702387 - RNA, 22 nt, Human
uggcugagagaagacggggaag

SEQ ID NO: 702388 - RNA, 22 nt, Human
cagagguggggaguauuucaag

SEQ ID NO: 702389 - RNA, 22 nt, Human
gagcagcagguggcugugaugg

SEQ ID NO: 702390 - RNA, 22 nt, Human
gaggcaugucuggccuguccca

SEQ ID NO: 702391 - RNA, 22 nt, Human
ugaggcccaucugagauuuuga

SEQ ID NO: 702392 - RNA, 22 nt, Human
aguucagcuucccaggucacug

SEQ ID NO: 702393 - RNA, 22 nt, Human
aagucacuggaggaacucuacu

SEQ ID NO: 702394 - RNA, 20 nt, Human
augugucuguaaacaacucu

SEQ ID NO: 702395 - RNA, 22 nt, Human
accaccucaucaagcuggauug

SEQ ID NO: 702396 - RNA, 22 nt, Human
cacuuucucaugaauuuggccc

SEQ ID NO: 702397 - RNA, 22 nt, Human
cucugugcccuacugcucagcu

SEQ ID NO: 702398 - RNA, 20 nt, Human
uuaugcaagcaucaauauug

SEQ ID NO: 702399 - RNA, 22 nt, Human
aagaccuugucuaaacauguag

SEQ ID NO: 702400 - RNA, 22 nt, Human
auuuccacauaagggaaauaag

SEQ ID NO: 702401 - RNA, 22 nt, Human
uucaguuggccauaccccuaga

SEQ ID NO: 702402 - RNA, 22 nt, Human
cagauggaaggcauagagguuu

SEQ ID NO: 702403 - RNA, 22 nt, Human
guuuucuaccagggaagagagu

SEQ ID NO: 702404 - RNA, 22 nt, Human
agcagcuaaguagcgcaguuaa

SEQ ID NO: 702405 - RNA, 19 nt, Human
acacugaauguagaauugg

SEQ ID NO: 702406 - RNA, 22 nt, Human
cugcucuggcuguguacuucag

SEQ ID NO: 702407 - RNA, 22 nt, Human
uuaauguggaaagcucuugagu

SEQ ID NO: 702408 - RNA, 22 nt, Human
auuuuucucucacacuuaccag

SEQ ID NO: 702409 - RNA, 22 nt, Human
ugucuugucugugagggcauug

SEQ ID NO: 702410 - RNA, 22 nt, Human
uggcuggauuauuggcuaguac

SEQ ID NO: 702411 - RNA, 22 nt, Human
auugauucuaccagcuacuuug

SEQ ID NO: 702412 - RNA, 22 nt, Human
ugacauuucuuguugauauaaa

SEQ ID NO: 702413 - RNA, 22 nt, Human
uguuuauagauggccacaauga

SEQ ID NO: 702414 - RNA, 22 nt, Human
aaauaguuguuuggaucaauaa

SEQ ID NO: 702415 - RNA, 22 nt, Human
ugagggugcauuuagcauguag

SEQ ID NO: 702416 - RNA, 22 nt, Human
cauugcaacuucaaacuccugg

SEQ ID NO: 702417 - RNA, 22 nt, Human
ggugacagugguuaaaauuugu

SEQ ID NO: 702418 - RNA, 20 nt, Human
ccagcauguacacaugugga

SEQ ID NO: 702419 - RNA, 22 nt, Human
aggaaggggagaaguuaaagcu

SEQ ID NO: 702420 - RNA, 22 nt, Human
gacaguguuuguauaauuccug

SEQ ID NO: 702421 - RNA, 22 nt, Human
uaugaaugcuccaguaacuuuc

SEQ ID NO: 702422 - RNA, 22 nt, Human
ugaucuuuuuggucauuugggu

SEQ ID NO: 702423 - RNA, 22 nt, Human
cuucuggguaauucuucuucau

SEQ ID NO: 702424 - RNA, 22 nt, Human
uaaucuguugacuaacuuggga

SEQ ID NO: 702425 - RNA, 22 nt, Human
ugcuucuaaucuacugcauuag

SEQ ID NO: 702426 - RNA, 22 nt, Human
uccguguucuccagagauaauc

SEQ ID NO: 702427 - RNA, 22 nt, Human
ggcucuggguucugcaaugcgu

SEQ ID NO: 702428 - RNA, 22 nt, Human
gcugucagaaggugaaggguaa

SEQ ID NO: 702429 - RNA, 22 nt, Human
augggcuggcagccugaacagc

SEQ ID NO: 702430 - RNA, 21 nt, Human
ucagagucucaggagcaaggg

SEQ ID NO: 702431 - RNA, 22 nt, Human
gggggcuggaauauccaucaac

SEQ ID NO: 702432 - RNA, 22 nt, Human
uggguagagacacagucugggg

SEQ ID NO: 702433 - RNA, 22 nt, Human
ggcuuccuggggccuccugcaa

SEQ ID NO: 702434 - RNA, 22 nt, Human
gcccugaauuccucaggcugug

SEQ ID NO: 702435 - RNA, 22 nt, Human
ggcuccagcccuggcucuucac

SEQ ID NO: 702436 - RNA, 21 nt, Human
agugucauuugaucauuguua

SEQ ID NO: 702437 - RNA, 22 nt, Human
aguauuucugcucaugaaagag

SEQ ID NO: 702438 - RNA, 22 nt, Human
ugugaugguucacugggcauga

SEQ ID NO: 702439 - RNA, 22 nt, Human
acaaagaucuugcuuuccuacu

SEQ ID NO: 702440 - RNA, 22 nt, Human
auuucugcuacugcacccuagu

SEQ ID NO: 702441 - RNA, 22 nt, Human
ccagaggggugggccugguuua

SEQ ID NO: 702442 - RNA, 22 nt, Human
uuucuggguuuaugucacagcu

SEQ ID NO: 702443 - RNA, 22 nt, Human
ccaggagccugggccaggcugg

SEQ ID NO: 702444 - RNA, 22 nt, Human
cucuggccuggggccugcuccc

SEQ ID NO: 702445 - RNA, 22 nt, Human
uaggcugggcauucuggccagg

SEQ ID NO: 702446 - RNA, 22 nt, Human
uugucucuaagugugaucuuca

SEQ ID NO: 702447 - RNA, 22 nt, Human
gagccaagggcgugcuggagag

SEQ ID NO: 702448 - RNA, 22 nt, Human
gggugaggccuugcugccauca

SEQ ID NO: 702449 - RNA, 19 nt, Human
ugucuggaagagcugcagg

SEQ ID NO: 702450 - RNA, 22 nt, Human
ggagcuggagagcuagccuagg

SEQ ID NO: 702451 - RNA, 22 nt, Human
uucuacagugacugcagccaua

SEQ ID NO: 702452 - RNA, 22 nt, Human
agcccagguugaggcugcagug

SEQ ID NO: 702453 - RNA, 20 nt, Human
gcacacauagaaaugcauau

SEQ ID NO: 702454 - RNA, 22 nt, Human
gcaggugguccccguggagugg

SEQ ID NO: 702455 - RNA, 22 nt, Human
ggcugccugugcccaggcacac

SEQ ID NO: 702456 - RNA, 20 nt, Human
agugccagggcaggugagag

SEQ ID NO: 702457 - RNA, 22 nt, Human
ugagcuucaaaguuggaucuga

SEQ ID NO: 702458 - RNA, 22 nt, Human
gugacgugcagguguggccagc

SEQ ID NO: 702459 - RNA, 21 nt, Human
accuucaagccagaggugguc

SEQ ID NO: 702460 - RNA, 22 nt, Human
auugacacaaugggauguaagg

SEQ ID NO: 702461 - RNA, 22 nt, Human
agugcauuauauguuucaaugg

SEQ ID NO: 702462 - RNA, 22 nt, Human
aggcugagcugaccugguuugg

SEQ ID NO: 702463 - RNA, 22 nt, Human
gccagggaggcuguaggguccu

SEQ ID NO: 702464 - RNA, 22 nt, Human
acuggcuuggcaggaggaagau

SEQ ID NO: 702465 - RNA, 22 nt, Human
acucucccuuggagccucaggc

SEQ ID NO: 702466 - RNA, 22 nt, Human
ggcucuccacuauggaugagaa

SEQ ID NO: 702467 - RNA, 19 nt, Human
cccuggggguuucugguac

SEQ ID NO: 702468 - RNA, 22 nt, Human
ggcagaggaagcuggaaguggg

SEQ ID NO: 702469 - RNA, 22 nt, Human
uguguugugucaccuaucaugc

SEQ ID NO: 702470 - RNA, 22 nt, Human
uuuucaccauagacacuggucc

SEQ ID NO: 702471 - RNA, 22 nt, Human
gggccucagguucuggagaagg

SEQ ID NO: 702472 - RNA, 22 nt, Human
ucucagagauguuagggaagag

SEQ ID NO: 702473 - RNA, 22 nt, Human
uuucagagcucagcagcuagag

SEQ ID NO: 702474 - RNA, 22 nt, Human
cagcccuguccaaugucugcuc

SEQ ID NO: 702475 - RNA, 22 nt, Human
ccugcucuaaaucucauggaac

SEQ ID NO: 702476 - RNA, 22 nt, Human
cugaggcucugggugucacugu

SEQ ID NO: 702477 - RNA, 22 nt, Human
aggucugaguauggccugagaa

SEQ ID NO: 702478 - RNA, 22 nt, Human
caaaguuaucaacugcaacauu

SEQ ID NO: 702479 - RNA, 21 nt, Human
ucccacugccacagcuucagg

SEQ ID NO: 702480 - RNA, 22 nt, Human
gcauucauucauucauuaggua

SEQ ID NO: 702481 - RNA, 22 nt, Human
uuccagccacuuuauacugcua

SEQ ID NO: 702482 - RNA, 22 nt, Human
auggaguucuuuaaauucacag

SEQ ID NO: 702483 - RNA, 22 nt, Human
ccuggcuucuauaccaccaggu

SEQ ID NO: 702484 - RNA, 22 nt, Human
aacauuucagcaaauaagaaca

SEQ ID NO: 702485 - RNA, 22 nt, Human
gacccaggguauccagagcugc

SEQ ID NO: 702486 - RNA, 22 nt, Human
gucauucaaacuguaucacuug

SEQ ID NO: 702487 - RNA, 21 nt, Human
acacacucugagucuucuauu

SEQ ID NO: 702488 - RNA, 22 nt, Human
agggugcagggacaggugugca

SEQ ID NO: 702489 - RNA, 22 nt, Human
cuguacaauguuaccuauuuau

SEQ ID NO: 702490 - RNA, 22 nt, Human
uauccaaagagauucauguucu

SEQ ID NO: 702491 - RNA, 22 nt, Human
ugagauggguggggagcucagg

SEQ ID NO: 702492 - RNA, 22 nt, Human
aaggaggaauuucagggugaau

SEQ ID NO: 702493 - RNA, 22 nt, Human
uuugcaaaauuauucccagcau

SEQ ID NO: 702494 - RNA, 22 nt, Human
aguguuuaguuaagauuucaaa

SEQ ID NO: 702495 - RNA, 22 nt, Human
uuccucaucugugcaccucacu

SEQ ID NO: 702496 - RNA, 22 nt, Human
uggaugaguucaaugaggcaga

SEQ ID NO: 702497 - RNA, 22 nt, Human
uccucuggucuucgguguggac

SEQ ID NO: 702498 - RNA, 22 nt, Human
agaaagcuuaugaaugggcaag

SEQ ID NO: 702499 - RNA, 22 nt, Human
uccugggagcccuugcuccacc

SEQ ID NO: 702500 - RNA, 21 nt, Human
ucagagggcccuggaggcuca

SEQ ID NO: 702501 - RNA, 22 nt, Human
ugaccugcguaggugguuucug

SEQ ID NO: 702502 - RNA, 22 nt, Human
uuggaaggccagcaccuugagu

SEQ ID NO: 702503 - RNA, 22 nt, Human
ucucugcuaagauugugucuag

SEQ ID NO: 702504 - RNA, 22 nt, Human
cucugggucuaccuguggccag

SEQ ID NO: 702505 - RNA, 22 nt, Human
aaaggccaccaacaugaagcau

SEQ ID NO: 702506 - RNA, 22 nt, Human
uugccagggccagugggggugu

SEQ ID NO: 702507 - RNA, 22 nt, Human
uguaugaagccagaaucuguuu

SEQ ID NO: 702508 - RNA, 22 nt, Human
aaccagcuccagccuccauuca

SEQ ID NO: 702509 - RNA, 22 nt, Human
acagaauugaagcugaguaaau

SEQ ID NO: 702510 - RNA, 22 nt, Human
ggucagaggucacaagcuggca

SEQ ID NO: 702511 - RNA, 22 nt, Human
cuccagaauuguccauuggaaa

SEQ ID NO: 702512 - RNA, 22 nt, Human
cucucagggucccugcggagga

SEQ ID NO: 702513 - RNA, 22 nt, Human
uuacagaaaggaaggacugacu

SEQ ID NO: 702514 - RNA, 19 nt, Human
auucuucucuuccugcugu

SEQ ID NO: 702515 - RNA, 22 nt, Human
cugcagaguggagccucggcug

SEQ ID NO: 702516 - RNA, 18 nt, Human
uaguuucuaauggccuuu

SEQ ID NO: 702517 - RNA, 22 nt, Human
uguagaaguaggagucaucuca

SEQ ID NO: 702518 - RNA, 22 nt, Human
guggcugcagcccagcggcacg

SEQ ID NO: 702519 - RNA, 22 nt, Human
acucuggggcgcuacuccaacu

SEQ ID NO: 702520 - RNA, 22 nt, Human
guuuugaaucacugcgcuucac

SEQ ID NO: 702521 - RNA, 22 nt, Human
agaguccacccuggggucaggc

SEQ ID NO: 702522 - RNA, 22 nt, Human
ucagcaguagagggggcacagu

SEQ ID NO: 702523 - RNA, 21 nt, Human
uuuggcuucucugcugcagcc

SEQ ID NO: 702524 - RNA, 22 nt, Human
gcccuuggaagcggcagguagc

SEQ ID NO: 702525 - RNA, 22 nt, Human
cagugugaggaauuagugucca

SEQ ID NO: 702526 - RNA, 22 nt, Human
ggacaacacuucauuccagcua

SEQ ID NO: 702527 - RNA, 22 nt, Human
aaacacauuuuaggaaaaucua

SEQ ID NO: 702528 - RNA, 22 nt, Human
ucuugaauaaguuucaugagcu

SEQ ID NO: 702529 - RNA, 22 nt, Human
agacacugagcauuuuccuagc

SEQ ID NO: 702530 - RNA, 22 nt, Human
cugggcucaccuguggcuggca

SEQ ID NO: 702531 - RNA, 22 nt, Human
uuuggucuuuuauuuaaagcag

SEQ ID NO: 702532 - RNA, 20 nt, Human
ccagagcagccacugaaguu

SEQ ID NO: 702533 - RNA, 22 nt, Human
gucugggccaggcgagccgagg

SEQ ID NO: 702534 - RNA, 22 nt, Human
cuauuuuaacuugauuaccucu

SEQ ID NO: 702535 - RNA, 22 nt, Human
aggcaugacuuuggcugaagaa

SEQ ID NO: 702536 - RNA, 17 nt, Human
uggcaagaauggaaaug

SEQ ID NO: 702537 - RNA, 22 nt, Human
acauggaaaguacuccacaauu

SEQ ID NO: 702538 - RNA, 22 nt, Human
uuugauuccuggggcagggcug

SEQ ID NO: 702539 - RNA, 22 nt, Human
uaggcugaaaggagaggugaag

SEQ ID NO: 702540 - RNA, 19 nt, Human
ugaagagcugucaaaagug

SEQ ID NO: 702541 - RNA, 18 nt, Human
acacaguggaugccuggu

SEQ ID NO: 702542 - RNA, 22 nt, Human
uccuucagcuuguuagagugac

SEQ ID NO: 702543 - RNA, 22 nt, Human
cuggcuccauccuugagcucug

SEQ ID NO: 702544 - RNA, 22 nt, Human
aauacaguagguaauaguucau

SEQ ID NO: 702545 - RNA, 22 nt, Human
cagagcaacacccuuuacaucg

SEQ ID NO: 702546 - RNA, 22 nt, Human
ugugucagcacaguaucaauua

SEQ ID NO: 702547 - RNA, 19 nt, Human
uccccaagaguucuagcuc

SEQ ID NO: 702548 - RNA, 22 nt, Human
caaaugauacuguuuuuagucu

SEQ ID NO: 702549 - RNA, 22 nt, Human
ugagaagcccacacucuuuccu

SEQ ID NO: 702550 - RNA, 21 nt, Human
acugagguuagaugccuugcc

SEQ ID NO: 702551 - RNA, 21 nt, Human
uacauagaggugauaucuguu

SEQ ID NO: 702552 - RNA, 22 nt, Human
acuuaaaguaguuuuacugugg

SEQ ID NO: 702553 - RNA, 22 nt, Human
gacuuuggcaucuagacauugu

SEQ ID NO: 702554 - RNA, 22 nt, Human
cuuaaauucuuaaugcccucau

SEQ ID NO: 702555 - RNA, 22 nt, Human
gaagccaaguccucgaguuuca

SEQ ID NO: 702556 - RNA, 21 nt, Human
guuuaugaaucuuguccugcu

SEQ ID NO: 702557 - RNA, 22 nt, Human
aauauuuccaaggccugucagg

SEQ ID NO: 702558 - RNA, 22 nt, Human
ugugucaauuuucauuccuacu

SEQ ID NO: 702559 - RNA, 22 nt, Human
uaauuacagagguuugccaguu

SEQ ID NO: 702560 - RNA, 20 nt, Human
accauuaauguaagcuuugu

SEQ ID NO: 702561 - RNA, 22 nt, Human
ugcuccaggcaagcugagaguu

SEQ ID NO: 702562 - RNA, 22 nt, Human
ugaaagcaggcgggcuacuuua

SEQ ID NO: 702563 - RNA, 22 nt, Human
gcaggggcuaaggacacagaga

SEQ ID NO: 702564 - RNA, 22 nt, Human
gcccagucucuucuggcccugu

SEQ ID NO: 702565 - RNA, 22 nt, Human
aauguacagcugucuuuccucc

SEQ ID NO: 702566 - RNA, 18 nt, Human
uagcagcacuggccgcuu

SEQ ID NO: 702567 - RNA, 22 nt, Human
ugcagaugagggaugaaaauga

SEQ ID NO: 702568 - RNA, 22 nt, Human
ggguuggauuacuuagggagaa

SEQ ID NO: 702569 - RNA, 22 nt, Human
cuggcucccgaagcccucagug

SEQ ID NO: 702570 - RNA, 23 nt, Human
ucugagguggcucuugcuuugaa

SEQ ID NO: 702571 - RNA, 22 nt, Human
cucuggagaacuccuugugucu

SEQ ID NO: 702572 - RNA, 22 nt, Human
gagaaagaaagggaaguuuguu

SEQ ID NO: 702573 - RNA, 22 nt, Human
agcagguaugacauagauaugu

SEQ ID NO: 702574 - RNA, 22 nt, Human
aaggcuuuuaacuacuguuuua

SEQ ID NO: 702575 - RNA, 22 nt, Human
cagcucuggccagaucuauccu

SEQ ID NO: 702576 - RNA, 19 nt, Human
uaauaagcaauauggaagu

SEQ ID NO: 702577 - RNA, 22 nt, Human
gugaggcagagaugccaaaacu

SEQ ID NO: 702578 - RNA, 22 nt, Human
augaggauaccgcagggggcag

SEQ ID NO: 702579 - RNA, 22 nt, Human
ucucugggaucagguggcccag

SEQ ID NO: 702580 - RNA, 22 nt, Human
uuucagacugcugugugaaacu

SEQ ID NO: 702581 - RNA, 22 nt, Human
uucacauugguucuugauagcu

SEQ ID NO: 702582 - RNA, 22 nt, Human
acauuucugucuuagggacugu

SEQ ID NO: 702583 - RNA, 22 nt, Human
agacugaauaacaagcaaauaa

SEQ ID NO: 702584 - RNA, 22 nt, Human
cugucauuguacauguuauaca

SEQ ID NO: 702585 - RNA, 22 nt, Human
ucagcuucuccaagugacaugg

SEQ ID NO: 702586 - RNA, 22 nt, Human
cccaguggggaaauagcuagcu

SEQ ID NO: 702587 - RNA, 22 nt, Human
aaaggcagagugcucagcuggc

SEQ ID NO: 702588 - RNA, 22 nt, Human
uaaguuucuccaaagcacagaa

SEQ ID NO: 702589 - RNA, 22 nt, Human
acuuuuaucaaggaagugaucu

SEQ ID NO: 702590 - RNA, 19 nt, Human
cugggccagagcuguccuc

SEQ ID NO: 702591 - RNA, 22 nt, Human
gacagugaacagguucccacug

SEQ ID NO: 702592 - RNA, 22 nt, Human
uaggaaaugaaugcaggcuccc

SEQ ID NO: 702593 - RNA, 22 nt, Human
agucuugucuuauuuuaauaga

SEQ ID NO: 702594 - RNA, 22 nt, Human
auaauguugaugauugucuuug

SEQ ID NO: 702595 - RNA, 22 nt, Human
ucugcagaauucgaggaagaaa

SEQ ID NO: 702596 - RNA, 22 nt, Human
cugaggcagagggcagaccaga

SEQ ID NO: 702597 - RNA, 22 nt, Human
cugccucacauuggcuguguga

SEQ ID NO: 702598 - RNA, 22 nt, Human
augaacaucggaaaugagacug

SEQ ID NO: 702599 - RNA, 22 nt, Human
cggcuggugucgggcacagcaa

SEQ ID NO: 702600 - RNA, 20 nt, Human
aaacgagccaucauucuggu

SEQ ID NO: 702601 - RNA, 22 nt, Human
gugcauauuuugcacacagaug

SEQ ID NO: 702602 - RNA, 22 nt, Human
acuucaguaggugauaugugca

SEQ ID NO: 702603 - RNA, 22 nt, Human
ggggaggaguguacagguuuau

SEQ ID NO: 702604 - RNA, 22 nt, Human
gacaaagcagacaagauaauuc

SEQ ID NO: 702605 - RNA, 22 nt, Human
accuuuauaugaaagaugacau

SEQ ID NO: 702606 - RNA, 22 nt, Human
uagcuguugcaauaaacaguuc

SEQ ID NO: 702607 - RNA, 22 nt, Human
uuuuaucugugacaucuggcag

SEQ ID NO: 702608 - RNA, 22 nt, Human
uccuuggggacgcugacaucgu

SEQ ID NO: 702609 - RNA, 22 nt, Human
ucagaaaggccacauggugcag

SEQ ID NO: 702610 - RNA, 22 nt, Human
acccccaagaggggccuucagc

SEQ ID NO: 702611 - RNA, 22 nt, Human
ugggaguuuguuagaaaugcag

SEQ ID NO: 702612 - RNA, 22 nt, Human
cugcugccggcgagccucccuu

SEQ ID NO: 702613 - RNA, 22 nt, Human
guuauuuucauuggcucagacu

SEQ ID NO: 702614 - RNA, 22 nt, Human
gcauugaagaucuuagacuagg

SEQ ID NO: 702615 - RNA, 22 nt, Human
cuucuccucugaguccugggag

SEQ ID NO: 702616 - RNA, 22 nt, Human
aaaaucugguaauuugaaugug

SEQ ID NO: 702617 - RNA, 22 nt, Human
uuccaauccaaacuucaccuuu

SEQ ID NO: 702618 - RNA, 22 nt, Human
ugcucuccugcuccucagccca

SEQ ID NO: 702619 - RNA, 22 nt, Human
caggccaaagaucccauugaca

SEQ ID NO: 702620 - RNA, 22 nt, Human
ggcuggguuauuuauggccaag

SEQ ID NO: 702621 - RNA, 22 nt, Human
ggugggugaaaucuaggugugu

SEQ ID NO: 702622 - RNA, 22 nt, Human
aguaaacugugugccuuugacu

SEQ ID NO: 702623 - RNA, 22 nt, Human
ugauacagagcaagcaucuuuu

SEQ ID NO: 702624 - RNA, 18 nt, Human
cggcagagugcuucuagc

SEQ ID NO: 702625 - RNA, 22 nt, Human
gugugcaugcauagacaccaca

SEQ ID NO: 702626 - RNA, 19 nt, Human
ccagcagacacagcugccc

SEQ ID NO: 702627 - RNA, 22 nt, Human
cagcuucuuagucuuuccuugu

SEQ ID NO: 702628 - RNA, 22 nt, Human
uaauuagagucacaaguaacca

SEQ ID NO: 702629 - RNA, 22 nt, Human
cagacaucacacucagauugca

SEQ ID NO: 702630 - RNA, 22 nt, Human
auucucauuugcuggcuauaug

SEQ ID NO: 702631 - RNA, 22 nt, Human
agcuccuguaguacauauuauu

SEQ ID NO: 702632 - RNA, 22 nt, Human
gcaggcagagagggguuuccag

SEQ ID NO: 702633 - RNA, 22 nt, Human
agucuccagaaauauagcagug

SEQ ID NO: 702634 - RNA, 22 nt, Human
ggggagaccaucugaaggugau

SEQ ID NO: 702635 - RNA, 23 nt, Human
agggguggucaguacccgcagug

SEQ ID NO: 702636 - RNA, 17 nt, Human
agccgggcauggaccag

SEQ ID NO: 702637 - RNA, 22 nt, Human
auggacuuaagagucagaagcu

SEQ ID NO: 702638 - RNA, 22 nt, Human
ucaaaggguaauguaauagucu

SEQ ID NO: 702639 - RNA, 22 nt, Human
guuuaugaaugugucagacaua

SEQ ID NO: 702640 - RNA, 22 nt, Human
gaggaggucccccgacaugccu

SEQ ID NO: 702641 - RNA, 22 nt, Human
cagcccuuccaggcagaauucu

SEQ ID NO: 702642 - RNA, 22 nt, Human
cuggagaaaauccauguguaug

SEQ ID NO: 702643 - RNA, 22 nt, Human
ccuuuaaauggauguucaacug

SEQ ID NO: 702644 - RNA, 22 nt, Human
aagggcuggcccugggaagagu

SEQ ID NO: 702645 - RNA, 22 nt, Human
uggccuggcccugaggcccugu

SEQ ID NO: 702646 - RNA, 22 nt, Human
ccagaugguauaguagggagag

SEQ ID NO: 702647 - RNA, 22 nt, Human
cugaggucucuuuccauaguga

SEQ ID NO: 702648 - RNA, 22 nt, Human
gcugucuugcucacucuugcag

SEQ ID NO: 702649 - RNA, 21 nt, Human
cauuucuauugaugagaaaag

SEQ ID NO: 702650 - RNA, 22 nt, Human
gcccaggaguuugcauuuuaac

SEQ ID NO: 702651 - RNA, 17 nt, Human
uggaagcuucauguugg

SEQ ID NO: 702652 - RNA, 22 nt, Human
guuucucaagcuugaaugcaca

SEQ ID NO: 702653 - RNA, 22 nt, Human
ugcagcagucagucaggccugg

SEQ ID NO: 702654 - RNA, 22 nt, Human
agggggugaaugucugucuaca

SEQ ID NO: 702655 - RNA, 22 nt, Human
aauccauagguuuuuccaagag

SEQ ID NO: 702656 - RNA, 22 nt, Human
agggucuaucucucugccuuug

SEQ ID NO: 702657 - RNA, 22 nt, Human
uccaugagacagauacuguaag

SEQ ID NO: 702658 - RNA, 22 nt, Human
ugaauaaacuaugaggaggaau

SEQ ID NO: 702659 - RNA, 21 nt, Human
uauuuaguuuuacaaaugugg

SEQ ID NO: 702660 - RNA, 22 nt, Human
cagggcagaaggcacucuacuc

SEQ ID NO: 702661 - RNA, 22 nt, Human
augagguccagggaaguuaaau

SEQ ID NO: 702662 - RNA, 22 nt, Human
uucauaggaaauaguguucuuu

SEQ ID NO: 702663 - RNA, 22 nt, Human
ucaguuucuaaaucuuaccaau

SEQ ID NO: 702664 - RNA, 22 nt, Human
gaagaaggguaaggaguguuga

SEQ ID NO: 702665 - RNA, 22 nt, Human
ugucuggacagagauucucaau

SEQ ID NO: 702666 - RNA, 22 nt, Human
ucugcagacuugccuaagugug

SEQ ID NO: 702667 - RNA, 22 nt, Human
caugccauuuacuuggaggaga

SEQ ID NO: 702668 - RNA, 22 nt, Human
ucuguucaucucaugggagaau

SEQ ID NO: 702669 - RNA, 22 nt, Human
agaaacagaaccaggugucauu

SEQ ID NO: 702670 - RNA, 22 nt, Human
uccugcagcugcagaccugggg

SEQ ID NO: 702671 - RNA, 22 nt, Human
gggcagcucucacagcagccaa

SEQ ID NO: 702672 - RNA, 22 nt, Human
cagagagagugggguguggauu

SEQ ID NO: 702673 - RNA, 22 nt, Human
cagcuuugugcaaugcagucuc

SEQ ID NO: 702674 - RNA, 22 nt, Human
guccuucaagguccuuggugug

SEQ ID NO: 702675 - RNA, 22 nt, Human
acuuccagcugcccugugugcu

SEQ ID NO: 702676 - RNA, 22 nt, Human
uggcugagcugcagcguggcuu

SEQ ID NO: 702677 - RNA, 18 nt, Human
uggcagugccaccuucuc

SEQ ID NO: 702678 - RNA, 22 nt, Human
aaugaagccacugaagacaauc

SEQ ID NO: 702679 - RNA, 22 nt, Human
ggcaauuucaugugguuuaaac

SEQ ID NO: 702680 - RNA, 22 nt, Human
guuccaggacccuggccucuga

SEQ ID NO: 702681 - RNA, 22 nt, Human
aaacaugagcacuugcuucaua

SEQ ID NO: 702682 - RNA, 22 nt, Human
ucuagagauacauuggucauuu

SEQ ID NO: 702683 - RNA, 22 nt, Human
aguguuucaagaagcaggaagu

SEQ ID NO: 702684 - RNA, 22 nt, Human
ucagaacauucucauugacugc

SEQ ID NO: 702685 - RNA, 22 nt, Human
guacacauacuauucaaagaga

SEQ ID NO: 702686 - RNA, 22 nt, Human
gguggccauggucagguagcgg

SEQ ID NO: 702687 - RNA, 22 nt, Human
uuacauuuugcacagauguccc

SEQ ID NO: 702688 - RNA, 22 nt, Human
ccagcacucugucccagcuucc

SEQ ID NO: 702689 - RNA, 22 nt, Human
gugcagagcaagggcugagggc

SEQ ID NO: 702690 - RNA, 22 nt, Human
uaagacacauucauaucugucu

SEQ ID NO: 702691 - RNA, 21 nt, Human
ucuccucccggggagaggccg

SEQ ID NO: 702692 - RNA, 20 nt, Human
uucuuucaucuacacguugu

SEQ ID NO: 702693 - RNA, 22 nt, Human
uagucacacaauuguguacauu

SEQ ID NO: 702694 - RNA, 22 nt, Human
uuguguacuacaguaugccaca

SEQ ID NO: 702695 - RNA, 22 nt, Human
cacuggugucugagcaggguga

SEQ ID NO: 702696 - RNA, 22 nt, Human
cuucagccucaacuacuauggu

SEQ ID NO: 702697 - RNA, 22 nt, Human
agagagcuuccauucuagugau

SEQ ID NO: 702698 - RNA, 22 nt, Human
acuuagcauuauguaauuacua

SEQ ID NO: 702699 - RNA, 20 nt, Human
ggccucggacuucaucguag

SEQ ID NO: 702700 - RNA, 22 nt, Human
cacagucucuguugcugggacc

SEQ ID NO: 702701 - RNA, 22 nt, Human
accuggaagugggugcuauggc

SEQ ID NO: 702702 - RNA, 22 nt, Human
auuguacagaugagguaaguga

SEQ ID NO: 702703 - RNA, 23 nt, Human
uggaagacuccucucuuggcugc

SEQ ID NO: 702704 - RNA, 22 nt, Human
aucuggcuccuacacuugaaga

SEQ ID NO: 702705 - RNA, 22 nt, Human
cuucuguguagaaagguagccc

SEQ ID NO: 702706 - RNA, 22 nt, Human
uuccaaaacaauauucugugaa

SEQ ID NO: 702707 - RNA, 22 nt, Human
cagggccuuauccugccauuga

SEQ ID NO: 702708 - RNA, 22 nt, Human
uaaaugagauguacauaacuca

SEQ ID NO: 702709 - RNA, 19 nt, Human
ccagguggaacugagguag

SEQ ID NO: 702710 - RNA, 22 nt, Human
gcagugggagcuuaggcagugc

SEQ ID NO: 702711 - RNA, 22 nt, Human
ucucccagaggaucccagugga

SEQ ID NO: 702712 - RNA, 22 nt, Human
aggucacccguuugacuaucca

SEQ ID NO: 702713 - RNA, 17 nt, Human
gcuuccucaugcaguuc

SEQ ID NO: 702714 - RNA, 19 nt, Human
uuuagacauugucugguau

SEQ ID NO: 702715 - RNA, 22 nt, Human
uuaauccggggugaauuuaauu

SEQ ID NO: 702716 - RNA, 22 nt, Human
gagucauuugggggcuucuuga

SEQ ID NO: 702717 - RNA, 22 nt, Human
uagagcaguguuguccaucaga

SEQ ID NO: 702718 - RNA, 22 nt, Human
agcucuccaucuaucugugaug

SEQ ID NO: 702719 - RNA, 22 nt, Human
augaagucugcacaugcaugug

SEQ ID NO: 702720 - RNA, 22 nt, Human
cccaggguaaucaugugaagcc

SEQ ID NO: 702721 - RNA, 22 nt, Human
cugccccuggugauggacgcca

SEQ ID NO: 702722 - RNA, 22 nt, Human
aagugcaugguauggucuccau

SEQ ID NO: 702723 - RNA, 22 nt, Human
acagggccucagccagggcaga

SEQ ID NO: 702724 - RNA, 22 nt, Human
guggagcaaucagagggucagu

SEQ ID NO: 702725 - RNA, 23 nt, Human
ugugaagguggguccaagggcug

SEQ ID NO: 702726 - RNA, 22 nt, Human
cagaguggcaugaaugaagccu

SEQ ID NO: 702727 - RNA, 22 nt, Human
ucagagguggagauaguuggga

SEQ ID NO: 702728 - RNA, 22 nt, Human
aggcacgagcaauggccgagga

SEQ ID NO: 702729 - RNA, 22 nt, Human
aaugagcuagaccugcuuccuc

SEQ ID NO: 702730 - RNA, 22 nt, Human
aucaguuucacuugcuugcaaa

SEQ ID NO: 702731 - RNA, 22 nt, Human
uuccauuguuucugucuucacu

SEQ ID NO: 702732 - RNA, 22 nt, Human
aggcauaaccuuuuaucuggau

SEQ ID NO: 702733 - RNA, 22 nt, Human
ucugggcucuuaguguacccuc

SEQ ID NO: 702734 - RNA, 22 nt, Human
cuuauguaugcuacuuuguggu

SEQ ID NO: 702735 - RNA, 17 nt, Human
aaucagauuucugagga

SEQ ID NO: 702736 - RNA, 22 nt, Human
aaaucaaaagacauguguuuua

SEQ ID NO: 702737 - RNA, 22 nt, Human
agugaaauaaagcugccuaugg

SEQ ID NO: 702738 - RNA, 22 nt, Human
ucacaugcacauacuuccugug

SEQ ID NO: 702739 - RNA, 22 nt, Human
uguuuuccuccugguuucugcc

SEQ ID NO: 702740 - RNA, 22 nt, Human
ucugucacuauuggccagaaca

SEQ ID NO: 702741 - RNA, 22 nt, Human
agaaauguuuacucacccccuu

SEQ ID NO: 702742 - RNA, 22 nt, Human
uaagugcaauguuuuacuuaaa

SEQ ID NO: 702743 - RNA, 22 nt, Human
uugaauuuagauuguauguuga

SEQ ID NO: 702744 - RNA, 22 nt, Human
ggcaggguggcagaggcucaga

SEQ ID NO: 702745 - RNA, 22 nt, Human
gccugugacccagggcccagga

SEQ ID NO: 702746 - RNA, 22 nt, Human
gcccaggagguugggcugugca

SEQ ID NO: 702747 - RNA, 22 nt, Human
uccacugcuacaaccucccaga

SEQ ID NO: 702748 - RNA, 22 nt, Human
gguccuggcagucuuugguugu

SEQ ID NO: 702749 - RNA, 22 nt, Human
cuuuaugacugaguugucaauu

SEQ ID NO: 702750 - RNA, 22 nt, Human
agcagcaggaggccauugucuu

SEQ ID NO: 702751 - RNA, 22 nt, Human
ucugggugcccuuugcucuguu

SEQ ID NO: 702752 - RNA, 22 nt, Human
gagcucauccccaugguccguc

SEQ ID NO: 702753 - RNA, 22 nt, Human
gaauauuuuuaaagggacuaau

SEQ ID NO: 702754 - RNA, 22 nt, Human
aaaggacaugucaauaucaggc

SEQ ID NO: 702755 - RNA, 22 nt, Human
gaauuacauaauaaaaugagag

SEQ ID NO: 702756 - RNA, 22 nt, Human
ugauuuuuaaaauucuccuugc

SEQ ID NO: 702757 - RNA, 22 nt, Human
cuucugcaggcccugucugacc

SEQ ID NO: 702758 - RNA, 22 nt, Human
gucagaaaccagucaaacaaga

SEQ ID NO: 702759 - RNA, 22 nt, Human
gcagcagugucucccaucuugc

SEQ ID NO: 702760 - RNA, 22 nt, Human
gcccuuccaacccagagggcaa

SEQ ID NO: 702761 - RNA, 22 nt, Human
gccuagagaaaaagccucugca

SEQ ID NO: 702762 - RNA, 22 nt, Human
aguguggccaaugaggaugggc

SEQ ID NO: 702763 - RNA, 20 nt, Human
gacacaggcaguccucagag

SEQ ID NO: 702764 - RNA, 22 nt, Human
auuagugcccaggcugccucuu

SEQ ID NO: 702765 - RNA, 22 nt, Human
aagaauaacacuuagguuuugc

SEQ ID NO: 702766 - RNA, 21 nt, Human
ugcaguccuuugacaugauuc

SEQ ID NO: 702767 - RNA, 16 nt, Human
ugcuccagaggaccca

SEQ ID NO: 702768 - RNA, 22 nt, Human
aaggcacagccacuugaucauc

SEQ ID NO: 702769 - RNA, 22 nt, Human
ugaguaaaaauucuacauuucc

SEQ ID NO: 702770 - RNA, 22 nt, Human
cagcaugaucccaguugauugc

SEQ ID NO: 702771 - RNA, 22 nt, Human
agagccugagccugaaagcccu

SEQ ID NO: 702772 - RNA, 22 nt, Human
aagccaguuagcacaucauugc

SEQ ID NO: 702773 - RNA, 22 nt, Human
uguggaauguccucagcauccu

SEQ ID NO: 702774 - RNA, 22 nt, Human
gggcaguguugcucucaaaguc

SEQ ID NO: 702775 - RNA, 22 nt, Human
cagcccugucuaugacugauga

SEQ ID NO: 702776 - RNA, 22 nt, Human
uccugcuggaaguagggaauga

SEQ ID NO: 702777 - RNA, 22 nt, Human
uugcauauccuccaacacaugg

SEQ ID NO: 702778 - RNA, 22 nt, Human
uggaggcaggagacagggcaaa

SEQ ID NO: 702779 - RNA, 22 nt, Human
accucugcaaugcaaugucaug

SEQ ID NO: 702780 - RNA, 22 nt, Human
ggaccaguuucaaacuguacca

SEQ ID NO: 702781 - RNA, 22 nt, Human
ugaaugauuugggugcauucag

SEQ ID NO: 702782 - RNA, 22 nt, Human
uggucugaaugacuuguuaguu

SEQ ID NO: 702783 - RNA, 22 nt, Human
ugacacagaaauuaagcuguca

SEQ ID NO: 702784 - RNA, 22 nt, Human
gauaauuauaggcuaagccacu

SEQ ID NO: 702785 - RNA, 20 nt, Human
ugucuccagggcugagugga

SEQ ID NO: 702786 - RNA, 22 nt, Human
uugacacaguuuucucauuaag

SEQ ID NO: 702787 - RNA, 22 nt, Human
uucccacagugacuccagagaa

SEQ ID NO: 702788 - RNA, 21 nt, Human
ccagaggccucucuuggccac

SEQ ID NO: 702789 - RNA, 22 nt, Human
cuggcucauagagcagcuccaa

SEQ ID NO: 702790 - RNA, 22 nt, Human
acggcaggcucagagcuggaau

SEQ ID NO: 702791 - RNA, 22 nt, Human
accauugccuagaaaaauuccu

SEQ ID NO: 702792 - RNA, 22 nt, Human
gaagauuuauaaggaccuuauu

SEQ ID NO: 702793 - RNA, 22 nt, Human
guuucuccucugugucuuguuu

SEQ ID NO: 702794 - RNA, 22 nt, Human
agcugguucagaaauuagaugg

SEQ ID NO: 702795 - RNA, 22 nt, Human
aggcacuugcauugaugagguc

SEQ ID NO: 702796 - RNA, 21 nt, Human
ucuggagcccuaagcugagaa

SEQ ID NO: 702797 - RNA, 22 nt, Human
gccuggugauaagcagugaccu

SEQ ID NO: 702798 - RNA, 22 nt, Human
ccugagguuauccaucuaccug

SEQ ID NO: 702799 - RNA, 18 nt, Human
gagaaaccugugaaugcu

SEQ ID NO: 702800 - RNA, 22 nt, Human
aagcccugucacccugacuuca

SEQ ID NO: 702801 - RNA, 22 nt, Human
auucuagcugaguaucagcccc

SEQ ID NO: 702802 - RNA, 23 nt, Human
agaggcugcaggguauugagaau

SEQ ID NO: 702803 - RNA, 22 nt, Human
guauuuuuaguagagucggggu

SEQ ID NO: 702804 - RNA, 22 nt, Human
aaauguguuuagaugguuuauu

SEQ ID NO: 702805 - RNA, 22 nt, Human
caggccuccacuccacgcagac

SEQ ID NO: 702806 - RNA, 23 nt, Human
cuucagcagaaacauaaauucuc

SEQ ID NO: 702807 - RNA, 22 nt, Human
accagggcugacaaucugaugg

SEQ ID NO: 702808 - RNA, 22 nt, Human
agcauguguaaucucaauaccu

SEQ ID NO: 702809 - RNA, 22 nt, Human
ggugccuuccugccagccgcaa

SEQ ID NO: 702810 - RNA, 22 nt, Human
guauaucuucagaaauuauagg

SEQ ID NO: 702811 - RNA, 22 nt, Human
ucugcugccucgguguggguac

SEQ ID NO: 702812 - RNA, 22 nt, Human
cagguggcaugacugccuacaa

SEQ ID NO: 702813 - RNA, 22 nt, Human
uucaccagguguacaguuaguu

SEQ ID NO: 702814 - RNA, 22 nt, Human
agaggauucacugcagaagaca

SEQ ID NO: 702815 - RNA, 22 nt, Human
uuuucuuaugugcagcuauaug

SEQ ID NO: 702816 - RNA, 22 nt, Human
acaugauuuuuaaagagauaau

SEQ ID NO: 702817 - RNA, 22 nt, Human
guagcauucugaguucgcagag

SEQ ID NO: 702818 - RNA, 22 nt, Human
ggcugggaggaugacuugcuac

SEQ ID NO: 702819 - RNA, 22 nt, Human
gcaguguuaccuugggcugguu

SEQ ID NO: 702820 - RNA, 22 nt, Human
gcguaaggccucuggucucgga

SEQ ID NO: 702821 - RNA, 22 nt, Human
acgaauaaaucuauuucacaca

SEQ ID NO: 702822 - RNA, 22 nt, Human
acauuuagcuguacaaucuaug

SEQ ID NO: 702823 - RNA, 22 nt, Human
aucauucagccuaagcaaguac

SEQ ID NO: 702824 - RNA, 22 nt, Human
agcugggaagacuggaagacag

SEQ ID NO: 702825 - RNA, 22 nt, Human
cuauucagguguccauuaaucc

SEQ ID NO: 702826 - RNA, 22 nt, Human
gcugggagccccgagccagcgc

SEQ ID NO: 702827 - RNA, 22 nt, Human
gcagccaccucccauggcgggg

SEQ ID NO: 702828 - RNA, 22 nt, Human
aagagagaagucucucugguuc

SEQ ID NO: 702829 - RNA, 22 nt, Human
aguguucaggaucugaggccag

SEQ ID NO: 702830 - RNA, 22 nt, Human
agugcccaguuagguuggagca

SEQ ID NO: 702831 - RNA, 22 nt, Human
ugcugggcucaaccuccagagc

SEQ ID NO: 702832 - RNA, 22 nt, Human
aauccagcugugucacagguga

SEQ ID NO: 702833 - RNA, 22 nt, Human
acagguggggaggcugagguuc

SEQ ID NO: 702834 - RNA, 22 nt, Human
uggaaugaaaaguacuucagaa

SEQ ID NO: 702835 - RNA, 22 nt, Human
cuauuuauuguggguauccagg

SEQ ID NO: 702836 - RNA, 22 nt, Human
aaugauuuccccuacacagaag

SEQ ID NO: 702837 - RNA, 22 nt, Human
uuaaauucauuccaacuuuuga

SEQ ID NO: 702838 - RNA, 22 nt, Human
ccugagugaauucccucacugu

SEQ ID NO: 702839 - RNA, 22 nt, Human
gcauuuuugaucccacuaggau

SEQ ID NO: 702840 - RNA, 22 nt, Human
ugaggcaggagaaucaccggaa

SEQ ID NO: 702841 - RNA, 22 nt, Human
uucuuucuuggggaacacacuc

SEQ ID NO: 702842 - RNA, 22 nt, Human
ugggugcaggaugagugcuggc

SEQ ID NO: 702843 - RNA, 22 nt, Human
augggaggcaaagaucgcagaa

SEQ ID NO: 702844 - RNA, 22 nt, Human
caugaaggcugccagcaggcau

SEQ ID NO: 702845 - RNA, 22 nt, Human
uaagugucccuauugugauuuu

SEQ ID NO: 702846 - RNA, 22 nt, Human
gcaggagaaaugaagauugggu

SEQ ID NO: 702847 - RNA, 22 nt, Human
gcuguacaucacaauuugcugu

SEQ ID NO: 702848 - RNA, 23 nt, Human
agaggccaacuucuugccccucc

SEQ ID NO: 702849 - RNA, 22 nt, Human
cugcuuucuuguugcaucuuaa

SEQ ID NO: 702850 - RNA, 22 nt, Human
accagcugauuuaagaauaaag

SEQ ID NO: 702851 - RNA, 22 nt, Human
ggaggaugccaagcugugcaca

SEQ ID NO: 702852 - RNA, 22 nt, Human
uggcucagagcagggacucugg

SEQ ID NO: 702853 - RNA, 22 nt, Human
accccuuuuauagaagaacaga

SEQ ID NO: 702854 - RNA, 22 nt, Human
agcagacagguaggaggauaaa

SEQ ID NO: 702855 - RNA, 22 nt, Human
cagcccuguccagcagagggug

SEQ ID NO: 702856 - RNA, 22 nt, Human
gccagcugaagcccugguggaa

SEQ ID NO: 702857 - RNA, 18 nt, Human
ccuucagcucugguuuuc

SEQ ID NO: 702858 - RNA, 22 nt, Human
ggagagucugcuggccacagug

SEQ ID NO: 702859 - RNA, 22 nt, Human
ccacugucagaggggcugugcc

SEQ ID NO: 702860 - RNA, 22 nt, Human
acugggccuggauuggcguguc

SEQ ID NO: 702861 - RNA, 22 nt, Human
ccuggggagccgccugagcccc

SEQ ID NO: 702862 - RNA, 22 nt, Human
auucucaaagccagagucaacg

SEQ ID NO: 702863 - RNA, 19 nt, Human
ucucacaagcaacauuguu

SEQ ID NO: 702864 - RNA, 22 nt, Human
cugauucuuugaagaugcaccc

SEQ ID NO: 702865 - RNA, 22 nt, Human
uguggccuggaaggggcugcuc

SEQ ID NO: 702866 - RNA, 22 nt, Human
cacauauuguaguucaccagga

SEQ ID NO: 702867 - RNA, 22 nt, Human
uugauucauuuauugagugccu

SEQ ID NO: 702868 - RNA, 22 nt, Human
cucagccaugcaacaugcuggg

SEQ ID NO: 702869 - RNA, 22 nt, Human
aagcaacuguugaauuggacua

SEQ ID NO: 702870 - RNA, 21 nt, Human
auucugaguugucagucuuca

SEQ ID NO: 702871 - RNA, 22 nt, Human
uucccaggcugugcuaccagag

SEQ ID NO: 702872 - RNA, 22 nt, Human
acuccagggcuccaucccuugu

SEQ ID NO: 702873 - RNA, 22 nt, Human
gcugccuccugagauuugggca

SEQ ID NO: 702874 - RNA, 22 nt, Human
caagggugaaggcagaggacau

SEQ ID NO: 702875 - RNA, 22 nt, Human
uucccaggacucugggugucuu

SEQ ID NO: 702876 - RNA, 22 nt, Human
uauuuauuggacaguguugcug

SEQ ID NO: 702877 - RNA, 22 nt, Human
gaaagccaucuggcugcuggga

SEQ ID NO: 702878 - RNA, 22 nt, Human
uaaauguuguaaguacaucuaa

SEQ ID NO: 702879 - RNA, 22 nt, Human
cauggaacuguauaaaggcacu

SEQ ID NO: 702880 - RNA, 22 nt, Human
caauaauuuacauuggauacca

SEQ ID NO: 702881 - RNA, 22 nt, Human
ucugagguccugugauuucucu

SEQ ID NO: 702882 - RNA, 22 nt, Human
ugucuccagaaagcaccaggag

SEQ ID NO: 702883 - RNA, 22 nt, Human
uuaccugguguuuaugguccau

SEQ ID NO: 702884 - RNA, 16 nt, Human
agcaccagaucauauc

SEQ ID NO: 702885 - RNA, 22 nt, Human
accuuuucaucugaaacuuuua

SEQ ID NO: 702886 - RNA, 22 nt, Human
aacauuuguuuggcuucaauua

SEQ ID NO: 702887 - RNA, 22 nt, Human
ggagggccaucuugggugugau

SEQ ID NO: 702888 - RNA, 22 nt, Human
uguggcucucagauccuccaau

SEQ ID NO: 702889 - RNA, 22 nt, Human
ccuuuuaagggagacuagagau

SEQ ID NO: 702890 - RNA, 22 nt, Human
uaugauaugcacuuuaucagaa

SEQ ID NO: 702891 - RNA, 22 nt, Human
aguuacaagcuauuuuacuuaa

SEQ ID NO: 702892 - RNA, 22 nt, Human
uuugauuuacuggauauucuca

SEQ ID NO: 702893 - RNA, 22 nt, Human
aggcaguuucugggacagcaua

SEQ ID NO: 702894 - RNA, 22 nt, Human
ucacuguuuugccugcacuucc

SEQ ID NO: 702895 - RNA, 22 nt, Human
uucuacaaauauuuacuguucc

SEQ ID NO: 702896 - RNA, 22 nt, Human
cagcucuuaacacagcuuguau

SEQ ID NO: 702897 - RNA, 22 nt, Human
cucugucuaucccauucugugc

SEQ ID NO: 702898 - RNA, 22 nt, Human
uccagcuccugaguucacugcu

SEQ ID NO: 702899 - RNA, 22 nt, Human
gagggaugucaggggaccuugg

SEQ ID NO: 702900 - RNA, 22 nt, Human
ggcagacuguaauaggagaauu

SEQ ID NO: 702901 - RNA, 22 nt, Human
agaugcagaguuugcuguggac

SEQ ID NO: 702902 - RNA, 23 nt, Human
gggaucuguaaaccuggagaacc

SEQ ID NO: 702903 - RNA, 22 nt, Human
cugcaggggcaguccacuuccu

SEQ ID NO: 702904 - RNA, 22 nt, Human
ugcugugcuggcggcagaggcc

SEQ ID NO: 702905 - RNA, 22 nt, Human
ugagauaguauguagcaccuga

SEQ ID NO: 702906 - RNA, 22 nt, Human
gggaccuggcgagggucacaca

SEQ ID NO: 702907 - RNA, 22 nt, Human
aauauccagguagaugucuucu

SEQ ID NO: 702908 - RNA, 22 nt, Human
auuuccauuaucaugacaaauu

SEQ ID NO: 702909 - RNA, 22 nt, Human
aggcugcuuccuuacguggcug

SEQ ID NO: 702910 - RNA, 21 nt, Human
uccuccuggccaggcggcccc

SEQ ID NO: 702911 - RNA, 22 nt, Human
cagggccucuccuccaggaacu

SEQ ID NO: 702912 - RNA, 22 nt, Human
aagacagugugucaggcaggug

SEQ ID NO: 702913 - RNA, 22 nt, Human
agcuucugcaucuuuucuuccc

SEQ ID NO: 702914 - RNA, 22 nt, Human
caccucugcuguccacaggaug

SEQ ID NO: 702915 - RNA, 22 nt, Human
uuccaguuggagccugccuuua

SEQ ID NO: 702916 - RNA, 22 nt, Human
aucaggaaagaaaagcuuggcg

SEQ ID NO: 702917 - RNA, 22 nt, Human
guaggggugcugagaucuggaa

SEQ ID NO: 702918 - RNA, 22 nt, Human
cagggacauuuccaagagaauu

SEQ ID NO: 702919 - RNA, 22 nt, Human
ugaugucucucuauacucuaac

SEQ ID NO: 702920 - RNA, 22 nt, Human
aauguagaugagauauuuuuug

SEQ ID NO: 702921 - RNA, 22 nt, Human
aggaggggcaaugauagucugg

SEQ ID NO: 702922 - RNA, 22 nt, Human
cuuucccuuuugccuugcgugg

SEQ ID NO: 702923 - RNA, 22 nt, Human
ugcccugcagugagugcgucug

SEQ ID NO: 702924 - RNA, 22 nt, Human
aucacgucaugguuugaucugg

SEQ ID NO: 702925 - RNA, 22 nt, Human
uuagaaaugauuucaccucuuu

SEQ ID NO: 702926 - RNA, 22 nt, Human
agauuucccacuccauguauug

SEQ ID NO: 702927 - RNA, 22 nt, Human
gcugucuguggugucagcugac

SEQ ID NO: 702928 - RNA, 22 nt, Human
augaaauggugguuuuccauuu

SEQ ID NO: 702929 - RNA, 20 nt, Human
gggaggcgagggcugagcag

SEQ ID NO: 702930 - RNA, 22 nt, Human
auuauuguuuuaauaguagaga

SEQ ID NO: 702931 - RNA, 22 nt, Human
cuaugaccccagcaugaauaag

SEQ ID NO: 702932 - RNA, 22 nt, Human
cucaaauauaagcuaaaugugg

SEQ ID NO: 702933 - RNA, 22 nt, Human
aagaaucauccugcaagagucu

SEQ ID NO: 702934 - RNA, 22 nt, Human
cuggggggagcugcguccagca

SEQ ID NO: 702935 - RNA, 22 nt, Human
ucuugggcaauuucucuagagg

SEQ ID NO: 702936 - RNA, 22 nt, Human
acccagccacagcauugaggga

SEQ ID NO: 702937 - RNA, 22 nt, Human
acaucccacagaaacauacaua

SEQ ID NO: 702938 - RNA, 22 nt, Human
aguguacauguacacauuagua

SEQ ID NO: 702939 - RNA, 22 nt, Human
aguaugaagcugaaugauuuua

SEQ ID NO: 702940 - RNA, 22 nt, Human
aaacuucagugaaugacuuaug

SEQ ID NO: 702941 - RNA, 22 nt, Human
guaaggcuaaugucuuuguggu

SEQ ID NO: 702942 - RNA, 22 nt, Human
gcucugacacauuuguucuacc

SEQ ID NO: 702943 - RNA, 22 nt, Human
uagcaaagaaccugauacccca

SEQ ID NO: 702944 - RNA, 22 nt, Human
ugguacuuggaggcagaaaaau

SEQ ID NO: 702945 - RNA, 22 nt, Human
uucuuuggggaauauucugguu

SEQ ID NO: 702946 - RNA, 22 nt, Human
agcuaaggaaucagaagagguu

SEQ ID NO: 702947 - RNA, 22 nt, Human
gacuacucaaacuuucucuaua

SEQ ID NO: 702948 - RNA, 22 nt, Human
aggcccuguccauggugcugaa

SEQ ID NO: 702949 - RNA, 23 nt, Human
cccugcucaggggucugauucuc

SEQ ID NO: 702950 - RNA, 22 nt, Human
uuggccaagauacgagcacaua

SEQ ID NO: 702951 - RNA, 22 nt, Human
caaguccucgcuucuagcugug

SEQ ID NO: 702952 - RNA, 22 nt, Human
cacaugaugguggaagccauag

SEQ ID NO: 702953 - RNA, 22 nt, Human
cacagggcaggccccaggccuc

SEQ ID NO: 702954 - RNA, 22 nt, Human
cugaggccggagcacugaagag

SEQ ID NO: 702955 - RNA, 22 nt, Human
uguggcugugguuuucauaaau

SEQ ID NO: 702956 - RNA, 22 nt, Human
uggagucugugaugcucugggu

SEQ ID NO: 702957 - RNA, 22 nt, Human
ugaaggccuaacuuccagugcu

SEQ ID NO: 702958 - RNA, 22 nt, Human
uuucuagcuguaggaagcugag

SEQ ID NO: 702959 - RNA, 22 nt, Human
gagauuuagcugcuuaacuccu

SEQ ID NO: 702960 - RNA, 22 nt, Human
uuugacauuaaggaacauauau

SEQ ID NO: 702961 - RNA, 22 nt, Human
ucaggaagucucaauuagcuac

SEQ ID NO: 702962 - RNA, 22 nt, Human
gcuggagcugcagccugggccu

SEQ ID NO: 702963 - RNA, 18 nt, Human
ugcuuggagcauuuacca

SEQ ID NO: 702964 - RNA, 22 nt, Human
ccuaacuuuaaugggaccagga

SEQ ID NO: 702965 - RNA, 22 nt, Human
aauuagggaggacaaagguaca

SEQ ID NO: 702966 - RNA, 22 nt, Human
agugucuuucauauccuccauc

SEQ ID NO: 702967 - RNA, 22 nt, Human
cccucucucgguugcugugguu

SEQ ID NO: 702968 - RNA, 22 nt, Human
uaauagaauaguggaaacauug

SEQ ID NO: 702969 - RNA, 23 nt, Human
ccuggggcacuugaguccucauc

SEQ ID NO: 702970 - RNA, 22 nt, Human
ugcagaagaaaacagcugugug

SEQ ID NO: 702971 - RNA, 22 nt, Human
cuucuguuacuguuagcugaag

SEQ ID NO: 702972 - RNA, 22 nt, Human
aaggggauagagcagacacucc

SEQ ID NO: 702973 - RNA, 23 nt, Human
ggcuagaguggaggggaacugca

SEQ ID NO: 702974 - RNA, 21 nt, Human
uugaaggaucacuucuguacc

SEQ ID NO: 702975 - RNA, 22 nt, Human
guguauugcacauccuguagcc

SEQ ID NO: 702976 - RNA, 22 nt, Human
acuucagugugguauaaaacgu

SEQ ID NO: 702977 - RNA, 21 nt, Human
aaagagcccgcugagagguuc

SEQ ID NO: 702978 - RNA, 22 nt, Human
uuguacagggaaguaauacaag

SEQ ID NO: 702979 - RNA, 22 nt, Human
ugacucaggaggaaagacucca

SEQ ID NO: 702980 - RNA, 22 nt, Human
cccagugucuccaacaucagau

SEQ ID NO: 702981 - RNA, 22 nt, Human
ccugguggccuucagcccacaa

SEQ ID NO: 702982 - RNA, 22 nt, Human
gggggucccaagcugggcugcu

SEQ ID NO: 702983 - RNA, 22 nt, Human
uuugucuucauccuucgagcug

SEQ ID NO: 702984 - RNA, 22 nt, Human
agcaccagcaacuaugggcugc

SEQ ID NO: 702985 - RNA, 22 nt, Human
gaggaggcagccuaucccuuag

SEQ ID NO: 702986 - RNA, 22 nt, Human
gucaacuuaucucuuuaucugu

SEQ ID NO: 702987 - RNA, 20 nt, Human
cuccugggacugcugguuau

SEQ ID NO: 702988 - RNA, 22 nt, Human
uaguguucuaagaacauccaug

SEQ ID NO: 702989 - RNA, 22 nt, Human
caguggccaacuuccugccucu

SEQ ID NO: 702990 - RNA, 22 nt, Human
ugcuggcuuuuugugucaaaga

SEQ ID NO: 702991 - RNA, 20 nt, Human
agcuggugaauuaaagacug

SEQ ID NO: 702992 - RNA, 22 nt, Human
ucaguguuacauuauauagaac

SEQ ID NO: 702993 - RNA, 22 nt, Human
cugcuuuuucuaggaggacaau

SEQ ID NO: 702994 - RNA, 22 nt, Human
auagcaaagccuggcacaauga

SEQ ID NO: 702995 - RNA, 21 nt, Human
uucagaaguugagggcagguu

SEQ ID NO: 702996 - RNA, 15 nt, Human
ccaggcucugcacuc

SEQ ID NO: 702997 - RNA, 22 nt, Human
acagugaggacagggacugugu

SEQ ID NO: 702998 - RNA, 22 nt, Human
acuucuucuucagcugggggau

SEQ ID NO: 702999 - RNA, 22 nt, Human
gccaggaaaaaggguggccaau

SEQ ID NO: 703000 - RNA, 22 nt, Human
uauucugguuuccggaucucua

SEQ ID NO: 703001 - RNA, 21 nt, Human
ugagcaggagucaugggaaug

SEQ ID NO: 703002 - RNA, 22 nt, Human
agugcuaaugugcaauauagag

SEQ ID NO: 703003 - RNA, 22 nt, Human
uuuauuaugauggacaccuucg

SEQ ID NO: 703004 - RNA, 22 nt, Human
ccuuggcauguggcauguggcu

SEQ ID NO: 703005 - RNA, 22 nt, Human
caacaucaguccucaugagaca

SEQ ID NO: 703006 - RNA, 22 nt, Human
agcuguccuggcucaggcugug

SEQ ID NO: 703007 - RNA, 22 nt, Human
uaugacauuauaaaggauuauu

SEQ ID NO: 703008 - RNA, 22 nt, Human
uggcucaguuuagcagcucagu

SEQ ID NO: 703009 - RNA, 22 nt, Human
ugcuuagggcuccuccaauaga

SEQ ID NO: 703010 - RNA, 18 nt, Human
uccgaggcaccauaaaaa

SEQ ID NO: 703011 - RNA, 22 nt, Human
ucugcugaccuuucucugacac

SEQ ID NO: 703012 - RNA, 22 nt, Human
gagcucagauucuggugucaga

SEQ ID NO: 703013 - RNA, 22 nt, Human
aggcuccguccagucucaggcc

SEQ ID NO: 703014 - RNA, 22 nt, Human
auacacagcuacauugaacaau

SEQ ID NO: 703015 - RNA, 22 nt, Human
ucaaggaaaagauaacuugaug

SEQ ID NO: 703016 - RNA, 22 nt, Human
uuauacagcauugcuagugaug

SEQ ID NO: 703017 - RNA, 22 nt, Human
uggaccugggguggccuccucu

SEQ ID NO: 703018 - RNA, 22 nt, Human
uggucuuagcuggaaggaggga

SEQ ID NO: 703019 - RNA, 21 nt, Human
uagaaucacuaauaagaugua

SEQ ID NO: 703020 - RNA, 22 nt, Human
gguuucaaaguggacaguuagu

SEQ ID NO: 703021 - RNA, 22 nt, Human
gagcuuggacaagcucugaagg

SEQ ID NO: 703022 - RNA, 22 nt, Human
cuucacuugcucaucaugcuau

SEQ ID NO: 703023 - RNA, 22 nt, Human
guccugaggaugcagagauaaa

SEQ ID NO: 703024 - RNA, 19 nt, Human
aggcugugagggaggacuc

SEQ ID NO: 703025 - RNA, 22 nt, Human
acagaacugggggcacagauag

SEQ ID NO: 703026 - RNA, 21 nt, Human
ggaaaauucagagugcaauuu

SEQ ID NO: 703027 - RNA, 18 nt, Human
ggugagggagcuggaagc

SEQ ID NO: 703028 - RNA, 22 nt, Human
auguuucucacuguuucucuau

SEQ ID NO: 703029 - RNA, 22 nt, Human
aaaggugacacucugccagcug

SEQ ID NO: 703030 - RNA, 22 nt, Human
cuucaaguugucugaggguggg

SEQ ID NO: 703031 - RNA, 22 nt, Human
gcggcccgagcaggacgggugg

SEQ ID NO: 703032 - RNA, 22 nt, Human
cacaguaucccucuuucucccc

SEQ ID NO: 703033 - RNA, 22 nt, Human
augcuaaaaacuugaucauuau

SEQ ID NO: 703034 - RNA, 17 nt, Human
cagagucugucugcauc

SEQ ID NO: 703035 - RNA, 22 nt, Human
augcacaguaaugagcugguug

SEQ ID NO: 703036 - RNA, 22 nt, Human
ucuggcagagucagugcacaca

SEQ ID NO: 703037 - RNA, 22 nt, Human
aagauucacagagugaaugaaa

SEQ ID NO: 703038 - RNA, 22 nt, Human
uuuauaauuaucucuacucuua

SEQ ID NO: 703039 - RNA, 22 nt, Human
agccaggcucaaggccugcucc

SEQ ID NO: 703040 - RNA, 22 nt, Human
augcaucuuaucaaaaauuaua

SEQ ID NO: 703041 - RNA, 22 nt, Human
gccagccacuucagcuauggcu

SEQ ID NO: 703042 - RNA, 22 nt, Human
uuggaauucagcuugcuuauaa

SEQ ID NO: 703043 - RNA, 22 nt, Human
acacauuuauuacaugcaugug

SEQ ID NO: 703044 - RNA, 22 nt, Human
caaauacuuuauauacuucaaa

SEQ ID NO: 703045 - RNA, 22 nt, Human
agguauggcauaaaucacaggg

SEQ ID NO: 703046 - RNA, 22 nt, Human
aagugacaaaaggguauccaaa

SEQ ID NO: 703047 - RNA, 22 nt, Human
cauuaaauaucaaccuagacua

SEQ ID NO: 703048 - RNA, 20 nt, Human
uuucacuggcuugauaaggu

SEQ ID NO: 703049 - RNA, 22 nt, Human
uaccuggagcaggaggcagaau

SEQ ID NO: 703050 - RNA, 18 nt, Human
auguacauguacucacac

SEQ ID NO: 703051 - RNA, 22 nt, Human
uggauaaaugugcagaugacau

SEQ ID NO: 703052 - RNA, 22 nt, Human
cuguggauuuaggcagagcuga

SEQ ID NO: 703053 - RNA, 22 nt, Human
ucagacuuccacuuugugcacu

SEQ ID NO: 703054 - RNA, 22 nt, Human
ccugauguccauaauccuguaa

SEQ ID NO: 703055 - RNA, 21 nt, Human
acuuuaauauacaugaggagg

SEQ ID NO: 703056 - RNA, 22 nt, Human
cuggucugggaugagggaugua

SEQ ID NO: 703057 - RNA, 22 nt, Human
accgcagugacgugggacuucc

SEQ ID NO: 703058 - RNA, 22 nt, Human
uuagugaucaaaaucaaaauug

SEQ ID NO: 703059 - RNA, 21 nt, Human
uuguaugcauacauacacaca

SEQ ID NO: 703060 - RNA, 22 nt, Human
uccaagaaucacugacacagcu

SEQ ID NO: 703061 - RNA, 22 nt, Human
cuguagcagugugcucuuuuuc

SEQ ID NO: 703062 - RNA, 22 nt, Human
uauuucugucagccagauaugg

SEQ ID NO: 703063 - RNA, 22 nt, Human
gcugcuguuccuccaguggauc

SEQ ID NO: 703064 - RNA, 22 nt, Human
acagggcaaccucugggagacu

SEQ ID NO: 703065 - RNA, 22 nt, Human
aagcacagccagguuaggggcu

SEQ ID NO: 703066 - RNA, 20 nt, Human
gccaguaccauucugccacu

SEQ ID NO: 703067 - RNA, 22 nt, Human
ucauccauuguccucacauuag

SEQ ID NO: 703068 - RNA, 22 nt, Human
agaaaggucaaaaucgugacau

SEQ ID NO: 703069 - RNA, 22 nt, Human
cagcucuguugcccuggaaacg

SEQ ID NO: 703070 - RNA, 22 nt, Human
aauguguuuauuuagugauuua

SEQ ID NO: 703071 - RNA, 22 nt, Human
ugcaugguaaccaggaugucua

SEQ ID NO: 703072 - RNA, 22 nt, Human
uuacauaguuaaauaguacagc

SEQ ID NO: 703073 - RNA, 22 nt, Human
ggcagguguggaguguuauuuu

SEQ ID NO: 703074 - RNA, 22 nt, Human
acugcucacgcauuacuugagc

SEQ ID NO: 703075 - RNA, 22 nt, Human
aucuuuagcauuacuuuauuca

SEQ ID NO: 703076 - RNA, 22 nt, Human
gacuuugacgaaagagucauua

SEQ ID NO: 703077 - RNA, 23 nt, Human
cccacaugucugagucagugcca

SEQ ID NO: 703078 - RNA, 22 nt, Human
aauuuauuauauccuaggggaa

SEQ ID NO: 703079 - RNA, 22 nt, Human
gcucagggaaggccacgugaga

SEQ ID NO: 703080 - RNA, 22 nt, Human
auugacaacccugguaugagca

SEQ ID NO: 703081 - RNA, 22 nt, Human
agacaauggcuaaguaaccugu

SEQ ID NO: 703082 - RNA, 22 nt, Human
ggcagaggugacagugucuuuu

SEQ ID NO: 703083 - RNA, 22 nt, Human
cucaggaggccauucucaaggu

SEQ ID NO: 703084 - RNA, 22 nt, Human
uuucagaagucacaguugacug

SEQ ID NO: 703085 - RNA, 22 nt, Human
uauuauugaaucaguucuuuga

SEQ ID NO: 703086 - RNA, 22 nt, Human
gggcuaggcuuggccagcacug

SEQ ID NO: 703087 - RNA, 18 nt, Human
uaagucauuuugccagca

SEQ ID NO: 703088 - RNA, 20 nt, Human
gcccacucuaauccacuguc

SEQ ID NO: 703089 - RNA, 22 nt, Human
cauucaaaaugggcugaccugu

SEQ ID NO: 703090 - RNA, 22 nt, Human
gugcugagcaucaugaggcacu

SEQ ID NO: 703091 - RNA, 22 nt, Human
ucucagguggcccccaugagug

SEQ ID NO: 703092 - RNA, 22 nt, Human
acuguucaagcaaaugacauug

SEQ ID NO: 703093 - RNA, 21 nt, Human
aggagcuggagaaaacuuucc

SEQ ID NO: 703094 - RNA, 22 nt, Human
agugauaaugugguaauuauuu

SEQ ID NO: 703095 - RNA, 22 nt, Human
gugcagagagguggagggacuu

SEQ ID NO: 703096 - RNA, 22 nt, Human
aucuacagccagucugguuugu

SEQ ID NO: 703097 - RNA, 22 nt, Human
uuacuucuuacaaaagaaauau

SEQ ID NO: 703098 - RNA, 22 nt, Human
ucucauuugccucaucuauaaa

SEQ ID NO: 703099 - RNA, 22 nt, Human
agggcuccaaggaaguguagcu

SEQ ID NO: 703100 - RNA, 22 nt, Human
gcaaugucuagucugagggcuu

SEQ ID NO: 703101 - RNA, 22 nt, Human
uucucagauauuuacugagcau

SEQ ID NO: 703102 - RNA, 23 nt, Human
cugggcuguccugaggucaccuc

SEQ ID NO: 703103 - RNA, 22 nt, Human
gugagaagauaaguauugcaaa

SEQ ID NO: 703104 - RNA, 22 nt, Human
ugcagcauucugguaaaaggca

SEQ ID NO: 703105 - RNA, 22 nt, Human
ccagcugcugacaugggcaggu

SEQ ID NO: 703106 - RNA, 22 nt, Human
agcagggaagccuccagaaccu

SEQ ID NO: 703107 - RNA, 18 nt, Human
uccugguucuguggccac

SEQ ID NO: 703108 - RNA, 20 nt, Human
uuuuccucguguuuguucua

SEQ ID NO: 703109 - RNA, 22 nt, Human
ucacuccucaggcuagcaucau

SEQ ID NO: 703110 - RNA, 22 nt, Human
uggaaugugaacauacaaggua

SEQ ID NO: 703111 - RNA, 22 nt, Human
aggagcugagucagcccgacag

SEQ ID NO: 703112 - RNA, 22 nt, Human
uucuucccuucauuccaccacc

SEQ ID NO: 703113 - RNA, 22 nt, Human
aagcagccuggcaugaugcuuu

SEQ ID NO: 703114 - RNA, 22 nt, Human
ccagcucccauucuucaccugu

SEQ ID NO: 703115 - RNA, 22 nt, Human
uguggucucguuauguugccca

SEQ ID NO: 703116 - RNA, 22 nt, Human
uuuccaggaaguaaggauaauc

SEQ ID NO: 703117 - RNA, 22 nt, Human
ucauaaaguuaucaccaaaucc

SEQ ID NO: 703118 - RNA, 22 nt, Human
augcccugagcaggccuucaag

SEQ ID NO: 703119 - RNA, 22 nt, Human
gcugaugggagcuggcucaccc

SEQ ID NO: 703120 - RNA, 22 nt, Human
uccaugggaagauuuugagugg

SEQ ID NO: 703121 - RNA, 22 nt, Human
uugcagcugaggaaauugaagc

SEQ ID NO: 703122 - RNA, 22 nt, Human
ccugcuuugagaugggcagcag

SEQ ID NO: 703123 - RNA, 22 nt, Human
acucccuuuucuacuucuaccc

SEQ ID NO: 703124 - RNA, 22 nt, Human
agaaggcaccguggccaauauu

SEQ ID NO: 703125 - RNA, 22 nt, Human
ggagccagagggaugcaguuga

SEQ ID NO: 703126 - RNA, 22 nt, Human
aguccagucucacucuuggcag

SEQ ID NO: 703127 - RNA, 22 nt, Human
aguauguauuuuauacuuacag

SEQ ID NO: 703128 - RNA, 22 nt, Human
uuggccaacagcgacagggcca

SEQ ID NO: 703129 - RNA, 22 nt, Human
ucaggaagacaaucuuuggcuc

SEQ ID NO: 703130 - RNA, 22 nt, Human
uccugccaccugcacagcuccc

SEQ ID NO: 703131 - RNA, 19 nt, Human
ugaggggaggagaggccug

SEQ ID NO: 703132 - RNA, 22 nt, Human
ucauguuuuugccauaugacuc

SEQ ID NO: 703133 - RNA, 22 nt, Human
caggcccaggggucuggcccac

SEQ ID NO: 703134 - RNA, 22 nt, Human
uauucuuguaccuuaaaugauu

SEQ ID NO: 703135 - RNA, 22 nt, Human
uauguucaugucaaacaaaugc

SEQ ID NO: 703136 - RNA, 22 nt, Human
uauagcaacuccaaagagacuu

SEQ ID NO: 703137 - RNA, 22 nt, Human
aaagaucuaugggcauuuagcu

SEQ ID NO: 703138 - RNA, 22 nt, Human
uguguauagguugugcuaauag

SEQ ID NO: 703139 - RNA, 22 nt, Human
ggagcugagacccaguggcuga

SEQ ID NO: 703140 - RNA, 20 nt, Human
cugggcaccugucugcaguu

SEQ ID NO: 703141 - RNA, 22 nt, Human
cuguuauuucugaaugccaucc

SEQ ID NO: 703142 - RNA, 22 nt, Human
cuaaauacuagccuucagauuu

SEQ ID NO: 703143 - RNA, 22 nt, Human
cacaguauucacugggcagauu

SEQ ID NO: 703144 - RNA, 22 nt, Human
aacuuuuagacuuggguauaaa

SEQ ID NO: 703145 - RNA, 22 nt, Human
aacacugaaguagugaauacug

SEQ ID NO: 703146 - RNA, 22 nt, Human
acaaauuuauugaagggcauau

SEQ ID NO: 703147 - RNA, 22 nt, Human
aucuuuacuuucagugcugagc

SEQ ID NO: 703148 - RNA, 22 nt, Human
cuggcccuaggcaaacacagau

SEQ ID NO: 703149 - RNA, 22 nt, Human
cagggauggcugucaggaugua

SEQ ID NO: 703150 - RNA, 21 nt, Human
gcucucagcugccugcugguu

SEQ ID NO: 703151 - RNA, 22 nt, Human
ugguagugacucccccagggcu

SEQ ID NO: 703152 - RNA, 23 nt, Human
uaccugaaguaagcauucaucca

SEQ ID NO: 703153 - RNA, 22 nt, Human
aggcuccauuccaggagcuaga

SEQ ID NO: 703154 - RNA, 22 nt, Human
aggcacuggucuaccccuuagu

SEQ ID NO: 703155 - RNA, 22 nt, Human
auuguaaaguacuguguacaau

SEQ ID NO: 703156 - RNA, 22 nt, Human
auccuucaauuagaaccaauug

SEQ ID NO: 703157 - RNA, 22 nt, Human
guuuuaguggguggccacugau

SEQ ID NO: 703158 - RNA, 22 nt, Human
uguuuucauggagaugguggcg

SEQ ID NO: 703159 - RNA, 22 nt, Human
ggaggaggggcgcuuugucuau

SEQ ID NO: 703160 - RNA, 22 nt, Human
caagaugugccuaaucagaccu

SEQ ID NO: 703161 - RNA, 22 nt, Human
uucacauuagccaagagaugga

SEQ ID NO: 703162 - RNA, 22 nt, Human
ccuuuggagcaacugagagcua

SEQ ID NO: 703163 - RNA, 22 nt, Human
agguuuauguuuggugcaggag

SEQ ID NO: 703164 - RNA, 18 nt, Human
uguuccaaggaaggaauc

SEQ ID NO: 703165 - RNA, 22 nt, Human
aaauuagaaauacuuucaaagc

SEQ ID NO: 703166 - RNA, 22 nt, Human
gcaggcuugggacgagcuggag

SEQ ID NO: 703167 - RNA, 18 nt, Human
ggcagggaaaagauaggg

SEQ ID NO: 703168 - RNA, 22 nt, Human
acaugucaauuuaguacucuua

SEQ ID NO: 703169 - RNA, 22 nt, Human
cacuggugacuucugagcugga

SEQ ID NO: 703170 - RNA, 22 nt, Human
cugggcagcuguaucagggagu

SEQ ID NO: 703171 - RNA, 22 nt, Human
aacacagaucaaaauauuuccu

SEQ ID NO: 703172 - RNA, 22 nt, Human
ucaggcagcuccaggaauggua

SEQ ID NO: 703173 - RNA, 19 nt, Human
uggauggagccugugguug

SEQ ID NO: 703174 - RNA, 22 nt, Human
gcagagauggcugccucugagu

SEQ ID NO: 703175 - RNA, 22 nt, Human
guccuggggauuauagaguguu

SEQ ID NO: 703176 - RNA, 22 nt, Human
uuuaucuucugcaguucuggcu

SEQ ID NO: 703177 - RNA, 22 nt, Human
ggaacuuuuuaacaagcugcug

SEQ ID NO: 703178 - RNA, 22 nt, Human
aacacugugcaguguaaugcug

SEQ ID NO: 703179 - RNA, 21 nt, Human
acaguucugccggcaucuuuc

SEQ ID NO: 703180 - RNA, 22 nt, Human
uguguuugaggcauguugcaga

SEQ ID NO: 703181 - RNA, 22 nt, Human
cuggccugugggcugucuccgg

SEQ ID NO: 703182 - RNA, 22 nt, Human
ugcuuaaagcugcucaguugua

SEQ ID NO: 703183 - RNA, 22 nt, Human
uaaaucacauucgucugcuccu

SEQ ID NO: 703184 - RNA, 22 nt, Human
aguggagcuuuuccuaucagag

SEQ ID NO: 703185 - RNA, 23 nt, Human
auuauuaaggacauggacuuugu

SEQ ID NO: 703186 - RNA, 22 nt, Human
ucugagagcuguagaagccuau

SEQ ID NO: 703187 - RNA, 22 nt, Human
auuuuguuaucagggcuuugca

SEQ ID NO: 703188 - RNA, 22 nt, Human
aaaugcuguguuuuaacauaga

SEQ ID NO: 703189 - RNA, 22 nt, Human
cauaacuagagugaaauguuga

SEQ ID NO: 703190 - RNA, 22 nt, Human
auguuuuuggcuucaaguuucu

SEQ ID NO: 703191 - RNA, 22 nt, Human
gccccuucguggaagugcauuc

SEQ ID NO: 703192 - RNA, 22 nt, Human
cauguguguggacgagcguggc

SEQ ID NO: 703193 - RNA, 22 nt, Human
aaacugugaagcaaguacaagg

SEQ ID NO: 703194 - RNA, 22 nt, Human
ggcaguggcagagcuuggucua

SEQ ID NO: 703195 - RNA, 22 nt, Human
ucugccuggguguggagcagag

SEQ ID NO: 703196 - RNA, 22 nt, Human
aucugggccuguucccucaccu

SEQ ID NO: 703197 - RNA, 22 nt, Human
gagcuucagaauuuaacagacu

SEQ ID NO: 703198 - RNA, 22 nt, Human
gcuuuagaagacacucuguuuu

SEQ ID NO: 703199 - RNA, 22 nt, Human
ucuguuucuucuucuguuauau

SEQ ID NO: 703200 - RNA, 22 nt, Human
aucugacaaccuauugacuuga

SEQ ID NO: 703201 - RNA, 22 nt, Human
uaaaugugggggccacgggcuu

SEQ ID NO: 703202 - RNA, 22 nt, Human
ccugggaguggcacucacagca

SEQ ID NO: 703203 - RNA, 22 nt, Human
aggaaggguucuuugugaaaga

SEQ ID NO: 703204 - RNA, 22 nt, Human
uacauacauuaccucauuuagu

SEQ ID NO: 703205 - RNA, 22 nt, Human
gagagacagcacacaguguggg

SEQ ID NO: 703206 - RNA, 22 nt, Human
ugaacacauuuucuucaguaga

SEQ ID NO: 703207 - RNA, 22 nt, Human
cugggaggauucauugagguga

SEQ ID NO: 703208 - RNA, 22 nt, Human
ucaggggcccuucccucagcag

SEQ ID NO: 703209 - RNA, 23 nt, Human
uuuuauugauauguagcuguugu

SEQ ID NO: 703210 - RNA, 22 nt, Human
auccuggaggcuggaggcuugc

SEQ ID NO: 703211 - RNA, 22 nt, Human
aaggaaggaauugaucaugcgc

SEQ ID NO: 703212 - RNA, 22 nt, Human
aaauuuaagaagugugugcgug

SEQ ID NO: 703213 - RNA, 22 nt, Human
uggcacugccuggcagggcccc

SEQ ID NO: 703214 - RNA, 22 nt, Human
guggcuucaccccaguugucuc

SEQ ID NO: 703215 - RNA, 19 nt, Human
ugcucaguggcuaaaagca

SEQ ID NO: 703216 - RNA, 22 nt, Human
ucugggcucugggaauuaggga

SEQ ID NO: 703217 - RNA, 19 nt, Human
auauacauacugugugcau

SEQ ID NO: 703218 - RNA, 22 nt, Human
ugcagaagcagagccgguggcc

SEQ ID NO: 703219 - RNA, 22 nt, Human
cugguuccaggauggaucuuuc

SEQ ID NO: 703220 - RNA, 22 nt, Human
agaaucaaagagaaauacuuug

SEQ ID NO: 703221 - RNA, 22 nt, Human
ugcauuaagggccuggagauac

SEQ ID NO: 703222 - RNA, 22 nt, Human
ucagcacuuggauuucagagau

SEQ ID NO: 703223 - RNA, 22 nt, Human
ggagucugcggcagacacugua

SEQ ID NO: 703224 - RNA, 22 nt, Human
ucaguuuucauuucaugagcag

SEQ ID NO: 703225 - RNA, 22 nt, Human
ucuuuggaugcguuacuuuuac

SEQ ID NO: 703226 - RNA, 22 nt, Human
cuucuucagcacaauauugaug

SEQ ID NO: 703227 - RNA, 22 nt, Human
gcuugcuuuguaaauaucugug

SEQ ID NO: 703228 - RNA, 20 nt, Human
aauacaugagcacacuuuca

SEQ ID NO: 703229 - RNA, 22 nt, Human
uggguagggacuuagcuggcug

SEQ ID NO: 703230 - RNA, 22 nt, Human
uagcaucuguuucucuuuguga

SEQ ID NO: 703231 - RNA, 22 nt, Human
acuguacaaauauugcaaaaua

SEQ ID NO: 703232 - RNA, 22 nt, Human
ggcuggaaccagagugaggcag

SEQ ID NO: 703233 - RNA, 22 nt, Human
cggggccuagcugcacacccuc

SEQ ID NO: 703234 - RNA, 22 nt, Human
uggcacagcccagagcucuuga

SEQ ID NO: 703235 - RNA, 19 nt, Human
auuaacaucaguguuggcc

SEQ ID NO: 703236 - RNA, 22 nt, Human
gcauuuuagaauauuggagcaa

SEQ ID NO: 703237 - RNA, 22 nt, Human
cuuagggaaucuuagagcugga

SEQ ID NO: 703238 - RNA, 22 nt, Human
uuuacagucugucuagcaaugu

SEQ ID NO: 703239 - RNA, 22 nt, Human
ggcuucacagccccauuagugc

SEQ ID NO: 703240 - RNA, 22 nt, Human
cugggagcuuguuaggaaugca

SEQ ID NO: 703241 - RNA, 22 nt, Human
gccuagggugcucagggacgag

SEQ ID NO: 703242 - RNA, 22 nt, Human
uggcuuccagaacugagcaaca

SEQ ID NO: 703243 - RNA, 22 nt, Human
acccuucauagaggagaagcug

SEQ ID NO: 703244 - RNA, 22 nt, Human
uuauugcagauggugugagaga

SEQ ID NO: 703245 - RNA, 22 nt, Human
ucccucuguguugggcaugccu

SEQ ID NO: 703246 - RNA, 22 nt, Human
uccugggauuugcccuuuucuc

SEQ ID NO: 703247 - RNA, 23 nt, Human
accugcuccaugucaccuucacu

SEQ ID NO: 703248 - RNA, 23 nt, Human
cagagcugauuaaacuuaaucuc

SEQ ID NO: 703249 - RNA, 23 nt, Human
caggcaggaugaggacuacacuc

SEQ ID NO: 703250 - RNA, 21 nt, Human
gaagccaagacaggaucaagg

SEQ ID NO: 703251 - RNA, 20 nt, Human
agauuaggggcuuucuucuu

SEQ ID NO: 703252 - RNA, 22 nt, Human
cugcugugucagaguccagggg

SEQ ID NO: 703253 - RNA, 22 nt, Human
cgaacacacuugggaguucuga

SEQ ID NO: 703254 - RNA, 22 nt, Human
cuccagagguucucaucuggga

SEQ ID NO: 703255 - RNA, 22 nt, Human
gcccauccauggggucauggcc

SEQ ID NO: 703256 - RNA, 22 nt, Human
cugagcugcuuugcuuuugggg

SEQ ID NO: 703257 - RNA, 22 nt, Human
uacauucuacuuuuucacuccc

SEQ ID NO: 703258 - RNA, 22 nt, Human
cugaggcaggggcagcuggaga

SEQ ID NO: 703259 - RNA, 22 nt, Human
ggugagggacaucacucagcca

SEQ ID NO: 703260 - RNA, 22 nt, Human
agauuucugggcuucaccaccu

SEQ ID NO: 703261 - RNA, 22 nt, Human
cuuggcucuguguugaugggac

SEQ ID NO: 703262 - RNA, 22 nt, Human
agaggucagaggucgccagguc

SEQ ID NO: 703263 - RNA, 17 nt, Human
gcuugccuugucuuccu

SEQ ID NO: 703264 - RNA, 22 nt, Human
uguguaugucuguaugcacaca

SEQ ID NO: 703265 - RNA, 22 nt, Human
uuaaauuagucaagcuucucug

SEQ ID NO: 703266 - RNA, 22 nt, Human
ugcucacagcccagaacauaau

SEQ ID NO: 703267 - RNA, 22 nt, Human
aggacuguuuuuucuucuaggg

SEQ ID NO: 703268 - RNA, 22 nt, Human
ccaguguggccaggugcuggua

SEQ ID NO: 703269 - RNA, 22 nt, Human
ugggccaguuggugacuacaaa

SEQ ID NO: 703270 - RNA, 22 nt, Human
ucccaagcaaugagucagggcc

SEQ ID NO: 703271 - RNA, 19 nt, Human
gaguacaggugcagaaaug

SEQ ID NO: 703272 - RNA, 19 nt, Human
cccagccaggucuugcauc

SEQ ID NO: 703273 - RNA, 21 nt, Human
auaauguacaaaaacugucuu

SEQ ID NO: 703274 - RNA, 22 nt, Human
cugacugucucuucucccauga

SEQ ID NO: 703275 - RNA, 22 nt, Human
gcuguauuuauuuucuaggguu

SEQ ID NO: 703276 - RNA, 22 nt, Human
cagaugagcaugggcacaagca

SEQ ID NO: 703277 - RNA, 22 nt, Human
guaggcagaccaguggaugggu

SEQ ID NO: 703278 - RNA, 22 nt, Human
uuucgagggauuagcuaggacu

SEQ ID NO: 703279 - RNA, 23 nt, Human
ccugacacaaaaggauucuugcu

SEQ ID NO: 703280 - RNA, 19 nt, Human
cgcagagggcuucugagag

SEQ ID NO: 703281 - RNA, 22 nt, Human
auauauuuugcggucacguggc

SEQ ID NO: 703282 - RNA, 22 nt, Human
gaaccuguaaguauagaugugg

SEQ ID NO: 703283 - RNA, 22 nt, Human
acaguacagcugaaacuuuagu

SEQ ID NO: 703284 - RNA, 22 nt, Human
uccugagacaucucugcugguc

SEQ ID NO: 703285 - RNA, 23 nt, Human
uguggcugagaaauugacaacuu

SEQ ID NO: 703286 - RNA, 22 nt, Human
gcuuccuccuggaggucacuca

SEQ ID NO: 703287 - RNA, 21 nt, Human
aucucacagcccagagaagcc

SEQ ID NO: 703288 - RNA, 22 nt, Human
ucacagugaggcaguucuugua

SEQ ID NO: 703289 - RNA, 22 nt, Human
uuuauucauuguuucgucgcag

SEQ ID NO: 703290 - RNA, 22 nt, Human
aaacugaggaguuagacuaggg

SEQ ID NO: 703291 - RNA, 22 nt, Human
gccagcucagaugcaggaagga

SEQ ID NO: 703292 - RNA, 23 nt, Human
agaugucuuagaaacugaagcug

SEQ ID NO: 703293 - RNA, 22 nt, Human
ucucuucuuguguuuuccugcc

SEQ ID NO: 703294 - RNA, 22 nt, Human
cuggaggagaacuugaggaagg

SEQ ID NO: 703295 - RNA, 22 nt, Human
cccaucucagucgugcuaaggg

SEQ ID NO: 703296 - RNA, 22 nt, Human
ggaggggcugagcaacuuucag

SEQ ID NO: 703297 - RNA, 22 nt, Human
uagcuuaaggaguaccagauca

SEQ ID NO: 703298 - RNA, 22 nt, Human
uuuacugaauuugguauauucc

SEQ ID NO: 703299 - RNA, 17 nt, Human
ugcuccuguggcagccu

SEQ ID NO: 703300 - RNA, 20 nt, Human
agacaaugagugacagaguu

SEQ ID NO: 703301 - RNA, 23 nt, Human
uccuggagaaaagaaacauuucu

SEQ ID NO: 703302 - RNA, 22 nt, Human
gagcagugagugaauguugccu

SEQ ID NO: 703303 - RNA, 22 nt, Human
aaaguacuuggauuacaggcau

SEQ ID NO: 703304 - RNA, 23 nt, Human
gucccucaccccuaggcaaugcc

SEQ ID NO: 703305 - RNA, 22 nt, Human
guggccagucccgaugcuuguu

SEQ ID NO: 703306 - RNA, 22 nt, Human
aggggagaauuucaacucaggu

SEQ ID NO: 703307 - RNA, 22 nt, Human
agcauaaaauaaauaguuugca

SEQ ID NO: 703308 - RNA, 22 nt, Human
uucuguuucuggggucucugac

SEQ ID NO: 703309 - RNA, 22 nt, Human
aaggcuguuugagcacuggagc

SEQ ID NO: 703310 - RNA, 22 nt, Human
acaggggcuccgaaggugaggg

SEQ ID NO: 703311 - RNA, 22 nt, Human
uggcugcagacaccuauggcag

SEQ ID NO: 703312 - RNA, 22 nt, Human
uuaagucacuuaucuaaagaca

SEQ ID NO: 703313 - RNA, 23 nt, Human
cucaacauccauucuugcccuuc

SEQ ID NO: 703314 - RNA, 22 nt, Human
cucuuucugauucgcugggacc

SEQ ID NO: 703315 - RNA, 22 nt, Human
cucagacaucugaaauggguua

SEQ ID NO: 703316 - RNA, 23 nt, Human
cugucuccugggcuagguggaau

SEQ ID NO: 703317 - RNA, 22 nt, Human
gagcccaggcagagguugcagu

SEQ ID NO: 703318 - RNA, 22 nt, Human
uugcauguguaauuuuucuaaa

SEQ ID NO: 703319 - RNA, 22 nt, Human
uguaccuuuuucugugcaugcu

SEQ ID NO: 703320 - RNA, 22 nt, Human
cccuccuuaccaccacagcucc

SEQ ID NO: 703321 - RNA, 22 nt, Human
cccagccugucuuucccaauga

SEQ ID NO: 703322 - RNA, 22 nt, Human
acauccauuugcuuuauuugcu

SEQ ID NO: 703323 - RNA, 22 nt, Human
ugaugcuucacgcugaauaugc

SEQ ID NO: 703324 - RNA, 22 nt, Human
ugcuucucuguucuaacccuug

SEQ ID NO: 703325 - RNA, 19 nt, Human
cacaucagcagggcugugg

SEQ ID NO: 703326 - RNA, 22 nt, Human
cugauuguguuccugggagcug

SEQ ID NO: 703327 - RNA, 22 nt, Human
gggcugacagcacgccuucugu

SEQ ID NO: 703328 - RNA, 22 nt, Human
ccugggaaggucuuagcaucua

SEQ ID NO: 703329 - RNA, 22 nt, Human
uggauugauaagagacaaguga

SEQ ID NO: 703330 - RNA, 22 nt, Human
ccaggcccugcuccucacacca

SEQ ID NO: 703331 - RNA, 22 nt, Human
gggccuggggugacguaccccu

SEQ ID NO: 703332 - RNA, 22 nt, Human
cauagaaaucaggugagaaucu

SEQ ID NO: 703333 - RNA, 22 nt, Human
ucccugaguguauguggugaac

SEQ ID NO: 703334 - RNA, 21 nt, Human
aggccucccuguugacagggc

SEQ ID NO: 703335 - RNA, 22 nt, Human
gcugagcacagcaaagagacaa

SEQ ID NO: 703336 - RNA, 21 nt, Human
aaacugaccuugccugagaca

SEQ ID NO: 703337 - RNA, 22 nt, Human
guuauuguccauuuauuuagca

SEQ ID NO: 703338 - RNA, 22 nt, Human
auaguuuaccuuccagauggcu

SEQ ID NO: 703339 - RNA, 22 nt, Human
agcuagagcugagaagcacuug

SEQ ID NO: 703340 - RNA, 22 nt, Human
ggccuggagucagggaaagcaa

SEQ ID NO: 703341 - RNA, 22 nt, Human
gcuuccaucuaugucuucauca

SEQ ID NO: 703342 - RNA, 22 nt, Human
ugcagcuccucuggcugccuga

SEQ ID NO: 703343 - RNA, 22 nt, Human
uccaggccugccugguguuugc

SEQ ID NO: 703344 - RNA, 22 nt, Human
cugaggcaugggaaguugggug

SEQ ID NO: 703345 - RNA, 22 nt, Human
aucaaaaugcuccagugauggu

SEQ ID NO: 703346 - RNA, 22 nt, Human
uggccaggaggcugcuucugac

SEQ ID NO: 703347 - RNA, 22 nt, Human
uacaguauuaugagugauugaa

SEQ ID NO: 703348 - RNA, 20 nt, Human
gauaaauugucucuuaagug

SEQ ID NO: 703349 - RNA, 22 nt, Human
gggcacagccuaacuauggaga

SEQ ID NO: 703350 - RNA, 22 nt, Human
aacacugagaacuguugguggu

SEQ ID NO: 703351 - RNA, 22 nt, Human
caaagccaggcuuucuaaugua

SEQ ID NO: 703352 - RNA, 22 nt, Human
ccaggcacgguggcucaugccu

SEQ ID NO: 703353 - RNA, 22 nt, Human
uaagccacuagucuguuaugaa

SEQ ID NO: 703354 - RNA, 22 nt, Human
acucagaagauguggguagaua

SEQ ID NO: 703355 - RNA, 20 nt, Human
gccugagcuauugccaggau

SEQ ID NO: 703356 - RNA, 22 nt, Human
cuccccauggcaacaguuaugg

SEQ ID NO: 703357 - RNA, 23 nt, Human
ccaguggcguaaacuagaggaua

SEQ ID NO: 703358 - RNA, 18 nt, Human
auguggcuagugcaacug

SEQ ID NO: 703359 - RNA, 22 nt, Human
uauaucaccaaaaacaguucug

SEQ ID NO: 703360 - RNA, 22 nt, Human
gccgaagcugccgucugguccu

SEQ ID NO: 703361 - RNA, 22 nt, Human
auuucuacauugaguuuuagca

SEQ ID NO: 703362 - RNA, 22 nt, Human
uuccaaaguuaguuauuagaaa

SEQ ID NO: 703363 - RNA, 23 nt, Human
uuaaaggcagauguugaguauua

SEQ ID NO: 703364 - RNA, 22 nt, Human
gccagggugagggcugagaggu

SEQ ID NO: 703365 - RNA, 23 nt, Human
cacauggauuaaaugagaccaca

SEQ ID NO: 703366 - RNA, 22 nt, Human
gaguuacauuuggugacacuuc

SEQ ID NO: 703367 - RNA, 22 nt, Human
gcuuuacaugauuucucacccu

SEQ ID NO: 703368 - RNA, 22 nt, Human
aucugggcagggcagcaaggcg

SEQ ID NO: 703369 - RNA, 22 nt, Human
uggcagguuuccuccucauagu

SEQ ID NO: 703370 - RNA, 22 nt, Human
cuggagggggaaauguucauug

SEQ ID NO: 703371 - RNA, 22 nt, Human
uuaauugggugcaacagcugaa

SEQ ID NO: 703372 - RNA, 22 nt, Human
cauacuuuuuagaucugccuuc

SEQ ID NO: 703373 - RNA, 22 nt, Human
uauucagaggugaaguagggag

SEQ ID NO: 703374 - RNA, 22 nt, Human
uucucugugagggugcuggauu

SEQ ID NO: 703375 - RNA, 22 nt, Human
ggccccagauucugggcugggu

SEQ ID NO: 703376 - RNA, 22 nt, Human
gcucuguaaagaagagaaaugc

SEQ ID NO: 703377 - RNA, 22 nt, Human
auucuucauaccuacugagguu

SEQ ID NO: 703378 - RNA, 22 nt, Human
gaggcagcagggcugguuccuu

SEQ ID NO: 703379 - RNA, 22 nt, Human
aaaugcuacacaggaauucuca

SEQ ID NO: 703380 - RNA, 22 nt, Human
ugcugccuccaacuccugggcu

SEQ ID NO: 703381 - RNA, 23 nt, Human
ucucugguuaggggagauuggug

SEQ ID NO: 703382 - RNA, 22 nt, Human
ugugccugacuaggugaaucaa

SEQ ID NO: 703383 - RNA, 22 nt, Human
uuucucaaauugcaugaguagc

SEQ ID NO: 703384 - RNA, 19 nt, Human
ggucucagugcagcugcag

SEQ ID NO: 703385 - RNA, 22 nt, Human
cuugaaagauuuggccucugug

SEQ ID NO: 703386 - RNA, 22 nt, Human
ugcucugggcaacagccucccu

SEQ ID NO: 703387 - RNA, 22 nt, Human
cucuggguggucucacugagug

SEQ ID NO: 703388 - RNA, 22 nt, Human
uuuggaaaguguacaaauuuga

SEQ ID NO: 703389 - RNA, 22 nt, Human
cuggcagaggauggggacccag

SEQ ID NO: 703390 - RNA, 22 nt, Human
aggaaugguuauggggauagua

SEQ ID NO: 703391 - RNA, 22 nt, Human
guggaugcuuaggcagccuggg

SEQ ID NO: 703392 - RNA, 22 nt, Human
uaugacaagguggaguaugagu

SEQ ID NO: 703393 - RNA, 22 nt, Human
ugacaguuguauuacaugggaa

SEQ ID NO: 703394 - RNA, 22 nt, Human
augaaaguggcuugauuaaaug

SEQ ID NO: 703395 - RNA, 22 nt, Human
acagauaauuuaauuaaugcau

SEQ ID NO: 703396 - RNA, 22 nt, Human
agcucagcuuccucuccaugcu

SEQ ID NO: 703397 - RNA, 22 nt, Human
guccaaauuuuucacauguaga

SEQ ID NO: 703398 - RNA, 22 nt, Human
ugaaggagggaagaaggcucug

SEQ ID NO: 703399 - RNA, 22 nt, Human
ccucagugagaugcucagcgaa

SEQ ID NO: 703400 - RNA, 22 nt, Human
ggcagcugucucugaguuagca

SEQ ID NO: 703401 - RNA, 22 nt, Human
uaggaagggaaaggcuucaacu

SEQ ID NO: 703402 - RNA, 22 nt, Human
aauaauaguugcaaaguguuua

SEQ ID NO: 703403 - RNA, 22 nt, Human
guuccacaucacacuacuugau

SEQ ID NO: 703404 - RNA, 23 nt, Human
ccucagcauggcaggagcccagc

SEQ ID NO: 703405 - RNA, 22 nt, Human
cccccucugccgggguccuuca

SEQ ID NO: 703406 - RNA, 22 nt, Human
acuuaaaguuauaauuugcuaa

SEQ ID NO: 703407 - RNA, 22 nt, Human
auagcaaaaggcaccagaguga

SEQ ID NO: 703408 - RNA, 22 nt, Human
ucaugcaguuucuuaucugcca

SEQ ID NO: 703409 - RNA, 22 nt, Human
aaacuguauagggaaaaguaga

SEQ ID NO: 703410 - RNA, 22 nt, Human
acagacuguuugguucaugucu

SEQ ID NO: 703411 - RNA, 22 nt, Human
agagcuguuuauugaugucaca

SEQ ID NO: 703412 - RNA, 22 nt, Human
cuggauccaucgggucccgagu

SEQ ID NO: 703413 - RNA, 22 nt, Human
ugauuucucauauuguucaaaa

SEQ ID NO: 703414 - RNA, 20 nt, Human
uccaggcagcucagaguguc

SEQ ID NO: 703415 - RNA, 22 nt, Human
cccacaggcaggggcagagaca

SEQ ID NO: 703416 - RNA, 22 nt, Human
aacacauuuugccuaggcaaua

SEQ ID NO: 703417 - RNA, 22 nt, Human
gaacauuuaugaugcaauaccu

SEQ ID NO: 703418 - RNA, 22 nt, Human
uuggcagaggccgaggugaaga

SEQ ID NO: 703419 - RNA, 21 nt, Human
ggaagggguccucccaacagu

SEQ ID NO: 703420 - RNA, 22 nt, Human
uauucagaggguugaauuuuua

SEQ ID NO: 703421 - RNA, 22 nt, Human
auauauuuacucuccuguugca

SEQ ID NO: 703422 - RNA, 22 nt, Human
cagcccagugcauuuguguacu

SEQ ID NO: 703423 - RNA, 22 nt, Human
gcugagguggaggaaggagacc

SEQ ID NO: 703424 - RNA, 22 nt, Human
ggcagcaggcgacuucccuauu

SEQ ID NO: 703425 - RNA, 22 nt, Human
aggagggagcuuaagccaggca

SEQ ID NO: 703426 - RNA, 22 nt, Human
aaagacagacggaaaccugagg

SEQ ID NO: 703427 - RNA, 22 nt, Human
uugucugaauauguauguaucc

SEQ ID NO: 703428 - RNA, 21 nt, Human
agguggcugcauccucagaag

SEQ ID NO: 703429 - RNA, 22 nt, Human
uggccuccccuaacagccucuu

SEQ ID NO: 703430 - RNA, 22 nt, Human
ucuuccagcuccccacgguguc

SEQ ID NO: 703431 - RNA, 22 nt, Human
ucaguaaaagggugcuuuacuc

SEQ ID NO: 703432 - RNA, 20 nt, Human
cuucuucaguaguuuguucu

SEQ ID NO: 703433 - RNA, 22 nt, Human
auuagaagaggcugacgaaugu

SEQ ID NO: 703434 - RNA, 22 nt, Human
cagcuggguggcucuucugcuc

SEQ ID NO: 703435 - RNA, 22 nt, Human
ccaguguguuuaaugcauucca

SEQ ID NO: 703436 - RNA, 22 nt, Human
ggcaggagauaaaauauuaguu

SEQ ID NO: 703437 - RNA, 22 nt, Human
cuggaaaaugaagaagcagagg

SEQ ID NO: 703438 - RNA, 22 nt, Human
cccauuuaucccaagguuacuc

SEQ ID NO: 703439 - RNA, 22 nt, Human
ugaaguaggcagcaugcugaga

SEQ ID NO: 703440 - RNA, 22 nt, Human
uugaaugaaauugcuguguuau

SEQ ID NO: 703441 - RNA, 22 nt, Human
aaggccagagcguguccugccu

SEQ ID NO: 703442 - RNA, 22 nt, Human
gcugugagccgcugcugagcau

SEQ ID NO: 703443 - RNA, 22 nt, Human
uguuuccauggugacagcagcu

SEQ ID NO: 703444 - RNA, 22 nt, Human
gagcucugcggaaaacgugccg

SEQ ID NO: 703445 - RNA, 22 nt, Human
gugaccauuugacauauccuug

SEQ ID NO: 703446 - RNA, 22 nt, Human
ugcaaacaccacagagacaauu

SEQ ID NO: 703447 - RNA, 22 nt, Human
cugcugccucgacauugggaca

SEQ ID NO: 703448 - RNA, 22 nt, Human
uguccaggucagcagcagggac

SEQ ID NO: 703449 - RNA, 22 nt, Human
gcaaggcugcccacuucaaaag

SEQ ID NO: 703450 - RNA, 22 nt, Human
guaaaacaagcuuuaugguucc

SEQ ID NO: 703451 - RNA, 22 nt, Human
aaggucagagcaggaaggaguc

SEQ ID NO: 703452 - RNA, 22 nt, Human
uaaaccuguaguugauguaauu

SEQ ID NO: 703453 - RNA, 22 nt, Human
caggcaggagaggaggauuucu

SEQ ID NO: 703454 - RNA, 22 nt, Human
ucuugcuucugcucaaggggag

SEQ ID NO: 703455 - RNA, 22 nt, Human
ugcaagagguaaaaugaaagga

SEQ ID NO: 703456 - RNA, 22 nt, Human
ccuuucucuuugcugaucaugu

SEQ ID NO: 703457 - RNA, 22 nt, Human
aauuggcagaacuuuauauauu

SEQ ID NO: 703458 - RNA, 22 nt, Human
uuuucccagagcuguccucaag

SEQ ID NO: 703459 - RNA, 22 nt, Human
uucuuuggcugccagucuggag

SEQ ID NO: 703460 - RNA, 21 nt, Human
uagcaucucuacugucauaga

SEQ ID NO: 703461 - RNA, 22 nt, Human
uccucagggguuucagguguac

SEQ ID NO: 703462 - RNA, 21 nt, Human
caugaagccgguucccuguuu

SEQ ID NO: 703463 - RNA, 22 nt, Human
uagcuuuacaaagugcugcacc

SEQ ID NO: 703464 - RNA, 22 nt, Human
acaguguuccuuuguugugacu

SEQ ID NO: 703465 - RNA, 22 nt, Human
aguguggagccacugaguggcu

SEQ ID NO: 703466 - RNA, 22 nt, Human
ggcacugacugugcagcgcacc

SEQ ID NO: 703467 - RNA, 22 nt, Human
uccccaccuaagauacccaucu

SEQ ID NO: 703468 - RNA, 22 nt, Human
cuagccagauuuaaagagagac

SEQ ID NO: 703469 - RNA, 22 nt, Human
auaugggggggcgugcagagga

SEQ ID NO: 703470 - RNA, 22 nt, Human
cacugucugcuucgacucuuca

SEQ ID NO: 703471 - RNA, 22 nt, Human
gagguggcuggcucagagccag

SEQ ID NO: 703472 - RNA, 22 nt, Human
gugguccaucaugcagagcucc

SEQ ID NO: 703473 - RNA, 22 nt, Human
aaggaaauuagguuauuuugcu

SEQ ID NO: 703474 - RNA, 22 nt, Human
gccaggcagcagcgaggauggu

SEQ ID NO: 703475 - RNA, 22 nt, Human
uuuauaucuggaguugcuagga

SEQ ID NO: 703476 - RNA, 22 nt, Human
ucccagagugugggcaucaagg

SEQ ID NO: 703477 - RNA, 22 nt, Human
ucucaccaaagccuugaccaua

SEQ ID NO: 703478 - RNA, 22 nt, Human
aguguggauuggcuggagcuau

SEQ ID NO: 703479 - RNA, 22 nt, Human
gugccagggggcacugaacaga

SEQ ID NO: 703480 - RNA, 20 nt, Human
aaucagaaagugugagcucu

SEQ ID NO: 703481 - RNA, 22 nt, Human
auuugcuuuuacuauguuaaaa

SEQ ID NO: 703482 - RNA, 22 nt, Human
acuuuguuguuccuugucuaaa

SEQ ID NO: 703483 - RNA, 19 nt, Human
uccagaugauauggauuac

SEQ ID NO: 703484 - RNA, 22 nt, Human
cuuuuaaugggagcaguauuug

SEQ ID NO: 703485 - RNA, 22 nt, Human
guuauucucuuggccuaauuau

SEQ ID NO: 703486 - RNA, 22 nt, Human
uguuuccuucugucucuuugga

SEQ ID NO: 703487 - RNA, 22 nt, Human
agcuuuaugaggagaccuuagu

SEQ ID NO: 703488 - RNA, 22 nt, Human
cugagcugaaacuugagaggcu

SEQ ID NO: 703489 - RNA, 22 nt, Human
aagaaagggagaaggauggugu

SEQ ID NO: 703490 - RNA, 22 nt, Human
uaacuguauagcuuggacuaaa

SEQ ID NO: 703491 - RNA, 22 nt, Human
gggcugacauauuuggugcucu

SEQ ID NO: 703492 - RNA, 22 nt, Human
ggugagaggcagaggacagcuu

SEQ ID NO: 703493 - RNA, 22 nt, Human
ugaagcagcaccauuuuagagc

SEQ ID NO: 703494 - RNA, 22 nt, Human
cucaggagacaguguccacaug

SEQ ID NO: 703495 - RNA, 22 nt, Human
ugucuuucugcaccaccucaca

SEQ ID NO: 703496 - RNA, 22 nt, Human
aaucugagggaacuugaacucc

SEQ ID NO: 703497 - RNA, 22 nt, Human
aaagaacucagagaggauuuua

SEQ ID NO: 703498 - RNA, 22 nt, Human
agaggcugauggaguagugucu

SEQ ID NO: 703499 - RNA, 22 nt, Human
gcaaagcaagauucagauguag

SEQ ID NO: 703500 - RNA, 22 nt, Human
cucugggccaugcuacugcucu

SEQ ID NO: 703501 - RNA, 22 nt, Human
uguuggaaaggccaggcugugg

SEQ ID NO: 703502 - RNA, 22 nt, Human
aggcuucuugagccccacaggc

SEQ ID NO: 703503 - RNA, 22 nt, Human
ucugccagaagccagggucugg

SEQ ID NO: 703504 - RNA, 22 nt, Human
uugcagagagguuaggaacuca

SEQ ID NO: 703505 - RNA, 22 nt, Human
aaaguuucaauagaggaagugg

SEQ ID NO: 703506 - RNA, 22 nt, Human
aauauguucaaaauagaucacu

SEQ ID NO: 703507 - RNA, 22 nt, Human
agauaucuggaaaaaauguaug

SEQ ID NO: 703508 - RNA, 22 nt, Human
ucugagccaccugagcccaugg

SEQ ID NO: 703509 - RNA, 22 nt, Human
uugcaucuagggcaacccagag

SEQ ID NO: 703510 - RNA, 19 nt, Human
ugggcuuccccagggcaga

SEQ ID NO: 703511 - RNA, 22 nt, Human
cacaggcuuuuuuggcugaugu

SEQ ID NO: 703512 - RNA, 22 nt, Human
cugcagaaagcugagaugauua

SEQ ID NO: 703513 - RNA, 22 nt, Human
aggccacaagaaaaugcuucau

SEQ ID NO: 703514 - RNA, 23 nt, Human
uuauggagugccagacauuuggc

SEQ ID NO: 703515 - RNA, 22 nt, Human
gacccuggaguuaguccugugu

SEQ ID NO: 703516 - RNA, 22 nt, Human
ccacagggccuuuccugcuggc

SEQ ID NO: 703517 - RNA, 22 nt, Human
gcucuagaaagaaggauguggg

SEQ ID NO: 703518 - RNA, 22 nt, Human
ucagaguucucuguccagauga

SEQ ID NO: 703519 - RNA, 22 nt, Human
cauggcagcuuugggaggagga

SEQ ID NO: 703520 - RNA, 22 nt, Human
cauaauuacugauaugcugauu

SEQ ID NO: 703521 - RNA, 22 nt, Human
uaauaauuggcaauguugagca

SEQ ID NO: 703522 - RNA, 22 nt, Human
uucuucucggcugucagauagu

SEQ ID NO: 703523 - RNA, 17 nt, Human
uccuuggcaaccaguuc

SEQ ID NO: 703524 - RNA, 22 nt, Human
ugggcucucaaagugcggcuug

SEQ ID NO: 703525 - RNA, 22 nt, Human
gguuuaauggagauauuucaga

SEQ ID NO: 703526 - RNA, 19 nt, Human
gaagaagcuugagaaguag

SEQ ID NO: 703527 - RNA, 22 nt, Human
ugcauuaaggccauugaaauuu

SEQ ID NO: 703528 - RNA, 22 nt, Human
caagagcuagacuuugucagga

SEQ ID NO: 703529 - RNA, 22 nt, Human
ucaggaagccgguuaaauagau

SEQ ID NO: 703530 - RNA, 22 nt, Human
cacacaucaaccuagacauugu

SEQ ID NO: 703531 - RNA, 22 nt, Human
acucugggcuguuaggagcugu

SEQ ID NO: 703532 - RNA, 22 nt, Human
aguucccuccacaacuucucac

SEQ ID NO: 703533 - RNA, 23 nt, Human
ggucccaguggagaggccucacc

SEQ ID NO: 703534 - RNA, 22 nt, Human
ucagcagaguggaacauuguca

SEQ ID NO: 703535 - RNA, 22 nt, Human
aagguuaaauagguauuuucca

SEQ ID NO: 703536 - RNA, 22 nt, Human
uuuuccucugagcuuugaauaa

SEQ ID NO: 703537 - RNA, 22 nt, Human
cugccuccucacguccacagug

SEQ ID NO: 703538 - RNA, 19 nt, Human
cuguggccuccaggaggga

SEQ ID NO: 703539 - RNA, 22 nt, Human
agccugggcaacaacacagcga

SEQ ID NO: 703540 - RNA, 22 nt, Human
ggccucucgaagcuucagucca

SEQ ID NO: 703541 - RNA, 22 nt, Human
cccagagccgguggugcucaca

SEQ ID NO: 703542 - RNA, 22 nt, Human
ccagagguuacacccucagccc

SEQ ID NO: 703543 - RNA, 22 nt, Human
aaggcccuggccccagcuucuu

SEQ ID NO: 703544 - RNA, 22 nt, Human
ugagcagaggccagcaccuggg

SEQ ID NO: 703545 - RNA, 22 nt, Human
guguccuuuuaugugacugguu

SEQ ID NO: 703546 - RNA, 22 nt, Human
ccagcuggaacggcagcccagc

SEQ ID NO: 703547 - RNA, 22 nt, Human
ccaugggaccuaccuccugugc

SEQ ID NO: 703548 - RNA, 22 nt, Human
gugaaggcuacaagagaucaag

SEQ ID NO: 703549 - RNA, 21 nt, Human
gccuggcuucacaggcacuga

SEQ ID NO: 703550 - RNA, 22 nt, Human
gagcuggugugugcccgagcac

SEQ ID NO: 703551 - RNA, 22 nt, Human
caccaggguacaauuucgcaga

SEQ ID NO: 703552 - RNA, 22 nt, Human
uucuucuuuaucucaguauccu

SEQ ID NO: 703553 - RNA, 22 nt, Human
uuugguccauuauaugcuguca

SEQ ID NO: 703554 - RNA, 22 nt, Human
cuaggaggcgggggcugcagua

SEQ ID NO: 703555 - RNA, 22 nt, Human
uugucugcauuguuucuauggg

SEQ ID NO: 703556 - RNA, 22 nt, Human
uugauuugcagaagguguagag

SEQ ID NO: 703557 - RNA, 22 nt, Human
acacuuuuguguauauccaguu

SEQ ID NO: 703558 - RNA, 22 nt, Human
uggcaaaguaauuggguuucuc

SEQ ID NO: 703559 - RNA, 22 nt, Human
ucccuccuggugaugaugcaaa

SEQ ID NO: 703560 - RNA, 22 nt, Human
caggcugacaacugagcauuuu

SEQ ID NO: 703561 - RNA, 22 nt, Human
gugagcguggucuucugugggu

SEQ ID NO: 703562 - RNA, 19 nt, Human
cagcaagaaugaaggcaua

SEQ ID NO: 703563 - RNA, 22 nt, Human
agcauccugccucuccucccaa

SEQ ID NO: 703564 - RNA, 20 nt, Human
cagcucugggcaggucgagg

SEQ ID NO: 703565 - RNA, 23 nt, Human
uuuaugcagcauguagaacaugg

SEQ ID NO: 703566 - RNA, 22 nt, Human
aguucuggugguuuggagaucu

SEQ ID NO: 703567 - RNA, 22 nt, Human
acauuugggacccucucuucac

SEQ ID NO: 703568 - RNA, 22 nt, Human
cucaggaugaaagucaugguga

SEQ ID NO: 703569 - RNA, 22 nt, Human
uccagcugcugccagccaagcu

SEQ ID NO: 703570 - RNA, 22 nt, Human
ugacaggcaggacagaggugug

SEQ ID NO: 703571 - RNA, 22 nt, Human
auuugcuuugggacagcuuaaa

SEQ ID NO: 703572 - RNA, 22 nt, Human
acauaaugagcucuuuauaaau

SEQ ID NO: 703573 - RNA, 22 nt, Human
aaccaggacaauuuugaaagua

SEQ ID NO: 703574 - RNA, 22 nt, Human
ugaagugaccuggggcagugua

SEQ ID NO: 703575 - RNA, 22 nt, Human
agcaguuguagucauggaaaau

SEQ ID NO: 703576 - RNA, 22 nt, Human
cugaggucuagacaccccaggg

SEQ ID NO: 703577 - RNA, 22 nt, Human
caaaugcuacuaauaggcaagu

SEQ ID NO: 703578 - RNA, 22 nt, Human
acuuuguuccuuucacaaagaa

SEQ ID NO: 703579 - RNA, 22 nt, Human
cugccacuuacuaggcauggug

SEQ ID NO: 703580 - RNA, 22 nt, Human
uaguagaauccaaaccaacagu

SEQ ID NO: 703581 - RNA, 18 nt, Human
uggcagugagguaggcau

SEQ ID NO: 703582 - RNA, 22 nt, Human
ccguguguaugguggaacugcu

SEQ ID NO: 703583 - RNA, 22 nt, Human
ugaaggagauuuuuagggaggc

SEQ ID NO: 703584 - RNA, 22 nt, Human
auaacagaugcuucagcauaaa

SEQ ID NO: 703585 - RNA, 22 nt, Human
gcaucuuucuguccauucagca

SEQ ID NO: 703586 - RNA, 21 nt, Human
uggagacucugguucuuugug

SEQ ID NO: 703587 - RNA, 22 nt, Human
cuugacagaagguuuuauccua

SEQ ID NO: 703588 - RNA, 21 nt, Human
cuauuggaaaagaaaauauuu

SEQ ID NO: 703589 - RNA, 22 nt, Human
gcugcaggcuguggcaggggag

SEQ ID NO: 703590 - RNA, 22 nt, Human
ugauuuuauuggugaggaaauu

SEQ ID NO: 703591 - RNA, 22 nt, Human
cugggaugauagugcuaguauu

SEQ ID NO: 703592 - RNA, 23 nt, Human
ggcagcugggcagcacucauggg

SEQ ID NO: 703593 - RNA, 22 nt, Human
aagggcuggucuagaaagggag

SEQ ID NO: 703594 - RNA, 22 nt, Human
uuacaguccuuuguauuguuua

SEQ ID NO: 703595 - RNA, 19 nt, Human
ugccuggcaccagcuccac

SEQ ID NO: 703596 - RNA, 22 nt, Human
caucagaaucugagucucugcc

SEQ ID NO: 703597 - RNA, 22 nt, Human
uuuaugcacacuuagacauggc

SEQ ID NO: 703598 - RNA, 22 nt, Human
ugucacagggauaccauggggc

SEQ ID NO: 703599 - RNA, 22 nt, Human
aacaauuagacugacgguauua

SEQ ID NO: 703600 - RNA, 22 nt, Human
acucagagaaacagcagggugu

SEQ ID NO: 703601 - RNA, 22 nt, Human
cagcucagacgcaggucgagca

SEQ ID NO: 703602 - RNA, 22 nt, Human
cuaaaauuaccuaccaguuuag

SEQ ID NO: 703603 - RNA, 22 nt, Human
aagcuggcaauuaucaaaacug

SEQ ID NO: 703604 - RNA, 22 nt, Human
cuagugaaauuugcaaguaauu

SEQ ID NO: 703605 - RNA, 22 nt, Human
ugagcagagaugacugggcauu

SEQ ID NO: 703606 - RNA, 22 nt, Human
aagaggaggauugaugugggag

SEQ ID NO: 703607 - RNA, 22 nt, Human
uacaugaauuugagucagagga

SEQ ID NO: 703608 - RNA, 22 nt, Human
aggcugugauggauguaaagga

SEQ ID NO: 703609 - RNA, 22 nt, Human
gauauauguaaaaguagacaga

SEQ ID NO: 703610 - RNA, 17 nt, Human
cccuggcucuaggugga

SEQ ID NO: 703611 - RNA, 22 nt, Human
aaagucuuuauuuuguaucuuu

SEQ ID NO: 703612 - RNA, 22 nt, Human
uaagaaacuauggagaagaacu

SEQ ID NO: 703613 - RNA, 20 nt, Human
agcaggaaaagugccagucu

SEQ ID NO: 703614 - RNA, 22 nt, Human
ccuccaggccuugcagguuaac

SEQ ID NO: 703615 - RNA, 22 nt, Human
ugcagugugauuuucuggcuga

SEQ ID NO: 703616 - RNA, 17 nt, Human
acugucuuuuacacccu

SEQ ID NO: 703617 - RNA, 22 nt, Human
gcuccagcaccuagagcagguc

SEQ ID NO: 703618 - RNA, 22 nt, Human
gaaaauagcagauagaccaaug

SEQ ID NO: 703619 - RNA, 22 nt, Human
cugcagggcauuguaacucuuu

SEQ ID NO: 703620 - RNA, 22 nt, Human
cccagguaguuggaagagacaa

SEQ ID NO: 703621 - RNA, 22 nt, Human
gggcauggugagggauaugaag

SEQ ID NO: 703622 - RNA, 22 nt, Human
cuggagaggcugggaacagguu

SEQ ID NO: 703623 - RNA, 22 nt, Human
ggagcagggcagugaauucugg

SEQ ID NO: 703624 - RNA, 22 nt, Human
cagcuguugugauccauuuacg

SEQ ID NO: 703625 - RNA, 22 nt, Human
caaggccaugagcagcgagugu

SEQ ID NO: 703626 - RNA, 22 nt, Human
ccucagugugcagcagcaucug

SEQ ID NO: 703627 - RNA, 22 nt, Human
gccuauggauuggagaaggagc

SEQ ID NO: 703628 - RNA, 22 nt, Human
gcacagccugucccuguccugg

SEQ ID NO: 703629 - RNA, 22 nt, Human
cagguaaggucacauucugaag

SEQ ID NO: 703630 - RNA, 22 nt, Human
gggagggaaggaggcgccgugu

SEQ ID NO: 703631 - RNA, 23 nt, Human
uagauacugcauauagguggaau

SEQ ID NO: 703632 - RNA, 23 nt, Human
cugagguggagagugagguaagu

SEQ ID NO: 703633 - RNA, 22 nt, Human
agguacagggugaaaguuuaug

SEQ ID NO: 703634 - RNA, 22 nt, Human
gcugccacauuuucaggacuaa

SEQ ID NO: 703635 - RNA, 22 nt, Human
aggcugagccugggcguggugg

SEQ ID NO: 703636 - RNA, 22 nt, Human
aguggcagagccaaguagagcc

SEQ ID NO: 703637 - RNA, 20 nt, Human
uaugaguauuacuuucagga

SEQ ID NO: 703638 - RNA, 22 nt, Human
ucuuccugcuuggugugucugg

SEQ ID NO: 703639 - RNA, 22 nt, Human
uagaaacaaugacaugcuugua

SEQ ID NO: 703640 - RNA, 22 nt, Human
uaguggagguggucugugaacu

SEQ ID NO: 703641 - RNA, 22 nt, Human
gccaggcagcaggaagccagug

SEQ ID NO: 703642 - RNA, 22 nt, Human
uugcuuuucccugucucugauu

SEQ ID NO: 703643 - RNA, 15 nt, Human
aaagugcacccaaua

SEQ ID NO: 703644 - RNA, 22 nt, Human
ggucuggaccauggacgccggg

SEQ ID NO: 703645 - RNA, 22 nt, Human
gccaaagcccaggagacagcca

SEQ ID NO: 703646 - RNA, 22 nt, Human
acacugugacaagaaagagcug

SEQ ID NO: 703647 - RNA, 22 nt, Human
cucucuuuuucgugugccgaag

SEQ ID NO: 703648 - RNA, 22 nt, Human
gaaaccugagccagagugggga

SEQ ID NO: 703649 - RNA, 22 nt, Human
guggggagcagccuuagccccu

SEQ ID NO: 703650 - RNA, 22 nt, Human
gacaagcucuuguuucaugguu

SEQ ID NO: 703651 - RNA, 22 nt, Human
guccugagcauuaagcaauugu

SEQ ID NO: 703652 - RNA, 22 nt, Human
gggaaugagagucagcccagga

SEQ ID NO: 703653 - RNA, 22 nt, Human
ucuggcuuguguccuuccuugc

SEQ ID NO: 703654 - RNA, 22 nt, Human
ggcuggcuaucugugguugccu

SEQ ID NO: 703655 - RNA, 22 nt, Human
cauuuguguccgucccaguucu

SEQ ID NO: 703656 - RNA, 22 nt, Human
uuguaacuuaaguuuugcauau

SEQ ID NO: 703657 - RNA, 22 nt, Human
ugccacacuccccugcugcagu

SEQ ID NO: 703658 - RNA, 22 nt, Human
cuuccuggcucggugccucacc

SEQ ID NO: 703659 - RNA, 22 nt, Human
agcggagcuaguuuuuguccuc

SEQ ID NO: 703660 - RNA, 22 nt, Human
gaugcacuugccccuccucaga

SEQ ID NO: 703661 - RNA, 21 nt, Human
uuuaugcagauaaugcuauuu

SEQ ID NO: 703662 - RNA, 22 nt, Human
cugcaucacucuuacuggcuuu

SEQ ID NO: 703663 - RNA, 22 nt, Human
agaggcaagggaccuuucuggg

SEQ ID NO: 703664 - RNA, 22 nt, Human
augaaaugucuggaucuuuuuc

SEQ ID NO: 703665 - RNA, 22 nt, Human
cugugggcgccugucagccuca

SEQ ID NO: 703666 - RNA, 22 nt, Human
acaucuguuuaacgaaggcauu

SEQ ID NO: 703667 - RNA, 22 nt, Human
guucuccacugcagagucucuc

SEQ ID NO: 703668 - RNA, 22 nt, Human
uccugggcugugugccacucug

SEQ ID NO: 703669 - RNA, 21 nt, Human
uccuggcuuuaugcuaccucu

SEQ ID NO: 703670 - RNA, 22 nt, Human
cagauucugggcccagcuuguc

SEQ ID NO: 703671 - RNA, 22 nt, Human
cccggacagaggggcagagugu

SEQ ID NO: 703672 - RNA, 22 nt, Human
gaagaagcaggaguguguagca

SEQ ID NO: 703673 - RNA, 22 nt, Human
uggucacccacugggacugcgg

SEQ ID NO: 703674 - RNA, 22 nt, Human
gccugccuuuguaugacccuga

SEQ ID NO: 703675 - RNA, 21 nt, Human
aacauuucaggauccaaauug

SEQ ID NO: 703676 - RNA, 22 nt, Human
agaaaaacacaaucgggccucc

SEQ ID NO: 703677 - RNA, 21 nt, Human
gccaaggggguagcuauuccu

SEQ ID NO: 703678 - RNA, 23 nt, Human
uguaacuucuuaaauucuucacu

SEQ ID NO: 703679 - RNA, 22 nt, Human
gagagaagaaagccaugguccu

SEQ ID NO: 703680 - RNA, 23 nt, Human
aacacuugcaugaacagcuacac

SEQ ID NO: 703681 - RNA, 22 nt, Human
uaccaaauguaaucauucuaau

SEQ ID NO: 703682 - RNA, 21 nt, Human
ugacauuuggauucauaguaa

SEQ ID NO: 703683 - RNA, 22 nt, Human
ucaaugucugcggcuagcugga

SEQ ID NO: 703684 - RNA, 22 nt, Human
aaaaguguucaggaagaauaau

SEQ ID NO: 703685 - RNA, 22 nt, Human
ggccaccugggaucucauccug

SEQ ID NO: 703686 - RNA, 22 nt, Human
uauguuucaucaggcauggagu

SEQ ID NO: 703687 - RNA, 22 nt, Human
cacaugcauaaggauaauuacu

SEQ ID NO: 703688 - RNA, 22 nt, Human
uuugaaagggacaaagucacug

SEQ ID NO: 703689 - RNA, 22 nt, Human
ucugucauuucaauaugguuaa

SEQ ID NO: 703690 - RNA, 21 nt, Human
uccagccuuucccucacuucc

SEQ ID NO: 703691 - RNA, 22 nt, Human
ucagucuauccagcucagaucc

SEQ ID NO: 703692 - RNA, 22 nt, Human
auuucacucuuaauugcuuccu

SEQ ID NO: 703693 - RNA, 22 nt, Human
ucaguguguuauucuacuuuca

SEQ ID NO: 703694 - RNA, 22 nt, Human
auuuaauuaaucauggugaauu

SEQ ID NO: 703695 - RNA, 22 nt, Human
uaaacagcuacugugucaaagg

SEQ ID NO: 703696 - RNA, 17 nt, Human
ucugucugugguccacu

SEQ ID NO: 703697 - RNA, 22 nt, Human
gugaggcaggcauucuccuuuc

SEQ ID NO: 703698 - RNA, 22 nt, Human
uuauaaagauccuuccagaguu

SEQ ID NO: 703699 - RNA, 22 nt, Human
auguuccugauccucguucuau

SEQ ID NO: 703700 - RNA, 22 nt, Human
aggaggagcagcuuuuugucuc

SEQ ID NO: 703701 - RNA, 22 nt, Human
ucugcguggcugcugugagcgu

SEQ ID NO: 703702 - RNA, 22 nt, Human
ugaacaguuucaagaaaacuuu

SEQ ID NO: 703703 - RNA, 22 nt, Human
gcaggcagaucaccugucagga

SEQ ID NO: 703704 - RNA, 22 nt, Human
ccuggguagacuuugaagcauu

SEQ ID NO: 703705 - RNA, 22 nt, Human
cugagcauuugugcagcuucuc

SEQ ID NO: 703706 - RNA, 22 nt, Human
gaggaggcacuaguuagugaca

SEQ ID NO: 703707 - RNA, 22 nt, Human
gcuaggaaaggaagaacuuuga

SEQ ID NO: 703708 - RNA, 19 nt, Human
cagcaucugagccgugucc

SEQ ID NO: 703709 - RNA, 22 nt, Human
cagaaguggauauuagaguaau

SEQ ID NO: 703710 - RNA, 22 nt, Human
cagccaggacucccauuuagga

SEQ ID NO: 703711 - RNA, 22 nt, Human
auggaucagaaucccgggaggg

SEQ ID NO: 703712 - RNA, 22 nt, Human
auuuguuccacacauauuuacu

SEQ ID NO: 703713 - RNA, 22 nt, Human
ugauucugccccuuggcucugg

SEQ ID NO: 703714 - RNA, 22 nt, Human
gaaccuguuuauguuaccugcg

SEQ ID NO: 703715 - RNA, 22 nt, Human
ggucuggaauaagguccaggaa

SEQ ID NO: 703716 - RNA, 22 nt, Human
augcauauauacauacacaguc

SEQ ID NO: 703717 - RNA, 22 nt, Human
aucauucaagugcucuaaaaug

SEQ ID NO: 703718 - RNA, 22 nt, Human
accagcuguguccuggcugcag

SEQ ID NO: 703719 - RNA, 22 nt, Human
acaggugugagaacaugccuug

SEQ ID NO: 703720 - RNA, 22 nt, Human
gaggcuguuagggccugaggua

SEQ ID NO: 703721 - RNA, 22 nt, Human
ugggcugcagggguugagagcu

SEQ ID NO: 703722 - RNA, 22 nt, Human
cagaggguugucaggcgccuug

SEQ ID NO: 703723 - RNA, 18 nt, Human
gucaggcaugaaucuggg

SEQ ID NO: 703724 - RNA, 22 nt, Human
gggcugggcaugguguucccuc

SEQ ID NO: 703725 - RNA, 21 nt, Human
uucauuuguuauagacaaagu

SEQ ID NO: 703726 - RNA, 22 nt, Human
accagcugugugacuuuuaaug

SEQ ID NO: 703727 - RNA, 22 nt, Human
ucacaguuuuagcuguuaaaua

SEQ ID NO: 703728 - RNA, 23 nt, Human
ugcaggggaggcuuaaagcaggu

SEQ ID NO: 703729 - RNA, 22 nt, Human
aagccucaccuuuuagaagcua

SEQ ID NO: 703730 - RNA, 22 nt, Human
agggcuggaggguacuaguuua

SEQ ID NO: 703731 - RNA, 20 nt, Human
ucucuuuuagcuuacagcug

SEQ ID NO: 703732 - RNA, 22 nt, Human
ugccaagaccacaauugcuuuu

SEQ ID NO: 703733 - RNA, 22 nt, Human
gguggcugggauuaguagccca

SEQ ID NO: 703734 - RNA, 22 nt, Human
aguuucuucauccaaaaaaugg

SEQ ID NO: 703735 - RNA, 22 nt, Human
ugcugcuccugccuggcuccca

SEQ ID NO: 703736 - RNA, 22 nt, Human
caguaugagaguugaaucaagg

SEQ ID NO: 703737 - RNA, 22 nt, Human
auacacauuugcuagagauggg

SEQ ID NO: 703738 - RNA, 22 nt, Human
uugauucuauguuguugucuca

SEQ ID NO: 703739 - RNA, 22 nt, Human
cccuccucaacucuggcuucca

SEQ ID NO: 703740 - RNA, 22 nt, Human
auggaaguuggaaccauucaua

SEQ ID NO: 703741 - RNA, 17 nt, Human
aggaaacauuuucuuuc

SEQ ID NO: 703742 - RNA, 22 nt, Human
acauuuaaugauccuacuguga

SEQ ID NO: 703743 - RNA, 22 nt, Human
guuugcauaaaguggaugcagg

SEQ ID NO: 703744 - RNA, 22 nt, Human
aggcugugaguaguucuuguug

SEQ ID NO: 703745 - RNA, 21 nt, Human
gcaaccagaccacagggcagu

SEQ ID NO: 703746 - RNA, 20 nt, Human
aacauugcuucaauguaacc

SEQ ID NO: 703747 - RNA, 22 nt, Human
cguuaauaggugcaagguaagg

SEQ ID NO: 703748 - RNA, 22 nt, Human
ucucugugagccagguccuagu

SEQ ID NO: 703749 - RNA, 20 nt, Human
uauggcuuggcaaagcuuca

SEQ ID NO: 703750 - RNA, 19 nt, Human
ucagcucuggggucagugg

SEQ ID NO: 703751 - RNA, 22 nt, Human
aggccucugagcagcacucaug

SEQ ID NO: 703752 - RNA, 22 nt, Human
agcagugaugcaugacagccua

SEQ ID NO: 703753 - RNA, 22 nt, Human
uuucauguuacauuuaaaaugu

SEQ ID NO: 703754 - RNA, 22 nt, Human
acauuacacugugguccuguuc

SEQ ID NO: 703755 - RNA, 22 nt, Human
uauaaagaaaugauuuccagaa

SEQ ID NO: 703756 - RNA, 22 nt, Human
cugacagauacuuaugacauaa

SEQ ID NO: 703757 - RNA, 22 nt, Human
uuacagguacuugcugcugaaa

SEQ ID NO: 703758 - RNA, 22 nt, Human
aaaucagugcucauuugaaagg

SEQ ID NO: 703759 - RNA, 22 nt, Human
uggcuccucaucacaguuggug

SEQ ID NO: 703760 - RNA, 22 nt, Human
auagcuuugagggcuccuuagg

SEQ ID NO: 703761 - RNA, 22 nt, Human
uucaggaugcagagguuguagu

SEQ ID NO: 703762 - RNA, 22 nt, Human
gcagccaggggcugugaccugu

SEQ ID NO: 703763 - RNA, 22 nt, Human
uaaggcaaagugauuucuuaaa

SEQ ID NO: 703764 - RNA, 22 nt, Human
ugggcacagagucccaucugcc

SEQ ID NO: 703765 - RNA, 22 nt, Human
aacaguuuguggauagcuugua

SEQ ID NO: 703766 - RNA, 19 nt, Human
agcugucugcugcuuuugu

SEQ ID NO: 703767 - RNA, 21 nt, Human
acagcaagccuucacaugagu

SEQ ID NO: 703768 - RNA, 22 nt, Human
aguggcagggacuucauauaaa

SEQ ID NO: 703769 - RNA, 22 nt, Human
uucucuaagccuuaguuucuuc

SEQ ID NO: 703770 - RNA, 22 nt, Human
uccaaagaacauugcugagacc

SEQ ID NO: 703771 - RNA, 22 nt, Human
uaaugcuuuguuuugaucuaac

SEQ ID NO: 703772 - RNA, 22 nt, Human
agacauagauaggcacugauug

SEQ ID NO: 703773 - RNA, 22 nt, Human
ccaguuuagguacuaggcucua

SEQ ID NO: 703774 - RNA, 22 nt, Human
aagcucugggguacacaucugc

SEQ ID NO: 703775 - RNA, 22 nt, Human
gcuuccucaccuucucuugcau

SEQ ID NO: 703776 - RNA, 22 nt, Human
aaaaagauguccugaaguuuag

SEQ ID NO: 703777 - RNA, 22 nt, Human
ggcagaaggcaauuagagacug

SEQ ID NO: 703778 - RNA, 22 nt, Human
caugagaaccaggucuguguuu

SEQ ID NO: 703779 - RNA, 22 nt, Human
gcagggcuuuuugaaacauggu

SEQ ID NO: 703780 - RNA, 22 nt, Human
ucuccuggcauuugguugagua

SEQ ID NO: 703781 - RNA, 19 nt, Human
ucugacacuuacacacccc

SEQ ID NO: 703782 - RNA, 22 nt, Human
guccuggcccacuggcaggcug

SEQ ID NO: 703783 - RNA, 22 nt, Human
uugucaaggcuuuuaauauucu

SEQ ID NO: 703784 - RNA, 22 nt, Human
guggccaauaggagcagcuauc

SEQ ID NO: 703785 - RNA, 22 nt, Human
gcagcagcagggagucugacuu

SEQ ID NO: 703786 - RNA, 22 nt, Human
accuggcugguugugauuccca

SEQ ID NO: 703787 - RNA, 22 nt, Human
uggggccuuggccucauuagau

SEQ ID NO: 703788 - RNA, 22 nt, Human
uuuaugcagcguuucaccaccc

SEQ ID NO: 703789 - RNA, 22 nt, Human
aacaguguguuuuguuauuaag

SEQ ID NO: 703790 - RNA, 22 nt, Human
acccugccaaggauggccccga

SEQ ID NO: 703791 - RNA, 22 nt, Human
ccucagaaggacaagagacaaa

SEQ ID NO: 703792 - RNA, 22 nt, Human
caucauuuuauuaaccaagaaa

SEQ ID NO: 703793 - RNA, 22 nt, Human
ucagcuuuccugcagcuaaggg

SEQ ID NO: 703794 - RNA, 22 nt, Human
ccacuggcugucagcaggacuc

SEQ ID NO: 703795 - RNA, 22 nt, Human
gaggaaugucagcacaggccuc

SEQ ID NO: 703796 - RNA, 22 nt, Human
ugaggggcggccugcagaggcc

SEQ ID NO: 703797 - RNA, 22 nt, Human
guggcccaggcuuggcgcuggc

SEQ ID NO: 703798 - RNA, 22 nt, Human
cauaauccauuugcacugcaga

SEQ ID NO: 703799 - RNA, 22 nt, Human
agggagcucgaugccugagugu

SEQ ID NO: 703800 - RNA, 22 nt, Human
uugaauuauaagugugucuacu

SEQ ID NO: 703801 - RNA, 22 nt, Human
gcaggcugggguagccccacuu

SEQ ID NO: 703802 - RNA, 22 nt, Human
ucagugcuccuaaagugaaugc

SEQ ID NO: 703803 - RNA, 22 nt, Human
augcuggugguugauggcagga

SEQ ID NO: 703804 - RNA, 19 nt, Human
cucagcuguagcucaugug

SEQ ID NO: 703805 - RNA, 22 nt, Human
cuguugguguugauuaaauagu

SEQ ID NO: 703806 - RNA, 22 nt, Human
aaggaagauauaucaagcuuaa

SEQ ID NO: 703807 - RNA, 22 nt, Human
uuuccuuugggcacccgagcuc

SEQ ID NO: 703808 - RNA, 22 nt, Human
cacacauggcugccagggaggu

SEQ ID NO: 703809 - RNA, 22 nt, Human
gacagguauuugagagcuggga

SEQ ID NO: 703810 - RNA, 22 nt, Human
cagaggaugaucuggccucucu

SEQ ID NO: 703811 - RNA, 22 nt, Human
cagcauggcuugaguguuuccu

SEQ ID NO: 703812 - RNA, 22 nt, Human
gauaaacuggaaccauugccuc

SEQ ID NO: 703813 - RNA, 22 nt, Human
cauaacauccuugcuacuuuga

SEQ ID NO: 703814 - RNA, 22 nt, Human
acaugagaagcugcaacaugac

SEQ ID NO: 703815 - RNA, 22 nt, Human
auccugggaaugggagggucau

SEQ ID NO: 703816 - RNA, 22 nt, Human
agagcuguggauaguccuggau

SEQ ID NO: 703817 - RNA, 22 nt, Human
agagugggcaggagccucgacu

SEQ ID NO: 703818 - RNA, 22 nt, Human
uauccguuagaaucaugcuggg

SEQ ID NO: 703819 - RNA, 22 nt, Human
caccuggcccagcuccagugcu

SEQ ID NO: 703820 - RNA, 17 nt, Human
aagaaucauuagagaag

SEQ ID NO: 703821 - RNA, 22 nt, Human
aacauguuuccaguguaaggcc

SEQ ID NO: 703822 - RNA, 22 nt, Human
uaauaacaauuguaggacauga

SEQ ID NO: 703823 - RNA, 22 nt, Human
uucuauguguugacaagccuga

SEQ ID NO: 703824 - RNA, 22 nt, Human
uucacaauagcuggcaucaucu

SEQ ID NO: 703825 - RNA, 22 nt, Human
aaaauugucagaaguugaucuu

SEQ ID NO: 703826 - RNA, 22 nt, Human
cccacacauuuuucacuuaccg

SEQ ID NO: 703827 - RNA, 22 nt, Human
aggcugggcaccguuuugaucc

SEQ ID NO: 703828 - RNA, 22 nt, Human
cagggaguuuuuguuccucuag

SEQ ID NO: 703829 - RNA, 19 nt, Human
gcccugagagcuuggguuc

SEQ ID NO: 703830 - RNA, 22 nt, Human
ucugcguuauugaaaagcagcc

SEQ ID NO: 703831 - RNA, 21 nt, Human
gcuucagcaaggcuugcuggu

SEQ ID NO: 703832 - RNA, 22 nt, Human
gcuccuggucuggagcuucaag

SEQ ID NO: 703833 - RNA, 22 nt, Human
aggugggcgcugcucccgcugg

SEQ ID NO: 703834 - RNA, 22 nt, Human
agcuuagugguuguaugaguua

SEQ ID NO: 703835 - RNA, 22 nt, Human
ucacauugaagaaauuuuaagu

SEQ ID NO: 703836 - RNA, 22 nt, Human
ucaugccacuuacaaaauaaug

SEQ ID NO: 703837 - RNA, 22 nt, Human
accacaggaggauggcugcugg

SEQ ID NO: 703838 - RNA, 20 nt, Human
gccaccucucuagcaguaga

SEQ ID NO: 703839 - RNA, 21 nt, Human
acauuuucuguuuuaggaagu

SEQ ID NO: 703840 - RNA, 22 nt, Human
aacagcagguccuggcaugggu

SEQ ID NO: 703841 - RNA, 22 nt, Human
uauaauccugcuucacauugaa

SEQ ID NO: 703842 - RNA, 22 nt, Human
acaaguaccaaaugcucaagua

SEQ ID NO: 703843 - RNA, 22 nt, Human
auccaggcgaaugcagaaggcc

SEQ ID NO: 703844 - RNA, 22 nt, Human
aaagcuauuuauuacagagaau

SEQ ID NO: 703845 - RNA, 22 nt, Human
uuuguaugugauaagacuauuc

SEQ ID NO: 703846 - RNA, 22 nt, Human
uccuucaaaaguugagagagcc

SEQ ID NO: 703847 - RNA, 22 nt, Human
ccagagacgucggucagggcgc

SEQ ID NO: 703848 - RNA, 22 nt, Human
acuuacaaguucccuuucucag

SEQ ID NO: 703849 - RNA, 22 nt, Human
ggaggcugagaggucgcagugg

SEQ ID NO: 703850 - RNA, 22 nt, Human
agaaaucacaggaggcagaagg

SEQ ID NO: 703851 - RNA, 22 nt, Human
augugcuuucuuuccaaggggc

SEQ ID NO: 703852 - RNA, 22 nt, Human
caggguggaauggaaugcuggc

SEQ ID NO: 703853 - RNA, 22 nt, Human
aucaggaucagggcuagcagag

SEQ ID NO: 703854 - RNA, 22 nt, Human
cacugcccuggggguugccauc

SEQ ID NO: 703855 - RNA, 22 nt, Human
aucuggcuuaccuagggugccu

SEQ ID NO: 703856 - RNA, 22 nt, Human
uagcuguuuuuugugaggaaau

SEQ ID NO: 703857 - RNA, 22 nt, Human
guuucacaugaaacuuggggaa

SEQ ID NO: 703858 - RNA, 22 nt, Human
cccagcucuggaagguggggga

SEQ ID NO: 703859 - RNA, 20 nt, Human
uagauccgcaguaaaacuuu

SEQ ID NO: 703860 - RNA, 22 nt, Human
uagauccugagcccuaucuacu

SEQ ID NO: 703861 - RNA, 22 nt, Human
uccaggcugugcaugaguuuag

SEQ ID NO: 703862 - RNA, 22 nt, Human
aguguugcaugaggcaguacca

SEQ ID NO: 703863 - RNA, 22 nt, Human
cugcccugagggccuguguguu

SEQ ID NO: 703864 - RNA, 22 nt, Human
aucaagaacuuauuuuggaaau

SEQ ID NO: 703865 - RNA, 21 nt, Human
aggcacuguuugugguuuggg

SEQ ID NO: 703866 - RNA, 23 nt, Human
uucauucaaaaggaaaagucaug

SEQ ID NO: 703867 - RNA, 22 nt, Human
uuucuugucuuuaguaucuggc

SEQ ID NO: 703868 - RNA, 22 nt, Human
caugcuauuuuccaauaaugua

SEQ ID NO: 703869 - RNA, 22 nt, Human
aaauauguuuuccaguugucau

SEQ ID NO: 703870 - RNA, 22 nt, Human
ugcauuccuuugucuguuaaag

SEQ ID NO: 703871 - RNA, 22 nt, Human
gcagaggugucaccuuccagga

SEQ ID NO: 703872 - RNA, 22 nt, Human
cgcgcggcucucgcgagaugug

SEQ ID NO: 703873 - RNA, 22 nt, Human
acaaaugcuuaguucaccaaaa

SEQ ID NO: 703874 - RNA, 22 nt, Human
cacagcuucugucugacccaug

SEQ ID NO: 703875 - RNA, 21 nt, Human
gccugcagaccccaccaggcu

SEQ ID NO: 703876 - RNA, 22 nt, Human
ccucucaucauuaucgcuuugu

SEQ ID NO: 703877 - RNA, 22 nt, Human
caaaguaauuuggagauauaua

SEQ ID NO: 703878 - RNA, 22 nt, Human
agcagagaagacacaggcuuca

SEQ ID NO: 703879 - RNA, 22 nt, Human
ccagccuggagggcaguggugg

SEQ ID NO: 703880 - RNA, 22 nt, Human
gcuggcuugucccaggacaaag

SEQ ID NO: 703881 - RNA, 22 nt, Human
agaggacagguuuuccaugggc

SEQ ID NO: 703882 - RNA, 22 nt, Human
aauugcuucccaagggaggucu

SEQ ID NO: 703883 - RNA, 22 nt, Human
uuucacaguagaaaucauuaug

SEQ ID NO: 703884 - RNA, 22 nt, Human
augaacaaaaacaaggccuguu

SEQ ID NO: 703885 - RNA, 22 nt, Human
ccaaagugcugggauucaggca

SEQ ID NO: 703886 - RNA, 22 nt, Human
aauugcuuaugccaggugagag

SEQ ID NO: 703887 - RNA, 22 nt, Human
uaggaacaaagagccucacauu

SEQ ID NO: 703888 - RNA, 22 nt, Human
uuuagcagagcauaugauaucc

SEQ ID NO: 703889 - RNA, 22 nt, Human
aacugaaacguauuuuugagau

SEQ ID NO: 703890 - RNA, 17 nt, Human
uuaaaccauaaagaagg

SEQ ID NO: 703891 - RNA, 22 nt, Human
augaggcacaucacagccaaug

SEQ ID NO: 703892 - RNA, 22 nt, Human
ccaaggcuggagggcuuaugua

SEQ ID NO: 703893 - RNA, 19 nt, Human
acccugagaggugguccgg

SEQ ID NO: 703894 - RNA, 22 nt, Human
gugcauauguaccugugaucau

SEQ ID NO: 703895 - RNA, 22 nt, Human
acacaaacagucuauagcacca

SEQ ID NO: 703896 - RNA, 22 nt, Human
cuaaaauuaucaagauaauucc

SEQ ID NO: 703897 - RNA, 22 nt, Human
cccaggcugaugggaugggcca

SEQ ID NO: 703898 - RNA, 22 nt, Human
ugcaucuuucugcauauguaaa

SEQ ID NO: 703899 - RNA, 21 nt, Human
ugcaaugcauugacagcagca

SEQ ID NO: 703900 - RNA, 22 nt, Human
gcccuucauuuauaguuggaau

SEQ ID NO: 703901 - RNA, 22 nt, Human
ucagauuuguccuacuaggcac

SEQ ID NO: 703902 - RNA, 22 nt, Human
uggcaaggcugugggggcagag

SEQ ID NO: 703903 - RNA, 22 nt, Human
ugguccuuguaggcauuugagc

SEQ ID NO: 703904 - RNA, 22 nt, Human
gaagcaaucuggcucccagcca

SEQ ID NO: 703905 - RNA, 22 nt, Human
cccuuuggcauuuccaggauau

SEQ ID NO: 703906 - RNA, 20 nt, Human
auguaaaagacagggaguag

SEQ ID NO: 703907 - RNA, 22 nt, Human
uacauuuccugucagagauaua

SEQ ID NO: 703908 - RNA, 22 nt, Human
uuucucugcagagccccaagga

SEQ ID NO: 703909 - RNA, 22 nt, Human
uccuuaggcaauuugggagagu

SEQ ID NO: 703910 - RNA, 22 nt, Human
uuccugggccuuaaaucuuuug

SEQ ID NO: 703911 - RNA, 22 nt, Human
accaagcucucuucccggcucu

SEQ ID NO: 703912 - RNA, 22 nt, Human
ccagugccuaucuccucuggga

SEQ ID NO: 703913 - RNA, 22 nt, Human
caugcuaauucccaggccccaa

SEQ ID NO: 703914 - RNA, 22 nt, Human
aaugaggugaggaaggccucag

SEQ ID NO: 703915 - RNA, 18 nt, Human
ugcagcauguucccauaa

SEQ ID NO: 703916 - RNA, 22 nt, Human
aggggucuauccugagaugguc

SEQ ID NO: 703917 - RNA, 22 nt, Human
cucugcugcuugccagucauug

SEQ ID NO: 703918 - RNA, 22 nt, Human
uccugggcuugcuccuccagcu

SEQ ID NO: 703919 - RNA, 22 nt, Human
uugagaagguggucauuugcaa

SEQ ID NO: 703920 - RNA, 21 nt, Human
agagggagaguggcccuucca

SEQ ID NO: 703921 - RNA, 22 nt, Human
acuggacucacguauuccugag

SEQ ID NO: 703922 - RNA, 22 nt, Human
ugcagcagacugaguaugagaa

SEQ ID NO: 703923 - RNA, 23 nt, Human
agcagugaguaaacagauaggau

SEQ ID NO: 703924 - RNA, 22 nt, Human
gcuucuggugaggccucaggaa

SEQ ID NO: 703925 - RNA, 22 nt, Human
aagauucuuugaggauuuuacu

SEQ ID NO: 703926 - RNA, 22 nt, Human
ccagcaggagacuagcaacaua

SEQ ID NO: 703927 - RNA, 22 nt, Human
cacagaggagugcacacucucu

SEQ ID NO: 703928 - RNA, 22 nt, Human
acccugagaaugagugucuccu

SEQ ID NO: 703929 - RNA, 22 nt, Human
uggcagauggccuggaaccaaa

SEQ ID NO: 703930 - RNA, 22 nt, Human
uacaggcauguagcauggugau

SEQ ID NO: 703931 - RNA, 22 nt, Human
agauauuuaaaucagacaaaga

SEQ ID NO: 703932 - RNA, 22 nt, Human
acccaggacaugggcacccgug

SEQ ID NO: 703933 - RNA, 22 nt, Human
ggaaaaacagucuuuauuauuu

SEQ ID NO: 703934 - RNA, 22 nt, Human
aaagugcugaaauuacaggggu

SEQ ID NO: 703935 - RNA, 22 nt, Human
aaauaacuuucuguguauaguc

SEQ ID NO: 703936 - RNA, 22 nt, Human
ucccggcgcugggagguggguc

SEQ ID NO: 703937 - RNA, 22 nt, Human
guaguacaugaagcacuuggca

SEQ ID NO: 703938 - RNA, 22 nt, Human
cugacccuugcucgggcccugu

SEQ ID NO: 703939 - RNA, 19 nt, Human
aacagcaacuuccuaguca

SEQ ID NO: 703940 - RNA, 22 nt, Human
uugcauuuguuugaguagaaug

SEQ ID NO: 703941 - RNA, 22 nt, Human
gcucugagaggaugcugagcag

SEQ ID NO: 703942 - RNA, 19 nt, Human
uccaggccauucccagagc

SEQ ID NO: 703943 - RNA, 22 nt, Human
uuuuacuuaauucuuggucaug

SEQ ID NO: 703944 - RNA, 22 nt, Human
aggcagugcagaguccucuucu

SEQ ID NO: 703945 - RNA, 22 nt, Human
cccugugggccaugugucuaca

SEQ ID NO: 703946 - RNA, 22 nt, Human
aggccuggguguucaccagaag

SEQ ID NO: 703947 - RNA, 22 nt, Human
uauagcaaaguacuaccaacuc

SEQ ID NO: 703948 - RNA, 22 nt, Human
gaccucagugaauggucaugua

SEQ ID NO: 703949 - RNA, 22 nt, Human
gggcccuggggccugauuugca

SEQ ID NO: 703950 - RNA, 22 nt, Human
uucagagguaagggucucagaa

SEQ ID NO: 703951 - RNA, 22 nt, Human
ugucucuuuggccucccauaug

SEQ ID NO: 703952 - RNA, 22 nt, Human
gaugcaaagaggaccuucagua

SEQ ID NO: 703953 - RNA, 22 nt, Human
ggggcugcugguauuuccaguu

SEQ ID NO: 703954 - RNA, 22 nt, Human
gcccaggagccuggagaugugu

SEQ ID NO: 703955 - RNA, 22 nt, Human
acugggcuaccccaccauuacc

SEQ ID NO: 703956 - RNA, 22 nt, Human
gagcuguccgccccugggccga

SEQ ID NO: 703957 - RNA, 22 nt, Human
uuaccacagugccugucuaaug

SEQ ID NO: 703958 - RNA, 22 nt, Human
ccuccugggacucauuagcacc

SEQ ID NO: 703959 - RNA, 22 nt, Human
aagcgcagacacagagagugga

SEQ ID NO: 703960 - RNA, 22 nt, Human
gccuugggauucuuggaugcuc

SEQ ID NO: 703961 - RNA, 22 nt, Human
cucucccuugggugggcuuugg

SEQ ID NO: 703962 - RNA, 22 nt, Human
uaagugcaugauugaacuuggc

SEQ ID NO: 703963 - RNA, 22 nt, Human
gcucccugcacucugcagcccu

SEQ ID NO: 703964 - RNA, 22 nt, Human
cugcagagaguaacugaaauau

SEQ ID NO: 703965 - RNA, 22 nt, Human
agaccuggugauagcuguccua

SEQ ID NO: 703966 - RNA, 22 nt, Human
cauggcuuaccccaggagcagc

SEQ ID NO: 703967 - RNA, 22 nt, Human
aaaauagaugaaaggaagucug

SEQ ID NO: 703968 - RNA, 22 nt, Human
uuauauacugugguaguacugu

SEQ ID NO: 703969 - RNA, 22 nt, Human
ugcagggcagauaugacuguag

SEQ ID NO: 703970 - RNA, 22 nt, Human
aaacuguaggagggaaaggaag

SEQ ID NO: 703971 - RNA, 22 nt, Human
acaguagcuaauauugcauuau

SEQ ID NO: 703972 - RNA, 22 nt, Human
acuguuucucaaauuauguggu

SEQ ID NO: 703973 - RNA, 22 nt, Human
acucuggcuauucacuauaaua

SEQ ID NO: 703974 - RNA, 22 nt, Human
gcugggcugagaaguuaagcaa

SEQ ID NO: 703975 - RNA, 22 nt, Human
gggucucuccuccccagcugug

SEQ ID NO: 703976 - RNA, 21 nt, Human
ugccagggauuuacagagccu

SEQ ID NO: 703977 - RNA, 17 nt, Human
ggccacagagcuugggg

SEQ ID NO: 703978 - RNA, 22 nt, Human
agggagcucuuuggucuugccg

SEQ ID NO: 703979 - RNA, 22 nt, Human
gaaaauugaaucaguagcugau

SEQ ID NO: 703980 - RNA, 22 nt, Human
uauucacaguugauuuacaguu

SEQ ID NO: 703981 - RNA, 22 nt, Human
cagcucagugaugccuucacag

SEQ ID NO: 703982 - RNA, 22 nt, Human
ccagcucagggucacauggcac

SEQ ID NO: 703983 - RNA, 22 nt, Human
auuauucaauguuauuucagug

SEQ ID NO: 703984 - RNA, 22 nt, Human
agcagcauacacaucauguuga

SEQ ID NO: 703985 - RNA, 21 nt, Human
ucaaagcacauauuugcacau

SEQ ID NO: 703986 - RNA, 22 nt, Human
ugccugcucugugccacaguug

SEQ ID NO: 703987 - RNA, 22 nt, Human
guggagccaggaucuccgcaca

SEQ ID NO: 703988 - RNA, 22 nt, Human
uaucaucacuguaauccguuga

SEQ ID NO: 703989 - RNA, 22 nt, Human
accugggaggcagagguugcag

SEQ ID NO: 703990 - RNA, 22 nt, Human
uuuauugcuagcccuuggucca

SEQ ID NO: 703991 - RNA, 20 nt, Human
ccuggcaggcggguuacuua

SEQ ID NO: 703992 - RNA, 22 nt, Human
agcugcugagccauguccugcu

SEQ ID NO: 703993 - RNA, 22 nt, Human
guggucaggggcuguggcuaug

SEQ ID NO: 703994 - RNA, 22 nt, Human
caggaccccauauucacugaac

SEQ ID NO: 703995 - RNA, 20 nt, Human
aagaagccgggaaggcaggc

SEQ ID NO: 703996 - RNA, 22 nt, Human
gauccguuccaccagucuuuau

SEQ ID NO: 703997 - RNA, 22 nt, Human
gccaguggugagauucccuggg

SEQ ID NO: 703998 - RNA, 22 nt, Human
cuggucccugcagugugcuggg

SEQ ID NO: 703999 - RNA, 22 nt, Human
gacccuccacucacugcugugu

SEQ ID NO: 704000 - RNA, 22 nt, Human
ugucacuacaucauaaauauau

SEQ ID NO: 704001 - RNA, 22 nt, Human
auuuuuucagauugaguguuaa

SEQ ID NO: 704002 - RNA, 22 nt, Human
accaaaggcagagcugaacacu

SEQ ID NO: 704003 - RNA, 22 nt, Human
gaaucaaugguagauuaaguaa

SEQ ID NO: 704004 - RNA, 22 nt, Human
aaaagagguuaaccaggugugu

SEQ ID NO: 704005 - RNA, 22 nt, Human
ucagaggcaucauucauaguua

SEQ ID NO: 704006 - RNA, 22 nt, Human
ucauauaccagagaguuuauau

SEQ ID NO: 704007 - RNA, 23 nt, Human
acuugauuauuguugauagauuc

SEQ ID NO: 704008 - RNA, 22 nt, Human
uucagacuuuguggggcccucc

SEQ ID NO: 704009 - RNA, 22 nt, Human
uguagauuuuggagucuacaag

SEQ ID NO: 704010 - RNA, 22 nt, Human
gagacauucuuaggaacaaugu

SEQ ID NO: 704011 - RNA, 22 nt, Human
ucucugagaucagccacugacu

SEQ ID NO: 704012 - RNA, 22 nt, Human
ggcuggcuggcuuagcagagga

SEQ ID NO: 704013 - RNA, 22 nt, Human
uauggauguuuaucuacaggcu

SEQ ID NO: 704014 - RNA, 22 nt, Human
ggcuuuauuauguggccaugug

SEQ ID NO: 704015 - RNA, 22 nt, Human
ggcuauccauggaucugaacuc

SEQ ID NO: 704016 - RNA, 20 nt, Human
uggcacagaacccuugccua

SEQ ID NO: 704017 - RNA, 22 nt, Human
ggcucugugagaacaaaggcua

SEQ ID NO: 704018 - RNA, 22 nt, Human
uuuucaaagacuggaggcugau

SEQ ID NO: 704019 - RNA, 22 nt, Human
ccuucucugcagguaguuggcu

SEQ ID NO: 704020 - RNA, 22 nt, Human
uguugggaagcucugccagggg

SEQ ID NO: 704021 - RNA, 22 nt, Human
aguuaacaaguuggcaaucaac

SEQ ID NO: 704022 - RNA, 22 nt, Human
aaacuuuuuuagguucauaggc

SEQ ID NO: 704023 - RNA, 22 nt, Human
aauuccaagagcuuccuaagug

SEQ ID NO: 704024 - RNA, 22 nt, Human
gcaaugucugugcuaaaaacug

SEQ ID NO: 704025 - RNA, 22 nt, Human
agccaacuaggagauuaaggua

SEQ ID NO: 704026 - RNA, 17 nt, Human
ccugucuuguuucugcc

SEQ ID NO: 704027 - RNA, 23 nt, Human
gcucacagaauguugaagggaau

SEQ ID NO: 704028 - RNA, 22 nt, Human
ucuugagaaauaauuaaacaug

SEQ ID NO: 704029 - RNA, 22 nt, Human
ccugucaccuagguacugagca

SEQ ID NO: 704030 - RNA, 22 nt, Human
uucaagucugcccagagucagc

SEQ ID NO: 704031 - RNA, 22 nt, Human
uucugcuuugguuccauggaug

SEQ ID NO: 704032 - RNA, 22 nt, Human
ucacagaaggcaucacagaaga

SEQ ID NO: 704033 - RNA, 18 nt, Human
ugcucuguuuaaugauuu

SEQ ID NO: 704034 - RNA, 22 nt, Human
ccaaaauauuagugcuuaagua

SEQ ID NO: 704035 - RNA, 23 nt, Human
cuugcagggcuggaggcuuagaa

SEQ ID NO: 704036 - RNA, 22 nt, Human
agccaggauggucucgaucggc

SEQ ID NO: 704037 - RNA, 22 nt, Human
cuauccauauccugggcauggc

SEQ ID NO: 704038 - RNA, 20 nt, Human
acauuugaguaucaucuacu

SEQ ID NO: 704039 - RNA, 22 nt, Human
uauauugggacuucaggacuuu

SEQ ID NO: 704040 - RNA, 23 nt, Human
uaaugccagcccugcaguuaagc

SEQ ID NO: 704041 - RNA, 18 nt, Human
gaagggcuuugaaguaga

SEQ ID NO: 704042 - RNA, 22 nt, Human
auaauucagguuuucuggcaca

SEQ ID NO: 704043 - RNA, 23 nt, Human
acagugucugcugcaagauaucu

SEQ ID NO: 704044 - RNA, 22 nt, Human
auucucuuuguauaacaucuug

SEQ ID NO: 704045 - RNA, 18 nt, Human
ucagccuguugucugccu

SEQ ID NO: 704046 - RNA, 22 nt, Human
uauaguacacuuagguacuuca

SEQ ID NO: 704047 - RNA, 22 nt, Human
auuuuacuuugugaauauugac

SEQ ID NO: 704048 - RNA, 22 nt, Human
uugcacagugguuuagagccug

SEQ ID NO: 704049 - RNA, 23 nt, Human
acagaucaucucgaaacaacuau

SEQ ID NO: 704050 - RNA, 22 nt, Human
uggcuggcugucaaggaaagcc

SEQ ID NO: 704051 - RNA, 22 nt, Human
uccagcccugugucugggagag

SEQ ID NO: 704052 - RNA, 22 nt, Human
cagugagggaagaucucagcac

SEQ ID NO: 704053 - RNA, 22 nt, Human
ugaggccuggagggaggaguuu

SEQ ID NO: 704054 - RNA, 21 nt, Human
uggcugagccaggugugugga

SEQ ID NO: 704055 - RNA, 22 nt, Human
uagggaggaggguuuucaaauc

SEQ ID NO: 704056 - RNA, 22 nt, Human
cacugcuucuggaggaauuugg

SEQ ID NO: 704057 - RNA, 21 nt, Human
aguguccuuuuacugugaaua

SEQ ID NO: 704058 - RNA, 22 nt, Human
cagcaucugaccaauaucuaca

SEQ ID NO: 704059 - RNA, 21 nt, Human
ugcagcagaagucucuguguc

SEQ ID NO: 704060 - RNA, 22 nt, Human
uggcuuugaaauccagucauua

SEQ ID NO: 704061 - RNA, 22 nt, Human
cccacacucugagaaaugcuga

SEQ ID NO: 704062 - RNA, 17 nt, Human
cagguacauugcuacug

SEQ ID NO: 704063 - RNA, 22 nt, Human
gcuggcccagggucaccuagga

SEQ ID NO: 704064 - RNA, 22 nt, Human
uucauguguauggaacauuuuu

SEQ ID NO: 704065 - RNA, 22 nt, Human
ugagccaggcuccaugccaccu

SEQ ID NO: 704066 - RNA, 21 nt, Human
uagaucaugguauucuuuggc

SEQ ID NO: 704067 - RNA, 22 nt, Human
gcugagggccgcauagggucau

SEQ ID NO: 704068 - RNA, 19 nt, Human
ggcucucuuaaagcuguuu

SEQ ID NO: 704069 - RNA, 22 nt, Human
cugaauaucauuuaucauuggc

SEQ ID NO: 704070 - RNA, 22 nt, Human
ucauguuuuagcugcaaaauga

SEQ ID NO: 704071 - RNA, 22 nt, Human
agcugccccaugagaggcaggu

SEQ ID NO: 704072 - RNA, 22 nt, Human
acacagcagaaggcccgugucu

SEQ ID NO: 704073 - RNA, 22 nt, Human
acaguugaggacuuaaacaaaa

SEQ ID NO: 704074 - RNA, 22 nt, Human
gucauauuauaaauguucuguu

SEQ ID NO: 704075 - RNA, 22 nt, Human
aauuguacaggaaguugcugga

SEQ ID NO: 704076 - RNA, 22 nt, Human
cauccugguuaccccauaguca

SEQ ID NO: 704077 - RNA, 22 nt, Human
caggcuccuucccagggauggu

SEQ ID NO: 704078 - RNA, 22 nt, Human
aacaugcauauagguaaaugga

SEQ ID NO: 704079 - RNA, 22 nt, Human
acagugcagggcgggaagaagg

SEQ ID NO: 704080 - RNA, 22 nt, Human
cacuugcuggaugguggcucag

SEQ ID NO: 704081 - RNA, 23 nt, Human
auuugcauggccggauuauggau

SEQ ID NO: 704082 - RNA, 22 nt, Human
cuacacuuugguugacuuugug

SEQ ID NO: 704083 - RNA, 22 nt, Human
uugugucugggggagugacauc

SEQ ID NO: 704084 - RNA, 22 nt, Human
aguggcagagguugacugcagu

SEQ ID NO: 704085 - RNA, 22 nt, Human
acauggcuaaagcaagucuaga

SEQ ID NO: 704086 - RNA, 22 nt, Human
uucuucugauugccuucugcaa

SEQ ID NO: 704087 - RNA, 21 nt, Human
agcugccuuuagagagaacca

SEQ ID NO: 704088 - RNA, 22 nt, Human
cucugcuguuuuguauacaggc

SEQ ID NO: 704089 - RNA, 22 nt, Human
cagucccaguuugagacucugg

SEQ ID NO: 704090 - RNA, 22 nt, Human
acacaggaacucugagaggugg

SEQ ID NO: 704091 - RNA, 22 nt, Human
cuacugaguccuucagcugcca

SEQ ID NO: 704092 - RNA, 22 nt, Human
ugagauaauaaacaucuccuua

SEQ ID NO: 704093 - RNA, 22 nt, Human
agugcccucgugcccagggccu

SEQ ID NO: 704094 - RNA, 22 nt, Human
ggcuggauguacuuuggggcug

SEQ ID NO: 704095 - RNA, 22 nt, Human
ugugucuuaaguuccaagacau

SEQ ID NO: 704096 - RNA, 22 nt, Human
cugccagccaggccagguaggc

SEQ ID NO: 704097 - RNA, 22 nt, Human
caugggcccgugagaggcaggg

SEQ ID NO: 704098 - RNA, 22 nt, Human
aggagcugauaaaaggggguca

SEQ ID NO: 704099 - RNA, 22 nt, Human
ugacaggugauugugaacuaag

SEQ ID NO: 704100 - RNA, 22 nt, Human
cuucuauuuucaugccuggguc

SEQ ID NO: 704101 - RNA, 22 nt, Human
caguaauagaggcuuugagucu

SEQ ID NO: 704102 - RNA, 22 nt, Human
uuguauuuauauugaauagcuu

SEQ ID NO: 704103 - RNA, 22 nt, Human
cugcucuguucccccaucaucu

SEQ ID NO: 704104 - RNA, 22 nt, Human
cagcucagucuugaagcacugg

SEQ ID NO: 704105 - RNA, 18 nt, Human
ccagcugcgcugaaccga

SEQ ID NO: 704106 - RNA, 16 nt, Human
gggggugagagagagu

SEQ ID NO: 704107 - RNA, 22 nt, Human
ucagaaagcuuuuacuuaaaca

SEQ ID NO: 704108 - RNA, 22 nt, Human
uuggcugucacugucaguucag

SEQ ID NO: 704109 - RNA, 22 nt, Human
gccagguucuggggagguacaa

SEQ ID NO: 704110 - RNA, 21 nt, Human
agagucugagugugcaagggc

SEQ ID NO: 704111 - RNA, 22 nt, Human
cccauucauccucgcuuccuuc

SEQ ID NO: 704112 - RNA, 22 nt, Human
ccacccaugugacuaccucaug

SEQ ID NO: 704113 - RNA, 22 nt, Human
uaggcagagaggccauaagaau

SEQ ID NO: 704114 - RNA, 22 nt, Human
ucacagcaaaagugugcagagc

SEQ ID NO: 704115 - RNA, 22 nt, Human
gcccagaaguugaggcugcagu

SEQ ID NO: 704116 - RNA, 22 nt, Human
uugaaugaauaguugcuagaag

SEQ ID NO: 704117 - RNA, 22 nt, Human
ucagauagugauaauagcaugu

SEQ ID NO: 704118 - RNA, 22 nt, Human
ucugccuaugcuguaccuuugu

SEQ ID NO: 704119 - RNA, 22 nt, Human
uggcacagaccuuaucuucucu

SEQ ID NO: 704120 - RNA, 22 nt, Human
aucucuucucccaacaccuggc

SEQ ID NO: 704121 - RNA, 22 nt, Human
uggcuggagcauuccuugucuu

SEQ ID NO: 704122 - RNA, 22 nt, Human
ucuccaaggagcuccugugccg

SEQ ID NO: 704123 - RNA, 22 nt, Human
augcauuguaacgaugugcaca

SEQ ID NO: 704124 - RNA, 22 nt, Human
ucugauguugcuucugcagaac

SEQ ID NO: 704125 - RNA, 22 nt, Human
ucugggaguggguccaaggaau

SEQ ID NO: 704126 - RNA, 22 nt, Human
auucugcugcacaccuuccccc

SEQ ID NO: 704127 - RNA, 22 nt, Human
caaacugagcaucagaaaguuu

SEQ ID NO: 704128 - RNA, 22 nt, Human
aucugccucuucuucauugcga

SEQ ID NO: 704129 - RNA, 22 nt, Human
aaugggcuuuggccaguaggag

SEQ ID NO: 704130 - RNA, 22 nt, Human
uauaccaaaaaaauucuugucu

SEQ ID NO: 704131 - RNA, 21 nt, Human
gcaaguguuucugacaguggc

SEQ ID NO: 704132 - RNA, 22 nt, Human
agagcccugcaguucuucagga

SEQ ID NO: 704133 - RNA, 22 nt, Human
ucaagaaggagacuccacugug

SEQ ID NO: 704134 - RNA, 22 nt, Human
cucuuuaaaguaaaauuugucu

SEQ ID NO: 704135 - RNA, 22 nt, Human
ucuucaaguuccaaagugcagg

SEQ ID NO: 704136 - RNA, 22 nt, Human
auucuggccuuggcucugucac

SEQ ID NO: 704137 - RNA, 22 nt, Human
cuggcuugcagcucaucauaaa

SEQ ID NO: 704138 - RNA, 22 nt, Human
uuauaagaguauauaguguacu

SEQ ID NO: 704139 - RNA, 22 nt, Human
aggcagagcuaggaagaauugu

SEQ ID NO: 704140 - RNA, 22 nt, Human
gguggggcuaggaccucaggau

SEQ ID NO: 704141 - RNA, 22 nt, Human
caaccugaauucugcuuuggca

SEQ ID NO: 704142 - RNA, 22 nt, Human
aaggcaugauguaaucaaugau

SEQ ID NO: 704143 - RNA, 22 nt, Human
caggucccgccccgggcugacc

SEQ ID NO: 704144 - RNA, 22 nt, Human
guuuccuacacuguaguauuau

SEQ ID NO: 704145 - RNA, 22 nt, Human
auauuaggugcucaauacaugc

SEQ ID NO: 704146 - RNA, 22 nt, Human
aguugucaccucuauucaaauc

SEQ ID NO: 704147 - RNA, 22 nt, Human
augaauggauggggucaagaua

SEQ ID NO: 704148 - RNA, 22 nt, Human
cuggccuagcucucugcuugaa

SEQ ID NO: 704149 - RNA, 23 nt, Human
agaguccacaagauuuuccagug

SEQ ID NO: 704150 - RNA, 22 nt, Human
gacagcaggugcuugggaaagg

SEQ ID NO: 704151 - RNA, 22 nt, Human
aagcaggaaggagcccagggca

SEQ ID NO: 704152 - RNA, 22 nt, Human
ggcugagucugugacccaugcg

SEQ ID NO: 704153 - RNA, 23 nt, Human
cauuucuagguguguuuggccau

SEQ ID NO: 704154 - RNA, 21 nt, Human
cuuggcacagggaagaugcac

SEQ ID NO: 704155 - RNA, 22 nt, Human
aguccaaggagagacagcauuu

SEQ ID NO: 704156 - RNA, 22 nt, Human
ugauauguaacuacuccuuaua

SEQ ID NO: 704157 - RNA, 22 nt, Human
gcaccugauugauuucacugcu

SEQ ID NO: 704158 - RNA, 22 nt, Human
cagcucuggcuuuggggagcuu

SEQ ID NO: 704159 - RNA, 22 nt, Human
aaaaggcagugcaagagagggu

SEQ ID NO: 704160 - RNA, 22 nt, Human
cuguuauuuaugcugcuccauu

SEQ ID NO: 704161 - RNA, 22 nt, Human
acagaacaacaagguggaccag

SEQ ID NO: 704162 - RNA, 22 nt, Human
gggaugaggaucaaucagggag

SEQ ID NO: 704163 - RNA, 22 nt, Human
aucacauuuauaguggcacgca

SEQ ID NO: 704164 - RNA, 22 nt, Human
agacaauggagggaaauacuuc

SEQ ID NO: 704165 - RNA, 22 nt, Human
auaaagcuauuuuuaauucugu

SEQ ID NO: 704166 - RNA, 22 nt, Human
aguucucaagacaauuaccugu

SEQ ID NO: 704167 - RNA, 22 nt, Human
cuggcagcucuacucagagccu

SEQ ID NO: 704168 - RNA, 22 nt, Human
aucugucuuuuauucaugagcu

SEQ ID NO: 704169 - RNA, 22 nt, Human
ucucugucacacaaucuacaca

SEQ ID NO: 704170 - RNA, 22 nt, Human
uaaagugcugggauuauaggcc

SEQ ID NO: 704171 - RNA, 22 nt, Human
auugugcuuugcaucuuguucc

SEQ ID NO: 704172 - RNA, 22 nt, Human
uggcuagguagcuuucugcugu

SEQ ID NO: 704173 - RNA, 22 nt, Human
cucucaguaaauuucugcccca

SEQ ID NO: 704174 - RNA, 22 nt, Human
guuccauaucacagcagacgaa

SEQ ID NO: 704175 - RNA, 22 nt, Human
ugcccaagcagaggagugauuc

SEQ ID NO: 704176 - RNA, 22 nt, Human
accuuuuuucagaacucuaaag

SEQ ID NO: 704177 - RNA, 22 nt, Human
uuguucauuagcgcuugggcac

SEQ ID NO: 704178 - RNA, 22 nt, Human
augcauauuggauuagcagcca

SEQ ID NO: 704179 - RNA, 22 nt, Human
cacauuucuaggaaauuaaaug

SEQ ID NO: 704180 - RNA, 22 nt, Human
ugagguaggugucgagagaggu

SEQ ID NO: 704181 - RNA, 22 nt, Human
agguccugucuaucacccucgc

SEQ ID NO: 704182 - RNA, 22 nt, Human
ccagagaguaucauggagagua

SEQ ID NO: 704183 - RNA, 22 nt, Human
cuuaaaggagguuuuguuucca

SEQ ID NO: 704184 - RNA, 22 nt, Human
aauaaagacaaacaggggagcc

SEQ ID NO: 704185 - RNA, 22 nt, Human
ggagcuggagaguacagaguuu

SEQ ID NO: 704186 - RNA, 22 nt, Human
aggaagaggugugcaauggugu

SEQ ID NO: 704187 - RNA, 22 nt, Human
aguauacaguaaugacauaucu

SEQ ID NO: 704188 - RNA, 22 nt, Human
ugacauuuuuaaaaccacuagu

SEQ ID NO: 704189 - RNA, 22 nt, Human
uccucuucugccuauaucugcc

SEQ ID NO: 704190 - RNA, 18 nt, Human
gguguguaacguguuuuc

SEQ ID NO: 704191 - RNA, 22 nt, Human
uaugaaaugguaguaggaaggg

SEQ ID NO: 704192 - RNA, 22 nt, Human
aaauuucuggaagugucagagu

SEQ ID NO: 704193 - RNA, 22 nt, Human
gggaggugauggcaagcagcgg

SEQ ID NO: 704194 - RNA, 20 nt, Human
uuggcucaugcaacaccuac

SEQ ID NO: 704195 - RNA, 22 nt, Human
cccucaggugaaaggaaaaauu

SEQ ID NO: 704196 - RNA, 22 nt, Human
gaugucuuucugugugccuaga

SEQ ID NO: 704197 - RNA, 22 nt, Human
ccacacugucuaacaaggcaua

SEQ ID NO: 704198 - RNA, 22 nt, Human
agugugggcccccagguuagcc

SEQ ID NO: 704199 - RNA, 22 nt, Human
cccagagguuccuuagggacca

SEQ ID NO: 704200 - RNA, 22 nt, Human
guggguguggaacugugagacc

SEQ ID NO: 704201 - RNA, 22 nt, Human
aaguccauucuuccagccagcu

SEQ ID NO: 704202 - RNA, 22 nt, Human
cuuguauuccccuaucucuaaa

SEQ ID NO: 704203 - RNA, 22 nt, Human
accaggcagcacuuuccuugca

SEQ ID NO: 704204 - RNA, 22 nt, Human
aucagagauggcuccagugcuc

SEQ ID NO: 704205 - RNA, 22 nt, Human
acagcagggaauaugggaauug

SEQ ID NO: 704206 - RNA, 22 nt, Human
uugaaggacaucuuguuucuag

SEQ ID NO: 704207 - RNA, 22 nt, Human
aaucacaugcagggccuccacc

SEQ ID NO: 704208 - RNA, 22 nt, Human
uagaaagcccuguguucacugc

SEQ ID NO: 704209 - RNA, 22 nt, Human
cggcagagcccugagucagccu

SEQ ID NO: 704210 - RNA, 22 nt, Human
gcugaggcugggagcagccugu

SEQ ID NO: 704211 - RNA, 22 nt, Human
caaggccaguccauuuuggaag

SEQ ID NO: 704212 - RNA, 22 nt, Human
ugagggacuugcuaguucucug

SEQ ID NO: 704213 - RNA, 22 nt, Human
gcucaggcaaauuucuggugaa

SEQ ID NO: 704214 - RNA, 19 nt, Human
aacauggaacuggagaggg

SEQ ID NO: 704215 - RNA, 22 nt, Human
gugggggcuggaaaucuugcca

SEQ ID NO: 704216 - RNA, 22 nt, Human
agacauguccacaaagcauuca

SEQ ID NO: 704217 - RNA, 22 nt, Human
ugcuggaggccgagaagcagca

SEQ ID NO: 704218 - RNA, 22 nt, Human
ucuuggaacuuauuauuguaga

SEQ ID NO: 704219 - RNA, 22 nt, Human
ucagagguaaaaacucacugua

SEQ ID NO: 704220 - RNA, 22 nt, Human
uugcuuggcccauugcuucagu

SEQ ID NO: 704221 - RNA, 22 nt, Human
ugggggaagagcuuguuaaagu

SEQ ID NO: 704222 - RNA, 22 nt, Human
ugccaaggagcuggaucagggc

SEQ ID NO: 704223 - RNA, 22 nt, Human
acacaauguaccauaucuccaa

SEQ ID NO: 704224 - RNA, 22 nt, Human
uucuggaguugugaccucaggg

SEQ ID NO: 704225 - RNA, 22 nt, Human
uccaggcucuaggcugcucucc

SEQ ID NO: 704226 - RNA, 20 nt, Human
ugcacagacaaugagcccag

SEQ ID NO: 704227 - RNA, 22 nt, Human
uguuguaaaauuugagauguca

SEQ ID NO: 704228 - RNA, 22 nt, Human
auggccagccacuccugauggc

SEQ ID NO: 704229 - RNA, 22 nt, Human
ccugcuucagggaugauggcac

SEQ ID NO: 704230 - RNA, 22 nt, Human
cccagcaucccagugggcagca

SEQ ID NO: 704231 - RNA, 22 nt, Human
cuucauuaacuauuggaaugca

SEQ ID NO: 704232 - RNA, 22 nt, Human
cagcacauaagccgaagacugu

SEQ ID NO: 704233 - RNA, 22 nt, Human
uucauucacccaggaaacaucu

SEQ ID NO: 704234 - RNA, 22 nt, Human
uagaaaguaaaucaguuuuauu

SEQ ID NO: 704235 - RNA, 22 nt, Human
ucugggugccacugucuguaca

SEQ ID NO: 704236 - RNA, 22 nt, Human
augaggccacaguuauagauuu

SEQ ID NO: 704237 - RNA, 22 nt, Human
agcauuccacacugaagucugc

SEQ ID NO: 704238 - RNA, 22 nt, Human
auuugacaacuucugguggcau

SEQ ID NO: 704239 - RNA, 22 nt, Human
aggccugaggaccagauaaaug

SEQ ID NO: 704240 - RNA, 22 nt, Human
uagcaacagaaaauaggagugc

SEQ ID NO: 704241 - RNA, 22 nt, Human
caguacuucuuggaaacuggau

SEQ ID NO: 704242 - RNA, 22 nt, Human
auuuggaaggcguuucucugua

SEQ ID NO: 704243 - RNA, 22 nt, Human
ugucucaguacacuccgauguu

SEQ ID NO: 704244 - RNA, 22 nt, Human
ccucucuguaagggucccuccc

SEQ ID NO: 704245 - RNA, 22 nt, Human
ucacauacugaaaguccaguga

SEQ ID NO: 704246 - RNA, 22 nt, Human
ucauccaguucacauggugagu

SEQ ID NO: 704247 - RNA, 22 nt, Human
auguuucugaaguuuacagaua

SEQ ID NO: 704248 - RNA, 22 nt, Human
gcagccuuuggaauuagagacu

SEQ ID NO: 704249 - RNA, 22 nt, Human
cagaggcagacccuccagggcg

SEQ ID NO: 704250 - RNA, 22 nt, Human
agcuuucucccugacgcuuugg

SEQ ID NO: 704251 - RNA, 22 nt, Human
guccuuggcuguggcuguaaug

SEQ ID NO: 704252 - RNA, 22 nt, Human
gcuguggcugaagaugcaggga

SEQ ID NO: 704253 - RNA, 22 nt, Human
acagccacucaaagggccgaag

SEQ ID NO: 704254 - RNA, 22 nt, Human
ccucagaagacuuuagggaaga

SEQ ID NO: 704255 - RNA, 22 nt, Human
agggcuggccacaugauuuggu

SEQ ID NO: 704256 - RNA, 22 nt, Human
uucagggcccugagagggcagu

SEQ ID NO: 704257 - RNA, 22 nt, Human
uuuucaguuacuguuuauguga

SEQ ID NO: 704258 - RNA, 22 nt, Human
uacacuguuugaacuguggucg

SEQ ID NO: 704259 - RNA, 22 nt, Human
aaaggagagugagucagaugcc

SEQ ID NO: 704260 - RNA, 17 nt, Human
caggcagacauguaagc

SEQ ID NO: 704261 - RNA, 19 nt, Human
uccagcagugcuugaaauc

SEQ ID NO: 704262 - RNA, 22 nt, Human
cuccgaacaguggcuccaaggc

SEQ ID NO: 704263 - RNA, 18 nt, Human
ucuguccuuccauucuuc

SEQ ID NO: 704264 - RNA, 22 nt, Human
ugagaucauugacuuguuccug

SEQ ID NO: 704265 - RNA, 22 nt, Human
ucucuguguguuggcuguauau

SEQ ID NO: 704266 - RNA, 23 nt, Human
ccacauggcaagaugaugcauuc

SEQ ID NO: 704267 - RNA, 21 nt, Human
cuguggccuggcuagcaccgu

SEQ ID NO: 704268 - RNA, 22 nt, Human
gacagcuggacagacacugaug

SEQ ID NO: 704269 - RNA, 22 nt, Human
cagggcuguuagcugcugcucu

SEQ ID NO: 704270 - RNA, 22 nt, Human
cugccuuugcccuugacacugu

SEQ ID NO: 704271 - RNA, 22 nt, Human
uuuuaucuaccuaugcucauuu

SEQ ID NO: 704272 - RNA, 22 nt, Human
ccaaggagaaaugcugugcuuu

SEQ ID NO: 704273 - RNA, 22 nt, Human
uuucagaaccaagagagacauc

SEQ ID NO: 704274 - RNA, 22 nt, Human
cugucauggucagauugucauc

SEQ ID NO: 704275 - RNA, 22 nt, Human
uuguauuccagccaccacaggc

SEQ ID NO: 704276 - RNA, 22 nt, Human
aacuuauacccagggcagaaau

SEQ ID NO: 704277 - RNA, 22 nt, Human
auaagcauguuagaauauuuga

SEQ ID NO: 704278 - RNA, 22 nt, Human
caaagacugcauaacacaugaa

SEQ ID NO: 704279 - RNA, 22 nt, Human
uguuauuaucuguuagguguuc

SEQ ID NO: 704280 - RNA, 22 nt, Human
aagggcagcuauuaucgucauc

SEQ ID NO: 704281 - RNA, 22 nt, Human
ucuggccacuaauaggucucac

SEQ ID NO: 704282 - RNA, 22 nt, Human
cucuggagaugguucucaauug

SEQ ID NO: 704283 - RNA, 22 nt, Human
agaaaugacacacaugagacau

SEQ ID NO: 704284 - RNA, 22 nt, Human
uguccccuuuaccuccgcagcc

SEQ ID NO: 704285 - RNA, 22 nt, Human
uucuuugugcugaagaagcccu

SEQ ID NO: 704286 - RNA, 22 nt, Human
ccaggccucaccugcccaccua

SEQ ID NO: 704287 - RNA, 22 nt, Human
agauggugauagagcugggauu

SEQ ID NO: 704288 - RNA, 22 nt, Human
acaaauguggacauggauaaug

SEQ ID NO: 704289 - RNA, 22 nt, Human
uguauauucugccuaaaagcuu

SEQ ID NO: 704290 - RNA, 22 nt, Human
gagcuuuggggaagaauacaga

SEQ ID NO: 704291 - RNA, 22 nt, Human
aaaagagaaaguggcaggcuuu

SEQ ID NO: 704292 - RNA, 22 nt, Human
ugugcccuuuccugcuccucca

SEQ ID NO: 704293 - RNA, 22 nt, Human
gggagccacagugaggugcaug

SEQ ID NO: 704294 - RNA, 22 nt, Human
caggaaguggggucauggagua

SEQ ID NO: 704295 - RNA, 22 nt, Human
uguauucagggacauauaugua

SEQ ID NO: 704296 - RNA, 22 nt, Human
gaaggcccugguauucuugagg

SEQ ID NO: 704297 - RNA, 22 nt, Human
cagaggagaauugcgggaucau

SEQ ID NO: 704298 - RNA, 22 nt, Human
cuacauaaauauuuaugugucu

SEQ ID NO: 704299 - RNA, 22 nt, Human
aggggcugacuggaaagugcca

SEQ ID NO: 704300 - RNA, 22 nt, Human
ugagaaaaguguggaggucaau

SEQ ID NO: 704301 - RNA, 22 nt, Human
gaaauaauucugugucugaaca

SEQ ID NO: 704302 - RNA, 22 nt, Human
uguggcaguaaaauugggcaac

SEQ ID NO: 704303 - RNA, 22 nt, Human
cuaggcagauggagaaguggcu

SEQ ID NO: 704304 - RNA, 22 nt, Human
aacuaguuuagcuuuuuaagac

SEQ ID NO: 704305 - RNA, 22 nt, Human
uccugaaguauggguauggagu

SEQ ID NO: 704306 - RNA, 22 nt, Human
agccaacaacucugagcccagu

SEQ ID NO: 704307 - RNA, 22 nt, Human
aggugggcaaugaggccugagu

SEQ ID NO: 704308 - RNA, 22 nt, Human
uuccugggcugcagagagcacc

SEQ ID NO: 704309 - RNA, 22 nt, Human
guggccugucagaagccguggg

SEQ ID NO: 704310 - RNA, 22 nt, Human
uggaagaauauggggguacaga

SEQ ID NO: 704311 - RNA, 22 nt, Human
uuugacaagagcaaauguucuu

SEQ ID NO: 704312 - RNA, 22 nt, Human
augucuauauagucaauaauca

SEQ ID NO: 704313 - RNA, 22 nt, Human
ggucugugucauaggcugaguu

SEQ ID NO: 704314 - RNA, 22 nt, Human
agggccugggauguccuccuag

SEQ ID NO: 704315 - RNA, 22 nt, Human
gcugccugaaauguugccuagc

SEQ ID NO: 704316 - RNA, 22 nt, Human
cccaggaaugagcaggcagggg

SEQ ID NO: 704317 - RNA, 22 nt, Human
uugagcucagugacucgacuuu

SEQ ID NO: 704318 - RNA, 22 nt, Human
gugacauuucgugacgugagaa

SEQ ID NO: 704319 - RNA, 22 nt, Human
uaagacaccucucugcccuuca

SEQ ID NO: 704320 - RNA, 22 nt, Human
ucaauuuccccuauugauagac

SEQ ID NO: 704321 - RNA, 22 nt, Human
cagggcucuucaucacacagua

SEQ ID NO: 704322 - RNA, 22 nt, Human
gcaaaaaccacaauuacuuuua

SEQ ID NO: 704323 - RNA, 22 nt, Human
agcugaggaauaauaacaaggu

SEQ ID NO: 704324 - RNA, 22 nt, Human
gugucaugggagucagaaguga

SEQ ID NO: 704325 - RNA, 22 nt, Human
ucuguuaucucaagucacaaga

SEQ ID NO: 704326 - RNA, 22 nt, Human
cuugggaaugcuaacagaugac

SEQ ID NO: 704327 - RNA, 22 nt, Human
ccugaggucagccauucuugcc

SEQ ID NO: 704328 - RNA, 22 nt, Human
uuagucccauuauaugacuucu

SEQ ID NO: 704329 - RNA, 22 nt, Human
cucacauuccacuugugccaac

SEQ ID NO: 704330 - RNA, 22 nt, Human
uaaaggaacagaggacucauuu

SEQ ID NO: 704331 - RNA, 22 nt, Human
ucauaugucacucaugggcaua

SEQ ID NO: 704332 - RNA, 22 nt, Human
aagaguuuaugauauaacaugu

SEQ ID NO: 704333 - RNA, 22 nt, Human
guccauacaguggcacacaucu

SEQ ID NO: 704334 - RNA, 22 nt, Human
gaggcugacggcaccaucuucu

SEQ ID NO: 704335 - RNA, 21 nt, Human
aacuuguauuucuccuuauuc

SEQ ID NO: 704336 - RNA, 22 nt, Human
auucucucucuaugaaaacuga

SEQ ID NO: 704337 - RNA, 22 nt, Human
caguuaaacgggccaugugagu

SEQ ID NO: 704338 - RNA, 22 nt, Human
auacaugugccgcguuggugug

SEQ ID NO: 704339 - RNA, 22 nt, Human
gagucucugcuauguuuucucu

SEQ ID NO: 704340 - RNA, 22 nt, Human
uaucuuugcaaauaucucuaag

SEQ ID NO: 704341 - RNA, 22 nt, Human
cugugucucuaccuccccaucc

SEQ ID NO: 704342 - RNA, 19 nt, Human
uccagguggagagacaccc

SEQ ID NO: 704343 - RNA, 22 nt, Human
aggcacuuguaauugcagucau

SEQ ID NO: 704344 - RNA, 22 nt, Human
uucuaauuauucccuuguccca

SEQ ID NO: 704345 - RNA, 22 nt, Human
accuccauggcucaguuucaga

SEQ ID NO: 704346 - RNA, 22 nt, Human
agaaacaagguguagguugacc

SEQ ID NO: 704347 - RNA, 22 nt, Human
cugaaggauuuaguucuuugcu

SEQ ID NO: 704348 - RNA, 22 nt, Human
aaaaccacaaugacuuuugcag

SEQ ID NO: 704349 - RNA, 22 nt, Human
gcauuuuucuaaucauuggcau

SEQ ID NO: 704350 - RNA, 22 nt, Human
gcaggcaccucguggaguggaa

SEQ ID NO: 704351 - RNA, 22 nt, Human
auaaucugagcuauuucaugag

SEQ ID NO: 704352 - RNA, 19 nt, Human
ucuggguauuuggaagaug

SEQ ID NO: 704353 - RNA, 21 nt, Human
uggcugcacuguggcuuucau

SEQ ID NO: 704354 - RNA, 22 nt, Human
cugucaguaggcucccaucauu

SEQ ID NO: 704355 - RNA, 22 nt, Human
acacaguaaauauguauugaau

SEQ ID NO: 704356 - RNA, 22 nt, Human
cugggaggcacuauucaggagg

SEQ ID NO: 704357 - RNA, 22 nt, Human
augugugcuacaggugugggaa

SEQ ID NO: 704358 - RNA, 19 nt, Human
aaaauugcguauuuugagg

SEQ ID NO: 704359 - RNA, 22 nt, Human
agcuuguuguuacugaugcauu

SEQ ID NO: 704360 - RNA, 22 nt, Human
cauuucaccuuagagaauuauu

SEQ ID NO: 704361 - RNA, 22 nt, Human
aggcugaggcagguggaucacc

SEQ ID NO: 704362 - RNA, 23 nt, Human
uuuauagcagcaugauuuauaau

SEQ ID NO: 704363 - RNA, 22 nt, Human
augugguugaagaauuacaucu

SEQ ID NO: 704364 - RNA, 22 nt, Human
gcccuggauguacaggcauguu

SEQ ID NO: 704365 - RNA, 22 nt, Human
caguacuuaguucucaugguuu

SEQ ID NO: 704366 - RNA, 22 nt, Human
uccaggcauaaugcccaguggu

SEQ ID NO: 704367 - RNA, 22 nt, Human
cuggagcuaggaaguccaagau

SEQ ID NO: 704368 - RNA, 22 nt, Human
uugcuguuuuacaucugguggg

SEQ ID NO: 704369 - RNA, 22 nt, Human
aagccauuuguuguccuucagg

SEQ ID NO: 704370 - RNA, 22 nt, Human
ucucaaggacuuugggcacuaa

SEQ ID NO: 704371 - RNA, 22 nt, Human
aacaaguguauuaauggaaaua

SEQ ID NO: 704372 - RNA, 22 nt, Human
cacagcuuccauuagaaugaga

SEQ ID NO: 704373 - RNA, 22 nt, Human
uauuuggaaaguuuaucuaucu

SEQ ID NO: 704374 - RNA, 22 nt, Human
aggcaacaugggccaggcagaa

SEQ ID NO: 704375 - RNA, 22 nt, Human
aauggcuuagcucagcgcucag

SEQ ID NO: 704376 - RNA, 22 nt, Human
ucacauuuauuucaaaguuacu

SEQ ID NO: 704377 - RNA, 22 nt, Human
uuucaucaucaaaauagugagg

SEQ ID NO: 704378 - RNA, 22 nt, Human
acacuuuacagcuuccuuugca

SEQ ID NO: 704379 - RNA, 22 nt, Human
auuugccucugcuuucaaggau

SEQ ID NO: 704380 - RNA, 22 nt, Human
ggguuccagucugaaacuacag

SEQ ID NO: 704381 - RNA, 18 nt, Human
agcugaggggacugaaga

SEQ ID NO: 704382 - RNA, 22 nt, Human
caguaauaaagcuaaguauuuc

SEQ ID NO: 704383 - RNA, 22 nt, Human
aaagucauuuuccagaccagua

SEQ ID NO: 704384 - RNA, 22 nt, Human
cacaccuguaauccuagcacuu

SEQ ID NO: 704385 - RNA, 22 nt, Human
caguuuuaaauuuugaaugucu

SEQ ID NO: 704386 - RNA, 22 nt, Human
uugaagaggacuuugcagcugu

SEQ ID NO: 704387 - RNA, 22 nt, Human
aagaugcagcaaacuacuuuuu

SEQ ID NO: 704388 - RNA, 22 nt, Human
acuggaugaggggaaagagaca

SEQ ID NO: 704389 - RNA, 22 nt, Human
agccuggguggggguucggaga

SEQ ID NO: 704390 - RNA, 22 nt, Human
ugccaggcuuagagcaggggcu

SEQ ID NO: 704391 - RNA, 22 nt, Human
uuuucuuauagagcuuaaaguu

SEQ ID NO: 704392 - RNA, 22 nt, Human
acagaauugauggaaaucucag

SEQ ID NO: 704393 - RNA, 22 nt, Human
aucugucccuccucacagccuc

SEQ ID NO: 704394 - RNA, 22 nt, Human
aggacaguuaguuaggaaguuu

SEQ ID NO: 704395 - RNA, 22 nt, Human
gaggucugagugcggaaagccu

SEQ ID NO: 704396 - RNA, 22 nt, Human
cagcagugucuccagcaucaca

SEQ ID NO: 704397 - RNA, 19 nt, Human
ucuaacagcuuucauucua

SEQ ID NO: 704398 - RNA, 22 nt, Human
ccuuggagaagacagugccagg

SEQ ID NO: 704399 - RNA, 22 nt, Human
cagagcaccagugggagacaag

SEQ ID NO: 704400 - RNA, 22 nt, Human
agggacccauagagagaccagu

SEQ ID NO: 704401 - RNA, 23 nt, Human
agcauggaauaggaaagaggcag

SEQ ID NO: 704402 - RNA, 22 nt, Human
cauuaacacuuuggauuuagac

SEQ ID NO: 704403 - RNA, 22 nt, Human
uguguucuuaaaagcagugaua

SEQ ID NO: 704404 - RNA, 22 nt, Human
gaacagcuucuugggagcuggg

SEQ ID NO: 704405 - RNA, 19 nt, Human
auacagauguauccaugau

SEQ ID NO: 704406 - RNA, 22 nt, Human
aguaacaggguauuuguguggg

SEQ ID NO: 704407 - RNA, 22 nt, Human
gccaggaaggcugaagccagaa

SEQ ID NO: 704408 - RNA, 22 nt, Human
aggcucugugauccacaaugag

SEQ ID NO: 704409 - RNA, 22 nt, Human
auuuucaucgcuagguuggccu

SEQ ID NO: 704410 - RNA, 22 nt, Human
uuaucauugucgcagucuaauu

SEQ ID NO: 704411 - RNA, 22 nt, Human
uguguuccugccuggcucuggu

SEQ ID NO: 704412 - RNA, 20 nt, Human
agaagccaagugacauguuu

SEQ ID NO: 704413 - RNA, 22 nt, Human
aacuguaaugaauuguucauga

SEQ ID NO: 704414 - RNA, 18 nt, Human
aggcuugggcccagcagc

SEQ ID NO: 704415 - RNA, 22 nt, Human
uaacacugauuuguucucaggg

SEQ ID NO: 704416 - RNA, 22 nt, Human
uacauaugaacuuuauaacuug

SEQ ID NO: 704417 - RNA, 22 nt, Human
cucugcugcccaggccugcuag

SEQ ID NO: 704418 - RNA, 22 nt, Human
ggccugggccuuuguguuuuga

SEQ ID NO: 704419 - RNA, 22 nt, Human
cccagcagccuugucccuucuc

SEQ ID NO: 704420 - RNA, 22 nt, Human
uucucagggucuggauggccug

SEQ ID NO: 704421 - RNA, 18 nt, Human
uccugguauugcaagcac

SEQ ID NO: 704422 - RNA, 22 nt, Human
acuuuagaccaucuuccacagu

SEQ ID NO: 704423 - RNA, 22 nt, Human
cugggccuagcaacagaggagu

SEQ ID NO: 704424 - RNA, 22 nt, Human
uggugguuaugcgcuuuguggg

SEQ ID NO: 704425 - RNA, 22 nt, Human
uuccugagggacuuuugagauu

SEQ ID NO: 704426 - RNA, 22 nt, Human
acccaggacucucuuccaguag

SEQ ID NO: 704427 - RNA, 22 nt, Human
ugggcgggcaggagcgcaccug

SEQ ID NO: 704428 - RNA, 22 nt, Human
ccucaggcccugucccugcgcc

SEQ ID NO: 704429 - RNA, 22 nt, Human
cucagcuacgcuuucaccagcu

SEQ ID NO: 704430 - RNA, 19 nt, Human
ggcaccuuucugcuguguc

SEQ ID NO: 704431 - RNA, 23 nt, Human
uggguagagcugcaaggacacug

SEQ ID NO: 704432 - RNA, 22 nt, Human
ucuccugugcacccucccugug

SEQ ID NO: 704433 - RNA, 22 nt, Human
gugagcagaauaaggguugaga

SEQ ID NO: 704434 - RNA, 22 nt, Human
agaaaaacuaagaguggguggu

SEQ ID NO: 704435 - RNA, 22 nt, Human
aucauggaaagguucagcaagc

SEQ ID NO: 704436 - RNA, 22 nt, Human
ccuuuggccgcuuuauggagga

SEQ ID NO: 704437 - RNA, 22 nt, Human
augugcaacuucagcagaaagg

SEQ ID NO: 704438 - RNA, 22 nt, Human
ggaggucacaaggugaguaaag

SEQ ID NO: 704439 - RNA, 22 nt, Human
uaaggucauggugaauaauaag

SEQ ID NO: 704440 - RNA, 22 nt, Human
ugccuccaggaggggcagcucu

SEQ ID NO: 704441 - RNA, 22 nt, Human
aaauugcuaaggaucucaugug

SEQ ID NO: 704442 - RNA, 19 nt, Human
gcacugaagaguuggucac

SEQ ID NO: 704443 - RNA, 18 nt, Human
gugaagcuuuauugaaug

SEQ ID NO: 704444 - RNA, 21 nt, Human
uugccccugaguuuuucugag

SEQ ID NO: 704445 - RNA, 22 nt, Human
cugauagacaaucaccauggga

SEQ ID NO: 704446 - RNA, 22 nt, Human
agagccacaguggauaggagcc

SEQ ID NO: 704447 - RNA, 22 nt, Human
uugaaaugagcaaacugucagc

SEQ ID NO: 704448 - RNA, 22 nt, Human
cacuucauugggaccagggcug

SEQ ID NO: 704449 - RNA, 22 nt, Human
guuuaucugcacucucuuguag

SEQ ID NO: 704450 - RNA, 22 nt, Human
uacauaauugucuuuguccuca

SEQ ID NO: 704451 - RNA, 22 nt, Human
cccuccaccaagcagggcgcca

SEQ ID NO: 704452 - RNA, 22 nt, Human
auccaucuuuccugcugaacug

SEQ ID NO: 704453 - RNA, 22 nt, Human
uucagcaaaauaucucagauag

SEQ ID NO: 704454 - RNA, 18 nt, Human
ggagucucaggagaggaa

SEQ ID NO: 704455 - RNA, 22 nt, Human
acauuuuuauucaucaaagcag

SEQ ID NO: 704456 - RNA, 22 nt, Human
agccacuggccugggcagcucu

SEQ ID NO: 704457 - RNA, 20 nt, Human
cccuccagcaaccaggacuu

SEQ ID NO: 704458 - RNA, 17 nt, Human
cuuugucaccaaugcca

SEQ ID NO: 704459 - RNA, 22 nt, Human
ugagaaauuacuucagugaugg

SEQ ID NO: 704460 - RNA, 22 nt, Human
cguauuucaucuccuuucugcu

SEQ ID NO: 704461 - RNA, 22 nt, Human
gcuugguuacugauggaaagga

SEQ ID NO: 704462 - RNA, 22 nt, Human
gagagugucgggggccccagga

SEQ ID NO: 704463 - RNA, 22 nt, Human
uuacagaaguauugagagaucc

SEQ ID NO: 704464 - RNA, 22 nt, Human
gauugagucugaggaugcugca

SEQ ID NO: 704465 - RNA, 22 nt, Human
uuuauguaaguggaaugaugcc

SEQ ID NO: 704466 - RNA, 22 nt, Human
uucuucuuucccccugugguac

SEQ ID NO: 704467 - RNA, 22 nt, Human
uuuuaucagcagggauaacaag

SEQ ID NO: 704468 - RNA, 22 nt, Human
cccaggcauuuucaacuuuagu

SEQ ID NO: 704469 - RNA, 22 nt, Human
uggcuggcguuggggccaguga

SEQ ID NO: 704470 - RNA, 22 nt, Human
uuuaccaaaugagacuauuguu

SEQ ID NO: 704471 - RNA, 22 nt, Human
gcugggcaaugccagagaggag

SEQ ID NO: 704472 - RNA, 22 nt, Human
gcugccucacuccagcccaaua

SEQ ID NO: 704473 - RNA, 22 nt, Human
ugugauuucaucugaggccagg

SEQ ID NO: 704474 - RNA, 22 nt, Human
gcugugcuauaucucugagugu

SEQ ID NO: 704475 - RNA, 22 nt, Human
caggaggcccggccacagccca

SEQ ID NO: 704476 - RNA, 22 nt, Human
agaguggccucagagaaauaca

SEQ ID NO: 704477 - RNA, 22 nt, Human
gcacauaugcuguaagcacaug

SEQ ID NO: 704478 - RNA, 22 nt, Human
ggaaaugugggcuguuucugua

SEQ ID NO: 704479 - RNA, 22 nt, Human
cucuccuuucacuaaauauucu

SEQ ID NO: 704480 - RNA, 22 nt, Human
cgaggcagggaagcugcaaaag

SEQ ID NO: 704481 - RNA, 21 nt, Human
uucuucaugaugauuaauggc

SEQ ID NO: 704482 - RNA, 22 nt, Human
cuggcuguaugcuggccucaga

SEQ ID NO: 704483 - RNA, 22 nt, Human
ucccacacuugaaacaaggcug

SEQ ID NO: 704484 - RNA, 22 nt, Human
gcggguggaucaugaggucagg

SEQ ID NO: 704485 - RNA, 22 nt, Human
gugaaugcaaacuguuucugau

SEQ ID NO: 704486 - RNA, 22 nt, Human
ugccuggcacuccuggagcuca

SEQ ID NO: 704487 - RNA, 23 nt, Human
uagacacuccuuugucuguccuu

SEQ ID NO: 704488 - RNA, 22 nt, Human
aucuuccuucacuuucucccac

SEQ ID NO: 704489 - RNA, 22 nt, Human
uccucaguuuucuaguauggca

SEQ ID NO: 704490 - RNA, 22 nt, Human
auguaguauuuggaaauguaaa

SEQ ID NO: 704491 - RNA, 22 nt, Human
aagcauucugcauuuucaaaga

SEQ ID NO: 704492 - RNA, 22 nt, Human
auuugcucuagcugcagugaau

SEQ ID NO: 704493 - RNA, 22 nt, Human
aagaguuuaauuuugucuagac

SEQ ID NO: 704494 - RNA, 22 nt, Human
auacuacauacuauguaaacau

SEQ ID NO: 704495 - RNA, 22 nt, Human
ucugugccucaucugguucagg

SEQ ID NO: 704496 - RNA, 22 nt, Human
ucuuuacuggaauggaacuuuc

SEQ ID NO: 704497 - RNA, 22 nt, Human
uggcucugugucucccagcagc

SEQ ID NO: 704498 - RNA, 22 nt, Human
uucaagauggcaccagugagug

SEQ ID NO: 704499 - RNA, 23 nt, Human
ugcuggcuuccagcugcucccuc

SEQ ID NO: 704500 - RNA, 22 nt, Human
ucuuaagcagagaagaaguuga

SEQ ID NO: 704501 - RNA, 20 nt, Human
gcuuccaggagggcugauau

SEQ ID NO: 704502 - RNA, 22 nt, Human
ccuaggccuuacuuuccugugc

SEQ ID NO: 704503 - RNA, 22 nt, Human
uuuacacugugaaacagguauc

SEQ ID NO: 704504 - RNA, 22 nt, Human
uucauagguuugcugugaacau

SEQ ID NO: 704505 - RNA, 22 nt, Human
ugcuuugggucucucuaguuuc

SEQ ID NO: 704506 - RNA, 22 nt, Human
acacaucucaggggacacucuc

SEQ ID NO: 704507 - RNA, 22 nt, Human
cuaggguggauuugugcagagu

SEQ ID NO: 704508 - RNA, 22 nt, Human
aaggcaccauaggcaaauccag

SEQ ID NO: 704509 - RNA, 22 nt, Human
uggcagaauuuuaaagacagau

SEQ ID NO: 704510 - RNA, 22 nt, Human
gcugauguaagacuuuugguuu

SEQ ID NO: 704511 - RNA, 22 nt, Human
uuacagaguagggaauugaagu

SEQ ID NO: 704512 - RNA, 22 nt, Human
aggcagccuauggggagcucag

SEQ ID NO: 704513 - RNA, 23 nt, Human
ugucaaguauagcaggcccuccc

SEQ ID NO: 704514 - RNA, 22 nt, Human
guuuucucaucuccucaauggu

SEQ ID NO: 704515 - RNA, 22 nt, Human
ugagcuguuucucugguggcuu

SEQ ID NO: 704516 - RNA, 22 nt, Human
ggcuccaggugcaugccaggcu

SEQ ID NO: 704517 - RNA, 22 nt, Human
uggcagagaacacggcugaucu

SEQ ID NO: 704518 - RNA, 22 nt, Human
ucucaguggcuuccucacuuuu

SEQ ID NO: 704519 - RNA, 22 nt, Human
ccugccuguacuagagacccag

SEQ ID NO: 704520 - RNA, 22 nt, Human
uauguaguguugagaaugcuug

SEQ ID NO: 704521 - RNA, 19 nt, Human
ugugguuucccggcggccu

SEQ ID NO: 704522 - RNA, 22 nt, Human
uaaaauuugucccugaguguug

SEQ ID NO: 704523 - RNA, 22 nt, Human
uucuuuauguuaaugaaucuau

SEQ ID NO: 704524 - RNA, 22 nt, Human
aggggagaggugagcaacuucu

SEQ ID NO: 704525 - RNA, 22 nt, Human
ggcuagaguggaacuggagcgg

SEQ ID NO: 704526 - RNA, 22 nt, Human
ucugggugcuacaaacaguauu

SEQ ID NO: 704527 - RNA, 22 nt, Human
agugucuguuacgcuugcagaa

SEQ ID NO: 704528 - RNA, 22 nt, Human
uccaggcacuauauauacuuuu

SEQ ID NO: 704529 - RNA, 22 nt, Human
uuggaauuccuguuguuucguc

SEQ ID NO: 704530 - RNA, 22 nt, Human
aaucaguauugguauagaauga

SEQ ID NO: 704531 - RNA, 22 nt, Human
gggcacugagggcccacaggau

SEQ ID NO: 704532 - RNA, 22 nt, Human
aaaccucugaauacuguuggca

SEQ ID NO: 704533 - RNA, 22 nt, Human
ccugguguugugaaguagccgu

SEQ ID NO: 704534 - RNA, 22 nt, Human
uaccaggucugugcagguguca

SEQ ID NO: 704535 - RNA, 22 nt, Human
ucuacauuuucacaaggucucc

SEQ ID NO: 704536 - RNA, 22 nt, Human
cacaauuuggugcuaaagaaag

SEQ ID NO: 704537 - RNA, 22 nt, Human
uccuggguggugguaggagcag

SEQ ID NO: 704538 - RNA, 22 nt, Human
cucuucaguaaaugacacuguu

SEQ ID NO: 704539 - RNA, 22 nt, Human
cuccaggggccagaagccuggc

SEQ ID NO: 704540 - RNA, 22 nt, Human
caguccucugcaacaccccuuc

SEQ ID NO: 704541 - RNA, 22 nt, Human
agucccaacagcuuacaaggaa

SEQ ID NO: 704542 - RNA, 22 nt, Human
cagccagaggcugcgaggggcc

SEQ ID NO: 704543 - RNA, 22 nt, Human
cagcuguggcugccacugcucc

SEQ ID NO: 704544 - RNA, 21 nt, Human
cugugcuuuuuaagugugaug

SEQ ID NO: 704545 - RNA, 19 nt, Human
cugucaggggcuggauguu

SEQ ID NO: 704546 - RNA, 22 nt, Human
uuagggaaagcagcauucccuu

SEQ ID NO: 704547 - RNA, 22 nt, Human
ugaggcaauguccuucauccuu

SEQ ID NO: 704548 - RNA, 22 nt, Human
uggccugacugucaggcuguau

SEQ ID NO: 704549 - RNA, 22 nt, Human
agcucugcaggcacagcugagg

SEQ ID NO: 704550 - RNA, 22 nt, Human
agcauuuaauccuacauagauc

SEQ ID NO: 704551 - RNA, 22 nt, Human
cugauugagaaggaaggggauc

SEQ ID NO: 704552 - RNA, 19 nt, Human
cuggcuucaagcaguccuc

SEQ ID NO: 704553 - RNA, 22 nt, Human
gagcacagcgcaguuuguaauu

SEQ ID NO: 704554 - RNA, 22 nt, Human
ucuagcaucuaauuauggaauc

SEQ ID NO: 704555 - RNA, 22 nt, Human
agacauuggcuaaaaguagugu

SEQ ID NO: 704556 - RNA, 22 nt, Human
agcuggaacgucacaggagcag

SEQ ID NO: 704557 - RNA, 22 nt, Human
uuucagugcacguaguuuauuu

SEQ ID NO: 704558 - RNA, 19 nt, Human
ucaggacugacuugaaguc

SEQ ID NO: 704559 - RNA, 23 nt, Human
gccaggcuccggucuguggccac

SEQ ID NO: 704560 - RNA, 22 nt, Human
aggugaguccugggcacaggua

SEQ ID NO: 704561 - RNA, 22 nt, Human
auaugcauguacgugugcacaa

SEQ ID NO: 704562 - RNA, 22 nt, Human
aggcugcucaguagauggagcu

SEQ ID NO: 704563 - RNA, 17 nt, Human
acaaugcagucucuagu

SEQ ID NO: 704564 - RNA, 22 nt, Human
ugguaaaaaccgcaauuacauu

SEQ ID NO: 704565 - RNA, 22 nt, Human
acacagugccaaauugcaguua

SEQ ID NO: 704566 - RNA, 22 nt, Human
gccagcagguugucaaggagcu

SEQ ID NO: 704567 - RNA, 22 nt, Human
gugugccacugccugaggaccc

SEQ ID NO: 704568 - RNA, 22 nt, Human
aauauugagaaccagcauguuu

SEQ ID NO: 704569 - RNA, 22 nt, Human
aauugcuuaucuuguugaauag

SEQ ID NO: 704570 - RNA, 18 nt, Human
uagauuaaaauugaauuc

SEQ ID NO: 704571 - RNA, 22 nt, Human
guggauggcuaguugagaaggg

SEQ ID NO: 704572 - RNA, 22 nt, Human
gagucacaaaagaugcccaggg

SEQ ID NO: 704573 - RNA, 22 nt, Human
agcugaggccacgagugaaggg

SEQ ID NO: 704574 - RNA, 22 nt, Human
ugacugugccuguugaaugaau

SEQ ID NO: 704575 - RNA, 22 nt, Human
cagcagccuaggguuccaucau

SEQ ID NO: 704576 - RNA, 17 nt, Human
uugaaaaguaagcuccc

SEQ ID NO: 704577 - RNA, 22 nt, Human
ggcuuugcaggcagcaucaagg

SEQ ID NO: 704578 - RNA, 19 nt, Human
gggcaaagugaucguccug

SEQ ID NO: 704579 - RNA, 22 nt, Human
acaaauagagauucaaauaaag

SEQ ID NO: 704580 - RNA, 22 nt, Human
uguguguuggcuggagagggcu

SEQ ID NO: 704581 - RNA, 22 nt, Human
gucacuggggccacaugcagaa

SEQ ID NO: 704582 - RNA, 22 nt, Human
gggccccuugcugcucugcugg

SEQ ID NO: 704583 - RNA, 22 nt, Human
gucagaggggacaagacacaga

SEQ ID NO: 704584 - RNA, 22 nt, Human
uugcuucagaaguucugcuugu

SEQ ID NO: 704585 - RNA, 21 nt, Human
acagagaaagagcagccuccu

SEQ ID NO: 704586 - RNA, 22 nt, Human
augaacucauuuauuuuccucu

SEQ ID NO: 704587 - RNA, 22 nt, Human
ucaguugcaccugcaugguacu

SEQ ID NO: 704588 - RNA, 22 nt, Human
gaaaguauucacaaaguucuug

SEQ ID NO: 704589 - RNA, 22 nt, Human
acugugagcagcgaccugagga

SEQ ID NO: 704590 - RNA, 22 nt, Human
uaaugaacaucuuaaucugaaa

SEQ ID NO: 704591 - RNA, 22 nt, Human
augcaacaaaugcuacgaaucg

SEQ ID NO: 704592 - RNA, 22 nt, Human
gagaggaagccaggggguguug

SEQ ID NO: 704593 - RNA, 22 nt, Human
gaagaauugcccauuucugucu

SEQ ID NO: 704594 - RNA, 22 nt, Human
aggcaaauuauuguaugcaguu

SEQ ID NO: 704595 - RNA, 22 nt, Human
gaggccauaagaaguucuuggg

SEQ ID NO: 704596 - RNA, 22 nt, Human
ccacagugacacgggcuggccc

SEQ ID NO: 704597 - RNA, 22 nt, Human
gguccuugggucuccuguguuu

SEQ ID NO: 704598 - RNA, 22 nt, Human
ucauaaaugcagugucauaaau

SEQ ID NO: 704599 - RNA, 22 nt, Human
gagaacacgaggaggcccagcg

SEQ ID NO: 704600 - RNA, 22 nt, Human
ucccuucaucagugagcaagcc

SEQ ID NO: 704601 - RNA, 22 nt, Human
gauuucaggcuaucuaugcaga

SEQ ID NO: 704602 - RNA, 22 nt, Human
cagaggccccagaacuagcucu

SEQ ID NO: 704603 - RNA, 19 nt, Human
uacacuuguaaugagcaga

SEQ ID NO: 704604 - RNA, 22 nt, Human
ucaggcucuggguacaccugac

SEQ ID NO: 704605 - RNA, 22 nt, Human
uggcucauucuggggaagucag

SEQ ID NO: 704606 - RNA, 22 nt, Human
aaugcacauauauguguauaca

SEQ ID NO: 704607 - RNA, 22 nt, Human
agugggagaaugaauaagggcc

SEQ ID NO: 704608 - RNA, 22 nt, Human
uagaaagcugaguaauacauuu

SEQ ID NO: 704609 - RNA, 22 nt, Human
cagaugcugcucaccugauuau

SEQ ID NO: 704610 - RNA, 22 nt, Human
agccagugucgugugacaugag

SEQ ID NO: 704611 - RNA, 22 nt, Human
auccuucuucugcuagugucua

SEQ ID NO: 704612 - RNA, 20 nt, Human
uuuaucaggcacuuacuauu

SEQ ID NO: 704613 - RNA, 22 nt, Human
uauuucaccuuacuaagcugug

SEQ ID NO: 704614 - RNA, 22 nt, Human
gcaagaccuaucuaguugcugu

SEQ ID NO: 704615 - RNA, 22 nt, Human
aucacaucucaccacugcaacc

SEQ ID NO: 704616 - RNA, 22 nt, Human
aagcacaugagcuauucaugcu

SEQ ID NO: 704617 - RNA, 22 nt, Human
gauucccauccucagcagcagc

SEQ ID NO: 704618 - RNA, 19 nt, Human
agcugggcugucacaguga

SEQ ID NO: 704619 - RNA, 22 nt, Human
uggcugggagcuggaacugggc

SEQ ID NO: 704620 - RNA, 22 nt, Human
gucagaggaauggaugagugau

SEQ ID NO: 704621 - RNA, 22 nt, Human
agcuguggcagcacuuuggagu

SEQ ID NO: 704622 - RNA, 23 nt, Human
uggagcugggcagcugggaaagu

SEQ ID NO: 704623 - RNA, 22 nt, Human
uucugccugauguagucauacc

SEQ ID NO: 704624 - RNA, 22 nt, Human
ccaguucuuucugugugcaaca

SEQ ID NO: 704625 - RNA, 22 nt, Human
gaacuuuauuccagaagaaagc

SEQ ID NO: 704626 - RNA, 19 nt, Human
agauaagaguugacugugg

SEQ ID NO: 704627 - RNA, 22 nt, Human
ucagggcugugguuccuuuucu

SEQ ID NO: 704628 - RNA, 22 nt, Human
uaugugugcuuuuuccaugcau

SEQ ID NO: 704629 - RNA, 22 nt, Human
aacacugauggaaaguauguuu

SEQ ID NO: 704630 - RNA, 22 nt, Human
ucuaaagccuuccauauaacgc

SEQ ID NO: 704631 - RNA, 22 nt, Human
agcuggggguagugagaaauaa

SEQ ID NO: 704632 - RNA, 22 nt, Human
ccagcagagucuaggaaggagg

SEQ ID NO: 704633 - RNA, 21 nt, Human
ucauuuuuauugcuaccuugc

SEQ ID NO: 704634 - RNA, 22 nt, Human
gcacagggcugccaggcggcuu

SEQ ID NO: 704635 - RNA, 22 nt, Human
uuuaacauguaauugcugcuuu

SEQ ID NO: 704636 - RNA, 22 nt, Human
caaaggaggugauaggcccucu

SEQ ID NO: 704637 - RNA, 22 nt, Human
ugucucuugaguuuguuuuaau

SEQ ID NO: 704638 - RNA, 22 nt, Human
auucuucaucacuaccuuguga

SEQ ID NO: 704639 - RNA, 22 nt, Human
ggucugaggcuccaaggaggug

SEQ ID NO: 704640 - RNA, 18 nt, Human
ggcugcuccucucccuac

SEQ ID NO: 704641 - RNA, 19 nt, Human
uucccaggaaaggggugca

SEQ ID NO: 704642 - RNA, 23 nt, Human
uugcauagacauccucauagauu

SEQ ID NO: 704643 - RNA, 22 nt, Human
aaggccacacuugcuggccagc

SEQ ID NO: 704644 - RNA, 22 nt, Human
uccugagcugacacuuggggag

SEQ ID NO: 704645 - RNA, 22 nt, Human
agauacaaaggccuacagagca

SEQ ID NO: 704646 - RNA, 22 nt, Human
uuucaccaagguaaccuuugau

SEQ ID NO: 704647 - RNA, 22 nt, Human
gcuggcauuacaggagagaacc

SEQ ID NO: 704648 - RNA, 20 nt, Human
uggacaggggcauagguugc

SEQ ID NO: 704649 - RNA, 22 nt, Human
guacacacuauguauuguacac

SEQ ID NO: 704650 - RNA, 22 nt, Human
ccugagagccagugccugccca

SEQ ID NO: 704651 - RNA, 22 nt, Human
gcuauuuauuaaaauagugaag

SEQ ID NO: 704652 - RNA, 22 nt, Human
gcuggcugugauuuugccaaca

SEQ ID NO: 704653 - RNA, 22 nt, Human
agaucagagaugcuaaaagagc

SEQ ID NO: 704654 - RNA, 22 nt, Human
uggaagaggccagaaaguggga

SEQ ID NO: 704655 - RNA, 22 nt, Human
uauuucucucacgguugccugg

SEQ ID NO: 704656 - RNA, 22 nt, Human
uagcaaggacaacauaugagag

SEQ ID NO: 704657 - RNA, 22 nt, Human
aucugaaaguuuagaauucuug

SEQ ID NO: 704658 - RNA, 22 nt, Human
gcuauacaaguguagaauagag

SEQ ID NO: 704659 - RNA, 23 nt, Human
cggacaaccauuguuuuaguauc

SEQ ID NO: 704660 - RNA, 22 nt, Human
ccucugcaucuggcugcugcag

SEQ ID NO: 704661 - RNA, 22 nt, Human
gcuuugcuggaaucaacgaaug

SEQ ID NO: 704662 - RNA, 22 nt, Human
cauaacuuuaaagacagugugg

SEQ ID NO: 704663 - RNA, 18 nt, Human
uccagcagcauaguuucc

SEQ ID NO: 704664 - RNA, 22 nt, Human
uugcaaaagccgaggcacucca

SEQ ID NO: 704665 - RNA, 22 nt, Human
cagggcuccccagagagccucu

SEQ ID NO: 704666 - RNA, 22 nt, Human
uccuggcccacuaugccagcau

SEQ ID NO: 704667 - RNA, 22 nt, Human
accucaguucaauucaguuaga

SEQ ID NO: 704668 - RNA, 22 nt, Human
uaaaguagcaaguuuagacuga

SEQ ID NO: 704669 - RNA, 22 nt, Human
uggacaugaccucgagcgagau

SEQ ID NO: 704670 - RNA, 22 nt, Human
uggcuggagaacuuggggaucu

SEQ ID NO: 704671 - RNA, 22 nt, Human
uguuugaauuuugcuaacgugu

SEQ ID NO: 704672 - RNA, 20 nt, Human
ucuccagaugcagaugacau

SEQ ID NO: 704673 - RNA, 22 nt, Human
ugcccugucuaagcugucagua

SEQ ID NO: 704674 - RNA, 22 nt, Human
uuuccuaguucuaagaaaugua

SEQ ID NO: 704675 - RNA, 22 nt, Human
guuuccagagugagggcacuug

SEQ ID NO: 704676 - RNA, 20 nt, Human
ucaugcaagauucauaaagg

SEQ ID NO: 704677 - RNA, 22 nt, Human
ccaaaauuauuacauuuguagg

SEQ ID NO: 704678 - RNA, 22 nt, Human
cagaaauaucaguugaaagugc

SEQ ID NO: 704679 - RNA, 23 nt, Human
aggagccagcccuguucucagua

SEQ ID NO: 704680 - RNA, 22 nt, Human
ugggccauuuuuggaagacugg

SEQ ID NO: 704681 - RNA, 22 nt, Human
ucaaagcacuggggaaagccug

SEQ ID NO: 704682 - RNA, 22 nt, Human
auuugacauuauucucucaguc

SEQ ID NO: 704683 - RNA, 20 nt, Human
uccuccuugcagagcccaga

SEQ ID NO: 704684 - RNA, 22 nt, Human
gugaagguggggagccucaguu

SEQ ID NO: 704685 - RNA, 22 nt, Human
gagguagcucuuacucucuccg

SEQ ID NO: 704686 - RNA, 22 nt, Human
caugcuuacuugucucagcaga

SEQ ID NO: 704687 - RNA, 22 nt, Human
uuggcucaccugucuacccaga

SEQ ID NO: 704688 - RNA, 22 nt, Human
cagacacuaggugacagagugc

SEQ ID NO: 704689 - RNA, 22 nt, Human
uauucacaaaaugagguccuca

SEQ ID NO: 704690 - RNA, 22 nt, Human
cgagcagaagccugguggucug

SEQ ID NO: 704691 - RNA, 22 nt, Human
uuuauuugaaucaggggagaau

SEQ ID NO: 704692 - RNA, 20 nt, Human
uuuuagcacuuguuauggug

SEQ ID NO: 704693 - RNA, 22 nt, Human
uauguuuuaggaauuaauuguu

SEQ ID NO: 704694 - RNA, 22 nt, Human
gauaaacaugggagaaaggaau

SEQ ID NO: 704695 - RNA, 22 nt, Human
ggagcugagcagcgauggcgga

SEQ ID NO: 704696 - RNA, 22 nt, Human
cacauuuaaagguugaagcuga

SEQ ID NO: 704697 - RNA, 18 nt, Human
aaaggcagauuacuggga

SEQ ID NO: 704698 - RNA, 22 nt, Human
uccugagggcgauucagcaggu

SEQ ID NO: 704699 - RNA, 22 nt, Human
uggagcugagaguuaauaagga

SEQ ID NO: 704700 - RNA, 22 nt, Human
gccaccugguggcaucuucugg

SEQ ID NO: 704701 - RNA, 22 nt, Human
uggaacaaauuuuggggaccuu

SEQ ID NO: 704702 - RNA, 22 nt, Human
auagauugcuaguuuuaaaauu

SEQ ID NO: 704703 - RNA, 22 nt, Human
ucccugaaacauaauagaugcc

SEQ ID NO: 704704 - RNA, 22 nt, Human
ugcuguuauacuuagcugguua

SEQ ID NO: 704705 - RNA, 18 nt, Human
ccuggaccugucuccuuu

SEQ ID NO: 704706 - RNA, 18 nt, Human
ugggcuugaaagcaaggu

SEQ ID NO: 704707 - RNA, 22 nt, Human
uguguaaauuuauuuacauaaa

SEQ ID NO: 704708 - RNA, 22 nt, Human
gggagggccagugcucucuaga

SEQ ID NO: 704709 - RNA, 22 nt, Human
gcugccagcccagcaaggugug

SEQ ID NO: 704710 - RNA, 22 nt, Human
gacccguggcaggcugccugcu

SEQ ID NO: 704711 - RNA, 22 nt, Human
ccugcagggugcugccacagau

SEQ ID NO: 704712 - RNA, 22 nt, Human
ggcccaguguggguggauguug

SEQ ID NO: 704713 - RNA, 22 nt, Human
uguguguguccucauuugcaga

SEQ ID NO: 704714 - RNA, 22 nt, Human
ucuaaacuucacuuuaagugcu

SEQ ID NO: 704715 - RNA, 19 nt, Human
uagcugccuguuaccucca

SEQ ID NO: 704716 - RNA, 22 nt, Human
gggaguaaacuauggugaggau

SEQ ID NO: 704717 - RNA, 22 nt, Human
aggcaggaacccugugugcgcc

SEQ ID NO: 704718 - RNA, 22 nt, Human
ccagugggagggagcuaggcca

SEQ ID NO: 704719 - RNA, 22 nt, Human
auuuaugauuagccuauuguug

SEQ ID NO: 704720 - RNA, 22 nt, Human
uaaggaaggggaaagacauguc

SEQ ID NO: 704721 - RNA, 22 nt, Human
augaagacaaacuggguagaaa

SEQ ID NO: 704722 - RNA, 22 nt, Human
ggcucccuguucuauucccugg

SEQ ID NO: 704723 - RNA, 22 nt, Human
uuagaaccauaaugaaucaaug

SEQ ID NO: 704724 - RNA, 22 nt, Human
ugcucccuugccagaggggaag

SEQ ID NO: 704725 - RNA, 22 nt, Human
ucugugugggauaguuugagga

SEQ ID NO: 704726 - RNA, 22 nt, Human
acaggggugcauggugcauggu

SEQ ID NO: 704727 - RNA, 22 nt, Human
augaggcagauguugcaugagg

SEQ ID NO: 704728 - RNA, 22 nt, Human
gagagccaugguggagaugggg

SEQ ID NO: 704729 - RNA, 22 nt, Human
uuucucaaccucaacacuauuu

SEQ ID NO: 704730 - RNA, 22 nt, Human
cagcuucccagcucacucauaa

SEQ ID NO: 704731 - RNA, 22 nt, Human
auucuggguuuuugucuucugu

SEQ ID NO: 704732 - RNA, 22 nt, Human
agcacagaaagcacauuugaaa

SEQ ID NO: 704733 - RNA, 22 nt, Human
aggcuuuaauuaucuacaggag

SEQ ID NO: 704734 - RNA, 22 nt, Human
gcugcccagcaggccccagggg

SEQ ID NO: 704735 - RNA, 18 nt, Human
uuucuuucugccuggggc

SEQ ID NO: 704736 - RNA, 22 nt, Human
uaccaguaauguaacuuugcaa

SEQ ID NO: 704737 - RNA, 22 nt, Human
uggcccagugcuuaugcucuga

SEQ ID NO: 704738 - RNA, 22 nt, Human
gagucauuguuggucccucccc

SEQ ID NO: 704739 - RNA, 22 nt, Human
aucuagcaguguuauaauugga

SEQ ID NO: 704740 - RNA, 20 nt, Human
uuucacaaugaacaugucuc

SEQ ID NO: 704741 - RNA, 22 nt, Human
ccugggcucugaggagggaguc

SEQ ID NO: 704742 - RNA, 22 nt, Human
uuccaaguccagccaggccaaa

SEQ ID NO: 704743 - RNA, 22 nt, Human
ucagucccuuaaagguggcagc

SEQ ID NO: 704744 - RNA, 22 nt, Human
ggaggugcugaucccagucaac

SEQ ID NO: 704745 - RNA, 22 nt, Human
agcaaacagugugcuaagaaau

SEQ ID NO: 704746 - RNA, 22 nt, Human
uagcuuuaaaaaucaucaaagc

SEQ ID NO: 704747 - RNA, 22 nt, Human
ucugggaacagcuuagcuccag

SEQ ID NO: 704748 - RNA, 22 nt, Human
cacagcaauagcuaacugauac

SEQ ID NO: 704749 - RNA, 22 nt, Human
augcaaauaaacagucuaguug

SEQ ID NO: 704750 - RNA, 22 nt, Human
gcagcugugggccucggagagc

SEQ ID NO: 704751 - RNA, 23 nt, Human
ucugggcugagcucgaguguaga

SEQ ID NO: 704752 - RNA, 22 nt, Human
cguggcuggggcgacuccacgg

SEQ ID NO: 704753 - RNA, 22 nt, Human
aaucacaaaugcaaguugucac

SEQ ID NO: 704754 - RNA, 22 nt, Human
ucucugcugagaagggcuggca

SEQ ID NO: 704755 - RNA, 22 nt, Human
ugguccuucuugaagagugagu

SEQ ID NO: 704756 - RNA, 22 nt, Human
uccugccauuugcuuuuucucc

SEQ ID NO: 704757 - RNA, 22 nt, Human
ugguggcagcugggacagaggu

SEQ ID NO: 704758 - RNA, 22 nt, Human
aggcuuccuggaggaagaggua

SEQ ID NO: 704759 - RNA, 22 nt, Human
aggggugugcauccuggaggau

SEQ ID NO: 704760 - RNA, 22 nt, Human
cacaucuucuuaacuccaaagu

SEQ ID NO: 704761 - RNA, 22 nt, Human
uaaguuucuacuugucgggucu

SEQ ID NO: 704762 - RNA, 20 nt, Human
gagugcuuuggcuugcucuc

SEQ ID NO: 704763 - RNA, 22 nt, Human
gcuggagguggugagaaaaggu

SEQ ID NO: 704764 - RNA, 22 nt, Human
aggcuccagucuccucuggcag

SEQ ID NO: 704765 - RNA, 22 nt, Human
uauuuucauucugugugacugu

SEQ ID NO: 704766 - RNA, 22 nt, Human
aaggaacugcugauguggugac

SEQ ID NO: 704767 - RNA, 22 nt, Human
acaaauuugaauccugacuucu

SEQ ID NO: 704768 - RNA, 22 nt, Human
uccaucuggugagugaggagcc

SEQ ID NO: 704769 - RNA, 22 nt, Human
acugucaccuaaauuuucauug

SEQ ID NO: 704770 - RNA, 23 nt, Human
agacaguggccgagagguacuag

SEQ ID NO: 704771 - RNA, 22 nt, Human
aaaaggaggucacuuuauuccu

SEQ ID NO: 704772 - RNA, 22 nt, Human
cugccccaggaccucuucugga

SEQ ID NO: 704773 - RNA, 22 nt, Human
cuaguguacaagugguggagau

SEQ ID NO: 704774 - RNA, 18 nt, Human
agcaaagcaagagaucac

SEQ ID NO: 704775 - RNA, 21 nt, Human
acaggagaccgccuggcaguc

SEQ ID NO: 704776 - RNA, 18 nt, Human
gaugggguccaggcauag

SEQ ID NO: 704777 - RNA, 22 nt, Human
auuuuccuucuaagaggaaggu

SEQ ID NO: 704778 - RNA, 22 nt, Human
agaggccuaaccaagauguccu

SEQ ID NO: 704779 - RNA, 22 nt, Human
aggaggccgggauucuggagau

SEQ ID NO: 704780 - RNA, 18 nt, Human
cuccagagcugugagaca

SEQ ID NO: 704781 - RNA, 22 nt, Human
ucugccuggauuuuggaaagcu

SEQ ID NO: 704782 - RNA, 22 nt, Human
uggucugagcaacugcccuauc

SEQ ID NO: 704783 - RNA, 22 nt, Human
gcauguggcccaaggaggcugu

SEQ ID NO: 704784 - RNA, 22 nt, Human
uagacaaugccaucuugugguu

SEQ ID NO: 704785 - RNA, 22 nt, Human
agcugcucuucauuucccccca

SEQ ID NO: 704786 - RNA, 22 nt, Human
guuuccauggcucuguuaaugg

SEQ ID NO: 704787 - RNA, 22 nt, Human
gacuccauccaaucuguguucu

SEQ ID NO: 704788 - RNA, 22 nt, Human
uccugggacucuuuaucagaga

SEQ ID NO: 704789 - RNA, 21 nt, Human
agguggggcugcaccucugcu

SEQ ID NO: 704790 - RNA, 22 nt, Human
caagagagaugcagcucacuca

SEQ ID NO: 704791 - RNA, 22 nt, Human
gaugcuccaaacagcaauucuu

SEQ ID NO: 704792 - RNA, 22 nt, Human
aucauuuaugccccaauuagau

SEQ ID NO: 704793 - RNA, 22 nt, Human
uacacauaggucugaauaaaaa

SEQ ID NO: 704794 - RNA, 22 nt, Human
gagcauggaucaugugcugggu

SEQ ID NO: 704795 - RNA, 22 nt, Human
guuuagaccaaucauaauuuau

SEQ ID NO: 704796 - RNA, 22 nt, Human
guuaucuucccuuugaugauuu

SEQ ID NO: 704797 - RNA, 22 nt, Human
aaagacagauggcaaggaugau

SEQ ID NO: 704798 - RNA, 22 nt, Human
gagucaggaguccugugugaga

SEQ ID NO: 704799 - RNA, 22 nt, Human
gggaaggacauucugggcucag

SEQ ID NO: 704800 - RNA, 22 nt, Human
cccaggaaaugggcucuugccu

SEQ ID NO: 704801 - RNA, 22 nt, Human
acccuuugucaagcacagaaga

SEQ ID NO: 704802 - RNA, 22 nt, Human
ucagggaacaucguuaaacuag

SEQ ID NO: 704803 - RNA, 22 nt, Human
ucuuuuagagcauuucugauuc

SEQ ID NO: 704804 - RNA, 22 nt, Human
uuggcuuucagaaucccuaucu

SEQ ID NO: 704805 - RNA, 22 nt, Human
uuucaaacuuuacucuugaauc

SEQ ID NO: 704806 - RNA, 22 nt, Human
ggcaggcugggagucaucagag

SEQ ID NO: 704807 - RNA, 22 nt, Human
augccagggucauccccugggu

SEQ ID NO: 704808 - RNA, 22 nt, Human
ugcaaggcuugcaauggugauc

SEQ ID NO: 704809 - RNA, 22 nt, Human
uagauuuuacuucugucauuac

SEQ ID NO: 704810 - RNA, 22 nt, Human
aguguguacucauauacuucca

SEQ ID NO: 704811 - RNA, 22 nt, Human
agcuucuugaccaagccuguaa

SEQ ID NO: 704812 - RNA, 22 nt, Human
cacaugaguguaggaagaggga

SEQ ID NO: 704813 - RNA, 22 nt, Human
uccaggcaucccccaggacaga

SEQ ID NO: 704814 - RNA, 22 nt, Human
uuuaagaugguauuuuauaaag

SEQ ID NO: 704815 - RNA, 22 nt, Human
cuggccacaacuagcccaggac

SEQ ID NO: 704816 - RNA, 22 nt, Human
gggcugaugugacagaacucuc

SEQ ID NO: 704817 - RNA, 19 nt, Human
cauauuuuugggcuggcau

SEQ ID NO: 704818 - RNA, 22 nt, Human
ggcagagacuggguuggcagag

SEQ ID NO: 704819 - RNA, 22 nt, Human
uguuaaauguauuauguguucu

SEQ ID NO: 704820 - RNA, 22 nt, Human
aggaggugcuguuuguccugga

SEQ ID NO: 704821 - RNA, 22 nt, Human
agauacauagcugugagcacac

SEQ ID NO: 704822 - RNA, 22 nt, Human
uagcaaccuauggauagagaag

SEQ ID NO: 704823 - RNA, 22 nt, Human
ugcagcaauuugcaguaauuua

SEQ ID NO: 704824 - RNA, 22 nt, Human
acccugggcuuggccugcucag

SEQ ID NO: 704825 - RNA, 22 nt, Human
cauuucaauacaguuuguaaau

SEQ ID NO: 704826 - RNA, 22 nt, Human
acuguguccucauguggcagaa

SEQ ID NO: 704827 - RNA, 22 nt, Human
uucagcuucauuugucuuuaug

SEQ ID NO: 704828 - RNA, 22 nt, Human
agcccccaggagucuccacgcc

SEQ ID NO: 704829 - RNA, 22 nt, Human
uaucuguuuauuguuacuguca

SEQ ID NO: 704830 - RNA, 22 nt, Human
cuugggaacugccuugccuuug

SEQ ID NO: 704831 - RNA, 22 nt, Human
cccaggcacagauuaucccaau

SEQ ID NO: 704832 - RNA, 22 nt, Human
uggcagcuauggucuaagggcc

SEQ ID NO: 704833 - RNA, 22 nt, Human
cccaggcagugcugaucccuca

SEQ ID NO: 704834 - RNA, 23 nt, Human
ugggagacuuuucauuuuguucu

SEQ ID NO: 704835 - RNA, 20 nt, Human
gagggcaggcacccauuuca

SEQ ID NO: 704836 - RNA, 22 nt, Human
gccucugcaggugcgguuaucc

SEQ ID NO: 704837 - RNA, 22 nt, Human
ggugaggggcuccucugcccgg

SEQ ID NO: 704838 - RNA, 22 nt, Human
aagcagaaggggaauaauauuu

SEQ ID NO: 704839 - RNA, 22 nt, Human
ucugcuucuccuacuucauggg

SEQ ID NO: 704840 - RNA, 22 nt, Human
aucugcuuagaauucauugucc

SEQ ID NO: 704841 - RNA, 18 nt, Human
aaaggcauauauagaagu

SEQ ID NO: 704842 - RNA, 22 nt, Human
cuucacagagucccugauuguu

SEQ ID NO: 704843 - RNA, 22 nt, Human
uuccaugccuagaacaggauuc

SEQ ID NO: 704844 - RNA, 22 nt, Human
acacagugguguuuacaaaauu

SEQ ID NO: 704845 - RNA, 22 nt, Human
gauuucuuuaugaaguacagaa

SEQ ID NO: 704846 - RNA, 22 nt, Human
agcuauguauaaauaggccacu

SEQ ID NO: 704847 - RNA, 22 nt, Human
cucugaaauuggcccucagcag

SEQ ID NO: 704848 - RNA, 19 nt, Human
gcauccauggaggccgcuu

SEQ ID NO: 704849 - RNA, 22 nt, Human
uacauugauggaguaccuagcu

SEQ ID NO: 704850 - RNA, 22 nt, Human
uucacuguaugagagggcuuga

SEQ ID NO: 704851 - RNA, 22 nt, Human
uagcucuggcauucuuuccaaa

SEQ ID NO: 704852 - RNA, 22 nt, Human
uacagugucccuuuuucagaca

SEQ ID NO: 704853 - RNA, 19 nt, Human
uuucuuaggccuuuggccu

SEQ ID NO: 704854 - RNA, 22 nt, Human
ugucagugguagacccagaggu

SEQ ID NO: 704855 - RNA, 22 nt, Human
aagcccagcucugccugcucug

SEQ ID NO: 704856 - RNA, 22 nt, Human
ugugggaagauguugcaggaga

SEQ ID NO: 704857 - RNA, 22 nt, Human
ccucacccagucaccuaggugg

SEQ ID NO: 704858 - RNA, 22 nt, Human
uucuggaauccucaaaacauga

SEQ ID NO: 704859 - RNA, 23 nt, Human
cacaccaggagccgucugggcca

SEQ ID NO: 704860 - RNA, 22 nt, Human
ugcaucauuuauaaugucuuug

SEQ ID NO: 704861 - RNA, 22 nt, Human
cauuaugugggaaaauguucuu

SEQ ID NO: 704862 - RNA, 22 nt, Human
aggcacugauucucagaguuac

SEQ ID NO: 704863 - RNA, 22 nt, Human
acaacacagcuuuccucaaguu

SEQ ID NO: 704864 - RNA, 22 nt, Human
aaggcacuuaacgugggaggau

SEQ ID NO: 704865 - RNA, 22 nt, Human
aaaugcacagguuuuaaauccu

SEQ ID NO: 704866 - RNA, 22 nt, Human
ugaugaaauguugaggcaguga

SEQ ID NO: 704867 - RNA, 22 nt, Human
aguggcagccgagcaggagaug

SEQ ID NO: 704868 - RNA, 17 nt, Human
ugaguggccgggggaca

SEQ ID NO: 704869 - RNA, 23 nt, Human
guuccuucauguggucauugguu

SEQ ID NO: 704870 - RNA, 22 nt, Human
uugccuuguuauucucucagaa

SEQ ID NO: 704871 - RNA, 21 nt, Human
ucccucagaagcucuugguca

SEQ ID NO: 704872 - RNA, 22 nt, Human
gguucacacuaagcuuaagugg

SEQ ID NO: 704873 - RNA, 22 nt, Human
cagucacacaaguggacuuggg

SEQ ID NO: 704874 - RNA, 19 nt, Human
uguguccuagcagccaguc

SEQ ID NO: 704875 - RNA, 22 nt, Human
uugcccugcggguccugcgcaa

SEQ ID NO: 704876 - RNA, 20 nt, Human
gcucaguggagaaaugcacc

SEQ ID NO: 704877 - RNA, 22 nt, Human
aaucauugagacaaauuagcuu

SEQ ID NO: 704878 - RNA, 22 nt, Human
caguguuuguugagaaaggcaa

SEQ ID NO: 704879 - RNA, 19 nt, Human
ggacuugguuuccaggcuc

SEQ ID NO: 704880 - RNA, 22 nt, Human
ggaaaaggccacagggacacau

SEQ ID NO: 704881 - RNA, 22 nt, Human
ugcucaguccuaccuuggcucc

SEQ ID NO: 704882 - RNA, 22 nt, Human
uagggcuuugcucauccuaggu

SEQ ID NO: 704883 - RNA, 22 nt, Human
ucuucauucucgccuuugucgu

SEQ ID NO: 704884 - RNA, 22 nt, Human
uggagcuggaagaauguagacg

SEQ ID NO: 704885 - RNA, 22 nt, Human
cccuuuaaguccuggaacaaag

SEQ ID NO: 704886 - RNA, 22 nt, Human
gcuccagguauuugcccuuuua

SEQ ID NO: 704887 - RNA, 22 nt, Human
uucaggauaguggugaguggca

SEQ ID NO: 704888 - RNA, 22 nt, Human
acaauagaaggaaacugacaua

SEQ ID NO: 704889 - RNA, 22 nt, Human
ucuucauuuuauagcaucugug

SEQ ID NO: 704890 - RNA, 20 nt, Human
gcugcucgcugcagucacuc

SEQ ID NO: 704891 - RNA, 22 nt, Human
gaacacaguacuuuuccugaug

SEQ ID NO: 704892 - RNA, 22 nt, Human
ucagaacagaagcuggcuauaa

SEQ ID NO: 704893 - RNA, 22 nt, Human
gugcccucacaaaguggaaaga

SEQ ID NO: 704894 - RNA, 23 nt, Human
gugcuugaaagaugcagaauuaa

SEQ ID NO: 704895 - RNA, 22 nt, Human
acuucaugcagaagagagcugu

SEQ ID NO: 704896 - RNA, 22 nt, Human
gggcuccaguuguccccaggau

SEQ ID NO: 704897 - RNA, 22 nt, Human
agaagccacaggccucgucugg

SEQ ID NO: 704898 - RNA, 22 nt, Human
aggucugaaagccucagucaca

SEQ ID NO: 704899 - RNA, 22 nt, Human
ggcuucucagcacacuguccac

SEQ ID NO: 704900 - RNA, 22 nt, Human
uaucagcaagauggcaguauag

SEQ ID NO: 704901 - RNA, 22 nt, Human
ccuuugcauucuagauguuuag

SEQ ID NO: 704902 - RNA, 22 nt, Human
gcuucugcagagccguccugag

SEQ ID NO: 704903 - RNA, 22 nt, Human
cucuuuuaugugacguguguga

SEQ ID NO: 704904 - RNA, 22 nt, Human
uucaugauaguauuuuuuguga

SEQ ID NO: 704905 - RNA, 22 nt, Human
guucagauuugacugguuucuc

SEQ ID NO: 704906 - RNA, 22 nt, Human
aucaggauccaccuugagccug

SEQ ID NO: 704907 - RNA, 22 nt, Human
gcuguacaguuuacuagguggg

SEQ ID NO: 704908 - RNA, 22 nt, Human
aaauuuaaggaggugcucacuu

SEQ ID NO: 704909 - RNA, 22 nt, Human
auucagcagccauggcuucuga

SEQ ID NO: 704910 - RNA, 22 nt, Human
uuuaucucuuuugaccaagauu

SEQ ID NO: 704911 - RNA, 22 nt, Human
cucuccagguuagagcacuuau

SEQ ID NO: 704912 - RNA, 23 nt, Human
uugcaaaaugagucuugagugaa

SEQ ID NO: 704913 - RNA, 22 nt, Human
caauguaucaagaagcaucagu

SEQ ID NO: 704914 - RNA, 22 nt, Human
acuguauuuggauauaagaucu

SEQ ID NO: 704915 - RNA, 22 nt, Human
caggaaaugggucguuuuauaa

SEQ ID NO: 704916 - RNA, 22 nt, Human
uggcugcuuguuuuagugaggc

SEQ ID NO: 704917 - RNA, 22 nt, Human
caguuuuucaaaauuacaugau

SEQ ID NO: 704918 - RNA, 22 nt, Human
cagggccagagagggcuggcug

SEQ ID NO: 704919 - RNA, 22 nt, Human
uaggcauuuaagauggauaagg

SEQ ID NO: 704920 - RNA, 19 nt, Human
cucucuccaguggcuggcu

SEQ ID NO: 704921 - RNA, 22 nt, Human
caggucugugugccauuuccaa

SEQ ID NO: 704922 - RNA, 22 nt, Human
acuguggccugcuguaugggcu

SEQ ID NO: 704923 - RNA, 22 nt, Human
uuggcccuggcacacccccacg

SEQ ID NO: 704924 - RNA, 22 nt, Human
aacaaucaaguuucuaaaugac

SEQ ID NO: 704925 - RNA, 22 nt, Human
aggaagagcaucuuugggucug

SEQ ID NO: 704926 - RNA, 19 nt, Human
aacaccagagucaggaguc

SEQ ID NO: 704927 - RNA, 22 nt, Human
cagaugugcaugaugggaaggg

SEQ ID NO: 704928 - RNA, 22 nt, Human
uucacauugaaggugcuuucuu

SEQ ID NO: 704929 - RNA, 22 nt, Human
cuaacuuuauuugcuaaguaga

SEQ ID NO: 704930 - RNA, 22 nt, Human
cagggccccagggaugucugcu

SEQ ID NO: 704931 - RNA, 22 nt, Human
ccaguggacuucucccuguggu

SEQ ID NO: 704932 - RNA, 22 nt, Human
aaagcaauagaggguaagacug

SEQ ID NO: 704933 - RNA, 22 nt, Human
caggaaauaucuccuggcagag

SEQ ID NO: 704934 - RNA, 22 nt, Human
agucccagcccaguccuguaag

SEQ ID NO: 704935 - RNA, 22 nt, Human
uacagccugauuuggagccacu

SEQ ID NO: 704936 - RNA, 22 nt, Human
auauuuguugaguucuuaugau

SEQ ID NO: 704937 - RNA, 22 nt, Human
uuccacuccuccugguggggug

SEQ ID NO: 704938 - RNA, 19 nt, Human
uccugcugugugaagggga

SEQ ID NO: 704939 - RNA, 22 nt, Human
gccaggacggugaaugggcuac

SEQ ID NO: 704940 - RNA, 22 nt, Human
cauuuaguuauacuaaaacauu

SEQ ID NO: 704941 - RNA, 22 nt, Human
uuacaugagguuaauuaagcau

SEQ ID NO: 704942 - RNA, 22 nt, Human
agaaauguacacgacacccaga

SEQ ID NO: 704943 - RNA, 22 nt, Human
ucaauacuuaagcuuaauucua

SEQ ID NO: 704944 - RNA, 22 nt, Human
gguuucuagcagagucucuuua

SEQ ID NO: 704945 - RNA, 22 nt, Human
cugagcugugcuaagugaaaug

SEQ ID NO: 704946 - RNA, 22 nt, Human
cauagaaacuugcagcaagcac

SEQ ID NO: 704947 - RNA, 22 nt, Human
uggcagaggaggcucagauuga

SEQ ID NO: 704948 - RNA, 22 nt, Human
gccccuucuucuggagauucaa

SEQ ID NO: 704949 - RNA, 22 nt, Human
cagugcuggcuguuaggacagu

SEQ ID NO: 704950 - RNA, 22 nt, Human
gcuaggagugggauggaagucg

SEQ ID NO: 704951 - RNA, 22 nt, Human
acacuguaaagugaugcuuaaa

SEQ ID NO: 704952 - RNA, 22 nt, Human
aaagacauggaacuagagaugg

SEQ ID NO: 704953 - RNA, 22 nt, Human
uccaagaaguuuauguuguuuc

SEQ ID NO: 704954 - RNA, 22 nt, Human
ugagccaaguucacaccauugc

SEQ ID NO: 704955 - RNA, 22 nt, Human
agcucagaagccuaugcauagu

SEQ ID NO: 704956 - RNA, 22 nt, Human
caggaagugccuggugagagga

SEQ ID NO: 704957 - RNA, 21 nt, Human
acacaggcagugucccgaggu

SEQ ID NO: 704958 - RNA, 19 nt, Human
gugcuuuuuaagagcucag

SEQ ID NO: 704959 - RNA, 22 nt, Human
uaaagucauaagaguggauccg

SEQ ID NO: 704960 - RNA, 22 nt, Human
ucucuguggguuucaccagcgc

SEQ ID NO: 704961 - RNA, 22 nt, Human
uauguacauggagagcaauuga

SEQ ID NO: 704962 - RNA, 22 nt, Human
cuggcagggugggcuuugcuuu

SEQ ID NO: 704963 - RNA, 22 nt, Human
ucugggagagcugcugucagag

SEQ ID NO: 704964 - RNA, 22 nt, Human
gcacagccagcaucugagggau

SEQ ID NO: 704965 - RNA, 22 nt, Human
accccagaggcggaggcugcag

SEQ ID NO: 704966 - RNA, 22 nt, Human
uucaggcauggaaacuggauua

SEQ ID NO: 704967 - RNA, 22 nt, Human
gcuuucugguucucaaagcacu

SEQ ID NO: 704968 - RNA, 22 nt, Human
uucagauaagucaaguuaguau

SEQ ID NO: 704969 - RNA, 22 nt, Human
ggaguggcacucugaggcgggg

SEQ ID NO: 704970 - RNA, 22 nt, Human
aacuccagggucaccauucaca

SEQ ID NO: 704971 - RNA, 22 nt, Human
agcugguugcuuaaccucucug

SEQ ID NO: 704972 - RNA, 22 nt, Human
uucaguauauuacucuugucaa

SEQ ID NO: 704973 - RNA, 22 nt, Human
gcugguccagggccucuguggg

SEQ ID NO: 704974 - RNA, 22 nt, Human
gagcaguaggagaacccugagc

SEQ ID NO: 704975 - RNA, 22 nt, Human
uucagaaacaucaguggaugga

SEQ ID NO: 704976 - RNA, 22 nt, Human
cugcuuggaguccuccagcacc

SEQ ID NO: 704977 - RNA, 22 nt, Human
ugggaugcccugacccucugga

SEQ ID NO: 704978 - RNA, 22 nt, Human
guggcucagcggagcucugcac

SEQ ID NO: 704979 - RNA, 22 nt, Human
uuacagauguuucaggaauacu

SEQ ID NO: 704980 - RNA, 22 nt, Human
cugcucuggcguacucggcauc

SEQ ID NO: 704981 - RNA, 22 nt, Human
ucccagaguuuccuguguccca

SEQ ID NO: 704982 - RNA, 22 nt, Human
ucaggacauuugucagcaggag

SEQ ID NO: 704983 - RNA, 22 nt, Human
gaccuggccugcacagcccuua

SEQ ID NO: 704984 - RNA, 22 nt, Human
uuaaaugaugcauaucauuuag

SEQ ID NO: 704985 - RNA, 17 nt, Human
ucauuucaguaaaucca

SEQ ID NO: 704986 - RNA, 22 nt, Human
caaggagaaaacggcuucugaa

SEQ ID NO: 704987 - RNA, 22 nt, Human
cacauggggcgcugcauuggcc

SEQ ID NO: 704988 - RNA, 22 nt, Human
uguccaggcggccuugccuguu

SEQ ID NO: 704989 - RNA, 22 nt, Human
agaaguggucugucuuccagau

SEQ ID NO: 704990 - RNA, 22 nt, Human
uucuagauagagugcaaauuau

SEQ ID NO: 704991 - RNA, 22 nt, Human
guguucauggaugucaauuuga

SEQ ID NO: 704992 - RNA, 22 nt, Human
aacacaugccuuaagaauaagu

SEQ ID NO: 704993 - RNA, 16 nt, Human
ucucugcuucauaggu

SEQ ID NO: 704994 - RNA, 22 nt, Human
augaagucuagcaagcauugaa

SEQ ID NO: 704995 - RNA, 19 nt, Human
cagagccucagagcuagaa

SEQ ID NO: 704996 - RNA, 22 nt, Human
caauauauaaugaguacuuucc

SEQ ID NO: 704997 - RNA, 22 nt, Human
cauuuauugguuaggccagcag

SEQ ID NO: 704998 - RNA, 22 nt, Human
ugcugguaccgcgccuccgcca

SEQ ID NO: 704999 - RNA, 22 nt, Human
ugcuggaagaaaauucuuuaac

SEQ ID NO: 705000 - RNA, 22 nt, Human
ucugccugaaauucacauguaa

SEQ ID NO: 705001 - RNA, 22 nt, Human
uuucaaacuuaaauaccuuucc

SEQ ID NO: 705002 - RNA, 22 nt, Human
caguaggaaggaugcagaaaaa

SEQ ID NO: 705003 - RNA, 18 nt, Human
ugagcagaguaaggcuuu

SEQ ID NO: 705004 - RNA, 22 nt, Human
uagauuuccucuuccucauucc

SEQ ID NO: 705005 - RNA, 22 nt, Human
gaagcuucuggcauuucucaaa

SEQ ID NO: 705006 - RNA, 22 nt, Human
ugaauaugugacuuugauuuca

SEQ ID NO: 705007 - RNA, 22 nt, Human
caucuuuugguaggagccgggc

SEQ ID NO: 705008 - RNA, 19 nt, Human
cucugaggauuagcugugg

SEQ ID NO: 705009 - RNA, 22 nt, Human
ugcaggccucacaccuggcacc

SEQ ID NO: 705010 - RNA, 22 nt, Human
cucucuggcuuggcacggagau

SEQ ID NO: 705011 - RNA, 22 nt, Human
auaaagcauacuuuguaugacu

SEQ ID NO: 705012 - RNA, 22 nt, Human
gugaauggggcaggaaggaugg

SEQ ID NO: 705013 - RNA, 22 nt, Human
ucagcacugucuauuagugaga

SEQ ID NO: 705014 - RNA, 22 nt, Human
ugucugaguggugcaaggcuga

SEQ ID NO: 705015 - RNA, 22 nt, Human
uccacagacuauuaagugaucu

SEQ ID NO: 705016 - RNA, 22 nt, Human
uugaaugaggaagagcacuggc

SEQ ID NO: 705017 - RNA, 22 nt, Human
uacaauguugguaaaguaucau

SEQ ID NO: 705018 - RNA, 22 nt, Human
ggggaggaagcuggaacacggg

SEQ ID NO: 705019 - RNA, 22 nt, Human
aauuaugguauguucaacaacu

SEQ ID NO: 705020 - RNA, 20 nt, Human
uuguuucugcuauuuucuaa

SEQ ID NO: 705021 - RNA, 22 nt, Human
cuguggcauuuagagguugcgu

SEQ ID NO: 705022 - RNA, 22 nt, Human
ucucuuaauuguaaugguuccu

SEQ ID NO: 705023 - RNA, 22 nt, Human
ucacccaggcuggugcgcagug

SEQ ID NO: 705024 - RNA, 22 nt, Human
ugccugcugccuuucaucccaa

SEQ ID NO: 705025 - RNA, 22 nt, Human
cucaguccagggaccggccucc

SEQ ID NO: 705026 - RNA, 21 nt, Human
uucugccuucgaggucucagg

SEQ ID NO: 705027 - RNA, 19 nt, Human
uuugccuugcagcugugug

SEQ ID NO: 705028 - RNA, 22 nt, Human
acucacuagagguagaucccug

SEQ ID NO: 705029 - RNA, 22 nt, Human
cagauggcugccuucuugcugu

SEQ ID NO: 705030 - RNA, 22 nt, Human
aaagcugcccuugugaaacaag

SEQ ID NO: 705031 - RNA, 22 nt, Human
aagauucuacaguagguacauu

SEQ ID NO: 705032 - RNA, 22 nt, Human
ugaauggucacugagcaucugu

SEQ ID NO: 705033 - RNA, 22 nt, Human
caaagcaggaagcuccugacag

SEQ ID NO: 705034 - RNA, 22 nt, Human
guggggaguguucugugauugg

SEQ ID NO: 705035 - RNA, 22 nt, Human
ucaugcaucugggcuggcuggu

SEQ ID NO: 705036 - RNA, 22 nt, Human
ugggccugggcuggacagccug

SEQ ID NO: 705037 - RNA, 22 nt, Human
aaccugaaaguaguaaaagcug

SEQ ID NO: 705038 - RNA, 22 nt, Human
ugccuggcagcuugaaagaaau

SEQ ID NO: 705039 - RNA, 22 nt, Human
uguaugcacauauauagguaca

SEQ ID NO: 705040 - RNA, 19 nt, Human
uucuggggccuggccuugg

SEQ ID NO: 705041 - RNA, 22 nt, Human
ucuggggaauguucauuucuga

SEQ ID NO: 705042 - RNA, 22 nt, Human
aaacucuagggcuccacauucc

SEQ ID NO: 705043 - RNA, 22 nt, Human
gcacagugauaggcaguugugc

SEQ ID NO: 705044 - RNA, 22 nt, Human
ugcauauuuucugauucagaag

SEQ ID NO: 705045 - RNA, 22 nt, Human
acagugaaaauucuauugauuu

SEQ ID NO: 705046 - RNA, 22 nt, Human
agcaccugcacaguggaggaaa

SEQ ID NO: 705047 - RNA, 22 nt, Human
ucacaccuguaaucccaggccu

SEQ ID NO: 705048 - RNA, 22 nt, Human
cuggcuggcagaugcucuugcu

SEQ ID NO: 705049 - RNA, 22 nt, Human
gcagugaacauaacacagaagg

SEQ ID NO: 705050 - RNA, 22 nt, Human
cacccugcccacuagcaaucug

SEQ ID NO: 705051 - RNA, 22 nt, Human
ccauuugucaccucugcacucc

SEQ ID NO: 705052 - RNA, 22 nt, Human
aaagguuaauguugucauguua

SEQ ID NO: 705053 - RNA, 22 nt, Human
gagcugagaagcagcgcuugau

SEQ ID NO: 705054 - RNA, 22 nt, Human
aggaaugaacucgagugaucug

SEQ ID NO: 705055 - RNA, 22 nt, Human
ucuuccaggagggcauuucuuu

SEQ ID NO: 705056 - RNA, 22 nt, Human
acuuguuuggucucauguuuaa

SEQ ID NO: 705057 - RNA, 22 nt, Human
gagugucugugacagcucauga

SEQ ID NO: 705058 - RNA, 22 nt, Human
aggccuggccuuuauguucaag

SEQ ID NO: 705059 - RNA, 22 nt, Human
cucacugucuguacuagcugau

SEQ ID NO: 705060 - RNA, 22 nt, Human
ugcaggcuggggaggcagacuu

SEQ ID NO: 705061 - RNA, 22 nt, Human
ugguaaaguugauuggugcucu

SEQ ID NO: 705062 - RNA, 19 nt, Human
gaaugucuccuacuucuga

SEQ ID NO: 705063 - RNA, 22 nt, Human
ccuucagccuucauccuuccuu

SEQ ID NO: 705064 - RNA, 22 nt, Human
aaaaccugauugaauucuauuu

SEQ ID NO: 705065 - RNA, 22 nt, Human
uuggcuucuggcagucuggacg

SEQ ID NO: 705066 - RNA, 22 nt, Human
agagauaugaguaguugugaca

SEQ ID NO: 705067 - RNA, 22 nt, Human
uccaggccgcaggggcagcccc

SEQ ID NO: 705068 - RNA, 22 nt, Human
ucccugaaucucgaacuagccu

SEQ ID NO: 705069 - RNA, 22 nt, Human
gcagcagggugccagcuuugca

SEQ ID NO: 705070 - RNA, 22 nt, Human
ggccugugcacaugugcaggaa

SEQ ID NO: 705071 - RNA, 22 nt, Human
gugugugucuccgcggccguag

SEQ ID NO: 705072 - RNA, 19 nt, Human
gccaggcuccauagccggc

SEQ ID NO: 705073 - RNA, 22 nt, Human
ugcucgcgcuguuccagcagcu

SEQ ID NO: 705074 - RNA, 21 nt, Human
ugccuggccuuugcuuuuccu

SEQ ID NO: 705075 - RNA, 22 nt, Human
gcuccuggugcuguagagauuu

SEQ ID NO: 705076 - RNA, 22 nt, Human
ucugucugcgcuugcccuggug

SEQ ID NO: 705077 - RNA, 22 nt, Human
augagauagacuaugucauaca

SEQ ID NO: 705078 - RNA, 22 nt, Human
gaaaguugcaaucauggcuuuu

SEQ ID NO: 705079 - RNA, 22 nt, Human
acauagcagaggacugagcaga

SEQ ID NO: 705080 - RNA, 22 nt, Human
ccuggcuuccuggagcucacaa

SEQ ID NO: 705081 - RNA, 19 nt, Human
augaagauugguaaauuca

SEQ ID NO: 705082 - RNA, 22 nt, Human
auccaaaggugacacagaauac

SEQ ID NO: 705083 - RNA, 21 nt, Human
ccuguggauuuuaaaauugga

SEQ ID NO: 705084 - RNA, 22 nt, Human
ucugccagugguuuggcccuga

SEQ ID NO: 705085 - RNA, 22 nt, Human
cuucaguguugccagggccuag

SEQ ID NO: 705086 - RNA, 22 nt, Human
auagacaaucccccauccuacc

SEQ ID NO: 705087 - RNA, 22 nt, Human
cagcugcccauccugggaaaug

SEQ ID NO: 705088 - RNA, 22 nt, Human
auauauuacaaaagaggaagga

SEQ ID NO: 705089 - RNA, 22 nt, Human
caaggcugugcaggguccauau

SEQ ID NO: 705090 - RNA, 22 nt, Human
ucugaguugaggaaaugcauuu

SEQ ID NO: 705091 - RNA, 22 nt, Human
acccugauauagguccaagagc

SEQ ID NO: 705092 - RNA, 22 nt, Human
ccaggcagcucugauuuauguc

SEQ ID NO: 705093 - RNA, 22 nt, Human
aaagagcuaacauugccgagau

SEQ ID NO: 705094 - RNA, 22 nt, Human
cagugcauagauccugaggccu

SEQ ID NO: 705095 - RNA, 22 nt, Human
gaucuuuucagaauuuaucagu

SEQ ID NO: 705096 - RNA, 22 nt, Human
cacaggcucuccagggccugga

SEQ ID NO: 705097 - RNA, 22 nt, Human
ugagguccugcauguugagguc

SEQ ID NO: 705098 - RNA, 22 nt, Human
auguacaagcuguuuuacugca

SEQ ID NO: 705099 - RNA, 22 nt, Human
gugcuacagacugaguacacuu

SEQ ID NO: 705100 - RNA, 22 nt, Human
agaaagcacucugucuuuuacc

SEQ ID NO: 705101 - RNA, 22 nt, Human
ggcaggugagagcucuuugaaa

SEQ ID NO: 705102 - RNA, 22 nt, Human
ggaggugcuggcggccagcucu

SEQ ID NO: 705103 - RNA, 18 nt, Human
ugcacuagaugcuggcag

SEQ ID NO: 705104 - RNA, 20 nt, Human
uauuuagauucaaguaugga

SEQ ID NO: 705105 - RNA, 22 nt, Human
ugaaaacagaauccuuguuuuc

SEQ ID NO: 705106 - RNA, 20 nt, Human
aguguuccggaagacuggca

SEQ ID NO: 705107 - RNA, 22 nt, Human
agugggcagugcgcucggaugc

SEQ ID NO: 705108 - RNA, 22 nt, Human
uaucagcaccgcggacagcauc

SEQ ID NO: 705109 - RNA, 22 nt, Human
cugaaagggagaacaccaagag

SEQ ID NO: 705110 - RNA, 21 nt, Human
gaguccuuccaauguccucag

SEQ ID NO: 705111 - RNA, 22 nt, Human
agggcaucucuaacagucuccu

SEQ ID NO: 705112 - RNA, 22 nt, Human
uguccugggaaaucccuuaggc

SEQ ID NO: 705113 - RNA, 22 nt, Human
ucagggaccaccacucacccag

SEQ ID NO: 705114 - RNA, 21 nt, Human
gcagcaaaugacaacagugag

SEQ ID NO: 705115 - RNA, 22 nt, Human
aggucagcaugaguagaaggua

SEQ ID NO: 705116 - RNA, 22 nt, Human
ccuguguggaaaccgcaugacg

SEQ ID NO: 705117 - RNA, 22 nt, Human
cugaacauucuugaacaucugu

SEQ ID NO: 705118 - RNA, 22 nt, Human
aguucaugugguuuaacuuaau

SEQ ID NO: 705119 - RNA, 22 nt, Human
uacuuuguggagauuaaaaaua

SEQ ID NO: 705120 - RNA, 22 nt, Human
cagauaaaggcuuacuaguagu

SEQ ID NO: 705121 - RNA, 22 nt, Human
ccuugcaggggaacaggcagug

SEQ ID NO: 705122 - RNA, 21 nt, Human
ugauuuccagaaaauuggccc

SEQ ID NO: 705123 - RNA, 22 nt, Human
ggcuugggagcaggcaugugac

SEQ ID NO: 705124 - RNA, 22 nt, Human
cagagacaggcuugcccuccac

SEQ ID NO: 705125 - RNA, 22 nt, Human
uggcucagcgguggcagcagac

SEQ ID NO: 705126 - RNA, 22 nt, Human
ucugagcuuuuauuaucaaccu

SEQ ID NO: 705127 - RNA, 22 nt, Human
ggucagggcucuuccaguggcu

SEQ ID NO: 705128 - RNA, 22 nt, Human
ugccaggagagugcaugcaggg

SEQ ID NO: 705129 - RNA, 19 nt, Human
gccagugugugguacagug

SEQ ID NO: 705130 - RNA, 22 nt, Human
cacauuuaagcagauguggacc

SEQ ID NO: 705131 - RNA, 22 nt, Human
guggcaugacagugaaugggca

SEQ ID NO: 705132 - RNA, 22 nt, Human
gacaggaagucugaaggaggga

SEQ ID NO: 705133 - RNA, 22 nt, Human
aagauagaugucaucagcauau

SEQ ID NO: 705134 - RNA, 22 nt, Human
aaucagaaccuugggucauaac

SEQ ID NO: 705135 - RNA, 22 nt, Human
uuuucauaguaauggugcaugu

SEQ ID NO: 705136 - RNA, 17 nt, Human
agggacagcaguuuagg

SEQ ID NO: 705137 - RNA, 22 nt, Human
ccuggcaguuuugcccaggauu

SEQ ID NO: 705138 - RNA, 22 nt, Human
auauuauaaguuauuucaaguu

SEQ ID NO: 705139 - RNA, 22 nt, Human
cuggguauaggaaacaguuaag

SEQ ID NO: 705140 - RNA, 22 nt, Human
cuccucccugcgauugcucugc

SEQ ID NO: 705141 - RNA, 22 nt, Human
gaggcugguucugaaguacugu

SEQ ID NO: 705142 - RNA, 21 nt, Human
agguuucugugagcagagcag

SEQ ID NO: 705143 - RNA, 22 nt, Human
acauagcuuaaaugagaagaua

SEQ ID NO: 705144 - RNA, 22 nt, Human
cuuuacagccccacuuccgggc

SEQ ID NO: 705145 - RNA, 22 nt, Human
aauucuuggaaacauuacugga

SEQ ID NO: 705146 - RNA, 22 nt, Human
gcagccacucucauuccacgug

SEQ ID NO: 705147 - RNA, 22 nt, Human
uggggcuguccuuagucugaga

SEQ ID NO: 705148 - RNA, 22 nt, Human
gauguguuuccaggauuuguuu

SEQ ID NO: 705149 - RNA, 22 nt, Human
uaaugucaaggugauagauuug

SEQ ID NO: 705150 - RNA, 22 nt, Human
ucacagugcaccccucacaggg

SEQ ID NO: 705151 - RNA, 22 nt, Human
acagguguugacucacaggccc

SEQ ID NO: 705152 - RNA, 22 nt, Human
ccugaacucuaaauagagcagu

SEQ ID NO: 705153 - RNA, 22 nt, Human
aacaguacaacuccacaagacu

SEQ ID NO: 705154 - RNA, 22 nt, Human
cagcagaagugcauuugugauu

SEQ ID NO: 705155 - RNA, 22 nt, Human
aggacaauuagacucuuuguuu

SEQ ID NO: 705156 - RNA, 22 nt, Human
gcucagugcagccuuucuguau

SEQ ID NO: 705157 - RNA, 21 nt, Human
aaagaacaggcagauguucuu

SEQ ID NO: 705158 - RNA, 22 nt, Human
uaccauuucauucuuuccucau

SEQ ID NO: 705159 - RNA, 22 nt, Human
ugaggggagguuggggcacauc

SEQ ID NO: 705160 - RNA, 22 nt, Human
uuccuuguucuacaucccugcc

SEQ ID NO: 705161 - RNA, 22 nt, Human
cugcccugggaguaccuguccu

SEQ ID NO: 705162 - RNA, 19 nt, Human
augcaucugcauugacagg

SEQ ID NO: 705163 - RNA, 22 nt, Human
acucagaguuuuacccagagac

SEQ ID NO: 705164 - RNA, 22 nt, Human
agcacaauauaaagugaacgca

SEQ ID NO: 705165 - RNA, 22 nt, Human
cagagccugccaccuuucuccc

SEQ ID NO: 705166 - RNA, 22 nt, Human
auggcccucuccuuaggucagc

SEQ ID NO: 705167 - RNA, 22 nt, Human
aacuucuugguccugagcuguu

SEQ ID NO: 705168 - RNA, 22 nt, Human
gggcaucugguggagccucagg

SEQ ID NO: 705169 - RNA, 22 nt, Human
uccuggugcuuguauuugaagu

SEQ ID NO: 705170 - RNA, 22 nt, Human
auggauggaacucugcuguggu

SEQ ID NO: 705171 - RNA, 22 nt, Human
acaggcugacuuccugccaugu

SEQ ID NO: 705172 - RNA, 19 nt, Human
augauggucccauucaccu

SEQ ID NO: 705173 - RNA, 22 nt, Human
uguauaugugcacaugugcuuc

SEQ ID NO: 705174 - RNA, 18 nt, Human
cacaauagacaccgauaa

SEQ ID NO: 705175 - RNA, 22 nt, Human
aggagccagauucucucacuuu

SEQ ID NO: 705176 - RNA, 22 nt, Human
cucaggcuccagacuuccgucc

SEQ ID NO: 705177 - RNA, 23 nt, Human
ggcuggcccggggcugcuccuga

SEQ ID NO: 705178 - RNA, 22 nt, Human
uaaccucuauuuuuauaaaagu

SEQ ID NO: 705179 - RNA, 22 nt, Human
ccaagagguaauacgagauauc

SEQ ID NO: 705180 - RNA, 22 nt, Human
gucuggacaggacuauuucuaa

SEQ ID NO: 705181 - RNA, 22 nt, Human
ggucccagguugacagggagac

SEQ ID NO: 705182 - RNA, 22 nt, Human
uggagucaucuuaaucuaggca

SEQ ID NO: 705183 - RNA, 21 nt, Human
ucucaucuccugaccugugcc

SEQ ID NO: 705184 - RNA, 22 nt, Human
acuugguggaacguguauuuua

SEQ ID NO: 705185 - RNA, 22 nt, Human
ucacuuuacuuuguuaaucugg

SEQ ID NO: 705186 - RNA, 22 nt, Human
uccucacagcugguucauucag

SEQ ID NO: 705187 - RNA, 22 nt, Human
acccugagucagacagccugac

SEQ ID NO: 705188 - RNA, 22 nt, Human
uuaaauagucaaaucaguggca

SEQ ID NO: 705189 - RNA, 22 nt, Human
aguucuagaagacuuuuccauu

SEQ ID NO: 705190 - RNA, 22 nt, Human
aguaugaagaauacauagauga

SEQ ID NO: 705191 - RNA, 22 nt, Human
cucagcagcagggaagagguca

SEQ ID NO: 705192 - RNA, 22 nt, Human
ucuguggauuuuaguguucaug

SEQ ID NO: 705193 - RNA, 19 nt, Human
cuuauuagagugagagcuu

SEQ ID NO: 705194 - RNA, 22 nt, Human
uugcgcgcggcuaggucucggu

SEQ ID NO: 705195 - RNA, 22 nt, Human
acaugcuuugauguauuuugca

SEQ ID NO: 705196 - RNA, 22 nt, Human
cccaggcacacugaagugacau

SEQ ID NO: 705197 - RNA, 22 nt, Human
cacccagagccugagagggaua

SEQ ID NO: 705198 - RNA, 22 nt, Human
ugccaucuuccuuccucugcac

SEQ ID NO: 705199 - RNA, 22 nt, Human
accagagaggcugcagugugug

SEQ ID NO: 705200 - RNA, 22 nt, Human
aguuggcgggacauguggaaag

SEQ ID NO: 705201 - RNA, 20 nt, Human
aggcuucaaccauacaccuu

SEQ ID NO: 705202 - RNA, 22 nt, Human
cugagcagaccauggcagaggu

SEQ ID NO: 705203 - RNA, 22 nt, Human
ccaggcacugcucgaggugcua

SEQ ID NO: 705204 - RNA, 22 nt, Human
cugggagcaagucaggaaaggu

SEQ ID NO: 705205 - RNA, 22 nt, Human
uggcuucucuguuuuaguauuu

SEQ ID NO: 705206 - RNA, 22 nt, Human
aaauugcauucaggaugcagga

SEQ ID NO: 705207 - RNA, 22 nt, Human
aagcgccacgagaagcuggacc

SEQ ID NO: 705208 - RNA, 22 nt, Human
gugcuuuaguucuugcaacugg

SEQ ID NO: 705209 - RNA, 18 nt, Human
gggcugugagaugggaag

SEQ ID NO: 705210 - RNA, 22 nt, Human
gucacacagagcccugugcuca

SEQ ID NO: 705211 - RNA, 22 nt, Human
uacuuuaauauaugugaaguuc

SEQ ID NO: 705212 - RNA, 22 nt, Human
cucugggccaccgcugguguau

SEQ ID NO: 705213 - RNA, 22 nt, Human
uauuacauccacuuuuauugca

SEQ ID NO: 705214 - RNA, 22 nt, Human
aacuagaacgucuaguugcugg

SEQ ID NO: 705215 - RNA, 22 nt, Human
gucacaugccagugcacacagg

SEQ ID NO: 705216 - RNA, 22 nt, Human
ugaaauguuaaacaaguggcuc

SEQ ID NO: 705217 - RNA, 22 nt, Human
augugcuguaauccauugaagg

SEQ ID NO: 705218 - RNA, 22 nt, Human
acaacaaaaucacuagucuucc

SEQ ID NO: 705219 - RNA, 22 nt, Human
augaagucucuuuuucaugaga

SEQ ID NO: 705220 - RNA, 22 nt, Human
gcccagcacuccucucugacau

SEQ ID NO: 705221 - RNA, 22 nt, Human
uucuucaggauacgucauccag

SEQ ID NO: 705222 - RNA, 22 nt, Human
ggcuccugauuugagggggcug

SEQ ID NO: 705223 - RNA, 22 nt, Human
aauaauguacauacauauuucg

SEQ ID NO: 705224 - RNA, 22 nt, Human
agauguaaacucucaugucauu

SEQ ID NO: 705225 - RNA, 22 nt, Human
gaggcacauauauacagagccc

SEQ ID NO: 705226 - RNA, 20 nt, Human
acagaugaggaaaaugaagu

SEQ ID NO: 705227 - RNA, 22 nt, Human
guuuccuuuuggaauuagagcu

SEQ ID NO: 705228 - RNA, 20 nt, Human
cuuccacacaagaagcacag

SEQ ID NO: 705229 - RNA, 23 nt, Human
ucaggauauugugugccaaggug

SEQ ID NO: 705230 - RNA, 22 nt, Human
uagcucaucuaggcuaccacag

SEQ ID NO: 705231 - RNA, 22 nt, Human
ugcagggauuagaggccgggga

SEQ ID NO: 705232 - RNA, 17 nt, Human
aaacugaaaaauucacu

SEQ ID NO: 705233 - RNA, 22 nt, Human
acuaaugauuauugucauugug

SEQ ID NO: 705234 - RNA, 22 nt, Human
uggccucugcacugggcucccc

SEQ ID NO: 705235 - RNA, 22 nt, Human
auaguggugagcugcauuuaug

SEQ ID NO: 705236 - RNA, 22 nt, Human
uccagggucagaagucacauac

SEQ ID NO: 705237 - RNA, 22 nt, Human
uuccuaacaaacuucagugaau

SEQ ID NO: 705238 - RNA, 22 nt, Human
ugccuggcauguuauagacaca

SEQ ID NO: 705239 - RNA, 22 nt, Human
uugaaaacauuuauauuagaau

SEQ ID NO: 705240 - RNA, 22 nt, Human
ucuuuguaacugucuauugaga

SEQ ID NO: 705241 - RNA, 22 nt, Human
ucauuuauuugacuuuggagug

SEQ ID NO: 705242 - RNA, 19 nt, Human
uagauacugaugaacucca

SEQ ID NO: 705243 - RNA, 22 nt, Human
acugggcagggaaggagaccga

SEQ ID NO: 705244 - RNA, 22 nt, Human
uuaaauuuuagaaacagacucu

SEQ ID NO: 705245 - RNA, 22 nt, Human
acucaggaauggggcugggacu

SEQ ID NO: 705246 - RNA, 22 nt, Human
cugcuuuagagcugagccucag

SEQ ID NO: 705247 - RNA, 22 nt, Human
ucucagaaucaggaccuacuuc

SEQ ID NO: 705248 - RNA, 22 nt, Human
ccucugggcagguagcagcagc

SEQ ID NO: 705249 - RNA, 22 nt, Human
caggugucuaauucucaccccc

SEQ ID NO: 705250 - RNA, 22 nt, Human
uuauucuguugcuuuuacagua

SEQ ID NO: 705251 - RNA, 22 nt, Human
aggaucagggugguggaaguca

SEQ ID NO: 705252 - RNA, 22 nt, Human
cuccaggaguggccuggacacc

SEQ ID NO: 705253 - RNA, 22 nt, Human
ggggaggaccuuuccaaggcuu

SEQ ID NO: 705254 - RNA, 22 nt, Human
gcuuaaaagccacuuagucuau

SEQ ID NO: 705255 - RNA, 22 nt, Human
caguaacaugaagagacaugga

SEQ ID NO: 705256 - RNA, 22 nt, Human
ugggggugcugagaagacagga

SEQ ID NO: 705257 - RNA, 22 nt, Human
auguuuaaggaacugguuugcu

SEQ ID NO: 705258 - RNA, 22 nt, Human
uuggcauucaugggacaacaaa

SEQ ID NO: 705259 - RNA, 20 nt, Human
caccucugaaaguuuccagc

SEQ ID NO: 705260 - RNA, 22 nt, Human
uccuuggcuuucuggagcuucu

SEQ ID NO: 705261 - RNA, 22 nt, Human
ucaggagcucaggcugauggaa

SEQ ID NO: 705262 - RNA, 17 nt, Human
aagauuucauuagcuga

SEQ ID NO: 705263 - RNA, 22 nt, Human
gacuccaggugcaggaggagcc

SEQ ID NO: 705264 - RNA, 22 nt, Human
cucuguugucaguggaagcagc

SEQ ID NO: 705265 - RNA, 22 nt, Human
ugaacucuaauggugcuuuucu

SEQ ID NO: 705266 - RNA, 22 nt, Human
caguccugggugcagcaggaaa

SEQ ID NO: 705267 - RNA, 22 nt, Human
gcuggaaggcuaggcucaguug

SEQ ID NO: 705268 - RNA, 22 nt, Human
uacaucauuuuggagaugagca

SEQ ID NO: 705269 - RNA, 22 nt, Human
cagcagcuaaggcauguuccug

SEQ ID NO: 705270 - RNA, 17 nt, Human
ccagaucccaguccuua

SEQ ID NO: 705271 - RNA, 22 nt, Human
aggcugcugccuuggagagugu

SEQ ID NO: 705272 - RNA, 22 nt, Human
cugaggagaccaucaacuaauu

SEQ ID NO: 705273 - RNA, 21 nt, Human
cuugggcuuguagauggugga

SEQ ID NO: 705274 - RNA, 22 nt, Human
agcacagguaauacagaguaac

SEQ ID NO: 705275 - RNA, 22 nt, Human
ugcccaggaucuggcgaugcuc

SEQ ID NO: 705276 - RNA, 22 nt, Human
ugugggcaggagcacaagucag

SEQ ID NO: 705277 - RNA, 22 nt, Human
uuucaguuuccagcuuugucau

SEQ ID NO: 705278 - RNA, 22 nt, Human
gugugccucgccaagcugucgg

SEQ ID NO: 705279 - RNA, 22 nt, Human
aauccauagaauaaaauugcag

SEQ ID NO: 705280 - RNA, 22 nt, Human
cuggacagugcugcuugagaug

SEQ ID NO: 705281 - RNA, 22 nt, Human
aacauaucuacggauacgauua

SEQ ID NO: 705282 - RNA, 22 nt, Human
uuugacauuggcuuauucuguu

SEQ ID NO: 705283 - RNA, 22 nt, Human
gcagcuuucuuuuugcaugucu

SEQ ID NO: 705284 - RNA, 22 nt, Human
auacuuuaacguggcgaaccuu

SEQ ID NO: 705285 - RNA, 22 nt, Human
cuggggcugcggacgggagccc

SEQ ID NO: 705286 - RNA, 22 nt, Human
cucuucuuggcccccaugaggg

SEQ ID NO: 705287 - RNA, 22 nt, Human
aguagaaaguugcaggaggaau

SEQ ID NO: 705288 - RNA, 22 nt, Human
auucuuucaaggaauaguuauu

SEQ ID NO: 705289 - RNA, 22 nt, Human
gcuucucuuguccaagggcagg

SEQ ID NO: 705290 - RNA, 22 nt, Human
ucaggcagaguuaauuugcucc

SEQ ID NO: 705291 - RNA, 22 nt, Human
ggccacacucugguagagguga

SEQ ID NO: 705292 - RNA, 22 nt, Human
cugaagucagauggcacaaggu

SEQ ID NO: 705293 - RNA, 19 nt, Human
guaagggcuaauggacuau

SEQ ID NO: 705294 - RNA, 22 nt, Human
gucugcccuuggcucagccaua

SEQ ID NO: 705295 - RNA, 22 nt, Human
uaacagaaacagauaaguguaa

SEQ ID NO: 705296 - RNA, 22 nt, Human
uucaguguauauuuuuugagua

SEQ ID NO: 705297 - RNA, 18 nt, Human
gggaggccccagcaggag

SEQ ID NO: 705298 - RNA, 22 nt, Human
ggaaaggagauauuggagagug

SEQ ID NO: 705299 - RNA, 18 nt, Human
agaagccacgaggagucc

SEQ ID NO: 705300 - RNA, 20 nt, Human
gcuguggcaagugcucacug

SEQ ID NO: 705301 - RNA, 23 nt, Human
ucauaaauauuagcacaguagga

SEQ ID NO: 705302 - RNA, 22 nt, Human
guccaggcucaaaagguuguua

SEQ ID NO: 705303 - RNA, 22 nt, Human
gcagcccugcaggcagcuccag

SEQ ID NO: 705304 - RNA, 22 nt, Human
cauggaggacccucagggagcu

SEQ ID NO: 705305 - RNA, 22 nt, Human
ccugggauuugcgccagaccuu

SEQ ID NO: 705306 - RNA, 22 nt, Human
uccccaggaaucaggugguugc

SEQ ID NO: 705307 - RNA, 22 nt, Human
ugauuccuaggcacucuucucc

SEQ ID NO: 705308 - RNA, 22 nt, Human
cuuccagcugauuacaggcuau

SEQ ID NO: 705309 - RNA, 22 nt, Human
uacaugucuacaugcauuuuug

SEQ ID NO: 705310 - RNA, 22 nt, Human
ucaggggcugugcauuucccag

SEQ ID NO: 705311 - RNA, 22 nt, Human
cagcaggcuguggaaauccugg

SEQ ID NO: 705312 - RNA, 22 nt, Human
ugccacagaggugaagcccacu

SEQ ID NO: 705313 - RNA, 22 nt, Human
agugaaauggaugcugcuacug

SEQ ID NO: 705314 - RNA, 22 nt, Human
ucccagaguucaaugggaaggu

SEQ ID NO: 705315 - RNA, 22 nt, Human
uucaaaacagcuagauauugga

SEQ ID NO: 705316 - RNA, 22 nt, Human
gcgguggggaaaggaggugcug

SEQ ID NO: 705317 - RNA, 22 nt, Human
acacuuuacucuuacaccauug

SEQ ID NO: 705318 - RNA, 22 nt, Human
cagaagacagcuguuucacucg

SEQ ID NO: 705319 - RNA, 22 nt, Human
ccccaaagcugaguucccgccu

SEQ ID NO: 705320 - RNA, 22 nt, Human
aggcaggcaaccaccugggaag

SEQ ID NO: 705321 - RNA, 22 nt, Human
uugcugaugguauuaugcuagu

SEQ ID NO: 705322 - RNA, 21 nt, Human
cauuucuaagccuggcuauag

SEQ ID NO: 705323 - RNA, 22 nt, Human
uggcuggucacaugguaggucu

SEQ ID NO: 705324 - RNA, 22 nt, Human
gcagaagggaauaaggagcuuu

SEQ ID NO: 705325 - RNA, 22 nt, Human
uauuccagaugaaaucauucag

SEQ ID NO: 705326 - RNA, 22 nt, Human
gccaggcagagccccgugcagc

SEQ ID NO: 705327 - RNA, 22 nt, Human
cuggaguuuguggcuugcucaa

SEQ ID NO: 705328 - RNA, 22 nt, Human
aggaacuagugcaacaggagcg

SEQ ID NO: 705329 - RNA, 22 nt, Human
ucaaugucugucuaucuauuua

SEQ ID NO: 705330 - RNA, 22 nt, Human
auguagaaaguucauagaugcg

SEQ ID NO: 705331 - RNA, 22 nt, Human
aaaggaguuacucauaaagcuu

SEQ ID NO: 705332 - RNA, 22 nt, Human
auuacaugagagaauguaaaua

SEQ ID NO: 705333 - RNA, 22 nt, Human
gggagcuggcggauuccccagg

SEQ ID NO: 705334 - RNA, 22 nt, Human
ugaggcuggaugggaugccucc

SEQ ID NO: 705335 - RNA, 22 nt, Human
aauagcuuuuacuccuccgagg

SEQ ID NO: 705336 - RNA, 22 nt, Human
uaacagcaguccucuucucaug

SEQ ID NO: 705337 - RNA, 22 nt, Human
gaguuaguauguucuguaagua

SEQ ID NO: 705338 - RNA, 18 nt, Human
uccagcgugcuccagggc

SEQ ID NO: 705339 - RNA, 22 nt, Human
uaaggcauucucaugcugugaa

SEQ ID NO: 705340 - RNA, 22 nt, Human
acaguuuaugguguuuuauaua

SEQ ID NO: 705341 - RNA, 22 nt, Human
cuguccuggagggcauaggacg

SEQ ID NO: 705342 - RNA, 22 nt, Human
augucuguauguggagaggggu

SEQ ID NO: 705343 - RNA, 22 nt, Human
cacaugaucacuucuugaaaau

SEQ ID NO: 705344 - RNA, 22 nt, Human
acucugcuggcugcagggcagc

SEQ ID NO: 705345 - RNA, 22 nt, Human
uauaagaaauugccaaccuguu

SEQ ID NO: 705346 - RNA, 22 nt, Human
agauggaguggagaugaguaaa

SEQ ID NO: 705347 - RNA, 22 nt, Human
gccacagggauuguuuugugag

SEQ ID NO: 705348 - RNA, 22 nt, Human
uacaugguuggcccauucuucu

SEQ ID NO: 705349 - RNA, 22 nt, Human
augcugggaaguccuaaccaca

SEQ ID NO: 705350 - RNA, 22 nt, Human
agugacacggagagacagcaug

SEQ ID NO: 705351 - RNA, 22 nt, Human
gagaaggaaguugagccagcau

SEQ ID NO: 705352 - RNA, 22 nt, Human
ucauccauauagaaagaugauu

SEQ ID NO: 705353 - RNA, 20 nt, Human
acacacuuugaucuugagcc

SEQ ID NO: 705354 - RNA, 19 nt, Human
ggagaagcaucuagaaaua

SEQ ID NO: 705355 - RNA, 21 nt, Human
uuucugaaggcaacaucuauc

SEQ ID NO: 705356 - RNA, 22 nt, Human
aaugaacaacacugaaggaaga

SEQ ID NO: 705357 - RNA, 22 nt, Human
uauguuaaauguuugauguuua

SEQ ID NO: 705358 - RNA, 22 nt, Human
agagacugcaaaucauaagaau

SEQ ID NO: 705359 - RNA, 22 nt, Human
agucugggcauuuaggauguug

SEQ ID NO: 705360 - RNA, 22 nt, Human
uuugugugcaacgcauggaguc

SEQ ID NO: 705361 - RNA, 22 nt, Human
uccagcagcccgaaggcccauc

SEQ ID NO: 705362 - RNA, 21 nt, Human
ugaagggcagccucaggcucc

SEQ ID NO: 705363 - RNA, 22 nt, Human
caccuguccacgcagucugccu

SEQ ID NO: 705364 - RNA, 22 nt, Human
uggcaccagggaacaagcauuu

SEQ ID NO: 705365 - RNA, 22 nt, Human
agcagcagccguagccuuauua

SEQ ID NO: 705366 - RNA, 22 nt, Human
agaucacuuugaugcuaccugg

SEQ ID NO: 705367 - RNA, 22 nt, Human
guccacucucugccgugccugu

SEQ ID NO: 705368 - RNA, 22 nt, Human
cacccugcuacaaagccuccug

SEQ ID NO: 705369 - RNA, 22 nt, Human
agcuuuauauaaaagaguacau

SEQ ID NO: 705370 - RNA, 22 nt, Human
uggucucugugcucgggcaugg

SEQ ID NO: 705371 - RNA, 21 nt, Human
ggguagcagaggaggccgugg

SEQ ID NO: 705372 - RNA, 19 nt, Human
auuguacauugaguuuggc

SEQ ID NO: 705373 - RNA, 22 nt, Human
guucugccuguggcuucugugg

SEQ ID NO: 705374 - RNA, 22 nt, Human
cugccacaagcuggcccugugu

SEQ ID NO: 705375 - RNA, 22 nt, Human
gggcagguacuggguggugagc

SEQ ID NO: 705376 - RNA, 19 nt, Human
auucuuugguguccauuuc

SEQ ID NO: 705377 - RNA, 22 nt, Human
uccaggcuuuggggcaggagcg

SEQ ID NO: 705378 - RNA, 22 nt, Human
aaaaagacuuccaacucaggag

SEQ ID NO: 705379 - RNA, 22 nt, Human
uuucuagcaagaaagaggugga

SEQ ID NO: 705380 - RNA, 22 nt, Human
cgggggaguugaggcacauggg

SEQ ID NO: 705381 - RNA, 19 nt, Human
acuucaaaucuuagagaaa

SEQ ID NO: 705382 - RNA, 22 nt, Human
agguuucuccuuuaaagcaugg

SEQ ID NO: 705383 - RNA, 22 nt, Human
uuggcuguauguacaucuguua

SEQ ID NO: 705384 - RNA, 22 nt, Human
uuagcaagauaacaguaauuuu

SEQ ID NO: 705385 - RNA, 22 nt, Human
aauugaacuugaucuuuagcua

SEQ ID NO: 705386 - RNA, 22 nt, Human
agacccugcauuuuccaggguu

SEQ ID NO: 705387 - RNA, 19 nt, Human
uuuauucaccuuuaccuug

SEQ ID NO: 705388 - RNA, 22 nt, Human
acccuggggguggccagugcca

SEQ ID NO: 705389 - RNA, 22 nt, Human
acagggaagcucaggggcucug

SEQ ID NO: 705390 - RNA, 22 nt, Human
aaagcauuacuagacuggauuu

SEQ ID NO: 705391 - RNA, 22 nt, Human
uccaggguugugggcuucagca

SEQ ID NO: 705392 - RNA, 22 nt, Human
uucugucucccugauguagagc

SEQ ID NO: 705393 - RNA, 22 nt, Human
cugugaguaaugaccugucuug

SEQ ID NO: 705394 - RNA, 22 nt, Human
agcucaagaguaguucgagggg

SEQ ID NO: 705395 - RNA, 22 nt, Human
agcaucugugauauuuuguuau

SEQ ID NO: 705396 - RNA, 18 nt, Human
ggaaggugaugugaaaag

SEQ ID NO: 705397 - RNA, 22 nt, Human
agcuggccuccgggugccuggg

SEQ ID NO: 705398 - RNA, 22 nt, Human
gaaacugaguaggcuagagcac

SEQ ID NO: 705399 - RNA, 22 nt, Human
uguuacuuggugucucuggcug

SEQ ID NO: 705400 - RNA, 22 nt, Human
acaucccuugcucggggccccu

SEQ ID NO: 705401 - RNA, 22 nt, Human
caggugcccaggggacaguggc

SEQ ID NO: 705402 - RNA, 23 nt, Human
uccaggcaugagcucuggaugga

SEQ ID NO: 705403 - RNA, 16 nt, Human
uccuggccccuaugga

SEQ ID NO: 705404 - RNA, 22 nt, Human
gcacagaggaagcacagacucu

SEQ ID NO: 705405 - RNA, 19 nt, Human
agacauaaagaguuugcaa

SEQ ID NO: 705406 - RNA, 23 nt, Human
uugaagucucaguuuucucauag

SEQ ID NO: 705407 - RNA, 22 nt, Human
cagauuucagcucauauauuau

SEQ ID NO: 705408 - RNA, 22 nt, Human
ucagaacauuuaaaaagugguu

SEQ ID NO: 705409 - RNA, 22 nt, Human
cagggcuugaucugcauccugc

SEQ ID NO: 705410 - RNA, 22 nt, Human
auggaacugagcuugccaaacu

SEQ ID NO: 705411 - RNA, 22 nt, Human
aaaggagaaaacauacaggacu

SEQ ID NO: 705412 - RNA, 22 nt, Human
ugaauuguggcuuuuuccaauu

SEQ ID NO: 705413 - RNA, 22 nt, Human
uccagcccaggcuggaguguag

SEQ ID NO: 705414 - RNA, 22 nt, Human
agcucugcuacucuguggggug

SEQ ID NO: 705415 - RNA, 22 nt, Human
uuuauuuaaagucguguguuaa

SEQ ID NO: 705416 - RNA, 22 nt, Human
cugcugggucccccugcugauu

SEQ ID NO: 705417 - RNA, 21 nt, Human
accugugaauagccacugcac

SEQ ID NO: 705418 - RNA, 22 nt, Human
ugugucucuccuggaagcacgu

SEQ ID NO: 705419 - RNA, 22 nt, Human
cagcucaggaaggaaggccggc

SEQ ID NO: 705420 - RNA, 22 nt, Human
uucuuugaauagauguucccag

SEQ ID NO: 705421 - RNA, 22 nt, Human
auaugcauaugucaaaacuuau

SEQ ID NO: 705422 - RNA, 22 nt, Human
ccacagcaggacuggagccgcc

SEQ ID NO: 705423 - RNA, 22 nt, Human
agccaggacguugcucagcucc

SEQ ID NO: 705424 - RNA, 22 nt, Human
guaaccuggaaguuuagggaag

SEQ ID NO: 705425 - RNA, 22 nt, Human
gugcuucuccguucugcagcac

SEQ ID NO: 705426 - RNA, 19 nt, Human
agcuuuggacuugcauuuc

SEQ ID NO: 705427 - RNA, 22 nt, Human
ugaaucugauuucccuggaggc

SEQ ID NO: 705428 - RNA, 22 nt, Human
guuucauucggcagcucauaag

SEQ ID NO: 705429 - RNA, 22 nt, Human
agauauguuacugcaucauggg

SEQ ID NO: 705430 - RNA, 22 nt, Human
gcaagaguuuuuucucucuuga

SEQ ID NO: 705431 - RNA, 23 nt, Human
cccugagcugguccaggcucaac

SEQ ID NO: 705432 - RNA, 23 nt, Human
aaaugacuaaauguucuuauaga

SEQ ID NO: 705433 - RNA, 22 nt, Human
ccaggaagggcucuuuaaagac

SEQ ID NO: 705434 - RNA, 22 nt, Human
ucacacaugaguaaauacaggg

SEQ ID NO: 705435 - RNA, 22 nt, Human
aaaaugaagcaaaggcauucag

SEQ ID NO: 705436 - RNA, 22 nt, Human
acagcagccuuguugguuucga

SEQ ID NO: 705437 - RNA, 22 nt, Human
acugaauagcccuucugucucc

SEQ ID NO: 705438 - RNA, 22 nt, Human
ccugucuggaacauggccuguu

SEQ ID NO: 705439 - RNA, 22 nt, Human
uggcucuuucugucugggaucc

SEQ ID NO: 705440 - RNA, 22 nt, Human
ggagauggcucugcaaggucua

SEQ ID NO: 705441 - RNA, 22 nt, Human
ugacuccaaacagaaaacgaau

SEQ ID NO: 705442 - RNA, 22 nt, Human
uaaauucccaacucugcucuuc

SEQ ID NO: 705443 - RNA, 22 nt, Human
ugucugggagggacagggcuac

SEQ ID NO: 705444 - RNA, 22 nt, Human
auuugucauguauguaaaguug

SEQ ID NO: 705445 - RNA, 22 nt, Human
augcaugcagggaagacaguag

SEQ ID NO: 705446 - RNA, 22 nt, Human
agauaacucauuuuguauaucc

SEQ ID NO: 705447 - RNA, 22 nt, Human
cuuucacagcacaagccugccu

SEQ ID NO: 705448 - RNA, 22 nt, Human
auguuuauuuugcagaguaggg

SEQ ID NO: 705449 - RNA, 22 nt, Human
gugagcuguuuuggacccaucu

SEQ ID NO: 705450 - RNA, 22 nt, Human
cucucuagaggcccaccuugag

SEQ ID NO: 705451 - RNA, 22 nt, Human
uauguacaaucagcaguucaua

SEQ ID NO: 705452 - RNA, 19 nt, Human
agagaaggauccuaugguu

SEQ ID NO: 705453 - RNA, 22 nt, Human
guggcagucucaucuguggcuc

SEQ ID NO: 705454 - RNA, 22 nt, Human
cucuggaguaagagcuaugaaa

SEQ ID NO: 705455 - RNA, 22 nt, Human
guuuagaauggcaaaauuaagu

SEQ ID NO: 705456 - RNA, 18 nt, Human
ucucucugauaacauuuu

SEQ ID NO: 705457 - RNA, 23 nt, Human
cagggcugggcuugguguuaggc

SEQ ID NO: 705458 - RNA, 22 nt, Human
uuuacagauucuggguauuagg

SEQ ID NO: 705459 - RNA, 22 nt, Human
gacaugcaugaaugcaggucuc

SEQ ID NO: 705460 - RNA, 22 nt, Human
uucuguccacugcuggggccuc

SEQ ID NO: 705461 - RNA, 22 nt, Human
cuuacagugacccugcagauuu

SEQ ID NO: 705462 - RNA, 22 nt, Human
uugaaagaggcaaaguuugauc

SEQ ID NO: 705463 - RNA, 22 nt, Human
aggagcugacuuguaaagcauu

SEQ ID NO: 705464 - RNA, 22 nt, Human
cuccccacauuucucccugucu

SEQ ID NO: 705465 - RNA, 22 nt, Human
uaacagaagaugaaacuucuuu

SEQ ID NO: 705466 - RNA, 22 nt, Human
augagggcagcuauguaagugu

SEQ ID NO: 705467 - RNA, 22 nt, Human
agguauuauuagcaucucuauu

SEQ ID NO: 705468 - RNA, 22 nt, Human
gaaugcugagucuuaucucuua

SEQ ID NO: 705469 - RNA, 22 nt, Human
aacagcuuuguauacaguaacu

SEQ ID NO: 705470 - RNA, 22 nt, Human
gccaccccaaccucccuaaguu

SEQ ID NO: 705471 - RNA, 22 nt, Human
ugggaaaguaauugucauccuu

SEQ ID NO: 705472 - RNA, 22 nt, Human
gaacuuuugggaagccguguga

SEQ ID NO: 705473 - RNA, 22 nt, Human
cugccugccuuggccuccagga

SEQ ID NO: 705474 - RNA, 22 nt, Human
cccagggaaggcagauggagga

SEQ ID NO: 705475 - RNA, 22 nt, Human
ggucuggaagcgucccaaaggu

SEQ ID NO: 705476 - RNA, 22 nt, Human
aacuuucuuugcaucuaaguuu

SEQ ID NO: 705477 - RNA, 22 nt, Human
ugggaaggaacugccuuuagcu

SEQ ID NO: 705478 - RNA, 22 nt, Human
ccacugccgugggccuugggga

SEQ ID NO: 705479 - RNA, 22 nt, Human
ucugagcuguggccauucuucc

SEQ ID NO: 705480 - RNA, 22 nt, Human
aaguuuauguucuuugaaggca

SEQ ID NO: 705481 - RNA, 22 nt, Human
ggccagcccagugguccucucu

SEQ ID NO: 705482 - RNA, 22 nt, Human
uugauuaaucccaugugaguag

SEQ ID NO: 705483 - RNA, 22 nt, Human
acugacucuuguuaacuucagc

SEQ ID NO: 705484 - RNA, 22 nt, Human
gugucagauguccagggcagca

SEQ ID NO: 705485 - RNA, 22 nt, Human
aaacucuaguuaugaaguuugu

SEQ ID NO: 705486 - RNA, 22 nt, Human
cggcuggagcuuugaaccugau

SEQ ID NO: 705487 - RNA, 22 nt, Human
cuccugcaugcucacauaugcc

SEQ ID NO: 705488 - RNA, 22 nt, Human
gccucagggauaggaugagcau

SEQ ID NO: 705489 - RNA, 22 nt, Human
uuuuaaguuggauugcuaagua

SEQ ID NO: 705490 - RNA, 22 nt, Human
ucagagccaaucauggugcauu

SEQ ID NO: 705491 - RNA, 22 nt, Human
cuccaaggauucuggacccuug

SEQ ID NO: 705492 - RNA, 19 nt, Human
cagagcagugguuccugaa

SEQ ID NO: 705493 - RNA, 22 nt, Human
ugaaggccacuuccugugagcu

SEQ ID NO: 705494 - RNA, 22 nt, Human
cacagcugucagcugaccuagg

SEQ ID NO: 705495 - RNA, 22 nt, Human
agaggggaaguaaugaaugaua

SEQ ID NO: 705496 - RNA, 22 nt, Human
acugccugccuuccagguacug

SEQ ID NO: 705497 - RNA, 22 nt, Human
uaguguaaugacauuuagacga

SEQ ID NO: 705498 - RNA, 22 nt, Human
agaagagaacugccaaacacuu

SEQ ID NO: 705499 - RNA, 17 nt, Human
ugcuuggcuucuuuagg

SEQ ID NO: 705500 - RNA, 22 nt, Human
ucuacagacagagcagguggga

SEQ ID NO: 705501 - RNA, 22 nt, Human
uuugaaagucaaccuuccaguu

SEQ ID NO: 705502 - RNA, 22 nt, Human
cugggcacacagugacucugca

SEQ ID NO: 705503 - RNA, 22 nt, Human
cucaaguccauagaaucaggaa

SEQ ID NO: 705504 - RNA, 22 nt, Human
ugcagaggcauuuauugaugua

SEQ ID NO: 705505 - RNA, 22 nt, Human
augacacaauuuuagagcugaa

SEQ ID NO: 705506 - RNA, 22 nt, Human
auccaggcauucugacuucaag

SEQ ID NO: 705507 - RNA, 22 nt, Human
cagaucaagcuguauggucaga

SEQ ID NO: 705508 - RNA, 22 nt, Human
uaggacaguagcuggugcacag

SEQ ID NO: 705509 - RNA, 22 nt, Human
acugugcuugccaaaccauuga

SEQ ID NO: 705510 - RNA, 22 nt, Human
auauguguguauuucuuacuag

SEQ ID NO: 705511 - RNA, 22 nt, Human
agagauuucuacugcacucuuu

SEQ ID NO: 705512 - RNA, 22 nt, Human
auucuacaacccaauaauaauu

SEQ ID NO: 705513 - RNA, 22 nt, Human
ggccugucucacccccgggugc

SEQ ID NO: 705514 - RNA, 22 nt, Human
cauugcacuuuggguccaggac

SEQ ID NO: 705515 - RNA, 22 nt, Human
uucugcuuagagggcauuugca

SEQ ID NO: 705516 - RNA, 22 nt, Human
cuccucagucaggucuaggguc

SEQ ID NO: 705517 - RNA, 22 nt, Human
uggcuaagauuuaaauguuugc

SEQ ID NO: 705518 - RNA, 22 nt, Human
cucucugcaaguuuugaaauag

SEQ ID NO: 705519 - RNA, 22 nt, Human
cacaggaaaauaaaagaucuaa

SEQ ID NO: 705520 - RNA, 22 nt, Human
gcaguccucguaaaggucgaag

SEQ ID NO: 705521 - RNA, 22 nt, Human
caaaccacacucagcguaucgg

SEQ ID NO: 705522 - RNA, 22 nt, Human
uugugggaucucccuguugcuc

SEQ ID NO: 705523 - RNA, 22 nt, Human
uauuaugagguauuuggacuuu

SEQ ID NO: 705524 - RNA, 22 nt, Human
cucuguugagcauuuuuccccu

SEQ ID NO: 705525 - RNA, 22 nt, Human
uuugaugaaagcuacuauuuac

SEQ ID NO: 705526 - RNA, 22 nt, Human
gaggguggagcuccagaaucug

SEQ ID NO: 705527 - RNA, 20 nt, Human
uuuaucugugggaguggaga

SEQ ID NO: 705528 - RNA, 22 nt, Human
aagccaauguugccuggguuuc

SEQ ID NO: 705529 - RNA, 22 nt, Human
agguucauucccaaauuuggag

SEQ ID NO: 705530 - RNA, 22 nt, Human
auacagugaauacuuacagugu

SEQ ID NO: 705531 - RNA, 22 nt, Human
auacacuggccuuugcagagcc

SEQ ID NO: 705532 - RNA, 22 nt, Human
ggaauucuguagcucuuccucu

SEQ ID NO: 705533 - RNA, 22 nt, Human
uucaaagugugaccugacaagc

SEQ ID NO: 705534 - RNA, 22 nt, Human
uccaagaguauaguuuauuggc

SEQ ID NO: 705535 - RNA, 22 nt, Human
ucucucccaaaucugcagauag

SEQ ID NO: 705536 - RNA, 22 nt, Human
agcaacauauaucaaugccuga

SEQ ID NO: 705537 - RNA, 22 nt, Human
cuucucaguugcaagugucaga

SEQ ID NO: 705538 - RNA, 22 nt, Human
cuauuuucccauaugguugaca

SEQ ID NO: 705539 - RNA, 22 nt, Human
uggcacuguagccacuacugcc

SEQ ID NO: 705540 - RNA, 22 nt, Human
gugaacuauuggguaucauaaa

SEQ ID NO: 705541 - RNA, 21 nt, Human
guggagagugauuuugaugca

SEQ ID NO: 705542 - RNA, 22 nt, Human
cuuuacaaacuauaaagugcgg

SEQ ID NO: 705543 - RNA, 22 nt, Human
uauguucuaaccuugucuuucc

SEQ ID NO: 705544 - RNA, 23 nt, Human
accuggcugcucaaccugcaggg

SEQ ID NO: 705545 - RNA, 22 nt, Human
ugucuucaaauauugaaauccu

SEQ ID NO: 705546 - RNA, 22 nt, Human
ucagagcacuuggcucauggca

SEQ ID NO: 705547 - RNA, 22 nt, Human
gcaggcuccaggccggccccuu

SEQ ID NO: 705548 - RNA, 22 nt, Human
ccuccuggggugaaggauggga

SEQ ID NO: 705549 - RNA, 15 nt, Human
uaccagcugauccgu

SEQ ID NO: 705550 - RNA, 22 nt, Human
aauguuuuagauuacugcuggg

SEQ ID NO: 705551 - RNA, 22 nt, Human
caguuucuuggaugccaauuuc

SEQ ID NO: 705552 - RNA, 22 nt, Human
agccucagugucaccaucuacc

SEQ ID NO: 705553 - RNA, 22 nt, Human
gucuguggucccugcuggggac

SEQ ID NO: 705554 - RNA, 22 nt, Human
aagaguauuugguauagaacac

SEQ ID NO: 705555 - RNA, 23 nt, Human
uucuggcuccgagcuccaucuuc

SEQ ID NO: 705556 - RNA, 21 nt, Human
uuccuggggacuuccguggga

SEQ ID NO: 705557 - RNA, 22 nt, Human
auguguguaaacaaguauaauu

SEQ ID NO: 705558 - RNA, 22 nt, Human
cccugaggaccaggaaggaggg

SEQ ID NO: 705559 - RNA, 22 nt, Human
cugccugugcaugcagucagaa

SEQ ID NO: 705560 - RNA, 22 nt, Human
gagggccaauggauuucaacug

SEQ ID NO: 705561 - RNA, 22 nt, Human
uuauugcaaaggaagagcuuga

SEQ ID NO: 705562 - RNA, 22 nt, Human
gcuuagcacagaaugagaguuc

SEQ ID NO: 705563 - RNA, 22 nt, Human
caguuucuacgaaggucaaccc

SEQ ID NO: 705564 - RNA, 22 nt, Human
cagcaucuccugugcagaggga

SEQ ID NO: 705565 - RNA, 22 nt, Human
gcuuagcaucuuacaaugcuga

SEQ ID NO: 705566 - RNA, 22 nt, Human
agcaggagauggggcgugaugu

SEQ ID NO: 705567 - RNA, 22 nt, Human
uuccugggcuuuccccucuggu

SEQ ID NO: 705568 - RNA, 22 nt, Human
cacauggaagagauacagugag

SEQ ID NO: 705569 - RNA, 22 nt, Human
cagaggccuucaauacucauuu

SEQ ID NO: 705570 - RNA, 22 nt, Human
gauucaaaaguuugagcuccaa

SEQ ID NO: 705571 - RNA, 22 nt, Human
ucucaaauauuuggagagagga

SEQ ID NO: 705572 - RNA, 22 nt, Human
gauggacaccuccugagguucu

SEQ ID NO: 705573 - RNA, 22 nt, Human
cugcugucaucuggcgcugugc

SEQ ID NO: 705574 - RNA, 22 nt, Human
acccaggcgggagugcaguguc

SEQ ID NO: 705575 - RNA, 22 nt, Human
aauggccagcaacaggagugaa

SEQ ID NO: 705576 - RNA, 22 nt, Human
cugugcccaccuggcucugagg

SEQ ID NO: 705577 - RNA, 21 nt, Human
acaaacugaaaugaguuuccu

SEQ ID NO: 705578 - RNA, 22 nt, Human
ggaaaagaauugcagugaagua

SEQ ID NO: 705579 - RNA, 22 nt, Human
ccacagugaguuagauugacca

SEQ ID NO: 705580 - RNA, 23 nt, Human
cugggcacccaguaccuaggccc

SEQ ID NO: 705581 - RNA, 22 nt, Human
ugcccuggaaaugagaggugug

SEQ ID NO: 705582 - RNA, 22 nt, Human
aggcuacuucuagagggacaau

SEQ ID NO: 705583 - RNA, 20 nt, Human
ucaaguuuugcuugacaaga

SEQ ID NO: 705584 - RNA, 22 nt, Human
ggggcucaguucggacagccug

SEQ ID NO: 705585 - RNA, 22 nt, Human
caaauacaaauacgggcagcuu

SEQ ID NO: 705586 - RNA, 23 nt, Human
ggacacugugcagaugcuagugc

SEQ ID NO: 705587 - RNA, 23 nt, Human
agcuaaugggacagauuccaugg

SEQ ID NO: 705588 - RNA, 22 nt, Human
ugcccccuuuucuuguuacacu

SEQ ID NO: 705589 - RNA, 22 nt, Human
aaucagaacuccuaccacagag

SEQ ID NO: 705590 - RNA, 22 nt, Human
ccugcugugaagccaggccugu

SEQ ID NO: 705591 - RNA, 22 nt, Human
ggggacagucgaucuagugauu

SEQ ID NO: 705592 - RNA, 22 nt, Human
ugguggggauucccucccuggc

SEQ ID NO: 705593 - RNA, 22 nt, Human
cagcagcauugcucuggauucc

SEQ ID NO: 705594 - RNA, 22 nt, Human
cuggagggaggaggcugcuauu

SEQ ID NO: 705595 - RNA, 22 nt, Human
uaaagcuagaauuguuccagca

SEQ ID NO: 705596 - RNA, 22 nt, Human
ccucuuccuucucacuguggaa

SEQ ID NO: 705597 - RNA, 22 nt, Human
cuggcuccugaggcuuggcccc

SEQ ID NO: 705598 - RNA, 22 nt, Human
cugucaaauggaaacuuauccu

SEQ ID NO: 705599 - RNA, 21 nt, Human
cucagagcaguucagagggau

SEQ ID NO: 705600 - RNA, 22 nt, Human
aagcuauauuauauuuguguuu

SEQ ID NO: 705601 - RNA, 22 nt, Human
uucauucaucacaugcagcugg

SEQ ID NO: 705602 - RNA, 22 nt, Human
ccuucagccuagaacuugagag

SEQ ID NO: 705603 - RNA, 23 nt, Human
agucagagcagaagggcugcuug

SEQ ID NO: 705604 - RNA, 22 nt, Human
acauuucuugaugccucuguga

SEQ ID NO: 705605 - RNA, 22 nt, Human
cuccaguggugauggggaagaa

SEQ ID NO: 705606 - RNA, 22 nt, Human
caggugguugagagcuguaggc

SEQ ID NO: 705607 - RNA, 18 nt, Human
cagagugggccaagagac

SEQ ID NO: 705608 - RNA, 19 nt, Human
guccaguguuuuccaguca

SEQ ID NO: 705609 - RNA, 22 nt, Human
uuguuaaaaugcauauucuggu

SEQ ID NO: 705610 - RNA, 22 nt, Human
augugcuuuagguuuguuuaca

SEQ ID NO: 705611 - RNA, 22 nt, Human
uagcagcugucaguuucacaua

SEQ ID NO: 705612 - RNA, 22 nt, Human
gcacuugauuacauuagugccu

SEQ ID NO: 705613 - RNA, 22 nt, Human
ugccuggcccugacagcccugg

SEQ ID NO: 705614 - RNA, 22 nt, Human
ggcugaaguguaguggcucacu

SEQ ID NO: 705615 - RNA, 22 nt, Human
cauuaugugcguacauguaucu

SEQ ID NO: 705616 - RNA, 22 nt, Human
gccuggggccagcuugggcuga

SEQ ID NO: 705617 - RNA, 23 nt, Human
acuuuucaauuagcuaugcuuaa

SEQ ID NO: 705618 - RNA, 22 nt, Human
uccagcugccaaccgggccccg

SEQ ID NO: 705619 - RNA, 22 nt, Human
auuuagucuguaacaguacagu

SEQ ID NO: 705620 - RNA, 22 nt, Human
auaccuuuuagacauguaguug

SEQ ID NO: 705621 - RNA, 22 nt, Human
cucgcaggacagugcuaggacu

SEQ ID NO: 705622 - RNA, 21 nt, Human
agaauuaaauuggauuugugu

SEQ ID NO: 705623 - RNA, 22 nt, Human
cgcagaagagguugucuagucc

SEQ ID NO: 705624 - RNA, 22 nt, Human
cccaguggagauaggagugugg

SEQ ID NO: 705625 - RNA, 22 nt, Human
aguugcuggcaccugugaguau

SEQ ID NO: 705626 - RNA, 22 nt, Human
uucugucuguaaacuucucaau

SEQ ID NO: 705627 - RNA, 22 nt, Human
agaaauaugcugauuagaugaa

SEQ ID NO: 705628 - RNA, 22 nt, Human
uaaaugacccaugcugaccuca

SEQ ID NO: 705629 - RNA, 22 nt, Human
augcugugaaaaagaaggcuga

SEQ ID NO: 705630 - RNA, 21 nt, Human
gcagacugcccugcugucccc

SEQ ID NO: 705631 - RNA, 21 nt, Human
aggugcagagccagggaccag

SEQ ID NO: 705632 - RNA, 22 nt, Human
ugcccagcuauuccuuucuuag

SEQ ID NO: 705633 - RNA, 22 nt, Human
uggagagagucgggauaguaca

SEQ ID NO: 705634 - RNA, 22 nt, Human
uggucauaacaugauuaguagg

SEQ ID NO: 705635 - RNA, 22 nt, Human
auaaacacuucuagggcacaca

SEQ ID NO: 705636 - RNA, 20 nt, Human
cuugaacugauucuauuucc

SEQ ID NO: 705637 - RNA, 22 nt, Human
uggcucaggugugagcugaaga

SEQ ID NO: 705638 - RNA, 17 nt, Human
aaucucaguggcuuaag

SEQ ID NO: 705639 - RNA, 22 nt, Human
aggauugugccuccagucagaa

SEQ ID NO: 705640 - RNA, 19 nt, Human
augcauuguuugaaguuga

SEQ ID NO: 705641 - RNA, 22 nt, Human
uagcaaaggaugacuauguacc

SEQ ID NO: 705642 - RNA, 22 nt, Human
ccacccuguguuuuugccauug

SEQ ID NO: 705643 - RNA, 19 nt, Human
acacauguaacaguuuuuc

SEQ ID NO: 705644 - RNA, 22 nt, Human
guaccagucucugugggcaccu

SEQ ID NO: 705645 - RNA, 22 nt, Human
ugggcagauguccucugaagug

SEQ ID NO: 705646 - RNA, 22 nt, Human
uuuagugcuuugcuauucaugg

SEQ ID NO: 705647 - RNA, 21 nt, Human
cuguuuauuucaccugggugc

SEQ ID NO: 705648 - RNA, 22 nt, Human
cagcagcugaggcgcuggcgug

SEQ ID NO: 705649 - RNA, 22 nt, Human
auaugauuccacuauuguaugg

SEQ ID NO: 705650 - RNA, 22 nt, Human
auugucuuuccacugagaaguu

SEQ ID NO: 705651 - RNA, 22 nt, Human
ucugaaagaaagauuuuguuuc

SEQ ID NO: 705652 - RNA, 22 nt, Human
caucugccuaaguggcccuguu

SEQ ID NO: 705653 - RNA, 21 nt, Human
cccugcaggccagggcugagc

SEQ ID NO: 705654 - RNA, 22 nt, Human
uggagaaugauauuccaucauu

SEQ ID NO: 705655 - RNA, 22 nt, Human
gcugagcugcuguucauccugc

SEQ ID NO: 705656 - RNA, 22 nt, Human
gcacacagaaucagugggcaua

SEQ ID NO: 705657 - RNA, 22 nt, Human
cuccuccaguccuccaaggaca

SEQ ID NO: 705658 - RNA, 20 nt, Human
uguucacaguaguugcugcu

SEQ ID NO: 705659 - RNA, 22 nt, Human
aucuggcugacuuugugggaca

SEQ ID NO: 705660 - RNA, 22 nt, Human
gugaaugccgcagucuguugcu

SEQ ID NO: 705661 - RNA, 22 nt, Human
caggaauguuugugcuccuuua

SEQ ID NO: 705662 - RNA, 23 nt, Human
gcacugccaugugcucugcaggc

SEQ ID NO: 705663 - RNA, 19 nt, Human
agcagagcagggccguggg

SEQ ID NO: 705664 - RNA, 22 nt, Human
agggcuacugccugccuucagg

SEQ ID NO: 705665 - RNA, 22 nt, Human
uacagauaacugaaugcagacu

SEQ ID NO: 705666 - RNA, 22 nt, Human
uaaaucacuccuaauaaucagu

SEQ ID NO: 705667 - RNA, 22 nt, Human
uuuaucugagcugauagauagu

SEQ ID NO: 705668 - RNA, 22 nt, Human
uccucugacuucugguugaguu

SEQ ID NO: 705669 - RNA, 18 nt, Human
ggccagccccaggccagc

SEQ ID NO: 705670 - RNA, 22 nt, Human
ucuaggaguaaugagcuagcac

SEQ ID NO: 705671 - RNA, 22 nt, Human
ccugccagccagaucacucgcc

SEQ ID NO: 705672 - RNA, 22 nt, Human
ugaggcaaagacaaagcagcau

SEQ ID NO: 705673 - RNA, 22 nt, Human
ucacacacauuugcugucugau

SEQ ID NO: 705674 - RNA, 22 nt, Human
acagcaauaggaaauacuugca

SEQ ID NO: 705675 - RNA, 22 nt, Human
ucugaaagaagggcagucuuuu

SEQ ID NO: 705676 - RNA, 22 nt, Human
ugggaguguucuuggcuugcuu

SEQ ID NO: 705677 - RNA, 22 nt, Human
uucagaaguagcuaagcaguca

SEQ ID NO: 705678 - RNA, 22 nt, Human
uccuggguaaacacugaccuuu

SEQ ID NO: 705679 - RNA, 22 nt, Human
gaggccugcuuuggcacucugg

SEQ ID NO: 705680 - RNA, 19 nt, Human
gguuugaagaaaaucuugc

SEQ ID NO: 705681 - RNA, 22 nt, Human
uaggugagguuacaagaguuca

SEQ ID NO: 705682 - RNA, 22 nt, Human
augaagaaaaauccagcugucc

SEQ ID NO: 705683 - RNA, 22 nt, Human
aucuggcuuacgaagcacuggu

SEQ ID NO: 705684 - RNA, 22 nt, Human
cugagggcuuccuugucccggg

SEQ ID NO: 705685 - RNA, 22 nt, Human
ccagggcuucaguuagugguga

SEQ ID NO: 705686 - RNA, 22 nt, Human
gcaggagccagggauuccagga

SEQ ID NO: 705687 - RNA, 22 nt, Human
gggcuuggcucauaaguggaug

SEQ ID NO: 705688 - RNA, 22 nt, Human
ggcuauggcaaagaacucagau

SEQ ID NO: 705689 - RNA, 22 nt, Human
ucucuucucuagugagcaacug

SEQ ID NO: 705690 - RNA, 22 nt, Human
agacacaguuugggauggguug

SEQ ID NO: 705691 - RNA, 22 nt, Human
cuagagaaaauguuaauacagu

SEQ ID NO: 705692 - RNA, 21 nt, Human
ccaggaaggacugagcucccu

SEQ ID NO: 705693 - RNA, 22 nt, Human
gcuggggagggcgucaaggcca

SEQ ID NO: 705694 - RNA, 22 nt, Human
ugaguugcuaucuagauccaga

SEQ ID NO: 705695 - RNA, 22 nt, Human
ugcagccaggaaauauuugcug

SEQ ID NO: 705696 - RNA, 22 nt, Human
ggcacugacacuagcauggcac

SEQ ID NO: 705697 - RNA, 21 nt, Human
ucagcauccugagcuguccuc

SEQ ID NO: 705698 - RNA, 22 nt, Human
uuccaggaugcugcugcuuuuu

SEQ ID NO: 705699 - RNA, 22 nt, Human
cacagccuugagcgaggacaag

SEQ ID NO: 705700 - RNA, 22 nt, Human
acuaaaugcugcauaaaugcuu

SEQ ID NO: 705701 - RNA, 22 nt, Human
uccuggaguuuguaaggugagc

SEQ ID NO: 705702 - RNA, 22 nt, Human
guccucuuagccacuuaauuau

SEQ ID NO: 705703 - RNA, 22 nt, Human
auaguuccagcaucuuugguaa

SEQ ID NO: 705704 - RNA, 23 nt, Human
uuaugcaagcuuccuggucucag

SEQ ID NO: 705705 - RNA, 22 nt, Human
acucagaagauauaaugacuca

SEQ ID NO: 705706 - RNA, 22 nt, Human
cuccugggaugacucuuucuuu

SEQ ID NO: 705707 - RNA, 22 nt, Human
acagcaaaagacaagaacuuaa

SEQ ID NO: 705708 - RNA, 22 nt, Human
auucccaccugaaaaagguagg

SEQ ID NO: 705709 - RNA, 22 nt, Human
ugagcaauuaacagagucuaaa

SEQ ID NO: 705710 - RNA, 15 nt, Human
aaucuggcggcaagu

SEQ ID NO: 705711 - RNA, 22 nt, Human
ugcaggaaacagaggcucaaau

SEQ ID NO: 705712 - RNA, 22 nt, Human
gacaggccaggggcugaggugg

SEQ ID NO: 705713 - RNA, 22 nt, Human
ccauuuuugacagaaggccuaa

SEQ ID NO: 705714 - RNA, 22 nt, Human
aaauguacgggaguagaauuag

SEQ ID NO: 705715 - RNA, 22 nt, Human
ccagaucuaaguccaaaguacu

SEQ ID NO: 705716 - RNA, 22 nt, Human
agcaggaaguccucucaggaga

SEQ ID NO: 705717 - RNA, 22 nt, Human
ggaagauucaguuaucucauga

SEQ ID NO: 705718 - RNA, 22 nt, Human
acuuauauuugcuuuaugcuuc

SEQ ID NO: 705719 - RNA, 19 nt, Human
aggcuucaggccacaugcu

SEQ ID NO: 705720 - RNA, 22 nt, Human
uccaguguggaccccugcaguc

SEQ ID NO: 705721 - RNA, 22 nt, Human
gugccaccucugccccagaggg

SEQ ID NO: 705722 - RNA, 22 nt, Human
agcuuccucaccucagaggucu

SEQ ID NO: 705723 - RNA, 22 nt, Human
gcucaagggaugggagugggug

SEQ ID NO: 705724 - RNA, 22 nt, Human
ucuguauaaggacaaacauuua

SEQ ID NO: 705725 - RNA, 22 nt, Human
uccagcuucuugacuugguggu

SEQ ID NO: 705726 - RNA, 21 nt, Human
uuaguucuaccacuugcauuc

SEQ ID NO: 705727 - RNA, 22 nt, Human
uuuggucacuggauuuggcugu

SEQ ID NO: 705728 - RNA, 22 nt, Human
ggagaaaggcauagcagaaccu

SEQ ID NO: 705729 - RNA, 22 nt, Human
cuguccccgcgaguccagagcu

SEQ ID NO: 705730 - RNA, 22 nt, Human
ucaaugucucuuucuaaaaugu

SEQ ID NO: 705731 - RNA, 22 nt, Human
ugauggaaauaaaagcauagcu

SEQ ID NO: 705732 - RNA, 23 nt, Human
uugauuuagcugggauugcaugc

SEQ ID NO: 705733 - RNA, 22 nt, Human
acaguggaugacauccuuuugc

SEQ ID NO: 705734 - RNA, 22 nt, Human
gcccagggcagggcaagaguga

SEQ ID NO: 705735 - RNA, 22 nt, Human
cguguacagucuaucuuuuuuc

SEQ ID NO: 705736 - RNA, 22 nt, Human
uaggaaaaauacagaauuauau

SEQ ID NO: 705737 - RNA, 22 nt, Human
ugagccagcuccuugccuguca

SEQ ID NO: 705738 - RNA, 22 nt, Human
gcagggaggaagagaugcuucc

SEQ ID NO: 705739 - RNA, 22 nt, Human
uaauuuacagagauacagucag

SEQ ID NO: 705740 - RNA, 22 nt, Human
ucagggcaucucuuaaguggug

SEQ ID NO: 705741 - RNA, 22 nt, Human
aacagucuuccuacggccauua

SEQ ID NO: 705742 - RNA, 22 nt, Human
uucuguuagcauucugaucucc

SEQ ID NO: 705743 - RNA, 22 nt, Human
caaugucagaauuacaguugau

SEQ ID NO: 705744 - RNA, 22 nt, Human
aaacacugcaggguuuacuuga

SEQ ID NO: 705745 - RNA, 22 nt, Human
caggggaaggagccuugaaacu

SEQ ID NO: 705746 - RNA, 22 nt, Human
cucaggccauuccuaccaaggg

SEQ ID NO: 705747 - RNA, 22 nt, Human
agucugggcugucugcaggagu

SEQ ID NO: 705748 - RNA, 22 nt, Human
gggcuucucccuaaggacucug

SEQ ID NO: 705749 - RNA, 22 nt, Human
acacccaggcuggcgugcagug

SEQ ID NO: 705750 - RNA, 22 nt, Human
aggaccuggaucacagagaucu

SEQ ID NO: 705751 - RNA, 22 nt, Human
aaguuuuaacaaguacuuacua

SEQ ID NO: 705752 - RNA, 19 nt, Human
uuaaagugcgagaagucuu

SEQ ID NO: 705753 - RNA, 22 nt, Human
cuaaaggcuaggucugaacuca

SEQ ID NO: 705754 - RNA, 22 nt, Human
ugggcagaguagcucagaagaa

SEQ ID NO: 705755 - RNA, 19 nt, Human
ugucaccuucugucaguuu

SEQ ID NO: 705756 - RNA, 22 nt, Human
agacaguaugauauaugaauac

SEQ ID NO: 705757 - RNA, 22 nt, Human
agcagggccuggcacuccuggg

SEQ ID NO: 705758 - RNA, 22 nt, Human
acagaucaccuguuagccaaaa

SEQ ID NO: 705759 - RNA, 22 nt, Human
uaauuuaauuccauggauucua

SEQ ID NO: 705760 - RNA, 22 nt, Human
auuucuaaagagggugguuugg

SEQ ID NO: 705761 - RNA, 22 nt, Human
ugcauccuagggaaggcacuga

SEQ ID NO: 705762 - RNA, 22 nt, Human
agggggugcauuugugaaugaa

SEQ ID NO: 705763 - RNA, 22 nt, Human
aggagguugccagucugggggu

SEQ ID NO: 705764 - RNA, 22 nt, Human
ggguccagggacguuucugcag

SEQ ID NO: 705765 - RNA, 22 nt, Human
ucuaaagauguuuauugacaua

SEQ ID NO: 705766 - RNA, 22 nt, Human
uccaaaaaacguuugaauaguu

SEQ ID NO: 705767 - RNA, 22 nt, Human
cagcugucuaaguugagcagga

SEQ ID NO: 705768 - RNA, 17 nt, Human
cugcuuugugcaacgcu

SEQ ID NO: 705769 - RNA, 23 nt, Human
gacagguaaggguugggagaauc

SEQ ID NO: 705770 - RNA, 22 nt, Human
gggucaaggcuacauggagacc

SEQ ID NO: 705771 - RNA, 22 nt, Human
ggucaaaguugaagaagggcau

SEQ ID NO: 705772 - RNA, 22 nt, Human
aaagcacagagcucccacagga

SEQ ID NO: 705773 - RNA, 22 nt, Human
cucagucaguuuuugugagaga

SEQ ID NO: 705774 - RNA, 22 nt, Human
aucugaaauagucuuaucugag

SEQ ID NO: 705775 - RNA, 22 nt, Human
gacccaggguuucugcacaggg

SEQ ID NO: 705776 - RNA, 22 nt, Human
aacacuaaugggagaacaaccc

SEQ ID NO: 705777 - RNA, 22 nt, Human
uccaggcccagacggggugagg

SEQ ID NO: 705778 - RNA, 22 nt, Human
auuugccuugugaauuggauau

SEQ ID NO: 705779 - RNA, 22 nt, Human
uguuuuguucacugcauugucc

SEQ ID NO: 705780 - RNA, 22 nt, Human
agcugcugagccaggcugaugu

SEQ ID NO: 705781 - RNA, 22 nt, Human
auugaacucugcaggagcugcc

SEQ ID NO: 705782 - RNA, 22 nt, Human
ugacuuuggauaagaaaaugag

SEQ ID NO: 705783 - RNA, 22 nt, Human
ccugccagcauggcuuaucucc

SEQ ID NO: 705784 - RNA, 22 nt, Human
uccuucuggaggcucuaagggg

SEQ ID NO: 705785 - RNA, 22 nt, Human
augggcagacagggagcucacg

SEQ ID NO: 705786 - RNA, 22 nt, Human
gggacuggccaggguuuggaau

SEQ ID NO: 705787 - RNA, 22 nt, Human
gggaagcugcguggucuagggc

SEQ ID NO: 705788 - RNA, 22 nt, Human
ucucacacuucuguguugcaca

SEQ ID NO: 705789 - RNA, 22 nt, Human
auuccagugugcaugguacaca

SEQ ID NO: 705790 - RNA, 19 nt, Human
gagacauguagauagaaga

SEQ ID NO: 705791 - RNA, 22 nt, Human
aagcccagcaucccugcaccag

SEQ ID NO: 705792 - RNA, 22 nt, Human
accacccucagcagagcugaaa

SEQ ID NO: 705793 - RNA, 22 nt, Human
uuuacacaaaagauagcacacc

SEQ ID NO: 705794 - RNA, 22 nt, Human
acagcuuuucaauucugcugag

SEQ ID NO: 705795 - RNA, 22 nt, Human
aucuguuauugaauaggugcua

SEQ ID NO: 705796 - RNA, 22 nt, Human
accauuaacaugauuuugggga

SEQ ID NO: 705797 - RNA, 22 nt, Human
agagccagcauuugacacuggc

SEQ ID NO: 705798 - RNA, 22 nt, Human
agccccccaagggccuucucuu

SEQ ID NO: 705799 - RNA, 19 nt, Human
gccucugcuggggacaggc

SEQ ID NO: 705800 - RNA, 22 nt, Human
auaaaagaaguuuugguacuug

SEQ ID NO: 705801 - RNA, 22 nt, Human
agggcuguuuuucaguguguga

SEQ ID NO: 705802 - RNA, 22 nt, Human
gaaggcagggaauguggugcua

SEQ ID NO: 705803 - RNA, 22 nt, Human
cuuguagcugacuaucuuguuc

SEQ ID NO: 705804 - RNA, 22 nt, Human
gagaugaaucauuccaugguca

SEQ ID NO: 705805 - RNA, 22 nt, Human
gagccaaaugugcagacauugu

SEQ ID NO: 705806 - RNA, 23 nt, Human
ucccugggcccgugccagcggug

SEQ ID NO: 705807 - RNA, 22 nt, Human
auuuuuuauauaccaagguggg

SEQ ID NO: 705808 - RNA, 17 nt, Human
gugcagggaugaaggau

SEQ ID NO: 705809 - RNA, 22 nt, Human
auguuuaauuaucuggguuuug

SEQ ID NO: 705810 - RNA, 22 nt, Human
ugcucuguaaggucagaaaagg

SEQ ID NO: 705811 - RNA, 22 nt, Human
ugcacaguaaacaugacuggag

SEQ ID NO: 705812 - RNA, 22 nt, Human
agcacacugaccugaagccuug

SEQ ID NO: 705813 - RNA, 22 nt, Human
caggugcuucuguaagaaagac

SEQ ID NO: 705814 - RNA, 22 nt, Human
uauuuccagcaguaagaagaca

SEQ ID NO: 705815 - RNA, 15 nt, Human
cuguggcuaaccuaa

SEQ ID NO: 705816 - RNA, 22 nt, Human
auccauauaggcagauggcaca

SEQ ID NO: 705817 - RNA, 22 nt, Human
cauuaacaaauggaagcaugaa

SEQ ID NO: 705818 - RNA, 22 nt, Human
acagguggacacagcagcaguc

SEQ ID NO: 705819 - RNA, 22 nt, Human
aguggccagugcugcucugggg

SEQ ID NO: 705820 - RNA, 22 nt, Human
gacaagacauugguaaagauau

SEQ ID NO: 705821 - RNA, 18 nt, Human
ggggagcagacugaacuc

SEQ ID NO: 705822 - RNA, 22 nt, Human
uggcuucucugugugagggaga

SEQ ID NO: 705823 - RNA, 22 nt, Human
cacagagcaggggucuguguca

SEQ ID NO: 705824 - RNA, 23 nt, Human
ugggaccuguuugcccacagaug

SEQ ID NO: 705825 - RNA, 22 nt, Human
cuguuuuaugaagggaaugaga

SEQ ID NO: 705826 - RNA, 22 nt, Human
ugggccccagcacgucugggga

SEQ ID NO: 705827 - RNA, 22 nt, Human
aagcacaucauguuguucagac

SEQ ID NO: 705828 - RNA, 22 nt, Human
augcaccugaacuccaucagcu

SEQ ID NO: 705829 - RNA, 22 nt, Human
ccagggaagaauaggugugguu

SEQ ID NO: 705830 - RNA, 22 nt, Human
ggccagucugggccacggucgg

SEQ ID NO: 705831 - RNA, 21 nt, Human
ggcugguguuuagcugugaua

SEQ ID NO: 705832 - RNA, 22 nt, Human
uggcagcauuaauuauucaggu

SEQ ID NO: 705833 - RNA, 22 nt, Human
gcuuccuuauuguugccauagu

SEQ ID NO: 705834 - RNA, 22 nt, Human
ccagaagugucuaucaagaugu

SEQ ID NO: 705835 - RNA, 22 nt, Human
guguguguauauauacacacac

SEQ ID NO: 705836 - RNA, 22 nt, Human
caucucugagaccucagcuggg

SEQ ID NO: 705837 - RNA, 22 nt, Human
uuguacuugccauagaacaaca

SEQ ID NO: 705838 - RNA, 22 nt, Human
acagugaaaauaauaucuucaa

SEQ ID NO: 705839 - RNA, 22 nt, Human
uuggacuccucuuuccucuugg

SEQ ID NO: 705840 - RNA, 22 nt, Human
gauuuccuaauguggaucucug

SEQ ID NO: 705841 - RNA, 22 nt, Human
gggcuagcagauucuaccuaau

SEQ ID NO: 705842 - RNA, 21 nt, Human
agacagcagucuccaaacccc

SEQ ID NO: 705843 - RNA, 20 nt, Human
uucuccacaggguggaggag

SEQ ID NO: 705844 - RNA, 22 nt, Human
aaauuuuaguaaggaaguugag

SEQ ID NO: 705845 - RNA, 22 nt, Human
guuggcuuugcucucuguccua

SEQ ID NO: 705846 - RNA, 22 nt, Human
accauuuaauaaguauuuccau

SEQ ID NO: 705847 - RNA, 22 nt, Human
cagagucaugggccgucaggca

SEQ ID NO: 705848 - RNA, 19 nt, Human
aagaagcaauaagcuguga

SEQ ID NO: 705849 - RNA, 22 nt, Human
aacaugaugugaagcaugaacu

SEQ ID NO: 705850 - RNA, 22 nt, Human
accagagauggggcuucucugu

SEQ ID NO: 705851 - RNA, 22 nt, Human
cacccagccuucacacaggagu

SEQ ID NO: 705852 - RNA, 22 nt, Human
gguccugggaagaugcucauga

SEQ ID NO: 705853 - RNA, 22 nt, Human
aacauuaauuacagucaaacau

SEQ ID NO: 705854 - RNA, 22 nt, Human
augucuuucuugugucccaaga

SEQ ID NO: 705855 - RNA, 17 nt, Human
ccuuccucaucuccuuc

SEQ ID NO: 705856 - RNA, 22 nt, Human
cagcccagccgagggccuggcu

SEQ ID NO: 705857 - RNA, 22 nt, Human
gcuggcuccucuguccucacgg

SEQ ID NO: 705858 - RNA, 20 nt, Human
cuaggcagcgagugacugag

SEQ ID NO: 705859 - RNA, 21 nt, Human
gcucuuggaaggggcucagcu

SEQ ID NO: 705860 - RNA, 22 nt, Human
uucuucuucuggcugcaccugg

SEQ ID NO: 705861 - RNA, 22 nt, Human
aggugccagugcuguggucccc

SEQ ID NO: 705862 - RNA, 22 nt, Human
accugcuuuauuccuccugccu

SEQ ID NO: 705863 - RNA, 22 nt, Human
cucuugguaagacauuagaggu

SEQ ID NO: 705864 - RNA, 17 nt, Human
gagagcugcugcuuccg

SEQ ID NO: 705865 - RNA, 19 nt, Human
uggggccuccugucccugg

SEQ ID NO: 705866 - RNA, 22 nt, Human
ggcaggcaaugaggaugggaag

SEQ ID NO: 705867 - RNA, 22 nt, Human
cagcacagcacagcggugacuc

SEQ ID NO: 705868 - RNA, 22 nt, Human
aggaauguggcaaucuucaagu

SEQ ID NO: 705869 - RNA, 22 nt, Human
gcuggccauauauuuugcuguu

SEQ ID NO: 705870 - RNA, 22 nt, Human
ccaaaggccaggcacugagguu

SEQ ID NO: 705871 - RNA, 21 nt, Human
acucaggcaccaggggauggc

SEQ ID NO: 705872 - RNA, 20 nt, Human
ccugaagaguuucucuuucu

SEQ ID NO: 705873 - RNA, 22 nt, Human
gaucuguuuuuucuuagacagu

SEQ ID NO: 705874 - RNA, 22 nt, Human
caaggccaagguuuugugaacu

SEQ ID NO: 705875 - RNA, 22 nt, Human
uccuugagagccacugucuugg

SEQ ID NO: 705876 - RNA, 22 nt, Human
ugccagcuacucuguaggcuga

SEQ ID NO: 705877 - RNA, 22 nt, Human
augucugagucugcuccaguug

SEQ ID NO: 705878 - RNA, 22 nt, Human
ccugccugucccucaguccaca

SEQ ID NO: 705879 - RNA, 22 nt, Human
agagucugugcuggggccagcu

SEQ ID NO: 705880 - RNA, 22 nt, Human
caaaauugauuguggugauggu

SEQ ID NO: 705881 - RNA, 22 nt, Human
aaggaggagugggguccuggaa

SEQ ID NO: 705882 - RNA, 22 nt, Human
ucugggaaugaauaagaccugu

SEQ ID NO: 705883 - RNA, 22 nt, Human
ucugagcugggggccuggcaug

SEQ ID NO: 705884 - RNA, 22 nt, Human
ggucucugucacugaguggccc

SEQ ID NO: 705885 - RNA, 22 nt, Human
cccuggagggacagcugcucua

SEQ ID NO: 705886 - RNA, 22 nt, Human
ggccccacgggggaguccuagu

SEQ ID NO: 705887 - RNA, 22 nt, Human
ggaagaugcccaacccagcuuu

SEQ ID NO: 705888 - RNA, 22 nt, Human
ggaaaauuggcgcguggggcug

SEQ ID NO: 705889 - RNA, 22 nt, Human
cauugaaaaacguugacugagu

SEQ ID NO: 705890 - RNA, 22 nt, Human
ugucaaaaagcugggacaagca

SEQ ID NO: 705891 - RNA, 22 nt, Human
uguguucauguugauucauagc

SEQ ID NO: 705892 - RNA, 22 nt, Human
auuuaagauugcguauucaugu

SEQ ID NO: 705893 - RNA, 22 nt, Human
gaaauugaaagaccaacugcau

SEQ ID NO: 705894 - RNA, 22 nt, Human
agccagcaucccuucagucucc

SEQ ID NO: 705895 - RNA, 22 nt, Human
ucugaaaucuaaugcucugugg

SEQ ID NO: 705896 - RNA, 22 nt, Human
ccuccaaguuugacucaggaca

SEQ ID NO: 705897 - RNA, 22 nt, Human
aaaugcacaaagauuuugcacu

SEQ ID NO: 705898 - RNA, 22 nt, Human
augagagguuucgucagaggaa

SEQ ID NO: 705899 - RNA, 23 nt, Human
ugcaugugaauucauacuuguuu

SEQ ID NO: 705900 - RNA, 22 nt, Human
guauuuaauucugugcuucuag

SEQ ID NO: 705901 - RNA, 22 nt, Human
accagggcagccgagguguguc

SEQ ID NO: 705902 - RNA, 21 nt, Human
ugggugggcagagucucuuca

SEQ ID NO: 705903 - RNA, 22 nt, Human
ggucaggguauaaucaagugag

SEQ ID NO: 705904 - RNA, 22 nt, Human
gggcuccagccaggugucccca

SEQ ID NO: 705905 - RNA, 22 nt, Human
aacauucaccucuaccuccuuc

SEQ ID NO: 705906 - RNA, 22 nt, Human
agcuccugcgcacggugcacac

SEQ ID NO: 705907 - RNA, 22 nt, Human
ucuuaugaaaagcacuuagaac

SEQ ID NO: 705908 - RNA, 22 nt, Human
gacccaggggcagggagaaagu

SEQ ID NO: 705909 - RNA, 22 nt, Human
gcucuggggaugcuucugccgu

SEQ ID NO: 705910 - RNA, 22 nt, Human
aggagaguaccauugggccgca

SEQ ID NO: 705911 - RNA, 22 nt, Human
auuuacaguuuagcauuucaag

SEQ ID NO: 705912 - RNA, 22 nt, Human
cagagucucugggaggcugggu

SEQ ID NO: 705913 - RNA, 22 nt, Human
gaggcagcugaagcuucaaaga

SEQ ID NO: 705914 - RNA, 22 nt, Human
ccucacucuuguccuggcaggu

SEQ ID NO: 705915 - RNA, 22 nt, Human
aagcuucaaugagauaauuguu

SEQ ID NO: 705916 - RNA, 22 nt, Human
gcccugguuuuagaggagcagg

SEQ ID NO: 705917 - RNA, 22 nt, Human
uugugggcuugccuggcucuug

SEQ ID NO: 705918 - RNA, 23 nt, Human
uuauaagaagcaucacaggaaga

SEQ ID NO: 705919 - RNA, 22 nt, Human
uuggcccuggggccagcuucga

SEQ ID NO: 705920 - RNA, 22 nt, Human
gaaaucugcuucuugcauagua

SEQ ID NO: 705921 - RNA, 22 nt, Human
cauugcaccacauugcaucccu

SEQ ID NO: 705922 - RNA, 22 nt, Human
gacaggaacauaaauguaggag

SEQ ID NO: 705923 - RNA, 22 nt, Human
gcuggcucugccccaccuguuc

SEQ ID NO: 705924 - RNA, 23 nt, Human
cguuuuuuccucagauguucugg

SEQ ID NO: 705925 - RNA, 22 nt, Human
uuuugcuuaaucuagauuuugc

SEQ ID NO: 705926 - RNA, 23 nt, Human
uugaaaaauauagucccauuguc

SEQ ID NO: 705927 - RNA, 22 nt, Human
ggacaggagugaggcggguucc

SEQ ID NO: 705928 - RNA, 21 nt, Human
gcuugccuuccuaucuuuggc

SEQ ID NO: 705929 - RNA, 22 nt, Human
aucuguggcuggugagaggcag

SEQ ID NO: 705930 - RNA, 20 nt, Human
agcaagaguaaggacagcga

SEQ ID NO: 705931 - RNA, 22 nt, Human
ugugccugucacccucagagag

SEQ ID NO: 705932 - RNA, 22 nt, Human
gccaggcauucuagaaguagug

SEQ ID NO: 705933 - RNA, 22 nt, Human
uauuaugcaaauauuccuaccu

SEQ ID NO: 705934 - RNA, 22 nt, Human
cucuggcuuguuaaugcauauu

SEQ ID NO: 705935 - RNA, 22 nt, Human
gcaguguguuucugagauaugg

SEQ ID NO: 705936 - RNA, 22 nt, Human
ccucucuuggccgcagucuucu

SEQ ID NO: 705937 - RNA, 22 nt, Human
uguggccuuauuuguauggggg

SEQ ID NO: 705938 - RNA, 22 nt, Human
gauggcuuaagaguaaaaggca

SEQ ID NO: 705939 - RNA, 22 nt, Human
agggcugaccuaagcuccacuu

SEQ ID NO: 705940 - RNA, 22 nt, Human
uuuccuaacucaucggauguac

SEQ ID NO: 705941 - RNA, 22 nt, Human
cuggccagacuacacaugugug

SEQ ID NO: 705942 - RNA, 20 nt, Human
agaaguggcugcagacacua

SEQ ID NO: 705943 - RNA, 22 nt, Human
acucugccuuucagcagaugaa

SEQ ID NO: 705944 - RNA, 22 nt, Human
ugcucugcacaucccucacaaa

SEQ ID NO: 705945 - RNA, 22 nt, Human
agaaccucaauuauuuuugcac

SEQ ID NO: 705946 - RNA, 22 nt, Human
cugagcuguggaauaaacacug

SEQ ID NO: 705947 - RNA, 22 nt, Human
uggcaagagggaugcaagguuu

SEQ ID NO: 705948 - RNA, 22 nt, Human
aguggggucuccuccagccccc

SEQ ID NO: 705949 - RNA, 22 nt, Human
ugcuuucacauguaugcacaaa

SEQ ID NO: 705950 - RNA, 22 nt, Human
ucagacuucaguuuuuaguugu

SEQ ID NO: 705951 - RNA, 22 nt, Human
aggagguggcugaacuugaggg

SEQ ID NO: 705952 - RNA, 22 nt, Human
uggcaugcaagaggaggcuccc

SEQ ID NO: 705953 - RNA, 22 nt, Human
aggcccugcccagagcuccucg

SEQ ID NO: 705954 - RNA, 22 nt, Human
aaggcaacuguaaaacaugcac

SEQ ID NO: 705955 - RNA, 22 nt, Human
cucuaggcugcccaggagcuga

SEQ ID NO: 705956 - RNA, 22 nt, Human
cagagcuguugcggggcuuggc

SEQ ID NO: 705957 - RNA, 22 nt, Human
ucacugaaaaccauacuucuuu

SEQ ID NO: 705958 - RNA, 22 nt, Human
cuuccugaacaaugccaucaau

SEQ ID NO: 705959 - RNA, 22 nt, Human
uucuuuuaauagagauccugug

SEQ ID NO: 705960 - RNA, 23 nt, Human
agcccugcugagacccagcuccc

SEQ ID NO: 705961 - RNA, 19 nt, Human
cuggucugcugcuuccagg

SEQ ID NO: 705962 - RNA, 22 nt, Human
uauugucuaucgcugcuuucau

SEQ ID NO: 705963 - RNA, 22 nt, Human
uuccacagaugaaaauuaaguu

SEQ ID NO: 705964 - RNA, 22 nt, Human
caugaaagcaggaaugguuuua

SEQ ID NO: 705965 - RNA, 22 nt, Human
aucaugacaucugaguuuaagu

SEQ ID NO: 705966 - RNA, 22 nt, Human
auuuccuaauuuaugcaggagu

SEQ ID NO: 705967 - RNA, 22 nt, Human
gcuaggcuucaaaaucucccug

SEQ ID NO: 705968 - RNA, 22 nt, Human
gaggaagaaucaggguggugag

SEQ ID NO: 705969 - RNA, 22 nt, Human
uugcuuccuggcagggcgagcg

SEQ ID NO: 705970 - RNA, 22 nt, Human
ugugcugguacaugugaggaug

SEQ ID NO: 705971 - RNA, 22 nt, Human
acugaucuguuuucagauucug

SEQ ID NO: 705972 - RNA, 22 nt, Human
aaagcauuucaugucuagaaag

SEQ ID NO: 705973 - RNA, 22 nt, Human
gugauccuauaaagugagcaca

SEQ ID NO: 705974 - RNA, 22 nt, Human
ccacaguaaauggauucagacc

SEQ ID NO: 705975 - RNA, 22 nt, Human
auuugcagagcucugaauuuug

SEQ ID NO: 705976 - RNA, 23 nt, Human
uauuacaauuggucuuauuaaga

SEQ ID NO: 705977 - RNA, 22 nt, Human
uuuauuaauguagcauccaugg

SEQ ID NO: 705978 - RNA, 22 nt, Human
ccuguuuaccacugaggggcag

SEQ ID NO: 705979 - RNA, 22 nt, Human
cucacagcacuugugucauugg

SEQ ID NO: 705980 - RNA, 20 nt, Human
aggcuggcacuccuggccag

SEQ ID NO: 705981 - RNA, 21 nt, Human
gauuucacuuaccuucauuua

SEQ ID NO: 705982 - RNA, 22 nt, Human
uguugggaucgaaugguggaac

SEQ ID NO: 705983 - RNA, 22 nt, Human
acugucacuccaacugagucgu

SEQ ID NO: 705984 - RNA, 22 nt, Human
cuguggaguuccaucaggggag

SEQ ID NO: 705985 - RNA, 19 nt, Human
uugaauaugcaaacugaag

SEQ ID NO: 705986 - RNA, 22 nt, Human
aaggcuuuaugugaccaaaaga

SEQ ID NO: 705987 - RNA, 22 nt, Human
cagcucccuauggugaggcgac

SEQ ID NO: 705988 - RNA, 22 nt, Human
gaagucugacucuuuguaagcu

SEQ ID NO: 705989 - RNA, 22 nt, Human
augaaacagaguacuuaauaua

SEQ ID NO: 705990 - RNA, 22 nt, Human
cccaggaggacauuccauaccc

SEQ ID NO: 705991 - RNA, 22 nt, Human
agugaguggguuacagauggga

SEQ ID NO: 705992 - RNA, 22 nt, Human
ucugggcaauggaugcacucac

SEQ ID NO: 705993 - RNA, 22 nt, Human
cuuauuuaaugaggguuagaau

SEQ ID NO: 705994 - RNA, 22 nt, Human
uggcugaaucugcagcaggaag

SEQ ID NO: 705995 - RNA, 22 nt, Human
gaucucuguggacucuuagcac

SEQ ID NO: 705996 - RNA, 22 nt, Human
uggcugagagucauccugugug

SEQ ID NO: 705997 - RNA, 22 nt, Human
cuguuuauacucaaaagauaca

SEQ ID NO: 705998 - RNA, 22 nt, Human
ucucucuaggcaucuauuuuca

SEQ ID NO: 705999 - RNA, 22 nt, Human
gaaccuggcagcccuauaucug

SEQ ID NO: 706000 - RNA, 22 nt, Human
uuuuuccaggguuagauguuua

SEQ ID NO: 706001 - RNA, 22 nt, Human
ggagguggcagagggacauucu

SEQ ID NO: 706002 - RNA, 22 nt, Human
aggagcuggguuccuuuggugg

SEQ ID NO: 706003 - RNA, 22 nt, Human
ugugguuuacuguggcgcugcu

SEQ ID NO: 706004 - RNA, 22 nt, Human
ucagaggugguaaaggacagca

SEQ ID NO: 706005 - RNA, 22 nt, Human
gacagugucccucuggggugga

SEQ ID NO: 706006 - RNA, 22 nt, Human
ugaaggaauggaggaucagagc

SEQ ID NO: 706007 - RNA, 22 nt, Human
ggcagcugcaaaucugcucugu

SEQ ID NO: 706008 - RNA, 22 nt, Human
aacaugaaacccaaacagaaua

SEQ ID NO: 706009 - RNA, 22 nt, Human
uuugagaaugguaaguggaucg

SEQ ID NO: 706010 - RNA, 22 nt, Human
gaaggagcuaaagggagcccug

SEQ ID NO: 706011 - RNA, 22 nt, Human
uucaaagauggagggauagauu

SEQ ID NO: 706012 - RNA, 22 nt, Human
aacaucuaguuccuauauaaua

SEQ ID NO: 706013 - RNA, 22 nt, Human
ucaggacagacuagacuagcgu

SEQ ID NO: 706014 - RNA, 22 nt, Human
agagaauuugagacuugcccaa

SEQ ID NO: 706015 - RNA, 22 nt, Human
uggucugauagucugaaaauga

SEQ ID NO: 706016 - RNA, 22 nt, Human
agguaaaugucagagccuuuaa

SEQ ID NO: 706017 - RNA, 22 nt, Human
ggcaggugcuaagagagguaaa

SEQ ID NO: 706018 - RNA, 22 nt, Human
aauugcuaaagauuauguuuuc

SEQ ID NO: 706019 - RNA, 22 nt, Human
agugucauaugccacugcaucc

SEQ ID NO: 706020 - RNA, 22 nt, Human
cuaggcagacugagcucuaggg

SEQ ID NO: 706021 - RNA, 22 nt, Human
ugucaacacaccuaucucaauu

SEQ ID NO: 706022 - RNA, 22 nt, Human
guggccaagagauaaaauugug

SEQ ID NO: 706023 - RNA, 22 nt, Human
agacacaguguugaaggcuagu

SEQ ID NO: 706024 - RNA, 22 nt, Human
aagcucugcucagcagacuagg

SEQ ID NO: 706025 - RNA, 22 nt, Human
ugaugaaaguucaguagugaau

SEQ ID NO: 706026 - RNA, 22 nt, Human
agaaauuauuagugaauagucu

SEQ ID NO: 706027 - RNA, 22 nt, Human
ccuccccacagcccaggagacu

SEQ ID NO: 706028 - RNA, 22 nt, Human
uauaauuuuagaagagauggaa

SEQ ID NO: 706029 - RNA, 22 nt, Human
ugcagcuggaacuuagaggaga

SEQ ID NO: 706030 - RNA, 22 nt, Human
ugugacagaucuuuaaauaaug

SEQ ID NO: 706031 - RNA, 22 nt, Human
ugcuccuggacuggugugagau

SEQ ID NO: 706032 - RNA, 22 nt, Human
gcuguuucuaagcugguuccua

SEQ ID NO: 706033 - RNA, 22 nt, Human
uaccauuuugaaacauuucauc

SEQ ID NO: 706034 - RNA, 22 nt, Human
gcacagagagucccgggugccc

SEQ ID NO: 706035 - RNA, 22 nt, Human
gcugggucccaagccuggggag

SEQ ID NO: 706036 - RNA, 18 nt, Human
gcuccuggaccaggucac

SEQ ID NO: 706037 - RNA, 22 nt, Human
ucugggagauccaagcagaacu

SEQ ID NO: 706038 - RNA, 22 nt, Human
cagcaucuaaucuucaugccgg

SEQ ID NO: 706039 - RNA, 20 nt, Human
acagagacugagacacuugc

SEQ ID NO: 706040 - RNA, 22 nt, Human
aauacagauggcaugugaagau

SEQ ID NO: 706041 - RNA, 22 nt, Human
auuucacucucccugccacuua

SEQ ID NO: 706042 - RNA, 22 nt, Human
ccuggcugcauuuugcuggaug

SEQ ID NO: 706043 - RNA, 22 nt, Human
acuguguggaaauuugugaggg

SEQ ID NO: 706044 - RNA, 22 nt, Human
gcagcagaguuugggagauggu

SEQ ID NO: 706045 - RNA, 22 nt, Human
auucaagauuaauucuauguca

SEQ ID NO: 706046 - RNA, 22 nt, Human
auguguguauauauagucauuu

SEQ ID NO: 706047 - RNA, 21 nt, Human
ugucuuuggccucauucccag

SEQ ID NO: 706048 - RNA, 22 nt, Human
ucaagcaucuuggucuacgauc

SEQ ID NO: 706049 - RNA, 22 nt, Human
uccugagggcucggggcucaug

SEQ ID NO: 706050 - RNA, 22 nt, Human
ccagcccaugcccuuauagcau

SEQ ID NO: 706051 - RNA, 22 nt, Human
caguggaggccuugggaccuuu

SEQ ID NO: 706052 - RNA, 22 nt, Human
acacauauauuauuuguggcuc

SEQ ID NO: 706053 - RNA, 22 nt, Human
uauaauuuggggaaaguggugu

SEQ ID NO: 706054 - RNA, 18 nt, Human
gagagggaucccucagga

SEQ ID NO: 706055 - RNA, 22 nt, Human
cacagugacauuagugagaaaa

SEQ ID NO: 706056 - RNA, 22 nt, Human
gcaauguuuuuccuuccauauu

SEQ ID NO: 706057 - RNA, 22 nt, Human
cagagggaaaaggggaguaaua

SEQ ID NO: 706058 - RNA, 22 nt, Human
cuucuucccagcuucccucacc

SEQ ID NO: 706059 - RNA, 22 nt, Human
ccuaagauuggugugcacugug

SEQ ID NO: 706060 - RNA, 22 nt, Human
gagaggucggggacacugcaaa

SEQ ID NO: 706061 - RNA, 22 nt, Human
uuaagacauucagauauuucua

SEQ ID NO: 706062 - RNA, 22 nt, Human
caggcuugugucucagcugcag

SEQ ID NO: 706063 - RNA, 22 nt, Human
ucucucuuuuuaaucauguaau

SEQ ID NO: 706064 - RNA, 22 nt, Human
gcagcagcucagccgggcacug

SEQ ID NO: 706065 - RNA, 22 nt, Human
gccaggucgucuccauguccaa

SEQ ID NO: 706066 - RNA, 22 nt, Human
uaaacacucacuucauagccau

SEQ ID NO: 706067 - RNA, 22 nt, Human
uuuguaugaacugguauguagg

SEQ ID NO: 706068 - RNA, 22 nt, Human
acugccuguagcucuucaucuc

SEQ ID NO: 706069 - RNA, 22 nt, Human
agaggcaccaucuggaacagcc

SEQ ID NO: 706070 - RNA, 22 nt, Human
ucagacagcuugggauaacuga

SEQ ID NO: 706071 - RNA, 22 nt, Human
uuccugugguccagagucaucc

SEQ ID NO: 706072 - RNA, 22 nt, Human
gcucugaagggugagcuguucg

SEQ ID NO: 706073 - RNA, 22 nt, Human
aggguccugagccuggggcgca

SEQ ID NO: 706074 - RNA, 22 nt, Human
gccugcaguucugugcuaggca

SEQ ID NO: 706075 - RNA, 22 nt, Human
gugggcagccuccuuuauuuuc

SEQ ID NO: 706076 - RNA, 22 nt, Human
auagguacagcagauauucuua

SEQ ID NO: 706077 - RNA, 18 nt, Human
aagcacagguguuucagg

SEQ ID NO: 706078 - RNA, 18 nt, Human
ugugguggagcugccuuc

SEQ ID NO: 706079 - RNA, 22 nt, Human
uggcuuccaaaggaaugggccu

SEQ ID NO: 706080 - RNA, 22 nt, Human
aggucaaaaugcuuuucagguc

SEQ ID NO: 706081 - RNA, 22 nt, Human
guggucaggcagugggagagaa

SEQ ID NO: 706082 - RNA, 22 nt, Human
gugcacagagcccagggccgcg

SEQ ID NO: 706083 - RNA, 22 nt, Human
ugaagaaacgcagagagguagg

SEQ ID NO: 706084 - RNA, 22 nt, Human
agaaggaaacagcugugcuuug

SEQ ID NO: 706085 - RNA, 22 nt, Human
cuggcuaugugguuagacauaa

SEQ ID NO: 706086 - RNA, 22 nt, Human
cuucuucuucccccuucagggg

SEQ ID NO: 706087 - RNA, 22 nt, Human
aaacaguggccaauucuggaga

SEQ ID NO: 706088 - RNA, 22 nt, Human
acaccaaaguagaauuaaugua

SEQ ID NO: 706089 - RNA, 18 nt, Human
ugagaauguaagaaaugg

SEQ ID NO: 706090 - RNA, 22 nt, Human
cuccaggaaaauagggaaugag

SEQ ID NO: 706091 - RNA, 18 nt, Human
ucagagguacagaaaagu

SEQ ID NO: 706092 - RNA, 22 nt, Human
caaagaauagcauggcauuugu

SEQ ID NO: 706093 - RNA, 22 nt, Human
ugucauuuggacuuugguauua

SEQ ID NO: 706094 - RNA, 22 nt, Human
ggccaggagcaagccaggcucu

SEQ ID NO: 706095 - RNA, 22 nt, Human
acacauuuucuaacagggauca

SEQ ID NO: 706096 - RNA, 22 nt, Human
cugcaugcugagccaacaguga

SEQ ID NO: 706097 - RNA, 22 nt, Human
ucauuuacuugguuuuaaucuu

SEQ ID NO: 706098 - RNA, 22 nt, Human
uuugcauuuguucaaguauuga

SEQ ID NO: 706099 - RNA, 20 nt, Human
cucagaaaagcuaaggagaa

SEQ ID NO: 706100 - RNA, 22 nt, Human
cuuagacauggcagcuccaagu

SEQ ID NO: 706101 - RNA, 22 nt, Human
ucccacaggaggaguuggaaau

SEQ ID NO: 706102 - RNA, 20 nt, Human
uccaagcccuccuuccauuc

SEQ ID NO: 706103 - RNA, 22 nt, Human
gucugaauacguacuugugaag

SEQ ID NO: 706104 - RNA, 22 nt, Human
cccuggcugccagucaccagac

SEQ ID NO: 706105 - RNA, 22 nt, Human
uaaccugggaucugacgggaug

SEQ ID NO: 706106 - RNA, 22 nt, Human
uagaaaccucagggaaaucuuu

SEQ ID NO: 706107 - RNA, 22 nt, Human
gguggcucucugucagugacag

SEQ ID NO: 706108 - RNA, 22 nt, Human
ggcuggcucaugcaaaggguga

SEQ ID NO: 706109 - RNA, 22 nt, Human
aggcugaggcggguagaucacc

SEQ ID NO: 706110 - RNA, 22 nt, Human
uuggcaaaauuuaaagaaguga

SEQ ID NO: 706111 - RNA, 16 nt, Human
ccugggcucuguugga

SEQ ID NO: 706112 - RNA, 22 nt, Human
uauuuguccuuauuaagaucug

SEQ ID NO: 706113 - RNA, 22 nt, Human
cccagcccugaccuauuggaaa

SEQ ID NO: 706114 - RNA, 22 nt, Human
gaugaugaggccaugaggcagg

SEQ ID NO: 706115 - RNA, 22 nt, Human
aagugauacaucuagucuauaa

SEQ ID NO: 706116 - RNA, 22 nt, Human
uucccuaagcauugcaauggcg

SEQ ID NO: 706117 - RNA, 22 nt, Human
uagaaaacuaauacaugcuuga

SEQ ID NO: 706118 - RNA, 22 nt, Human
aggaagcugggguguucuucau

SEQ ID NO: 706119 - RNA, 22 nt, Human
ggccuaguuuuuucugguaggu

SEQ ID NO: 706120 - RNA, 22 nt, Human
ccucccugcgcuccugcggcgg

SEQ ID NO: 706121 - RNA, 22 nt, Human
gggacgacaggcucugugguag

SEQ ID NO: 706122 - RNA, 18 nt, Human
auuaaucauaaaaugcug

SEQ ID NO: 706123 - RNA, 22 nt, Human
uacagccucacauuuacuuaca

SEQ ID NO: 706124 - RNA, 22 nt, Human
cacugacuaaguuugugaaggu

SEQ ID NO: 706125 - RNA, 22 nt, Human
ugaggccugaagccuggagccu

SEQ ID NO: 706126 - RNA, 22 nt, Human
auuucacauuaauuugaugcuc

SEQ ID NO: 706127 - RNA, 22 nt, Human
uauauguagauuguaccaaugu

SEQ ID NO: 706128 - RNA, 22 nt, Human
uugagauagaucucaucuuccc

SEQ ID NO: 706129 - RNA, 22 nt, Human
cccaaaggcauuuugcugacca

SEQ ID NO: 706130 - RNA, 22 nt, Human
ugaaaacuugacaagugaggua

SEQ ID NO: 706131 - RNA, 22 nt, Human
caggcucccgcuccacugggca

SEQ ID NO: 706132 - RNA, 22 nt, Human
agaagcaaggucugucaguaua

SEQ ID NO: 706133 - RNA, 22 nt, Human
uacagagaguacagcauccaca

SEQ ID NO: 706134 - RNA, 19 nt, Human
cuguuauugucagagcucc

SEQ ID NO: 706135 - RNA, 22 nt, Human
cugggccuggggcuguugagag

SEQ ID NO: 706136 - RNA, 22 nt, Human
uuuccauauuuaaucaaaauaa

SEQ ID NO: 706137 - RNA, 18 nt, Human
acauuucuccuucugacc

SEQ ID NO: 706138 - RNA, 22 nt, Human
aggguggcaccuggaagggaug

SEQ ID NO: 706139 - RNA, 22 nt, Human
uguguauagaugcaugcauaua

SEQ ID NO: 706140 - RNA, 23 nt, Human
aggcagcagguuguccaggguga

SEQ ID NO: 706141 - RNA, 22 nt, Human
ugagaggguucccagggguuuc

SEQ ID NO: 706142 - RNA, 22 nt, Human
ucacaugucagucuuaaacaga

SEQ ID NO: 706143 - RNA, 22 nt, Human
auccuucagcugcccuguuacc

SEQ ID NO: 706144 - RNA, 22 nt, Human
uaaaucaguaaggcauauucuc

SEQ ID NO: 706145 - RNA, 22 nt, Human
ucaagacagauggguaacuugg

SEQ ID NO: 706146 - RNA, 22 nt, Human
ccugcaagacuauuuaguucca

SEQ ID NO: 706147 - RNA, 22 nt, Human
aaggucugcuuguuuucuugag

SEQ ID NO: 706148 - RNA, 22 nt, Human
ccaggcacuucaucauuagggu

SEQ ID NO: 706149 - RNA, 22 nt, Human
aaguaucucaaaaacaguaauc

SEQ ID NO: 706150 - RNA, 22 nt, Human
caggauggcagagaaaagggug

SEQ ID NO: 706151 - RNA, 16 nt, Human
cuccucuccuucagga

SEQ ID NO: 706152 - RNA, 22 nt, Human
aguuaaacucuaguagauacaa

SEQ ID NO: 706153 - RNA, 22 nt, Human
agauuucucuuucccuggcuga

SEQ ID NO: 706154 - RNA, 22 nt, Human
uucagucucaauuuaaguuuaa

SEQ ID NO: 706155 - RNA, 22 nt, Human
ccugccccucaaggccuggugc

SEQ ID NO: 706156 - RNA, 22 nt, Human
ccugaagagcacucuagaguug

SEQ ID NO: 706157 - RNA, 22 nt, Human
caggagacuauggcccaaggcc

SEQ ID NO: 706158 - RNA, 22 nt, Human
uaauguguccugaaagcuucug

SEQ ID NO: 706159 - RNA, 21 nt, Human
ucuguacaucauugagucccc

SEQ ID NO: 706160 - RNA, 22 nt, Human
uuuuauguuccugaagcuaucu

SEQ ID NO: 706161 - RNA, 22 nt, Human
ugcuuaaaguguuaacccuguu

SEQ ID NO: 706162 - RNA, 23 nt, Human
ugugucuguuuagggaggaugug

SEQ ID NO: 706163 - RNA, 22 nt, Human
ugagaauuacaaaugagucaca

SEQ ID NO: 706164 - RNA, 22 nt, Human
aaguuacauuuuggucuaauug

SEQ ID NO: 706165 - RNA, 22 nt, Human
ugaaauucauuguuuuaugugu

SEQ ID NO: 706166 - RNA, 22 nt, Human
agggagcuucuacuucaaggca

SEQ ID NO: 706167 - RNA, 22 nt, Human
aaaauugagagucuugugcaag

SEQ ID NO: 706168 - RNA, 22 nt, Human
agcuggagccagugugaggcuu

SEQ ID NO: 706169 - RNA, 22 nt, Human
cauuagcaggcacuaagaaggu

SEQ ID NO: 706170 - RNA, 18 nt, Human
augggcagguaagaucca

SEQ ID NO: 706171 - RNA, 21 nt, Human
uggcacagcaagugggcucau

SEQ ID NO: 706172 - RNA, 22 nt, Human
agcccugggauacaguaaaagc

SEQ ID NO: 706173 - RNA, 22 nt, Human
agcugccccgaggcggcgggaa

SEQ ID NO: 706174 - RNA, 21 nt, Human
gccuggcuagaagcuccuagc

SEQ ID NO: 706175 - RNA, 22 nt, Human
uacagcuuugggaaggccccau

SEQ ID NO: 706176 - RNA, 22 nt, Human
ucacuggagaaaaguaauguau

SEQ ID NO: 706177 - RNA, 22 nt, Human
cgcggagcuccgcccggugccc

SEQ ID NO: 706178 - RNA, 22 nt, Human
gcaguaggagggacaacuaccu

SEQ ID NO: 706179 - RNA, 22 nt, Human
uuuaauuauguuaagccacuga

SEQ ID NO: 706180 - RNA, 22 nt, Human
ggcagugagaggucuccugguc

SEQ ID NO: 706181 - RNA, 22 nt, Human
aggcuucauuguggcaucagga

SEQ ID NO: 706182 - RNA, 18 nt, Human
uguggcugguccacacug

SEQ ID NO: 706183 - RNA, 22 nt, Human
acagaauuuacacaucucuaaa

SEQ ID NO: 706184 - RNA, 22 nt, Human
agggagaagagaacaaagcccu

SEQ ID NO: 706185 - RNA, 22 nt, Human
agcuuuaaaucaauccagugag

SEQ ID NO: 706186 - RNA, 22 nt, Human
gguggaguaauucgcagagguu

SEQ ID NO: 706187 - RNA, 20 nt, Human
acaggagaucugaggaaagg

SEQ ID NO: 706188 - RNA, 22 nt, Human
agcuccugaaaauccagacugg

SEQ ID NO: 706189 - RNA, 22 nt, Human
acuuccuggcguagcugacauu

SEQ ID NO: 706190 - RNA, 22 nt, Human
cagucucucugaaguauuaaga

SEQ ID NO: 706191 - RNA, 22 nt, Human
uuucuaagucugagggaguaua

SEQ ID NO: 706192 - RNA, 22 nt, Human
gggcacaccuugucugagcaca

SEQ ID NO: 706193 - RNA, 22 nt, Human
ucacacagcuuggaguuauggu

SEQ ID NO: 706194 - RNA, 22 nt, Human
gauggagucugaagcugggaac

SEQ ID NO: 706195 - RNA, 22 nt, Human
agccacaggaaacagagacagc

SEQ ID NO: 706196 - RNA, 22 nt, Human
gugcaagaaggggagacugggu

SEQ ID NO: 706197 - RNA, 22 nt, Human
acucuuauuuugaaguaauaau

SEQ ID NO: 706198 - RNA, 22 nt, Human
agcaaugcaaucuuaaccuuga

SEQ ID NO: 706199 - RNA, 22 nt, Human
aagguuuccagugauauugugg

SEQ ID NO: 706200 - RNA, 22 nt, Human
agugaaaaccuaaucaugcagu

SEQ ID NO: 706201 - RNA, 20 nt, Human
ugcagagcuggcuggcuccu

SEQ ID NO: 706202 - RNA, 19 nt, Human
ggcugucucggcccagcca

SEQ ID NO: 706203 - RNA, 22 nt, Human
ugaauaguccuuggaauaacug

SEQ ID NO: 706204 - RNA, 22 nt, Human
ucccaaggccucuaguugauua

SEQ ID NO: 706205 - RNA, 22 nt, Human
gucucccacuuucuggccucuu

SEQ ID NO: 706206 - RNA, 22 nt, Human
gaucucuggguccuguuggccu

SEQ ID NO: 706207 - RNA, 22 nt, Human
ugcucccagggacucuggcugg

SEQ ID NO: 706208 - RNA, 22 nt, Human
gguacagggcuuccuggacaag

SEQ ID NO: 706209 - RNA, 19 nt, Human
gcuggauggauccuggagu

SEQ ID NO: 706210 - RNA, 22 nt, Human
uuggaagggaaccgaguuugcu

SEQ ID NO: 706211 - RNA, 22 nt, Human
gguucaguuuacauuaaaaucu

SEQ ID NO: 706212 - RNA, 18 nt, Human
aacuaaagaucuuuaagc

SEQ ID NO: 706213 - RNA, 20 nt, Human
agugaggcaguucagugggc

SEQ ID NO: 706214 - RNA, 19 nt, Human
ugaagcaggcagagaagau

SEQ ID NO: 706215 - RNA, 19 nt, Human
ucaaaugccaaugucacag

SEQ ID NO: 706216 - RNA, 22 nt, Human
augagcugggccauccagugau

SEQ ID NO: 706217 - RNA, 22 nt, Human
uaaguucaagucuuggauauaa

SEQ ID NO: 706218 - RNA, 22 nt, Human
uauuauugcaaguauauaaagu

SEQ ID NO: 706219 - RNA, 22 nt, Human
uggagcagccaugaugacagag

SEQ ID NO: 706220 - RNA, 22 nt, Human
aaggcuaaauucuguacugcau

SEQ ID NO: 706221 - RNA, 20 nt, Human
aagaaacuugaaaguacaag

SEQ ID NO: 706222 - RNA, 22 nt, Human
ccucccagugccggggccggcu

SEQ ID NO: 706223 - RNA, 22 nt, Human
ccuguucaccauggucacgugc

SEQ ID NO: 706224 - RNA, 23 nt, Human
gcuugucuagugaauucauaucu

SEQ ID NO: 706225 - RNA, 22 nt, Human
uauccugcuuuguuccucuuga

SEQ ID NO: 706226 - RNA, 21 nt, Human
ugaggcucaucuuauguggcu

SEQ ID NO: 706227 - RNA, 23 nt, Human
ugccagaggcagucacaguggug

SEQ ID NO: 706228 - RNA, 22 nt, Human
uggccagugggguugagcagga

SEQ ID NO: 706229 - RNA, 22 nt, Human
uucugagagagccucucauguu

SEQ ID NO: 706230 - RNA, 20 nt, Human
cucuuuugacucuuugcaag

SEQ ID NO: 706231 - RNA, 22 nt, Human
cccagccucuggguucugccgg

SEQ ID NO: 706232 - RNA, 22 nt, Human
gaagcuucgaaagagugauuuc

SEQ ID NO: 706233 - RNA, 22 nt, Human
aagcacugaggaaaaauuugau

SEQ ID NO: 706234 - RNA, 22 nt, Human
ucaggccugcaggcuuccugga

SEQ ID NO: 706235 - RNA, 22 nt, Human
ucagaaagcugauucuugauac

SEQ ID NO: 706236 - RNA, 22 nt, Human
cacauacugagaaucacaccca

SEQ ID NO: 706237 - RNA, 23 nt, Human
uggcuggcagaaacugaagcaug

SEQ ID NO: 706238 - RNA, 22 nt, Human
gcggggcacagugauggagcac

SEQ ID NO: 706239 - RNA, 22 nt, Human
gaugaagccccaguguaaguaa

SEQ ID NO: 706240 - RNA, 22 nt, Human
ccuggcugggguagaagugagg

SEQ ID NO: 706241 - RNA, 22 nt, Human
ggggcucaggggaaguguccag

SEQ ID NO: 706242 - RNA, 22 nt, Human
uggccagacagagaggcuuugu

SEQ ID NO: 706243 - RNA, 22 nt, Human
ggacgcagcgagggaagcagcc

SEQ ID NO: 706244 - RNA, 22 nt, Human
uuggaaacuuggauggaaaacc

SEQ ID NO: 706245 - RNA, 22 nt, Human
uguucuguaccuguccuggggc

SEQ ID NO: 706246 - RNA, 22 nt, Human
acacagccgugaaucugcuucu

SEQ ID NO: 706247 - RNA, 22 nt, Human
gcuuuggagccuguguucugcc

SEQ ID NO: 706248 - RNA, 22 nt, Human
cauggccacaucuagcugcaag

SEQ ID NO: 706249 - RNA, 22 nt, Human
ucaggucccacugcuaguaagu

SEQ ID NO: 706250 - RNA, 22 nt, Human
cuauuaaacacuacugugcacu

SEQ ID NO: 706251 - RNA, 22 nt, Human
gacagacagagaaugggcuuga

SEQ ID NO: 706252 - RNA, 22 nt, Human
ugacaccuugcuaaauggcacc

SEQ ID NO: 706253 - RNA, 22 nt, Human
aaguuuagaacuauaagaguga

SEQ ID NO: 706254 - RNA, 22 nt, Human
cuucauaaacucagaaggcagc

SEQ ID NO: 706255 - RNA, 22 nt, Human
cugaccugcuaagccccugucc

SEQ ID NO: 706256 - RNA, 22 nt, Human
ugcagggccuucuagaccaugg

SEQ ID NO: 706257 - RNA, 22 nt, Human
ccagggcuccccagaaguaccc

SEQ ID NO: 706258 - RNA, 22 nt, Human
uccaaacacccuccaugcugca

SEQ ID NO: 706259 - RNA, 22 nt, Human
ugggccuugcugagcuauggag

SEQ ID NO: 706260 - RNA, 22 nt, Human
aggccuggugugccggaugcag

SEQ ID NO: 706261 - RNA, 22 nt, Human
accagguggccccagcgugguu

SEQ ID NO: 706262 - RNA, 22 nt, Human
cauggcagaaaccugagcugcu

SEQ ID NO: 706263 - RNA, 22 nt, Human
auugcuuuugagcuagaauuuu

SEQ ID NO: 706264 - RNA, 22 nt, Human
cacaggaagcugacugcuggca

SEQ ID NO: 706265 - RNA, 22 nt, Human
uuguccuugugauaguuugcug

SEQ ID NO: 706266 - RNA, 22 nt, Human
ucucucugaguugagcaggagu

SEQ ID NO: 706267 - RNA, 22 nt, Human
uaggagcuaaaauauuuuauau

SEQ ID NO: 706268 - RNA, 22 nt, Human
acaagauuuaaugcaacccaag

SEQ ID NO: 706269 - RNA, 21 nt, Human
ugcaggcugugcgcuccugcc

SEQ ID NO: 706270 - RNA, 22 nt, Human
ggcugcaggcaggguauccacu

SEQ ID NO: 706271 - RNA, 17 nt, Human
uuucaagguuacguucc

SEQ ID NO: 706272 - RNA, 22 nt, Human
uuccucuuccaucuucccaggg

SEQ ID NO: 706273 - RNA, 22 nt, Human
uguauauugccugagucuuucc

SEQ ID NO: 706274 - RNA, 22 nt, Human
ucaaaguuacuugugguuuucu

SEQ ID NO: 706275 - RNA, 21 nt, Human
uuaagacacacagauuaagga

SEQ ID NO: 706276 - RNA, 22 nt, Human
auccucucugugacagggaacg

SEQ ID NO: 706277 - RNA, 22 nt, Human
gucacaggccuggaugaggggc

SEQ ID NO: 706278 - RNA, 23 nt, Human
acacauuuuucccguucugaggu

SEQ ID NO: 706279 - RNA, 21 nt, Human
ggcagccucuguggaagggga

SEQ ID NO: 706280 - RNA, 22 nt, Human
uagcaaccagaacagcacucua

SEQ ID NO: 706281 - RNA, 22 nt, Human
agaguuugugggcuuuuccucc

SEQ ID NO: 706282 - RNA, 22 nt, Human
uagcuguuuugccauaagcgcu

SEQ ID NO: 706283 - RNA, 22 nt, Human
augcccugcugcuggggcagug

SEQ ID NO: 706284 - RNA, 22 nt, Human
gaucacauaauuuggaaacagc

SEQ ID NO: 706285 - RNA, 22 nt, Human
gacaguguuacaauuuaaugga

SEQ ID NO: 706286 - RNA, 22 nt, Human
guuuucucuguguuuggaugau

SEQ ID NO: 706287 - RNA, 22 nt, Human
uagggcuguggucaguccucua

SEQ ID NO: 706288 - RNA, 19 nt, Human
aggcagcaggccagggaug

SEQ ID NO: 706289 - RNA, 22 nt, Human
cagcucuggcgucagggagcga

SEQ ID NO: 706290 - RNA, 22 nt, Human
caggaacaacucccagcaucuc

SEQ ID NO: 706291 - RNA, 19 nt, Human
gaaggagagcugaguuagg

SEQ ID NO: 706292 - RNA, 22 nt, Human
ugaggccucugaggccuaggcu

SEQ ID NO: 706293 - RNA, 22 nt, Human
aaauccuaaaaguuugacuuaa

SEQ ID NO: 706294 - RNA, 22 nt, Human
ugggcacagggguaggaaugag

SEQ ID NO: 706295 - RNA, 22 nt, Human
uagaaauggguuacauuuagag

SEQ ID NO: 706296 - RNA, 22 nt, Human
cggucaggugcagcguuggcac

SEQ ID NO: 706297 - RNA, 22 nt, Human
uuauucuuuucuccagaauccc

SEQ ID NO: 706298 - RNA, 22 nt, Human
guugaaagcuuuucauuuaguu

SEQ ID NO: 706299 - RNA, 18 nt, Human
uuguuuuaagacucuguc

SEQ ID NO: 706300 - RNA, 18 nt, Human
gccugagggucaagugug

SEQ ID NO: 706301 - RNA, 22 nt, Human
caucccugcugguggaaggggu

SEQ ID NO: 706302 - RNA, 22 nt, Human
auggcaccuuccccagagcuca

SEQ ID NO: 706303 - RNA, 22 nt, Human
agaaggcagguuuuaaaauguc

SEQ ID NO: 706304 - RNA, 22 nt, Human
uuuccuuguuauuauuuguccu

SEQ ID NO: 706305 - RNA, 22 nt, Human
uaguuuaugcugcugcagugag

SEQ ID NO: 706306 - RNA, 22 nt, Human
auuaauuuccaggcacugugcu

SEQ ID NO: 706307 - RNA, 22 nt, Human
cggcuucagucucaucaucgcc

SEQ ID NO: 706308 - RNA, 22 nt, Human
ugucuguauugaggugcauauu

SEQ ID NO: 706309 - RNA, 22 nt, Human
cucaguaaggaugcuucagcgg

SEQ ID NO: 706310 - RNA, 22 nt, Human
ugccuggcugaggugacagguu

SEQ ID NO: 706311 - RNA, 22 nt, Human
ugcugccaugcagagcaacaga

SEQ ID NO: 706312 - RNA, 22 nt, Human
aucagaaauagucauguuacuu

SEQ ID NO: 706313 - RNA, 22 nt, Human
acaugcucuccuaaggcccugu

SEQ ID NO: 706314 - RNA, 23 nt, Human
cuggggcucauugcaguagccau

SEQ ID NO: 706315 - RNA, 22 nt, Human
aagaggcagaaauaucgcugaa

SEQ ID NO: 706316 - RNA, 22 nt, Human
auuguaacaggaucccuguggc

SEQ ID NO: 706317 - RNA, 19 nt, Human
ucaucucacagggccuggc

SEQ ID NO: 706318 - RNA, 22 nt, Human
guuuucucaggaugguguguac

SEQ ID NO: 706319 - RNA, 22 nt, Human
aggcuaaggugggaggaucgcu

SEQ ID NO: 706320 - RNA, 22 nt, Human
uuaauugagccagaaaguaucu

SEQ ID NO: 706321 - RNA, 22 nt, Human
agaacagaugugggcagaccug

SEQ ID NO: 706322 - RNA, 22 nt, Human
uuccucuccucccaccagguga

SEQ ID NO: 706323 - RNA, 22 nt, Human
aagugucuuuuagccacuuuua

SEQ ID NO: 706324 - RNA, 22 nt, Human
cacacugauagcacuaagucag

SEQ ID NO: 706325 - RNA, 22 nt, Human
auuauuggacacuucuucugca

SEQ ID NO: 706326 - RNA, 22 nt, Human
gggcuccagauugcagcgauca

SEQ ID NO: 706327 - RNA, 22 nt, Human
cuuugggcaaagggccaauucg

SEQ ID NO: 706328 - RNA, 22 nt, Human
cagauaaauagauagauaaacu

SEQ ID NO: 706329 - RNA, 22 nt, Human
uguguauucagcaagcgaaaca

SEQ ID NO: 706330 - RNA, 22 nt, Human
ugggacagauuauaagucugca

SEQ ID NO: 706331 - RNA, 22 nt, Human
cauuuaugauaguaauaugaaa

SEQ ID NO: 706332 - RNA, 22 nt, Human
uaggcuucccgcucacaugccc

SEQ ID NO: 706333 - RNA, 17 nt, Human
ggcaguggaggaagaga

SEQ ID NO: 706334 - RNA, 22 nt, Human
agcuucuuggcucagcacuugg

SEQ ID NO: 706335 - RNA, 22 nt, Human
ucacugaugcuuaugaaagugu

SEQ ID NO: 706336 - RNA, 22 nt, Human
auuaguguguaggcuggaaaaa

SEQ ID NO: 706337 - RNA, 19 nt, Human
augagcaauaguuuuaauc

SEQ ID NO: 706338 - RNA, 20 nt, Human
ucugaacacaauauaucccc

SEQ ID NO: 706339 - RNA, 21 nt, Human
guucaaauggguagauucaca

SEQ ID NO: 706340 - RNA, 22 nt, Human
auuugucuuuggaccugugaga

SEQ ID NO: 706341 - RNA, 22 nt, Human
uucauuuaauuuguguauuaac

SEQ ID NO: 706342 - RNA, 22 nt, Human
ugcagaaguauuccaggcccca

SEQ ID NO: 706343 - RNA, 23 nt, Human
augacaaacaggacaucuugugc

SEQ ID NO: 706344 - RNA, 22 nt, Human
uuagugcucacguguuagaaag

SEQ ID NO: 706345 - RNA, 22 nt, Human
auugaguaauaauugaucuugg

SEQ ID NO: 706346 - RNA, 22 nt, Human
auccuuggaugugucuuuuugu

SEQ ID NO: 706347 - RNA, 22 nt, Human
auaaaaugguaaacgaagcuga

SEQ ID NO: 706348 - RNA, 22 nt, Human
uaauuggauguucucuggaagc

SEQ ID NO: 706349 - RNA, 22 nt, Human
aagcagcuuaaauuagagccug

SEQ ID NO: 706350 - RNA, 22 nt, Human
agacccugcaccucucgugggc

SEQ ID NO: 706351 - RNA, 22 nt, Human
aggcggguacccuggcucgaaa

SEQ ID NO: 706352 - RNA, 22 nt, Human
uaaugcuuaacagcuggcuuuu

SEQ ID NO: 706353 - RNA, 22 nt, Human
ucuggcagcagcaucaguggcu

SEQ ID NO: 706354 - RNA, 22 nt, Human
gcggugggggaaaggagcgguu

SEQ ID NO: 706355 - RNA, 22 nt, Human
cagucuccaaaucaaucugaau

SEQ ID NO: 706356 - RNA, 22 nt, Human
guggcccuuuguuuugauaccu

SEQ ID NO: 706357 - RNA, 22 nt, Human
uuagagccaguuacaaggucaa

SEQ ID NO: 706358 - RNA, 22 nt, Human
cacuuggaggcccccugugccc

SEQ ID NO: 706359 - RNA, 17 nt, Human
uauugaccuuuguaugu

SEQ ID NO: 706360 - RNA, 22 nt, Human
uacauaaugagcuaguuaaguu

SEQ ID NO: 706361 - RNA, 22 nt, Human
gacuguggcugcguguaaggaa

SEQ ID NO: 706362 - RNA, 22 nt, Human
cagugagcuccugucugucccu

SEQ ID NO: 706363 - RNA, 22 nt, Human
ugcucgagguccccaccggcuc

SEQ ID NO: 706364 - RNA, 22 nt, Human
ccuggggaagucacuucucuuu

SEQ ID NO: 706365 - RNA, 22 nt, Human
agugauuuacuaccauauuggg

SEQ ID NO: 706366 - RNA, 22 nt, Human
aacaucucagaagugacccuga

SEQ ID NO: 706367 - RNA, 22 nt, Human
aauauuaguuucucaagagaga

SEQ ID NO: 706368 - RNA, 22 nt, Human
uagggaugauggagccuaugua

SEQ ID NO: 706369 - RNA, 23 nt, Human
ugugcucccaaauguaggucuau

SEQ ID NO: 706370 - RNA, 22 nt, Human
agaggacagagugcuggauuua

SEQ ID NO: 706371 - RNA, 22 nt, Human
uguuauuuauuucaccuccaga

SEQ ID NO: 706372 - RNA, 22 nt, Human
uuacaguuuauccaggaagagc

SEQ ID NO: 706373 - RNA, 22 nt, Human
gaaagugcucucucuauacaca

SEQ ID NO: 706374 - RNA, 22 nt, Human
ucugagcacaauuacuuacauc

SEQ ID NO: 706375 - RNA, 22 nt, Human
auucauaaguaaaugauuaccu

SEQ ID NO: 706376 - RNA, 22 nt, Human
cagagccagaacuagaccuugu

SEQ ID NO: 706377 - RNA, 22 nt, Human
gggcccaguacccucugccaag

SEQ ID NO: 706378 - RNA, 17 nt, Human
caggaaaauaugaguga

SEQ ID NO: 706379 - RNA, 22 nt, Human
agcugaaggcuagaacagcugg

SEQ ID NO: 706380 - RNA, 22 nt, Human
cuucaauaggaacugcauggca

SEQ ID NO: 706381 - RNA, 22 nt, Human
uuuagaauguuagcguuaaagg

SEQ ID NO: 706382 - RNA, 22 nt, Human
uuccugccccugagagcuccca

SEQ ID NO: 706383 - RNA, 22 nt, Human
uguacaaugccgagacuaacuc

SEQ ID NO: 706384 - RNA, 20 nt, Human
aauguucaguaauuguuuua

SEQ ID NO: 706385 - RNA, 22 nt, Human
uauuuuaaagacugccagccua

SEQ ID NO: 706386 - RNA, 22 nt, Human
ggcaaagcugggauucaaaccc

SEQ ID NO: 706387 - RNA, 22 nt, Human
acaugggacagagaaagaggcc

SEQ ID NO: 706388 - RNA, 22 nt, Human
ggcucugggguuggcccaucuc

SEQ ID NO: 706389 - RNA, 22 nt, Human
ccaccucugagcccaaacccug

SEQ ID NO: 706390 - RNA, 19 nt, Human
uaugucccuuucccccauu

SEQ ID NO: 706391 - RNA, 22 nt, Human
agucugccaagccagaucaugu

SEQ ID NO: 706392 - RNA, 22 nt, Human
cccagcugaacuugcauuccaa

SEQ ID NO: 706393 - RNA, 22 nt, Human
cugcuuccaagaaagagauagg

SEQ ID NO: 706394 - RNA, 22 nt, Human
cuggaagggagcacuguagaga

SEQ ID NO: 706395 - RNA, 22 nt, Human
uagaauucauguuacuguuagc

SEQ ID NO: 706396 - RNA, 22 nt, Human
uuuugccuaagaaucucucuga

SEQ ID NO: 706397 - RNA, 22 nt, Human
ucagacagauuuugacacuugc

SEQ ID NO: 706398 - RNA, 22 nt, Human
gaggcuuugguuauaaaagauc

SEQ ID NO: 706399 - RNA, 22 nt, Human
cuuccaggugcuggccuggccu

SEQ ID NO: 706400 - RNA, 22 nt, Human
uguggcuuccacgauggucacc

SEQ ID NO: 706401 - RNA, 22 nt, Human
ggcuaggggaauaaucuguggu

SEQ ID NO: 706402 - RNA, 22 nt, Human
cuuucuugcauaauuugaaacc

SEQ ID NO: 706403 - RNA, 22 nt, Human
agaguaaauaggagaugacagc

SEQ ID NO: 706404 - RNA, 23 nt, Human
agcuaacagaucgacaaaguaua

SEQ ID NO: 706405 - RNA, 18 nt, Human
ucaguguagaucugugua

SEQ ID NO: 706406 - RNA, 22 nt, Human
gggcugccaagccugccugccu

SEQ ID NO: 706407 - RNA, 22 nt, Human
auacccuuuacaggaacagcaa

SEQ ID NO: 706408 - RNA, 22 nt, Human
guguucucuagagcuguacaaa

SEQ ID NO: 706409 - RNA, 22 nt, Human
ccagccacugggccacugccag

SEQ ID NO: 706410 - RNA, 22 nt, Human
gaagccacagggaaggagaaca

SEQ ID NO: 706411 - RNA, 22 nt, Human
aaggagaauuuggcuugugaug

SEQ ID NO: 706412 - RNA, 22 nt, Human
aagcccuggcggguggagggcc

SEQ ID NO: 706413 - RNA, 22 nt, Human
cuguacaggucaaugauaagau

SEQ ID NO: 706414 - RNA, 22 nt, Human
uuggcauugaaguuucauuggu

SEQ ID NO: 706415 - RNA, 22 nt, Human
ucuucaugccaaaugaguuuug

SEQ ID NO: 706416 - RNA, 22 nt, Human
ugggccuggaguuuguccagag

SEQ ID NO: 706417 - RNA, 19 nt, Human
uggagcagggcccuuguuu

SEQ ID NO: 706418 - RNA, 22 nt, Human
gccccaccgagggugcaguccu

SEQ ID NO: 706419 - RNA, 22 nt, Human
augcaaugguauauggucaccu

SEQ ID NO: 706420 - RNA, 22 nt, Human
acagaugaaacccagcuaguug

SEQ ID NO: 706421 - RNA, 22 nt, Human
ccagagagguagcuuacccucu

SEQ ID NO: 706422 - RNA, 19 nt, Human
gucucugcuccagggucuc

SEQ ID NO: 706423 - RNA, 22 nt, Human
uuacacacucugcccugcuguu

SEQ ID NO: 706424 - RNA, 21 nt, Human
uauuaauuuuucuucccacua

SEQ ID NO: 706425 - RNA, 22 nt, Human
uaaucucuagcccaugcaaaga

SEQ ID NO: 706426 - RNA, 22 nt, Human
aguuuacauaaaaaggcagagg

SEQ ID NO: 706427 - RNA, 22 nt, Human
ucugcucagugcuuaucucuaa

SEQ ID NO: 706428 - RNA, 22 nt, Human
aaugugaacuuugucauguaac

SEQ ID NO: 706429 - RNA, 22 nt, Human
auucuggaauucuaagauucug

SEQ ID NO: 706430 - RNA, 22 nt, Human
aagagggcagcacagguggguc

SEQ ID NO: 706431 - RNA, 22 nt, Human
ucauuuaugcaggaauggcaua

SEQ ID NO: 706432 - RNA, 22 nt, Human
ccaaaucaccagcacgaucauu

SEQ ID NO: 706433 - RNA, 22 nt, Human
cccuggcagugcuccuuuagac

SEQ ID NO: 706434 - RNA, 22 nt, Human
gaccucuugcacccuggcucuu

SEQ ID NO: 706435 - RNA, 22 nt, Human
guguccuguuucccugucuaua

SEQ ID NO: 706436 - RNA, 22 nt, Human
uaauuuuuccacguacacuggg

SEQ ID NO: 706437 - RNA, 22 nt, Human
uccugccugcaaucccagcacu

SEQ ID NO: 706438 - RNA, 22 nt, Human
gcaugagguucuuggccagcau

SEQ ID NO: 706439 - RNA, 22 nt, Human
uugcagaacuuaaagacagagu

SEQ ID NO: 706440 - RNA, 19 nt, Human
ucacauucagccuugcuga

SEQ ID NO: 706441 - RNA, 22 nt, Human
cuugaagacaauggcagauucc

SEQ ID NO: 706442 - RNA, 22 nt, Human
ccucagggucucucacagcacc

SEQ ID NO: 706443 - RNA, 22 nt, Human
uuguuuucacagcuuugcccgg

SEQ ID NO: 706444 - RNA, 22 nt, Human
ugugggaaucagccaggggggc

SEQ ID NO: 706445 - RNA, 22 nt, Human
uaacaauucucaaaagagggga

SEQ ID NO: 706446 - RNA, 22 nt, Human
uggcugcagugcuugagauguc

SEQ ID NO: 706447 - RNA, 19 nt, Human
agcagggacauggaacuuu

SEQ ID NO: 706448 - RNA, 22 nt, Human
ggcacuagugacaaggggacau

SEQ ID NO: 706449 - RNA, 22 nt, Human
acacaaugcauauuuuuccaga

SEQ ID NO: 706450 - RNA, 22 nt, Human
agauguaagaccuucaugaggg

SEQ ID NO: 706451 - RNA, 22 nt, Human
agagugaagguugacacuucac

SEQ ID NO: 706452 - RNA, 21 nt, Human
ucauuugugaucugauuucca

SEQ ID NO: 706453 - RNA, 22 nt, Human
cuggcuguauuaguuugauccu

SEQ ID NO: 706454 - RNA, 18 nt, Human
acugaagaugcaagaccu

SEQ ID NO: 706455 - RNA, 22 nt, Human
gaacagacuuggaggagugauc

SEQ ID NO: 706456 - RNA, 22 nt, Human
ugugggccucagcaggacucca

SEQ ID NO: 706457 - RNA, 22 nt, Human
uucagccaauuagaagccccac

SEQ ID NO: 706458 - RNA, 22 nt, Human
agcaucagcagacucucagcua

SEQ ID NO: 706459 - RNA, 22 nt, Human
agccagagacuuuaccugugca

SEQ ID NO: 706460 - RNA, 22 nt, Human
aaauguccugagauucaacuua

SEQ ID NO: 706461 - RNA, 22 nt, Human
auagacgcggccgcugaugcag

SEQ ID NO: 706462 - RNA, 22 nt, Human
gucagaaaaagcaaggcugggc

SEQ ID NO: 706463 - RNA, 22 nt, Human
guucugaggcaaaggcagcagc

SEQ ID NO: 706464 - RNA, 19 nt, Human
uuagggguaugaaguggua

SEQ ID NO: 706465 - RNA, 22 nt, Human
gcacggcaagacggggccuccu

SEQ ID NO: 706466 - RNA, 18 nt, Human
acauuucuaggugaaagc

SEQ ID NO: 706467 - RNA, 22 nt, Human
uuguguccugauuugacacaau

SEQ ID NO: 706468 - RNA, 22 nt, Human
cuggggggcuacugacagagga

SEQ ID NO: 706469 - RNA, 22 nt, Human
ugaaaauggccugaagaagcaa

SEQ ID NO: 706470 - RNA, 19 nt, Human
agaggcaagggcucaugac

SEQ ID NO: 706471 - RNA, 22 nt, Human
ccuggcuggcaagaucgugaag

SEQ ID NO: 706472 - RNA, 22 nt, Human
ggauccuuaacuaucacaguga

SEQ ID NO: 706473 - RNA, 22 nt, Human
uaauagucauuguauaccuugg

SEQ ID NO: 706474 - RNA, 22 nt, Human
gccaggcuggugcaaggauauu

SEQ ID NO: 706475 - RNA, 22 nt, Human
ccagaagcaaaacagacaguuu

SEQ ID NO: 706476 - RNA, 22 nt, Human
cccagcagccagaaugaggagc

SEQ ID NO: 706477 - RNA, 22 nt, Human
gaaggccaguuuugagauaggu

SEQ ID NO: 706478 - RNA, 22 nt, Human
gcuucuauccuaccaugucuug

SEQ ID NO: 706479 - RNA, 20 nt, Human
aucaucuuuacaaugucagu

SEQ ID NO: 706480 - RNA, 23 nt, Human
acaacuuuacagauacauuuugu

SEQ ID NO: 706481 - RNA, 22 nt, Human
uuacuguguuuggcuuuagaug

SEQ ID NO: 706482 - RNA, 22 nt, Human
aaccuggagugcugguuucacu

SEQ ID NO: 706483 - RNA, 17 nt, Human
cagcugugagagccuua

SEQ ID NO: 706484 - RNA, 22 nt, Human
caaaugcaugagaaauaagagg

SEQ ID NO: 706485 - RNA, 22 nt, Human
cuucuuuagggaucucuugcug

SEQ ID NO: 706486 - RNA, 22 nt, Human
ucuaugucuccaccuucgcaga

SEQ ID NO: 706487 - RNA, 19 nt, Human
uacauccggguuacuuaag

SEQ ID NO: 706488 - RNA, 22 nt, Human
cuggagaguuggaagauggacu

SEQ ID NO: 706489 - RNA, 21 nt, Human
gauuaaauuuaagcuacaugc

SEQ ID NO: 706490 - RNA, 22 nt, Human
agacuguaauugacaugucagc

SEQ ID NO: 706491 - RNA, 22 nt, Human
gagaguucuugccuggguauua

SEQ ID NO: 706492 - RNA, 22 nt, Human
ccaccuggggccucugagucuc

SEQ ID NO: 706493 - RNA, 22 nt, Human
ugaucuuuucaaagacaagcuu

SEQ ID NO: 706494 - RNA, 23 nt, Human
agacccagagacuggcucugcuc

SEQ ID NO: 706495 - RNA, 22 nt, Human
uacagugauuucuacugguguu

SEQ ID NO: 706496 - RNA, 20 nt, Human
agcaguguuucuugacucua

SEQ ID NO: 706497 - RNA, 22 nt, Human
ugccugggugcccucugcuccu

SEQ ID NO: 706498 - RNA, 22 nt, Human
ucuguccagcucuggggcucac

SEQ ID NO: 706499 - RNA, 22 nt, Human
ucuggcagcgaagcguguacuu

SEQ ID NO: 706500 - RNA, 22 nt, Human
cacuccagccucagugacagag

SEQ ID NO: 706501 - RNA, 22 nt, Human
aacauucuauuuugcuaaaaca

SEQ ID NO: 706502 - RNA, 22 nt, Human
cuguguuuuuggucugaucuau

SEQ ID NO: 706503 - RNA, 22 nt, Human
ugcugcuuugauguguaaauca

SEQ ID NO: 706504 - RNA, 22 nt, Human
uuaacacuugaacucuacaugu

SEQ ID NO: 706505 - RNA, 22 nt, Human
cacauuccugagcuucgaccug

SEQ ID NO: 706506 - RNA, 22 nt, Human
cuugaacucaaugugaggaaga

SEQ ID NO: 706507 - RNA, 22 nt, Human
aacauacuuauacuaaauaaug

SEQ ID NO: 706508 - RNA, 22 nt, Human
gcugggcaaggcugaagcuacc

SEQ ID NO: 706509 - RNA, 22 nt, Human
gaggaagggcugccugccgggc

SEQ ID NO: 706510 - RNA, 22 nt, Human
uguguucauuucucucugcugu

SEQ ID NO: 706511 - RNA, 22 nt, Human
gcccagccagagcugugugaug

SEQ ID NO: 706512 - RNA, 22 nt, Human
ucauuuggagccuuccuguuuu

SEQ ID NO: 706513 - RNA, 22 nt, Human
auuauuuguguccacagaauac

SEQ ID NO: 706514 - RNA, 21 nt, Human
gaagacacauaaccucucucc

SEQ ID NO: 706515 - RNA, 22 nt, Human
caggcuucagggaacgcagucu

SEQ ID NO: 706516 - RNA, 22 nt, Human
ugucaauguguacaggagcuca

SEQ ID NO: 706517 - RNA, 22 nt, Human
agacaaauuuguuuuccugucu

SEQ ID NO: 706518 - RNA, 22 nt, Human
gcugagaaaugcagacaugcug

SEQ ID NO: 706519 - RNA, 22 nt, Human
uggcacugaaaaaggagagguu

SEQ ID NO: 706520 - RNA, 22 nt, Human
gcagggcaaacccagguguuca

SEQ ID NO: 706521 - RNA, 22 nt, Human
guuauuucagccacagagugca

SEQ ID NO: 706522 - RNA, 22 nt, Human
gacuggccuggagaugcagcug

SEQ ID NO: 706523 - RNA, 22 nt, Human
accauguuggccaagcuggucu

SEQ ID NO: 706524 - RNA, 22 nt, Human
gcagcuuugaagacuuauuugc

SEQ ID NO: 706525 - RNA, 22 nt, Human
ggcucugggccuccaaggucug

SEQ ID NO: 706526 - RNA, 22 nt, Human
uuaguuaaaauucugcugacau

SEQ ID NO: 706527 - RNA, 22 nt, Human
cacuugaguucuuaauagucag

SEQ ID NO: 706528 - RNA, 22 nt, Human
gcaggucuguugauuacaguca

SEQ ID NO: 706529 - RNA, 22 nt, Human
uauucauggggguccagguacc

SEQ ID NO: 706530 - RNA, 22 nt, Human
guagggcucaguaaauacuuug

SEQ ID NO: 706531 - RNA, 22 nt, Human
uagaaagucaaaacacuguguu

SEQ ID NO: 706532 - RNA, 22 nt, Human
agggaagaaaauccaucgcugc

SEQ ID NO: 706533 - RNA, 22 nt, Human
ugguggagggaacuauuuccag

SEQ ID NO: 706534 - RNA, 22 nt, Human
ggcugugcuuugcccaaagggc

SEQ ID NO: 706535 - RNA, 22 nt, Human
guguagagugacaaggugggaa

SEQ ID NO: 706536 - RNA, 22 nt, Human
ggcaggaagcauuaaaacgauu

SEQ ID NO: 706537 - RNA, 22 nt, Human
caugucuuauauccugucuuca

SEQ ID NO: 706538 - RNA, 22 nt, Human
aaagaacuuaagaaauuaggcu

SEQ ID NO: 706539 - RNA, 22 nt, Human
ucaguucuugggcugcuaggac

SEQ ID NO: 706540 - RNA, 22 nt, Human
gaugaucugagguacaugaaac

SEQ ID NO: 706541 - RNA, 22 nt, Human
guaaacaauagcauugccugau

SEQ ID NO: 706542 - RNA, 22 nt, Human
aaccugaauuacuuuugcacca

SEQ ID NO: 706543 - RNA, 22 nt, Human
gugaaacugcuuuguaaacugu

SEQ ID NO: 706544 - RNA, 22 nt, Human
uggauggggcagcuuaggugug

SEQ ID NO: 706545 - RNA, 22 nt, Human
aaauauaccaguugccugcauc

SEQ ID NO: 706546 - RNA, 22 nt, Human
ucugggaagugagaugcugugu

SEQ ID NO: 706547 - RNA, 22 nt, Human
uuucaagaacaacauucauuca

SEQ ID NO: 706548 - RNA, 22 nt, Human
aaagugcugaaauuacaggugu

SEQ ID NO: 706549 - RNA, 22 nt, Human
aaaugcuuguauauuucuuggu

SEQ ID NO: 706550 - RNA, 22 nt, Human
agcccaugcaacaggccuagcg

SEQ ID NO: 706551 - RNA, 22 nt, Human
gauguacaagauuguaggaaug

SEQ ID NO: 706552 - RNA, 22 nt, Human
cagaaacauguauaaaguugua

SEQ ID NO: 706553 - RNA, 21 nt, Human
uuucuaagugcuugguuuggg

SEQ ID NO: 706554 - RNA, 22 nt, Human
auaaggcaucucucaguuagca

SEQ ID NO: 706555 - RNA, 22 nt, Human
ugauuucucuccguuauuucag

SEQ ID NO: 706556 - RNA, 22 nt, Human
uuuguuuaucaaggucuagcau

SEQ ID NO: 706557 - RNA, 22 nt, Human
gagaggccaagggauccgugag

SEQ ID NO: 706558 - RNA, 22 nt, Human
uauuacugagguuuuauggagu

SEQ ID NO: 706559 - RNA, 22 nt, Human
cacaggaaauauuaggagggau

SEQ ID NO: 706560 - RNA, 22 nt, Human
gaacaaauucucaucaacuugu

SEQ ID NO: 706561 - RNA, 22 nt, Human
uagcaucuguucuuucauuaaa

SEQ ID NO: 706562 - RNA, 22 nt, Human
gcccaggauaaugcugucccug

SEQ ID NO: 706563 - RNA, 22 nt, Human
aggcuucagaugaccuuagcau

SEQ ID NO: 706564 - RNA, 22 nt, Human
guaacaaaguuucuaggugcug

SEQ ID NO: 706565 - RNA, 22 nt, Human
agguucuggagaacuuggaggu

SEQ ID NO: 706566 - RNA, 22 nt, Human
gcaaagcaaaugccugaaggcg

SEQ ID NO: 706567 - RNA, 22 nt, Human
gcagagcaccaaagugaaagau

SEQ ID NO: 706568 - RNA, 22 nt, Human
ugcugaggcaguccuaacagga

SEQ ID NO: 706569 - RNA, 22 nt, Human
aaauuugccagaucaauucuga

SEQ ID NO: 706570 - RNA, 21 nt, Human
ugcuugucugccuagaggcuu

SEQ ID NO: 706571 - RNA, 22 nt, Human
gaaggaagacugguuuaaaugu

SEQ ID NO: 706572 - RNA, 21 nt, Human
ugucagcaacaauacuuucuc

SEQ ID NO: 706573 - RNA, 22 nt, Human
gucuccaguguucaggugacug

SEQ ID NO: 706574 - RNA, 22 nt, Human
gaaggagagaaaggcaauucug

SEQ ID NO: 706575 - RNA, 18 nt, Human
gccucaguuuccucaccu

SEQ ID NO: 706576 - RNA, 22 nt, Human
ugaaugaguggauucugaguag

SEQ ID NO: 706577 - RNA, 22 nt, Human
guacaggaaggagggaguuuca

SEQ ID NO: 706578 - RNA, 22 nt, Human
uguuauuugggaaaguuguaca

SEQ ID NO: 706579 - RNA, 22 nt, Human
cuguccaucagaaaggggcuua

SEQ ID NO: 706580 - RNA, 22 nt, Human
ucaggucuuuugucuccuagaa

SEQ ID NO: 706581 - RNA, 22 nt, Human
aaccccaggcuggaggagucuc

SEQ ID NO: 706582 - RNA, 22 nt, Human
aagacacucauuaucacugguu

SEQ ID NO: 706583 - RNA, 22 nt, Human
uuccugccuacaugccuuaugc

SEQ ID NO: 706584 - RNA, 22 nt, Human
cagagccuggcgaugucaugga

SEQ ID NO: 706585 - RNA, 22 nt, Human
cacuguuuuuauguaaucagug

SEQ ID NO: 706586 - RNA, 22 nt, Human
ugguguguacauuuuugcuucu

SEQ ID NO: 706587 - RNA, 22 nt, Human
gggagagagagcucauguugaa

SEQ ID NO: 706588 - RNA, 22 nt, Human
uacaaagugugcccaugcugag

SEQ ID NO: 706589 - RNA, 22 nt, Human
uuuccuaaucccaaugacauuu

SEQ ID NO: 706590 - RNA, 22 nt, Human
aagccaguguggucugcccauu

SEQ ID NO: 706591 - RNA, 22 nt, Human
cagguggguacaucacagagac

SEQ ID NO: 706592 - RNA, 21 nt, Human
cagcaaaucauugggcagacu

SEQ ID NO: 706593 - RNA, 22 nt, Human
ccugcccagggucaccacagag

SEQ ID NO: 706594 - RNA, 22 nt, Human
auguacaggauggugcucaucu

SEQ ID NO: 706595 - RNA, 18 nt, Human
cgggcgggcgccuggccc

SEQ ID NO: 706596 - RNA, 22 nt, Human
uggcaacaugucgaagugcugu

SEQ ID NO: 706597 - RNA, 19 nt, Human
cagaggcacuuucucuuag

SEQ ID NO: 706598 - RNA, 22 nt, Human
gcuggggacuccccaccauagc

SEQ ID NO: 706599 - RNA, 22 nt, Human
gggaagugauggagccaggauu

SEQ ID NO: 706600 - RNA, 22 nt, Human
acauucuuucaccuugugucca

SEQ ID NO: 706601 - RNA, 22 nt, Human
gaggccuccucugagacaucug

SEQ ID NO: 706602 - RNA, 22 nt, Human
caggaaacaaagccuugcucau

SEQ ID NO: 706603 - RNA, 22 nt, Human
aaauugccaaauuguuuuccag

SEQ ID NO: 706604 - RNA, 22 nt, Human
gaauguuuuucaaaccuguggc

SEQ ID NO: 706605 - RNA, 22 nt, Human
agcaccuccuuagcuaugacca

SEQ ID NO: 706606 - RNA, 22 nt, Human
guuuacaguggcuucauuggau

SEQ ID NO: 706607 - RNA, 22 nt, Human
auucuagcaguuacaggcugau

SEQ ID NO: 706608 - RNA, 22 nt, Human
cuggccaggcauccccugaucc

SEQ ID NO: 706609 - RNA, 22 nt, Human
ccagggugagaaaaggcuggau

SEQ ID NO: 706610 - RNA, 22 nt, Human
guuccacaaagauugucucucu

SEQ ID NO: 706611 - RNA, 22 nt, Human
uucuuguuccaugaaagacaga

SEQ ID NO: 706612 - RNA, 22 nt, Human
acugugaacggacugaagccca

SEQ ID NO: 706613 - RNA, 22 nt, Human
aggaaugucugagaaagaggca

SEQ ID NO: 706614 - RNA, 22 nt, Human
aaauacauuuacagucguggcu

SEQ ID NO: 706615 - RNA, 22 nt, Human
ccucaccucagucugggccuca

SEQ ID NO: 706616 - RNA, 22 nt, Human
aaucuugaguguuacucucauu

SEQ ID NO: 706617 - RNA, 22 nt, Human
cauuaugaagcaucaucuuauu

SEQ ID NO: 706618 - RNA, 22 nt, Human
cacaguuucaauaauuauucuu

SEQ ID NO: 706619 - RNA, 22 nt, Human
agcagagcaugcuaagugacuc

SEQ ID NO: 706620 - RNA, 22 nt, Human
acuagcagggauguuauuacuu

SEQ ID NO: 706621 - RNA, 23 nt, Human
gaggcacucaggaaaugugagug

SEQ ID NO: 706622 - RNA, 22 nt, Human
ugucuauuugaauuauccuaau

SEQ ID NO: 706623 - RNA, 23 nt, Human
aagcuucuaucucugcagaagga

SEQ ID NO: 706624 - RNA, 22 nt, Human
agggcacaucugcugggaaugg

SEQ ID NO: 706625 - RNA, 21 nt, Human
uuucauugaaugagauaaggu

SEQ ID NO: 706626 - RNA, 22 nt, Human
gcaguuauguauguguuugaga

SEQ ID NO: 706627 - RNA, 22 nt, Human
cagggcucugccuugagggaug

SEQ ID NO: 706628 - RNA, 22 nt, Human
aagccacuguuuuggagugcuu

SEQ ID NO: 706629 - RNA, 22 nt, Human
uuagaaaugcacccaagaccua

SEQ ID NO: 706630 - RNA, 22 nt, Human
agugacaggaccaggucuggaa

SEQ ID NO: 706631 - RNA, 20 nt, Human
agcugguccccaagccucuc

SEQ ID NO: 706632 - RNA, 17 nt, Human
ggcagcugccacuuuuu

SEQ ID NO: 706633 - RNA, 22 nt, Human
ugcugucuucucugaggucccu

SEQ ID NO: 706634 - RNA, 22 nt, Human
gcaaggaccuuugagcgugcca

SEQ ID NO: 706635 - RNA, 22 nt, Human
aaagcagcaaguauuuguuacu

SEQ ID NO: 706636 - RNA, 22 nt, Human
cagccugcuagggcaaugccuu

SEQ ID NO: 706637 - RNA, 22 nt, Human
ugaaguccuagaacuccuggua

SEQ ID NO: 706638 - RNA, 21 nt, Human
gacuucaugggucaaccaauu

SEQ ID NO: 706639 - RNA, 22 nt, Human
uuccucuccucacaugagucac

SEQ ID NO: 706640 - RNA, 22 nt, Human
cugaacugacagacugccugcu

SEQ ID NO: 706641 - RNA, 22 nt, Human
uaaacuaucuguguuugaaguu

SEQ ID NO: 706642 - RNA, 22 nt, Human
ucagcagggccaugcucucucu

SEQ ID NO: 706643 - RNA, 22 nt, Human
aggcagauuacuugaggccagg

SEQ ID NO: 706644 - RNA, 22 nt, Human
ugaaggcauuugaguuggugag

SEQ ID NO: 706645 - RNA, 22 nt, Human
ccggcgggcgcggugacgucag

SEQ ID NO: 706646 - RNA, 22 nt, Human
agugaccauuuucagcuagagg

SEQ ID NO: 706647 - RNA, 22 nt, Human
ggcuuccaagguccucuccacc

SEQ ID NO: 706648 - RNA, 22 nt, Human
agcucaggcaacucugggcccc

SEQ ID NO: 706649 - RNA, 22 nt, Human
ggguccagaaugagaaugggcu

SEQ ID NO: 706650 - RNA, 22 nt, Human
caaagcugauacucagcaagua

SEQ ID NO: 706651 - RNA, 22 nt, Human
cagcacaauuuucaggagucca

SEQ ID NO: 706652 - RNA, 22 nt, Human
guggggcaguggccugggagca

SEQ ID NO: 706653 - RNA, 22 nt, Human
aagaggaacugggggcugaguc

SEQ ID NO: 706654 - RNA, 22 nt, Human
agggcugccugacuccagagcc

SEQ ID NO: 706655 - RNA, 20 nt, Human
auaauuuacccugcaccacu

SEQ ID NO: 706656 - RNA, 22 nt, Human
ugauacuuuucuuuuagacuaa

SEQ ID NO: 706657 - RNA, 22 nt, Human
auaaggaaaauuggagaaauug

SEQ ID NO: 706658 - RNA, 22 nt, Human
uagaggagggcuguucuucagu

SEQ ID NO: 706659 - RNA, 22 nt, Human
gcagagcucaugccugcaccuc

SEQ ID NO: 706660 - RNA, 22 nt, Human
acaugcaauauugagacuuucu

SEQ ID NO: 706661 - RNA, 22 nt, Human
gcccacuggcuggagugcuggu

SEQ ID NO: 706662 - RNA, 22 nt, Human
uugacaaaacaacacagauuuc

SEQ ID NO: 706663 - RNA, 22 nt, Human
ugauuuuauugaaacuucacuu

SEQ ID NO: 706664 - RNA, 22 nt, Human
gugauuaagcauuucagaauuu

SEQ ID NO: 706665 - RNA, 22 nt, Human
ugagcagcccuuccuccggcca

SEQ ID NO: 706666 - RNA, 22 nt, Human
agcuccaggccuugggccccgg

SEQ ID NO: 706667 - RNA, 22 nt, Human
gggcuucuagaauuucugauau

SEQ ID NO: 706668 - RNA, 22 nt, Human
gggcaccagcggccgcacugcc

SEQ ID NO: 706669 - RNA, 22 nt, Human
acuuggcuuuuccaucucugca

SEQ ID NO: 706670 - RNA, 22 nt, Human
ggugucugaugguggcuucuca

SEQ ID NO: 706671 - RNA, 22 nt, Human
agcucacaguguccuuccucaa

SEQ ID NO: 706672 - RNA, 22 nt, Human
cagaaauguuuauauguggugu

SEQ ID NO: 706673 - RNA, 22 nt, Human
agugugagcccuggaguggugc

SEQ ID NO: 706674 - RNA, 22 nt, Human
auuucaacguuagauguaauag

SEQ ID NO: 706675 - RNA, 20 nt, Human
ucuucagcacuccuuaggua

SEQ ID NO: 706676 - RNA, 23 nt, Human
cccagggacacgaugacaccucc

SEQ ID NO: 706677 - RNA, 22 nt, Human
guggcacaaggcuuacacagca

SEQ ID NO: 706678 - RNA, 22 nt, Human
gaguaauuccaauauaaaucac

SEQ ID NO: 706679 - RNA, 22 nt, Human
ccuccaggcugaauaucuagaa

SEQ ID NO: 706680 - RNA, 22 nt, Human
aaugcaaugcagcaccuccuug

SEQ ID NO: 706681 - RNA, 22 nt, Human
uuuccucuucgauuaaguuugg

SEQ ID NO: 706682 - RNA, 22 nt, Human
agaagccagaauauucauggau

SEQ ID NO: 706683 - RNA, 22 nt, Human
aagagcaggacagaaucagaac

SEQ ID NO: 706684 - RNA, 22 nt, Human
ccaggccuggaccaugccaggg

SEQ ID NO: 706685 - RNA, 22 nt, Human
uuugcucaguucucuguauuuu

SEQ ID NO: 706686 - RNA, 22 nt, Human
agacacugaaauguauugaaga

SEQ ID NO: 706687 - RNA, 22 nt, Human
guccaggucuggacccugagcc

SEQ ID NO: 706688 - RNA, 22 nt, Human
ugggccacaagccaugggacca

SEQ ID NO: 706689 - RNA, 22 nt, Human
gguggggcugcaagcaguucgg

SEQ ID NO: 706690 - RNA, 22 nt, Human
gaacacaagcguaugucuuugu

SEQ ID NO: 706691 - RNA, 22 nt, Human
gcagcagugcgggcagcuacag

SEQ ID NO: 706692 - RNA, 22 nt, Human
aacuagaaagaacauauuucca

SEQ ID NO: 706693 - RNA, 22 nt, Human
gcacaugucuuauucacuguua

SEQ ID NO: 706694 - RNA, 22 nt, Human
aaggauuuuuggaaugagaugg

SEQ ID NO: 706695 - RNA, 22 nt, Human
uuaagaauggaaugaggaauuu

SEQ ID NO: 706696 - RNA, 21 nt, Human
acugggcuagccugacuucug

SEQ ID NO: 706697 - RNA, 22 nt, Human
cuggagguaauguuauuuuugu

SEQ ID NO: 706698 - RNA, 23 nt, Human
cagugcagggcaacucagacucc

SEQ ID NO: 706699 - RNA, 22 nt, Human
uacaagaaugucuuaaaagcuc

SEQ ID NO: 706700 - RNA, 22 nt, Human
auucacaugugcuucuuaucac

SEQ ID NO: 706701 - RNA, 22 nt, Human
acuugaaaagcucagcaguagu

SEQ ID NO: 706702 - RNA, 22 nt, Human
caguuaacuucauaugaucauu

SEQ ID NO: 706703 - RNA, 22 nt, Human
cagcuggaucccugcagaacuu

SEQ ID NO: 706704 - RNA, 22 nt, Human
gccuggagggauagaaugcaag

SEQ ID NO: 706705 - RNA, 22 nt, Human
cacugaaccugaaccaauacuc

SEQ ID NO: 706706 - RNA, 22 nt, Human
gagaugguuggguuaacaacua

SEQ ID NO: 706707 - RNA, 22 nt, Human
uuuaacccaaauaaccacagga

SEQ ID NO: 706708 - RNA, 22 nt, Human
gaggagggcaguuccucuuuua

SEQ ID NO: 706709 - RNA, 19 nt, Human
ugucccagacuccgugucu

SEQ ID NO: 706710 - RNA, 22 nt, Human
ccugggaccucgcgggaagcgg

SEQ ID NO: 706711 - RNA, 22 nt, Human
ccugucuguauugguuugcuau

SEQ ID NO: 706712 - RNA, 22 nt, Human
cacuucaaccucugaguccugg

SEQ ID NO: 706713 - RNA, 22 nt, Human
uuacuuucaaaaacuacguggg

SEQ ID NO: 706714 - RNA, 22 nt, Human
gugcaggugguuggcccagccg

SEQ ID NO: 706715 - RNA, 22 nt, Human
ccaggagguggcaggacuugcc

SEQ ID NO: 706716 - RNA, 22 nt, Human
cuccuccagugggucccucagg

SEQ ID NO: 706717 - RNA, 22 nt, Human
ggggaccuaggcucugucucuu

SEQ ID NO: 706718 - RNA, 22 nt, Human
acaggcaccugccaccacaucu

SEQ ID NO: 706719 - RNA, 22 nt, Human
ucagcuucaaauuuggugaagu

SEQ ID NO: 706720 - RNA, 22 nt, Human
gcagaugauguagacagacagu

SEQ ID NO: 706721 - RNA, 22 nt, Human
cacaggcuuuucugacauaggc

SEQ ID NO: 706722 - RNA, 20 nt, Human
cucugcagcaaggccugggu

SEQ ID NO: 706723 - RNA, 22 nt, Human
agcugcccucgcuggggccaga

SEQ ID NO: 706724 - RNA, 22 nt, Human
uaacacagugucuaccauuauu

SEQ ID NO: 706725 - RNA, 22 nt, Human
uacaccugggacccauccaaga

SEQ ID NO: 706726 - RNA, 22 nt, Human
accaggaggaaguguuaaugau

SEQ ID NO: 706727 - RNA, 22 nt, Human
gucaguucauuagcacuuccaa

SEQ ID NO: 706728 - RNA, 22 nt, Human
acacaagaauaaugaugaaggu

SEQ ID NO: 706729 - RNA, 19 nt, Human
auucagcauucugcacuuc

SEQ ID NO: 706730 - RNA, 22 nt, Human
uugacaagaaucguugccuugg

SEQ ID NO: 706731 - RNA, 22 nt, Human
uaacuucuggaaaugcaucugc

SEQ ID NO: 706732 - RNA, 22 nt, Human
agggagacacaugaggaaguca

SEQ ID NO: 706733 - RNA, 22 nt, Human
cuucuugucaauuugccauugu

SEQ ID NO: 706734 - RNA, 22 nt, Human
gggcucuguggaugugagagcu

SEQ ID NO: 706735 - RNA, 22 nt, Human
agaggucuuaaguuccuugaug

SEQ ID NO: 706736 - RNA, 22 nt, Human
aagcuuggaagucuuccuuuca

SEQ ID NO: 706737 - RNA, 22 nt, Human
acuugggauuucagaugcugug

SEQ ID NO: 706738 - RNA, 22 nt, Human
cugggccuugcaucccagagcc

SEQ ID NO: 706739 - RNA, 22 nt, Human
agcuggccagcaccuccagguc

SEQ ID NO: 706740 - RNA, 22 nt, Human
acaggaaauuggcauaucaguu

SEQ ID NO: 706741 - RNA, 22 nt, Human
gaaaagaacugcaugggauuaa

SEQ ID NO: 706742 - RNA, 23 nt, Human
gaggaccaaauauauacauggaa

SEQ ID NO: 706743 - RNA, 22 nt, Human
aggagagaauuacuggguguca

SEQ ID NO: 706744 - RNA, 22 nt, Human
aagaggucauaccagauaaggg

SEQ ID NO: 706745 - RNA, 22 nt, Human
ugcagagaaaacuccuggguac

SEQ ID NO: 706746 - RNA, 22 nt, Human
agcaugaaaggcgugccaacuu

SEQ ID NO: 706747 - RNA, 22 nt, Human
gcucccagggaccgcagggcag

SEQ ID NO: 706748 - RNA, 22 nt, Human
uguucugccagcacuucucagc

SEQ ID NO: 706749 - RNA, 22 nt, Human
ggcuucaaauggagcaaccaga

SEQ ID NO: 706750 - RNA, 21 nt, Human
cugggcucaagcaauccuuuc

SEQ ID NO: 706751 - RNA, 22 nt, Human
augcuuccuuuuucccuuaagg

SEQ ID NO: 706752 - RNA, 20 nt, Human
uguauucuucuccuuccucc

SEQ ID NO: 706753 - RNA, 23 nt, Human
auaauaauuauggcagcaaagug

SEQ ID NO: 706754 - RNA, 22 nt, Human
ucucugaagcuguuguagucuc

SEQ ID NO: 706755 - RNA, 22 nt, Human
aggcucaguucuguggugagcc

SEQ ID NO: 706756 - RNA, 22 nt, Human
gcugggcuugguuucccugcuu

SEQ ID NO: 706757 - RNA, 22 nt, Human
agggugcagucacaggaaaugu

SEQ ID NO: 706758 - RNA, 22 nt, Human
aguucugcugcugccuagggug

SEQ ID NO: 706759 - RNA, 22 nt, Human
auacuuacuuuucuucagacua

SEQ ID NO: 706760 - RNA, 22 nt, Human
gaaggccacuuuguguugagaa

SEQ ID NO: 706761 - RNA, 22 nt, Human
uuaacauuaaaagcagcauuuu

SEQ ID NO: 706762 - RNA, 22 nt, Human
auguaaacaagguuauugucca

SEQ ID NO: 706763 - RNA, 22 nt, Human
gaaaaccaccucccaucaagca

SEQ ID NO: 706764 - RNA, 22 nt, Human
agcugggcaaaaugugagguug

SEQ ID NO: 706765 - RNA, 22 nt, Human
uuuguguguauauguauauaga

SEQ ID NO: 706766 - RNA, 22 nt, Human
ucgcaccuguccucugauuaug

SEQ ID NO: 706767 - RNA, 22 nt, Human
uacaugacauuucuuucuguuc

SEQ ID NO: 706768 - RNA, 22 nt, Human
uucacauuauaaucaguucugc

SEQ ID NO: 706769 - RNA, 20 nt, Human
uacccuggcuaugcuucuga

SEQ ID NO: 706770 - RNA, 22 nt, Human
uagacacuuuagaaguaagggu

SEQ ID NO: 706771 - RNA, 22 nt, Human
gggugcagcuuugaaagcaugu

SEQ ID NO: 706772 - RNA, 22 nt, Human
uggcuccacaggccagggugug

SEQ ID NO: 706773 - RNA, 22 nt, Human
uguccacaucacucacuuguca

SEQ ID NO: 706774 - RNA, 22 nt, Human
gaugucuuacuaacuagccuuu

SEQ ID NO: 706775 - RNA, 22 nt, Human
augagcucauccgagucacacu

SEQ ID NO: 706776 - RNA, 22 nt, Human
uccaggcugcagucuugcccuc

SEQ ID NO: 706777 - RNA, 22 nt, Human
auaacuucaguuucuguguccu

SEQ ID NO: 706778 - RNA, 18 nt, Human
cguuuuuccgggauugca

SEQ ID NO: 706779 - RNA, 22 nt, Human
gcccaugggccugaggcccuag

SEQ ID NO: 706780 - RNA, 22 nt, Human
agaugaagauaucugcaggggc

SEQ ID NO: 706781 - RNA, 22 nt, Human
uauuucuuguuauucucguuga

SEQ ID NO: 706782 - RNA, 22 nt, Human
ggaucuucagccagcaggugcc

SEQ ID NO: 706783 - RNA, 22 nt, Human
cagaaaauaaacauuuguggaa

SEQ ID NO: 706784 - RNA, 17 nt, Human
aggccagaugaggcaag

SEQ ID NO: 706785 - RNA, 22 nt, Human
agcaagagcaugucggccuggu

SEQ ID NO: 706786 - RNA, 22 nt, Human
auucuucaguauguguggauug

SEQ ID NO: 706787 - RNA, 22 nt, Human
agacaauuaaaaaauuaugcuu

SEQ ID NO: 706788 - RNA, 19 nt, Human
agcacagacaagaccagca

SEQ ID NO: 706789 - RNA, 23 nt, Human
aucuaaaguguuaaauagcuggg

SEQ ID NO: 706790 - RNA, 22 nt, Human
aucuggcuuuuacugaauugcu

SEQ ID NO: 706791 - RNA, 19 nt, Human
acagugcuucugagugagg

SEQ ID NO: 706792 - RNA, 22 nt, Human
guaguggagucuccuguccugg

SEQ ID NO: 706793 - RNA, 22 nt, Human
agcaaggcuaaauuucaguuau

SEQ ID NO: 706794 - RNA, 22 nt, Human
uucuggaagauaccucuccuaa

SEQ ID NO: 706795 - RNA, 19 nt, Human
ugagggugagcuuuggaga

SEQ ID NO: 706796 - RNA, 22 nt, Human
acaaggaucuguguaggcaggc

SEQ ID NO: 706797 - RNA, 22 nt, Human
cacuucaaauaagcucuucuca

SEQ ID NO: 706798 - RNA, 22 nt, Human
uaaacaagcugucugauauucu

SEQ ID NO: 706799 - RNA, 22 nt, Human
uggccuugggcagguggccugc

SEQ ID NO: 706800 - RNA, 22 nt, Human
acacagagggcagaagauacau

SEQ ID NO: 706801 - RNA, 22 nt, Human
uucaaagauuagcauacgcaau

SEQ ID NO: 706802 - RNA, 22 nt, Human
ccuuucuuuuauccaccagcca

SEQ ID NO: 706803 - RNA, 22 nt, Human
agaggaauguauuucccugcaa

SEQ ID NO: 706804 - RNA, 22 nt, Human
gaaagugccagaauaggaggcc

SEQ ID NO: 706805 - RNA, 22 nt, Human
ugaacaaaugaaucaguguagc

SEQ ID NO: 706806 - RNA, 22 nt, Human
uucccucucuagcuuuccccaa

SEQ ID NO: 706807 - RNA, 22 nt, Human
cagugucucaaaacaaguugcu

SEQ ID NO: 706808 - RNA, 22 nt, Human
gcagaggucuagcaccaagaau

SEQ ID NO: 706809 - RNA, 22 nt, Human
uccaccuccaugcugggcagag

SEQ ID NO: 706810 - RNA, 22 nt, Human
cuggccccgguuccuaaaaacc

SEQ ID NO: 706811 - RNA, 22 nt, Human
cugccaccaaauagcugcauga

SEQ ID NO: 706812 - RNA, 22 nt, Human
aagcaauagcaacaacuuuaca

SEQ ID NO: 706813 - RNA, 22 nt, Human
acucauuugacacuuuaaacug

SEQ ID NO: 706814 - RNA, 22 nt, Human
aacauugaaauauuugcaauag

SEQ ID NO: 706815 - RNA, 22 nt, Human
augaaguucuagugagaaaugc

SEQ ID NO: 706816 - RNA, 22 nt, Human
uucccacagucacugggagaag

SEQ ID NO: 706817 - RNA, 22 nt, Human
uacagacauuuacuccacuccu

SEQ ID NO: 706818 - RNA, 22 nt, Human
aucagcaggugcugguggagac

SEQ ID NO: 706819 - RNA, 22 nt, Human
agacuccaggagggaggcugcu

SEQ ID NO: 706820 - RNA, 22 nt, Human
aauuucacagugaacuuugagg

SEQ ID NO: 706821 - RNA, 22 nt, Human
augaggcaucugcagucacuag

SEQ ID NO: 706822 - RNA, 22 nt, Human
uuaacaguuaaacaauuggcua

SEQ ID NO: 706823 - RNA, 22 nt, Human
uuuguaaauagcaguacucaug

SEQ ID NO: 706824 - RNA, 22 nt, Human
gcaguguguggugagggcugcc

SEQ ID NO: 706825 - RNA, 22 nt, Human
ggaccugcccuggcucagaugc

SEQ ID NO: 706826 - RNA, 22 nt, Human
caccacugaauuguucacuuuc

SEQ ID NO: 706827 - RNA, 22 nt, Human
aaaugugcuugugaucagcugu

SEQ ID NO: 706828 - RNA, 22 nt, Human
gcaguccauugacagaggucuu

SEQ ID NO: 706829 - RNA, 22 nt, Human
cagucccagacauaguaaggga

SEQ ID NO: 706830 - RNA, 22 nt, Human
ucagcuugugggucagccucug

SEQ ID NO: 706831 - RNA, 22 nt, Human
guggcaucgucugagguggggu

SEQ ID NO: 706832 - RNA, 22 nt, Human
gauguacaaguaaaauaugugu

SEQ ID NO: 706833 - RNA, 22 nt, Human
auuguacauaaaauguaugucu

SEQ ID NO: 706834 - RNA, 22 nt, Human
cacuguccaugcuugcuaaccc

SEQ ID NO: 706835 - RNA, 22 nt, Human
agggccaguaccaggugggugg

SEQ ID NO: 706836 - RNA, 22 nt, Human
uggagcugggguuugaaucugg

SEQ ID NO: 706837 - RNA, 19 nt, Human
acaggggcuagcggaagca

SEQ ID NO: 706838 - RNA, 22 nt, Human
acaaucacacaugcaauuauac

SEQ ID NO: 706839 - RNA, 22 nt, Human
cucuggcacacuccuuccaggu

SEQ ID NO: 706840 - RNA, 22 nt, Human
aggaagcaaaaggcagggucua

SEQ ID NO: 706841 - RNA, 22 nt, Human
guguuuaauagguagcugaauc

SEQ ID NO: 706842 - RNA, 22 nt, Human
agguuccuuauggggauggcua

SEQ ID NO: 706843 - RNA, 22 nt, Human
ccuggaagauucaccacuacca

SEQ ID NO: 706844 - RNA, 22 nt, Human
ucacuguuaauaaauagcaaag

SEQ ID NO: 706845 - RNA, 22 nt, Human
aucagaauaauuagauuucaga

SEQ ID NO: 706846 - RNA, 22 nt, Human
cuggguccugcucucccuaaga

SEQ ID NO: 706847 - RNA, 22 nt, Human
cacaugaagagagucuaguaau

SEQ ID NO: 706848 - RNA, 22 nt, Human
cugggcaguucgcuuucguuuu

SEQ ID NO: 706849 - RNA, 22 nt, Human
gagacugcugguaaagauggga

SEQ ID NO: 706850 - RNA, 22 nt, Human
cugugcugauucagcacaggcc

SEQ ID NO: 706851 - RNA, 22 nt, Human
uugcauaaaugcuuaaaauuug

SEQ ID NO: 706852 - RNA, 22 nt, Human
gcuggcuuugaucuucccaucu

SEQ ID NO: 706853 - RNA, 22 nt, Human
uaagaacauaaauucauacggg

SEQ ID NO: 706854 - RNA, 22 nt, Human
cuucugggcauucagcugcaca

SEQ ID NO: 706855 - RNA, 22 nt, Human
agugcguggaccccuggcugcu

SEQ ID NO: 706856 - RNA, 22 nt, Human
ccucaaaguagagggagaugag

SEQ ID NO: 706857 - RNA, 22 nt, Human
uucuuuccucccagccuuugga

SEQ ID NO: 706858 - RNA, 22 nt, Human
ggugacugguuuaucuggcagu

SEQ ID NO: 706859 - RNA, 22 nt, Human
ggccuagggcuuggucauggca

SEQ ID NO: 706860 - RNA, 21 nt, Human
aucugaaaugucaaagcagau

SEQ ID NO: 706861 - RNA, 22 nt, Human
acugauacaucuguggaagugg

SEQ ID NO: 706862 - RNA, 22 nt, Human
gcucugcugaagccccuugcau

SEQ ID NO: 706863 - RNA, 19 nt, Human
gagcagcuuccuaucuggu

SEQ ID NO: 706864 - RNA, 22 nt, Human
uuaauuggccucuuagagguua

SEQ ID NO: 706865 - RNA, 22 nt, Human
acacaucagccucagcuuuggg

SEQ ID NO: 706866 - RNA, 22 nt, Human
gauuuacagcuauacccaaugg

SEQ ID NO: 706867 - RNA, 22 nt, Human
gugucugcauauucaaacuugu

SEQ ID NO: 706868 - RNA, 22 nt, Human
uuugaagaccuuaucucuaaau

SEQ ID NO: 706869 - RNA, 22 nt, Human
cauuuaaucuggcucaugagca

SEQ ID NO: 706870 - RNA, 22 nt, Human
ucuaguuaauuccuuugguguu

SEQ ID NO: 706871 - RNA, 22 nt, Human
cacagcugcccccucucuaacu

SEQ ID NO: 706872 - RNA, 18 nt, Human
uccuccuuuggccuuuuc

SEQ ID NO: 706873 - RNA, 22 nt, Human
agggcucaagggcaugcuacgu

SEQ ID NO: 706874 - RNA, 22 nt, Human
ugcuggaagagauuggagccuc

SEQ ID NO: 706875 - RNA, 22 nt, Human
uauuccaacugucauagucaua

SEQ ID NO: 706876 - RNA, 22 nt, Human
gggacuggaacuacuggugcag

SEQ ID NO: 706877 - RNA, 22 nt, Human
cugaggagggaaguccccaaag

SEQ ID NO: 706878 - RNA, 22 nt, Human
ugggcugagcacugaggaagga

SEQ ID NO: 706879 - RNA, 22 nt, Human
cagggaugaccagagggaugug

SEQ ID NO: 706880 - RNA, 22 nt, Human
gccugggacccuuagcucuugg

SEQ ID NO: 706881 - RNA, 22 nt, Human
uuauuguuagugagacuguaga

SEQ ID NO: 706882 - RNA, 22 nt, Human
guacaaaugcagguuuguuaca

SEQ ID NO: 706883 - RNA, 22 nt, Human
ucucugggaaauggagaauuuu

SEQ ID NO: 706884 - RNA, 22 nt, Human
aacauuugcaugcuuuauuaga

SEQ ID NO: 706885 - RNA, 22 nt, Human
caaaugaauagggagugugaug

SEQ ID NO: 706886 - RNA, 22 nt, Human
uugcugccuuccgaauccucuc

SEQ ID NO: 706887 - RNA, 22 nt, Human
ggcauguuucaucacaucaaga

SEQ ID NO: 706888 - RNA, 22 nt, Human
uauguauucucagauuuacuaa

SEQ ID NO: 706889 - RNA, 22 nt, Human
cuccaggaaagccugaggcccg

SEQ ID NO: 706890 - RNA, 22 nt, Human
cuuaacucuacacugcacuuua

SEQ ID NO: 706891 - RNA, 22 nt, Human
uaguggaggggaugcaaagcuu

SEQ ID NO: 706892 - RNA, 22 nt, Human
gcccaagaguuaagucucugcu

SEQ ID NO: 706893 - RNA, 22 nt, Human
gcauucaugccugugugagcuc

SEQ ID NO: 706894 - RNA, 22 nt, Human
acugagaagauucucacucuua

SEQ ID NO: 706895 - RNA, 22 nt, Human
ugaguaaauacaaaaucaccuc

SEQ ID NO: 706896 - RNA, 22 nt, Human
ccagauucauagaaacucauag

SEQ ID NO: 706897 - RNA, 22 nt, Human
gccagcugaauuuccaacuguu

SEQ ID NO: 706898 - RNA, 22 nt, Human
agcuggcugggugccagucucc

SEQ ID NO: 706899 - RNA, 22 nt, Human
uauuuccagaggaguauagaag

SEQ ID NO: 706900 - RNA, 22 nt, Human
aacugagccccugcacuuguga

SEQ ID NO: 706901 - RNA, 22 nt, Human
auggucuuaggguaggcagcug

SEQ ID NO: 706902 - RNA, 22 nt, Human
aucuggaauccuuguggacaau

SEQ ID NO: 706903 - RNA, 22 nt, Human
ugcagagccccagauuggagag

SEQ ID NO: 706904 - RNA, 22 nt, Human
gcuguacauucuguggguuugg

SEQ ID NO: 706905 - RNA, 22 nt, Human
cuggauaagaguuuuacuuccu

SEQ ID NO: 706906 - RNA, 22 nt, Human
uuuggacauguugagucugaua

SEQ ID NO: 706907 - RNA, 22 nt, Human
guccugucccccaaggcugugg

SEQ ID NO: 706908 - RNA, 22 nt, Human
ggcuccuggaggcaccacuggu

SEQ ID NO: 706909 - RNA, 22 nt, Human
auggaauugagcaucaguuguu

SEQ ID NO: 706910 - RNA, 19 nt, Human
ccaggccuccugggagguc

SEQ ID NO: 706911 - RNA, 22 nt, Human
cauauguauuucucauaauuag

SEQ ID NO: 706912 - RNA, 22 nt, Human
uucaaacacuguuggcacuggg

SEQ ID NO: 706913 - RNA, 22 nt, Human
cuugaauguaaauaauguacag

SEQ ID NO: 706914 - RNA, 22 nt, Human
ugaaauuccaggagaguuaaaa

SEQ ID NO: 706915 - RNA, 22 nt, Human
ugggaugagcuauauagaaagu

SEQ ID NO: 706916 - RNA, 22 nt, Human
cuaacuuuuacagucauguugc

SEQ ID NO: 706917 - RNA, 22 nt, Human
uggcauuuaguugcguauugca

SEQ ID NO: 706918 - RNA, 17 nt, Human
ggcugcugugcuggugc

SEQ ID NO: 706919 - RNA, 21 nt, Human
ucaggaagagcuucucccacu

SEQ ID NO: 706920 - RNA, 22 nt, Human
augccaaauucuacuuucagca

SEQ ID NO: 706921 - RNA, 22 nt, Human
aaccugaaacuacauucuugau

SEQ ID NO: 706922 - RNA, 22 nt, Human
gccuugcuaauuucuccucaac

SEQ ID NO: 706923 - RNA, 22 nt, Human
cuugcagaggcuguuccagaug

SEQ ID NO: 706924 - RNA, 22 nt, Human
gcaggguacauugggaugggau

SEQ ID NO: 706925 - RNA, 22 nt, Human
aagaacauaacagaagcugugu

SEQ ID NO: 706926 - RNA, 22 nt, Human
caacauguguuagacaauagac

SEQ ID NO: 706927 - RNA, 22 nt, Human
ggagagagagcucauuagcugc

SEQ ID NO: 706928 - RNA, 22 nt, Human
gggcagccucggugccugcugc

SEQ ID NO: 706929 - RNA, 22 nt, Human
agagaaucugggaagauguuaa

SEQ ID NO: 706930 - RNA, 22 nt, Human
cugaaguucauacaauggccau

SEQ ID NO: 706931 - RNA, 22 nt, Human
gaggcuccuccuuacauuuacc

SEQ ID NO: 706932 - RNA, 22 nt, Human
gccagaugccguaaagaugggc

SEQ ID NO: 706933 - RNA, 22 nt, Human
cagugcugugcuggaagcuguu

SEQ ID NO: 706934 - RNA, 22 nt, Human
ggggaggaagcucucaguucca

SEQ ID NO: 706935 - RNA, 22 nt, Human
cugggcccugaagacagucagg

SEQ ID NO: 706936 - RNA, 22 nt, Human
agcugcugugugcucaggcagg

SEQ ID NO: 706937 - RNA, 22 nt, Human
cagccucuguggcugccacacc

SEQ ID NO: 706938 - RNA, 19 nt, Human
ggaugagggucaggcauag

SEQ ID NO: 706939 - RNA, 22 nt, Human
auuucauggcagacuuuaaccc

SEQ ID NO: 706940 - RNA, 22 nt, Human
uguggggguacacguacacaug

SEQ ID NO: 706941 - RNA, 22 nt, Human
caugcuuaauuggagcauucau

SEQ ID NO: 706942 - RNA, 22 nt, Human
ggucccuggggaacuaggcugu

SEQ ID NO: 706943 - RNA, 22 nt, Human
caguggcacccacgggcugggc

SEQ ID NO: 706944 - RNA, 22 nt, Human
gcagcugcuggaaguuccugcc

SEQ ID NO: 706945 - RNA, 22 nt, Human
uuaaauuauuucuagugaggug

SEQ ID NO: 706946 - RNA, 22 nt, Human
caggccugggcuucggggcuga

SEQ ID NO: 706947 - RNA, 22 nt, Human
ucauuuacauagaaacaauaua

SEQ ID NO: 706948 - RNA, 22 nt, Human
cuggcucccguuguccuugaag

SEQ ID NO: 706949 - RNA, 22 nt, Human
auagugguuggauaugucagag

SEQ ID NO: 706950 - RNA, 22 nt, Human
uccaucugguggcuuccuuuug

SEQ ID NO: 706951 - RNA, 22 nt, Human
agagggaaugugauugcaccau

SEQ ID NO: 706952 - RNA, 22 nt, Human
ggcuguagguuggugcuggaca

SEQ ID NO: 706953 - RNA, 22 nt, Human
ugcagaguugcuuugauagucc

SEQ ID NO: 706954 - RNA, 22 nt, Human
uugcugagcaguguuuaauugu

SEQ ID NO: 706955 - RNA, 22 nt, Human
ucaaugauaucagcaggaugug

SEQ ID NO: 706956 - RNA, 22 nt, Human
guuccaaauuuggaucuuuagg

SEQ ID NO: 706957 - RNA, 22 nt, Human
cagccacuucgagcuuccugau

SEQ ID NO: 706958 - RNA, 22 nt, Human
agcaaagcaucacuccaaucug

SEQ ID NO: 706959 - RNA, 22 nt, Human
ugugugucugcacauguauaau

SEQ ID NO: 706960 - RNA, 22 nt, Human
ggccagcuuucugucuucuagg

SEQ ID NO: 706961 - RNA, 22 nt, Human
uccagguguauuuacugaagua

SEQ ID NO: 706962 - RNA, 20 nt, Human
aauguauauuuuaugccagg

SEQ ID NO: 706963 - RNA, 22 nt, Human
ugccaggcccagcagggcggcc

SEQ ID NO: 706964 - RNA, 22 nt, Human
cugugugugucugcagcauacu

SEQ ID NO: 706965 - RNA, 22 nt, Human
gugaagaucugagcccucaggu

SEQ ID NO: 706966 - RNA, 22 nt, Human
ccucaggcuugugagccuucag

SEQ ID NO: 706967 - RNA, 21 nt, Human
cugagggccgcagcugggcuc

SEQ ID NO: 706968 - RNA, 22 nt, Human
auugaaagcauggauuuggauu

SEQ ID NO: 706969 - RNA, 18 nt, Human
ccagcccugcagcaccug

SEQ ID NO: 706970 - RNA, 22 nt, Human
uugaaacugaguguguuugggg

SEQ ID NO: 706971 - RNA, 22 nt, Human
caagagacuuauguggaaaccu

SEQ ID NO: 706972 - RNA, 22 nt, Human
uuuaaucaggcaaagcauaaua

SEQ ID NO: 706973 - RNA, 22 nt, Human
augaaacaugagaaauggagag

SEQ ID NO: 706974 - RNA, 23 nt, Human
agcuguguggccuugggcaaguu

SEQ ID NO: 706975 - RNA, 22 nt, Human
gugagcuggaauaguggagaaa

SEQ ID NO: 706976 - RNA, 22 nt, Human
aucuuuuugacauggugauggu

SEQ ID NO: 706977 - RNA, 21 nt, Human
ugcagcuggguucugguuugc

SEQ ID NO: 706978 - RNA, 22 nt, Human
uucguguggagauguuucugca

SEQ ID NO: 706979 - RNA, 22 nt, Human
cucugcauuuuaacagaugauu

SEQ ID NO: 706980 - RNA, 22 nt, Human
ucaggcuggggugcuaaggugu

SEQ ID NO: 706981 - RNA, 22 nt, Human
uuugaaagaauuuauguacuuu

SEQ ID NO: 706982 - RNA, 22 nt, Human
gcugcaggcagaaucucccaau

SEQ ID NO: 706983 - RNA, 22 nt, Human
caggacagguguucuagaucag

SEQ ID NO: 706984 - RNA, 22 nt, Human
ccucccaccauuuagagagagc

SEQ ID NO: 706985 - RNA, 17 nt, Human
uuauugucaagguucca

SEQ ID NO: 706986 - RNA, 22 nt, Human
aagccauggcugcaucagccug

SEQ ID NO: 706987 - RNA, 20 nt, Human
cuuuagaagaacccaagcau

SEQ ID NO: 706988 - RNA, 22 nt, Human
guuccaaagucucugagcugag

SEQ ID NO: 706989 - RNA, 20 nt, Human
gagcagcuguuugcauugca

SEQ ID NO: 706990 - RNA, 21 nt, Human
ucaggaaacaccucuuaagga

SEQ ID NO: 706991 - RNA, 22 nt, Human
cauaucccauuggccaggacau

SEQ ID NO: 706992 - RNA, 22 nt, Human
cagcaucuguucccaacgagau

SEQ ID NO: 706993 - RNA, 22 nt, Human
cccuccccagggucauauugaa

SEQ ID NO: 706994 - RNA, 22 nt, Human
agcagaugugucucugcacugu

SEQ ID NO: 706995 - RNA, 22 nt, Human
ccaggcauugugagugggcagg

SEQ ID NO: 706996 - RNA, 22 nt, Human
ugucuuuaguugcuuagauuug

SEQ ID NO: 706997 - RNA, 22 nt, Human
uauacugauuugucuauacucu

SEQ ID NO: 706998 - RNA, 22 nt, Human
cauuucuacagcuucuucagaa

SEQ ID NO: 706999 - RNA, 22 nt, Human
cuauuucauguuccuauggccg

SEQ ID NO: 707000 - RNA, 22 nt, Human
uucuggaaggguggaguagcuu

SEQ ID NO: 707001 - RNA, 22 nt, Human
uuauuucccugaggguugcagg

SEQ ID NO: 707002 - RNA, 23 nt, Human
ucauuucauccagccuugagagu

SEQ ID NO: 707003 - RNA, 22 nt, Human
gcuguguaggauccuguuguau

SEQ ID NO: 707004 - RNA, 23 nt, Human
uggaccugaaccagugccucugu

SEQ ID NO: 707005 - RNA, 22 nt, Human
ccccagggacugguuucaugga

SEQ ID NO: 707006 - RNA, 22 nt, Human
guggcuucaucaacugugcuua

SEQ ID NO: 707007 - RNA, 17 nt, Human
cugagcauccgugcucu

SEQ ID NO: 707008 - RNA, 21 nt, Human
uuaagagcuuagcaguaggcc

SEQ ID NO: 707009 - RNA, 22 nt, Human
uuacagaaucuacucgugguga

SEQ ID NO: 707010 - RNA, 22 nt, Human
agcugcccugggucuugcugcu

SEQ ID NO: 707011 - RNA, 22 nt, Human
ccucuucaccucgggcacacug

SEQ ID NO: 707012 - RNA, 22 nt, Human
uaagauagaacucugaggcuac

SEQ ID NO: 707013 - RNA, 22 nt, Human
uggugcagucauuggcccaggg

SEQ ID NO: 707014 - RNA, 22 nt, Human
cagacaggcaggugcugcuuug

SEQ ID NO: 707015 - RNA, 17 nt, Human
uauacacagacagacug

SEQ ID NO: 707016 - RNA, 22 nt, Human
aagguguucagguuuucccauu

SEQ ID NO: 707017 - RNA, 22 nt, Human
auggcugggucaccaucagggu

SEQ ID NO: 707018 - RNA, 22 nt, Human
uccaggcaaagugcugggcugc

SEQ ID NO: 707019 - RNA, 22 nt, Human
gcugagggggaaggaaagcuga

SEQ ID NO: 707020 - RNA, 22 nt, Human
gccaggcuguggggaacuugaa

SEQ ID NO: 707021 - RNA, 22 nt, Human
ucagagugcagcgggaggcugg

SEQ ID NO: 707022 - RNA, 22 nt, Human
gacacagauaucucugagauua

SEQ ID NO: 707023 - RNA, 22 nt, Human
caaaugaagguggugggucauu

SEQ ID NO: 707024 - RNA, 22 nt, Human
accagagcuuacaugcuagaaa

SEQ ID NO: 707025 - RNA, 22 nt, Human
ccaggcacaggugggccucaga

SEQ ID NO: 707026 - RNA, 22 nt, Human
aacagugcuucauucacacauu

SEQ ID NO: 707027 - RNA, 22 nt, Human
uggagcaggaaacaucuagagg

SEQ ID NO: 707028 - RNA, 23 nt, Human
acugccugugccgaucucucuca

SEQ ID NO: 707029 - RNA, 22 nt, Human
gcaggugaaagugaguagugag

SEQ ID NO: 707030 - RNA, 22 nt, Human
uagaaacagaauaugagugaga

SEQ ID NO: 707031 - RNA, 22 nt, Human
uuugggacuggagcuuggagag

SEQ ID NO: 707032 - RNA, 18 nt, Human
gcaacaguaucagcaggc

SEQ ID NO: 707033 - RNA, 22 nt, Human
caggucagagguagaugagaug

SEQ ID NO: 707034 - RNA, 22 nt, Human
cugucaccugccagcauaccca

SEQ ID NO: 707035 - RNA, 22 nt, Human
gaagccucaacaucucugcguc

SEQ ID NO: 707036 - RNA, 22 nt, Human
auuaaauuuucacuaggcuccc

SEQ ID NO: 707037 - RNA, 22 nt, Human
ugggaagguguagaaagaacaa

SEQ ID NO: 707038 - RNA, 22 nt, Human
ccagccaccgcuuguuugcacu

SEQ ID NO: 707039 - RNA, 22 nt, Human
acaguacugcuguucuuguccu

SEQ ID NO: 707040 - RNA, 22 nt, Human
caggcagaugcugacaagaguu

SEQ ID NO: 707041 - RNA, 22 nt, Human
cucagauaaucuuugagucuuc

SEQ ID NO: 707042 - RNA, 22 nt, Human
ucuugaauuguacucccauaag

SEQ ID NO: 707043 - RNA, 22 nt, Human
uggcccgaagauccgaggguca

SEQ ID NO: 707044 - RNA, 22 nt, Human
cagcccgucacacgcuagcauc

SEQ ID NO: 707045 - RNA, 19 nt, Human
cugucugguucauguguuc

SEQ ID NO: 707046 - RNA, 22 nt, Human
agagucugaggaggaccaacag

SEQ ID NO: 707047 - RNA, 22 nt, Human
gagccuggauugucaccgacuu

SEQ ID NO: 707048 - RNA, 22 nt, Human
uuacagguggagaaguaaggcu

SEQ ID NO: 707049 - RNA, 22 nt, Human
uaugucuggaccacugcagccc

SEQ ID NO: 707050 - RNA, 22 nt, Human
uugauucaaaacaggagguagg

SEQ ID NO: 707051 - RNA, 19 nt, Human
ccaggccuggcgucuccgc

SEQ ID NO: 707052 - RNA, 22 nt, Human
aauucuagcauugugaaaauau

SEQ ID NO: 707053 - RNA, 22 nt, Human
cagaacaggucaugcuugcugu

SEQ ID NO: 707054 - RNA, 22 nt, Human
ucccaggccauaaaacucagag

SEQ ID NO: 707055 - RNA, 22 nt, Human
ccucugagcuggccuguggggc

SEQ ID NO: 707056 - RNA, 23 nt, Human
acauauugaaugcugagaauuuu

SEQ ID NO: 707057 - RNA, 22 nt, Human
uagaaagcaaaauccuaccaag

SEQ ID NO: 707058 - RNA, 22 nt, Human
aggaccagaccgaacuagcuaa

SEQ ID NO: 707059 - RNA, 19 nt, Human
caggucuucuuggaggacu

SEQ ID NO: 707060 - RNA, 22 nt, Human
acacuucaggacucuggggcaa

SEQ ID NO: 707061 - RNA, 22 nt, Human
acucagaguagaaaauagguuc

SEQ ID NO: 707062 - RNA, 22 nt, Human
ccuagagcucugcuuuaucuaa

SEQ ID NO: 707063 - RNA, 22 nt, Human
uuucauguuuauggaaaaugag

SEQ ID NO: 707064 - RNA, 22 nt, Human
uagcuuuagaaauauucucaga

SEQ ID NO: 707065 - RNA, 22 nt, Human
aaggccaugaccacuugcugug

SEQ ID NO: 707066 - RNA, 22 nt, Human
cugcaguagcaccuguggcuuu

SEQ ID NO: 707067 - RNA, 22 nt, Human
ugcauuggaaacucagcagcac

SEQ ID NO: 707068 - RNA, 22 nt, Human
gugugucugaaguugaguagac

SEQ ID NO: 707069 - RNA, 22 nt, Human
gugccugcuaccugacuuguuu

SEQ ID NO: 707070 - RNA, 22 nt, Human
uagaaacagagcagguggccca

SEQ ID NO: 707071 - RNA, 22 nt, Human
aggagcuagccaggcauaugca

SEQ ID NO: 707072 - RNA, 22 nt, Human
agucugaaaguauguuguaaug

SEQ ID NO: 707073 - RNA, 22 nt, Human
aucuuagagagucguguuuugu

SEQ ID NO: 707074 - RNA, 22 nt, Human
ccacugagaagggguugggguc

SEQ ID NO: 707075 - RNA, 21 nt, Human
ucuuguccuugcucucccacu

SEQ ID NO: 707076 - RNA, 22 nt, Human
gaggcuggaauauuagaaaugu

SEQ ID NO: 707077 - RNA, 22 nt, Human
agugugaguuugguugagacuu

SEQ ID NO: 707078 - RNA, 22 nt, Human
agacccuguuaguuccagucuu

SEQ ID NO: 707079 - RNA, 23 nt, Human
ucugaagaugcuguuuccaguga

SEQ ID NO: 707080 - RNA, 22 nt, Human
gcgcucaggugccaggccugcg

SEQ ID NO: 707081 - RNA, 22 nt, Human
agcuggguacugaugucuucag

SEQ ID NO: 707082 - RNA, 22 nt, Human
ucccaaggccaggcaucuagaa

SEQ ID NO: 707083 - RNA, 22 nt, Human
auagaaaacagauguccuuaaa

SEQ ID NO: 707084 - RNA, 22 nt, Human
ggcuuugggcccucaagucucc

SEQ ID NO: 707085 - RNA, 22 nt, Human
cucugaaaguuagagaaaauag

SEQ ID NO: 707086 - RNA, 23 nt, Human
aaugugcuguauucauuucugga

SEQ ID NO: 707087 - RNA, 22 nt, Human
gcaguguuucagugcuuuuucu

SEQ ID NO: 707088 - RNA, 22 nt, Human
acccacaccuccguauaucacu

SEQ ID NO: 707089 - RNA, 22 nt, Human
uccaaaggggcaguguccagcc

SEQ ID NO: 707090 - RNA, 22 nt, Human
uccaggagaaaacugacggugg

SEQ ID NO: 707091 - RNA, 22 nt, Human
aaacagaaggguagguaaacau

SEQ ID NO: 707092 - RNA, 17 nt, Human
uuauugcagugcugaag

SEQ ID NO: 707093 - RNA, 22 nt, Human
ccagacaguuccuugagguuca

SEQ ID NO: 707094 - RNA, 22 nt, Human
auucacacauacucauguguga

SEQ ID NO: 707095 - RNA, 22 nt, Human
uacagcaaagaaacccucaguc

SEQ ID NO: 707096 - RNA, 22 nt, Human
accagcuggucaccugggcacu

SEQ ID NO: 707097 - RNA, 22 nt, Human
gcaaagcagucuucugugccua

SEQ ID NO: 707098 - RNA, 22 nt, Human
gucagccugcacucagggagcg

SEQ ID NO: 707099 - RNA, 22 nt, Human
uagacaaacugauacuuggcga

SEQ ID NO: 707100 - RNA, 22 nt, Human
gaauuugugcucaggaagauua

SEQ ID NO: 707101 - RNA, 22 nt, Human
agagcagagggcucugggacaa

SEQ ID NO: 707102 - RNA, 22 nt, Human
ugaggcaggaaguuauauaaug

SEQ ID NO: 707103 - RNA, 18 nt, Human
ucugaaggaaugauucca

SEQ ID NO: 707104 - RNA, 22 nt, Human
ugccagaacagcucaucuggcc

SEQ ID NO: 707105 - RNA, 22 nt, Human
gaaguggguggugauaucacug

SEQ ID NO: 707106 - RNA, 19 nt, Human
guguauguaaguugugagg

SEQ ID NO: 707107 - RNA, 22 nt, Human
aggcaugaugugcaguggcaaa

SEQ ID NO: 707108 - RNA, 20 nt, Human
agccaggccucaaguuaagu

SEQ ID NO: 707109 - RNA, 22 nt, Human
agcaacaguguauaucauaggc

SEQ ID NO: 707110 - RNA, 22 nt, Human
cagaggaguucaguacacagcc

SEQ ID NO: 707111 - RNA, 22 nt, Human
ccccagggaagcuuugcuuacu

SEQ ID NO: 707112 - RNA, 22 nt, Human
uuaucugugauccuaaaugucu

SEQ ID NO: 707113 - RNA, 22 nt, Human
gucuggcuguuccugccuguga

SEQ ID NO: 707114 - RNA, 22 nt, Human
aggguagcuacccaacuccaga

SEQ ID NO: 707115 - RNA, 22 nt, Human
uccaggccccagaccguacugc

SEQ ID NO: 707116 - RNA, 22 nt, Human
cagggagcuggcuggcgugagu

SEQ ID NO: 707117 - RNA, 22 nt, Human
gacuguccagaauuccuaggug

SEQ ID NO: 707118 - RNA, 22 nt, Human
uauuauggcagcauucaguaug

SEQ ID NO: 707119 - RNA, 22 nt, Human
ugcagggaaaguguuggcagca

SEQ ID NO: 707120 - RNA, 22 nt, Human
ucaaucaaugugucaguuccca

SEQ ID NO: 707121 - RNA, 22 nt, Human
uugucugaaagaucauuacauu

SEQ ID NO: 707122 - RNA, 22 nt, Human
gaauuugucccuugauauaaaa

SEQ ID NO: 707123 - RNA, 22 nt, Human
uacaucuauuugacagauacag

SEQ ID NO: 707124 - RNA, 22 nt, Human
ucugaauaauguccuuguauca

SEQ ID NO: 707125 - RNA, 22 nt, Human
aaaccuggaacauuugacuagg

SEQ ID NO: 707126 - RNA, 22 nt, Human
guaugaaguuggacuguauaaa

SEQ ID NO: 707127 - RNA, 22 nt, Human
cucuccccgguacgagcggccg

SEQ ID NO: 707128 - RNA, 22 nt, Human
cugagggagcugcuggccuugg

SEQ ID NO: 707129 - RNA, 23 nt, Human
gcuguccccaugcuccaucccug

SEQ ID NO: 707130 - RNA, 22 nt, Human
agcucugacugaagagaugcaa

SEQ ID NO: 707131 - RNA, 22 nt, Human
gaggcuaaguaacuguccaugg

SEQ ID NO: 707132 - RNA, 23 nt, Human
accccaggcaucgcauuccucuu

SEQ ID NO: 707133 - RNA, 22 nt, Human
uaaugcuuaauuuucacaagcc

SEQ ID NO: 707134 - RNA, 22 nt, Human
uucuggaauucuugcagccacu

SEQ ID NO: 707135 - RNA, 22 nt, Human
acagugaaaaguagcuaacaca

SEQ ID NO: 707136 - RNA, 22 nt, Human
cuauuugucacaacugguguuu

SEQ ID NO: 707137 - RNA, 22 nt, Human
cagcuccucacgagucuugaaa

SEQ ID NO: 707138 - RNA, 22 nt, Human
cacuuuacuaucuauaaaauaa

SEQ ID NO: 707139 - RNA, 21 nt, Human
augucuguucugauuggugcg

SEQ ID NO: 707140 - RNA, 22 nt, Human
ggcagggcaggaaagucaggaa

SEQ ID NO: 707141 - RNA, 22 nt, Human
uuucuuccuggauuccuacuuc

SEQ ID NO: 707142 - RNA, 22 nt, Human
cagcccagcagucuuagccugc

SEQ ID NO: 707143 - RNA, 18 nt, Human
cugucaccgccaccacac

SEQ ID NO: 707144 - RNA, 22 nt, Human
auugaaaguccuaucuaaggga

SEQ ID NO: 707145 - RNA, 22 nt, Human
acagauauguuggguucuuguu

SEQ ID NO: 707146 - RNA, 22 nt, Human
ugcuggcauaccaccuaguuca

SEQ ID NO: 707147 - RNA, 22 nt, Human
gaugcaaaccuuacauggaccu

SEQ ID NO: 707148 - RNA, 21 nt, Human
gcugucucuggcuccugggaa

SEQ ID NO: 707149 - RNA, 22 nt, Human
ugcagugguguccagguguacu

SEQ ID NO: 707150 - RNA, 22 nt, Human
aggcaccaguaagaguagaacu

SEQ ID NO: 707151 - RNA, 22 nt, Human
cuuccuccgaagaaguugcugg

SEQ ID NO: 707152 - RNA, 22 nt, Human
auaaugcaccuuugaguauggc

SEQ ID NO: 707153 - RNA, 22 nt, Human
uucauucuugucuuuguauagu

SEQ ID NO: 707154 - RNA, 22 nt, Human
uaauuucuagggacuaaggugc

SEQ ID NO: 707155 - RNA, 22 nt, Human
uacaggagcauggggaagggau

SEQ ID NO: 707156 - RNA, 22 nt, Human
cugggcagcuaccaccacugcu

SEQ ID NO: 707157 - RNA, 22 nt, Human
uaucaguauggauucauggauu

SEQ ID NO: 707158 - RNA, 22 nt, Human
ucuucuguuuuagauugcauac

SEQ ID NO: 707159 - RNA, 22 nt, Human
gaguccuuccagcaggcauuua

SEQ ID NO: 707160 - RNA, 22 nt, Human
ugggagagaauucuggugacug

SEQ ID NO: 707161 - RNA, 22 nt, Human
uuucugucauaguuaucuuugu

SEQ ID NO: 707162 - RNA, 22 nt, Human
ggcaugaguaacgugagugagg

SEQ ID NO: 707163 - RNA, 22 nt, Human
acacauuuagcaccagguuuau

SEQ ID NO: 707164 - RNA, 22 nt, Human
cagaaaggacuuugguuggcuu

SEQ ID NO: 707165 - RNA, 22 nt, Human
aacugcaauaacuugugcacca

SEQ ID NO: 707166 - RNA, 22 nt, Human
gucuucaacaauaacuaccacu

SEQ ID NO: 707167 - RNA, 22 nt, Human
uuucugaagauacagcuuugcu

SEQ ID NO: 707168 - RNA, 22 nt, Human
aaaugguauaaugucauguauu

SEQ ID NO: 707169 - RNA, 22 nt, Human
gaauugcugaaucauauguuua

SEQ ID NO: 707170 - RNA, 18 nt, Human
aguuucagggcaggaaac

SEQ ID NO: 707171 - RNA, 22 nt, Human
caacugugaauuuuaugauacc

SEQ ID NO: 707172 - RNA, 22 nt, Human
uaugugauauaggcuauuugau

SEQ ID NO: 707173 - RNA, 22 nt, Human
uucaaucauugcaaaguaaugg

SEQ ID NO: 707174 - RNA, 22 nt, Human
ucccaggugaugcugaggccac

SEQ ID NO: 707175 - RNA, 22 nt, Human
aucuacagcugucugcacagua

SEQ ID NO: 707176 - RNA, 22 nt, Human
caucaugccccgcuacagugca

SEQ ID NO: 707177 - RNA, 22 nt, Human
ggcucaggagaggggcuaaaag

SEQ ID NO: 707178 - RNA, 22 nt, Human
gauugaaucauaugaaauugug

SEQ ID NO: 707179 - RNA, 22 nt, Human
uaaagugcaugcggggccagau

SEQ ID NO: 707180 - RNA, 22 nt, Human
uggcagaguaggauggcccugu

SEQ ID NO: 707181 - RNA, 20 nt, Human
uauaaauucagagcuuuggu

SEQ ID NO: 707182 - RNA, 19 nt, Human
uucuuacaacacccuggga

SEQ ID NO: 707183 - RNA, 22 nt, Human
uggccucuuacgacauagccuu

SEQ ID NO: 707184 - RNA, 22 nt, Human
aagaauauagauuuuuugaagu

SEQ ID NO: 707185 - RNA, 22 nt, Human
aaaagcagaccacgcuuugugg

SEQ ID NO: 707186 - RNA, 22 nt, Human
ucugagguguagcugggcuuca

SEQ ID NO: 707187 - RNA, 22 nt, Human
ccagugcagucccccugaacug

SEQ ID NO: 707188 - RNA, 22 nt, Human
agucuggggucugguagaacga

SEQ ID NO: 707189 - RNA, 22 nt, Human
aggagccaguuccaccccagga

SEQ ID NO: 707190 - RNA, 22 nt, Human
uggaaugacagagagucugaau

SEQ ID NO: 707191 - RNA, 22 nt, Human
uggagguugggaugcuugugau

SEQ ID NO: 707192 - RNA, 22 nt, Human
ccucuuugugccugcaggcugc

SEQ ID NO: 707193 - RNA, 22 nt, Human
acauuuuucacauuuguagggu

SEQ ID NO: 707194 - RNA, 18 nt, Human
gaugaagcugcuggggau

SEQ ID NO: 707195 - RNA, 19 nt, Human
ccuggagucgcgcugccuc

SEQ ID NO: 707196 - RNA, 23 nt, Human
gacagggcugacuuggcagcugc

SEQ ID NO: 707197 - RNA, 22 nt, Human
ccaggcuuuucucauggaguca

SEQ ID NO: 707198 - RNA, 22 nt, Human
gcuccagggucagcucagaacu

SEQ ID NO: 707199 - RNA, 22 nt, Human
uggaaaauuaguagugaaaggc

SEQ ID NO: 707200 - RNA, 22 nt, Human
uggccugcagcucucagggaag

SEQ ID NO: 707201 - RNA, 22 nt, Human
cccugcugugucccaccuggaa

SEQ ID NO: 707202 - RNA, 22 nt, Human
augcaacagcugggaauaugua

SEQ ID NO: 707203 - RNA, 22 nt, Human
uggcaaagaugaagcauuucgu

SEQ ID NO: 707204 - RNA, 20 nt, Human
ucagauuuuucuaacuuuga

SEQ ID NO: 707205 - RNA, 22 nt, Human
caggagcaggcccaaggacaca

SEQ ID NO: 707206 - RNA, 22 nt, Human
aaauauguaagauuagcacuag

SEQ ID NO: 707207 - RNA, 22 nt, Human
gcacaacaccaagggagguauc

SEQ ID NO: 707208 - RNA, 22 nt, Human
ggcucugggccagaguuggcuu

SEQ ID NO: 707209 - RNA, 22 nt, Human
aacagucagcuucucgggacau

SEQ ID NO: 707210 - RNA, 22 nt, Human
uggcuucaguuccuguguuguu

SEQ ID NO: 707211 - RNA, 22 nt, Human
ucugcuguucucaugcugauuu

SEQ ID NO: 707212 - RNA, 22 nt, Human
gaaacucucgcauccugggaac

SEQ ID NO: 707213 - RNA, 22 nt, Human
auagcacaauauuaccuuuaug

SEQ ID NO: 707214 - RNA, 22 nt, Human
cugcuucuccaaaguaggacuu

SEQ ID NO: 707215 - RNA, 22 nt, Human
ggcugcggccgcgggucugugc

SEQ ID NO: 707216 - RNA, 22 nt, Human
acccaggcugcuucucaguggc

SEQ ID NO: 707217 - RNA, 22 nt, Human
cacugaaggcugcagcucagcc

SEQ ID NO: 707218 - RNA, 22 nt, Human
ugucugggauguuggcagccac

SEQ ID NO: 707219 - RNA, 22 nt, Human
acacauaagaaacuacaaagag

SEQ ID NO: 707220 - RNA, 22 nt, Human
uuguuuccuuucuauacaggau

SEQ ID NO: 707221 - RNA, 22 nt, Human
caaugacauggauaaucauauu

SEQ ID NO: 707222 - RNA, 22 nt, Human
uggcagaaugaagacuggggcc

SEQ ID NO: 707223 - RNA, 22 nt, Human
auguccagaguaaagcacauuc

SEQ ID NO: 707224 - RNA, 19 nt, Human
cacugugguccuucacugc

SEQ ID NO: 707225 - RNA, 22 nt, Human
cagcacaguuucccccaugagc

SEQ ID NO: 707226 - RNA, 22 nt, Human
cugugggcugaaagugcucccg

SEQ ID NO: 707227 - RNA, 22 nt, Human
acuugguugaugucauaagguu

SEQ ID NO: 707228 - RNA, 22 nt, Human
uuggcagaauuaaccacugaag

SEQ ID NO: 707229 - RNA, 22 nt, Human
gcugagggaggcugaacugagu

SEQ ID NO: 707230 - RNA, 22 nt, Human
uuccuaauggcaaaacauguuu

SEQ ID NO: 707231 - RNA, 22 nt, Human
auuugcuaguggaauuuuccug

SEQ ID NO: 707232 - RNA, 16 nt, Human
gagaagagcccggcag

SEQ ID NO: 707233 - RNA, 19 nt, Human
cugggucuuauucugugaa

SEQ ID NO: 707234 - RNA, 22 nt, Human
aucagaagcuuguagucucucu

SEQ ID NO: 707235 - RNA, 22 nt, Human
ggcaucguccugggcauaggga

SEQ ID NO: 707236 - RNA, 22 nt, Human
ccucaggguggcaucagaucuu

SEQ ID NO: 707237 - RNA, 22 nt, Human
accugcaguggccacuccuaau

SEQ ID NO: 707238 - RNA, 22 nt, Human
uccccagauggccagcuacaug

SEQ ID NO: 707239 - RNA, 22 nt, Human
ccuuagagaguacugggcugcc

SEQ ID NO: 707240 - RNA, 22 nt, Human
agguggcaaggggcgccucucu

SEQ ID NO: 707241 - RNA, 22 nt, Human
aacuuaaacccacucauguaga

SEQ ID NO: 707242 - RNA, 22 nt, Human
agaccaggucuuuauggcucca

SEQ ID NO: 707243 - RNA, 22 nt, Human
uugggcagguguggcucuccuu

SEQ ID NO: 707244 - RNA, 22 nt, Human
uggaagcacugaagagacaacc

SEQ ID NO: 707245 - RNA, 17 nt, Human
cacaggugugguuugag

SEQ ID NO: 707246 - RNA, 22 nt, Human
uuaacagagugccuggcaugua

SEQ ID NO: 707247 - RNA, 22 nt, Human
ucaauaauggcaggauaaauuu

SEQ ID NO: 707248 - RNA, 22 nt, Human
aagaugaaaauuuacugugaug

SEQ ID NO: 707249 - RNA, 22 nt, Human
gguaauaaaauugugucaaaca

SEQ ID NO: 707250 - RNA, 22 nt, Human
ucagagguaguagcagaguuga

SEQ ID NO: 707251 - RNA, 22 nt, Human
ucccagccuuccagucugguuu

SEQ ID NO: 707252 - RNA, 22 nt, Human
uagaauucaagauucaacaggc

SEQ ID NO: 707253 - RNA, 22 nt, Human
uggccaauggcuccggccucau

SEQ ID NO: 707254 - RNA, 23 nt, Human
uacauucuguauuuuuauagagu

SEQ ID NO: 707255 - RNA, 22 nt, Human
gagacacaaucucauuuacauu

SEQ ID NO: 707256 - RNA, 22 nt, Human
acauaugugcuuauauccauga

SEQ ID NO: 707257 - RNA, 22 nt, Human
uccuggagccacggagcuuuca

SEQ ID NO: 707258 - RNA, 22 nt, Human
agaaggaaaaccugucuuaugu

SEQ ID NO: 707259 - RNA, 21 nt, Human
ccagcugucuguccuuaggca

SEQ ID NO: 707260 - RNA, 19 nt, Human
gcucagugaugccagacca

SEQ ID NO: 707261 - RNA, 22 nt, Human
uuuccaggugcauagaaaacag

SEQ ID NO: 707262 - RNA, 22 nt, Human
gaaaccugugcugauuuguuag

SEQ ID NO: 707263 - RNA, 22 nt, Human
cucuugggagugcucuggagaa

SEQ ID NO: 707264 - RNA, 22 nt, Human
uaaggaagagcuugguaauagg

SEQ ID NO: 707265 - RNA, 22 nt, Human
uggaggcugguuucugcugagg

SEQ ID NO: 707266 - RNA, 22 nt, Human
gguccccagcaguggcugcuuc

SEQ ID NO: 707267 - RNA, 21 nt, Human
uuacaugguuuaucauaugga

SEQ ID NO: 707268 - RNA, 22 nt, Human
ggcuuuauuucacuguaccaua

SEQ ID NO: 707269 - RNA, 22 nt, Human
cugagcugggacucaguagcaa

SEQ ID NO: 707270 - RNA, 20 nt, Human
caccuucaaauuuccuggca

SEQ ID NO: 707271 - RNA, 22 nt, Human
ucagcugugauccaucuaucua

SEQ ID NO: 707272 - RNA, 21 nt, Human
uucagcaagcacucuggacac

SEQ ID NO: 707273 - RNA, 22 nt, Human
ccagccugguucagaauuggcu

SEQ ID NO: 707274 - RNA, 18 nt, Human
uacaugcauaaaugaagc

SEQ ID NO: 707275 - RNA, 22 nt, Human
aggcugagucgggaggaucacu

SEQ ID NO: 707276 - RNA, 20 nt, Human
gugccaggcaagacaggugg

SEQ ID NO: 707277 - RNA, 22 nt, Human
gugggugucucaagaauggggg

SEQ ID NO: 707278 - RNA, 22 nt, Human
gcuguagauggacuggcaucca

SEQ ID NO: 707279 - RNA, 23 nt, Human
uugcacugaucaauuugauaagc

SEQ ID NO: 707280 - RNA, 22 nt, Human
ucugaaggaaaaggguagauau

SEQ ID NO: 707281 - RNA, 20 nt, Human
ccagaggcugacagacuuug

SEQ ID NO: 707282 - RNA, 22 nt, Human
uuucaguugcagugguugucua

SEQ ID NO: 707283 - RNA, 22 nt, Human
cauucaaagcaggaaaggccuu

SEQ ID NO: 707284 - RNA, 17 nt, Human
aaggauauuauaguucu

SEQ ID NO: 707285 - RNA, 22 nt, Human
cugggcucccucaugugucugc

SEQ ID NO: 707286 - RNA, 22 nt, Human
gcaggcccuuagccuugguggg

SEQ ID NO: 707287 - RNA, 22 nt, Human
acucaggaaauugagauaaugg

SEQ ID NO: 707288 - RNA, 18 nt, Human
caggccucuugaucuucc

SEQ ID NO: 707289 - RNA, 22 nt, Human
ggcagguggacgugcuaaagcu

SEQ ID NO: 707290 - RNA, 22 nt, Human
ucaaaaauggucuuugagcugc

SEQ ID NO: 707291 - RNA, 22 nt, Human
uguuugaaguucuucugugacu

SEQ ID NO: 707292 - RNA, 22 nt, Human
ggcuggucacaccacugcaggg

SEQ ID NO: 707293 - RNA, 22 nt, Human
agcaggccugccaccucggggu

SEQ ID NO: 707294 - RNA, 22 nt, Human
augcagaagacugaaaagcuga

SEQ ID NO: 707295 - RNA, 22 nt, Human
ugugaauauacuuaaugccacu

SEQ ID NO: 707296 - RNA, 23 nt, Human
ugggaagauauguauguucaagg

SEQ ID NO: 707297 - RNA, 16 nt, Human
gcacacacaucaauga

SEQ ID NO: 707298 - RNA, 22 nt, Human
ucaucaaaagccuucuggguua

SEQ ID NO: 707299 - RNA, 23 nt, Human
uuuaaugaccaauagaaggaaca

SEQ ID NO: 707300 - RNA, 19 nt, Human
uagucuuuauucuuaauuu

SEQ ID NO: 707301 - RNA, 22 nt, Human
ucucuuggagguucuuccuguu

SEQ ID NO: 707302 - RNA, 22 nt, Human
ucagucacacucacugagguag

SEQ ID NO: 707303 - RNA, 22 nt, Human
gggccagaccucuucucaggga

SEQ ID NO: 707304 - RNA, 22 nt, Human
gugagagcugcuccagaucucu

SEQ ID NO: 707305 - RNA, 19 nt, Human
cccaggaagcggagguugc

SEQ ID NO: 707306 - RNA, 22 nt, Human
gaaugcuguagacagacucuau

SEQ ID NO: 707307 - RNA, 22 nt, Human
cuggggcagagcccagcaauuu

SEQ ID NO: 707308 - RNA, 22 nt, Human
ugcugagaagagggccgaccca

SEQ ID NO: 707309 - RNA, 22 nt, Human
ucuucauguugcuguagggaga

SEQ ID NO: 707310 - RNA, 22 nt, Human
gguguugggagagcugguuuug

SEQ ID NO: 707311 - RNA, 22 nt, Human
gagagcugucagcguagcaccg

SEQ ID NO: 707312 - RNA, 22 nt, Human
gacuuucuugcagaaauauucc

SEQ ID NO: 707313 - RNA, 22 nt, Human
gucuccugccacacucaguccc

SEQ ID NO: 707314 - RNA, 18 nt, Human
gacacauccccaggccuc

SEQ ID NO: 707315 - RNA, 22 nt, Human
aaguuacaguuauuauuuaaaa

SEQ ID NO: 707316 - RNA, 22 nt, Human
gugagagauugauuguagcggc

SEQ ID NO: 707317 - RNA, 22 nt, Human
gaugcauucgggauguuuacuu

SEQ ID NO: 707318 - RNA, 22 nt, Human
ugcacagaugcuaggaggugaa

SEQ ID NO: 707319 - RNA, 19 nt, Human
cugggaguucacugcugcc

SEQ ID NO: 707320 - RNA, 22 nt, Human
acaagagacaagagguucuucu

SEQ ID NO: 707321 - RNA, 19 nt, Human
ccugugucccacguagaug

SEQ ID NO: 707322 - RNA, 22 nt, Human
gggcaagcuuugaacaucagca

SEQ ID NO: 707323 - RNA, 22 nt, Human
aggacacagguaagccagugga

SEQ ID NO: 707324 - RNA, 20 nt, Human
ucagagagagggugccacuu

SEQ ID NO: 707325 - RNA, 22 nt, Human
auguguucgcuagauugcuguu

SEQ ID NO: 707326 - RNA, 22 nt, Human
ucauaaagcucuuccaaaugua

SEQ ID NO: 707327 - RNA, 22 nt, Human
uccugagcaccuaugccauggc

SEQ ID NO: 707328 - RNA, 22 nt, Human
ggcagcucugaugaugcucugg

SEQ ID NO: 707329 - RNA, 22 nt, Human
gcugcccugcaucugugccuuc

SEQ ID NO: 707330 - RNA, 22 nt, Human
aagcugccuagaguugaauguc

SEQ ID NO: 707331 - RNA, 22 nt, Human
acagacagggcaccugccuccu

SEQ ID NO: 707332 - RNA, 22 nt, Human
uguggggcuuacaaaggcagau

SEQ ID NO: 707333 - RNA, 22 nt, Human
uaucaguagauaaacggauugc

SEQ ID NO: 707334 - RNA, 22 nt, Human
cagguccaacuauuuaucugug

SEQ ID NO: 707335 - RNA, 22 nt, Human
ugcuucugaguugcaggacuug

SEQ ID NO: 707336 - RNA, 17 nt, Human
ugcagcugcucccaggc

SEQ ID NO: 707337 - RNA, 22 nt, Human
ggcauggcucggagucagaaca

SEQ ID NO: 707338 - RNA, 22 nt, Human
uagagaaaagcagggaucagga

SEQ ID NO: 707339 - RNA, 22 nt, Human
ugacaguguuggggguaaauuu

SEQ ID NO: 707340 - RNA, 22 nt, Human
augaacaagagagggaagauuc

SEQ ID NO: 707341 - RNA, 20 nt, Human
cgcccagugcgguucugacc

SEQ ID NO: 707342 - RNA, 22 nt, Human
aagugacuauuugaguacauca

SEQ ID NO: 707343 - RNA, 22 nt, Human
guucucuaucauuagugaauuu

SEQ ID NO: 707344 - RNA, 22 nt, Human
uccauuuagcuggcaaacaaug

SEQ ID NO: 707345 - RNA, 22 nt, Human
aauuuucugaugaugaagcacg

SEQ ID NO: 707346 - RNA, 22 nt, Human
auucuguguuaggauagauggu

SEQ ID NO: 707347 - RNA, 22 nt, Human
ucucucauagagaaaaauauau

SEQ ID NO: 707348 - RNA, 22 nt, Human
gacuucagauauuuuuuaaguu

SEQ ID NO: 707349 - RNA, 20 nt, Human
gucgaaaaagauaaacaggc

SEQ ID NO: 707350 - RNA, 22 nt, Human
cuacaaaaguaauugugguuuu

SEQ ID NO: 707351 - RNA, 22 nt, Human
uagugucugacauuuaagagca

SEQ ID NO: 707352 - RNA, 22 nt, Human
gugcccugaguggguaggagag

SEQ ID NO: 707353 - RNA, 22 nt, Human
ucuggguccgggacuguggaug

SEQ ID NO: 707354 - RNA, 22 nt, Human
gagagcccucacuccuucccug

SEQ ID NO: 707355 - RNA, 22 nt, Human
cugcuggguuugccuuucacca

SEQ ID NO: 707356 - RNA, 22 nt, Human
ucuuuacuuguguauuguauau

SEQ ID NO: 707357 - RNA, 22 nt, Human
augaaaauugacagcggaagua

SEQ ID NO: 707358 - RNA, 23 nt, Human
uggucucacuugguaagaugaag

SEQ ID NO: 707359 - RNA, 22 nt, Human
auguagagcaguguuguccaau

SEQ ID NO: 707360 - RNA, 22 nt, Human
cauuugaauggcauuucacuuu

SEQ ID NO: 707361 - RNA, 22 nt, Human
cagcuuggauuuuggcacgugu

SEQ ID NO: 707362 - RNA, 22 nt, Human
aggcuggacccgacaccugccc

SEQ ID NO: 707363 - RNA, 22 nt, Human
ggucugugcucuggagccucug

SEQ ID NO: 707364 - RNA, 22 nt, Human
uuucagaacagggauugggccu

SEQ ID NO: 707365 - RNA, 22 nt, Human
ugauuucaguaaugaggaugaa

SEQ ID NO: 707366 - RNA, 22 nt, Human
acucccucucuaguccuugcaa

SEQ ID NO: 707367 - RNA, 22 nt, Human
ggauaaagucuuuagguggaca

SEQ ID NO: 707368 - RNA, 22 nt, Human
auauaguuuaagaaaguacagu

SEQ ID NO: 707369 - RNA, 22 nt, Human
cuggcagcauuaacagagagca

SEQ ID NO: 707370 - RNA, 22 nt, Human
uagauuucaggcuggcuugcgg

SEQ ID NO: 707371 - RNA, 22 nt, Human
uccaggaggcagggcugugccc

SEQ ID NO: 707372 - RNA, 22 nt, Human
uuggcucugauggggaucagga

SEQ ID NO: 707373 - RNA, 22 nt, Human
auaaaggauaauccauuagacu

SEQ ID NO: 707374 - RNA, 22 nt, Human
cacaaaguuggacaacgcaccc

SEQ ID NO: 707375 - RNA, 22 nt, Human
guggguggggagcucucuggag

SEQ ID NO: 707376 - RNA, 22 nt, Human
gaagcagaagguuuggacgugc

SEQ ID NO: 707377 - RNA, 22 nt, Human
cuucugcaagagcaucaguugu

SEQ ID NO: 707378 - RNA, 22 nt, Human
ugaucuggaauucccuguggua

SEQ ID NO: 707379 - RNA, 22 nt, Human
uccagagagguuucuccaugcu

SEQ ID NO: 707380 - RNA, 22 nt, Human
acugggccgcgcugcagagggc

SEQ ID NO: 707381 - RNA, 22 nt, Human
agcugcucugagcccugauucu

SEQ ID NO: 707382 - RNA, 22 nt, Human
uggcuggcgccgggcuagccac

SEQ ID NO: 707383 - RNA, 17 nt, Human
ugugcgcuugugugagg

SEQ ID NO: 707384 - RNA, 18 nt, Human
ggacaucaucaggugcuu

SEQ ID NO: 707385 - RNA, 22 nt, Human
aguuaaugagcauuuuggaaug

SEQ ID NO: 707386 - RNA, 22 nt, Human
uucugggcucucuuucugugug

SEQ ID NO: 707387 - RNA, 22 nt, Human
auucugcugguaacucuauaaa

SEQ ID NO: 707388 - RNA, 22 nt, Human
cagagccaaaccucagggcccg

SEQ ID NO: 707389 - RNA, 22 nt, Human
augaggcaggauuaagcuauca

SEQ ID NO: 707390 - RNA, 22 nt, Human
gugggaagagccaauuggggua

SEQ ID NO: 707391 - RNA, 22 nt, Human
agaugacaaaucaggggacggg

SEQ ID NO: 707392 - RNA, 23 nt, Human
uuugcaaauuggacacaaccaca

SEQ ID NO: 707393 - RNA, 21 nt, Human
cuguuucuugugaagugacac

SEQ ID NO: 707394 - RNA, 22 nt, Human
aaaugcagcagcuaauugaaaa

SEQ ID NO: 707395 - RNA, 22 nt, Human
ugagccaguucuucagauccau

SEQ ID NO: 707396 - RNA, 22 nt, Human
auagcacuuauagauuuggucu

SEQ ID NO: 707397 - RNA, 22 nt, Human
gaaucagaaucucuaagguggg

SEQ ID NO: 707398 - RNA, 19 nt, Human
caucaaguggaguaucucg

SEQ ID NO: 707399 - RNA, 22 nt, Human
ucacugauuaugaaaaugaagg

SEQ ID NO: 707400 - RNA, 18 nt, Human
gggaagccgggaagccgg

SEQ ID NO: 707401 - RNA, 22 nt, Human
caucaguguucacuauuccuuc

SEQ ID NO: 707402 - RNA, 22 nt, Human
agcccuccuggggccacgcugg

SEQ ID NO: 707403 - RNA, 22 nt, Human
cccaggaggaggaaaaagcucg

SEQ ID NO: 707404 - RNA, 22 nt, Human
gaaaucugaaucuucuguuggu

SEQ ID NO: 707405 - RNA, 22 nt, Human
cugaggggaaaagucaggauga

SEQ ID NO: 707406 - RNA, 22 nt, Human
aaaugcaaggccaugugaagga

SEQ ID NO: 707407 - RNA, 22 nt, Human
ccaucuccaaauaccaucacau

SEQ ID NO: 707408 - RNA, 22 nt, Human
ugccaccuugugcagcaggagg

SEQ ID NO: 707409 - RNA, 22 nt, Human
gauggcagcagcagccagggau

SEQ ID NO: 707410 - RNA, 18 nt, Human
uguaaugcagcggguggc

SEQ ID NO: 707411 - RNA, 22 nt, Human
acuucaaacaauuaacagagaa

SEQ ID NO: 707412 - RNA, 23 nt, Human
ggcagagagcauggcuggggccc

SEQ ID NO: 707413 - RNA, 22 nt, Human
aggcccaguguggcuuccugga

SEQ ID NO: 707414 - RNA, 22 nt, Human
aggcugugcaauuaggguaaga

SEQ ID NO: 707415 - RNA, 22 nt, Human
uaaugucuguguuucagugcag

SEQ ID NO: 707416 - RNA, 22 nt, Human
uucucugaaggccaugcucacu

SEQ ID NO: 707417 - RNA, 18 nt, Human
cccugaagggcaagauaa

SEQ ID NO: 707418 - RNA, 22 nt, Human
ccagagcccagcacacggugcu

SEQ ID NO: 707419 - RNA, 22 nt, Human
ggcccagcugugcuuccagccc

SEQ ID NO: 707420 - RNA, 22 nt, Human
acuggaaauugagaggucacug

SEQ ID NO: 707421 - RNA, 22 nt, Human
aauuuguguuauaccugcuccu

SEQ ID NO: 707422 - RNA, 22 nt, Human
ggaguggcaggccacagugcug

SEQ ID NO: 707423 - RNA, 22 nt, Human
aagaaaucauaucauuucuugg

SEQ ID NO: 707424 - RNA, 23 nt, Human
acuaaauggggcuuugcuuaaag

SEQ ID NO: 707425 - RNA, 22 nt, Human
ccauugaaccccucuaggccac

SEQ ID NO: 707426 - RNA, 22 nt, Human
aacaggcaggagaauucugccu

SEQ ID NO: 707427 - RNA, 22 nt, Human
uucucaaggacaaaaugacaug

SEQ ID NO: 707428 - RNA, 22 nt, Human
auuacuccuuuucuagcaggug

SEQ ID NO: 707429 - RNA, 23 nt, Human
ucacaggggccagcgcucugugg

SEQ ID NO: 707430 - RNA, 22 nt, Human
ucuacccugcggucuuggggca

SEQ ID NO: 707431 - RNA, 22 nt, Human
caguggaagacucagcucuccc

SEQ ID NO: 707432 - RNA, 22 nt, Human
gggccaugagagguucaucaac

SEQ ID NO: 707433 - RNA, 22 nt, Human
uuguacauaaugaaaggaggcu

SEQ ID NO: 707434 - RNA, 22 nt, Human
auucuggguuugcuguacaaag

SEQ ID NO: 707435 - RNA, 22 nt, Human
cagagcuuugugucagggcugu

SEQ ID NO: 707436 - RNA, 22 nt, Human
ugagccaugggacuccaaggga

SEQ ID NO: 707437 - RNA, 22 nt, Human
uccaggcuacuuggauuccugg

SEQ ID NO: 707438 - RNA, 22 nt, Human
ucucugugucucauguuccuau

SEQ ID NO: 707439 - RNA, 22 nt, Human
guucacaauuuuuacugauugg

SEQ ID NO: 707440 - RNA, 22 nt, Human
ggccagcggcacagccuggccc

SEQ ID NO: 707441 - RNA, 22 nt, Human
uaaggcaguuuugccugagaua

SEQ ID NO: 707442 - RNA, 18 nt, Human
ugcccaccagaagaggga

SEQ ID NO: 707443 - RNA, 22 nt, Human
ggcccaaacggguccagugaaa

SEQ ID NO: 707444 - RNA, 22 nt, Human
uuaaccuguuaugcccccagag

SEQ ID NO: 707445 - RNA, 22 nt, Human
cugugccuucuacuucacucua

SEQ ID NO: 707446 - RNA, 22 nt, Human
uggcugugaacaaagagaauaa

SEQ ID NO: 707447 - RNA, 22 nt, Human
cuacacugagagcucuucaggg

SEQ ID NO: 707448 - RNA, 23 nt, Human
ugagucuugagcuuuggauucug

SEQ ID NO: 707449 - RNA, 22 nt, Human
uuuauguuauggguaggaucaa

SEQ ID NO: 707450 - RNA, 22 nt, Human
uucaggauggcggauguugggg

SEQ ID NO: 707451 - RNA, 20 nt, Human
uccaggagaacugggagccg

SEQ ID NO: 707452 - RNA, 22 nt, Human
aaaugcaugguaaaugauugcc

SEQ ID NO: 707453 - RNA, 22 nt, Human
cugagaaaaguaugagcucugg

SEQ ID NO: 707454 - RNA, 20 nt, Human
uuucaguugguuaauggcau

SEQ ID NO: 707455 - RNA, 21 nt, Human
aagaacuauugagguacacag

SEQ ID NO: 707456 - RNA, 22 nt, Human
gaguccaguaguuaggacagag

SEQ ID NO: 707457 - RNA, 22 nt, Human
acugauggcccaccuuggucuc

SEQ ID NO: 707458 - RNA, 22 nt, Human
gacuuucugagucaaagaaagg

SEQ ID NO: 707459 - RNA, 22 nt, Human
cucugggaccauggcaagugcg

SEQ ID NO: 707460 - RNA, 22 nt, Human
gcugaaauucagauuccuaggc

SEQ ID NO: 707461 - RNA, 22 nt, Human
ucuaaaaugcagaucuacuggu

SEQ ID NO: 707462 - RNA, 22 nt, Human
cacacauauugucccuagugug

SEQ ID NO: 707463 - RNA, 22 nt, Human
ggcggcuuauucacucugggga

SEQ ID NO: 707464 - RNA, 22 nt, Human
ugaagacagaccaaggagaaug

SEQ ID NO: 707465 - RNA, 22 nt, Human
gucccugcaucugcaggccaug

SEQ ID NO: 707466 - RNA, 22 nt, Human
caagucaaugauuauaagaguc

SEQ ID NO: 707467 - RNA, 22 nt, Human
aaagccaggcuggccugggguu

SEQ ID NO: 707468 - RNA, 22 nt, Human
aagguuucuccgaggcuauuuu

SEQ ID NO: 707469 - RNA, 22 nt, Human
cacugugggucccagacuggag

SEQ ID NO: 707470 - RNA, 22 nt, Human
aauguauucugggaaaauguua

SEQ ID NO: 707471 - RNA, 22 nt, Human
cuggcagguuuggugucuggug

SEQ ID NO: 707472 - RNA, 22 nt, Human
uagagguauuuuugauggucau

SEQ ID NO: 707473 - RNA, 22 nt, Human
gagcucaggagcaucagaagaa

SEQ ID NO: 707474 - RNA, 22 nt, Human
accagcugccuuuucuuaguag

SEQ ID NO: 707475 - RNA, 22 nt, Human
agcagccacccagcugcucauu

SEQ ID NO: 707476 - RNA, 22 nt, Human
augcaaaaacugcacuuacgcu

SEQ ID NO: 707477 - RNA, 22 nt, Human
cugcauugaucaggcagaaucu

SEQ ID NO: 707478 - RNA, 22 nt, Human
augcaguuuaucuccaaaucau

SEQ ID NO: 707479 - RNA, 22 nt, Human
uccuggagauaauugcagugaa

SEQ ID NO: 707480 - RNA, 21 nt, Human
uauacaugugugcauacgugu

SEQ ID NO: 707481 - RNA, 22 nt, Human
gugggcuggauuugcuugcaga

SEQ ID NO: 707482 - RNA, 19 nt, Human
gccaggucuuggguccagg

SEQ ID NO: 707483 - RNA, 21 nt, Human
uugaaaguaaauucagcagcu

SEQ ID NO: 707484 - RNA, 22 nt, Human
acauugaaagcauauuaucucc

SEQ ID NO: 707485 - RNA, 22 nt, Human
ugaaaucaguaugucuuucuca

SEQ ID NO: 707486 - RNA, 17 nt, Human
ugaaguuaggcugcaga

SEQ ID NO: 707487 - RNA, 22 nt, Human
agucucugccagcuuguccucu

SEQ ID NO: 707488 - RNA, 22 nt, Human
gcuggaguuggcaaggcaugua

SEQ ID NO: 707489 - RNA, 22 nt, Human
ccugcagaaaggguccccagga

SEQ ID NO: 707490 - RNA, 22 nt, Human
gggcuccugccuccuggcaccu

SEQ ID NO: 707491 - RNA, 22 nt, Human
gcugcaugacagacaggccugg

SEQ ID NO: 707492 - RNA, 22 nt, Human
uaucaaaguuguccugugaagu

SEQ ID NO: 707493 - RNA, 22 nt, Human
uacagacauucaauuuugaccc

SEQ ID NO: 707494 - RNA, 22 nt, Human
ugagaaucagcugcacagaggu

SEQ ID NO: 707495 - RNA, 22 nt, Human
auucucugugcagauuuaagac

SEQ ID NO: 707496 - RNA, 21 nt, Human
caugcagauucuggagccaga

SEQ ID NO: 707497 - RNA, 22 nt, Human
ucugaagcuggaggaagcuuug

SEQ ID NO: 707498 - RNA, 19 nt, Human
cuucuucuuggcagccaag

SEQ ID NO: 707499 - RNA, 22 nt, Human
aagauucugucaguuaggagga

SEQ ID NO: 707500 - RNA, 22 nt, Human
cugaggaaugagugaggagcca

SEQ ID NO: 707501 - RNA, 22 nt, Human
ucucagucaguuuggacugugu

SEQ ID NO: 707502 - RNA, 22 nt, Human
agggcccaggacagcaucaggg

SEQ ID NO: 707503 - RNA, 22 nt, Human
cuguuuccuaccguuuuucauu

SEQ ID NO: 707504 - RNA, 21 nt, Human
auccguuuaauaauacugaau

SEQ ID NO: 707505 - RNA, 22 nt, Human
cuggcuccaccccaggaggaug

SEQ ID NO: 707506 - RNA, 17 nt, Human
ugcuugacucucuuguu

SEQ ID NO: 707507 - RNA, 23 nt, Human
ugcccucccaaugcuucggucac

SEQ ID NO: 707508 - RNA, 21 nt, Human
gucugaugcuugaugcaguug

SEQ ID NO: 707509 - RNA, 22 nt, Human
gccccagcguggcuguguuagg

SEQ ID NO: 707510 - RNA, 22 nt, Human
gagggccagcagccucagcaug

SEQ ID NO: 707511 - RNA, 22 nt, Human
cugacuccuuaccauaugcuuu

SEQ ID NO: 707512 - RNA, 22 nt, Human
uguuucuuacguuuuuagaggc

SEQ ID NO: 707513 - RNA, 22 nt, Human
ccuggcuggacuggaccguggc

SEQ ID NO: 707514 - RNA, 22 nt, Human
cagaugaggcaaccucauugcu

SEQ ID NO: 707515 - RNA, 22 nt, Human
gaagaugugcaauacaaagaaa

SEQ ID NO: 707516 - RNA, 22 nt, Human
uguucacaaggugaugcuuuga

SEQ ID NO: 707517 - RNA, 22 nt, Human
gcccagcuggcuuccagcacau

SEQ ID NO: 707518 - RNA, 22 nt, Human
uccuucuggaggcuguaaagga

SEQ ID NO: 707519 - RNA, 22 nt, Human
aaauacaaaaauuagccaggca

SEQ ID NO: 707520 - RNA, 22 nt, Human
ucuuccagucuguaggacuagg

SEQ ID NO: 707521 - RNA, 22 nt, Human
caucuuuaacagaauggauuug

SEQ ID NO: 707522 - RNA, 22 nt, Human
acagcagagcaccagggccacu

SEQ ID NO: 707523 - RNA, 22 nt, Human
gugcaguggcagauccuagcuc

SEQ ID NO: 707524 - RNA, 22 nt, Human
aaagccaggguccaggccugcc

SEQ ID NO: 707525 - RNA, 22 nt, Human
cugcccaggaaccagaggggca

SEQ ID NO: 707526 - RNA, 22 nt, Human
ugcuuccagcucucuguaaggu

SEQ ID NO: 707527 - RNA, 22 nt, Human
auuauuaggugcucucugacaa

SEQ ID NO: 707528 - RNA, 22 nt, Human
aguuucuguuaccauauuugac

SEQ ID NO: 707529 - RNA, 22 nt, Human
aucaggaauuaggugagaugga

SEQ ID NO: 707530 - RNA, 22 nt, Human
cugguggagagugggcucugga

SEQ ID NO: 707531 - RNA, 22 nt, Human
ccuguacagugaaugaauguga

SEQ ID NO: 707532 - RNA, 22 nt, Human
uggggcucuccacagugucuca

SEQ ID NO: 707533 - RNA, 22 nt, Human
ugaggcaggacugagcgggaug

SEQ ID NO: 707534 - RNA, 22 nt, Human
uauacagauaucuaagauguaa

SEQ ID NO: 707535 - RNA, 23 nt, Human
cagugggcuucuaacugcuccug

SEQ ID NO: 707536 - RNA, 22 nt, Human
ggacaagccugugaguggguuu

SEQ ID NO: 707537 - RNA, 22 nt, Human
uccagggccuuaccucuucaga

SEQ ID NO: 707538 - RNA, 22 nt, Human
uaaauuguuuucuagaaguugu

SEQ ID NO: 707539 - RNA, 22 nt, Human
gaauuugaaaagugaugggaau

SEQ ID NO: 707540 - RNA, 22 nt, Human
auguaugcauguauguaucgcu

SEQ ID NO: 707541 - RNA, 20 nt, Human
ugcaguguggaagacugaga

SEQ ID NO: 707542 - RNA, 22 nt, Human
ugucaguuaccuagcacaagaa

SEQ ID NO: 707543 - RNA, 22 nt, Human
aggagccccucuucaguccugg

SEQ ID NO: 707544 - RNA, 22 nt, Human
aaguuuaguggugguguuccau

SEQ ID NO: 707545 - RNA, 22 nt, Human
ugaaauaucauuuucaucuccc

SEQ ID NO: 707546 - RNA, 22 nt, Human
uaaagcuacacauuauuaaucc

SEQ ID NO: 707547 - RNA, 23 nt, Human
uuugcaaauuuuccugacuacuc

SEQ ID NO: 707548 - RNA, 22 nt, Human
agcuggggcauuuauccacuaa

SEQ ID NO: 707549 - RNA, 22 nt, Human
ucacauuugcaauugcauuguu

SEQ ID NO: 707550 - RNA, 19 nt, Human
uuucuaagcuaaaugcuuc

SEQ ID NO: 707551 - RNA, 22 nt, Human
agagagcugacuuuggagucag

SEQ ID NO: 707552 - RNA, 22 nt, Human
ccacuggcaaccccgccucaua

SEQ ID NO: 707553 - RNA, 22 nt, Human
agagccuggaccugagcuacaa

SEQ ID NO: 707554 - RNA, 22 nt, Human
uaggaaauggcucaguuacugc

SEQ ID NO: 707555 - RNA, 22 nt, Human
gcacucaguaccaggucacugc

SEQ ID NO: 707556 - RNA, 22 nt, Human
aaacuguaagagaauaaacuac

SEQ ID NO: 707557 - RNA, 22 nt, Human
uggagaauaggggccacuggug

SEQ ID NO: 707558 - RNA, 22 nt, Human
cagagcacacaugcauagagug

SEQ ID NO: 707559 - RNA, 22 nt, Human
agguccugacuccacguucuag

SEQ ID NO: 707560 - RNA, 22 nt, Human
ccgggcgggggcucucgucacc

SEQ ID NO: 707561 - RNA, 22 nt, Human
cugaaagcaaaguaauucuuaa

SEQ ID NO: 707562 - RNA, 22 nt, Human
gcugcccaguucugcugcugcc

SEQ ID NO: 707563 - RNA, 22 nt, Human
uagauguuaagcuucuagaagg

SEQ ID NO: 707564 - RNA, 22 nt, Human
agcaggaaggucugugugaguc

SEQ ID NO: 707565 - RNA, 22 nt, Human
auugaacuguuggagagguuuu

SEQ ID NO: 707566 - RNA, 22 nt, Human
aguggguguagucuuccuccug

SEQ ID NO: 707567 - RNA, 20 nt, Human
cacaggcuauaugagagcca

SEQ ID NO: 707568 - RNA, 22 nt, Human
agcucugaugacuuuacaacuu

SEQ ID NO: 707569 - RNA, 22 nt, Human
cuuggcagcuuuuggaggagcc

SEQ ID NO: 707570 - RNA, 22 nt, Human
gcagcgagugcggcugccacag

SEQ ID NO: 707571 - RNA, 22 nt, Human
ugcagcagguuccaaaggguua

SEQ ID NO: 707572 - RNA, 22 nt, Human
ugcaaauauugggacagucuag

SEQ ID NO: 707573 - RNA, 22 nt, Human
aauaccuuuucagugcacaaaa

SEQ ID NO: 707574 - RNA, 22 nt, Human
auuauacaaggcuggugccuaa

SEQ ID NO: 707575 - RNA, 20 nt, Human
auuguacuucuguugauggu

SEQ ID NO: 707576 - RNA, 21 nt, Human
aagaaguuuggauuuuguccu

SEQ ID NO: 707577 - RNA, 22 nt, Human
ucugggcuuuaguuuguuaucu

SEQ ID NO: 707578 - RNA, 22 nt, Human
ucuggagaagcagugagaguca

SEQ ID NO: 707579 - RNA, 22 nt, Human
uuugaaaggugucgagaugugu

SEQ ID NO: 707580 - RNA, 20 nt, Human
ucagugcagauuguccaagu

SEQ ID NO: 707581 - RNA, 22 nt, Human
gccagcagguggagagaucaag

SEQ ID NO: 707582 - RNA, 22 nt, Human
aggaaaugggaauagaugguau

SEQ ID NO: 707583 - RNA, 23 nt, Human
acagccccaugcagguguguuug

SEQ ID NO: 707584 - RNA, 22 nt, Human
ugcaauauuuuauauccaacaa

SEQ ID NO: 707585 - RNA, 22 nt, Human
uauuugugagacugacugaagu

SEQ ID NO: 707586 - RNA, 22 nt, Human
caagcugcagcgccugcgccgg

SEQ ID NO: 707587 - RNA, 22 nt, Human
ugcauuucacagacugagaaau

SEQ ID NO: 707588 - RNA, 22 nt, Human
aaaguuacccaaucucuaugaa

SEQ ID NO: 707589 - RNA, 22 nt, Human
cauuucugucacguucuuuuau

SEQ ID NO: 707590 - RNA, 22 nt, Human
acugcccauuaaaggugcuuug

SEQ ID NO: 707591 - RNA, 22 nt, Human
uauucuugucuuuuccagaaau

SEQ ID NO: 707592 - RNA, 22 nt, Human
aagggcugccagggggugccag

SEQ ID NO: 707593 - RNA, 22 nt, Human
uggcucaugcaucuuuucuaca

SEQ ID NO: 707594 - RNA, 22 nt, Human
uugaacauuggcaauuucauau

SEQ ID NO: 707595 - RNA, 22 nt, Human
gcccagcaccucucucaggguu

SEQ ID NO: 707596 - RNA, 21 nt, Human
ugcaugcuauguuuuuauuuc

SEQ ID NO: 707597 - RNA, 22 nt, Human
gccaccagguuagauccagccu

SEQ ID NO: 707598 - RNA, 22 nt, Human
caucuuauaggcagaguucagu

SEQ ID NO: 707599 - RNA, 22 nt, Human
aaaauugaagugaucaggaacu

SEQ ID NO: 707600 - RNA, 22 nt, Human
guccucagcaccagaacuaggg

SEQ ID NO: 707601 - RNA, 23 nt, Human
uuggaacacaguaaaugcacaau

SEQ ID NO: 707602 - RNA, 17 nt, Human
cacugugggggcauuua

SEQ ID NO: 707603 - RNA, 22 nt, Human
ccagggaugcuuucccaggacu

SEQ ID NO: 707604 - RNA, 22 nt, Human
aagagcuggucacagguccauu

SEQ ID NO: 707605 - RNA, 22 nt, Human
gggucuggagauccgggugaag

SEQ ID NO: 707606 - RNA, 21 nt, Human
ugagagacugguggauacagg

SEQ ID NO: 707607 - RNA, 22 nt, Human
caucuugagacaugaaaggugu

SEQ ID NO: 707608 - RNA, 22 nt, Human
aaagacaugacacauuggagag

SEQ ID NO: 707609 - RNA, 22 nt, Human
ccauggcaauggucagucuauu

SEQ ID NO: 707610 - RNA, 22 nt, Human
uuguguuuucuuauggcauaaa

SEQ ID NO: 707611 - RNA, 22 nt, Human
gcagggcaaugaucccgagagg

SEQ ID NO: 707612 - RNA, 18 nt, Human
gguccugggccuggcuca

SEQ ID NO: 707613 - RNA, 22 nt, Human
acagagucaugguagucaaagg

SEQ ID NO: 707614 - RNA, 22 nt, Human
ugaugaggcauaugcuacacau

SEQ ID NO: 707615 - RNA, 22 nt, Human
gcugugugcucacguaguggaa

SEQ ID NO: 707616 - RNA, 22 nt, Human
aggacagcagccauuggcaguc

SEQ ID NO: 707617 - RNA, 22 nt, Human
ucugaauaguucuauuuuaaag

SEQ ID NO: 707618 - RNA, 22 nt, Human
gcucacugccauucucuagaug

SEQ ID NO: 707619 - RNA, 21 nt, Human
gggcagaggggccuccugggu

SEQ ID NO: 707620 - RNA, 22 nt, Human
ccuuaaauucuccauuugaaag

SEQ ID NO: 707621 - RNA, 22 nt, Human
aaauaagugugggccagucaaa

SEQ ID NO: 707622 - RNA, 22 nt, Human
ccugaaaauauccucuccuuug

SEQ ID NO: 707623 - RNA, 20 nt, Human
uuucacagucccuguuuccu

SEQ ID NO: 707624 - RNA, 22 nt, Human
uguauuuauucuucugguguuu

SEQ ID NO: 707625 - RNA, 22 nt, Human
cugcccugugaggguccuuggg

SEQ ID NO: 707626 - RNA, 22 nt, Human
agaaaucaggaacaguaaggag

SEQ ID NO: 707627 - RNA, 22 nt, Human
ccagagccagagaggugccugc

SEQ ID NO: 707628 - RNA, 22 nt, Human
ccagccuuugcaucccccaucu

SEQ ID NO: 707629 - RNA, 22 nt, Human
gcuguuucuugaggcuacuccu

SEQ ID NO: 707630 - RNA, 22 nt, Human
acuuuugugcaggucucuccca

SEQ ID NO: 707631 - RNA, 22 nt, Human
ugggcaguggcugggccucucu

SEQ ID NO: 707632 - RNA, 23 nt, Human
ugauuacaagggccaaagaaagg

SEQ ID NO: 707633 - RNA, 22 nt, Human
aaucacaugugcucaauuuuaa

SEQ ID NO: 707634 - RNA, 22 nt, Human
caguaaaagauggaaauagaau

SEQ ID NO: 707635 - RNA, 18 nt, Human
aguaaagcuuauuacaug

SEQ ID NO: 707636 - RNA, 22 nt, Human
uccuucaggccucauucucaua

SEQ ID NO: 707637 - RNA, 22 nt, Human
gcccuccagcuguugcgcgucg

SEQ ID NO: 707638 - RNA, 22 nt, Human
gaugaaaugugaaaguucuggg

SEQ ID NO: 707639 - RNA, 22 nt, Human
gaggcucagagacuuuaaguuu

SEQ ID NO: 707640 - RNA, 18 nt, Human
cugauagggguggcagcu

SEQ ID NO: 707641 - RNA, 21 nt, Human
ugagggguuauaacagggugg

SEQ ID NO: 707642 - RNA, 22 nt, Human
aucaaauauaauaauuuucgcu

SEQ ID NO: 707643 - RNA, 22 nt, Human
agggcacaagacucugagcccc

SEQ ID NO: 707644 - RNA, 22 nt, Human
guccuucuuuucaucccugguu

SEQ ID NO: 707645 - RNA, 22 nt, Human
cugggucuggaggccaagggug

SEQ ID NO: 707646 - RNA, 20 nt, Human
cugcuuaaguaagugacaca

SEQ ID NO: 707647 - RNA, 22 nt, Human
ucugagcccucuuuugcagccc

SEQ ID NO: 707648 - RNA, 22 nt, Human
ugacuuaagcuguucuuuagau

SEQ ID NO: 707649 - RNA, 22 nt, Human
acauagaacuucgaugucuuuu

SEQ ID NO: 707650 - RNA, 23 nt, Human
agcugugugcgcguccggguucu

SEQ ID NO: 707651 - RNA, 22 nt, Human
gcagguaagagaggcuggcuuc

SEQ ID NO: 707652 - RNA, 22 nt, Human
cggagcagaaggcgccgccggc

SEQ ID NO: 707653 - RNA, 22 nt, Human
caagcaacgacuuucaagcugu

SEQ ID NO: 707654 - RNA, 22 nt, Human
uccagggcuguuacuuuacaua

SEQ ID NO: 707655 - RNA, 22 nt, Human
gcucauccagcaagccagggcc

SEQ ID NO: 707656 - RNA, 18 nt, Human
gggguagaguguccuauu

SEQ ID NO: 707657 - RNA, 22 nt, Human
uaggguccugccuacagagaca

SEQ ID NO: 707658 - RNA, 22 nt, Human
uuuuacaggugugagccaccau

SEQ ID NO: 707659 - RNA, 19 nt, Human
ggcugccuuuccuuaccag

SEQ ID NO: 707660 - RNA, 21 nt, Human
ugaggcuguuguaccagggag

SEQ ID NO: 707661 - RNA, 22 nt, Human
ccuguguuaguuaugggucucu

SEQ ID NO: 707662 - RNA, 22 nt, Human
uuugacaugcaaagcacuuuag

SEQ ID NO: 707663 - RNA, 22 nt, Human
cuggcuuuagguuggagagcug

SEQ ID NO: 707664 - RNA, 22 nt, Human
agcugcaguaugaggcuggugg

SEQ ID NO: 707665 - RNA, 22 nt, Human
ugugugccagccuacgaggagc

SEQ ID NO: 707666 - RNA, 22 nt, Human
ucacugaaggaagacacuguca

SEQ ID NO: 707667 - RNA, 22 nt, Human
aauugaaaauauuguagaccau

SEQ ID NO: 707668 - RNA, 22 nt, Human
uuuaaauguuuaaaacucguga

SEQ ID NO: 707669 - RNA, 22 nt, Human
gaggggucuuuuguugucaggg

SEQ ID NO: 707670 - RNA, 22 nt, Human
gcuauuuccaaagcugcuguuc

SEQ ID NO: 707671 - RNA, 22 nt, Human
agagcugguuuacucaggaauu

SEQ ID NO: 707672 - RNA, 22 nt, Human
uucaccuggcacaugugagccu

SEQ ID NO: 707673 - RNA, 22 nt, Human
aaccacagacccagacuagaga

SEQ ID NO: 707674 - RNA, 22 nt, Human
cuggugggagcagcaggcagcu

SEQ ID NO: 707675 - RNA, 22 nt, Human
ucucuggggccuuucuacauca

SEQ ID NO: 707676 - RNA, 21 nt, Human
uucugggccggagaaggggcg

SEQ ID NO: 707677 - RNA, 22 nt, Human
uggaacacaggacuaucagcug

SEQ ID NO: 707678 - RNA, 22 nt, Human
ucucagaguuugaaucuggagu

SEQ ID NO: 707679 - RNA, 22 nt, Human
acucuugaagguggugggagug

SEQ ID NO: 707680 - RNA, 22 nt, Human
uuccaaagcacuugauguaaag

SEQ ID NO: 707681 - RNA, 22 nt, Human
uuucacaaagcauagcacuuua

SEQ ID NO: 707682 - RNA, 22 nt, Human
acucacagcaugagcuuggcag

SEQ ID NO: 707683 - RNA, 22 nt, Human
gagguucauucagcucugucac

SEQ ID NO: 707684 - RNA, 22 nt, Human
caggcuugcugcuagagcacuu

SEQ ID NO: 707685 - RNA, 22 nt, Human
agaggaaggaugcauauccaaa

SEQ ID NO: 707686 - RNA, 18 nt, Human
gcagugaagaaagagcuu

SEQ ID NO: 707687 - RNA, 22 nt, Human
ugguccuggaagguccugaggg

SEQ ID NO: 707688 - RNA, 18 nt, Human
ucugcccugccauucacu

SEQ ID NO: 707689 - RNA, 22 nt, Human
uagcacaguuccugacucuuug

SEQ ID NO: 707690 - RNA, 22 nt, Human
ucaugcauauuuguaguaguuc

SEQ ID NO: 707691 - RNA, 22 nt, Human
aagaaucucugaucaggcuuua

SEQ ID NO: 707692 - RNA, 20 nt, Human
uggaaccuaggcagagcugg

SEQ ID NO: 707693 - RNA, 22 nt, Human
aucacacuguuauuuuaguuaa

SEQ ID NO: 707694 - RNA, 17 nt, Human
ucuuucccugggagaug

SEQ ID NO: 707695 - RNA, 22 nt, Human
gcacagacuuugauugcaguca

SEQ ID NO: 707696 - RNA, 22 nt, Human
gagacugguguuugcugggcug

SEQ ID NO: 707697 - RNA, 22 nt, Human
aaauuauuaugccccucuauaa

SEQ ID NO: 707698 - RNA, 21 nt, Human
ucucugagaggucugcuuaga

SEQ ID NO: 707699 - RNA, 22 nt, Human
uggccaccuucccacuucugcc

SEQ ID NO: 707700 - RNA, 22 nt, Human
ugaggcucaagaaagauuuguu

SEQ ID NO: 707701 - RNA, 22 nt, Human
aggccugaggaccuucuggagg

SEQ ID NO: 707702 - RNA, 22 nt, Human
gggaagguauuuagcugcugaa

SEQ ID NO: 707703 - RNA, 22 nt, Human
aaaugacacucauucaguguca

SEQ ID NO: 707704 - RNA, 22 nt, Human
gggcuccaccuagggacacugg

SEQ ID NO: 707705 - RNA, 22 nt, Human
uggaaauacuugccauaaaacu

SEQ ID NO: 707706 - RNA, 22 nt, Human
agacacagugcugggugcugag

SEQ ID NO: 707707 - RNA, 22 nt, Human
uguuacaagucuugagguacuu

SEQ ID NO: 707708 - RNA, 22 nt, Human
ucagcuccucaugcaggggaua

SEQ ID NO: 707709 - RNA, 22 nt, Human
auagcaaaacccacugcauuac

SEQ ID NO: 707710 - RNA, 22 nt, Human
uuucuuccccacugcaggcucu

SEQ ID NO: 707711 - RNA, 22 nt, Human
auucuucagaauaucuggcacu

SEQ ID NO: 707712 - RNA, 22 nt, Human
acuaaaugagauacugucuuca

SEQ ID NO: 707713 - RNA, 22 nt, Human
cugggcugucccaaccccaucc

SEQ ID NO: 707714 - RNA, 22 nt, Human
augucuagagcaagagaugcug

SEQ ID NO: 707715 - RNA, 22 nt, Human
ucuggcucuguguccucaccca

SEQ ID NO: 707716 - RNA, 22 nt, Human
ucaucucuagacaggaggcugg

SEQ ID NO: 707717 - RNA, 22 nt, Human
cugaggagcugaaggcccucca

SEQ ID NO: 707718 - RNA, 22 nt, Human
gcaguuuuauuaugauggaaau

SEQ ID NO: 707719 - RNA, 23 nt, Human
agaaaagcuuggacacauggccu

SEQ ID NO: 707720 - RNA, 22 nt, Human
ucucccaggugggugccuggag

SEQ ID NO: 707721 - RNA, 18 nt, Human
ggaagaaaaggaacucag

SEQ ID NO: 707722 - RNA, 22 nt, Human
agaauuacagcuuuuagaauag

SEQ ID NO: 707723 - RNA, 22 nt, Human
aaggaauucuagaagguuuugu

SEQ ID NO: 707724 - RNA, 22 nt, Human
agugacaucaugucagcaaagu

SEQ ID NO: 707725 - RNA, 22 nt, Human
uuagcauuucuggaaucacaag

SEQ ID NO: 707726 - RNA, 22 nt, Human
gggccuuggcgaaguguggugg

SEQ ID NO: 707727 - RNA, 22 nt, Human
uuuccuggaggguccccagcag

SEQ ID NO: 707728 - RNA, 22 nt, Human
uuugacucauugauuuucucug

SEQ ID NO: 707729 - RNA, 22 nt, Human
guggagagagugacagcaucuu

SEQ ID NO: 707730 - RNA, 22 nt, Human
aauaggcaguuggauaugcaag

SEQ ID NO: 707731 - RNA, 22 nt, Human
cauguccacaguucugagaggc

SEQ ID NO: 707732 - RNA, 22 nt, Human
ugucagugaguuaguugcaagu

SEQ ID NO: 707733 - RNA, 22 nt, Human
aaagaauacuccuuuugccuug

SEQ ID NO: 707734 - RNA, 21 nt, Human
ggcuuugcucagcuuaccaaa

SEQ ID NO: 707735 - RNA, 21 nt, Human
gccauguuuccuuacuaagag

SEQ ID NO: 707736 - RNA, 22 nt, Human
ccacgcucauccucucugagag

SEQ ID NO: 707737 - RNA, 20 nt, Human
cucuucaaauauuuuauucu

SEQ ID NO: 707738 - RNA, 22 nt, Human
cagcuccuauuagacacugaau

SEQ ID NO: 707739 - RNA, 22 nt, Human
ugagcagaauguucagauaaau

SEQ ID NO: 707740 - RNA, 22 nt, Human
aauguuuuuuggucugaugaau

SEQ ID NO: 707741 - RNA, 20 nt, Human
cuggcccaggaugauggcgc

SEQ ID NO: 707742 - RNA, 22 nt, Human
agaagcaggccucacagaucug

SEQ ID NO: 707743 - RNA, 22 nt, Human
auaugcuauguauguaaaugag

SEQ ID NO: 707744 - RNA, 22 nt, Human
acaauguaguugucaugagaca

SEQ ID NO: 707745 - RNA, 22 nt, Human
agguggggaguauauguaauug

SEQ ID NO: 707746 - RNA, 22 nt, Human
gagcccagcuguccuuggcaaa

SEQ ID NO: 707747 - RNA, 22 nt, Human
aguugaaauuaagagagaguuu

SEQ ID NO: 707748 - RNA, 22 nt, Human
cagagucauaucagagaauaug

SEQ ID NO: 707749 - RNA, 22 nt, Human
ggaguuggaggcuccagggaac

SEQ ID NO: 707750 - RNA, 22 nt, Human
auugcagugaugguugcauaau

SEQ ID NO: 707751 - RNA, 21 nt, Human
uugcaccaugauaaauucaga

SEQ ID NO: 707752 - RNA, 22 nt, Human
uggggccacagccuccuagcuu

SEQ ID NO: 707753 - RNA, 22 nt, Human
cauccccaauuagcgcccagcu

SEQ ID NO: 707754 - RNA, 22 nt, Human
aucaaauaaagguaccuagcuu

SEQ ID NO: 707755 - RNA, 22 nt, Human
acaggacuuaagucauuuauaa

SEQ ID NO: 707756 - RNA, 22 nt, Human
cacuugaaauauuaggggugau

SEQ ID NO: 707757 - RNA, 22 nt, Human
auucuccaguagucauucuauc

SEQ ID NO: 707758 - RNA, 22 nt, Human
cugccugcacugccuggcucca

SEQ ID NO: 707759 - RNA, 22 nt, Human
ugacaacagccaucacuuuuag

SEQ ID NO: 707760 - RNA, 18 nt, Human
gaguguggcacugggccc

SEQ ID NO: 707761 - RNA, 22 nt, Human
gggcugcuuuuuucuuagcaga

SEQ ID NO: 707762 - RNA, 21 nt, Human
acagaacuguauagugauaaa

SEQ ID NO: 707763 - RNA, 22 nt, Human
agggucaccugcuugccagggc

SEQ ID NO: 707764 - RNA, 22 nt, Human
augguggacgggagacaggacu

SEQ ID NO: 707765 - RNA, 22 nt, Human
uguuauuucuuugccauaucuu

SEQ ID NO: 707766 - RNA, 22 nt, Human
ucccucucccuauugccuggag

SEQ ID NO: 707767 - RNA, 22 nt, Human
acuucagaguuaguuauagacc

SEQ ID NO: 707768 - RNA, 22 nt, Human
ucuguuucuuccuagccaugcu

SEQ ID NO: 707769 - RNA, 22 nt, Human
agacagacugguuugaauuggu

SEQ ID NO: 707770 - RNA, 22 nt, Human
uggaagcaucacuucuugccug

SEQ ID NO: 707771 - RNA, 22 nt, Human
uccugcagccuugggcuggagc

SEQ ID NO: 707772 - RNA, 22 nt, Human
uaaaauguagcuucuaggcugg

SEQ ID NO: 707773 - RNA, 22 nt, Human
cagaugcugcuauuucacccug

SEQ ID NO: 707774 - RNA, 22 nt, Human
uauaagugacagauuauccaaa

SEQ ID NO: 707775 - RNA, 22 nt, Human
cccucuacagggaagcgcuuuc

SEQ ID NO: 707776 - RNA, 22 nt, Human
ggcugcuggcauugagguaggu

SEQ ID NO: 707777 - RNA, 18 nt, Human
ucacuggguguauguggc

SEQ ID NO: 707778 - RNA, 22 nt, Human
augaggucuuauugcaguaguu

SEQ ID NO: 707779 - RNA, 22 nt, Human
guugccguuuguucuaccagac

SEQ ID NO: 707780 - RNA, 22 nt, Human
gagauuggccuggcuugccaac

SEQ ID NO: 707781 - RNA, 22 nt, Human
gaagucugagugggggccaggc

SEQ ID NO: 707782 - RNA, 20 nt, Human
uucugggcagccauguacuu

SEQ ID NO: 707783 - RNA, 22 nt, Human
uaaaugucuuugucacguuggg

SEQ ID NO: 707784 - RNA, 20 nt, Human
acacaugugcguguucagua

SEQ ID NO: 707785 - RNA, 22 nt, Human
uucaguguggugcacaguuuug

SEQ ID NO: 707786 - RNA, 22 nt, Human
agucuggaauuuggccugagca

SEQ ID NO: 707787 - RNA, 22 nt, Human
cagaagcacauguuuacaugua

SEQ ID NO: 707788 - RNA, 23 nt, Human
aaagacugcugagaauuuuagga

SEQ ID NO: 707789 - RNA, 22 nt, Human
ccauagcaagaggagcagaaau

SEQ ID NO: 707790 - RNA, 18 nt, Human
ucacaugacagcuguugc

SEQ ID NO: 707791 - RNA, 21 nt, Human
gaguggaacgcucuucacacc

SEQ ID NO: 707792 - RNA, 22 nt, Human
uggugcaggccaagcugcgagc

SEQ ID NO: 707793 - RNA, 22 nt, Human
gaauagcuuagauuccuuagug

SEQ ID NO: 707794 - RNA, 21 nt, Human
uuccuggggaaggagcugccu

SEQ ID NO: 707795 - RNA, 22 nt, Human
uucagugcagacgccgaagccc

SEQ ID NO: 707796 - RNA, 22 nt, Human
augcuguggaaguuccugaagc

SEQ ID NO: 707797 - RNA, 22 nt, Human
uggugcugccucagaugccuua

SEQ ID NO: 707798 - RNA, 22 nt, Human
gaccacugaugacaugaggaga

SEQ ID NO: 707799 - RNA, 22 nt, Human
caggcucccugggcaguggcag

SEQ ID NO: 707800 - RNA, 23 nt, Human
acugggcugaaauuuuucauggc

SEQ ID NO: 707801 - RNA, 22 nt, Human
cagaguccugcaccagcuccag

SEQ ID NO: 707802 - RNA, 23 nt, Human
cacacccaucacuaagagcuccu

SEQ ID NO: 707803 - RNA, 22 nt, Human
cagcaaagguagaagcacagga

SEQ ID NO: 707804 - RNA, 20 nt, Human
gccaggagggugugaugagc

SEQ ID NO: 707805 - RNA, 22 nt, Human
cuccugaggacuucuauugggu

SEQ ID NO: 707806 - RNA, 22 nt, Human
auauaccucauucuuugagugc

SEQ ID NO: 707807 - RNA, 22 nt, Human
ccucuggccuaggccgggagag

SEQ ID NO: 707808 - RNA, 22 nt, Human
cccaggcuccugcuguguugac

SEQ ID NO: 707809 - RNA, 22 nt, Human
gacauucauugaugucuuccuc

SEQ ID NO: 707810 - RNA, 22 nt, Human
ugccuugguuuccccaucugua

SEQ ID NO: 707811 - RNA, 22 nt, Human
aguguuuacucaaaggguucca

SEQ ID NO: 707812 - RNA, 22 nt, Human
ucuggcugggugagagcuucuc

SEQ ID NO: 707813 - RNA, 22 nt, Human
cuguccugauggugccacuggu

SEQ ID NO: 707814 - RNA, 22 nt, Human
agguagcuauccagacgcugaa

SEQ ID NO: 707815 - RNA, 22 nt, Human
ugcacagagagaugagacacgu

SEQ ID NO: 707816 - RNA, 19 nt, Human
cauaauacaguggaucuga

SEQ ID NO: 707817 - RNA, 22 nt, Human
caaugucaugauuuuccauuag

SEQ ID NO: 707818 - RNA, 22 nt, Human
uagaaauaaaucugcagcuggg

SEQ ID NO: 707819 - RNA, 22 nt, Human
uauguuguggggugcaucaaaa

SEQ ID NO: 707820 - RNA, 18 nt, Human
guuuacauuacugaauag

SEQ ID NO: 707821 - RNA, 22 nt, Human
ugacaggcuaggaggcugaagg

SEQ ID NO: 707822 - RNA, 22 nt, Human
gccagcugggccuuagggcugg

SEQ ID NO: 707823 - RNA, 22 nt, Human
cacuugaaaaucagaggaaauu

SEQ ID NO: 707824 - RNA, 22 nt, Human
aaaccauggaguaaguucacau

SEQ ID NO: 707825 - RNA, 22 nt, Human
auuuaugacguguucggucaau

SEQ ID NO: 707826 - RNA, 22 nt, Human
uuacauaacuuuaaaaugccgu

SEQ ID NO: 707827 - RNA, 22 nt, Human
cagaaaucuccaugucagacau

SEQ ID NO: 707828 - RNA, 22 nt, Human
ugucagaccugugauuucagca

SEQ ID NO: 707829 - RNA, 22 nt, Human
uuagaaucuuuagagucucacu

SEQ ID NO: 707830 - RNA, 22 nt, Human
ccuuuggucaccuccacucuua

SEQ ID NO: 707831 - RNA, 22 nt, Human
aucagagauuguaguaugugca

SEQ ID NO: 707832 - RNA, 22 nt, Human
acauugagugcuccauaaauca

SEQ ID NO: 707833 - RNA, 22 nt, Human
uaauaguuucauaaugugcuuc

SEQ ID NO: 707834 - RNA, 22 nt, Human
ucccuggagguguuugcucagg

SEQ ID NO: 707835 - RNA, 22 nt, Human
ucccaucaucuguucuggcuac

SEQ ID NO: 707836 - RNA, 22 nt, Human
auuuucucucaaaccuuaaaau

SEQ ID NO: 707837 - RNA, 22 nt, Human
cugagguaaaauuucuauuuug

SEQ ID NO: 707838 - RNA, 20 nt, Human
caucuugaaggucuuccaca

SEQ ID NO: 707839 - RNA, 22 nt, Human
uacacucuuaggaauugguuau

SEQ ID NO: 707840 - RNA, 22 nt, Human
uccuugaaaggggcugcagggc

SEQ ID NO: 707841 - RNA, 22 nt, Human
ccucuucuagguuucagccugc

SEQ ID NO: 707842 - RNA, 22 nt, Human
uacagggacucccgcagagaua

SEQ ID NO: 707843 - RNA, 22 nt, Human
cugccagguaaacugcaggaau

SEQ ID NO: 707844 - RNA, 22 nt, Human
auacaucuggauguaugcauuu

SEQ ID NO: 707845 - RNA, 19 nt, Human
ugcugaaguugucagucug

SEQ ID NO: 707846 - RNA, 22 nt, Human
acucugaggcaggucagggcag

SEQ ID NO: 707847 - RNA, 22 nt, Human
uaaggaaagugccaugauuucu

SEQ ID NO: 707848 - RNA, 22 nt, Human
ggagcugaugguagaagaauga

SEQ ID NO: 707849 - RNA, 22 nt, Human
uuaggcuguucuuguguuguua

SEQ ID NO: 707850 - RNA, 17 nt, Human
uggagcugcguguguuc

SEQ ID NO: 707851 - RNA, 22 nt, Human
uugccuuauagugcucugcauu

SEQ ID NO: 707852 - RNA, 22 nt, Human
uggucucugcugcagcuucuca

SEQ ID NO: 707853 - RNA, 21 nt, Human
uucaagauauuuaaaaggugg

SEQ ID NO: 707854 - RNA, 22 nt, Human
agugaagugauaguuugccuag

SEQ ID NO: 707855 - RNA, 22 nt, Human
uucaggauccccaccgcguuua

SEQ ID NO: 707856 - RNA, 22 nt, Human
uguguguuaucuuaguucaucu

SEQ ID NO: 707857 - RNA, 22 nt, Human
acauugauauuucaaauacagg

SEQ ID NO: 707858 - RNA, 22 nt, Human
aucaguuuauacuuauaaaucu

SEQ ID NO: 707859 - RNA, 22 nt, Human
gcaggagacuggcugugguagu

SEQ ID NO: 707860 - RNA, 23 nt, Human
caacagcuguuagauaugggcuu

SEQ ID NO: 707861 - RNA, 22 nt, Human
acagcuugucugguuucagguc

SEQ ID NO: 707862 - RNA, 22 nt, Human
aggcagccaaucagaggcugac

SEQ ID NO: 707863 - RNA, 22 nt, Human
aacauuuauucuaauucuggga

SEQ ID NO: 707864 - RNA, 22 nt, Human
gaugaagaggcacugacauauu

SEQ ID NO: 707865 - RNA, 20 nt, Human
uggacacagcccuguugagu

SEQ ID NO: 707866 - RNA, 22 nt, Human
cucaggcaaggcccgcauucuc

SEQ ID NO: 707867 - RNA, 22 nt, Human
auucuucaucagagaugcacua

SEQ ID NO: 707868 - RNA, 22 nt, Human
auuauggagaaauauguacagg

SEQ ID NO: 707869 - RNA, 21 nt, Human
ugcuggccaugugcugggcau

SEQ ID NO: 707870 - RNA, 22 nt, Human
cuucucaaaguugugaaucagg

SEQ ID NO: 707871 - RNA, 22 nt, Human
ccugagcugaacuaagcaguuu

SEQ ID NO: 707872 - RNA, 22 nt, Human
uuugaagacuacugggagugaa

SEQ ID NO: 707873 - RNA, 23 nt, Human
agaagcaaugcuuuuuuuccucu

SEQ ID NO: 707874 - RNA, 22 nt, Human
gccuggcugcugguucugagga

SEQ ID NO: 707875 - RNA, 22 nt, Human
cagauucuuaauuuaugggauu

SEQ ID NO: 707876 - RNA, 22 nt, Human
ugggccaggucugcggucauuu

SEQ ID NO: 707877 - RNA, 22 nt, Human
gaccacaguccagucaucaugg

SEQ ID NO: 707878 - RNA, 18 nt, Human
ugagaaacugacacaugg

SEQ ID NO: 707879 - RNA, 22 nt, Human
ggagacacauauacagaaagag

SEQ ID NO: 707880 - RNA, 22 nt, Human
agaaauacuaggaauauucaua

SEQ ID NO: 707881 - RNA, 22 nt, Human
cacagugcucaaacacaagugc

SEQ ID NO: 707882 - RNA, 20 nt, Human
cagcugccuggcucugggau

SEQ ID NO: 707883 - RNA, 22 nt, Human
uauuucuugagacucgucuucc

SEQ ID NO: 707884 - RNA, 22 nt, Human
gugccugggacacgagauuuuc

SEQ ID NO: 707885 - RNA, 22 nt, Human
auugcuuuagaaagaaaaauau

SEQ ID NO: 707886 - RNA, 22 nt, Human
ucauugcaggcauuccccugcc

SEQ ID NO: 707887 - RNA, 22 nt, Human
auuagcagcuuucuggucucua

SEQ ID NO: 707888 - RNA, 22 nt, Human
cagcagcuacuuggagcagcag

SEQ ID NO: 707889 - RNA, 22 nt, Human
ccaggcucacugacuaccacau

SEQ ID NO: 707890 - RNA, 22 nt, Human
ucagacugcugucccugccugg

SEQ ID NO: 707891 - RNA, 22 nt, Human
ugagccaggucucacucaccuu

SEQ ID NO: 707892 - RNA, 22 nt, Human
uuucuucuccauggcagguccu

SEQ ID NO: 707893 - RNA, 22 nt, Human
gugugcuguuguucagguagaa

SEQ ID NO: 707894 - RNA, 22 nt, Human
ucagcaggguuugacuucuaau

SEQ ID NO: 707895 - RNA, 22 nt, Human
gaaauaauuuagaagguauucc

SEQ ID NO: 707896 - RNA, 22 nt, Human
caggugguuaugaggaagguga

SEQ ID NO: 707897 - RNA, 22 nt, Human
cagagacauucuccccauugga

SEQ ID NO: 707898 - RNA, 18 nt, Human
uucauguuggcuuaggga

SEQ ID NO: 707899 - RNA, 22 nt, Human
ucagggcacugucaccugauau

SEQ ID NO: 707900 - RNA, 22 nt, Human
agcucagagaauagggcuugag

SEQ ID NO: 707901 - RNA, 22 nt, Human
agacauuuggaagauacacaua

SEQ ID NO: 707902 - RNA, 22 nt, Human
acauauuggcaaacuggaggca

SEQ ID NO: 707903 - RNA, 22 nt, Human
uccaggcugccacagugcaacg

SEQ ID NO: 707904 - RNA, 22 nt, Human
gcaccaggugcagccgggcccc

SEQ ID NO: 707905 - RNA, 22 nt, Human
uuacaaagagaaguuguagaau

SEQ ID NO: 707906 - RNA, 20 nt, Human
ugcuggaaaaagucacucau

SEQ ID NO: 707907 - RNA, 22 nt, Human
caggaagagaacauggaggcug

SEQ ID NO: 707908 - RNA, 22 nt, Human
ccagggcuggugggagaugcug

SEQ ID NO: 707909 - RNA, 22 nt, Human
gucccuggaaaagagcugguga

SEQ ID NO: 707910 - RNA, 20 nt, Human
ugugccuggcuuuguccuga

SEQ ID NO: 707911 - RNA, 22 nt, Human
ugucaccuugcucauccucgga

SEQ ID NO: 707912 - RNA, 22 nt, Human
uugucuuucccagcuucuagag

SEQ ID NO: 707913 - RNA, 22 nt, Human
ucucuucccuuuaugguaugug

SEQ ID NO: 707914 - RNA, 22 nt, Human
agucuggcuuuuugaugagcuu

SEQ ID NO: 707915 - RNA, 22 nt, Human
gucuuauugcguauguauacaa

SEQ ID NO: 707916 - RNA, 22 nt, Human
gccugccuuuuggaggcacauu

SEQ ID NO: 707917 - RNA, 22 nt, Human
uguguacagcaugguccagcag

SEQ ID NO: 707918 - RNA, 22 nt, Human
gagcugcugguugcuggugccu

SEQ ID NO: 707919 - RNA, 22 nt, Human
ggccacagugggaaauccuggg

SEQ ID NO: 707920 - RNA, 22 nt, Human
ggugagagaaaagaaacacugu

SEQ ID NO: 707921 - RNA, 20 nt, Human
acaguggguggggagcacug

SEQ ID NO: 707922 - RNA, 22 nt, Human
caggcagcgcucguggccuggc

SEQ ID NO: 707923 - RNA, 22 nt, Human
ccaggaggcuucguccguggag

SEQ ID NO: 707924 - RNA, 22 nt, Human
aaagcagcagaaagcuggcccc

SEQ ID NO: 707925 - RNA, 22 nt, Human
cagucuaaguuaauuuccacaa

SEQ ID NO: 707926 - RNA, 22 nt, Human
agucucuuuugcgaagaguguu

SEQ ID NO: 707927 - RNA, 23 nt, Human
auauuagggagauuagcccucua

SEQ ID NO: 707928 - RNA, 22 nt, Human
guccucugagggggcugcacgc

SEQ ID NO: 707929 - RNA, 21 nt, Human
cuuaacauuuuaaaugaaagg

SEQ ID NO: 707930 - RNA, 22 nt, Human
auccuguggggcggcugcaggg

SEQ ID NO: 707931 - RNA, 20 nt, Human
cagaacagucugagaggcca

SEQ ID NO: 707932 - RNA, 21 nt, Human
gucagggauucaagugcucac

SEQ ID NO: 707933 - RNA, 22 nt, Human
uauggguauuuuauacauaacc

SEQ ID NO: 707934 - RNA, 22 nt, Human
aaugucucucuaaauaaacuuu

SEQ ID NO: 707935 - RNA, 22 nt, Human
acacuaagguuggagucacagu

SEQ ID NO: 707936 - RNA, 22 nt, Human
acacagggauauuucagguggu

SEQ ID NO: 707937 - RNA, 22 nt, Human
gacccugaggauucccugcuga

SEQ ID NO: 707938 - RNA, 22 nt, Human
cacaggcuccggccuugcagcc

SEQ ID NO: 707939 - RNA, 22 nt, Human
agaaauacuuuguaaaucucac

SEQ ID NO: 707940 - RNA, 22 nt, Human
uucaaagaauuuugagaccuga

SEQ ID NO: 707941 - RNA, 22 nt, Human
ucaggccugcagugccaaccca

SEQ ID NO: 707942 - RNA, 22 nt, Human
ucuguguacgcaggcgugcgcg

SEQ ID NO: 707943 - RNA, 22 nt, Human
ggccuguggcuuuggcgucuaa

SEQ ID NO: 707944 - RNA, 22 nt, Human
ugcacugauccugaccagugaa

SEQ ID NO: 707945 - RNA, 22 nt, Human
uugcuucuggaacuuucuguuc

SEQ ID NO: 707946 - RNA, 22 nt, Human
uugaaguccuugccucuugcac

SEQ ID NO: 707947 - RNA, 22 nt, Human
gcaagcaaaaugggagauuccc

SEQ ID NO: 707948 - RNA, 23 nt, Human
cauggcugauuucaagcuaccac

SEQ ID NO: 707949 - RNA, 22 nt, Human
agggucucugggaguagggcac

SEQ ID NO: 707950 - RNA, 22 nt, Human
agcccagccugauucuacaccc

SEQ ID NO: 707951 - RNA, 22 nt, Human
aggaaaggccucagcagaaacc

SEQ ID NO: 707952 - RNA, 22 nt, Human
ccagcugguuuauauuccccac

SEQ ID NO: 707953 - RNA, 22 nt, Human
gacagcagacaaaccauguuuu

SEQ ID NO: 707954 - RNA, 22 nt, Human
cuuuuucauuggcuuuaggaca

SEQ ID NO: 707955 - RNA, 22 nt, Human
ugcugaauaauaagauuacuca

SEQ ID NO: 707956 - RNA, 22 nt, Human
acauuucuaucauccuguaaug

SEQ ID NO: 707957 - RNA, 22 nt, Human
gcuccagguggcuuauuuguau

SEQ ID NO: 707958 - RNA, 22 nt, Human
gaggagaaagcagugauuugug

SEQ ID NO: 707959 - RNA, 22 nt, Human
uuccaggcacaucccaacucca

SEQ ID NO: 707960 - RNA, 22 nt, Human
agucagcuuggcuccucccaug

SEQ ID NO: 707961 - RNA, 22 nt, Human
gugccuggcagggucagcugcu

SEQ ID NO: 707962 - RNA, 22 nt, Human
cugcugcccuagacccaguccu

SEQ ID NO: 707963 - RNA, 22 nt, Human
uguaggaaaaacaaugaucugc

SEQ ID NO: 707964 - RNA, 22 nt, Human
gacagugagagucuacacccuc

SEQ ID NO: 707965 - RNA, 22 nt, Human
cuaggaacaguucaacaguuua

SEQ ID NO: 707966 - RNA, 22 nt, Human
gcagaggcuguagggaagguug

SEQ ID NO: 707967 - RNA, 22 nt, Human
acuguuacagggcacugaacau

SEQ ID NO: 707968 - RNA, 20 nt, Human
ggcugcugugggcagagagg

SEQ ID NO: 707969 - RNA, 22 nt, Human
ugcagguggcuccagggacugc

SEQ ID NO: 707970 - RNA, 22 nt, Human
gcccugcuucuggcaugcagaa

SEQ ID NO: 707971 - RNA, 22 nt, Human
aucugcuauguuauuucccacu

SEQ ID NO: 707972 - RNA, 20 nt, Human
agcugccccugggcacugcc

SEQ ID NO: 707973 - RNA, 22 nt, Human
uccaguggugguuugaagggca

SEQ ID NO: 707974 - RNA, 22 nt, Human
ucugccuagguuuccaaugugc

SEQ ID NO: 707975 - RNA, 22 nt, Human
uuuaacagaugugaaauuuuca

SEQ ID NO: 707976 - RNA, 22 nt, Human
uuccccagggaagcuccugcgc

SEQ ID NO: 707977 - RNA, 22 nt, Human
ucaagaugaaccaggacauuca

SEQ ID NO: 707978 - RNA, 22 nt, Human
gagcugggaguuauagcauguu

SEQ ID NO: 707979 - RNA, 23 nt, Human
gggggcgugucauggagggccac

SEQ ID NO: 707980 - RNA, 22 nt, Human
ucaacuuuaguguagcuauuua

SEQ ID NO: 707981 - RNA, 22 nt, Human
ugguuucugcccucagagcuca

SEQ ID NO: 707982 - RNA, 23 nt, Human
gugcucugcggucugcuagucug

SEQ ID NO: 707983 - RNA, 22 nt, Human
gucuccagagguuacauccugu

SEQ ID NO: 707984 - RNA, 22 nt, Human
ucuggucccuuuuccugcaguc

SEQ ID NO: 707985 - RNA, 22 nt, Human
auuucagaauguccuaauuuag

SEQ ID NO: 707986 - RNA, 19 nt, Human
uggcaugaugauggauggg

SEQ ID NO: 707987 - RNA, 22 nt, Human
cugggcacauuuugacuagugu

SEQ ID NO: 707988 - RNA, 22 nt, Human
ucaggagucugugcaguuccac

SEQ ID NO: 707989 - RNA, 22 nt, Human
uuuaagcacagggauaaaguua

SEQ ID NO: 707990 - RNA, 22 nt, Human
cauugcacuccagcuugggcaa

SEQ ID NO: 707991 - RNA, 22 nt, Human
uggggugagauucagauauuca

SEQ ID NO: 707992 - RNA, 22 nt, Human
acauccaugcaugucugugcac

SEQ ID NO: 707993 - RNA, 22 nt, Human
cuggugucugcucccucacagc

SEQ ID NO: 707994 - RNA, 22 nt, Human
ugaaaucaugagauagugucac

SEQ ID NO: 707995 - RNA, 22 nt, Human
ugaaauacacaaauuuaguaag

SEQ ID NO: 707996 - RNA, 22 nt, Human
agcaucaguacuaaucuggcca

SEQ ID NO: 707997 - RNA, 22 nt, Human
cagcaucuggggaacauucaag

SEQ ID NO: 707998 - RNA, 23 nt, Human
cuguagcuaaaagcugggauuug

SEQ ID NO: 707999 - RNA, 22 nt, Human
caggcaggugcagauuccucuu

SEQ ID NO: 708000 - RNA, 22 nt, Human
aaccuguuuugauuaacaagua

SEQ ID NO: 708001 - RNA, 22 nt, Human
uggaagcucaaggcagggugag

SEQ ID NO: 708002 - RNA, 22 nt, Human
gcuggcccagcguggggccgug

SEQ ID NO: 708003 - RNA, 22 nt, Human
ucucuguaguugggcagcugcu

SEQ ID NO: 708004 - RNA, 22 nt, Human
gaggcucaguuauuuuagccug

SEQ ID NO: 708005 - RNA, 22 nt, Human
gugccagagaugacaggccugc

SEQ ID NO: 708006 - RNA, 22 nt, Human
acugccugagcuauuggaaaag

SEQ ID NO: 708007 - RNA, 20 nt, Human
gcugaggggucuauggcaua

SEQ ID NO: 708008 - RNA, 22 nt, Human
cacuugaauggcauuguuccuu

SEQ ID NO: 708009 - RNA, 22 nt, Human
uuacauucuuggaaucuuguuu

SEQ ID NO: 708010 - RNA, 22 nt, Human
acaggaguuaaccaugggaagu

SEQ ID NO: 708011 - RNA, 22 nt, Human
ugccaggcccugcgggguccca

SEQ ID NO: 708012 - RNA, 22 nt, Human
cugugccuccagucucgcuucu

SEQ ID NO: 708013 - RNA, 22 nt, Human
uuccagagugacugugccacuu

SEQ ID NO: 708014 - RNA, 22 nt, Human
uggggaggauaugugaguuauu

SEQ ID NO: 708015 - RNA, 22 nt, Human
aagguagauucuggaucgaagg

SEQ ID NO: 708016 - RNA, 22 nt, Human
cuagagaagagguuaagcauga

SEQ ID NO: 708017 - RNA, 22 nt, Human
agcacagugcucuggacagagu

SEQ ID NO: 708018 - RNA, 22 nt, Human
caggccaaaauucaggcauucu

SEQ ID NO: 708019 - RNA, 22 nt, Human
cuccagggaggucugcaggacu

SEQ ID NO: 708020 - RNA, 22 nt, Human
ggguggagaggcuaaguccagu

SEQ ID NO: 708021 - RNA, 22 nt, Human
augugcaauggugucaccacau

SEQ ID NO: 708022 - RNA, 22 nt, Human
auauucuugaagggagauuaua

SEQ ID NO: 708023 - RNA, 22 nt, Human
accaguuaaagggaaauugaaa

SEQ ID NO: 708024 - RNA, 19 nt, Human
aggcaugggaagagaaguc

SEQ ID NO: 708025 - RNA, 22 nt, Human
ugcuucuguuuguuucugucau

SEQ ID NO: 708026 - RNA, 19 nt, Human
ucucuggcauagacucaau

SEQ ID NO: 708027 - RNA, 20 nt, Human
gcuucucagggcuucucuga

SEQ ID NO: 708028 - RNA, 22 nt, Human
gcuuuggaugugugccugaggu

SEQ ID NO: 708029 - RNA, 22 nt, Human
uguuuguaucucucucuguggc

SEQ ID NO: 708030 - RNA, 21 nt, Human
agacagcagauagucgaaagg

SEQ ID NO: 708031 - RNA, 22 nt, Human
ucuccaggaaccaucaugguaa

SEQ ID NO: 708032 - RNA, 22 nt, Human
acagagcaucagaugaaaucaa

SEQ ID NO: 708033 - RNA, 22 nt, Human
aaggcagagggcuggaucagag

SEQ ID NO: 708034 - RNA, 22 nt, Human
uccagagaauucuacgcagugc

SEQ ID NO: 708035 - RNA, 22 nt, Human
gcauccauuguuuauguguuuc

SEQ ID NO: 708036 - RNA, 22 nt, Human
uggcuuccgccgcgggccucgg

SEQ ID NO: 708037 - RNA, 22 nt, Human
gugccagcucuccccacaucug

SEQ ID NO: 708038 - RNA, 22 nt, Human
cuacagugaagacuagcuauag

SEQ ID NO: 708039 - RNA, 18 nt, Human
aagauguuuaaugggaag

SEQ ID NO: 708040 - RNA, 22 nt, Human
gugugagagaagcugccaugga

SEQ ID NO: 708041 - RNA, 22 nt, Human
caagaaauuucuuaagaacuaa

SEQ ID NO: 708042 - RNA, 22 nt, Human
uauguuuauacuuugauguacu

SEQ ID NO: 708043 - RNA, 22 nt, Human
aaaacauguccauacagaaacu

SEQ ID NO: 708044 - RNA, 22 nt, Human
aggaauaugagcugcugcagug

SEQ ID NO: 708045 - RNA, 22 nt, Human
auuacagaaagcaauauugagu

SEQ ID NO: 708046 - RNA, 23 nt, Human
ggcaccaggccauggagcgggag

SEQ ID NO: 708047 - RNA, 22 nt, Human
uccagucaagcuugagaauuuc

SEQ ID NO: 708048 - RNA, 22 nt, Human
caugcagccugugaacaguguc

SEQ ID NO: 708049 - RNA, 22 nt, Human
uuuuucucuucuguaaaguggu

SEQ ID NO: 708050 - RNA, 22 nt, Human
augguagguacaacagcaggca

SEQ ID NO: 708051 - RNA, 22 nt, Human
gaccuucaguguguuucucaca

SEQ ID NO: 708052 - RNA, 22 nt, Human
cuuuaugaaccuguucagcuug

SEQ ID NO: 708053 - RNA, 16 nt, Human
aggaggggaauuagga

SEQ ID NO: 708054 - RNA, 22 nt, Human
auucacagagugguuaguggua

SEQ ID NO: 708055 - RNA, 22 nt, Human
agugaaaugauaguguaaauac

SEQ ID NO: 708056 - RNA, 22 nt, Human
cuagaaacauuacauguguuaa

SEQ ID NO: 708057 - RNA, 22 nt, Human
aggggcaguuccaaguuuugug

SEQ ID NO: 708058 - RNA, 22 nt, Human
gugucugccuuuggacuaacug

SEQ ID NO: 708059 - RNA, 19 nt, Human
gcaggguggcagagcucuu

SEQ ID NO: 708060 - RNA, 22 nt, Human
acauugaagggcuauccaauag

SEQ ID NO: 708061 - RNA, 22 nt, Human
aaguuacaggagaaagagauca

SEQ ID NO: 708062 - RNA, 22 nt, Human
gaaauacagaaagggcugaaug

SEQ ID NO: 708063 - RNA, 22 nt, Human
ugcaaaaauugcuggaaucuuu

SEQ ID NO: 708064 - RNA, 22 nt, Human
aagaggagaaaggcuggcuuug

SEQ ID NO: 708065 - RNA, 19 nt, Human
ugaagcaauaccauuuuug

SEQ ID NO: 708066 - RNA, 22 nt, Human
cugaggaccccacaggaggccc

SEQ ID NO: 708067 - RNA, 22 nt, Human
guuaaacaauaacuggcacaca

SEQ ID NO: 708068 - RNA, 22 nt, Human
uugucucugggacaugguauua

SEQ ID NO: 708069 - RNA, 22 nt, Human
cagcucuguucauagauggugc

SEQ ID NO: 708070 - RNA, 22 nt, Human
uauggcaagaugacauguucuc

SEQ ID NO: 708071 - RNA, 22 nt, Human
gcauuuuucucuccuauaggag

SEQ ID NO: 708072 - RNA, 22 nt, Human
uuucaacaucaccuagcaguuc

SEQ ID NO: 708073 - RNA, 22 nt, Human
cuggccucauagccaagcugug

SEQ ID NO: 708074 - RNA, 22 nt, Human
aagcagaaguugaucuaccaua

SEQ ID NO: 708075 - RNA, 22 nt, Human
cugggccaucucucugcaagug

SEQ ID NO: 708076 - RNA, 22 nt, Human
guuuaacauuguaccaacaccu

SEQ ID NO: 708077 - RNA, 22 nt, Human
ggcuuuaugcacagcagauggu

SEQ ID NO: 708078 - RNA, 22 nt, Human
ucucuacagaaucuuauuauug

SEQ ID NO: 708079 - RNA, 22 nt, Human
ucccuccauaacagaggugagc

SEQ ID NO: 708080 - RNA, 22 nt, Human
ggagcuguugauuguuugagga

SEQ ID NO: 708081 - RNA, 22 nt, Human
aaaaucaguacacuuuauuuug

SEQ ID NO: 708082 - RNA, 22 nt, Human
uuagucaggaccuuuugguuuc

SEQ ID NO: 708083 - RNA, 22 nt, Human
uaaaugugucuuuuuaaggccu

SEQ ID NO: 708084 - RNA, 22 nt, Human
ucacaauggcauaguauaaaau

SEQ ID NO: 708085 - RNA, 22 nt, Human
gagauucuuuccagaacuuuga

SEQ ID NO: 708086 - RNA, 22 nt, Human
uggcccuguggcuucagaacag

SEQ ID NO: 708087 - RNA, 22 nt, Human
caguugcuacaguucaagugug

SEQ ID NO: 708088 - RNA, 22 nt, Human
caggcaccacacuaggggcuga

SEQ ID NO: 708089 - RNA, 22 nt, Human
cagagccagucagucagaaacu

SEQ ID NO: 708090 - RNA, 22 nt, Human
ccuccccacccacggcuggugg

SEQ ID NO: 708091 - RNA, 22 nt, Human
gaagggaaggaaagaaccagca

SEQ ID NO: 708092 - RNA, 22 nt, Human
aauauagauuuacucaagagaa

SEQ ID NO: 708093 - RNA, 22 nt, Human
accucagagauacaaaccaugg

SEQ ID NO: 708094 - RNA, 18 nt, Human
gaaaauacucugggcuca

SEQ ID NO: 708095 - RNA, 22 nt, Human
uacuacaguauguguguuauac

SEQ ID NO: 708096 - RNA, 22 nt, Human
auuuugcacacuaugcagcuuu

SEQ ID NO: 708097 - RNA, 22 nt, Human
agaaaggagcaccgugggggau

SEQ ID NO: 708098 - RNA, 21 nt, Human
ggcagcacuaccugaagcaua

SEQ ID NO: 708099 - RNA, 22 nt, Human
agagguucaaacuucauaauuu

SEQ ID NO: 708100 - RNA, 22 nt, Human
aucuggauagguuguuuugcau

SEQ ID NO: 708101 - RNA, 22 nt, Human
gcaaacuguuggaguagagucu

SEQ ID NO: 708102 - RNA, 22 nt, Human
ucugggaaaugggcagcuucgc

SEQ ID NO: 708103 - RNA, 22 nt, Human
aguguguccaggaagcagaugg

SEQ ID NO: 708104 - RNA, 22 nt, Human
aggaauuacucaucugugguau

SEQ ID NO: 708105 - RNA, 22 nt, Human
cugaauaucauuuacauuugga

SEQ ID NO: 708106 - RNA, 22 nt, Human
ugacaauggguggacaagauag

SEQ ID NO: 708107 - RNA, 22 nt, Human
uuucauaaucugucaagugggg

SEQ ID NO: 708108 - RNA, 23 nt, Human
ggcuucuugccugucuuggugcu

SEQ ID NO: 708109 - RNA, 22 nt, Human
cucugaaagaguuuaguauuau

SEQ ID NO: 708110 - RNA, 22 nt, Human
uuccauuuggcacuucacugag

SEQ ID NO: 708111 - RNA, 17 nt, Human
gccuggcccagccuggc

SEQ ID NO: 708112 - RNA, 22 nt, Human
augcugcacaagccacauguag

SEQ ID NO: 708113 - RNA, 22 nt, Human
uaaugucaaggucauucuagag

SEQ ID NO: 708114 - RNA, 22 nt, Human
aguggcuaugcaugacuggaau

SEQ ID NO: 708115 - RNA, 22 nt, Human
uacacaugugcacgcguguccu

SEQ ID NO: 708116 - RNA, 22 nt, Human
agucacaggguacacaaggauu

SEQ ID NO: 708117 - RNA, 17 nt, Human
uuguuucuucucugugg

SEQ ID NO: 708118 - RNA, 22 nt, Human
gggcuuuaggggccagugacca

SEQ ID NO: 708119 - RNA, 22 nt, Human
ccagucucaguucacguuggua

SEQ ID NO: 708120 - RNA, 22 nt, Human
ugcugcacgauaaauaauuucu

SEQ ID NO: 708121 - RNA, 22 nt, Human
cugccccugcucauggcugucc

SEQ ID NO: 708122 - RNA, 22 nt, Human
ugucuccuauuuccugcuaagg

SEQ ID NO: 708123 - RNA, 17 nt, Human
ucugaagccagucugcu

SEQ ID NO: 708124 - RNA, 22 nt, Human
uuaccuguguguuugauacaua

SEQ ID NO: 708125 - RNA, 22 nt, Human
gcacacugcggugaugugaguc

SEQ ID NO: 708126 - RNA, 22 nt, Human
aggaauuuuacaagcugguugc

SEQ ID NO: 708127 - RNA, 22 nt, Human
ugcugggcaccagugccugcag

SEQ ID NO: 708128 - RNA, 22 nt, Human
auuugucuagugguauucacgu

SEQ ID NO: 708129 - RNA, 22 nt, Human
ugcauuggguugacauacuaaa

SEQ ID NO: 708130 - RNA, 22 nt, Human
uaaucacugucaaccuuuguuc

SEQ ID NO: 708131 - RNA, 22 nt, Human
ucauguuuuaaugccuuuuucu

SEQ ID NO: 708132 - RNA, 22 nt, Human
uugauuaaaaugagacaucauu

SEQ ID NO: 708133 - RNA, 22 nt, Human
uuugauaauuaaaaauuguagu

SEQ ID NO: 708134 - RNA, 22 nt, Human
gaauuacagccagaagaaugaa

SEQ ID NO: 708135 - RNA, 22 nt, Human
ggaggggucucuagcgaggaga

SEQ ID NO: 708136 - RNA, 23 nt, Human
aagguguuuguuuucagaaagca

SEQ ID NO: 708137 - RNA, 18 nt, Human
gccaggaagaggaaugug

SEQ ID NO: 708138 - RNA, 22 nt, Human
aguuuuuccguggcuacgauaa

SEQ ID NO: 708139 - RNA, 22 nt, Human
ggcccacacugacagcugagcu

SEQ ID NO: 708140 - RNA, 22 nt, Human
cuucuccuaaggucagaauugc

SEQ ID NO: 708141 - RNA, 22 nt, Human
gacagacaggaggcauucaggg

SEQ ID NO: 708142 - RNA, 22 nt, Human
gcugagagugagcacuggauau

SEQ ID NO: 708143 - RNA, 22 nt, Human
gaagccaguacugugcucugca

SEQ ID NO: 708144 - RNA, 22 nt, Human
aaagcagcugaucucagagccu

SEQ ID NO: 708145 - RNA, 22 nt, Human
uuauuuauguuaacagucgaga

SEQ ID NO: 708146 - RNA, 22 nt, Human
aggcucuguuauucuagagggc

SEQ ID NO: 708147 - RNA, 22 nt, Human
ucagaacauguuugaguaagac

SEQ ID NO: 708148 - RNA, 18 nt, Human
uuaagagcugaaagggga

SEQ ID NO: 708149 - RNA, 22 nt, Human
gggcuccaaaguaagcuuuagu

SEQ ID NO: 708150 - RNA, 22 nt, Human
ucugagccguauggcuuggcua

SEQ ID NO: 708151 - RNA, 22 nt, Human
gcugggugucacggggcucgug

SEQ ID NO: 708152 - RNA, 22 nt, Human
guuccuaaauuugaaggacuuu

SEQ ID NO: 708153 - RNA, 22 nt, Human
uauuuguauuucaugcaguaaa

SEQ ID NO: 708154 - RNA, 21 nt, Human
uccagaggaggacagacucag

SEQ ID NO: 708155 - RNA, 22 nt, Human
ugaaaucauugccaaguauuga

SEQ ID NO: 708156 - RNA, 22 nt, Human
cuagggagggauguuggcauga

SEQ ID NO: 708157 - RNA, 22 nt, Human
uuccaggauagcuuucaggaau

SEQ ID NO: 708158 - RNA, 22 nt, Human
aagauacuucacuugccgaaau

SEQ ID NO: 708159 - RNA, 22 nt, Human
gcucugggugaaggguaccauu

SEQ ID NO: 708160 - RNA, 22 nt, Human
gacauaaaccuugagauauuaa

SEQ ID NO: 708161 - RNA, 22 nt, Human
ugauaggcuuaauuuuccuguc

SEQ ID NO: 708162 - RNA, 18 nt, Human
agcuucccucugagaggg

SEQ ID NO: 708163 - RNA, 22 nt, Human
uuuucagaauuagcauaccauu

SEQ ID NO: 708164 - RNA, 20 nt, Human
caguccugcaggcgggagaa

SEQ ID NO: 708165 - RNA, 22 nt, Human
ggcugagaacaggcccagccuc

SEQ ID NO: 708166 - RNA, 22 nt, Human
gugacucacacaggccugggcu

SEQ ID NO: 708167 - RNA, 22 nt, Human
uggagacugauaaaggcuauug

SEQ ID NO: 708168 - RNA, 22 nt, Human
uggccaagaugcgaccucucag

SEQ ID NO: 708169 - RNA, 22 nt, Human
ccuuuggucuugaugaacuguu

SEQ ID NO: 708170 - RNA, 22 nt, Human
uagacuuuuaagucccucuuua

SEQ ID NO: 708171 - RNA, 22 nt, Human
aaucucucugggguucaguccu

SEQ ID NO: 708172 - RNA, 22 nt, Human
cugaggagugggugggcaguga

SEQ ID NO: 708173 - RNA, 20 nt, Human
cuguggugagcaggagagua

SEQ ID NO: 708174 - RNA, 22 nt, Human
ugcuggccgugagcucucggga

SEQ ID NO: 708175 - RNA, 20 nt, Human
cgcuccagucgcuggugugu

SEQ ID NO: 708176 - RNA, 19 nt, Human
agagaaagaauugagucua

SEQ ID NO: 708177 - RNA, 22 nt, Human
uaaacacugccuugguggguca

SEQ ID NO: 708178 - RNA, 22 nt, Human
cccaaagggcuuccuguucuca

SEQ ID NO: 708179 - RNA, 22 nt, Human
aagcauuuuucacagcaacagc

SEQ ID NO: 708180 - RNA, 22 nt, Human
caguccugagcuccugggcuga

SEQ ID NO: 708181 - RNA, 22 nt, Human
aucuugcauuugcuaaaaugca

SEQ ID NO: 708182 - RNA, 22 nt, Human
uagauggaggcuagaugcaggg

SEQ ID NO: 708183 - RNA, 22 nt, Human
agcugcacugugaaguucauag

SEQ ID NO: 708184 - RNA, 22 nt, Human
cagaacuuggcaaagccgacug

SEQ ID NO: 708185 - RNA, 18 nt, Human
cagucccaaaccuuagga

SEQ ID NO: 708186 - RNA, 22 nt, Human
agcacccuccaacuucccugua

SEQ ID NO: 708187 - RNA, 22 nt, Human
ugagcuggcuugucaaccaggg

SEQ ID NO: 708188 - RNA, 20 nt, Human
ggcagcaggaguuuccucuu

SEQ ID NO: 708189 - RNA, 22 nt, Human
aguuggguuugugucaguugca

SEQ ID NO: 708190 - RNA, 22 nt, Human
ggcuuuuguuucagcucugcua

SEQ ID NO: 708191 - RNA, 22 nt, Human
cucuuuuaauugucauaacaac

SEQ ID NO: 708192 - RNA, 22 nt, Human
agugggcagcccaggaggucuu

SEQ ID NO: 708193 - RNA, 22 nt, Human
gcuggcagggugguugagagag

SEQ ID NO: 708194 - RNA, 22 nt, Human
gaggccugguuugcaugagaau

SEQ ID NO: 708195 - RNA, 22 nt, Human
ugaguauucugaauuucaaacu

SEQ ID NO: 708196 - RNA, 22 nt, Human
guugcuuuuuugauagguggaa

SEQ ID NO: 708197 - RNA, 21 nt, Human
gccugccugcgugacccucuu

SEQ ID NO: 708198 - RNA, 22 nt, Human
gggaucugaguugucaggaagg

SEQ ID NO: 708199 - RNA, 22 nt, Human
ccuuuccuuuuuagugugggag

SEQ ID NO: 708200 - RNA, 22 nt, Human
auaggaauuucuucagcacuga

SEQ ID NO: 708201 - RNA, 22 nt, Human
cagggagcugacaaccaaggag

SEQ ID NO: 708202 - RNA, 22 nt, Human
ucaauagauaaagcuacauaaa

SEQ ID NO: 708203 - RNA, 22 nt, Human
accuucaagauugugggucaau

SEQ ID NO: 708204 - RNA, 22 nt, Human
cucagagcugaggccagggaca

SEQ ID NO: 708205 - RNA, 22 nt, Human
cucuccagccuuuagcccacgc

SEQ ID NO: 708206 - RNA, 22 nt, Human
aggagauggagcucagugggca

SEQ ID NO: 708207 - RNA, 22 nt, Human
ggaauguagaaucucuggucuc

SEQ ID NO: 708208 - RNA, 22 nt, Human
gggcucugggaugcucuuagag

SEQ ID NO: 708209 - RNA, 22 nt, Human
gcacugagcuuuggaggagcag

SEQ ID NO: 708210 - RNA, 17 nt, Human
gcaaggaaguucuuugc

SEQ ID NO: 708211 - RNA, 16 nt, Human
gcugcugcuuccugcu

SEQ ID NO: 708212 - RNA, 22 nt, Human
cuucucugcccauaggaaaugc

SEQ ID NO: 708213 - RNA, 22 nt, Human
uaguauuuuagaaaaccaugaa

SEQ ID NO: 708214 - RNA, 18 nt, Human
acacugcagcagucugcu

SEQ ID NO: 708215 - RNA, 22 nt, Human
acuuucucaaaucagacuuuaa

SEQ ID NO: 708216 - RNA, 22 nt, Human
gccccagcucugccacaacuag

SEQ ID NO: 708217 - RNA, 22 nt, Human
caugugugucuccaccagcugc

SEQ ID NO: 708218 - RNA, 22 nt, Human
ggcagccagagggcagcuggau

SEQ ID NO: 708219 - RNA, 22 nt, Human
caaauuaaugugucucaaaaua

SEQ ID NO: 708220 - RNA, 22 nt, Human
uaaauguuaugcccaucaucca

SEQ ID NO: 708221 - RNA, 22 nt, Human
caggcacucauucagagaggug

SEQ ID NO: 708222 - RNA, 18 nt, Human
cacuggaccucaugagag

SEQ ID NO: 708223 - RNA, 22 nt, Human
uuauacuaaaacgcauugaauu

SEQ ID NO: 708224 - RNA, 22 nt, Human
ccaacaccaucugagcuccagc

SEQ ID NO: 708225 - RNA, 22 nt, Human
acagcuuguaucccaauggagc

SEQ ID NO: 708226 - RNA, 22 nt, Human
acuagaaauuacucagaauaaa

SEQ ID NO: 708227 - RNA, 18 nt, Human
gucucaggaguggcacgu

SEQ ID NO: 708228 - RNA, 22 nt, Human
ccagcccuccuccaucagagga

SEQ ID NO: 708229 - RNA, 19 nt, Human
ccagggcuuuaaguugagg

SEQ ID NO: 708230 - RNA, 22 nt, Human
uccugagagccuuggcuucaga

SEQ ID NO: 708231 - RNA, 22 nt, Human
uuauuagguuauucucuguacu

SEQ ID NO: 708232 - RNA, 22 nt, Human
guucuauucuccaguuacauau

SEQ ID NO: 708233 - RNA, 20 nt, Human
gugcagccaagcugagccgc

SEQ ID NO: 708234 - RNA, 22 nt, Human
uucuggagaaucaccaccaggc

SEQ ID NO: 708235 - RNA, 22 nt, Human
guaacugaggcagcuuuuaaga

SEQ ID NO: 708236 - RNA, 22 nt, Human
cacagacagugucccuuuguug

SEQ ID NO: 708237 - RNA, 23 nt, Human
ucucaagccagaccaggccucgc

SEQ ID NO: 708238 - RNA, 22 nt, Human
ucugggagaagcugaugugaag

SEQ ID NO: 708239 - RNA, 22 nt, Human
uguuguuuucucauggagaaua

SEQ ID NO: 708240 - RNA, 18 nt, Human
acugucucugagaguggu

SEQ ID NO: 708241 - RNA, 20 nt, Human
acagcagauaccacaacuau

SEQ ID NO: 708242 - RNA, 22 nt, Human
uuugacacugggagugugggug

SEQ ID NO: 708243 - RNA, 21 nt, Human
ggcccugguuacgccuccucu

SEQ ID NO: 708244 - RNA, 22 nt, Human
cuggcagcuggaggcuagaggc

SEQ ID NO: 708245 - RNA, 19 nt, Human
gcagcaguggaaggaaaaa

SEQ ID NO: 708246 - RNA, 22 nt, Human
cccacugagccuauacaaacag

SEQ ID NO: 708247 - RNA, 22 nt, Human
ugcagggaagucccagcuccug

SEQ ID NO: 708248 - RNA, 22 nt, Human
agauaauguucugauccauuuc

SEQ ID NO: 708249 - RNA, 22 nt, Human
aaacauguagugcaugaggauc

SEQ ID NO: 708250 - RNA, 22 nt, Human
gcccugagugccuguguaagaa

SEQ ID NO: 708251 - RNA, 22 nt, Human
agaggccuuucuguugagugaa

SEQ ID NO: 708252 - RNA, 22 nt, Human
ucuuucuggucucgccuuauuc

SEQ ID NO: 708253 - RNA, 22 nt, Human
uuuacacggcauuaucuucaug

SEQ ID NO: 708254 - RNA, 22 nt, Human
uccugagguauaugcuuugcag

SEQ ID NO: 708255 - RNA, 22 nt, Human
ggucccugaagaggccuggggu

SEQ ID NO: 708256 - RNA, 22 nt, Human
uggcagagguauauugggagga

SEQ ID NO: 708257 - RNA, 22 nt, Human
ugcuuccugcuaaggcugccug

SEQ ID NO: 708258 - RNA, 22 nt, Human
acagaaugcagagaugcccaga

SEQ ID NO: 708259 - RNA, 22 nt, Human
acaguuucccccuagggcagca

SEQ ID NO: 708260 - RNA, 22 nt, Human
ucauauagagggcauacaaaug

SEQ ID NO: 708261 - RNA, 23 nt, Human
ccuggcugaccugaagguguagu

SEQ ID NO: 708262 - RNA, 22 nt, Human
uuucgagggccuuaaguauucc

SEQ ID NO: 708263 - RNA, 20 nt, Human
cucugcugcccgccggcugc

SEQ ID NO: 708264 - RNA, 22 nt, Human
uuuggacuuagccugcagaauu

SEQ ID NO: 708265 - RNA, 22 nt, Human
caucacauguaggcagcaucac

SEQ ID NO: 708266 - RNA, 22 nt, Human
ccauuuguauuacugccccagg

SEQ ID NO: 708267 - RNA, 22 nt, Human
cugccgagugggucaugaggca

SEQ ID NO: 708268 - RNA, 22 nt, Human
auuuaauuuggagagagaaacc

SEQ ID NO: 708269 - RNA, 22 nt, Human
aucugcauguaucucucugcau

SEQ ID NO: 708270 - RNA, 22 nt, Human
uuguucuuggagcaggcagaga

SEQ ID NO: 708271 - RNA, 22 nt, Human
uauuaugguuguagguuaacaa

SEQ ID NO: 708272 - RNA, 20 nt, Human
cugcccagccacugagggau

SEQ ID NO: 708273 - RNA, 22 nt, Human
ucacagcuaagcuuggucacug

SEQ ID NO: 708274 - RNA, 22 nt, Human
ucuugccucuuccccuuuccau

SEQ ID NO: 708275 - RNA, 22 nt, Human
acugaaguucauacaacagacu

SEQ ID NO: 708276 - RNA, 22 nt, Human
uuggggaagcuuugaaauacuu

SEQ ID NO: 708277 - RNA, 22 nt, Human
aacaggaauugaugggaguccu

SEQ ID NO: 708278 - RNA, 22 nt, Human
ucuuaaaggcacauagugucua

SEQ ID NO: 708279 - RNA, 22 nt, Human
gauuauauaauggaagcucuug

SEQ ID NO: 708280 - RNA, 22 nt, Human
gcuguacauucugcacaggccc

SEQ ID NO: 708281 - RNA, 22 nt, Human
agucaccagguuuuagagaccu

SEQ ID NO: 708282 - RNA, 22 nt, Human
ucuacuuuucccuauacaguuu

SEQ ID NO: 708283 - RNA, 22 nt, Human
gcucaggacccaggugugaccu

SEQ ID NO: 708284 - RNA, 22 nt, Human
guguggcuugggugaggcgccu

SEQ ID NO: 708285 - RNA, 22 nt, Human
gcugcuguccuucaagucugcg

SEQ ID NO: 708286 - RNA, 22 nt, Human
uauuauuaugcauagcaugaaa

SEQ ID NO: 708287 - RNA, 22 nt, Human
cugucugccaauaaucuauggc

SEQ ID NO: 708288 - RNA, 22 nt, Human
agugcuccacauugcacuauuc

SEQ ID NO: 708289 - RNA, 22 nt, Human
augugaaugcaguuaucuauaa

SEQ ID NO: 708290 - RNA, 21 nt, Human
cagggcaaccaaguccagaga

SEQ ID NO: 708291 - RNA, 22 nt, Human
caaggccacguucugcaugcgg

SEQ ID NO: 708292 - RNA, 22 nt, Human
uugauucuucugaauuugcaga

SEQ ID NO: 708293 - RNA, 22 nt, Human
cggcagcaucgaaacuacauuc

SEQ ID NO: 708294 - RNA, 23 nt, Human
ccguguguauacucuguaauaga

SEQ ID NO: 708295 - RNA, 22 nt, Human
caaagucauggggaugcagguc

SEQ ID NO: 708296 - RNA, 22 nt, Human
cuggugcacguggcugcagucg

SEQ ID NO: 708297 - RNA, 22 nt, Human
ucuaaggagcgcuccagaaaaa

SEQ ID NO: 708298 - RNA, 22 nt, Human
agccuggauccuaggcucagcu

SEQ ID NO: 708299 - RNA, 22 nt, Human
uguggccaccagagcugcuauu

SEQ ID NO: 708300 - RNA, 22 nt, Human
gguaacaguauguagaguaaga

SEQ ID NO: 708301 - RNA, 22 nt, Human
uuagaaaggcuuauggugccuu

SEQ ID NO: 708302 - RNA, 22 nt, Human
acuuuagaaaagcauccauaga

SEQ ID NO: 708303 - RNA, 22 nt, Human
ugcucuggaguggcuugugcac

SEQ ID NO: 708304 - RNA, 22 nt, Human
ggggaagaauggcagaaaacau

SEQ ID NO: 708305 - RNA, 22 nt, Human
ggcagccaggaggguguaguuu

SEQ ID NO: 708306 - RNA, 22 nt, Human
acagauuuuugguaaauaauuu

SEQ ID NO: 708307 - RNA, 22 nt, Human
agguucaaaugcaagagaugcu

SEQ ID NO: 708308 - RNA, 22 nt, Human
aacaauaggcuauaugcuaggc

SEQ ID NO: 708309 - RNA, 22 nt, Human
cagcacccucggaggcugccgu

SEQ ID NO: 708310 - RNA, 22 nt, Human
uggaacaagaagcaggucgcuu

SEQ ID NO: 708311 - RNA, 22 nt, Human
augcaugugugagagcaagagg

SEQ ID NO: 708312 - RNA, 22 nt, Human
acugggcuagaguggaagcugg

SEQ ID NO: 708313 - RNA, 22 nt, Human
gcacuguagugggggagaaaug

SEQ ID NO: 708314 - RNA, 22 nt, Human
gugcccugagcuuaugcauucu

SEQ ID NO: 708315 - RNA, 22 nt, Human
aauguuuaauguuagugguaau

SEQ ID NO: 708316 - RNA, 22 nt, Human
gcaguguuguuaaaagauuaga

SEQ ID NO: 708317 - RNA, 22 nt, Human
agacagcacuuuuguauggggg

SEQ ID NO: 708318 - RNA, 22 nt, Human
acuccagguaggcacauugaca

SEQ ID NO: 708319 - RNA, 21 nt, Human
acagcuggugcagggcgggga

SEQ ID NO: 708320 - RNA, 22 nt, Human
uggcucaguuaggucagaaaca

SEQ ID NO: 708321 - RNA, 20 nt, Human
cucuggcuccgcgugaccgc

SEQ ID NO: 708322 - RNA, 22 nt, Human
ugagccuggggccugggcagcg

SEQ ID NO: 708323 - RNA, 22 nt, Human
ucacugacguggggcuacuuga

SEQ ID NO: 708324 - RNA, 22 nt, Human
ccuucccaggcuagaccaacau

SEQ ID NO: 708325 - RNA, 22 nt, Human
auaaacuggguaucaagaggcc

SEQ ID NO: 708326 - RNA, 22 nt, Human
agagugaaguucaucgugcagc

SEQ ID NO: 708327 - RNA, 23 nt, Human
cugaagagccaacaaaaagcuug

SEQ ID NO: 708328 - RNA, 22 nt, Human
uuuccugugacuaaucuggaca

SEQ ID NO: 708329 - RNA, 22 nt, Human
caguggcaugguugacugcagu

SEQ ID NO: 708330 - RNA, 22 nt, Human
ugacacaggcagcucccagcac

SEQ ID NO: 708331 - RNA, 22 nt, Human
uacagaguuuuccugccaagaa

SEQ ID NO: 708332 - RNA, 22 nt, Human
agucccuguacuuuccacugcc

SEQ ID NO: 708333 - RNA, 20 nt, Human
aggaaagccugugugagucu

SEQ ID NO: 708334 - RNA, 19 nt, Human
acauuuaaauucagaucuc

SEQ ID NO: 708335 - RNA, 22 nt, Human
cugagaggcggagguugcagug

SEQ ID NO: 708336 - RNA, 22 nt, Human
ggcagugggaaauaagugagaa

SEQ ID NO: 708337 - RNA, 22 nt, Human
acccucaggcagaauguauucu

SEQ ID NO: 708338 - RNA, 22 nt, Human
cacccagagggcuugcugaaca

SEQ ID NO: 708339 - RNA, 22 nt, Human
aauucccauuugcagaaaauca

SEQ ID NO: 708340 - RNA, 22 nt, Human
aagcaauaggguaaucuacuca

SEQ ID NO: 708341 - RNA, 22 nt, Human
ucugugugaccauaagccagcu

SEQ ID NO: 708342 - RNA, 22 nt, Human
gagcucugauguuuaguggaga

SEQ ID NO: 708343 - RNA, 22 nt, Human
ugggagagaauaaucaauaggu

SEQ ID NO: 708344 - RNA, 22 nt, Human
cucugaaacuccugcaccuucu

SEQ ID NO: 708345 - RNA, 22 nt, Human
uguuuaaguucugcuccuuauu

SEQ ID NO: 708346 - RNA, 21 nt, Human
acugaacuuguguucuagagg

SEQ ID NO: 708347 - RNA, 22 nt, Human
cagcuggcagcccuggcccugc

SEQ ID NO: 708348 - RNA, 20 nt, Human
acugacagggaacuaaggcu

SEQ ID NO: 708349 - RNA, 22 nt, Human
gcucacuggccugaagaggacg

SEQ ID NO: 708350 - RNA, 22 nt, Human
caggugaccuauggucacuaca

SEQ ID NO: 708351 - RNA, 22 nt, Human
ucuuccaagguugcacacuauc

SEQ ID NO: 708352 - RNA, 22 nt, Human
ugaacuuuuauuugaugacagg

SEQ ID NO: 708353 - RNA, 22 nt, Human
gaugaagcuuugaagucuaauc

SEQ ID NO: 708354 - RNA, 22 nt, Human
cccugggaguccacugauguca

SEQ ID NO: 708355 - RNA, 22 nt, Human
aagagagucagucugagcacca

SEQ ID NO: 708356 - RNA, 22 nt, Human
caccauaaccaacaugucaguu

SEQ ID NO: 708357 - RNA, 22 nt, Human
gccagguguccucacagugagg

SEQ ID NO: 708358 - RNA, 22 nt, Human
gagccagcugagcugcacuguc

SEQ ID NO: 708359 - RNA, 22 nt, Human
uuucuugacugcuuaggaaugc

SEQ ID NO: 708360 - RNA, 21 nt, Human
uggcaggcagcuggaagcuug

SEQ ID NO: 708361 - RNA, 22 nt, Human
agcaggagacauggggguggug

SEQ ID NO: 708362 - RNA, 22 nt, Human
gggaaggcaggauucucuggug

SEQ ID NO: 708363 - RNA, 17 nt, Human
uuccugugguuugaucu

SEQ ID NO: 708364 - RNA, 22 nt, Human
acacaugaccuccgcagcagca

SEQ ID NO: 708365 - RNA, 22 nt, Human
cugccaggcagggagauggcug

SEQ ID NO: 708366 - RNA, 20 nt, Human
ucccagucagccagagugag

SEQ ID NO: 708367 - RNA, 22 nt, Human
ccuugaaauguucucacugggg

SEQ ID NO: 708368 - RNA, 22 nt, Human
guguguuucagaagccaggugu

SEQ ID NO: 708369 - RNA, 22 nt, Human
uguuucuugagaguauuacccu

SEQ ID NO: 708370 - RNA, 22 nt, Human
uauacaggaacuguuggcuccc

SEQ ID NO: 708371 - RNA, 22 nt, Human
cagguuucuaguucuaagaaua

SEQ ID NO: 708372 - RNA, 22 nt, Human
augugugugaugggcgccgcca

SEQ ID NO: 708373 - RNA, 22 nt, Human
aguguuucucagaagggccuau

SEQ ID NO: 708374 - RNA, 22 nt, Human
uccagccaaucagagcugaggc

SEQ ID NO: 708375 - RNA, 22 nt, Human
uguggaaugcuccuaagugaau

SEQ ID NO: 708376 - RNA, 22 nt, Human
ugcuugucacauacaggagcau

SEQ ID NO: 708377 - RNA, 22 nt, Human
ucaacaguugcacuggagaggu

SEQ ID NO: 708378 - RNA, 22 nt, Human
ggucagaaggauucugggaaau

SEQ ID NO: 708379 - RNA, 22 nt, Human
gaugccuccaaaugagggcaga

SEQ ID NO: 708380 - RNA, 22 nt, Human
uuuucuaucuccuagaacugcc

SEQ ID NO: 708381 - RNA, 22 nt, Human
cacugaaggaaggacuacugca

SEQ ID NO: 708382 - RNA, 22 nt, Human
ccuucuccccucugcagggugu

SEQ ID NO: 708383 - RNA, 22 nt, Human
cagcuucuagcaucggcuuuga

SEQ ID NO: 708384 - RNA, 22 nt, Human
aaggcaaauguguucuuuuagu

SEQ ID NO: 708385 - RNA, 22 nt, Human
ugguccuggugcaagugcauuu

SEQ ID NO: 708386 - RNA, 22 nt, Human
cucaccaggaacagcugcggag

SEQ ID NO: 708387 - RNA, 22 nt, Human
auugcuggcagcuggaucugca

SEQ ID NO: 708388 - RNA, 22 nt, Human
uacuauuuuugcaacguauaca

SEQ ID NO: 708389 - RNA, 20 nt, Human
gaaaucaguuaaugaugguu

SEQ ID NO: 708390 - RNA, 22 nt, Human
uucuaaacuucaauucuaaauu

SEQ ID NO: 708391 - RNA, 22 nt, Human
cuccuggacauggagcggagga

SEQ ID NO: 708392 - RNA, 22 nt, Human
cucuggcuuaguaugcuccaaa

SEQ ID NO: 708393 - RNA, 22 nt, Human
ugaggcagauauuuauuggguu

SEQ ID NO: 708394 - RNA, 17 nt, Human
gaacaguguaagacacu

SEQ ID NO: 708395 - RNA, 22 nt, Human
acagcagcuugucuguucuuua

SEQ ID NO: 708396 - RNA, 22 nt, Human
gaaauacaaagccagccauuuu

SEQ ID NO: 708397 - RNA, 21 nt, Human
gagacagacuuucguccccug

SEQ ID NO: 708398 - RNA, 22 nt, Human
auccaucuugauguaauagcca

SEQ ID NO: 708399 - RNA, 22 nt, Human
aaauaguccugggaauaguacu

SEQ ID NO: 708400 - RNA, 22 nt, Human
agcugugguucugggcagcgac

SEQ ID NO: 708401 - RNA, 22 nt, Human
ccucagucuugaauuagccaga

SEQ ID NO: 708402 - RNA, 22 nt, Human
uccuuaauucugugcaauaugu

SEQ ID NO: 708403 - RNA, 22 nt, Human
aguguuuauggaacccuggugg

SEQ ID NO: 708404 - RNA, 22 nt, Human
guguaaacaacagugguuugaa

SEQ ID NO: 708405 - RNA, 22 nt, Human
uccucucagugugguuguggga

SEQ ID NO: 708406 - RNA, 20 nt, Human
cacucuaaccauauuuccuc

SEQ ID NO: 708407 - RNA, 22 nt, Human
augcugaagagugcacaggcua

SEQ ID NO: 708408 - RNA, 22 nt, Human
acuguauacuucuguauacaau

SEQ ID NO: 708409 - RNA, 22 nt, Human
aaauauacggucccuaacaguc

SEQ ID NO: 708410 - RNA, 20 nt, Human
ucucugagcuucucuugggg

SEQ ID NO: 708411 - RNA, 22 nt, Human
ccacagaaccucagcuuugagc

SEQ ID NO: 708412 - RNA, 22 nt, Human
cuggggaccagugucuguuugu

SEQ ID NO: 708413 - RNA, 22 nt, Human
auccacuugccacuguauaguu

SEQ ID NO: 708414 - RNA, 22 nt, Human
gggggugaggacaggagcacug

SEQ ID NO: 708415 - RNA, 22 nt, Human
uggcuggaguauaggaguagga

SEQ ID NO: 708416 - RNA, 23 nt, Human
gugugccaagcacugugccagga

SEQ ID NO: 708417 - RNA, 22 nt, Human
caggagaccugguaagccaagu

SEQ ID NO: 708418 - RNA, 22 nt, Human
gagacaggauuuaaccaaagcu

SEQ ID NO: 708419 - RNA, 22 nt, Human
uuuauugacuucagugagucuu

SEQ ID NO: 708420 - RNA, 22 nt, Human
uauccuguuuugcacaauuaua

SEQ ID NO: 708421 - RNA, 22 nt, Human
guacagcauuugaaauuacugg

SEQ ID NO: 708422 - RNA, 22 nt, Human
ccugucucuuucaaucugagag

SEQ ID NO: 708423 - RNA, 22 nt, Human
aagugguaggaagagagcacug

SEQ ID NO: 708424 - RNA, 23 nt, Human
uggggcugauggagacggaccag

SEQ ID NO: 708425 - RNA, 22 nt, Human
aggcccuggcccccagagauuc

SEQ ID NO: 708426 - RNA, 20 nt, Human
guauauaaccauagugacua

SEQ ID NO: 708427 - RNA, 22 nt, Human
ggucugagugccagggagagaa

SEQ ID NO: 708428 - RNA, 22 nt, Human
agcuaagacuuagugacuuagu

SEQ ID NO: 708429 - RNA, 17 nt, Human
gauuuccugaaguucuu

SEQ ID NO: 708430 - RNA, 22 nt, Human
caaacauugggggcuucaacac

SEQ ID NO: 708431 - RNA, 22 nt, Human
guuaacuuucaggugcauguuu

SEQ ID NO: 708432 - RNA, 22 nt, Human
cucaggauagcugcgcagccug

SEQ ID NO: 708433 - RNA, 22 nt, Human
acaguuauuuucccagcauuua

SEQ ID NO: 708434 - RNA, 22 nt, Human
gggcuggagccagcuguggcug

SEQ ID NO: 708435 - RNA, 22 nt, Human
ggaugcuggggaccaaucucug

SEQ ID NO: 708436 - RNA, 22 nt, Human
agucagagucuauugcuguggu

SEQ ID NO: 708437 - RNA, 22 nt, Human
ucaucucaaaacccaaggggca

SEQ ID NO: 708438 - RNA, 22 nt, Human
ucuucaaauccuacagugucug

SEQ ID NO: 708439 - RNA, 22 nt, Human
auuuuuuguuaacucaggauag

SEQ ID NO: 708440 - RNA, 22 nt, Human
gcccucucuucugcagccucca

SEQ ID NO: 708441 - RNA, 22 nt, Human
guaauagucucaaacuccugga

SEQ ID NO: 708442 - RNA, 22 nt, Human
ucuuugugccaugcagugaggc

SEQ ID NO: 708443 - RNA, 22 nt, Human
cucagcaagacccccaccgugu

SEQ ID NO: 708444 - RNA, 22 nt, Human
gucuggagacuugggucaucaa

SEQ ID NO: 708445 - RNA, 22 nt, Human
accaugaugggaagcucagggc

SEQ ID NO: 708446 - RNA, 22 nt, Human
agucugcuuuugugaagagcug

SEQ ID NO: 708447 - RNA, 22 nt, Human
cagccacuugugaugcugggga

SEQ ID NO: 708448 - RNA, 22 nt, Human
aaguagcauuccaugguauaga

SEQ ID NO: 708449 - RNA, 22 nt, Human
cacacauggucaguggcuacuc

SEQ ID NO: 708450 - RNA, 22 nt, Human
cggggcuuggaccagccacccc

SEQ ID NO: 708451 - RNA, 22 nt, Human
gcagugcugaucccauggcaga

SEQ ID NO: 708452 - RNA, 21 nt, Human
uccaaaucccauucuguaguc

SEQ ID NO: 708453 - RNA, 22 nt, Human
gagguggugguggaggcauagc

SEQ ID NO: 708454 - RNA, 22 nt, Human
uucuaacucuacacuagcuuug

SEQ ID NO: 708455 - RNA, 22 nt, Human
guuucuuaccacuuggaccucu

SEQ ID NO: 708456 - RNA, 22 nt, Human
gccaggcugguuauuuaaugag

SEQ ID NO: 708457 - RNA, 22 nt, Human
agauaaaguccaaacuguguag

SEQ ID NO: 708458 - RNA, 22 nt, Human
ugcucccagcuguaggaauguu

SEQ ID NO: 708459 - RNA, 22 nt, Human
gcccaagccgccuuccagagac

SEQ ID NO: 708460 - RNA, 22 nt, Human
cagcaagaaaauucacaugcuc

SEQ ID NO: 708461 - RNA, 22 nt, Human
gaugggaggaaccugggucccu

SEQ ID NO: 708462 - RNA, 22 nt, Human
uuguguguguaacuuuaugaga

SEQ ID NO: 708463 - RNA, 22 nt, Human
cagagcaguccuugucaaucag

SEQ ID NO: 708464 - RNA, 22 nt, Human
uaguuuagaauguugcaauaca

SEQ ID NO: 708465 - RNA, 18 nt, Human
aaagaaggauuggagagc

SEQ ID NO: 708466 - RNA, 22 nt, Human
gaugagaaggcucagauccaaa

SEQ ID NO: 708467 - RNA, 22 nt, Human
uuagcuguggaagcuucagcca

SEQ ID NO: 708468 - RNA, 22 nt, Human
ggaggacacuggcucugccuuc

SEQ ID NO: 708469 - RNA, 22 nt, Human
ugaauacuauuucauaaugugg

SEQ ID NO: 708470 - RNA, 22 nt, Human
gagagguacacccuuuaaacuu

SEQ ID NO: 708471 - RNA, 22 nt, Human
uagcauuaucugucuuaucauu

SEQ ID NO: 708472 - RNA, 22 nt, Human
uuugcuugauuaggauauggaa

SEQ ID NO: 708473 - RNA, 22 nt, Human
aauuuguuagcauacucuaguu

SEQ ID NO: 708474 - RNA, 22 nt, Human
gcagggguggaggcuguccugu

SEQ ID NO: 708475 - RNA, 22 nt, Human
gcacccagcccagggcgugaug

SEQ ID NO: 708476 - RNA, 22 nt, Human
uugggccaaauagcuauuuacu

SEQ ID NO: 708477 - RNA, 22 nt, Human
aggaguguugaguuggguuuug

SEQ ID NO: 708478 - RNA, 16 nt, Human
ugugcauguucugugu

SEQ ID NO: 708479 - RNA, 22 nt, Human
gacaauacagaaagggacaugc

SEQ ID NO: 708480 - RNA, 22 nt, Human
cuggcuggucaucagcaguacg

SEQ ID NO: 708481 - RNA, 22 nt, Human
ucagggaaaggggagagucauu

SEQ ID NO: 708482 - RNA, 22 nt, Human
ccagcccugucaccaacuggag

SEQ ID NO: 708483 - RNA, 22 nt, Human
agugaaaacacuaguucuugcc

SEQ ID NO: 708484 - RNA, 22 nt, Human
acaagaauaaggauaagagauu

SEQ ID NO: 708485 - RNA, 22 nt, Human
ugcagugccucggcagugcagc

SEQ ID NO: 708486 - RNA, 22 nt, Human
acugacauuuuucccuaagcau

SEQ ID NO: 708487 - RNA, 18 nt, Human
ccagggagcuuauuagga

SEQ ID NO: 708488 - RNA, 22 nt, Human
cccaggaggcgcagguugcggu

SEQ ID NO: 708489 - RNA, 22 nt, Human
agcagcuccucuaggaacggau

SEQ ID NO: 708490 - RNA, 22 nt, Human
augcaugagucacucagugcag

SEQ ID NO: 708491 - RNA, 22 nt, Human
agauccaucaucauauuuucua

SEQ ID NO: 708492 - RNA, 22 nt, Human
uaugacauuuucccagauuuau

SEQ ID NO: 708493 - RNA, 22 nt, Human
ucagaagccaccuuuuguuggg

SEQ ID NO: 708494 - RNA, 22 nt, Human
agcauucuguggucuucuaugg

SEQ ID NO: 708495 - RNA, 22 nt, Human
cccugagcauucaugugagcuu

SEQ ID NO: 708496 - RNA, 22 nt, Human
uuuugcuuuaagauggagagga

SEQ ID NO: 708497 - RNA, 22 nt, Human
gcugcccacagcggguguuucg

SEQ ID NO: 708498 - RNA, 22 nt, Human
cagaggcagccgggggagaacg

SEQ ID NO: 708499 - RNA, 22 nt, Human
gcuucuggaagcugcuucugcc

SEQ ID NO: 708500 - RNA, 23 nt, Human
gaggugugaauucugggugcugc

SEQ ID NO: 708501 - RNA, 22 nt, Human
uacacugaauacuaguuuuccu

SEQ ID NO: 708502 - RNA, 23 nt, Human
cuacagguuaauuuucaguggaa

SEQ ID NO: 708503 - RNA, 22 nt, Human
augaugguggguaauguguaaa

SEQ ID NO: 708504 - RNA, 22 nt, Human
uucucuuuuugcaucucaaccu

SEQ ID NO: 708505 - RNA, 22 nt, Human
aagcauuuuugaaaugguagga

SEQ ID NO: 708506 - RNA, 22 nt, Human
ucccuccuuaauaagaggucug

SEQ ID NO: 708507 - RNA, 22 nt, Human
aguagcauaaauagugguagua

SEQ ID NO: 708508 - RNA, 22 nt, Human
ugaguucagauccuggcucugc

SEQ ID NO: 708509 - RNA, 22 nt, Human
uaggaacuaguagauguguaaa

SEQ ID NO: 708510 - RNA, 22 nt, Human
uugagaaaacacagaguuuauu

SEQ ID NO: 708511 - RNA, 22 nt, Human
gcagagcaguacucucuugacu

SEQ ID NO: 708512 - RNA, 22 nt, Human
cagaggucugacacugaauggu

SEQ ID NO: 708513 - RNA, 22 nt, Human
uagagaggccgcggguccccuc

SEQ ID NO: 708514 - RNA, 18 nt, Human
agguuugguggaaacaua

SEQ ID NO: 708515 - RNA, 22 nt, Human
agccuccuguagcccucaccca

SEQ ID NO: 708516 - RNA, 22 nt, Human
ugggggugaaagucuggacagu

SEQ ID NO: 708517 - RNA, 22 nt, Human
auggccuggccagagcucugcu

SEQ ID NO: 708518 - RNA, 22 nt, Human
auugaaagauuuugggcucaug

SEQ ID NO: 708519 - RNA, 22 nt, Human
gccuggucucuuucaugucagu

SEQ ID NO: 708520 - RNA, 22 nt, Human
aagacauuuaugaaaagugcug

SEQ ID NO: 708521 - RNA, 22 nt, Human
gagaaaaucuugggucaagaau

SEQ ID NO: 708522 - RNA, 22 nt, Human
gggcugcugcugccagcgacac

SEQ ID NO: 708523 - RNA, 22 nt, Human
acagauguuacaguaugaucuc

SEQ ID NO: 708524 - RNA, 20 nt, Human
cugcuuccaggcucaccccc

SEQ ID NO: 708525 - RNA, 22 nt, Human
auuauuaaagcuuaggucuuau

SEQ ID NO: 708526 - RNA, 22 nt, Human
uuacauguacugguuugacuua

SEQ ID NO: 708527 - RNA, 22 nt, Human
uugugggauggcucuucccaaa

SEQ ID NO: 708528 - RNA, 22 nt, Human
cuugacuucuucuagaaauaag

SEQ ID NO: 708529 - RNA, 22 nt, Human
uagcagaggcaaggaugugaau

SEQ ID NO: 708530 - RNA, 22 nt, Human
uuauugugucuugguuuaucuu

SEQ ID NO: 708531 - RNA, 22 nt, Human
uaggguccucaucuguaaauga

SEQ ID NO: 708532 - RNA, 18 nt, Human
uuuuaauuucaggggugg

SEQ ID NO: 708533 - RNA, 22 nt, Human
caggguugauuccuucugaggg

SEQ ID NO: 708534 - RNA, 22 nt, Human
agagaucuagcaccugcugguc

SEQ ID NO: 708535 - RNA, 22 nt, Human
ucagccuccuaauuuccuguga

SEQ ID NO: 708536 - RNA, 22 nt, Human
uucuucagcccauaucuuccag

SEQ ID NO: 708537 - RNA, 22 nt, Human
aaacagcuuguuucaggaaagu

SEQ ID NO: 708538 - RNA, 22 nt, Human
aaucauccugaagucaauaaag

SEQ ID NO: 708539 - RNA, 22 nt, Human
gggcuuggaguaggcugaugaa

SEQ ID NO: 708540 - RNA, 22 nt, Human
ugagccuggguggucgaggcug

SEQ ID NO: 708541 - RNA, 22 nt, Human
cuggcugcuuguuuugaugggu

SEQ ID NO: 708542 - RNA, 22 nt, Human
gacacagaauuccccuccaagu

SEQ ID NO: 708543 - RNA, 22 nt, Human
uaauauacuucccauaguuuga

SEQ ID NO: 708544 - RNA, 22 nt, Human
agggagcucugggggcacacgg

SEQ ID NO: 708545 - RNA, 23 nt, Human
ccaagcuucuaaugcugcugagc

SEQ ID NO: 708546 - RNA, 22 nt, Human
cacugguagagagaagacaagg

SEQ ID NO: 708547 - RNA, 22 nt, Human
cuacuucugugaugaaacuaca

SEQ ID NO: 708548 - RNA, 22 nt, Human
uggggcuaacgagagagcagag

SEQ ID NO: 708549 - RNA, 22 nt, Human
gcuaggucugugcgcagccgcu

SEQ ID NO: 708550 - RNA, 22 nt, Human
ccaggcauccauugcuuccucu

SEQ ID NO: 708551 - RNA, 22 nt, Human
uacagccucaucacgggagcug

SEQ ID NO: 708552 - RNA, 22 nt, Human
ucaugugacaggcacuguucug

SEQ ID NO: 708553 - RNA, 22 nt, Human
cacuguacagcauuaacaaggc

SEQ ID NO: 708554 - RNA, 22 nt, Human
aggucaagggagcugagggcca

SEQ ID NO: 708555 - RNA, 22 nt, Human
aacagccucagugagauuagga

SEQ ID NO: 708556 - RNA, 22 nt, Human
accuuaaaugugacauagucua

SEQ ID NO: 708557 - RNA, 20 nt, Human
ugugcccaauguccagguuc

SEQ ID NO: 708558 - RNA, 21 nt, Human
acauuauaauucauauuccac

SEQ ID NO: 708559 - RNA, 22 nt, Human
ucagagaaguaggcuaauggug

SEQ ID NO: 708560 - RNA, 22 nt, Human
ucucagaagugaucaggauguu

SEQ ID NO: 708561 - RNA, 22 nt, Human
uggagaugaacauggugauguu

SEQ ID NO: 708562 - RNA, 22 nt, Human
ggaggccaaggcgggcggauca

SEQ ID NO: 708563 - RNA, 22 nt, Human
gcuguacaggguuauccuuucc

SEQ ID NO: 708564 - RNA, 22 nt, Human
cugaggccucucuccuuggcuu

SEQ ID NO: 708565 - RNA, 22 nt, Human
augcuaaggcccaggagaaaau

SEQ ID NO: 708566 - RNA, 22 nt, Human
cccagcucucucaguucugcuu

SEQ ID NO: 708567 - RNA, 22 nt, Human
augaacucuucugguuauuuuu

SEQ ID NO: 708568 - RNA, 22 nt, Human
uccugggaguggccauguaaug

SEQ ID NO: 708569 - RNA, 22 nt, Human
gaauccaggguuguuugagcua

SEQ ID NO: 708570 - RNA, 22 nt, Human
ugccccugaccucaggcgaagg

SEQ ID NO: 708571 - RNA, 22 nt, Human
gagaccuggaggauguggaugg

SEQ ID NO: 708572 - RNA, 22 nt, Human
ugaagccagucaauguuaaguu

SEQ ID NO: 708573 - RNA, 22 nt, Human
cagaccuggaaaacaggcuugc

SEQ ID NO: 708574 - RNA, 22 nt, Human
acacacaugccuuuccuaagua

SEQ ID NO: 708575 - RNA, 23 nt, Human
uguguguguauucuacgcaaggu

SEQ ID NO: 708576 - RNA, 18 nt, Human
ucucuuuccucaguggag

SEQ ID NO: 708577 - RNA, 22 nt, Human
ucagaauuaagcucuuggucag

SEQ ID NO: 708578 - RNA, 22 nt, Human
cagaaacagacaugacgcagua

SEQ ID NO: 708579 - RNA, 22 nt, Human
aggacagcauaugggaaccagu

SEQ ID NO: 708580 - RNA, 22 nt, Human
uggaaauggaucugaugagucu

SEQ ID NO: 708581 - RNA, 22 nt, Human
guuaacuuccccaugucugcau

SEQ ID NO: 708582 - RNA, 22 nt, Human
ugagaggugaggcaugaggcau

SEQ ID NO: 708583 - RNA, 22 nt, Human
ugacaggaguggcuagugggag

SEQ ID NO: 708584 - RNA, 22 nt, Human
acuuugcagguacaugagcauc

SEQ ID NO: 708585 - RNA, 22 nt, Human
ugagugccugaacauagaguag

SEQ ID NO: 708586 - RNA, 22 nt, Human
uuugcaaauacagaggucuugc

SEQ ID NO: 708587 - RNA, 22 nt, Human
augcuguguauuuuacucuuuc

SEQ ID NO: 708588 - RNA, 22 nt, Human
auucugagcuacuaauuaggca

SEQ ID NO: 708589 - RNA, 22 nt, Human
ugaagacuuugcucuuaaccac

SEQ ID NO: 708590 - RNA, 22 nt, Human
agggcagcaaugcagcugcugc

SEQ ID NO: 708591 - RNA, 19 nt, Human
accaggcuuauggucagug

SEQ ID NO: 708592 - RNA, 23 nt, Human
ugaaucaauuaugggauucaaug

SEQ ID NO: 708593 - RNA, 22 nt, Human
aaguguuaaagacuugaacacu

SEQ ID NO: 708594 - RNA, 22 nt, Human
cagcugaaagaaggaaguguca

SEQ ID NO: 708595 - RNA, 18 nt, Human
cagcaucuucauuaggcc

SEQ ID NO: 708596 - RNA, 20 nt, Human
aggagaccaagccaagugga

SEQ ID NO: 708597 - RNA, 20 nt, Human
uaucuaaaugcuuacauuac

SEQ ID NO: 708598 - RNA, 22 nt, Human
uguuaauggcugaagacauccu

SEQ ID NO: 708599 - RNA, 22 nt, Human
cucuuuuucagccuuaccaaag

SEQ ID NO: 708600 - RNA, 18 nt, Human
agacccucuaagggcagu

SEQ ID NO: 708601 - RNA, 22 nt, Human
uccuggcaggucugagaggucu

SEQ ID NO: 708602 - RNA, 22 nt, Human
uacaaaucagaucaugaguuua

SEQ ID NO: 708603 - RNA, 22 nt, Human
ugucccaguucccaggguugcu

SEQ ID NO: 708604 - RNA, 22 nt, Human
ggucacauauccucgguuugga

SEQ ID NO: 708605 - RNA, 22 nt, Human
gcagacugcgagcgugcuggug

SEQ ID NO: 708606 - RNA, 22 nt, Human
ugcagaguaaaagcagaugcua

SEQ ID NO: 708607 - RNA, 22 nt, Human
ccagucuguucucaccucugag

SEQ ID NO: 708608 - RNA, 22 nt, Human
ccaggcagggcucaaggaaccu

SEQ ID NO: 708609 - RNA, 23 nt, Human
uucaaaacuggaaaaucagaugc

SEQ ID NO: 708610 - RNA, 22 nt, Human
cagggcagagggaaacuccuuu

SEQ ID NO: 708611 - RNA, 22 nt, Human
ugaaugcaagaaggaacaugaa

SEQ ID NO: 708612 - RNA, 22 nt, Human
auucacagggggagaaggguau

SEQ ID NO: 708613 - RNA, 18 nt, Human
ucugucuguguugucuuu

SEQ ID NO: 708614 - RNA, 20 nt, Human
gaugagacccaugcaugaga

SEQ ID NO: 708615 - RNA, 17 nt, Human
uucugugcuuccuggcu

SEQ ID NO: 708616 - RNA, 22 nt, Human
uuuccucacacagaagaucuug

SEQ ID NO: 708617 - RNA, 22 nt, Human
ugagcagagcaguaacaggagc

SEQ ID NO: 708618 - RNA, 22 nt, Human
uucacaguuuaauggcaaggau

SEQ ID NO: 708619 - RNA, 22 nt, Human
aggaaagacuggggccccagaa

SEQ ID NO: 708620 - RNA, 22 nt, Human
caugccaguuuugagaugcacc

SEQ ID NO: 708621 - RNA, 22 nt, Human
guagaauaaauguacacaucug

SEQ ID NO: 708622 - RNA, 22 nt, Human
acaugccuccauugagcugugg

SEQ ID NO: 708623 - RNA, 19 nt, Human
uguuucuuccuccaucuga

SEQ ID NO: 708624 - RNA, 22 nt, Human
gcucagaaauggcagauggaga

SEQ ID NO: 708625 - RNA, 22 nt, Human
cuugaucuacauagugaaaccc

SEQ ID NO: 708626 - RNA, 22 nt, Human
gggaccugccauugcucacagg

SEQ ID NO: 708627 - RNA, 22 nt, Human
augcuuaauacacuguuaaagg

SEQ ID NO: 708628 - RNA, 22 nt, Human
caggaaauguauaauuuuauaa

SEQ ID NO: 708629 - RNA, 22 nt, Human
agaaucagugagcaguugugau

SEQ ID NO: 708630 - RNA, 22 nt, Human
agcccagggaaccaggaagugg

SEQ ID NO: 708631 - RNA, 22 nt, Human
uucacacucucacucccugacc

SEQ ID NO: 708632 - RNA, 22 nt, Human
ucugggaaccagugcggcuggg

SEQ ID NO: 708633 - RNA, 22 nt, Human
guuaacauuucuaggugcaggg

SEQ ID NO: 708634 - RNA, 22 nt, Human
ccaucuguaucugacaaauucu

SEQ ID NO: 708635 - RNA, 22 nt, Human
guuuggcaguuuuagagugcaa

SEQ ID NO: 708636 - RNA, 22 nt, Human
uccuacaucagcucucaguagc

SEQ ID NO: 708637 - RNA, 22 nt, Human
uaguuaggguucugcagagaca

SEQ ID NO: 708638 - RNA, 22 nt, Human
acaauucuggguauuuauauag

SEQ ID NO: 708639 - RNA, 21 nt, Human
uagcaggagcgaauuuugaug

SEQ ID NO: 708640 - RNA, 22 nt, Human
cucuuaaugaccuuaauucaag

SEQ ID NO: 708641 - RNA, 22 nt, Human
caaguuuaaggcacugauaagu

SEQ ID NO: 708642 - RNA, 22 nt, Human
cuuuggaggaaaauugagguca

SEQ ID NO: 708643 - RNA, 22 nt, Human
gcaugcaggauagguugagcuc

SEQ ID NO: 708644 - RNA, 22 nt, Human
cuccagccagagugccucuguu

SEQ ID NO: 708645 - RNA, 22 nt, Human
agcuuuauagaaaggaucagug

SEQ ID NO: 708646 - RNA, 22 nt, Human
auuuauucuccagauggcgaga

SEQ ID NO: 708647 - RNA, 22 nt, Human
gugggagaagauuuggucaucu

SEQ ID NO: 708648 - RNA, 22 nt, Human
ggcagacuuuuucucugaaggg

SEQ ID NO: 708649 - RNA, 22 nt, Human
ugggcaugaguggacagagaag

SEQ ID NO: 708650 - RNA, 22 nt, Human
aggaaagcaauggcugagaaca

SEQ ID NO: 708651 - RNA, 22 nt, Human
uggccaccuuauggcuauugga

SEQ ID NO: 708652 - RNA, 22 nt, Human
uaacagucaugugcuacugcua

SEQ ID NO: 708653 - RNA, 22 nt, Human
gacagcuguggagaggcaugug

SEQ ID NO: 708654 - RNA, 22 nt, Human
cucagccaggagaguguucaca

SEQ ID NO: 708655 - RNA, 22 nt, Human
gaccacagauuccuaaguggca

SEQ ID NO: 708656 - RNA, 22 nt, Human
augaacaauaaucaugucuaug

SEQ ID NO: 708657 - RNA, 22 nt, Human
uuccugggcucuggcuggccua

SEQ ID NO: 708658 - RNA, 22 nt, Human
ucccagggucaguggugaggcc

SEQ ID NO: 708659 - RNA, 22 nt, Human
uuccauaauaaccugagagaaa

SEQ ID NO: 708660 - RNA, 21 nt, Human
ucagaggcacugagagcaaug

SEQ ID NO: 708661 - RNA, 22 nt, Human
agccuggcuuaauccuccuuuu

SEQ ID NO: 708662 - RNA, 22 nt, Human
ucucccaacauguggaggucag

SEQ ID NO: 708663 - RNA, 22 nt, Human
agcccagcuuccuucugucucu

SEQ ID NO: 708664 - RNA, 22 nt, Human
auucacaacaaaaggauaugag

SEQ ID NO: 708665 - RNA, 22 nt, Human
ugcugaaagaccguauuuaucu

SEQ ID NO: 708666 - RNA, 22 nt, Human
cugccaggacugacgucuucag

SEQ ID NO: 708667 - RNA, 22 nt, Human
aagggcucccaacucaucuuuu

SEQ ID NO: 708668 - RNA, 22 nt, Human
cagaugcuuggaggacacuugg

SEQ ID NO: 708669 - RNA, 22 nt, Human
augcaugcuucuuauaguacuu

SEQ ID NO: 708670 - RNA, 22 nt, Human
aucucugguccaaauguuaccu

SEQ ID NO: 708671 - RNA, 20 nt, Human
uugcacagagaaggaggcag

SEQ ID NO: 708672 - RNA, 22 nt, Human
uccccagggucccugcuuccau

SEQ ID NO: 708673 - RNA, 22 nt, Human
uuggaagcaguguacacuguac

SEQ ID NO: 708674 - RNA, 22 nt, Human
aagcaucuguaaagacccuuau

SEQ ID NO: 708675 - RNA, 22 nt, Human
uccugcagucugcacucugccu

SEQ ID NO: 708676 - RNA, 22 nt, Human
agugauauuagcaaaugguuau

SEQ ID NO: 708677 - RNA, 22 nt, Human
agaugguucagaauuauaaaga

SEQ ID NO: 708678 - RNA, 22 nt, Human
cuuuggcugcauucgaguugcu

SEQ ID NO: 708679 - RNA, 22 nt, Human
ucugagccaaaauaaacagcau

SEQ ID NO: 708680 - RNA, 22 nt, Human
agugcauucuccaucaucuagg

SEQ ID NO: 708681 - RNA, 20 nt, Human
gauuucaaagcagaguggcc

SEQ ID NO: 708682 - RNA, 22 nt, Human
gcacggcuaauuuuuguauuuu

SEQ ID NO: 708683 - RNA, 22 nt, Human
cuccucacacccacugcaacca

SEQ ID NO: 708684 - RNA, 22 nt, Human
aggccagcuguuacuagagcca

SEQ ID NO: 708685 - RNA, 22 nt, Human
aacaguguuuuucuucagcacu

SEQ ID NO: 708686 - RNA, 22 nt, Human
aggagaggaaucauuauuacaa

SEQ ID NO: 708687 - RNA, 22 nt, Human
cugccuuggaaaaugugguaau

SEQ ID NO: 708688 - RNA, 22 nt, Human
uagcaaguguuggugaagaugu

SEQ ID NO: 708689 - RNA, 22 nt, Human
uuuacagcuucuauacuaugug

SEQ ID NO: 708690 - RNA, 22 nt, Human
cugcagcuuuuugugcuuguaa

SEQ ID NO: 708691 - RNA, 22 nt, Human
uuaaaggaauugaguuucuugu

SEQ ID NO: 708692 - RNA, 22 nt, Human
acagcucugguccuuuagagag

SEQ ID NO: 708693 - RNA, 20 nt, Human
gauucugggcagucaguguc

SEQ ID NO: 708694 - RNA, 22 nt, Human
gauguccugcagaaacaugaga

SEQ ID NO: 708695 - RNA, 22 nt, Human
gcagagaagaugcccaggcuuc

SEQ ID NO: 708696 - RNA, 20 nt, Human
uggcuucauaaugguuucug

SEQ ID NO: 708697 - RNA, 22 nt, Human
uuagccauguugaagauuuaga

SEQ ID NO: 708698 - RNA, 22 nt, Human
uuaaagccugacuguggacuac

SEQ ID NO: 708699 - RNA, 22 nt, Human
cagcucugaagaaaggugucua

SEQ ID NO: 708700 - RNA, 22 nt, Human
caguuucuauggcugggcucug

SEQ ID NO: 708701 - RNA, 21 nt, Human
cucuugcugaugucuccuuua

SEQ ID NO: 708702 - RNA, 22 nt, Human
acagauauuuaagagcuuuugu

SEQ ID NO: 708703 - RNA, 22 nt, Human
uaaugagacucaauugugugug

SEQ ID NO: 708704 - RNA, 22 nt, Human
ucugggcuuggauuggcucugc

SEQ ID NO: 708705 - RNA, 22 nt, Human
agaacaaugcguauuuuacucc

SEQ ID NO: 708706 - RNA, 22 nt, Human
uucacaaaaaugcugaacaguu

SEQ ID NO: 708707 - RNA, 22 nt, Human
ucacaugucaagaagauaauuu

SEQ ID NO: 708708 - RNA, 22 nt, Human
gaugucuuaagcccagaaguuc

SEQ ID NO: 708709 - RNA, 22 nt, Human
ugggccagcacugggugcucau

SEQ ID NO: 708710 - RNA, 23 nt, Human
ccuggaguacuaaggggauggaa

SEQ ID NO: 708711 - RNA, 20 nt, Human
ucugugcauugccugcuggu

SEQ ID NO: 708712 - RNA, 22 nt, Human
ccaguggaguuuuuauacccag

SEQ ID NO: 708713 - RNA, 20 nt, Human
ggcagcaauucacccuaucc

SEQ ID NO: 708714 - RNA, 22 nt, Human
uguuucuucucacacaaacuca

SEQ ID NO: 708715 - RNA, 22 nt, Human
ugugaggauggaguucuacagg

SEQ ID NO: 708716 - RNA, 22 nt, Human
gggagcugagggaccucugugg

SEQ ID NO: 708717 - RNA, 22 nt, Human
cuguggcugucucuuucccaug

SEQ ID NO: 708718 - RNA, 22 nt, Human
gaucauuugacuuuauaaggcu

SEQ ID NO: 708719 - RNA, 22 nt, Human
gcaggccauucaggagaugugc

SEQ ID NO: 708720 - RNA, 22 nt, Human
agugcuggaaagggacggagga

SEQ ID NO: 708721 - RNA, 22 nt, Human
cuuaagauugucagcuucagcc

SEQ ID NO: 708722 - RNA, 19 nt, Human
uauauuugagugugcaugc

SEQ ID NO: 708723 - RNA, 22 nt, Human
gaagaagguggcccagggguag

SEQ ID NO: 708724 - RNA, 22 nt, Human
aaaugacagagcugggacuagu

SEQ ID NO: 708725 - RNA, 22 nt, Human
uaauuauagcauuggaguggcc

SEQ ID NO: 708726 - RNA, 22 nt, Human
auguguguacacacgugacucu

SEQ ID NO: 708727 - RNA, 22 nt, Human
ccucucugucacaccaguggcc

SEQ ID NO: 708728 - RNA, 22 nt, Human
agaaaugaagcaggaguuauua

SEQ ID NO: 708729 - RNA, 22 nt, Human
aaauucucuucagaggaaccag

SEQ ID NO: 708730 - RNA, 22 nt, Human
cagugcaugaaacaauaugcag

SEQ ID NO: 708731 - RNA, 22 nt, Human
ugugaaaugcuauugugacaaa

SEQ ID NO: 708732 - RNA, 22 nt, Human
agucagagaauguuuucaugga

SEQ ID NO: 708733 - RNA, 22 nt, Human
augcugagauaaggcuuuaguc

SEQ ID NO: 708734 - RNA, 22 nt, Human
uguaaacugcuucucaccaagg

SEQ ID NO: 708735 - RNA, 22 nt, Human
guuccugaaagaugaguaauua

SEQ ID NO: 708736 - RNA, 22 nt, Human
gugaggggccaagaguagggca

SEQ ID NO: 708737 - RNA, 22 nt, Human
gagcugccuacauugccaagag

SEQ ID NO: 708738 - RNA, 22 nt, Human
aagauguuagaggucaugcaga

SEQ ID NO: 708739 - RNA, 22 nt, Human
uuguuaaaauuggagccgagag

SEQ ID NO: 708740 - RNA, 22 nt, Human
gauacuuucucauuuacccaag

SEQ ID NO: 708741 - RNA, 22 nt, Human
cacagagaggcuugucuccaag

SEQ ID NO: 708742 - RNA, 22 nt, Human
cagaggacaauagaauggaaag

SEQ ID NO: 708743 - RNA, 21 nt, Human
ggaacuuucaugaaucuagca

SEQ ID NO: 708744 - RNA, 22 nt, Human
guccugggagaugggacccuga

SEQ ID NO: 708745 - RNA, 22 nt, Human
guuauguacuuuuuaaaucuug

SEQ ID NO: 708746 - RNA, 18 nt, Human
caauguuuuagaucucua

SEQ ID NO: 708747 - RNA, 23 nt, Human
aacucuggcuagcauagaauaga

SEQ ID NO: 708748 - RNA, 17 nt, Human
gaauaaguggauggcac

SEQ ID NO: 708749 - RNA, 22 nt, Human
ccagguguaggacaccaaggga

SEQ ID NO: 708750 - RNA, 22 nt, Human
agcuccaggcagcauuaauaaa

SEQ ID NO: 708751 - RNA, 22 nt, Human
aaggcuccagugaaugcuggca

SEQ ID NO: 708752 - RNA, 22 nt, Human
ugugaaaugaagauaauucuug

SEQ ID NO: 708753 - RNA, 22 nt, Human
gugcugugugauccaugcuggc

SEQ ID NO: 708754 - RNA, 22 nt, Human
ggggcagggagguuaucgccga

SEQ ID NO: 708755 - RNA, 22 nt, Human
uggccaugaaggaggcagcaga

SEQ ID NO: 708756 - RNA, 22 nt, Human
ugggcaccugaggccuggcagg

SEQ ID NO: 708757 - RNA, 22 nt, Human
gggagggaucugcuaggcaaug

SEQ ID NO: 708758 - RNA, 22 nt, Human
ucagaucuggugaaguuauagu

SEQ ID NO: 708759 - RNA, 22 nt, Human
auuuacaggacagcuuggcauu

SEQ ID NO: 708760 - RNA, 22 nt, Human
cauagugucugguaacauagua

SEQ ID NO: 708761 - RNA, 22 nt, Human
uaccauuugagagagaacauaa

SEQ ID NO: 708762 - RNA, 22 nt, Human
gcaggcuguagacaccaaacua

SEQ ID NO: 708763 - RNA, 22 nt, Human
uggccugaggcucggcaugggu

SEQ ID NO: 708764 - RNA, 17 nt, Human
uaucaagaagucuggcc

SEQ ID NO: 708765 - RNA, 22 nt, Human
uucauguuuguaggacugaggc

SEQ ID NO: 708766 - RNA, 18 nt, Human
gccagcccuccaaccucc

SEQ ID NO: 708767 - RNA, 22 nt, Human
guugaauauuuuaagaguuuug

SEQ ID NO: 708768 - RNA, 22 nt, Human
uaaaagagaauggauaacagag

SEQ ID NO: 708769 - RNA, 22 nt, Human
ugguccugcccacgcccaucug

SEQ ID NO: 708770 - RNA, 22 nt, Human
aagagaaagcagacuuugucau

SEQ ID NO: 708771 - RNA, 22 nt, Human
uauugacacuuuuuguguagcc

SEQ ID NO: 708772 - RNA, 18 nt, Human
uuggcuuugagaacuggu

SEQ ID NO: 708773 - RNA, 22 nt, Human
acagacuggccugucucgcacc

SEQ ID NO: 708774 - RNA, 22 nt, Human
ggcacuggccuggggccaagag

SEQ ID NO: 708775 - RNA, 22 nt, Human
cagagcagucuggagauccagc

SEQ ID NO: 708776 - RNA, 22 nt, Human
cugcugagcccuggcacaggug

SEQ ID NO: 708777 - RNA, 22 nt, Human
cuggggaacgcagcgagcagcg

SEQ ID NO: 708778 - RNA, 22 nt, Human
ccaaggcugucauucaguagcu

SEQ ID NO: 708779 - RNA, 21 nt, Human
ugcuuaccgccccagggcucc

SEQ ID NO: 708780 - RNA, 22 nt, Human
gucaggggaugugcugguggcc

SEQ ID NO: 708781 - RNA, 22 nt, Human
uucaccagcagcucacuaguca

SEQ ID NO: 708782 - RNA, 22 nt, Human
gcaguggggcaaucauagcuca

SEQ ID NO: 708783 - RNA, 22 nt, Human
gcuuccuguauccuccuguacc

SEQ ID NO: 708784 - RNA, 23 nt, Human
acuacagauacuccugcuguuug

SEQ ID NO: 708785 - RNA, 22 nt, Human
aggaugugccaccagcuuugca

SEQ ID NO: 708786 - RNA, 22 nt, Human
acuacacagggaugugacuacc

SEQ ID NO: 708787 - RNA, 22 nt, Human
cuguagagaaagcauggaagcu

SEQ ID NO: 708788 - RNA, 22 nt, Human
agcaggcagccuaggaagugaa

SEQ ID NO: 708789 - RNA, 20 nt, Human
gcugaggucauuaugccuca

SEQ ID NO: 708790 - RNA, 22 nt, Human
guguugaugacauuuuagaaac

SEQ ID NO: 708791 - RNA, 22 nt, Human
agccaggccagcugucuugagu

SEQ ID NO: 708792 - RNA, 22 nt, Human
cuagagaagaggcucagccagc

SEQ ID NO: 708793 - RNA, 18 nt, Human
cugggccagaguuucugc

SEQ ID NO: 708794 - RNA, 22 nt, Human
uuagaaaucugcugccaugcaa

SEQ ID NO: 708795 - RNA, 22 nt, Human
acucuaaaccccacucugcugg

SEQ ID NO: 708796 - RNA, 20 nt, Human
acgugugugugcacgcgcgc

SEQ ID NO: 708797 - RNA, 22 nt, Human
ggcuucccuuuccgagaggaga

SEQ ID NO: 708798 - RNA, 22 nt, Human
cuggacaaccacucagccucag

SEQ ID NO: 708799 - RNA, 22 nt, Human
ggccacugaccuacaucugggg

SEQ ID NO: 708800 - RNA, 22 nt, Human
gugucaauaaauagcggugugg

SEQ ID NO: 708801 - RNA, 22 nt, Human
uggaggauuccacuuacaugag

SEQ ID NO: 708802 - RNA, 22 nt, Human
ccagggauguggcagcaccaua

SEQ ID NO: 708803 - RNA, 22 nt, Human
acauccacauuuauucagucau

SEQ ID NO: 708804 - RNA, 22 nt, Human
ccuucuccugccuuggguucau

SEQ ID NO: 708805 - RNA, 18 nt, Human
gaggaaacaggcucugug

SEQ ID NO: 708806 - RNA, 22 nt, Human
ugcugcucuguaaagugaugag

SEQ ID NO: 708807 - RNA, 22 nt, Human
cauguggcacaaagaaggaaau

SEQ ID NO: 708808 - RNA, 22 nt, Human
gcugcagcagaaguucucagag

SEQ ID NO: 708809 - RNA, 22 nt, Human
uaagaaacccaggaauuucuua

SEQ ID NO: 708810 - RNA, 23 nt, Human
cugaggggaaaagggcuucaggc

SEQ ID NO: 708811 - RNA, 21 nt, Human
uaaaagaugacaagacagcuc

SEQ ID NO: 708812 - RNA, 21 nt, Human
ccugcagcaccagaaggagau

SEQ ID NO: 708813 - RNA, 22 nt, Human
ucuuucugguuauguauagaga

SEQ ID NO: 708814 - RNA, 22 nt, Human
cacagaauggaccaguuuuaga

SEQ ID NO: 708815 - RNA, 22 nt, Human
agugcacaccuuaguacaaagu

SEQ ID NO: 708816 - RNA, 22 nt, Human
aggaggccgauuucagaggucg

SEQ ID NO: 708817 - RNA, 22 nt, Human
uagaggauuuugcauuucauau

SEQ ID NO: 708818 - RNA, 22 nt, Human
ugacauuuaauuaacgaaugcu

SEQ ID NO: 708819 - RNA, 22 nt, Human
uuuaucugauauucagcgauuu

SEQ ID NO: 708820 - RNA, 22 nt, Human
ccccuuccuuccucagacagcc

SEQ ID NO: 708821 - RNA, 22 nt, Human
caucagcacuaugauuaaagua

SEQ ID NO: 708822 - RNA, 20 nt, Human
accuugaacccgccagccau

SEQ ID NO: 708823 - RNA, 22 nt, Human
aacuuuaaggcuauaaauuaug

SEQ ID NO: 708824 - RNA, 22 nt, Human
auauauuuuuugagacagaguc

SEQ ID NO: 708825 - RNA, 22 nt, Human
uggcuggcuuguucacugacug

SEQ ID NO: 708826 - RNA, 22 nt, Human
cagguccccuccccuaccaggc

SEQ ID NO: 708827 - RNA, 19 nt, Human
cugcagggaugugcagagu

SEQ ID NO: 708828 - RNA, 22 nt, Human
aaggcugacguuuguguuuauu

SEQ ID NO: 708829 - RNA, 22 nt, Human
caggccagaggcuguuguugcg

SEQ ID NO: 708830 - RNA, 22 nt, Human
gauggcagcauauugacagcau

SEQ ID NO: 708831 - RNA, 22 nt, Human
auucauccuuaccaguccccgg

SEQ ID NO: 708832 - RNA, 22 nt, Human
cuucaacuucccuagaugucau

SEQ ID NO: 708833 - RNA, 22 nt, Human
auggagagugaaagucucucua

SEQ ID NO: 708834 - RNA, 22 nt, Human
gucucaguuacucucccuggua

SEQ ID NO: 708835 - RNA, 22 nt, Human
ugacauaaguugguagaaagga

SEQ ID NO: 708836 - RNA, 21 nt, Human
ugaaugaucugguugccuuuu

SEQ ID NO: 708837 - RNA, 22 nt, Human
cauuggcacaaguagcuucauc

SEQ ID NO: 708838 - RNA, 21 nt, Human
uggcugcuggcccucucucca

SEQ ID NO: 708839 - RNA, 22 nt, Human
agugcagugguuaggagccagg

SEQ ID NO: 708840 - RNA, 22 nt, Human
ugcccacaucugcuuauuucau

SEQ ID NO: 708841 - RNA, 22 nt, Human
cagggcugucuccaaaggcccc

SEQ ID NO: 708842 - RNA, 22 nt, Human
gcucuggccagacccucagugg

SEQ ID NO: 708843 - RNA, 22 nt, Human
uagcaaggacguccaaagaacu

SEQ ID NO: 708844 - RNA, 22 nt, Human
uaaccagcaugaaaucugcagc

SEQ ID NO: 708845 - RNA, 22 nt, Human
ugggcucucacacauguucuga

SEQ ID NO: 708846 - RNA, 22 nt, Human
uggcaugcacagcccuguucgg

SEQ ID NO: 708847 - RNA, 22 nt, Human
ucucgacagccuggcacagugg

SEQ ID NO: 708848 - RNA, 22 nt, Human
cuggcauucuuguuucuggaaa

SEQ ID NO: 708849 - RNA, 22 nt, Human
aacauucugguucuaaaaaccu

SEQ ID NO: 708850 - RNA, 22 nt, Human
cuuuacagaaagagaacucugg

SEQ ID NO: 708851 - RNA, 22 nt, Human
gcagcacacgguggugcccugg

SEQ ID NO: 708852 - RNA, 22 nt, Human
ccagggagcggggcugggucuc

SEQ ID NO: 708853 - RNA, 22 nt, Human
gggagcugaaggagccggcggg

SEQ ID NO: 708854 - RNA, 22 nt, Human
gccagcccauuaaccccugucc

SEQ ID NO: 708855 - RNA, 22 nt, Human
cagguagguauggugcagucuu

SEQ ID NO: 708856 - RNA, 22 nt, Human
gcaccuggacagugacccuagc

SEQ ID NO: 708857 - RNA, 22 nt, Human
ucugaggaauucugcagugaga

SEQ ID NO: 708858 - RNA, 22 nt, Human
auugguuaagacgcaucaugcu

SEQ ID NO: 708859 - RNA, 22 nt, Human
cccuggauuuacaucauucuga

SEQ ID NO: 708860 - RNA, 21 nt, Human
cugcuuccucucuucauggca

SEQ ID NO: 708861 - RNA, 22 nt, Human
aacaguauggaagccauuagga

SEQ ID NO: 708862 - RNA, 20 nt, Human
ugggucugcuuggcuucagu

SEQ ID NO: 708863 - RNA, 20 nt, Human
ucagaugggagugagccauc

SEQ ID NO: 708864 - RNA, 22 nt, Human
ugaaaaaacaaguuggcccauu

SEQ ID NO: 708865 - RNA, 22 nt, Human
cagagcucagagcugccaggca

SEQ ID NO: 708866 - RNA, 22 nt, Human
ucaggacaacaagacuuguuua

SEQ ID NO: 708867 - RNA, 22 nt, Human
uggacagcuugcagagccaccc

SEQ ID NO: 708868 - RNA, 22 nt, Human
uccugcuucagguagagggggu

SEQ ID NO: 708869 - RNA, 22 nt, Human
gcugcuugauuagguugacacu

SEQ ID NO: 708870 - RNA, 22 nt, Human
ccuguuuagugaggugaggagu

SEQ ID NO: 708871 - RNA, 22 nt, Human
uaguugaagagaugaaugacca

SEQ ID NO: 708872 - RNA, 22 nt, Human
uuuacaaguuuacagaaugaug

SEQ ID NO: 708873 - RNA, 19 nt, Human
ggcuggaguggccaucugu

SEQ ID NO: 708874 - RNA, 22 nt, Human
aaagccaggggagggauuccca

SEQ ID NO: 708875 - RNA, 22 nt, Human
aaauagacacaugcguucauau

SEQ ID NO: 708876 - RNA, 22 nt, Human
ccaaacauuucaaauuuagaga

SEQ ID NO: 708877 - RNA, 22 nt, Human
auguacauuuagaucauuucug

SEQ ID NO: 708878 - RNA, 22 nt, Human
ugcaaauaggggacaacucuuu

SEQ ID NO: 708879 - RNA, 22 nt, Human
ugucauauguaauauguucauu

SEQ ID NO: 708880 - RNA, 22 nt, Human
guacagugccagacuucuaggu

SEQ ID NO: 708881 - RNA, 22 nt, Human
uccaguggcaggcggugagguc

SEQ ID NO: 708882 - RNA, 22 nt, Human
caccagcuucccaucgcggguc

SEQ ID NO: 708883 - RNA, 20 nt, Human
augcuuaaguguucauuauu

SEQ ID NO: 708884 - RNA, 22 nt, Human
caaucacugggauauuggugug

SEQ ID NO: 708885 - RNA, 22 nt, Human
cuguccucaccuuggcaggggg

SEQ ID NO: 708886 - RNA, 22 nt, Human
cauugacaguucuuuaaguugc

SEQ ID NO: 708887 - RNA, 22 nt, Human
aggcccaguccucugccgucug

SEQ ID NO: 708888 - RNA, 22 nt, Human
aaagaaauaccuuucucagcuu

SEQ ID NO: 708889 - RNA, 22 nt, Human
aacugcauuugcauaaguccau

SEQ ID NO: 708890 - RNA, 22 nt, Human
cagagcuguuacuauucaugaa

SEQ ID NO: 708891 - RNA, 19 nt, Human
agauggcuuggacugaaaa

SEQ ID NO: 708892 - RNA, 22 nt, Human
aggguucagugagguguacucc

SEQ ID NO: 708893 - RNA, 22 nt, Human
ucaaaacacuauuaccuuuaau

SEQ ID NO: 708894 - RNA, 22 nt, Human
uuggggagaaaugaaaugaagu

SEQ ID NO: 708895 - RNA, 22 nt, Human
aaaacaggaguuuugguaggcu

SEQ ID NO: 708896 - RNA, 22 nt, Human
agguggagaucagggacuaagg

SEQ ID NO: 708897 - RNA, 22 nt, Human
cagugcauaaucuaaauggggg

SEQ ID NO: 708898 - RNA, 22 nt, Human
agcauccagcauccuauagaaa

SEQ ID NO: 708899 - RNA, 22 nt, Human
ccaguguauuauuugagaaauu

SEQ ID NO: 708900 - RNA, 22 nt, Human
aguccaggaaaauaagcuaggu

SEQ ID NO: 708901 - RNA, 22 nt, Human
ucacagcacccugaggugcugg

SEQ ID NO: 708902 - RNA, 22 nt, Human
aggcaccgcuccucaguccaga

SEQ ID NO: 708903 - RNA, 22 nt, Human
agguccuguuucuucccugggg

SEQ ID NO: 708904 - RNA, 22 nt, Human
caggguucagugggcccucuug

SEQ ID NO: 708905 - RNA, 22 nt, Human
gcuguccagagcaugggagcaa

SEQ ID NO: 708906 - RNA, 22 nt, Human
gcugauguuucaaguauagcuu

SEQ ID NO: 708907 - RNA, 22 nt, Human
auguauuugcguauggacauac

SEQ ID NO: 708908 - RNA, 22 nt, Human
uagcuccuggcugcagggccuc

SEQ ID NO: 708909 - RNA, 22 nt, Human
gcuuauacucuggagaauaaga

SEQ ID NO: 708910 - RNA, 22 nt, Human
ggggcagcucccgagggcagga

SEQ ID NO: 708911 - RNA, 22 nt, Human
auuauuuggaauaggcauugca

SEQ ID NO: 708912 - RNA, 19 nt, Human
cugcugggugcugagggag

SEQ ID NO: 708913 - RNA, 22 nt, Human
caucauuuaauuauaggggcug

SEQ ID NO: 708914 - RNA, 22 nt, Human
ucucucuucuuuguuaagaaug

SEQ ID NO: 708915 - RNA, 22 nt, Human
uaggccagaggagcagcuuugg

SEQ ID NO: 708916 - RNA, 22 nt, Human
ugccaggcgugguggugcgcac

SEQ ID NO: 708917 - RNA, 22 nt, Human
augcacagacccaaaggccauc

SEQ ID NO: 708918 - RNA, 17 nt, Human
aggugcagaggcagagc

SEQ ID NO: 708919 - RNA, 22 nt, Human
gccagcuguaagcuggggugau

SEQ ID NO: 708920 - RNA, 18 nt, Human
cucaguguuugcugaaaa

SEQ ID NO: 708921 - RNA, 22 nt, Human
uuggcuucuuuagucaguuugg

SEQ ID NO: 708922 - RNA, 22 nt, Human
acuugguuggucucacccuguu

SEQ ID NO: 708923 - RNA, 22 nt, Human
ucccagagcucugacaccagcu

SEQ ID NO: 708924 - RNA, 22 nt, Human
aauaucagcacuuuugugguau

SEQ ID NO: 708925 - RNA, 22 nt, Human
uuuccuugggucucuuaguggc

SEQ ID NO: 708926 - RNA, 22 nt, Human
aaugauacauauguaucguuag

SEQ ID NO: 708927 - RNA, 22 nt, Human
uugaagaccuuuagugcuaugu

SEQ ID NO: 708928 - RNA, 18 nt, Human
uccauccucugcucuuca

SEQ ID NO: 708929 - RNA, 22 nt, Human
uccuuucccuuuccauccuggc

SEQ ID NO: 708930 - RNA, 22 nt, Human
aggagcacuaauuccugcagag

SEQ ID NO: 708931 - RNA, 22 nt, Human
aagcacaaugaacaucuuagau

SEQ ID NO: 708932 - RNA, 22 nt, Human
cugcacagcccucaagagccug

SEQ ID NO: 708933 - RNA, 22 nt, Human
gaauauuuucaguacagauggu

SEQ ID NO: 708934 - RNA, 22 nt, Human
ggcuggcugauaaaggguugag

SEQ ID NO: 708935 - RNA, 22 nt, Human
gcagguggggcugcuaccagaa

SEQ ID NO: 708936 - RNA, 22 nt, Human
agagucaccuuuuccucaggau

SEQ ID NO: 708937 - RNA, 19 nt, Human
accaggaguaucagagcug

SEQ ID NO: 708938 - RNA, 22 nt, Human
uugcagcuguugcaaagucucu

SEQ ID NO: 708939 - RNA, 22 nt, Human
gucaccagugcuaagaggugga

SEQ ID NO: 708940 - RNA, 22 nt, Human
aaaauuuugcccuauccuucau

SEQ ID NO: 708941 - RNA, 22 nt, Human
guucugcuuccuugcuugcgca

SEQ ID NO: 708942 - RNA, 22 nt, Human
agcucagcacugucagcacucc

SEQ ID NO: 708943 - RNA, 22 nt, Human
ucaggcuuauagguagugguua

SEQ ID NO: 708944 - RNA, 23 nt, Human
ccuggggagcuguauccagagug

SEQ ID NO: 708945 - RNA, 22 nt, Human
uagauuguucuuaacuuuauaa

SEQ ID NO: 708946 - RNA, 22 nt, Human
accucccagaaaguuuugcagg

SEQ ID NO: 708947 - RNA, 22 nt, Human
ucugcugugucccuggucuccu

SEQ ID NO: 708948 - RNA, 22 nt, Human
aaguuugacagaaguuucuaau

SEQ ID NO: 708949 - RNA, 22 nt, Human
agcagagcuuuuuggacucaga

SEQ ID NO: 708950 - RNA, 23 nt, Human
uggagccugggauacaauagaug

SEQ ID NO: 708951 - RNA, 22 nt, Human
cugcuccagacaccugcagggg

SEQ ID NO: 708952 - RNA, 22 nt, Human
guagagcaggacuugagauguu

SEQ ID NO: 708953 - RNA, 22 nt, Human
uaggcugagcuuguagaucgua

SEQ ID NO: 708954 - RNA, 22 nt, Human
aaacauucacucucaauuuuag

SEQ ID NO: 708955 - RNA, 22 nt, Human
uuuaccaagcuuuaauuacaua

SEQ ID NO: 708956 - RNA, 22 nt, Human
augucacauuggagcugcugga

SEQ ID NO: 708957 - RNA, 22 nt, Human
cauguguggagggcaugcaugg

SEQ ID NO: 708958 - RNA, 22 nt, Human
agugcccuggcccagcuggacc

SEQ ID NO: 708959 - RNA, 22 nt, Human
gggaagcagacggcggggaaau

SEQ ID NO: 708960 - RNA, 22 nt, Human
acauucaaaaagcaucugucac

SEQ ID NO: 708961 - RNA, 22 nt, Human
gcugccucccagagcccugcag

SEQ ID NO: 708962 - RNA, 22 nt, Human
ugcaggugugugcaagggaggg

SEQ ID NO: 708963 - RNA, 22 nt, Human
gcugggaggaucucucccuguc

SEQ ID NO: 708964 - RNA, 22 nt, Human
auggagacgcaagggaccuagg

SEQ ID NO: 708965 - RNA, 22 nt, Human
gucacaaagcgcgguggucggu

SEQ ID NO: 708966 - RNA, 22 nt, Human
gagccagccuccgccucucucc

SEQ ID NO: 708967 - RNA, 22 nt, Human
aacccuggggcagcugcuaggg

SEQ ID NO: 708968 - RNA, 19 nt, Human
gguuggagaagagcggccc

SEQ ID NO: 708969 - RNA, 22 nt, Human
ugcagcagccaagguucugugc

SEQ ID NO: 708970 - RNA, 22 nt, Human
ucacccagguaauagcaguuug

SEQ ID NO: 708971 - RNA, 21 nt, Human
ggucuucaaagcuuuuacgau

SEQ ID NO: 708972 - RNA, 22 nt, Human
ccugcccuagagaugacacaau

SEQ ID NO: 708973 - RNA, 22 nt, Human
ucauggaagagguauuuuuugu

SEQ ID NO: 708974 - RNA, 23 nt, Human
acuccccagucucuucuugccaa

SEQ ID NO: 708975 - RNA, 23 nt, Human
ggaggcucaaguaucacgggcag

SEQ ID NO: 708976 - RNA, 22 nt, Human
acacagaugauguuccaggaac

SEQ ID NO: 708977 - RNA, 22 nt, Human
caccugagcaacccugugcggg

SEQ ID NO: 708978 - RNA, 22 nt, Human
aucauaaaauugcaccauuucu

SEQ ID NO: 708979 - RNA, 22 nt, Human
acuuuggggaucuacggcugga

SEQ ID NO: 708980 - RNA, 22 nt, Human
aguggcaggaucucgguucacu

SEQ ID NO: 708981 - RNA, 22 nt, Human
ugucucagaauggcucauaaua

SEQ ID NO: 708982 - RNA, 21 nt, Human
cuggcucuguugucacccggc

SEQ ID NO: 708983 - RNA, 22 nt, Human
ucagcaggucugaggcggggcc

SEQ ID NO: 708984 - RNA, 22 nt, Human
aauuuuacauaggggauauggg

SEQ ID NO: 708985 - RNA, 22 nt, Human
aaaaguugcaaaauugcucuuc

SEQ ID NO: 708986 - RNA, 22 nt, Human
agccaguuggcuaugaggagga

SEQ ID NO: 708987 - RNA, 22 nt, Human
gccugcagugagugcagaaggu

SEQ ID NO: 708988 - RNA, 22 nt, Human
aggcagcauccagaggagaaug

SEQ ID NO: 708989 - RNA, 22 nt, Human
ggcuuugacaugcugaauuaaa

SEQ ID NO: 708990 - RNA, 22 nt, Human
aggauguggguuuucacauugu

SEQ ID NO: 708991 - RNA, 22 nt, Human
cuaaaugacuuccagugguuau

SEQ ID NO: 708992 - RNA, 22 nt, Human
gcccacacaccagcucaggagg

SEQ ID NO: 708993 - RNA, 22 nt, Human
caaauuuuguguguucucuagu

SEQ ID NO: 708994 - RNA, 22 nt, Human
gagcuuaaauggcuaaauauaa

SEQ ID NO: 708995 - RNA, 22 nt, Human
caggcagaaaguauucugugua

SEQ ID NO: 708996 - RNA, 22 nt, Human
uuggagagauuaucagaccagc

SEQ ID NO: 708997 - RNA, 20 nt, Human
acagugcauggggggacagc

SEQ ID NO: 708998 - RNA, 22 nt, Human
ucucccuuggucacagauuccu

SEQ ID NO: 708999 - RNA, 22 nt, Human
agcuucuuuaauucagcaugau

SEQ ID NO: 709000 - RNA, 22 nt, Human
uagaacagaguuccagugauca

SEQ ID NO: 709001 - RNA, 22 nt, Human
gcccugagaagaagucggaggg

SEQ ID NO: 709002 - RNA, 22 nt, Human
cccagccugaucucggccagcu

SEQ ID NO: 709003 - RNA, 22 nt, Human
ugugaauauccauuuguuucag

SEQ ID NO: 709004 - RNA, 22 nt, Human
cucugguuucgcaggaaauaga

SEQ ID NO: 709005 - RNA, 20 nt, Human
acuggacacugaggugagcu

SEQ ID NO: 709006 - RNA, 22 nt, Human
caguccugcuagugugaaaagc

SEQ ID NO: 709007 - RNA, 22 nt, Human
agcaaugcuaccgggugauucg

SEQ ID NO: 709008 - RNA, 22 nt, Human
cuuuaaauaauacaagguccag

SEQ ID NO: 709009 - RNA, 17 nt, Human
cucagagaggguaagua

SEQ ID NO: 709010 - RNA, 23 nt, Human
uccagcagagccuuccaggaggg

SEQ ID NO: 709011 - RNA, 20 nt, Human
acaaagacuggaaaagcaag

SEQ ID NO: 709012 - RNA, 22 nt, Human
uucaggaucaaguugccaguag

SEQ ID NO: 709013 - RNA, 22 nt, Human
uguucuuuagcagaccauguug

SEQ ID NO: 709014 - RNA, 22 nt, Human
gccaggcugcuggcugcugucc

SEQ ID NO: 709015 - RNA, 22 nt, Human
guuccuaaaucuggaggaccuc

SEQ ID NO: 709016 - RNA, 22 nt, Human
cugggcugcagcgggagcgacg

SEQ ID NO: 709017 - RNA, 23 nt, Human
acucaaaauuuggcauuugagga

SEQ ID NO: 709018 - RNA, 19 nt, Human
aucagcaagguaggaugug

SEQ ID NO: 709019 - RNA, 22 nt, Human
cagauggaacacagaaaggaga

SEQ ID NO: 709020 - RNA, 23 nt, Human
uuacaguaggaguuggaaaacca

SEQ ID NO: 709021 - RNA, 22 nt, Human
auuugccuuggugauuuguaaa

SEQ ID NO: 709022 - RNA, 22 nt, Human
aucugcaucagacuuugcauga

SEQ ID NO: 709023 - RNA, 22 nt, Human
cccagcucccugguauuugugc

SEQ ID NO: 709024 - RNA, 18 nt, Human
uuuuacucauagcaggcc

SEQ ID NO: 709025 - RNA, 22 nt, Human
agaucuauuagcaaacugccau

SEQ ID NO: 709026 - RNA, 22 nt, Human
agcagauggugucaugggaugg

SEQ ID NO: 709027 - RNA, 22 nt, Human
auauuaguguagguagcuaaua

SEQ ID NO: 709028 - RNA, 22 nt, Human
ccagcaggcagucauauccuuu

SEQ ID NO: 709029 - RNA, 22 nt, Human
cuagaauaucauaugaagagac

SEQ ID NO: 709030 - RNA, 22 nt, Human
auacaugauacuuaguacguag

SEQ ID NO: 709031 - RNA, 22 nt, Human
guggggagggagaugcugaagu

SEQ ID NO: 709032 - RNA, 22 nt, Human
auaacagauacucucugugagg

SEQ ID NO: 709033 - RNA, 22 nt, Human
ggccuugggcagacacgucaca

SEQ ID NO: 709034 - RNA, 22 nt, Human
acaguguucacuaagguuagcu

SEQ ID NO: 709035 - RNA, 22 nt, Human
guccugugcucagacauggggg

SEQ ID NO: 709036 - RNA, 22 nt, Human
agcuguggucuucaaguugccu

SEQ ID NO: 709037 - RNA, 22 nt, Human
auuuccuucggacaguuugggu

SEQ ID NO: 709038 - RNA, 22 nt, Human
augaaaguaccuguaauauguu

SEQ ID NO: 709039 - RNA, 22 nt, Human
guuguauauguagagaaugguc

SEQ ID NO: 709040 - RNA, 20 nt, Human
ggguaaaaggcaguguugca

SEQ ID NO: 709041 - RNA, 20 nt, Human
ccugaggguuuguguucuuu

SEQ ID NO: 709042 - RNA, 22 nt, Human
aaauugcugggucccacccaag

SEQ ID NO: 709043 - RNA, 22 nt, Human
aagaaauauugggccuuauaaa

SEQ ID NO: 709044 - RNA, 22 nt, Human
ggcagaccucuccagccccaca

SEQ ID NO: 709045 - RNA, 22 nt, Human
aggaauguguuucuaggcuguu

SEQ ID NO: 709046 - RNA, 22 nt, Human
ugagccugaguucaaggcugca

SEQ ID NO: 709047 - RNA, 22 nt, Human
auuugaaaucccuucuacugua

SEQ ID NO: 709048 - RNA, 22 nt, Human
gacugagggacagggcagugga

SEQ ID NO: 709049 - RNA, 22 nt, Human
uccaaauacauuuacuguauuu

SEQ ID NO: 709050 - RNA, 22 nt, Human
cuccagugucucagagcagaug

SEQ ID NO: 709051 - RNA, 22 nt, Human
augaugcaccauuauaagaguu

SEQ ID NO: 709052 - RNA, 22 nt, Human
agaccuggauuccaauccuacc

SEQ ID NO: 709053 - RNA, 21 nt, Human
cccaggagaagaaaagaugca

SEQ ID NO: 709054 - RNA, 22 nt, Human
ggcacaagguuuaaauaacauc

SEQ ID NO: 709055 - RNA, 22 nt, Human
ugggggagaguuuagaugauuu

SEQ ID NO: 709056 - RNA, 22 nt, Human
acccugccgugggcugcuugug

SEQ ID NO: 709057 - RNA, 22 nt, Human
aaacagcugucauuguuuuaaa

SEQ ID NO: 709058 - RNA, 22 nt, Human
uuggccacacucacuagagccc

SEQ ID NO: 709059 - RNA, 22 nt, Human
ggagccugggccuccugcccuu

SEQ ID NO: 709060 - RNA, 21 nt, Human
ugaggccaauagccccuggac

SEQ ID NO: 709061 - RNA, 22 nt, Human
gugggcugcccuugaggucagc

SEQ ID NO: 709062 - RNA, 22 nt, Human
aagauacaccaagagccuagua

SEQ ID NO: 709063 - RNA, 22 nt, Human
uauuccuuggcaaaaaauauau

SEQ ID NO: 709064 - RNA, 22 nt, Human
agccuccaucccaugcacaaag

SEQ ID NO: 709065 - RNA, 22 nt, Human
cuggcagauauuugcagacaug

SEQ ID NO: 709066 - RNA, 22 nt, Human
uccucagucagcuccguucuug

SEQ ID NO: 709067 - RNA, 22 nt, Human
agcggcuggaccagcguucaag

SEQ ID NO: 709068 - RNA, 22 nt, Human
ugugcaguuuuaaguggucuaa

SEQ ID NO: 709069 - RNA, 22 nt, Human
uuauaugaguaucauaucacuu

SEQ ID NO: 709070 - RNA, 22 nt, Human
gcacuugaggacgacucagcug

SEQ ID NO: 709071 - RNA, 22 nt, Human
guaaacaacacaaaucauuuga

SEQ ID NO: 709072 - RNA, 22 nt, Human
uaaauacuuaguuuugugucua

SEQ ID NO: 709073 - RNA, 22 nt, Human
guauuucccccagacucccugg

SEQ ID NO: 709074 - RNA, 22 nt, Human
uggagccagcgagccgaggcgg

SEQ ID NO: 709075 - RNA, 22 nt, Human
cccuggcagaaugucucugggc

SEQ ID NO: 709076 - RNA, 22 nt, Human
cagagagcuuagugugcugcau

SEQ ID NO: 709077 - RNA, 22 nt, Human
aggacuucuccgauaagucaga

SEQ ID NO: 709078 - RNA, 22 nt, Human
gggccagagcacagaggauguu

SEQ ID NO: 709079 - RNA, 22 nt, Human
uaauacacaagggccagcucuu

SEQ ID NO: 709080 - RNA, 22 nt, Human
ucaucaaaggauugcaugauuu

SEQ ID NO: 709081 - RNA, 22 nt, Human
ucacagaagagauauugacaga

SEQ ID NO: 709082 - RNA, 21 nt, Human
acucugucuugagccaucugu

SEQ ID NO: 709083 - RNA, 22 nt, Human
cagucucacccuggaggcccca

SEQ ID NO: 709084 - RNA, 22 nt, Human
accuguguuuucccucaguuuc

SEQ ID NO: 709085 - RNA, 22 nt, Human
aagucucauccguguagcucca

SEQ ID NO: 709086 - RNA, 22 nt, Human
aggcaguuguagagagggcucu

SEQ ID NO: 709087 - RNA, 22 nt, Human
agggcuuucuuuguaaaagaag

SEQ ID NO: 709088 - RNA, 22 nt, Human
gccuggugguauccuggcaaga

SEQ ID NO: 709089 - RNA, 22 nt, Human
agagcuguuuggacaucugagu

SEQ ID NO: 709090 - RNA, 22 nt, Human
auggagcuaaauuguaaucaua

SEQ ID NO: 709091 - RNA, 21 nt, Human
agcaggaggcagucacagcuc

SEQ ID NO: 709092 - RNA, 22 nt, Human
uggagcugauacagcuggcuuu

SEQ ID NO: 709093 - RNA, 22 nt, Human
ccuuugugguggcccagugugg

SEQ ID NO: 709094 - RNA, 22 nt, Human
gcacauacauauuagugucaca

SEQ ID NO: 709095 - RNA, 22 nt, Human
ccugaaacaguccuugcccuca

SEQ ID NO: 709096 - RNA, 22 nt, Human
gcagaccagccccuggagcugc

SEQ ID NO: 709097 - RNA, 22 nt, Human
ccucacagggccaggccccuca

SEQ ID NO: 709098 - RNA, 22 nt, Human
caguggauuagccagagcugga

SEQ ID NO: 709099 - RNA, 22 nt, Human
agcuauggaacagaguggcugu

SEQ ID NO: 709100 - RNA, 22 nt, Human
aacaguuauuaucacauuagug

SEQ ID NO: 709101 - RNA, 22 nt, Human
uggagggcaugcuguccauggg

SEQ ID NO: 709102 - RNA, 22 nt, Human
gugcagcugugugagagcucca

SEQ ID NO: 709103 - RNA, 22 nt, Human
gaauugcugaugaaucugauug

SEQ ID NO: 709104 - RNA, 22 nt, Human
acugcugauuaugaaagugaca

SEQ ID NO: 709105 - RNA, 20 nt, Human
cuugcccagggucuccugcc

SEQ ID NO: 709106 - RNA, 22 nt, Human
ccaggcuggaguguagucgcau

SEQ ID NO: 709107 - RNA, 22 nt, Human
gcacaggcucucuuggggacac

SEQ ID NO: 709108 - RNA, 22 nt, Human
agagaagagcaaugauaaauuu

SEQ ID NO: 709109 - RNA, 22 nt, Human
uucaguuucuaaagauguuccu

SEQ ID NO: 709110 - RNA, 22 nt, Human
aaagcugucaaggcaggaggcu

SEQ ID NO: 709111 - RNA, 23 nt, Human
ugcaagaguuccaaacuguucaa

SEQ ID NO: 709112 - RNA, 22 nt, Human
accacuuaucaucacuaucuca

SEQ ID NO: 709113 - RNA, 22 nt, Human
gggcagcuguaucugagcuuau

SEQ ID NO: 709114 - RNA, 22 nt, Human
uugcaggauuuuagagaugaca

SEQ ID NO: 709115 - RNA, 22 nt, Human
auccauuuuugcaaaguuguuc

SEQ ID NO: 709116 - RNA, 22 nt, Human
cauggcuucuaagugauaacgu

SEQ ID NO: 709117 - RNA, 22 nt, Human
uuccaagguguucugcugguuu

SEQ ID NO: 709118 - RNA, 22 nt, Human
gcuguuuccagacaaugucuuu

SEQ ID NO: 709119 - RNA, 22 nt, Human
caaggccuccugggcccagaga

SEQ ID NO: 709120 - RNA, 22 nt, Human
cagcagggggcagcgcagauca

SEQ ID NO: 709121 - RNA, 22 nt, Human
ucugccuggagaguucuucucu

SEQ ID NO: 709122 - RNA, 22 nt, Human
uuaugacaggaaaaucacagaa

SEQ ID NO: 709123 - RNA, 22 nt, Human
cugagggccuuggcuccugccc

SEQ ID NO: 709124 - RNA, 22 nt, Human
uccagccuugccacuuuucugu

SEQ ID NO: 709125 - RNA, 22 nt, Human
ccuccaggcugguuaucagcug

SEQ ID NO: 709126 - RNA, 22 nt, Human
ugcuauugugaacagugccaca

SEQ ID NO: 709127 - RNA, 22 nt, Human
gcugauguauauagugauugag

SEQ ID NO: 709128 - RNA, 22 nt, Human
gaacuauaugucuuaaagcuuu

SEQ ID NO: 709129 - RNA, 22 nt, Human
uggcuagcccuuguggggagag

SEQ ID NO: 709130 - RNA, 19 nt, Human
cauggcugcugcuugggag

SEQ ID NO: 709131 - RNA, 22 nt, Human
caccuagggcaucccugcccca

SEQ ID NO: 709132 - RNA, 22 nt, Human
aacaggaaacaaguuguuagga

SEQ ID NO: 709133 - RNA, 22 nt, Human
ucucagagcucacaccuccugg

SEQ ID NO: 709134 - RNA, 22 nt, Human
ucccucagauuggcaauuagau

SEQ ID NO: 709135 - RNA, 23 nt, Human
ugcuuggacaagacucuauuaag

SEQ ID NO: 709136 - RNA, 22 nt, Human
aaaucaguaaauguucauuaac

SEQ ID NO: 709137 - RNA, 22 nt, Human
agggccugcaucaggagcuugg

SEQ ID NO: 709138 - RNA, 22 nt, Human
auggccugggcccgcuucagau

SEQ ID NO: 709139 - RNA, 22 nt, Human
cauccugcggggagcagagggc

SEQ ID NO: 709140 - RNA, 22 nt, Human
cauuugauccucacaacaaucu

SEQ ID NO: 709141 - RNA, 22 nt, Human
uuuaguaaguucacugcaaagc

SEQ ID NO: 709142 - RNA, 23 nt, Human
agacauuuuaauaaggacuuuuu

SEQ ID NO: 709143 - RNA, 22 nt, Human
uuuaacauguucaagaaacaua

SEQ ID NO: 709144 - RNA, 22 nt, Human
guucacagcugggacaagacug

SEQ ID NO: 709145 - RNA, 22 nt, Human
uuacaaacaacagacauuuauu

SEQ ID NO: 709146 - RNA, 22 nt, Human
aggaagccaagccugacacuca

SEQ ID NO: 709147 - RNA, 22 nt, Human
uaaaagauuuuauaggaacaag

SEQ ID NO: 709148 - RNA, 22 nt, Human
acaauucucucauaucuuauua

SEQ ID NO: 709149 - RNA, 22 nt, Human
cagggcuccaugcagggacucc

SEQ ID NO: 709150 - RNA, 22 nt, Human
acugugugaaacaucaaugugu

SEQ ID NO: 709151 - RNA, 22 nt, Human
ggcaggaaguagcagucugagc

SEQ ID NO: 709152 - RNA, 22 nt, Human
uucacaaaaugguuuguugaug

SEQ ID NO: 709153 - RNA, 22 nt, Human
agacaguggcucagccccaguc

SEQ ID NO: 709154 - RNA, 22 nt, Human
uucaaaauuguucuaagcucug

SEQ ID NO: 709155 - RNA, 22 nt, Human
acauuugagaugccuuuuaggu

SEQ ID NO: 709156 - RNA, 22 nt, Human
aauuucagcuuaaguuguuugg

SEQ ID NO: 709157 - RNA, 22 nt, Human
cagaguguuagcgcugguuggg

SEQ ID NO: 709158 - RNA, 22 nt, Human
gcaguccuccugccucagccuc

SEQ ID NO: 709159 - RNA, 22 nt, Human
gcugccugauuuacauagugaa

SEQ ID NO: 709160 - RNA, 22 nt, Human
uggaauaaugaccacagaaaca

SEQ ID NO: 709161 - RNA, 22 nt, Human
auggcucucuagggcccagguu

SEQ ID NO: 709162 - RNA, 22 nt, Human
aaaggucagcugccaucguucu

SEQ ID NO: 709163 - RNA, 21 nt, Human
gccuucacucccagaguuugu

SEQ ID NO: 709164 - RNA, 20 nt, Human
ugcagggccuaaaaagggaa

SEQ ID NO: 709165 - RNA, 22 nt, Human
cacuccaggucccaguuccugg

SEQ ID NO: 709166 - RNA, 22 nt, Human
aucacacuggacauuggauacu

SEQ ID NO: 709167 - RNA, 22 nt, Human
cauggcaggaaaaugaacaggc

SEQ ID NO: 709168 - RNA, 22 nt, Human
aauauagaaucacuuuccuuca

SEQ ID NO: 709169 - RNA, 17 nt, Human
caaaccaguaagacugc

SEQ ID NO: 709170 - RNA, 22 nt, Human
ucagggacugcagagggaagcu

SEQ ID NO: 709171 - RNA, 22 nt, Human
aagccagugugacaggaaacuu

SEQ ID NO: 709172 - RNA, 22 nt, Human
gagcuggggcagcuuaggagug

SEQ ID NO: 709173 - RNA, 22 nt, Human
uccuggugaggcuagaaguguc

SEQ ID NO: 709174 - RNA, 22 nt, Human
ucaauguuuggaaauccuuugu

SEQ ID NO: 709175 - RNA, 22 nt, Human
uaauuguauggagaaggcugca

SEQ ID NO: 709176 - RNA, 22 nt, Human
gcagcagaguagacagagcccu

SEQ ID NO: 709177 - RNA, 22 nt, Human
guaaacaucgacccaacagggg

SEQ ID NO: 709178 - RNA, 22 nt, Human
cucagaaucugccaaguucagg

SEQ ID NO: 709179 - RNA, 22 nt, Human
agcuguggcaaccuugucagac

SEQ ID NO: 709180 - RNA, 22 nt, Human
aacaaacauuaccuggugcugg

SEQ ID NO: 709181 - RNA, 22 nt, Human
cugaacuuauugagugcuugcu

SEQ ID NO: 709182 - RNA, 22 nt, Human
guccuggcuuaguucgcuguaa

SEQ ID NO: 709183 - RNA, 22 nt, Human
cagcugugcuguauuaagcucu

SEQ ID NO: 709184 - RNA, 22 nt, Human
agccagcaggugcagaauucca

SEQ ID NO: 709185 - RNA, 22 nt, Human
gaaauacaguugggaggaggua

SEQ ID NO: 709186 - RNA, 22 nt, Human
cguggucucccacagaaagaag

SEQ ID NO: 709187 - RNA, 22 nt, Human
guuuucaugucuauugggcaua

SEQ ID NO: 709188 - RNA, 22 nt, Human
aggcucagggacucccucccuc

SEQ ID NO: 709189 - RNA, 22 nt, Human
aaacaaugaaauucauucuuca

SEQ ID NO: 709190 - RNA, 22 nt, Human
gguggcagucuuaagagaucuu

SEQ ID NO: 709191 - RNA, 22 nt, Human
uuuacaauugguuuucucuaau

SEQ ID NO: 709192 - RNA, 20 nt, Human
ggggaagaaaaggaugugau

SEQ ID NO: 709193 - RNA, 22 nt, Human
gcugcuaagcguuucuguucca

SEQ ID NO: 709194 - RNA, 22 nt, Human
ugcucugggaccgucauuaaaa

SEQ ID NO: 709195 - RNA, 22 nt, Human
cggggccuagucuaccucggca

SEQ ID NO: 709196 - RNA, 22 nt, Human
ggaaagaacccuggauggcugg

SEQ ID NO: 709197 - RNA, 19 nt, Human
ggcagucacggucaggagc

SEQ ID NO: 709198 - RNA, 22 nt, Human
aauuauggucacuguuccuggg

SEQ ID NO: 709199 - RNA, 22 nt, Human
guaaacauuuucaucugugccc

SEQ ID NO: 709200 - RNA, 17 nt, Human
caacuucacaaacuguc

SEQ ID NO: 709201 - RNA, 22 nt, Human
cugaggugugaaaugguggcaa

SEQ ID NO: 709202 - RNA, 22 nt, Human
auaagacacgccccacucacuc

SEQ ID NO: 709203 - RNA, 22 nt, Human
uugagguauauucacauauauc

SEQ ID NO: 709204 - RNA, 22 nt, Human
auuagcaugccaagcuuuuaga

SEQ ID NO: 709205 - RNA, 22 nt, Human
uguaggaauggauucuagaagg

SEQ ID NO: 709206 - RNA, 19 nt, Human
gcugugccucucuccugcu

SEQ ID NO: 709207 - RNA, 22 nt, Human
uagaaguuaaaggaauacagaa

SEQ ID NO: 709208 - RNA, 22 nt, Human
uaugagcuuccaguguugcaug

SEQ ID NO: 709209 - RNA, 22 nt, Human
ugcugccucaacugucaggaac

SEQ ID NO: 709210 - RNA, 22 nt, Human
guguccagagaacugugggagc

SEQ ID NO: 709211 - RNA, 22 nt, Human
ggcccucugccugugcuggcga

SEQ ID NO: 709212 - RNA, 22 nt, Human
ucucccacagccgugcuucaag

SEQ ID NO: 709213 - RNA, 22 nt, Human
auaggaugauaaaauuagaaac

SEQ ID NO: 709214 - RNA, 23 nt, Human
uacuacagggucuugcuaugaau

SEQ ID NO: 709215 - RNA, 22 nt, Human
cuggcuuuaaugucaucuuucu

SEQ ID NO: 709216 - RNA, 22 nt, Human
augcuuuaaacuauaaauccac

SEQ ID NO: 709217 - RNA, 22 nt, Human
uuucacagcuagugagcuucua

SEQ ID NO: 709218 - RNA, 23 nt, Human
acagaauaccauugacuaggugu

SEQ ID NO: 709219 - RNA, 22 nt, Human
ggcuucuaaggaguauccuuug

SEQ ID NO: 709220 - RNA, 22 nt, Human
uacaucauggcuucaugcugca

SEQ ID NO: 709221 - RNA, 22 nt, Human
augacagcauucaagacauaga

SEQ ID NO: 709222 - RNA, 23 nt, Human
uaaauuucuugauucuuauguga

SEQ ID NO: 709223 - RNA, 22 nt, Human
ccaggcuuuaagagguggaaac

SEQ ID NO: 709224 - RNA, 21 nt, Human
uugcuguuuucccaaugcagu

SEQ ID NO: 709225 - RNA, 22 nt, Human
uucccaaaauauaacaguuaac

SEQ ID NO: 709226 - RNA, 22 nt, Human
ucuagaaaaccaauauuacaug

SEQ ID NO: 709227 - RNA, 22 nt, Human
gcacccucugagcuccgcuccg

SEQ ID NO: 709228 - RNA, 22 nt, Human
auggcuuuugaugcuaagccaa

SEQ ID NO: 709229 - RNA, 22 nt, Human
uauugucuucaacucuacuuuu

SEQ ID NO: 709230 - RNA, 22 nt, Human
acugaccagauaugucauaccu

SEQ ID NO: 709231 - RNA, 22 nt, Human
cagcugccagcuucucuccauc

SEQ ID NO: 709232 - RNA, 22 nt, Human
guguggggagcugcagccacau

SEQ ID NO: 709233 - RNA, 22 nt, Human
agaaaacuugcucgagccuguu

SEQ ID NO: 709234 - RNA, 22 nt, Human
ccagcccugaacccugcugcau

SEQ ID NO: 709235 - RNA, 22 nt, Human
ccaggagcuggcauguggagag

SEQ ID NO: 709236 - RNA, 23 nt, Human
gaggccacauuccccugcuugag

SEQ ID NO: 709237 - RNA, 22 nt, Human
cuuuccuaguaguuacagaaug

SEQ ID NO: 709238 - RNA, 23 nt, Human
ccucccaccuauuucacuuucuu

SEQ ID NO: 709239 - RNA, 22 nt, Human
aauguguucacaggaaauacag

SEQ ID NO: 709240 - RNA, 22 nt, Human
cucacucagacauccagugcag

SEQ ID NO: 709241 - RNA, 22 nt, Human
aauauuucaaaaggaaacacag

SEQ ID NO: 709242 - RNA, 22 nt, Human
gaagcacauggcuauagcuauu

SEQ ID NO: 709243 - RNA, 22 nt, Human
acaggccagagguggggcagcc

SEQ ID NO: 709244 - RNA, 22 nt, Human
cgguccuguacuugaugagaua

SEQ ID NO: 709245 - RNA, 22 nt, Human
aucuggcucaccuggguaaaua

SEQ ID NO: 709246 - RNA, 22 nt, Human
gcacacauucggauucuuaacc

SEQ ID NO: 709247 - RNA, 22 nt, Human
uuacagaacugucuugaaauuu

SEQ ID NO: 709248 - RNA, 22 nt, Human
cucugugucugaguuauggucu

SEQ ID NO: 709249 - RNA, 22 nt, Human
agucacugggcugcuuccuaua

SEQ ID NO: 709250 - RNA, 22 nt, Human
uuucuguagugugguauguagg

SEQ ID NO: 709251 - RNA, 22 nt, Human
ugcauacuuuuaaugacuguuu

SEQ ID NO: 709252 - RNA, 22 nt, Human
ccuggagggcagcccauucugg

SEQ ID NO: 709253 - RNA, 22 nt, Human
uucugaggcacuggcucuccca

SEQ ID NO: 709254 - RNA, 22 nt, Human
ccugaagcucuuaagaccuuua

SEQ ID NO: 709255 - RNA, 22 nt, Human
ugacaaugauuagguagcuucu

SEQ ID NO: 709256 - RNA, 22 nt, Human
auaaauagugaagggagccggu

SEQ ID NO: 709257 - RNA, 19 nt, Human
ucagcaucaauuugguccu

SEQ ID NO: 709258 - RNA, 22 nt, Human
cccaggaauuggaggcugcagu

SEQ ID NO: 709259 - RNA, 22 nt, Human
aaaggcacugaucuuauccagu

SEQ ID NO: 709260 - RNA, 22 nt, Human
ggaggagauuccccucucacuu

SEQ ID NO: 709261 - RNA, 22 nt, Human
ucuacagagagucauagacuca

SEQ ID NO: 709262 - RNA, 22 nt, Human
ugauuacacaccacagugcucc

SEQ ID NO: 709263 - RNA, 22 nt, Human
ucuguaggacagagaaaugggg

SEQ ID NO: 709264 - RNA, 22 nt, Human
uuucaaagggaaguuaugaagu

SEQ ID NO: 709265 - RNA, 22 nt, Human
uaggauuuaggcuuuaacaucu

SEQ ID NO: 709266 - RNA, 22 nt, Human
aagcacaguucuuagaguuaca

SEQ ID NO: 709267 - RNA, 22 nt, Human
aggcuccacggcaggaugcugu

SEQ ID NO: 709268 - RNA, 22 nt, Human
caggauggucagaugcauuguc

SEQ ID NO: 709269 - RNA, 22 nt, Human
uuaaagggccgauuuccaggcc

SEQ ID NO: 709270 - RNA, 22 nt, Human
ucugucaccauucagcuugaau

SEQ ID NO: 709271 - RNA, 22 nt, Human
aaagcagccacagagagagcgu

SEQ ID NO: 709272 - RNA, 22 nt, Human
ggaguguggagaggacaugggu

SEQ ID NO: 709273 - RNA, 22 nt, Human
cacuggucagcaugguagacca

SEQ ID NO: 709274 - RNA, 22 nt, Human
caggaucugccaauauucaacc

SEQ ID NO: 709275 - RNA, 22 nt, Human
ucaagcuggcuguugcuauuuc

SEQ ID NO: 709276 - RNA, 22 nt, Human
cagcacuaauccugcaauuucu

SEQ ID NO: 709277 - RNA, 22 nt, Human
uggagcccacggaugucgcuuu

SEQ ID NO: 709278 - RNA, 22 nt, Human
agggucaguucugugagguguu

SEQ ID NO: 709279 - RNA, 22 nt, Human
agcauuuauuucuuagaaauug

SEQ ID NO: 709280 - RNA, 22 nt, Human
ccggcucggcgaccaggcugaa

SEQ ID NO: 709281 - RNA, 22 nt, Human
uagaaaagaagucuggccggga

SEQ ID NO: 709282 - RNA, 22 nt, Human
uuagugaaaagaaaaugagugg

SEQ ID NO: 709283 - RNA, 22 nt, Human
gcuaggaggaagaaugugaauu

SEQ ID NO: 709284 - RNA, 22 nt, Human
uucuuuucccaauauuuugcug

SEQ ID NO: 709285 - RNA, 20 nt, Human
cugcuccacccggcucucag

SEQ ID NO: 709286 - RNA, 21 nt, Human
ucccagcugggucagugcugc

SEQ ID NO: 709287 - RNA, 22 nt, Human
ggagacagugguagggccuaag

SEQ ID NO: 709288 - RNA, 22 nt, Human
caugcagugaaauugauaucca

SEQ ID NO: 709289 - RNA, 21 nt, Human
uuacuuuagaaauugccuuuu

SEQ ID NO: 709290 - RNA, 22 nt, Human
gcccagugcccuagaaugcacu

SEQ ID NO: 709291 - RNA, 22 nt, Human
aagaaauaagacuucucugucc

SEQ ID NO: 709292 - RNA, 22 nt, Human
uagauguguugccuggaguugu

SEQ ID NO: 709293 - RNA, 22 nt, Human
acuagccaaguuuuacgacuaa

SEQ ID NO: 709294 - RNA, 19 nt, Human
acagggcucuggacgccau

SEQ ID NO: 709295 - RNA, 22 nt, Human
cugagaaaugcauuuuuccagc

SEQ ID NO: 709296 - RNA, 22 nt, Human
cacugccugcuggcugucacuu

SEQ ID NO: 709297 - RNA, 22 nt, Human
aucugccugcaguggagguggg

SEQ ID NO: 709298 - RNA, 22 nt, Human
cuggcugugcagucuuccagaa

SEQ ID NO: 709299 - RNA, 22 nt, Human
uugggucuacguagaaagaaca

SEQ ID NO: 709300 - RNA, 22 nt, Human
gguauuuauaguggugcuuagu

SEQ ID NO: 709301 - RNA, 22 nt, Human
ugucccauggauaccaggcuau

SEQ ID NO: 709302 - RNA, 22 nt, Human
ucucucuugaaguauuagcuag

SEQ ID NO: 709303 - RNA, 22 nt, Human
aaugucugaggcucaucugagg

SEQ ID NO: 709304 - RNA, 18 nt, Human
uccuaacuuagauacucc

SEQ ID NO: 709305 - RNA, 22 nt, Human
gagaggaaagaaccaaugaccc

SEQ ID NO: 709306 - RNA, 22 nt, Human
cuaauacucauuucuguaacuc

SEQ ID NO: 709307 - RNA, 22 nt, Human
ggugaggggcgccucugcccgg

SEQ ID NO: 709308 - RNA, 22 nt, Human
ccuucuucuguguggcccaaga

SEQ ID NO: 709309 - RNA, 22 nt, Human
gccugaggaauugaggggguaa

SEQ ID NO: 709310 - RNA, 22 nt, Human
aaucuucuacuugacaguucuc

SEQ ID NO: 709311 - RNA, 22 nt, Human
agucaguguucuccggagaggc

SEQ ID NO: 709312 - RNA, 22 nt, Human
cugggccuggacgggcagaucu

SEQ ID NO: 709313 - RNA, 22 nt, Human
ggaggguuagcaaaggcacaga

SEQ ID NO: 709314 - RNA, 22 nt, Human
ggcagaguugguggagucaguu

SEQ ID NO: 709315 - RNA, 22 nt, Human
aacacuguacuggaagauggac

SEQ ID NO: 709316 - RNA, 22 nt, Human
uaguacagaaaaccucaggguc

SEQ ID NO: 709317 - RNA, 21 nt, Human
cuguggaagggaacuagaggg

SEQ ID NO: 709318 - RNA, 23 nt, Human
uggucucagccugugagagcuga

SEQ ID NO: 709319 - RNA, 22 nt, Human
aucuuugacugccauucuugac

SEQ ID NO: 709320 - RNA, 22 nt, Human
cagccucuugcacuuugaaggc

SEQ ID NO: 709321 - RNA, 22 nt, Human
aguggcugcuaugaucaggaca

SEQ ID NO: 709322 - RNA, 22 nt, Human
aaggggaguuagugauaaaacc

SEQ ID NO: 709323 - RNA, 22 nt, Human
guggaaguagauuugagaaggu

SEQ ID NO: 709324 - RNA, 22 nt, Human
uuuacagcauugcugaaaguuc

SEQ ID NO: 709325 - RNA, 22 nt, Human
ucucagagaaaugugucaccau

SEQ ID NO: 709326 - RNA, 20 nt, Human
uagggcucauuaugaucucc

SEQ ID NO: 709327 - RNA, 22 nt, Human
uggcccuuugguuuaugacuga

SEQ ID NO: 709328 - RNA, 22 nt, Human
ugagguggugcuaaucucugcu

SEQ ID NO: 709329 - RNA, 23 nt, Human
uggcacagcaggugugcuuuguu

SEQ ID NO: 709330 - RNA, 22 nt, Human
aaaugaugauuaaaaugaggua

SEQ ID NO: 709331 - RNA, 18 nt, Human
ugaacagaugaguugaag

SEQ ID NO: 709332 - RNA, 22 nt, Human
ccucagggacuccaugcugcag

SEQ ID NO: 709333 - RNA, 23 nt, Human
ugcaacaaugaggaaagcuacug

SEQ ID NO: 709334 - RNA, 22 nt, Human
agucacaucgauuauaaaauuu

SEQ ID NO: 709335 - RNA, 22 nt, Human
uuguaugaucccauuuagugaa

SEQ ID NO: 709336 - RNA, 22 nt, Human
uuauaacaucaaucagaguuaa

SEQ ID NO: 709337 - RNA, 22 nt, Human
uuauuauuggugaguuaaggaa

SEQ ID NO: 709338 - RNA, 18 nt, Human
auuuaugcuaaugggaua

SEQ ID NO: 709339 - RNA, 22 nt, Human
uacaauguuaaggaaagagaga

SEQ ID NO: 709340 - RNA, 22 nt, Human
gagccauacaaccuauaaagug

SEQ ID NO: 709341 - RNA, 22 nt, Human
uccaggcagggcagccaucaag

SEQ ID NO: 709342 - RNA, 22 nt, Human
acagcagacagucggcuuccug

SEQ ID NO: 709343 - RNA, 22 nt, Human
aagcaaggcccagagcaucagc

SEQ ID NO: 709344 - RNA, 19 nt, Human
gugauuucuuuccacaagc

SEQ ID NO: 709345 - RNA, 22 nt, Human
uagauucuuaguuucauagaau

SEQ ID NO: 709346 - RNA, 21 nt, Human
uuucucaccaugguauggaaa

SEQ ID NO: 709347 - RNA, 22 nt, Human
aggccaagauuuuggaucagcu

SEQ ID NO: 709348 - RNA, 22 nt, Human
uucaagcaccaaauuaguaggc

SEQ ID NO: 709349 - RNA, 22 nt, Human
acacaggagaaaagaucuccca

SEQ ID NO: 709350 - RNA, 22 nt, Human
ggagcaaaugccaagugggagg

SEQ ID NO: 709351 - RNA, 20 nt, Human
ucaggcaguggggaaaggca

SEQ ID NO: 709352 - RNA, 23 nt, Human
ucagugugcaagaauggagaagc

SEQ ID NO: 709353 - RNA, 22 nt, Human
guuuagaaaauagugaagcaag

SEQ ID NO: 709354 - RNA, 22 nt, Human
ccaggacacugcuucacagcag

SEQ ID NO: 709355 - RNA, 22 nt, Human
ucuuuaagggauguucugcuuu

SEQ ID NO: 709356 - RNA, 22 nt, Human
uuugucuaauugcaaggcaagu

SEQ ID NO: 709357 - RNA, 22 nt, Human
ggcuuuaaggaguaaaaaugcc

SEQ ID NO: 709358 - RNA, 22 nt, Human
gggccucugugcagaggggccu

SEQ ID NO: 709359 - RNA, 22 nt, Human
ccccagcagacucagggcaggu

SEQ ID NO: 709360 - RNA, 22 nt, Human
ucugagggugggagaaggagcu

SEQ ID NO: 709361 - RNA, 22 nt, Human
ucacagucggugacuucuugcu

SEQ ID NO: 709362 - RNA, 22 nt, Human
cugggggugagcagcagcgacg

SEQ ID NO: 709363 - RNA, 22 nt, Human
uugcagagccaugaggcuggcu

SEQ ID NO: 709364 - RNA, 22 nt, Human
uguauuugaaacagugcauggg

SEQ ID NO: 709365 - RNA, 21 nt, Human
ugacagcacaugcaaucggag

SEQ ID NO: 709366 - RNA, 22 nt, Human
acuuccugcaaucguccacucc

SEQ ID NO: 709367 - RNA, 22 nt, Human
gcagccagccccucugaccucu

SEQ ID NO: 709368 - RNA, 22 nt, Human
aagcuauacaaugcacaaauga

SEQ ID NO: 709369 - RNA, 22 nt, Human
aaaauuauucauggcuuuugga

SEQ ID NO: 709370 - RNA, 22 nt, Human
aagugagugaaaaugcagaaua

SEQ ID NO: 709371 - RNA, 22 nt, Human
uggcugccuagugucugagcag

SEQ ID NO: 709372 - RNA, 22 nt, Human
uuucaguguaagguuuccagga

SEQ ID NO: 709373 - RNA, 22 nt, Human
cuauuacauuucuggacauuca

SEQ ID NO: 709374 - RNA, 22 nt, Human
aaugagaauguaagugaagaga

SEQ ID NO: 709375 - RNA, 22 nt, Human
uaauuucacaguucaacgcaca

SEQ ID NO: 709376 - RNA, 22 nt, Human
cagaggccucacuuccagccag

SEQ ID NO: 709377 - RNA, 22 nt, Human
guaaaucccauccuuucucugg

SEQ ID NO: 709378 - RNA, 22 nt, Human
aggaagagcuggaccagaggac

SEQ ID NO: 709379 - RNA, 22 nt, Human
ucagcaguccuccaggaucaag

SEQ ID NO: 709380 - RNA, 22 nt, Human
uaaagguagugugacauauugu

SEQ ID NO: 709381 - RNA, 22 nt, Human
ugaacaaacugcauucuucacu

SEQ ID NO: 709382 - RNA, 22 nt, Human
auucuacacaacaugaugaugg

SEQ ID NO: 709383 - RNA, 22 nt, Human
ggucccaguccucucccugcua

SEQ ID NO: 709384 - RNA, 22 nt, Human
gagcaggcauucuaguggcuga

SEQ ID NO: 709385 - RNA, 22 nt, Human
ugccugcuagauauccagguga

SEQ ID NO: 709386 - RNA, 22 nt, Human
cccugcccuggagacacuuaaa

SEQ ID NO: 709387 - RNA, 22 nt, Human
uggagccauaacccuuucguac

SEQ ID NO: 709388 - RNA, 23 nt, Human
aaaugacauaugguuucugaagg

SEQ ID NO: 709389 - RNA, 22 nt, Human
ucagagguuacccaugggacag

SEQ ID NO: 709390 - RNA, 22 nt, Human
aaaggccauuacuugcuuuuag

SEQ ID NO: 709391 - RNA, 22 nt, Human
uccugagaaggcacagcuugca

SEQ ID NO: 709392 - RNA, 22 nt, Human
uuagaggggcugcugaauggga

SEQ ID NO: 709393 - RNA, 22 nt, Human
gugcugagugcagagugcagag

SEQ ID NO: 709394 - RNA, 19 nt, Human
uucuccagccugaccugag

SEQ ID NO: 709395 - RNA, 20 nt, Human
uguuucugacgguaggagag

SEQ ID NO: 709396 - RNA, 22 nt, Human
ccagcucuuggugcacuuacau

SEQ ID NO: 709397 - RNA, 22 nt, Human
cuggcuccaaggaagagguuuu

SEQ ID NO: 709398 - RNA, 22 nt, Human
ccccagccuuccaugggaauug

SEQ ID NO: 709399 - RNA, 20 nt, Human
cugcaguccccucugaauca

SEQ ID NO: 709400 - RNA, 22 nt, Human
auggaggaugugcagcaugggc

SEQ ID NO: 709401 - RNA, 22 nt, Human
ugucacaaaaaucaguaauugc

SEQ ID NO: 709402 - RNA, 20 nt, Human
ccugggcuccaggagccccg

SEQ ID NO: 709403 - RNA, 22 nt, Human
aacacugaaaugucuuaagauu

SEQ ID NO: 709404 - RNA, 22 nt, Human
cuaaacaagggauuauaauuga

SEQ ID NO: 709405 - RNA, 22 nt, Human
gacuuugagggauacaaacauu

SEQ ID NO: 709406 - RNA, 22 nt, Human
uggagcuggaauuucugggccu

SEQ ID NO: 709407 - RNA, 22 nt, Human
caguccuuauuccuauauuccu

SEQ ID NO: 709408 - RNA, 22 nt, Human
agaggaucuaagugaguccuca

SEQ ID NO: 709409 - RNA, 22 nt, Human
agcaggcacgcucccugcgcga

SEQ ID NO: 709410 - RNA, 22 nt, Human
agauaugucccugucuaauauu

SEQ ID NO: 709411 - RNA, 20 nt, Human
ucagugauuuugaagaggaa

SEQ ID NO: 709412 - RNA, 22 nt, Human
ggaaaagacagaauucuagaau

SEQ ID NO: 709413 - RNA, 22 nt, Human
ugccauauugcaaagugucugc

SEQ ID NO: 709414 - RNA, 22 nt, Human
ucuguuuugcauaauguucuuu

SEQ ID NO: 709415 - RNA, 22 nt, Human
gaaccugagcgggcagcaagcg

SEQ ID NO: 709416 - RNA, 22 nt, Human
uguauguauacacugaucauca

SEQ ID NO: 709417 - RNA, 22 nt, Human
cucacagaugcugugggucagg

SEQ ID NO: 709418 - RNA, 21 nt, Human
ugcagauaauugaaagcugac

SEQ ID NO: 709419 - RNA, 22 nt, Human
aaaucugggagcagcucggcca

SEQ ID NO: 709420 - RNA, 22 nt, Human
ucuaggagaaccaucagggagg

SEQ ID NO: 709421 - RNA, 22 nt, Human
uggaaugaauuuggcuuccucc

SEQ ID NO: 709422 - RNA, 22 nt, Human
cugccugguacuuuaggcacuu

SEQ ID NO: 709423 - RNA, 22 nt, Human
aaugaacaaaauaugcuuugca

SEQ ID NO: 709424 - RNA, 22 nt, Human
uuuacaacauaggccccaagaa

SEQ ID NO: 709425 - RNA, 22 nt, Human
acccuuccaaaugagcuuauua

SEQ ID NO: 709426 - RNA, 22 nt, Human
auugucuuuaaaaauauacaac

SEQ ID NO: 709427 - RNA, 22 nt, Human
ggcugagguguggggaacuaua

SEQ ID NO: 709428 - RNA, 22 nt, Human
gcagggauugugcagggggcua

SEQ ID NO: 709429 - RNA, 22 nt, Human
gcugucccuugucccaccuugc

SEQ ID NO: 709430 - RNA, 20 nt, Human
aguguauuuggguagagugu

SEQ ID NO: 709431 - RNA, 22 nt, Human
caggcuggacauuagauacaua

SEQ ID NO: 709432 - RNA, 20 nt, Human
aucaaaauccuauugagguu

SEQ ID NO: 709433 - RNA, 22 nt, Human
uuuauauuguaaaaaugguucu

SEQ ID NO: 709434 - RNA, 20 nt, Human
gacuucaauuucuaucuuuu

SEQ ID NO: 709435 - RNA, 22 nt, Human
guggggucucucuguaccuccc

SEQ ID NO: 709436 - RNA, 22 nt, Human
agcccagcuccuccacagaaua

SEQ ID NO: 709437 - RNA, 21 nt, Human
gggcuggaggaugggaagccc

SEQ ID NO: 709438 - RNA, 22 nt, Human
augcuuuacaguuuuccaaaca

SEQ ID NO: 709439 - RNA, 22 nt, Human
caaguccaggugggcaaauaaa

SEQ ID NO: 709440 - RNA, 22 nt, Human
accuuuaugauucacaauguau

SEQ ID NO: 709441 - RNA, 22 nt, Human
uugcuuauuugauuaaaugucu

SEQ ID NO: 709442 - RNA, 22 nt, Human
caucaaauaaagaaauuccuug

SEQ ID NO: 709443 - RNA, 22 nt, Human
ucugauguugaugcuucugccu

SEQ ID NO: 709444 - RNA, 22 nt, Human
uccuugaaugaauguucucucc

SEQ ID NO: 709445 - RNA, 22 nt, Human
ucaggcauggcucuuccucagg

SEQ ID NO: 709446 - RNA, 22 nt, Human
ucauggcaguuuaauaaguggu

SEQ ID NO: 709447 - RNA, 20 nt, Human
cguaaggcaagugcugcauc

SEQ ID NO: 709448 - RNA, 22 nt, Human
agaaugauagcuaguauuuacu

SEQ ID NO: 709449 - RNA, 22 nt, Human
uuuugaaagaguccugcuacag

SEQ ID NO: 709450 - RNA, 22 nt, Human
uacacagaaccugguguacagu

SEQ ID NO: 709451 - RNA, 22 nt, Human
ucauaguucuguuuugaaggau

SEQ ID NO: 709452 - RNA, 22 nt, Human
uugcuuuacggcaaggccccag

SEQ ID NO: 709453 - RNA, 22 nt, Human
gguaaauuuuaugugaugaaac

SEQ ID NO: 709454 - RNA, 22 nt, Human
uacacugaagugucuugguaua

SEQ ID NO: 709455 - RNA, 22 nt, Human
uucuaaagacucauggaagugg

SEQ ID NO: 709456 - RNA, 22 nt, Human
agggaagcuuguuacugagaag

SEQ ID NO: 709457 - RNA, 22 nt, Human
uguuaugaacuucuagaaaaca

SEQ ID NO: 709458 - RNA, 22 nt, Human
uuuacacauuauuuucagugug

SEQ ID NO: 709459 - RNA, 22 nt, Human
cauauuuauucuucugccagug

SEQ ID NO: 709460 - RNA, 20 nt, Human
uggaagacacugaagggcca

SEQ ID NO: 709461 - RNA, 22 nt, Human
uguaaacagccccauggagagc

SEQ ID NO: 709462 - RNA, 22 nt, Human
ccugcagacacuuguccagcaa

SEQ ID NO: 709463 - RNA, 22 nt, Human
agagggggaaaauagagguguu

SEQ ID NO: 709464 - RNA, 22 nt, Human
cauuuagagucuugcaauuuua

SEQ ID NO: 709465 - RNA, 22 nt, Human
ucagggaccccucugaguggag

SEQ ID NO: 709466 - RNA, 23 nt, Human
ggagccuccggugugugagaggc

SEQ ID NO: 709467 - RNA, 22 nt, Human
aguggcuucauuucugccagaa

SEQ ID NO: 709468 - RNA, 22 nt, Human
aaggcaguagguguuucaaacu

SEQ ID NO: 709469 - RNA, 22 nt, Human
cauaacauuaagccucuauuuc

SEQ ID NO: 709470 - RNA, 22 nt, Human
cagccccuuguccgguagccac

SEQ ID NO: 709471 - RNA, 22 nt, Human
agugucuuucucucuccaagug

SEQ ID NO: 709472 - RNA, 22 nt, Human
auucacacuuuacuucuuucca

SEQ ID NO: 709473 - RNA, 22 nt, Human
aaaucagaaaauauggagagga

SEQ ID NO: 709474 - RNA, 22 nt, Human
auuuuacuaaguggauaucugu

SEQ ID NO: 709475 - RNA, 22 nt, Human
cuuugugucuguuaauaauuau

SEQ ID NO: 709476 - RNA, 22 nt, Human
auggcucuagaauaccccucag

SEQ ID NO: 709477 - RNA, 22 nt, Human
uccugcuggacucugaguacaa

SEQ ID NO: 709478 - RNA, 22 nt, Human
ucagccagagggggcaaaggaa

SEQ ID NO: 709479 - RNA, 22 nt, Human
ccuggcacaucuaacucacucu

SEQ ID NO: 709480 - RNA, 22 nt, Human
uacaguuucucauuaugcucuc

SEQ ID NO: 709481 - RNA, 22 nt, Human
ggcacagggugauguugcaguu

SEQ ID NO: 709482 - RNA, 22 nt, Human
cucagggaggccucugcugguu

SEQ ID NO: 709483 - RNA, 19 nt, Human
agucagguggcuggugcca

SEQ ID NO: 709484 - RNA, 22 nt, Human
agugucugaaggauuuggcuuc

SEQ ID NO: 709485 - RNA, 22 nt, Human
agaagccaauccuugucucucu

SEQ ID NO: 709486 - RNA, 22 nt, Human
ccucccuuuuggugucugcaua

SEQ ID NO: 709487 - RNA, 22 nt, Human
cacacugucuuucagaaugguu

SEQ ID NO: 709488 - RNA, 22 nt, Human
uuucuugauuagcuguggcuca

SEQ ID NO: 709489 - RNA, 22 nt, Human
ucaaaacaaucauuggaugugc

SEQ ID NO: 709490 - RNA, 22 nt, Human
gugcaaaaguacuugcggauuu

SEQ ID NO: 709491 - RNA, 22 nt, Human
gcuacaggagauaaaggccucu

SEQ ID NO: 709492 - RNA, 22 nt, Human
agagguagagguugcagugagc

SEQ ID NO: 709493 - RNA, 22 nt, Human
auuguacagacaugggaaacaa

SEQ ID NO: 709494 - RNA, 22 nt, Human
caugaacaauuugcucacugau

SEQ ID NO: 709495 - RNA, 22 nt, Human
aauagauggguuaaacagcaaa

SEQ ID NO: 709496 - RNA, 22 nt, Human
ucauucugcaucacucuugcuc

SEQ ID NO: 709497 - RNA, 22 nt, Human
uagcaucucaaccuccugaaag

SEQ ID NO: 709498 - RNA, 22 nt, Human
caguuuuaucaucugugaaaug

SEQ ID NO: 709499 - RNA, 22 nt, Human
ccucaggaaccacauugcugcu

SEQ ID NO: 709500 - RNA, 22 nt, Human
gaggcagcaugguaccuuggag

SEQ ID NO: 709501 - RNA, 22 nt, Human
uccugcaggcuugaguccucag

SEQ ID NO: 709502 - RNA, 22 nt, Human
uguuacuuaucucacgugaugc

SEQ ID NO: 709503 - RNA, 22 nt, Human
cugugccaccugagggacucua

SEQ ID NO: 709504 - RNA, 22 nt, Human
agcuggugauguggucccucac

SEQ ID NO: 709505 - RNA, 22 nt, Human
acugggguuuaggccugggcaa

SEQ ID NO: 709506 - RNA, 22 nt, Human
ucucugugagaugccuuccuga

SEQ ID NO: 709507 - RNA, 22 nt, Human
ccacaucucgguccccucuuug

SEQ ID NO: 709508 - RNA, 22 nt, Human
cacaguggauugggugaugccc

SEQ ID NO: 709509 - RNA, 22 nt, Human
gcaagagacuuuuaugucugcc

SEQ ID NO: 709510 - RNA, 22 nt, Human
gccugagggcuccuagcaggcu

SEQ ID NO: 709511 - RNA, 22 nt, Human
uauuuugagguauuuuugagcu

SEQ ID NO: 709512 - RNA, 22 nt, Human
gagucagguuucugccuauaga

SEQ ID NO: 709513 - RNA, 22 nt, Human
gagauccuguaggcagcuaaga

SEQ ID NO: 709514 - RNA, 22 nt, Human
gagguccaggguggggccugag

SEQ ID NO: 709515 - RNA, 16 nt, Human
uggcacagagcagaua

SEQ ID NO: 709516 - RNA, 22 nt, Human
ucccacugcuuugcucugcuca

SEQ ID NO: 709517 - RNA, 22 nt, Human
auacagguggacuucaguuagu

SEQ ID NO: 709518 - RNA, 22 nt, Human
uuuagcaauuauuaaggguuga

SEQ ID NO: 709519 - RNA, 22 nt, Human
cuuugggauuucaugagagcua

SEQ ID NO: 709520 - RNA, 22 nt, Human
uuucagacucagaacuuagcaa

SEQ ID NO: 709521 - RNA, 22 nt, Human
uauacagaacugcacgugcacg

SEQ ID NO: 709522 - RNA, 22 nt, Human
uacaguguuucccccaggauag

SEQ ID NO: 709523 - RNA, 22 nt, Human
ucacagagagguuaagcaguug

SEQ ID NO: 709524 - RNA, 22 nt, Human
gacaugaauguuauacuuuauu

SEQ ID NO: 709525 - RNA, 21 nt, Human
uucauugaacuauuuguggag

SEQ ID NO: 709526 - RNA, 22 nt, Human
guuauuaaaguauuugauguua

SEQ ID NO: 709527 - RNA, 18 nt, Human
aaugcacacauuuacucc

SEQ ID NO: 709528 - RNA, 22 nt, Human
cugaagcaaaugaaacagcucu

SEQ ID NO: 709529 - RNA, 22 nt, Human
uuguaugcugaucaaaagcuuc

SEQ ID NO: 709530 - RNA, 22 nt, Human
ucaggcagaggauggggagcgu

SEQ ID NO: 709531 - RNA, 22 nt, Human
aaagccaguuucuggaaguacc

SEQ ID NO: 709532 - RNA, 22 nt, Human
cucugggaccacgugacucugc

SEQ ID NO: 709533 - RNA, 22 nt, Human
acaaaugcaaguuuuaugucaa

SEQ ID NO: 709534 - RNA, 22 nt, Human
ggaagaggcucucauugagggc

SEQ ID NO: 709535 - RNA, 22 nt, Human
aaggaagaggcagguuuugcug

SEQ ID NO: 709536 - RNA, 22 nt, Human
ccuccuuccugggacagagcug

SEQ ID NO: 709537 - RNA, 22 nt, Human
agcuugggugugccugcgagcu

SEQ ID NO: 709538 - RNA, 22 nt, Human
uggcccaaagcagcccagcagg

SEQ ID NO: 709539 - RNA, 22 nt, Human
ucagguccccaacucuucucac

SEQ ID NO: 709540 - RNA, 22 nt, Human
ucuacauuuucuuuauguacau

SEQ ID NO: 709541 - RNA, 22 nt, Human
gccagguggcugagugacugag

SEQ ID NO: 709542 - RNA, 22 nt, Human
acccaggaggcagagguugcag

SEQ ID NO: 709543 - RNA, 22 nt, Human
augcacuaugaugagcuagucu

SEQ ID NO: 709544 - RNA, 22 nt, Human
ccuaugccugucacucugcgcu

SEQ ID NO: 709545 - RNA, 22 nt, Human
caguucuuauuuggccaguguc

SEQ ID NO: 709546 - RNA, 22 nt, Human
acuguucauuuggauuucucug

SEQ ID NO: 709547 - RNA, 19 nt, Human
aggguggcaaaggagggug

SEQ ID NO: 709548 - RNA, 22 nt, Human
aaacacugguaugauguauagu

SEQ ID NO: 709549 - RNA, 22 nt, Human
ccaaagagcuagaauuauaggc

SEQ ID NO: 709550 - RNA, 22 nt, Human
uucugucuucucgguuguuuac

SEQ ID NO: 709551 - RNA, 22 nt, Human
uuuuccuguuaaaucugggcac

SEQ ID NO: 709552 - RNA, 22 nt, Human
ggaaggagccauaucauaucca

SEQ ID NO: 709553 - RNA, 22 nt, Human
gucagcuucccuuugguuuauu

SEQ ID NO: 709554 - RNA, 22 nt, Human
ggcauccaguucugaucaacaa

SEQ ID NO: 709555 - RNA, 22 nt, Human
guccagagaggcaggaggcuac

SEQ ID NO: 709556 - RNA, 22 nt, Human
aauggcuuacccuggauugugu

SEQ ID NO: 709557 - RNA, 22 nt, Human
gggcgcagccaauccuggcccu

SEQ ID NO: 709558 - RNA, 22 nt, Human
ugcuucuuuaaaugauagucaa

SEQ ID NO: 709559 - RNA, 22 nt, Human
gcuguaugaguucauguguaga

SEQ ID NO: 709560 - RNA, 22 nt, Human
uacauguucaaauuugucuuuc

SEQ ID NO: 709561 - RNA, 22 nt, Human
aaucuggcucagaagaagauga

SEQ ID NO: 709562 - RNA, 21 nt, Human
acccuuuguuuaugaaucagc

SEQ ID NO: 709563 - RNA, 22 nt, Human
ugauuuccaauaaggagaaugu

SEQ ID NO: 709564 - RNA, 22 nt, Human
cagaggcagaauggagauuugg

SEQ ID NO: 709565 - RNA, 22 nt, Human
uuggcaggaauauugcagaggu

SEQ ID NO: 709566 - RNA, 22 nt, Human
ugucuauguauacauguguaua

SEQ ID NO: 709567 - RNA, 22 nt, Human
ucuucagagacucugagccccu

SEQ ID NO: 709568 - RNA, 22 nt, Human
uccuggccuagcucacccugga

SEQ ID NO: 709569 - RNA, 22 nt, Human
acacauaagccuaaucaucucc

SEQ ID NO: 709570 - RNA, 22 nt, Human
cugcugccuuccaaaggccagg

SEQ ID NO: 709571 - RNA, 22 nt, Human
uaauugcuaaaugaaggagaag

SEQ ID NO: 709572 - RNA, 22 nt, Human
gucccauaaguagugcaacuug

SEQ ID NO: 709573 - RNA, 19 nt, Human
acccucucuguagaaagau

SEQ ID NO: 709574 - RNA, 22 nt, Human
ucugccuuucacacagacggcc

SEQ ID NO: 709575 - RNA, 22 nt, Human
uucuguuuccugccuucccauu

SEQ ID NO: 709576 - RNA, 22 nt, Human
gcacacagcuagauuaccauuc

SEQ ID NO: 709577 - RNA, 23 nt, Human
agagaaucauggaaacucuuucu

SEQ ID NO: 709578 - RNA, 22 nt, Human
ugugauuacugaauagaaaaua

SEQ ID NO: 709579 - RNA, 22 nt, Human
acacauauguaugcaucaugug

SEQ ID NO: 709580 - RNA, 22 nt, Human
ggcaggcuccagagcccucucc

SEQ ID NO: 709581 - RNA, 21 nt, Human
ucacaggcucagggagagagu

SEQ ID NO: 709582 - RNA, 22 nt, Human
auaaccuggauauaaacagaug

SEQ ID NO: 709583 - RNA, 22 nt, Human
ugaaauguugccaugaggucuc

SEQ ID NO: 709584 - RNA, 19 nt, Human
gcaggccaggaggcggagg

SEQ ID NO: 709585 - RNA, 22 nt, Human
uuauugggucccaacaaguugc

SEQ ID NO: 709586 - RNA, 22 nt, Human
cuggcuguaagcguguuuccua

SEQ ID NO: 709587 - RNA, 22 nt, Human
aaggccacuuuaccuuaaaucc

SEQ ID NO: 709588 - RNA, 22 nt, Human
ucccaggguuacagccagggca

SEQ ID NO: 709589 - RNA, 23 nt, Human
uuucauaugguguggaugaagaa

SEQ ID NO: 709590 - RNA, 22 nt, Human
cacaaaugguuguagacauuaa

SEQ ID NO: 709591 - RNA, 22 nt, Human
gucuaaacuuuacagagucaag

SEQ ID NO: 709592 - RNA, 22 nt, Human
aagugccugggcaacauagcaa

SEQ ID NO: 709593 - RNA, 22 nt, Human
gcacugcagguggguggagagg

SEQ ID NO: 709594 - RNA, 22 nt, Human
gaaggcacccuccaucacucac

SEQ ID NO: 709595 - RNA, 22 nt, Human
agaacagucguggugagagaaa

SEQ ID NO: 709596 - RNA, 22 nt, Human
aggagcagaacugauucugacu

SEQ ID NO: 709597 - RNA, 22 nt, Human
uagcacauuguugaccagaagg

SEQ ID NO: 709598 - RNA, 22 nt, Human
uugcaaauuaaagaggauagca

SEQ ID NO: 709599 - RNA, 22 nt, Human
agucuucuugaucuuuucagug

SEQ ID NO: 709600 - RNA, 22 nt, Human
acucucccugagagggaggcau

SEQ ID NO: 709601 - RNA, 22 nt, Human
ccacugucugcaggccucagca

SEQ ID NO: 709602 - RNA, 22 nt, Human
cagcaaaguaagcugacaugua

SEQ ID NO: 709603 - RNA, 22 nt, Human
ucacaugucacaaaacacugcc

SEQ ID NO: 709604 - RNA, 22 nt, Human
aaauguauccuacuuccugagu

SEQ ID NO: 709605 - RNA, 22 nt, Human
caggccuggagugcaauggcac

SEQ ID NO: 709606 - RNA, 22 nt, Human
ggccgggcaggucucagccagc

SEQ ID NO: 709607 - RNA, 22 nt, Human
uagcaaggugaaguauggguga

SEQ ID NO: 709608 - RNA, 22 nt, Human
gcuguccaugucuggccucagu

SEQ ID NO: 709609 - RNA, 22 nt, Human
agagacuguacguggcaaguau

SEQ ID NO: 709610 - RNA, 22 nt, Human
ccucucccacguggcagaggcu

SEQ ID NO: 709611 - RNA, 22 nt, Human
ucagccagaaagugauuuucag

SEQ ID NO: 709612 - RNA, 22 nt, Human
ucauggcuugcagauggccacc

SEQ ID NO: 709613 - RNA, 22 nt, Human
auguggcuguggacaccuuuca

SEQ ID NO: 709614 - RNA, 22 nt, Human
ggcaggagggcggacaaugacc

SEQ ID NO: 709615 - RNA, 22 nt, Human
ccaaaugcuccacugacuuugg

SEQ ID NO: 709616 - RNA, 22 nt, Human
gcugcccugucugcagcaggac

SEQ ID NO: 709617 - RNA, 22 nt, Human
auuacaaaagaagggagaaggu

SEQ ID NO: 709618 - RNA, 22 nt, Human
uaaauagaaucuaaacugcuca

SEQ ID NO: 709619 - RNA, 18 nt, Human
ugcuggguaacuguaugg

SEQ ID NO: 709620 - RNA, 22 nt, Human
agcagccccucggcgggugcgc

SEQ ID NO: 709621 - RNA, 22 nt, Human
guggccuccuccguccgccucu

SEQ ID NO: 709622 - RNA, 22 nt, Human
ucccucaggugguucuuguuuc

SEQ ID NO: 709623 - RNA, 22 nt, Human
gcuuccagacgaucauguaaga

SEQ ID NO: 709624 - RNA, 20 nt, Human
aucagaagugauauuaacca

SEQ ID NO: 709625 - RNA, 22 nt, Human
aaggcccucaugcgucagagcc

SEQ ID NO: 709626 - RNA, 22 nt, Human
agcagccaggaaucugcagagc

SEQ ID NO: 709627 - RNA, 22 nt, Human
gucaggaucucccaguacauau

SEQ ID NO: 709628 - RNA, 22 nt, Human
augccacauaaccaguucacuu

SEQ ID NO: 709629 - RNA, 22 nt, Human
ugagcaccuaccuuguccagug

SEQ ID NO: 709630 - RNA, 22 nt, Human
augcauaugcauggacacucag

SEQ ID NO: 709631 - RNA, 22 nt, Human
gggcucucaugaguguguggua

SEQ ID NO: 709632 - RNA, 22 nt, Human
cagcaucucguggcuggauaga

SEQ ID NO: 709633 - RNA, 22 nt, Human
cugggacuuuguaggccaguug

SEQ ID NO: 709634 - RNA, 22 nt, Human
cugagagugcucuuugauguca

SEQ ID NO: 709635 - RNA, 22 nt, Human
cacagaguggaggcuuggccug

SEQ ID NO: 709636 - RNA, 22 nt, Human
gagcaacacgcaguaguauacg

SEQ ID NO: 709637 - RNA, 22 nt, Human
cuuauacacccucuucccaggc

SEQ ID NO: 709638 - RNA, 22 nt, Human
agcaaauaauugucuuugaggg

SEQ ID NO: 709639 - RNA, 16 nt, Human
gccuggaguggcaggg

SEQ ID NO: 709640 - RNA, 22 nt, Human
uucuggcugaaaguuuauuuga

SEQ ID NO: 709641 - RNA, 22 nt, Human
cacagggaguuacagaagcacu

SEQ ID NO: 709642 - RNA, 22 nt, Human
ugaauauggcaacucuuguaac

SEQ ID NO: 709643 - RNA, 22 nt, Human
auucacaguucauuagcuguaa

SEQ ID NO: 709644 - RNA, 22 nt, Human
uccuuccaugguggggcugcuu

SEQ ID NO: 709645 - RNA, 22 nt, Human
ccugggcaauauagugaggccc

SEQ ID NO: 709646 - RNA, 22 nt, Human
auggcugccuagaggugagaug

SEQ ID NO: 709647 - RNA, 23 nt, Human
aaugacagugugugauugaagaa

SEQ ID NO: 709648 - RNA, 22 nt, Human
aagacaaugcauuacuaagaag

SEQ ID NO: 709649 - RNA, 22 nt, Human
agaauaguggcaaugacugcac

SEQ ID NO: 709650 - RNA, 22 nt, Human
uuuguuuacaaaaauaagcagu

SEQ ID NO: 709651 - RNA, 22 nt, Human
aggucauuccagccauuccccu

SEQ ID NO: 709652 - RNA, 22 nt, Human
gcaaacaagcugccugaagauu

SEQ ID NO: 709653 - RNA, 23 nt, Human
cccagcuggaaguuagaggacca

SEQ ID NO: 709654 - RNA, 22 nt, Human
gagggcagagucuaaugaugca

SEQ ID NO: 709655 - RNA, 22 nt, Human
ggucuccauuccuucaucucac

SEQ ID NO: 709656 - RNA, 22 nt, Human
aguuauuuacuccuuugucucu

SEQ ID NO: 709657 - RNA, 22 nt, Human
gagcagcuguccccaaagcuuc

SEQ ID NO: 709658 - RNA, 22 nt, Human
cuuuacugaagugaagaccugg

SEQ ID NO: 709659 - RNA, 22 nt, Human
cccuggaggcggagcuugcagu

SEQ ID NO: 709660 - RNA, 22 nt, Human
ucaguccucacuugguucuaag

SEQ ID NO: 709661 - RNA, 22 nt, Human
gaggcucagagggagcaugguc

SEQ ID NO: 709662 - RNA, 22 nt, Human
agcggcugucggccagccggag

SEQ ID NO: 709663 - RNA, 22 nt, Human
ggcucaggccuguaauccuagc

SEQ ID NO: 709664 - RNA, 22 nt, Human
auaguuuuauagauauugugua

SEQ ID NO: 709665 - RNA, 16 nt, Human
gcuccugggcccucga

SEQ ID NO: 709666 - RNA, 22 nt, Human
ggcuggcauccagggaaaucca

SEQ ID NO: 709667 - RNA, 22 nt, Human
ucuucagaaaauuaucacuugu

SEQ ID NO: 709668 - RNA, 18 nt, Human
cugucccauccucagguu

SEQ ID NO: 709669 - RNA, 22 nt, Human
gcagcaagucuaguuuguaggc

SEQ ID NO: 709670 - RNA, 22 nt, Human
uuguucaugguuguaaguuuga

SEQ ID NO: 709671 - RNA, 22 nt, Human
cagaggucuccaucacccuccu

SEQ ID NO: 709672 - RNA, 22 nt, Human
cuucaguuaguuucaugugagc

SEQ ID NO: 709673 - RNA, 22 nt, Human
ugagagauugcuguauguuuug

SEQ ID NO: 709674 - RNA, 22 nt, Human
uuggcugaccagaaccugcccc

SEQ ID NO: 709675 - RNA, 22 nt, Human
aggccaggauagcauggaucag

SEQ ID NO: 709676 - RNA, 22 nt, Human
ucuguacaguaccagauaguaa

SEQ ID NO: 709677 - RNA, 22 nt, Human
gaccacagaagccuugauaggg

SEQ ID NO: 709678 - RNA, 22 nt, Human
acagauguuagcaaugaugaug

SEQ ID NO: 709679 - RNA, 20 nt, Human
uccuaacuauaaaguggcuc

SEQ ID NO: 709680 - RNA, 22 nt, Human
agugaguggagagcucuagguu

SEQ ID NO: 709681 - RNA, 22 nt, Human
aaauugaaugauuaagugguga

SEQ ID NO: 709682 - RNA, 22 nt, Human
gcucacagagggugcuuaauac

SEQ ID NO: 709683 - RNA, 22 nt, Human
ucagagagcagaacuuuuuuac

SEQ ID NO: 709684 - RNA, 22 nt, Human
acaaaacaguguuccugccccu

SEQ ID NO: 709685 - RNA, 22 nt, Human
aggaagaaaacuaauuagaugg

SEQ ID NO: 709686 - RNA, 22 nt, Human
ggcacugauuccauucaugaag

SEQ ID NO: 709687 - RNA, 22 nt, Human
ucaggaggucugcugcggggug

SEQ ID NO: 709688 - RNA, 22 nt, Human
ccaggguuggcaagcaaggcuu

SEQ ID NO: 709689 - RNA, 22 nt, Human
gccucugggguggagcccagca

SEQ ID NO: 709690 - RNA, 22 nt, Human
aucuggaaaacacaguguagac

SEQ ID NO: 709691 - RNA, 22 nt, Human
cugggcugucccagggcggcag

SEQ ID NO: 709692 - RNA, 23 nt, Human
cagggcccugcucaauuucucca

SEQ ID NO: 709693 - RNA, 22 nt, Human
uccccucugguugacccaggag

SEQ ID NO: 709694 - RNA, 22 nt, Human
gacacagagacuugcaguugua

SEQ ID NO: 709695 - RNA, 22 nt, Human
aacauucaaguucugguuuaug

SEQ ID NO: 709696 - RNA, 22 nt, Human
cuggcaggcggcagagcccagg

SEQ ID NO: 709697 - RNA, 22 nt, Human
agagcaaauagagaagccagcu

SEQ ID NO: 709698 - RNA, 22 nt, Human
agcaauauuucagcuagcaggu

SEQ ID NO: 709699 - RNA, 22 nt, Human
gcuuccaggucauucucacccu

SEQ ID NO: 709700 - RNA, 22 nt, Human
uuuuguuuguguccacugcagu

SEQ ID NO: 709701 - RNA, 22 nt, Human
ggguggcuccuaugggcauagc

SEQ ID NO: 709702 - RNA, 22 nt, Human
gaggacgggcuucauggggccu

SEQ ID NO: 709703 - RNA, 22 nt, Human
gggagucagagagguaauggga

SEQ ID NO: 709704 - RNA, 22 nt, Human
auggaacaggcucagagaugcu

SEQ ID NO: 709705 - RNA, 22 nt, Human
ccucagagaaagguauggcuga

SEQ ID NO: 709706 - RNA, 22 nt, Human
cuggagccccagacagggagag

SEQ ID NO: 709707 - RNA, 22 nt, Human
acaucuaagccaauuuugauuu

SEQ ID NO: 709708 - RNA, 22 nt, Human
ccuaaguauuuucaguguuaac

SEQ ID NO: 709709 - RNA, 21 nt, Human
gcuauacagaauggccagagg

SEQ ID NO: 709710 - RNA, 22 nt, Human
uuccaggaaaacaguuggaagu

SEQ ID NO: 709711 - RNA, 22 nt, Human
auggauaacccaguucauuucu

SEQ ID NO: 709712 - RNA, 22 nt, Human
uuuaaagaaauuccucaucuuu

SEQ ID NO: 709713 - RNA, 22 nt, Human
ucugggaaugaggcccagcgau

SEQ ID NO: 709714 - RNA, 22 nt, Human
ugcaagacgugaaauugagaca

SEQ ID NO: 709715 - RNA, 22 nt, Human
auccaucccaucuucaccaggg

SEQ ID NO: 709716 - RNA, 19 nt, Human
agagucggggggacauagg

SEQ ID NO: 709717 - RNA, 22 nt, Human
gucuucuuuaaccuacuaaagc

SEQ ID NO: 709718 - RNA, 22 nt, Human
guuuuacaagguuaaucagcag

SEQ ID NO: 709719 - RNA, 23 nt, Human
gccuggguuguaacuagugcauc

SEQ ID NO: 709720 - RNA, 22 nt, Human
cagguggggcgcccucaggcag

SEQ ID NO: 709721 - RNA, 22 nt, Human
uaaucuguauuccuacuuugca

SEQ ID NO: 709722 - RNA, 22 nt, Human
cugcuuuguguggucccuccag

SEQ ID NO: 709723 - RNA, 22 nt, Human
agaggucucaguuauguuuaaa

SEQ ID NO: 709724 - RNA, 22 nt, Human
cccauggagugccugagggcca

SEQ ID NO: 709725 - RNA, 22 nt, Human
ccccacccaccuaagagaaacu

SEQ ID NO: 709726 - RNA, 22 nt, Human
caugauacuugaauuuggaagg

SEQ ID NO: 709727 - RNA, 22 nt, Human
ugccauagcaaugguaagcuga

SEQ ID NO: 709728 - RNA, 19 nt, Human
ucuguaacacucuagccuu

SEQ ID NO: 709729 - RNA, 17 nt, Human
guguaacuaugagccau

SEQ ID NO: 709730 - RNA, 23 nt, Human
uucaugaguuggacaagacuggg

SEQ ID NO: 709731 - RNA, 22 nt, Human
augcaggggcagcagagccugg

SEQ ID NO: 709732 - RNA, 22 nt, Human
auuucuccuccagauggugguu

SEQ ID NO: 709733 - RNA, 22 nt, Human
ggaucuggggcucugcugcuca

SEQ ID NO: 709734 - RNA, 22 nt, Human
aaguggggccuggugguacagu

SEQ ID NO: 709735 - RNA, 22 nt, Human
agucuuuaacauuuggagauug

SEQ ID NO: 709736 - RNA, 22 nt, Human
gagcacauguggagagucuggg

SEQ ID NO: 709737 - RNA, 22 nt, Human
aggacaagacaaggaccagaga

SEQ ID NO: 709738 - RNA, 23 nt, Human
uuacagcuaacugcuguuauuag

SEQ ID NO: 709739 - RNA, 22 nt, Human
acacuguguggucucucucgga

SEQ ID NO: 709740 - RNA, 22 nt, Human
gccagggcugugcagguuuguu

SEQ ID NO: 709741 - RNA, 22 nt, Human
acauauuaacugcacuacacua

SEQ ID NO: 709742 - RNA, 22 nt, Human
gaggggaugcagagaggcuuau

SEQ ID NO: 709743 - RNA, 22 nt, Human
auuuugcugugguacauuagga

SEQ ID NO: 709744 - RNA, 22 nt, Human
auuuauuauugugguuacuucu

SEQ ID NO: 709745 - RNA, 22 nt, Human
uccugcuuccuugucuuuagac

SEQ ID NO: 709746 - RNA, 22 nt, Human
uucaaagauaauguagcauuuu

SEQ ID NO: 709747 - RNA, 22 nt, Human
aacagugagaagguggacagga

SEQ ID NO: 709748 - RNA, 22 nt, Human
gcagagugccgagauggaagcg

SEQ ID NO: 709749 - RNA, 22 nt, Human
gcagggcacaaggacgcacagg

SEQ ID NO: 709750 - RNA, 22 nt, Human
uaucugauacaacagaauaaca

SEQ ID NO: 709751 - RNA, 22 nt, Human
ugacagugagcuugggguacuu

SEQ ID NO: 709752 - RNA, 22 nt, Human
ucuaccacuuauuagcucugug

SEQ ID NO: 709753 - RNA, 22 nt, Human
ucuaaagaagaggguucugcgg

SEQ ID NO: 709754 - RNA, 22 nt, Human
uaaucuguuucccaaggugaua

SEQ ID NO: 709755 - RNA, 22 nt, Human
aggcagcguagcaaggcuagua

SEQ ID NO: 709756 - RNA, 23 nt, Human
aguguuaaauuucgcaccuaaau

SEQ ID NO: 709757 - RNA, 22 nt, Human
gaaagaaucaacuaugucucug

SEQ ID NO: 709758 - RNA, 21 nt, Human
ucagaagugcagcccaggaau

SEQ ID NO: 709759 - RNA, 22 nt, Human
cugcugggggacacagguccgg

SEQ ID NO: 709760 - RNA, 22 nt, Human
agagcauccaucggccaggacc

SEQ ID NO: 709761 - RNA, 22 nt, Human
acaauggcaugcuagcaaaugg

SEQ ID NO: 709762 - RNA, 22 nt, Human
uggcacaggaucucagcggcca

SEQ ID NO: 709763 - RNA, 22 nt, Human
cccugggauugccuuggccuug

SEQ ID NO: 709764 - RNA, 22 nt, Human
agagcuguuugucuagagagug

SEQ ID NO: 709765 - RNA, 22 nt, Human
aaggucucaaguuuuccaaagu

SEQ ID NO: 709766 - RNA, 22 nt, Human
gugucugcugcacccucacacc

SEQ ID NO: 709767 - RNA, 22 nt, Human
gagagaccucagaaacaaucua

SEQ ID NO: 709768 - RNA, 22 nt, Human
gcaggcagagaaggaacauuua

SEQ ID NO: 709769 - RNA, 23 nt, Human
ucagugauguugaaccuagcagu

SEQ ID NO: 709770 - RNA, 22 nt, Human
aacagaauaguugauguacagu

SEQ ID NO: 709771 - RNA, 22 nt, Human
aacucaguucuuuccacaaugc

SEQ ID NO: 709772 - RNA, 20 nt, Human
gcacugaaauucaauguuug

SEQ ID NO: 709773 - RNA, 22 nt, Human
gaugcagaaaguagacaccauc

SEQ ID NO: 709774 - RNA, 17 nt, Human
gcugccaccuuuggagc

SEQ ID NO: 709775 - RNA, 22 nt, Human
aacugcauuuaacaaauacucu

SEQ ID NO: 709776 - RNA, 22 nt, Human
uuaauugguaaccucuggacua

SEQ ID NO: 709777 - RNA, 22 nt, Human
agcuauaguacuuggcuuuucu

SEQ ID NO: 709778 - RNA, 20 nt, Human
acacaguagcaauuagugca

SEQ ID NO: 709779 - RNA, 22 nt, Human
gcuucuggaagcauaugcaaga

SEQ ID NO: 709780 - RNA, 22 nt, Human
caguuuauaugucagagcugua

SEQ ID NO: 709781 - RNA, 22 nt, Human
aagcucagugaugccuccaggg

SEQ ID NO: 709782 - RNA, 22 nt, Human
cugagggcagugaugaagguga

SEQ ID NO: 709783 - RNA, 22 nt, Human
ggggggcagcuguccuggccau

SEQ ID NO: 709784 - RNA, 22 nt, Human
uucaguguucuuuucuguuagc

SEQ ID NO: 709785 - RNA, 22 nt, Human
ucccagaagagaugccacuuga

SEQ ID NO: 709786 - RNA, 22 nt, Human
cugugucucuccuuacaagacu

SEQ ID NO: 709787 - RNA, 22 nt, Human
auuucagagugagagugcucaa

SEQ ID NO: 709788 - RNA, 22 nt, Human
agcuccugcacccagccuugag

SEQ ID NO: 709789 - RNA, 22 nt, Human
gugcaggguagcgacggcagga

SEQ ID NO: 709790 - RNA, 22 nt, Human
caaauagacuuaagcaucugua

SEQ ID NO: 709791 - RNA, 21 nt, Human
ucauucgauuuccucuaucuc

SEQ ID NO: 709792 - RNA, 22 nt, Human
gccagccaguuugcugauggcu

SEQ ID NO: 709793 - RNA, 22 nt, Human
ucccuagguccuagucacagua

SEQ ID NO: 709794 - RNA, 22 nt, Human
augugacaauauuuggucuuau

SEQ ID NO: 709795 - RNA, 19 nt, Human
uggcagacacaccuucuuc

SEQ ID NO: 709796 - RNA, 20 nt, Human
ugcauuuguuauuuguacuc

SEQ ID NO: 709797 - RNA, 22 nt, Human
agaaauacugccuaagacugua

SEQ ID NO: 709798 - RNA, 22 nt, Human
uacagccacaggugacucucau

SEQ ID NO: 709799 - RNA, 22 nt, Human
uacuucaauuauaugccaguua

SEQ ID NO: 709800 - RNA, 22 nt, Human
uuuacaugaguagcagauguuc

SEQ ID NO: 709801 - RNA, 22 nt, Human
ucagcuggugaguggauagaca

SEQ ID NO: 709802 - RNA, 21 nt, Human
agaggccuuacaggauagacc

SEQ ID NO: 709803 - RNA, 22 nt, Human
cacauuugaaggaauuagcauu

SEQ ID NO: 709804 - RNA, 22 nt, Human
ccaaaggccaagcucagguaaa

SEQ ID NO: 709805 - RNA, 22 nt, Human
cugguggagggacaggcuuagc

SEQ ID NO: 709806 - RNA, 22 nt, Human
ugaccccacugugcucagaggu

SEQ ID NO: 709807 - RNA, 22 nt, Human
uacaaagagguaauugcauaua

SEQ ID NO: 709808 - RNA, 22 nt, Human
gcucaggagcucuugguggcgc

SEQ ID NO: 709809 - RNA, 22 nt, Human
ggcugguguuacagucggcagc

SEQ ID NO: 709810 - RNA, 22 nt, Human
gccugggagugcacagugaggu

SEQ ID NO: 709811 - RNA, 22 nt, Human
gcagauggugccaugucuugug

SEQ ID NO: 709812 - RNA, 22 nt, Human
cuuuagaaaucuggauguauuu

SEQ ID NO: 709813 - RNA, 22 nt, Human
uaggccuucggugugugcuugg

SEQ ID NO: 709814 - RNA, 22 nt, Human
aucuggcuggauucuuagcguu

SEQ ID NO: 709815 - RNA, 22 nt, Human
gagggguguggagccaucaguu

SEQ ID NO: 709816 - RNA, 22 nt, Human
ccagagcugauuccugggacuu

SEQ ID NO: 709817 - RNA, 22 nt, Human
ccagggagcccacaggacaaug

SEQ ID NO: 709818 - RNA, 22 nt, Human
cagcugaagguaggaaccagga

SEQ ID NO: 709819 - RNA, 20 nt, Human
gggugaggauggagaauuug

SEQ ID NO: 709820 - RNA, 22 nt, Human
ucacuguagagucuguuuccac

SEQ ID NO: 709821 - RNA, 22 nt, Human
cacuggaaccauccacauagug

SEQ ID NO: 709822 - RNA, 21 nt, Human
ucuggcaggaagacggauggg

SEQ ID NO: 709823 - RNA, 22 nt, Human
agggccacuggcugacggcugc

SEQ ID NO: 709824 - RNA, 22 nt, Human
ccgggagacuuugagcaccaug

SEQ ID NO: 709825 - RNA, 22 nt, Human
agguccuguccuuggucucuga

SEQ ID NO: 709826 - RNA, 23 nt, Human
uagaacaucggugucuuggagca

SEQ ID NO: 709827 - RNA, 22 nt, Human
ugucucagaggcaggaagagcc

SEQ ID NO: 709828 - RNA, 22 nt, Human
agaugacagcuacgggaugaaa

SEQ ID NO: 709829 - RNA, 19 nt, Human
acuugaaagcagagaguuu

SEQ ID NO: 709830 - RNA, 22 nt, Human
ucuguuccauguuuuguuccau

SEQ ID NO: 709831 - RNA, 17 nt, Human
ucaggcugugccuggua

SEQ ID NO: 709832 - RNA, 22 nt, Human
uugugucuuaaagauuaaaugg

SEQ ID NO: 709833 - RNA, 22 nt, Human
ugugccagaauguuuuuauaca

SEQ ID NO: 709834 - RNA, 17 nt, Human
ugauaguucauuuuaag

SEQ ID NO: 709835 - RNA, 22 nt, Human
ucucuucuugauuuucacugga

SEQ ID NO: 709836 - RNA, 22 nt, Human
uuggccagaucugaggauacug

SEQ ID NO: 709837 - RNA, 22 nt, Human
uaacuuuuacauuuggcucacu

SEQ ID NO: 709838 - RNA, 19 nt, Human
ugcugaggaugcaagaucc

SEQ ID NO: 709839 - RNA, 22 nt, Human
agagacagaucugagggaccuc

SEQ ID NO: 709840 - RNA, 23 nt, Human
acagacauuccauaauguacacc

SEQ ID NO: 709841 - RNA, 22 nt, Human
ugcuuaaaauaguucauuuuug

SEQ ID NO: 709842 - RNA, 22 nt, Human
gcuuccagccuuuucuccucug

SEQ ID NO: 709843 - RNA, 21 nt, Human
cuggaagaagcagcaggauuc

SEQ ID NO: 709844 - RNA, 22 nt, Human
uuugagaaaggggauuuaauuc

SEQ ID NO: 709845 - RNA, 22 nt, Human
cgcugggggaacagcgagggug

SEQ ID NO: 709846 - RNA, 22 nt, Human
ucugccccugcugggcacagag

SEQ ID NO: 709847 - RNA, 22 nt, Human
aaaguuuacagugcacaugggu

SEQ ID NO: 709848 - RNA, 22 nt, Human
agccagagaacagcaggaaaug

SEQ ID NO: 709849 - RNA, 19 nt, Human
cuggaaugauagagaccuc

SEQ ID NO: 709850 - RNA, 22 nt, Human
agucugucuaauauuauucagg

SEQ ID NO: 709851 - RNA, 22 nt, Human
uucuggaaguuuucuccugugg

SEQ ID NO: 709852 - RNA, 22 nt, Human
aaucgguugaacccaggaagug

SEQ ID NO: 709853 - RNA, 18 nt, Human
ggcagcaagaagggaggg

SEQ ID NO: 709854 - RNA, 22 nt, Human
gccacaggucggcuagaggguc

SEQ ID NO: 709855 - RNA, 22 nt, Human
ggcugcagagcuggugcccugg

SEQ ID NO: 709856 - RNA, 22 nt, Human
uuucuaagcuuaguaugaggca

SEQ ID NO: 709857 - RNA, 22 nt, Human
agcauauugucuuuggugucuc

SEQ ID NO: 709858 - RNA, 22 nt, Human
aauagcaauuacccuucaacuc

SEQ ID NO: 709859 - RNA, 22 nt, Human
cucccuccucaaauaucuuugu

SEQ ID NO: 709860 - RNA, 22 nt, Human
gcaauaaagauuuuacugucag

SEQ ID NO: 709861 - RNA, 22 nt, Human
agcuuucucucagccaggcugc

SEQ ID NO: 709862 - RNA, 22 nt, Human
gucaggaagcaagguugggcau

SEQ ID NO: 709863 - RNA, 22 nt, Human
agacagcaggggagucugguuu

SEQ ID NO: 709864 - RNA, 22 nt, Human
caaauacuggguaaguuaauuu

SEQ ID NO: 709865 - RNA, 22 nt, Human
ggcuggucuccaacccccgauc

SEQ ID NO: 709866 - RNA, 21 nt, Human
agucuggggaagggaucccag

SEQ ID NO: 709867 - RNA, 22 nt, Human
gccugcaagauggcuggucacu

SEQ ID NO: 709868 - RNA, 22 nt, Human
aaaugcuguaacugauauucug

SEQ ID NO: 709869 - RNA, 22 nt, Human
aaacuuuaaauuuguaccucug

SEQ ID NO: 709870 - RNA, 22 nt, Human
uuacuguuuugguaccucauug

SEQ ID NO: 709871 - RNA, 22 nt, Human
ugucaccucuuuggcugcagcu

SEQ ID NO: 709872 - RNA, 22 nt, Human
gauuuuuauauaaagugagaaa

SEQ ID NO: 709873 - RNA, 22 nt, Human
cucugggcaggacgccaggccu

SEQ ID NO: 709874 - RNA, 22 nt, Human
uucaaaggcaggauagcagcug

SEQ ID NO: 709875 - RNA, 22 nt, Human
uucaugccagcccuguguggua

SEQ ID NO: 709876 - RNA, 22 nt, Human
uauguagaagcugcucaaagaa

SEQ ID NO: 709877 - RNA, 22 nt, Human
acagcuuuuuacuaauagauug

SEQ ID NO: 709878 - RNA, 22 nt, Human
gaauagauauccuugagggucu

SEQ ID NO: 709879 - RNA, 22 nt, Human
ggagcucuccugaugugaagau

SEQ ID NO: 709880 - RNA, 22 nt, Human
caguacuugggggguucuaagu

SEQ ID NO: 709881 - RNA, 22 nt, Human
uggggcagcuccaucuauucca

SEQ ID NO: 709882 - RNA, 22 nt, Human
gcagcagagaacacaaugaugg

SEQ ID NO: 709883 - RNA, 22 nt, Human
cucccugaggacaggcccuguc

SEQ ID NO: 709884 - RNA, 22 nt, Human
uccugaggugcucagccaggaa

SEQ ID NO: 709885 - RNA, 22 nt, Human
agcucccaauugacuugaacua

SEQ ID NO: 709886 - RNA, 22 nt, Human
uuccacagguuucagacuguuc

SEQ ID NO: 709887 - RNA, 22 nt, Human
uaagcauacauucucuccuuuc

SEQ ID NO: 709888 - RNA, 22 nt, Human
gucaacauaggccucagugagg

SEQ ID NO: 709889 - RNA, 22 nt, Human
aaugucugccugaacuuuauau

SEQ ID NO: 709890 - RNA, 20 nt, Human
gccacugugcuuacacugcu

SEQ ID NO: 709891 - RNA, 22 nt, Human
auauuccuguuuuuaacacuuu

SEQ ID NO: 709892 - RNA, 22 nt, Human
guacauuuacugaugaaaagua

SEQ ID NO: 709893 - RNA, 22 nt, Human
aauguuuggacuggaagguccc

SEQ ID NO: 709894 - RNA, 22 nt, Human
cucuccagucauauucucaguc

SEQ ID NO: 709895 - RNA, 20 nt, Human
ugcuuuaugcuauacuuugu

SEQ ID NO: 709896 - RNA, 22 nt, Human
ggacagcuccugcacuugagua

SEQ ID NO: 709897 - RNA, 22 nt, Human
agcugucuuucauuaccucauu

SEQ ID NO: 709898 - RNA, 20 nt, Human
ucagagucaucaaagauggu

SEQ ID NO: 709899 - RNA, 22 nt, Human
aaggcagauauaaagacuagag

SEQ ID NO: 709900 - RNA, 22 nt, Human
gggcaguguggucgugccuuug

SEQ ID NO: 709901 - RNA, 22 nt, Human
gugcauuacauguaauaaaaua

SEQ ID NO: 709902 - RNA, 20 nt, Human
uuuccuaagugguuugcuga

SEQ ID NO: 709903 - RNA, 22 nt, Human
gacucagugauuugacaugccu

SEQ ID NO: 709904 - RNA, 22 nt, Human
uaugaagugaguuaugguugcu

SEQ ID NO: 709905 - RNA, 22 nt, Human
gccacugauuccaagucaauuu

SEQ ID NO: 709906 - RNA, 21 nt, Human
cagaggggcuagccuggcugc

SEQ ID NO: 709907 - RNA, 22 nt, Human
cucaaauguuuccacuucugcu

SEQ ID NO: 709908 - RNA, 22 nt, Human
ucuaagacacuguacuuucagu

SEQ ID NO: 709909 - RNA, 23 nt, Human
acauccaugaaucaucugcuuuc

SEQ ID NO: 709910 - RNA, 22 nt, Human
acuggcagaacgugaugcgggu

SEQ ID NO: 709911 - RNA, 22 nt, Human
aacauuuuuaagaccaagugcu

SEQ ID NO: 709912 - RNA, 22 nt, Human
aucuugcugcuacaaagugccc

SEQ ID NO: 709913 - RNA, 22 nt, Human
uucauuuguugacagagacaug

SEQ ID NO: 709914 - RNA, 20 nt, Human
ugucauuuauuuaucaaaug

SEQ ID NO: 709915 - RNA, 22 nt, Human
gacaguuaggacaacugacuuc

SEQ ID NO: 709916 - RNA, 22 nt, Human
uuagaauuauuguuuccuucua

SEQ ID NO: 709917 - RNA, 22 nt, Human
uccaucauguucacagcuauau

SEQ ID NO: 709918 - RNA, 22 nt, Human
uuuaugauuauuuuaaagcagc

SEQ ID NO: 709919 - RNA, 22 nt, Human
auacuguacgucccagauagga

SEQ ID NO: 709920 - RNA, 22 nt, Human
cuacauucugggaaaucagaug

SEQ ID NO: 709921 - RNA, 20 nt, Human
cuguggcucaugcaucugcc

SEQ ID NO: 709922 - RNA, 22 nt, Human
uuggagagaggcugcucaggcu

SEQ ID NO: 709923 - RNA, 22 nt, Human
caaguuuacaauguguaugugu

SEQ ID NO: 709924 - RNA, 22 nt, Human
uaaugcuuauguuaugcaauuu

SEQ ID NO: 709925 - RNA, 22 nt, Human
uauguaaaaauucaucaggcug

SEQ ID NO: 709926 - RNA, 23 nt, Human
agguccuggacauaugugcauca

SEQ ID NO: 709927 - RNA, 20 nt, Human
ucugggcagggcacauggaa

SEQ ID NO: 709928 - RNA, 23 nt, Human
ucucaaauaugaucugggucauc

SEQ ID NO: 709929 - RNA, 22 nt, Human
ggcugaguggcugggucuaguu

SEQ ID NO: 709930 - RNA, 22 nt, Human
ggcucuggugcccuggcuccca

SEQ ID NO: 709931 - RNA, 22 nt, Human
aaauuucuguuguuuugagcca

SEQ ID NO: 709932 - RNA, 22 nt, Human
aaugccucuuggaagaagacuu

SEQ ID NO: 709933 - RNA, 20 nt, Human
ggcagaccugcugagagccc

SEQ ID NO: 709934 - RNA, 22 nt, Human
ucucugugugccuucaucugcc

SEQ ID NO: 709935 - RNA, 22 nt, Human
uccugaggacuaacaggaagga

SEQ ID NO: 709936 - RNA, 22 nt, Human
aguguggacuuuuccuaggagg

SEQ ID NO: 709937 - RNA, 22 nt, Human
cagugcagguuuagggcugggg

SEQ ID NO: 709938 - RNA, 22 nt, Human
ugugaggaccucagcagagucu

SEQ ID NO: 709939 - RNA, 21 nt, Human
gcagggacaaagcuucaggag

SEQ ID NO: 709940 - RNA, 22 nt, Human
uaggucuguaaaugagagagac

SEQ ID NO: 709941 - RNA, 22 nt, Human
caguccuuagauuuuacugcca

SEQ ID NO: 709942 - RNA, 22 nt, Human
ggaugcaggacggcauggaugu

SEQ ID NO: 709943 - RNA, 22 nt, Human
guagaucugccuuaaccuggga

SEQ ID NO: 709944 - RNA, 22 nt, Human
ugucucugaacagcuuacuaaa

SEQ ID NO: 709945 - RNA, 22 nt, Human
gacauaaaugaaguuugacuau

SEQ ID NO: 709946 - RNA, 19 nt, Human
gcugugggacagcagggug

SEQ ID NO: 709947 - RNA, 22 nt, Human
aaagugcugggauuccaggcgu

SEQ ID NO: 709948 - RNA, 22 nt, Human
aggcuccaugcuaagcgauaug

SEQ ID NO: 709949 - RNA, 22 nt, Human
accacccaccucacagcauagu

SEQ ID NO: 709950 - RNA, 22 nt, Human
uugcagggaaauagaaauaaac

SEQ ID NO: 709951 - RNA, 22 nt, Human
uuggcugccuucaccccuggcc

SEQ ID NO: 709952 - RNA, 22 nt, Human
gaacuguggguaauauauuaga

SEQ ID NO: 709953 - RNA, 18 nt, Human
cccagcccaccauuucuc

SEQ ID NO: 709954 - RNA, 22 nt, Human
uggugucugcacucccuggcgu

SEQ ID NO: 709955 - RNA, 22 nt, Human
ucucagggugaggaaagaauuu

SEQ ID NO: 709956 - RNA, 23 nt, Human
gacaucuguuuugucccugugcu

SEQ ID NO: 709957 - RNA, 22 nt, Human
agguaggaguugauggauguuc

SEQ ID NO: 709958 - RNA, 22 nt, Human
aaaacauugaauugcacacuau

SEQ ID NO: 709959 - RNA, 22 nt, Human
agagacaggauaucugcucaug

SEQ ID NO: 709960 - RNA, 22 nt, Human
gagcuucagcgugugcuaaggg

SEQ ID NO: 709961 - RNA, 22 nt, Human
ggcagguggccaagugucuaag

SEQ ID NO: 709962 - RNA, 22 nt, Human
cacaccuguaauaccagcuacu

SEQ ID NO: 709963 - RNA, 17 nt, Human
agguggguggaucaccu

SEQ ID NO: 709964 - RNA, 22 nt, Human
augacaaaauucacagguguga

SEQ ID NO: 709965 - RNA, 22 nt, Human
uuggcuaaccuggguuaucagc

SEQ ID NO: 709966 - RNA, 22 nt, Human
ggccagcauggcaagaccaacu

SEQ ID NO: 709967 - RNA, 22 nt, Human
aggcccagagcaggaaaggguu

SEQ ID NO: 709968 - RNA, 22 nt, Human
acuguggggggcuuugcucagu

SEQ ID NO: 709969 - RNA, 22 nt, Human
gcuuggcccugccgccuggguc

SEQ ID NO: 709970 - RNA, 19 nt, Human
cagagagaccaaggcgcca

SEQ ID NO: 709971 - RNA, 22 nt, Human
ugucuuuggaauauuuagcuga

SEQ ID NO: 709972 - RNA, 22 nt, Human
ggacugggucacuaagauagua

SEQ ID NO: 709973 - RNA, 17 nt, Human
gcaggcacugcugccug

SEQ ID NO: 709974 - RNA, 22 nt, Human
gcccagcgagcagagguggacg

SEQ ID NO: 709975 - RNA, 22 nt, Human
uagcagcaauuucagaaguuug

SEQ ID NO: 709976 - RNA, 22 nt, Human
accauacauuaaaugacuuuca

SEQ ID NO: 709977 - RNA, 22 nt, Human
cugggaggcccacguugggaag

SEQ ID NO: 709978 - RNA, 18 nt, Human
gacaccagccucugcccc

SEQ ID NO: 709979 - RNA, 22 nt, Human
uucacacuguuuuucauagugg

SEQ ID NO: 709980 - RNA, 22 nt, Human
uuaacuugucagaaaauacagu

SEQ ID NO: 709981 - RNA, 22 nt, Human
guaaaauucuagcaucugaaag

SEQ ID NO: 709982 - RNA, 22 nt, Human
uggccugcaagcuaaaaaucua

SEQ ID NO: 709983 - RNA, 21 nt, Human
agugaagagugaaacacaugg

SEQ ID NO: 709984 - RNA, 22 nt, Human
ucugagccauaagaguacagga

SEQ ID NO: 709985 - RNA, 22 nt, Human
agcuccuccugugccaggccag

SEQ ID NO: 709986 - RNA, 22 nt, Human
ccuuuucuguuuccugucacug

SEQ ID NO: 709987 - RNA, 22 nt, Human
uaaagacaaacccacuaggguu

SEQ ID NO: 709988 - RNA, 22 nt, Human
cuucucccugggggcucuuuau

SEQ ID NO: 709989 - RNA, 22 nt, Human
aagcagcacagcaaugacucua

SEQ ID NO: 709990 - RNA, 22 nt, Human
ucaaggaauuuaguuuaguaaa

SEQ ID NO: 709991 - RNA, 22 nt, Human
uggugcaagucucugaggaggg

SEQ ID NO: 709992 - RNA, 22 nt, Human
guuuguuuuaagauaggaugga

SEQ ID NO: 709993 - RNA, 22 nt, Human
agaggccugugugcuccagugg

SEQ ID NO: 709994 - RNA, 23 nt, Human
gcacauacuacacagaaaauggc

SEQ ID NO: 709995 - RNA, 22 nt, Human
gucauuuucuagaauuauuuga

SEQ ID NO: 709996 - RNA, 22 nt, Human
gcaugcaugugugcagacaguc

SEQ ID NO: 709997 - RNA, 22 nt, Human
cugauuccagagucuguguucu

SEQ ID NO: 709998 - RNA, 22 nt, Human
ggcacauggagacuuggcauca

SEQ ID NO: 709999 - RNA, 22 nt, Human
ggcaggugaggcaugugccugg

SEQ ID NO: 710000 - RNA, 22 nt, Human
caugggcucucugagcuccagg

SEQ ID NO: 710001 - RNA, 22 nt, Human
ucuggcucuuugggugauugua

SEQ ID NO: 710002 - RNA, 22 nt, Human
ucaggagccugaaagaggucua

SEQ ID NO: 710003 - RNA, 22 nt, Human
ugagcagggacuuugaguguag

SEQ ID NO: 710004 - RNA, 22 nt, Human
caucucuucauuagcauuauug

SEQ ID NO: 710005 - RNA, 22 nt, Human
ugggccugugaugcugggcuau

SEQ ID NO: 710006 - RNA, 22 nt, Human
uugaggucauauauauuuggca

SEQ ID NO: 710007 - RNA, 22 nt, Human
uggcauguucucuuagcagcuc

SEQ ID NO: 710008 - RNA, 22 nt, Human
agugcuguccaguuucacaggu

SEQ ID NO: 710009 - RNA, 22 nt, Human
uacaguuacuguuauaugugcu

SEQ ID NO: 710010 - RNA, 22 nt, Human
caccugccucauuugucccugc

SEQ ID NO: 710011 - RNA, 22 nt, Human
gguacaauucugggguaugcuc

SEQ ID NO: 710012 - RNA, 22 nt, Human
cuggcuuccucaggagcagugg

SEQ ID NO: 710013 - RNA, 22 nt, Human
uuuauuaauuagugacccaaug

SEQ ID NO: 710014 - RNA, 22 nt, Human
cuguuaucuguuauugccaguu

SEQ ID NO: 710015 - RNA, 22 nt, Human
cuaaaugucagaguagcuugca

SEQ ID NO: 710016 - RNA, 22 nt, Human
gcaggcaggagcccaacugccu

SEQ ID NO: 710017 - RNA, 22 nt, Human
cuuagcaagaaucagcugcugg

SEQ ID NO: 710018 - RNA, 22 nt, Human
gacacagggacgugcucugccu

SEQ ID NO: 710019 - RNA, 22 nt, Human
uaacauugaguccacuaaacag

SEQ ID NO: 710020 - RNA, 22 nt, Human
ucugggaacugagcuccccuag

SEQ ID NO: 710021 - RNA, 22 nt, Human
uucccagagaaggaugaaaaag

SEQ ID NO: 710022 - RNA, 22 nt, Human
gguucccggaucuccgaguccc

SEQ ID NO: 710023 - RNA, 22 nt, Human
acugaggauuagcccaggcuag

SEQ ID NO: 710024 - RNA, 22 nt, Human
augccauugcuuuaaaauuaag

SEQ ID NO: 710025 - RNA, 22 nt, Human
cagcucuucagugccugagaua

SEQ ID NO: 710026 - RNA, 22 nt, Human
gcaaaugcucuccuuggucagg

SEQ ID NO: 710027 - RNA, 22 nt, Human
ugcuuaaaaacaguaugguagu

SEQ ID NO: 710028 - RNA, 22 nt, Human
gccuggccugaacuaggaggug

SEQ ID NO: 710029 - RNA, 22 nt, Human
ucugaaauaggcuucuuuuggu

SEQ ID NO: 710030 - RNA, 22 nt, Human
aggagucauaaaugugaacaaa

SEQ ID NO: 710031 - RNA, 23 nt, Human
uuucuguuggguauauauccaag

SEQ ID NO: 710032 - RNA, 21 nt, Human
uucuaacugggugggccuuga

SEQ ID NO: 710033 - RNA, 22 nt, Human
aagcacaccucccuggcaggag

SEQ ID NO: 710034 - RNA, 22 nt, Human
accugccuaucagcugccugcu

SEQ ID NO: 710035 - RNA, 22 nt, Human
ggcccugagcugaaguacugug

SEQ ID NO: 710036 - RNA, 22 nt, Human
ugcuugaugauugcugucuccc

SEQ ID NO: 710037 - RNA, 22 nt, Human
gagauguuaacuacauagcuac

SEQ ID NO: 710038 - RNA, 22 nt, Human
ccugagcuggagacauuacaua

SEQ ID NO: 710039 - RNA, 22 nt, Human
guuagugugacugaggaaugca

SEQ ID NO: 710040 - RNA, 22 nt, Human
ccagugcuucuuugcuagcugg

SEQ ID NO: 710041 - RNA, 22 nt, Human
uccuccuucgggacugcuugac

SEQ ID NO: 710042 - RNA, 21 nt, Human
cucuugucuuugcucaguagc

SEQ ID NO: 710043 - RNA, 22 nt, Human
uguccuggccaaggccuugcuu

SEQ ID NO: 710044 - RNA, 22 nt, Human
agaaauagcagagucaggcggg

SEQ ID NO: 710045 - RNA, 22 nt, Human
aaggauguggcauuuuucauau

SEQ ID NO: 710046 - RNA, 22 nt, Human
ggaaaauuuccuucaaaaugug

SEQ ID NO: 710047 - RNA, 20 nt, Human
uucugcuugcaaauaucaag

SEQ ID NO: 710048 - RNA, 23 nt, Human
agucucagcuggaaacauguguc

SEQ ID NO: 710049 - RNA, 22 nt, Human
cgcaggcaagagaguacaguua

SEQ ID NO: 710050 - RNA, 22 nt, Human
uccucacaagcaagcacaggua

SEQ ID NO: 710051 - RNA, 22 nt, Human
uggcuucaccucagcaugaagg

SEQ ID NO: 710052 - RNA, 22 nt, Human
aacaggcuuccaggagggacga

SEQ ID NO: 710053 - RNA, 22 nt, Human
uuccaggaggcauucuuaguuu

SEQ ID NO: 710054 - RNA, 22 nt, Human
ccucugccaccucccacgaggc

SEQ ID NO: 710055 - RNA, 22 nt, Human
uggggcugaggagccucacucu

SEQ ID NO: 710056 - RNA, 22 nt, Human
uuuaaaaguuaucaucugucca

SEQ ID NO: 710057 - RNA, 22 nt, Human
ucaggaagcugcucuggguggu

SEQ ID NO: 710058 - RNA, 22 nt, Human
ucaaggugcugugcugugcuag

SEQ ID NO: 710059 - RNA, 22 nt, Human
agguccaggcauuuggguuggg

SEQ ID NO: 710060 - RNA, 22 nt, Human
caguuaaacagauugaguguua

SEQ ID NO: 710061 - RNA, 22 nt, Human
gcugagagcggccagcugggaa

SEQ ID NO: 710062 - RNA, 22 nt, Human
aaugauaccgccaauauuacca

SEQ ID NO: 710063 - RNA, 22 nt, Human
uucagcauagcagcuucaggac

SEQ ID NO: 710064 - RNA, 22 nt, Human
cagugguauuugagagaaugga

SEQ ID NO: 710065 - RNA, 17 nt, Human
agugaggagauuggaag

SEQ ID NO: 710066 - RNA, 22 nt, Human
aaacaucuucucuugauucuuu

SEQ ID NO: 710067 - RNA, 22 nt, Human
ggcacagugauuaagagccagu

SEQ ID NO: 710068 - RNA, 22 nt, Human
aauaauguuaugucauucuucu

SEQ ID NO: 710069 - RNA, 22 nt, Human
aaguggcaguucaggaagcaga

SEQ ID NO: 710070 - RNA, 22 nt, Human
ugagcaggcaaacaaugguuau

SEQ ID NO: 710071 - RNA, 21 nt, Human
ugaucauuuguguaaaggaga

SEQ ID NO: 710072 - RNA, 22 nt, Human
uaggaacaguccuagaaaucug

SEQ ID NO: 710073 - RNA, 22 nt, Human
uagccaguuucuuuaacagcaa

SEQ ID NO: 710074 - RNA, 22 nt, Human
augauacaagcaaaacuaauca

SEQ ID NO: 710075 - RNA, 19 nt, Human
gggcaguggcacuagggag

SEQ ID NO: 710076 - RNA, 22 nt, Human
cagcacuggggccacuggaguu

SEQ ID NO: 710077 - RNA, 22 nt, Human
ucagaucuaauuggauuauuau

SEQ ID NO: 710078 - RNA, 22 nt, Human
ucacccaggauauugaagucag

SEQ ID NO: 710079 - RNA, 22 nt, Human
ugguauucuuucuguagaucau

SEQ ID NO: 710080 - RNA, 22 nt, Human
gaucacaugaguuaucuaacuu

SEQ ID NO: 710081 - RNA, 22 nt, Human
ucuggucaagacauccuaacau

SEQ ID NO: 710082 - RNA, 22 nt, Human
aauguacaauaagacaaagagg

SEQ ID NO: 710083 - RNA, 22 nt, Human
uucucuggggacugucucuauu

SEQ ID NO: 710084 - RNA, 22 nt, Human
uuacacagaaauuuuauugccu

SEQ ID NO: 710085 - RNA, 22 nt, Human
ugccauggaaucaccuccagcu

SEQ ID NO: 710086 - RNA, 19 nt, Human
ugcuugccugccuuuccca

SEQ ID NO: 710087 - RNA, 22 nt, Human
acuucucuucauagguggcaau

SEQ ID NO: 710088 - RNA, 22 nt, Human
cugcagggaugugaggcccguu

SEQ ID NO: 710089 - RNA, 22 nt, Human
auuauggauggaggcauuaguc

SEQ ID NO: 710090 - RNA, 22 nt, Human
uccugucugucuuuggucccuu

SEQ ID NO: 710091 - RNA, 21 nt, Human
uggccaaaaccauauuauuaa

SEQ ID NO: 710092 - RNA, 22 nt, Human
uauucucugcagcugaauguuu

SEQ ID NO: 710093 - RNA, 22 nt, Human
cagacacuauuguguauaaauc

SEQ ID NO: 710094 - RNA, 22 nt, Human
uagcuguucaaguuccuggaaa

SEQ ID NO: 710095 - RNA, 22 nt, Human
acauguuugccugcaggcuuag

SEQ ID NO: 710096 - RNA, 22 nt, Human
gagauguacaauguguauuaau

SEQ ID NO: 710097 - RNA, 22 nt, Human
caugcuuauauggaaaggaaga

SEQ ID NO: 710098 - RNA, 22 nt, Human
auuuaguuuaggaaaaguaggu

SEQ ID NO: 710099 - RNA, 22 nt, Human
uuccuuccagcuugugacaguc

SEQ ID NO: 710100 - RNA, 22 nt, Human
aaggcucuggguuucauaggug

SEQ ID NO: 710101 - RNA, 22 nt, Human
aaaucucaguguucuaagcauu

SEQ ID NO: 710102 - RNA, 22 nt, Human
aauucauacucuauauugcuuu

SEQ ID NO: 710103 - RNA, 20 nt, Human
acaaaugcauucugugacau

SEQ ID NO: 710104 - RNA, 22 nt, Human
aaaacaggugucagcaaacuau

SEQ ID NO: 710105 - RNA, 23 nt, Human
agcagcagugagaggugucuuac

SEQ ID NO: 710106 - RNA, 20 nt, Human
ugcacagggugggaagcaac

SEQ ID NO: 710107 - RNA, 22 nt, Human
ugaggcaggagaaucacaugaa

SEQ ID NO: 710108 - RNA, 22 nt, Human
aucugccugcuuaugaugccug

SEQ ID NO: 710109 - RNA, 20 nt, Human
cugcugugguccuuuauuuu

SEQ ID NO: 710110 - RNA, 22 nt, Human
cuuuccaaugcauuuccaaugu

SEQ ID NO: 710111 - RNA, 22 nt, Human
agauaaauuccuaagauuucag

SEQ ID NO: 710112 - RNA, 18 nt, Human
gcaggcccuguuucuggg

SEQ ID NO: 710113 - RNA, 22 nt, Human
agggaggagaauggacuccuuc

SEQ ID NO: 710114 - RNA, 18 nt, Human
cugaggccaacuacacug

SEQ ID NO: 710115 - RNA, 22 nt, Human
cccuuuccauggcucuccuagg

SEQ ID NO: 710116 - RNA, 22 nt, Human
uuucagcacuuuaggcagcagg

SEQ ID NO: 710117 - RNA, 22 nt, Human
ggagugacucacagcugggaca

SEQ ID NO: 710118 - RNA, 21 nt, Human
ccuccaggagcagagcccuga

SEQ ID NO: 710119 - RNA, 22 nt, Human
ugagaguuuugacgcuuguaac

SEQ ID NO: 710120 - RNA, 22 nt, Human
agcuccuguucugagagcagga

SEQ ID NO: 710121 - RNA, 22 nt, Human
gcagcagcucaguucugggagg

SEQ ID NO: 710122 - RNA, 22 nt, Human
uggaauguugauaaacauaggc

SEQ ID NO: 710123 - RNA, 22 nt, Human
caagagcucccagaccugggca

SEQ ID NO: 710124 - RNA, 18 nt, Human
uacagcuugaguugacug

SEQ ID NO: 710125 - RNA, 22 nt, Human
aggucagaagugccagggaauu

SEQ ID NO: 710126 - RNA, 22 nt, Human
uccuggauucugcccugaaggc

SEQ ID NO: 710127 - RNA, 22 nt, Human
cucaguuuugcuagcuggaguu

SEQ ID NO: 710128 - RNA, 22 nt, Human
ucugcuguugagcacaagugaa

SEQ ID NO: 710129 - RNA, 22 nt, Human
acuccauacaauggcaggcugu

SEQ ID NO: 710130 - RNA, 22 nt, Human
uuuccuccuagccuccagccgc

SEQ ID NO: 710131 - RNA, 22 nt, Human
auuguacaugcagugagucauc

SEQ ID NO: 710132 - RNA, 22 nt, Human
acauuucuucccuuuagcagaa

SEQ ID NO: 710133 - RNA, 22 nt, Human
cuuuggcugacgaggaggaggc

SEQ ID NO: 710134 - RNA, 22 nt, Human
cagacaggaaguucagaagaaa

SEQ ID NO: 710135 - RNA, 22 nt, Human
cuggccagcauuuuugcuuuag

SEQ ID NO: 710136 - RNA, 22 nt, Human
gauugaaauauaaauauguguu

SEQ ID NO: 710137 - RNA, 22 nt, Human
ccugaauaauuugugaaaagau

SEQ ID NO: 710138 - RNA, 20 nt, Human
ugugacaaaggcauauuuua

SEQ ID NO: 710139 - RNA, 22 nt, Human
gucugcugcagucguggcucua

SEQ ID NO: 710140 - RNA, 22 nt, Human
aaguaugucaaucauacuucaa

SEQ ID NO: 710141 - RNA, 22 nt, Human
cuuugcaagggauuucaugucu

SEQ ID NO: 710142 - RNA, 22 nt, Human
gcuaaucaauguuaaggcugug

SEQ ID NO: 710143 - RNA, 22 nt, Human
ugagucugggcauguucacuuu

SEQ ID NO: 710144 - RNA, 22 nt, Human
gagaaacaacacuugaugccuu

SEQ ID NO: 710145 - RNA, 22 nt, Human
acccagagucauggcacuuagc

SEQ ID NO: 710146 - RNA, 23 nt, Human
uccucgcaggagggagaugaugc

SEQ ID NO: 710147 - RNA, 22 nt, Human
uucagugucaauuuuuaaauau

SEQ ID NO: 710148 - RNA, 22 nt, Human
ccuuccuggcuguccgccugau

SEQ ID NO: 710149 - RNA, 22 nt, Human
ucagcucuguguacaguuagca

SEQ ID NO: 710150 - RNA, 22 nt, Human
uuucuccugaguuccacgcuac

SEQ ID NO: 710151 - RNA, 22 nt, Human
aauuacacagggaucacuuuuu

SEQ ID NO: 710152 - RNA, 23 nt, Human
auccaugugagaauagacuagca

SEQ ID NO: 710153 - RNA, 17 nt, Human
ugaggcucggugaggag

SEQ ID NO: 710154 - RNA, 22 nt, Human
gugugucuuuauaagaagaggg

SEQ ID NO: 710155 - RNA, 22 nt, Human
gcuucacaggcaaguuaagccu

SEQ ID NO: 710156 - RNA, 22 nt, Human
uggagagcaggggaugcgggcg

SEQ ID NO: 710157 - RNA, 22 nt, Human
aaaauucauggcuugggaaaag

SEQ ID NO: 710158 - RNA, 22 nt, Human
ucuggcuugucucagggucuga

SEQ ID NO: 710159 - RNA, 22 nt, Human
ccaaaggcggaacugagucucu

SEQ ID NO: 710160 - RNA, 22 nt, Human
uucuguuacaagugaaaaaaug

SEQ ID NO: 710161 - RNA, 22 nt, Human
guuccugggaggcaugggcugg

SEQ ID NO: 710162 - RNA, 20 nt, Human
ccuggaagagcuccccaggc

SEQ ID NO: 710163 - RNA, 22 nt, Human
agacaggcagaggcugcagagg

SEQ ID NO: 710164 - RNA, 22 nt, Human
ucagcauauguuuggagugucc

SEQ ID NO: 710165 - RNA, 22 nt, Human
accaggcccuccagcugcgugg

SEQ ID NO: 710166 - RNA, 22 nt, Human
acauugaugaaaagguaucauu

SEQ ID NO: 710167 - RNA, 22 nt, Human
ccugggaagagcugacaggagg

SEQ ID NO: 710168 - RNA, 21 nt, Human
gcaggguuugugcugugaguu

SEQ ID NO: 710169 - RNA, 22 nt, Human
accugagacuugggaugggaau

SEQ ID NO: 710170 - RNA, 23 nt, Human
ucucucuuagcuaugcuuauggc

SEQ ID NO: 710171 - RNA, 23 nt, Human
cuuuccuuucuuugacacccagc

SEQ ID NO: 710172 - RNA, 22 nt, Human
ccuuuagaauucugccccuccu

SEQ ID NO: 710173 - RNA, 21 nt, Human
cagugguugcugaauuagugg

SEQ ID NO: 710174 - RNA, 22 nt, Human
ccucuggcagccagccaguugu

SEQ ID NO: 710175 - RNA, 22 nt, Human
acauuuuacaguugucuggcua

SEQ ID NO: 710176 - RNA, 22 nt, Human
cuuagggaauugggaggaugcc

SEQ ID NO: 710177 - RNA, 22 nt, Human
gggggaugcucaggaggcugcu

SEQ ID NO: 710178 - RNA, 22 nt, Human
agcagcucaacagugucucuau

SEQ ID NO: 710179 - RNA, 22 nt, Human
cuuuacuucagcaagcuuuccu

SEQ ID NO: 710180 - RNA, 17 nt, Human
auggcuuccauugacca

SEQ ID NO: 710181 - RNA, 21 nt, Human
ccugugccagucuauguguuc

SEQ ID NO: 710182 - RNA, 22 nt, Human
cagagagggcggcccuggcuuc

SEQ ID NO: 710183 - RNA, 22 nt, Human
guggcugcagagccagcaagcu

SEQ ID NO: 710184 - RNA, 22 nt, Human
aauauuucuguagcuauguucu

SEQ ID NO: 710185 - RNA, 22 nt, Human
uuuauguuugacaaugaucugg

SEQ ID NO: 710186 - RNA, 22 nt, Human
ucugucauuagccuugacugua

SEQ ID NO: 710187 - RNA, 19 nt, Human
gccuuggcauucucugcuu

SEQ ID NO: 710188 - RNA, 22 nt, Human
uacuuguguucuacuagagaaa

SEQ ID NO: 710189 - RNA, 22 nt, Human
gaggccuggcucugcccuccug

SEQ ID NO: 710190 - RNA, 22 nt, Human
acagcugggaaucagcugggga

SEQ ID NO: 710191 - RNA, 22 nt, Human
aggcuagacuuuggcgaagcac

SEQ ID NO: 710192 - RNA, 22 nt, Human
uaggaaacuaauacagucugga

SEQ ID NO: 710193 - RNA, 22 nt, Human
caggcagugugacgcuaggguu

SEQ ID NO: 710194 - RNA, 22 nt, Human
guggcugcaucggggugaccag

SEQ ID NO: 710195 - RNA, 22 nt, Human
aauuuccagaccccauccacag

SEQ ID NO: 710196 - RNA, 19 nt, Human
aggucccucccucgaggcu

SEQ ID NO: 710197 - RNA, 22 nt, Human
gcaggggcggcuggguuuccag

SEQ ID NO: 710198 - RNA, 23 nt, Human
cagaagcaccuguugacugcugc

SEQ ID NO: 710199 - RNA, 22 nt, Human
uuaucuuggguaacuuugugca

SEQ ID NO: 710200 - RNA, 22 nt, Human
auguuuaagaaagucuuccaua

SEQ ID NO: 710201 - RNA, 22 nt, Human
agucugaaguagucuuuagugu

SEQ ID NO: 710202 - RNA, 17 nt, Human
augugucugaguguccu

SEQ ID NO: 710203 - RNA, 22 nt, Human
gagagagaggugcugccaggca

SEQ ID NO: 710204 - RNA, 22 nt, Human
gaggccacauuacuuggugggu

SEQ ID NO: 710205 - RNA, 22 nt, Human
aaauuauucaaaaagcuguguu

SEQ ID NO: 710206 - RNA, 22 nt, Human
guucagcaagaauguuucuauu

SEQ ID NO: 710207 - RNA, 22 nt, Human
ucagaaagugaacuguugacau

SEQ ID NO: 710208 - RNA, 22 nt, Human
uugaaguugguguggaaaguag

SEQ ID NO: 710209 - RNA, 22 nt, Human
aguccccuggcaggagggacgu

SEQ ID NO: 710210 - RNA, 22 nt, Human
uggcagauuuugaagacagaga

SEQ ID NO: 710211 - RNA, 22 nt, Human
gccuuaggggucagacagagcu

SEQ ID NO: 710212 - RNA, 17 nt, Human
ugagaaguaggcaucau

SEQ ID NO: 710213 - RNA, 22 nt, Human
cuguuaaaauguggucuuaaaa

SEQ ID NO: 710214 - RNA, 22 nt, Human
ccagagagucgaugggggacac

SEQ ID NO: 710215 - RNA, 22 nt, Human
aacaguuugagcuuugaauuuc

SEQ ID NO: 710216 - RNA, 22 nt, Human
aauagcaucuucugagacaaag

SEQ ID NO: 710217 - RNA, 19 nt, Human
ccaaaggaaguuucccucc

SEQ ID NO: 710218 - RNA, 22 nt, Human
agguacuaccagggauuuucag

SEQ ID NO: 710219 - RNA, 22 nt, Human
augaggaugggaagggagccaa

SEQ ID NO: 710220 - RNA, 22 nt, Human
acauucaaggccuucugacaca

SEQ ID NO: 710221 - RNA, 22 nt, Human
aacuugaaacuguuccagaaaa

SEQ ID NO: 710222 - RNA, 23 nt, Human
ugcucccaggugacgcugcuguu

SEQ ID NO: 710223 - RNA, 22 nt, Human
uagcacagcuucuugaugucac

SEQ ID NO: 710224 - RNA, 22 nt, Human
ugauuuccuagcugacaugaaa

SEQ ID NO: 710225 - RNA, 22 nt, Human
aguggcuugcucugccucagcc

SEQ ID NO: 710226 - RNA, 22 nt, Human
agaggcggagguugcagugagc

SEQ ID NO: 710227 - RNA, 22 nt, Human
caguaguguugcugagugucag

SEQ ID NO: 710228 - RNA, 22 nt, Human
uccugccuuagagcaaggaaaa

SEQ ID NO: 710229 - RNA, 22 nt, Human
aaaucuagaaguuuaaaaggau

SEQ ID NO: 710230 - RNA, 22 nt, Human
gcugccccgagccauccuucag

SEQ ID NO: 710231 - RNA, 22 nt, Human
gccaggcaaauuaaggaaugca

SEQ ID NO: 710232 - RNA, 22 nt, Human
gucugggcaggaaucugcauuc

SEQ ID NO: 710233 - RNA, 22 nt, Human
gcaacuuuagaaaaaucuauaa

SEQ ID NO: 710234 - RNA, 20 nt, Human
cagcuagugguaggagucgg

SEQ ID NO: 710235 - RNA, 22 nt, Human
aucuggagugggacacagaaau

SEQ ID NO: 710236 - RNA, 22 nt, Human
agcaccaggucgcuggcacgcu

SEQ ID NO: 710237 - RNA, 22 nt, Human
gcccggcagucacacacccagg

SEQ ID NO: 710238 - RNA, 22 nt, Human
aaagcuggcuuuuacaggggcu

SEQ ID NO: 710239 - RNA, 22 nt, Human
cuaagacaugcccugcaugaua

SEQ ID NO: 710240 - RNA, 22 nt, Human
ccagagggaagaggaagcgcug

SEQ ID NO: 710241 - RNA, 22 nt, Human
cagugggugccaucgugcccuu

SEQ ID NO: 710242 - RNA, 22 nt, Human
ucugaggccccugggcaggaug

SEQ ID NO: 710243 - RNA, 22 nt, Human
uuacauuuuaguuaaccuguga

SEQ ID NO: 710244 - RNA, 22 nt, Human
gcugugcugcgggaggauuccg

SEQ ID NO: 710245 - RNA, 22 nt, Human
uucacauuucauaccacagcuu

SEQ ID NO: 710246 - RNA, 22 nt, Human
ugugagcacuauggcuaggcuc

SEQ ID NO: 710247 - RNA, 22 nt, Human
caugaugucacagagaagcaca

SEQ ID NO: 710248 - RNA, 22 nt, Human
gguacaaaguuagauuuaacuu

SEQ ID NO: 710249 - RNA, 22 nt, Human
uccaggcaaagccuuguagacg

SEQ ID NO: 710250 - RNA, 20 nt, Human
uuggcucugaucaguggagc

SEQ ID NO: 710251 - RNA, 22 nt, Human
cuggcaugaaauggcaucucau

SEQ ID NO: 710252 - RNA, 22 nt, Human
uuauuuguggcauccauguugg

SEQ ID NO: 710253 - RNA, 22 nt, Human
acccagagcccuuagcacagac

SEQ ID NO: 710254 - RNA, 21 nt, Human
auguggccauuguaguccacg

SEQ ID NO: 710255 - RNA, 22 nt, Human
aaccagagugacacucuacaga

SEQ ID NO: 710256 - RNA, 22 nt, Human
acacuuauuucuugucuaacca

SEQ ID NO: 710257 - RNA, 21 nt, Human
ugucagcucccuguccugugu

SEQ ID NO: 710258 - RNA, 22 nt, Human
gcuucugugguugucacgacua

SEQ ID NO: 710259 - RNA, 22 nt, Human
acacagcuuucagucauuaucu

SEQ ID NO: 710260 - RNA, 20 nt, Human
cuuguacaugauaaagauuu

SEQ ID NO: 710261 - RNA, 22 nt, Human
auucagcauaaucaguagcuug

SEQ ID NO: 710262 - RNA, 22 nt, Human
aaugacaauggcagagguagaa

SEQ ID NO: 710263 - RNA, 22 nt, Human
uucauaugcagauuaacaaaua

SEQ ID NO: 710264 - RNA, 22 nt, Human
auucaguguaguuauuaucuuu

SEQ ID NO: 710265 - RNA, 22 nt, Human
uccuucagggggccgccugcac

SEQ ID NO: 710266 - RNA, 19 nt, Human
uccagggcuuuauggcuuu

SEQ ID NO: 710267 - RNA, 22 nt, Human
agugaaaagaugcauuucucug

SEQ ID NO: 710268 - RNA, 22 nt, Human
agccacagagcaggagaccuuu

SEQ ID NO: 710269 - RNA, 22 nt, Human
ucuccaggacugagcuccagcc

SEQ ID NO: 710270 - RNA, 22 nt, Human
uuucuuaguccuagagugauuu

SEQ ID NO: 710271 - RNA, 22 nt, Human
ucugccaggcuuggugcuagau

SEQ ID NO: 710272 - RNA, 22 nt, Human
uuucuaggucuuccauacugcc

SEQ ID NO: 710273 - RNA, 22 nt, Human
uaacacauuuuaagccauuuua

SEQ ID NO: 710274 - RNA, 22 nt, Human
gccuggggucccuuguuggcac

SEQ ID NO: 710275 - RNA, 22 nt, Human
gcugacugguucaggucccgcu

SEQ ID NO: 710276 - RNA, 22 nt, Human
ugcugcucaaugagaugccauc

SEQ ID NO: 710277 - RNA, 22 nt, Human
cuucacaguaaauccagaagaa

SEQ ID NO: 710278 - RNA, 18 nt, Human
guuaacaauuacuaacgc

SEQ ID NO: 710279 - RNA, 17 nt, Human
uguauuuguaccacagc

SEQ ID NO: 710280 - RNA, 22 nt, Human
gccucuggguuggugacaggcu

SEQ ID NO: 710281 - RNA, 22 nt, Human
aagugugggaaguugcuaaaau

SEQ ID NO: 710282 - RNA, 22 nt, Human
aaagugcugggauuacaagcgu

SEQ ID NO: 710283 - RNA, 22 nt, Human
cuugccagggacucagucaggg

SEQ ID NO: 710284 - RNA, 22 nt, Human
acugcauuaucaccaagaugua

SEQ ID NO: 710285 - RNA, 22 nt, Human
aguacauuuauuaaugguaaaa

SEQ ID NO: 710286 - RNA, 22 nt, Human
cagcccucugaagaggcgcuug

SEQ ID NO: 710287 - RNA, 22 nt, Human
augcaauaguaauucuagucug

SEQ ID NO: 710288 - RNA, 22 nt, Human
gucagcaaaaaauuuaugugag

SEQ ID NO: 710289 - RNA, 19 nt, Human
cucuuacagaauagacaca

SEQ ID NO: 710290 - RNA, 22 nt, Human
aacauguagcagaaacgacuaa

SEQ ID NO: 710291 - RNA, 22 nt, Human
agagccugcaucuagccucaga

SEQ ID NO: 710292 - RNA, 22 nt, Human
agguacugaaaaaauguuugca

SEQ ID NO: 710293 - RNA, 22 nt, Human
gacuggagugccuccaggaaag

SEQ ID NO: 710294 - RNA, 22 nt, Human
gagguccagccaagcggcaagg

SEQ ID NO: 710295 - RNA, 20 nt, Human
acaauauguagaugaauagc

SEQ ID NO: 710296 - RNA, 22 nt, Human
agcuccugcucuuugucccuaa

SEQ ID NO: 710297 - RNA, 22 nt, Human
ccaggaggucugaguguggaca

SEQ ID NO: 710298 - RNA, 22 nt, Human
caaagucagccagcuaguaggu

SEQ ID NO: 710299 - RNA, 22 nt, Human
cuguguuggcuuuucucuugua

SEQ ID NO: 710300 - RNA, 22 nt, Human
uacauagauuuugaaacuggac

SEQ ID NO: 710301 - RNA, 17 nt, Human
gcaccgugggcacacuc

SEQ ID NO: 710302 - RNA, 22 nt, Human
gagcagcagguggggcuggcuu

SEQ ID NO: 710303 - RNA, 22 nt, Human
augagcaguagguucauggcug

SEQ ID NO: 710304 - RNA, 22 nt, Human
uguggcuguugaggaccccaag

SEQ ID NO: 710305 - RNA, 22 nt, Human
ccuggccacucagguguggggc

SEQ ID NO: 710306 - RNA, 18 nt, Human
gcagagcagaagcucaag

SEQ ID NO: 710307 - RNA, 22 nt, Human
agugaacaaagguagugagcau

SEQ ID NO: 710308 - RNA, 20 nt, Human
acaguguuagguuuuuccuu

SEQ ID NO: 710309 - RNA, 22 nt, Human
augccaaagcccaaguucauca

SEQ ID NO: 710310 - RNA, 22 nt, Human
acagauaaauuuauaggagugu

SEQ ID NO: 710311 - RNA, 21 nt, Human
gacaggcaaggagucacuuag

SEQ ID NO: 710312 - RNA, 22 nt, Human
cacccaggcagguggcugagaa

SEQ ID NO: 710313 - RNA, 21 nt, Human
ugggcaccaaaaccuaggagu

SEQ ID NO: 710314 - RNA, 22 nt, Human
caugaacuccaagcuuccuucc

SEQ ID NO: 710315 - RNA, 22 nt, Human
auccuuggcacaguggaauuca

SEQ ID NO: 710316 - RNA, 22 nt, Human
aggaggaacucagaaagaaggu

SEQ ID NO: 710317 - RNA, 22 nt, Human
aguaucuucaaguuucuucuag

SEQ ID NO: 710318 - RNA, 22 nt, Human
ucuucagagcauuucugaggua

SEQ ID NO: 710319 - RNA, 22 nt, Human
aguuuucaguaaauauuaguga

SEQ ID NO: 710320 - RNA, 22 nt, Human
aggcucagugcaaaucauucug

SEQ ID NO: 710321 - RNA, 22 nt, Human
gaggacugaaacuuacaggaaa

SEQ ID NO: 710322 - RNA, 22 nt, Human
caugagugucaucucagcagcu

SEQ ID NO: 710323 - RNA, 22 nt, Human
guguccuuauaagaagagaugc

SEQ ID NO: 710324 - RNA, 22 nt, Human
uacugcaugguggaguggagcu

SEQ ID NO: 710325 - RNA, 22 nt, Human
gcagaggaucaggcucuggaaa

SEQ ID NO: 710326 - RNA, 22 nt, Human
ccuggggaccugccucagcccu

SEQ ID NO: 710327 - RNA, 22 nt, Human
cauaaugugugucauacagacu

SEQ ID NO: 710328 - RNA, 22 nt, Human
cgggcagauugggaagguucau

SEQ ID NO: 710329 - RNA, 22 nt, Human
accaggaagaacaggcaaggca

SEQ ID NO: 710330 - RNA, 22 nt, Human
uagggcucacugagaugaauau

SEQ ID NO: 710331 - RNA, 22 nt, Human
uauuauauuuaguaauguggag

SEQ ID NO: 710332 - RNA, 22 nt, Human
uuggagaauguuuuccugcagu

SEQ ID NO: 710333 - RNA, 22 nt, Human
cuggggcucucuggaaugcuug

SEQ ID NO: 710334 - RNA, 22 nt, Human
uuugacaucuaagaauucuuac

SEQ ID NO: 710335 - RNA, 22 nt, Human
gggugcugacuggggccugaaa

SEQ ID NO: 710336 - RNA, 22 nt, Human
guggcaguugcuguggcaauaa

SEQ ID NO: 710337 - RNA, 22 nt, Human
acaagugcauggaaucagcugu

SEQ ID NO: 710338 - RNA, 22 nt, Human
aagggcucugcugucucucccc

SEQ ID NO: 710339 - RNA, 19 nt, Human
acagugucuguauauaaau

SEQ ID NO: 710340 - RNA, 22 nt, Human
gagagcuguguucauucuacca

SEQ ID NO: 710341 - RNA, 22 nt, Human
aaugaauggguuuaauauuuua

SEQ ID NO: 710342 - RNA, 22 nt, Human
uauuguacaugguuaugcagga

SEQ ID NO: 710343 - RNA, 22 nt, Human
gaagcaaagagcuagugccgcu

SEQ ID NO: 710344 - RNA, 22 nt, Human
cagggucaagagacuccagcag

SEQ ID NO: 710345 - RNA, 22 nt, Human
ggcuccugcuguccuuugaagc

SEQ ID NO: 710346 - RNA, 20 nt, Human
aagcuggaagaccagcauug

SEQ ID NO: 710347 - RNA, 22 nt, Human
gcuccaggcgagcuggaccaga

SEQ ID NO: 710348 - RNA, 22 nt, Human
uacauguuuacuccaagucagg

SEQ ID NO: 710349 - RNA, 22 nt, Human
aggaaugucauagaauaaucau

SEQ ID NO: 710350 - RNA, 19 nt, Human
ccagagcccgccagauggg

SEQ ID NO: 710351 - RNA, 22 nt, Human
gucccaggugggcuccaccucu

SEQ ID NO: 710352 - RNA, 23 nt, Human
ucuuggcuggacaagucacucac

SEQ ID NO: 710353 - RNA, 22 nt, Human
auaaggaaccugggcuuaagag

SEQ ID NO: 710354 - RNA, 22 nt, Human
ugcaaacaguuaagaugcaggc

SEQ ID NO: 710355 - RNA, 22 nt, Human
uguccaccgguccugugauggg

SEQ ID NO: 710356 - RNA, 22 nt, Human
agcaguaagacuuuuuucugug

SEQ ID NO: 710357 - RNA, 23 nt, Human
ccuccugggcacaggccugaugg

SEQ ID NO: 710358 - RNA, 22 nt, Human
agaaauguauucuguauguuuu

SEQ ID NO: 710359 - RNA, 22 nt, Human
guuucagaaaugguuuaugcaa

SEQ ID NO: 710360 - RNA, 22 nt, Human
uuguaaacugcugcaggagugc

SEQ ID NO: 710361 - RNA, 21 nt, Human
gcugcccaacccugcaucucc

SEQ ID NO: 710362 - RNA, 22 nt, Human
ggcaugcaugcaagguggugua

SEQ ID NO: 710363 - RNA, 22 nt, Human
gcuggguggaucggaggcucug

SEQ ID NO: 710364 - RNA, 22 nt, Human
ucugaggcuaagagacagaggc

SEQ ID NO: 710365 - RNA, 22 nt, Human
gcugaggagcgagaacucugcu

SEQ ID NO: 710366 - RNA, 22 nt, Human
uguacagacuguauuuacaagu

SEQ ID NO: 710367 - RNA, 22 nt, Human
ucuuugcaaaauacaacaaugg

SEQ ID NO: 710368 - RNA, 19 nt, Human
uuuuggaaaugugaacagc

SEQ ID NO: 710369 - RNA, 21 nt, Human
uagcaggaggccccugcuugc

SEQ ID NO: 710370 - RNA, 22 nt, Human
agggcagcccuucugggagggc

SEQ ID NO: 710371 - RNA, 22 nt, Human
uaccuuugaucuggaauuuuaa

SEQ ID NO: 710372 - RNA, 22 nt, Human
gagcugccaguguaugaauucu

SEQ ID NO: 710373 - RNA, 18 nt, Human
acucaggaaaugaugaca

SEQ ID NO: 710374 - RNA, 22 nt, Human
gaacuuuguggggcugagagga

SEQ ID NO: 710375 - RNA, 22 nt, Human
caguccuuucugaaauccuaua

SEQ ID NO: 710376 - RNA, 22 nt, Human
gucuccuguccugcaggaugga

SEQ ID NO: 710377 - RNA, 22 nt, Human
gauaaugaugacaaugacaacc

SEQ ID NO: 710378 - RNA, 22 nt, Human
uuugagaagaguuugagguauu

SEQ ID NO: 710379 - RNA, 22 nt, Human
gagccagcuacauggucugcaa

SEQ ID NO: 710380 - RNA, 22 nt, Human
aaaaaccuuucauugcaaaugu

SEQ ID NO: 710381 - RNA, 22 nt, Human
guuccugagaaauaaagagaga

SEQ ID NO: 710382 - RNA, 22 nt, Human
cuggagugauacucagaaugug

SEQ ID NO: 710383 - RNA, 22 nt, Human
acugucuguccugcucuccgug

SEQ ID NO: 710384 - RNA, 16 nt, Human
gggagggaguuggugg

SEQ ID NO: 710385 - RNA, 22 nt, Human
ggccucucucccuggcuugcag

SEQ ID NO: 710386 - RNA, 22 nt, Human
auacauucaucacuuuuggucc

SEQ ID NO: 710387 - RNA, 22 nt, Human
ucuuucuuaaauagguggauug

SEQ ID NO: 710388 - RNA, 22 nt, Human
auggacagguacugcagugggu

SEQ ID NO: 710389 - RNA, 23 nt, Human
acuguuggugcagaagugccuug

SEQ ID NO: 710390 - RNA, 22 nt, Human
ucuugggggacuuuggcaugga

SEQ ID NO: 710391 - RNA, 22 nt, Human
acaaugucucauauucguguuc

SEQ ID NO: 710392 - RNA, 22 nt, Human
uuuagcaaauuagcaccucuaa

SEQ ID NO: 710393 - RNA, 22 nt, Human
ucuuuugugccaaguaaugaau

SEQ ID NO: 710394 - RNA, 22 nt, Human
aggagcugguagucucauuggg

SEQ ID NO: 710395 - RNA, 20 nt, Human
gaauguuucacuugcuccau

SEQ ID NO: 710396 - RNA, 22 nt, Human
guuaaagugaucuugucagguu

SEQ ID NO: 710397 - RNA, 22 nt, Human
uacuauuuugacaugaaauuga

SEQ ID NO: 710398 - RNA, 22 nt, Human
aggcugugagaaguccuucagu

SEQ ID NO: 710399 - RNA, 22 nt, Human
uauguugcaccaaccuaauaau

SEQ ID NO: 710400 - RNA, 20 nt, Human
ggauggccggaccagagccu

SEQ ID NO: 710401 - RNA, 22 nt, Human
uccucccugcacucagugaagu

SEQ ID NO: 710402 - RNA, 22 nt, Human
uaucuacaguuaauaugucauc

SEQ ID NO: 710403 - RNA, 18 nt, Human
ggguucaccugccuuugg

SEQ ID NO: 710404 - RNA, 22 nt, Human
cuagaaaaauacuuuauuguga

SEQ ID NO: 710405 - RNA, 22 nt, Human
ggccugcuuuccgagccugcag

SEQ ID NO: 710406 - RNA, 22 nt, Human
acaagucuguuaugcaccugga

SEQ ID NO: 710407 - RNA, 20 nt, Human
uucauucacguagcuguuga

SEQ ID NO: 710408 - RNA, 22 nt, Human
auuucugccauagccaggggau

SEQ ID NO: 710409 - RNA, 22 nt, Human
ccuguuguuuagcacuuagaac

SEQ ID NO: 710410 - RNA, 20 nt, Human
acaaaguauugaggacaagu

SEQ ID NO: 710411 - RNA, 22 nt, Human
ugaucauuaucaaacuggucau

SEQ ID NO: 710412 - RNA, 19 nt, Human
cugaggcaaguggugguca

SEQ ID NO: 710413 - RNA, 22 nt, Human
acuuaaagguuagcuauucuac

SEQ ID NO: 710414 - RNA, 22 nt, Human
ggagagcugguauaugaagaca

SEQ ID NO: 710415 - RNA, 22 nt, Human
gcugggcagugagugaguccuu

SEQ ID NO: 710416 - RNA, 22 nt, Human
cuuuugcacccagaguuauuug

SEQ ID NO: 710417 - RNA, 22 nt, Human
cucagagagacaaugugggaca

SEQ ID NO: 710418 - RNA, 22 nt, Human
cucggguaccaugcuaggcacu

SEQ ID NO: 710419 - RNA, 22 nt, Human
ucccagagcucuggagguugga

SEQ ID NO: 710420 - RNA, 22 nt, Human
caggguacagaguuuucuaaac

SEQ ID NO: 710421 - RNA, 22 nt, Human
uuaaauauuauguugucugcaa

SEQ ID NO: 710422 - RNA, 22 nt, Human
acugaggaacauauauaagaug

SEQ ID NO: 710423 - RNA, 22 nt, Human
acuccugugggcauggcacccc

SEQ ID NO: 710424 - RNA, 22 nt, Human
auggccaguguugagaucaggc

SEQ ID NO: 710425 - RNA, 22 nt, Human
cccagccaagugaucugaccgc

SEQ ID NO: 710426 - RNA, 22 nt, Human
cugcuuugacuguuaagaacca

SEQ ID NO: 710427 - RNA, 22 nt, Human
aguaugaauggaaacuaccuau

SEQ ID NO: 710428 - RNA, 22 nt, Human
caaagguaaagaucugcugugg

SEQ ID NO: 710429 - RNA, 22 nt, Human
ccagagcugcauccagcagguu

SEQ ID NO: 710430 - RNA, 22 nt, Human
ccaccagcuucagcagccgcgg

SEQ ID NO: 710431 - RNA, 22 nt, Human
ggcuggccagggcccucgcugg

SEQ ID NO: 710432 - RNA, 23 nt, Human
uucucaguccugcccagggaggc

SEQ ID NO: 710433 - RNA, 22 nt, Human
gauugaaagacuguuugggaga

SEQ ID NO: 710434 - RNA, 22 nt, Human
ggaugcugcugcacauccugca

SEQ ID NO: 710435 - RNA, 22 nt, Human
agcuuuauucaugauuucaggg

SEQ ID NO: 710436 - RNA, 22 nt, Human
agcagggcucacauuaguggau

SEQ ID NO: 710437 - RNA, 22 nt, Human
augugcuuauggucucugguug

SEQ ID NO: 710438 - RNA, 20 nt, Human
ugugucuuccuuucuuuaug

SEQ ID NO: 710439 - RNA, 22 nt, Human
guguacauauugagucugcuga

SEQ ID NO: 710440 - RNA, 21 nt, Human
acuguuauucccauuuucacc

SEQ ID NO: 710441 - RNA, 22 nt, Human
agaaagcacccugcacuuucug

SEQ ID NO: 710442 - RNA, 22 nt, Human
uugggaaauauggauuguuauu

SEQ ID NO: 710443 - RNA, 20 nt, Human
gaggcugcggacugcuggac

SEQ ID NO: 710444 - RNA, 22 nt, Human
ccugccugcguccucugagggc

SEQ ID NO: 710445 - RNA, 22 nt, Human
aauagcauccuguaucucuucc

SEQ ID NO: 710446 - RNA, 22 nt, Human
acauagaaggaagaguaguagg

SEQ ID NO: 710447 - RNA, 22 nt, Human
acaacuggcuuuuuagcuuguu

SEQ ID NO: 710448 - RNA, 22 nt, Human
acagggcagaaauguugcaucu

SEQ ID NO: 710449 - RNA, 22 nt, Human
acaaagcuagagaagagaauug

SEQ ID NO: 710450 - RNA, 22 nt, Human
gcucucugcagccuccuuggag

SEQ ID NO: 710451 - RNA, 22 nt, Human
auguuuccagauaugucacccu

SEQ ID NO: 710452 - RNA, 22 nt, Human
agagggugaaugagauagaaaa

SEQ ID NO: 710453 - RNA, 22 nt, Human
aagaaaggauauaugggaggua

SEQ ID NO: 710454 - RNA, 22 nt, Human
caugcagaugucaugaggcaug

SEQ ID NO: 710455 - RNA, 22 nt, Human
acuggaagccaguugacaauca

SEQ ID NO: 710456 - RNA, 22 nt, Human
caucacagggggcuagaagucu

SEQ ID NO: 710457 - RNA, 23 nt, Human
ugagaagccaggggagcgugagg

SEQ ID NO: 710458 - RNA, 22 nt, Human
agcagauaguagaacauguaua

SEQ ID NO: 710459 - RNA, 21 nt, Human
uggcugccuacaugcugcagg

SEQ ID NO: 710460 - RNA, 21 nt, Human
gugugcugauacauuggagaa

SEQ ID NO: 710461 - RNA, 22 nt, Human
uuucucugcuguguuggcagcu

SEQ ID NO: 710462 - RNA, 22 nt, Human
uuguauuaaaauguguuucugu

SEQ ID NO: 710463 - RNA, 22 nt, Human
cagugagggcccccuuccaggu

SEQ ID NO: 710464 - RNA, 20 nt, Human
ggccacagggugcuggugga

SEQ ID NO: 710465 - RNA, 22 nt, Human
aaaaugaggaacggaucauggc

SEQ ID NO: 710466 - RNA, 22 nt, Human
ccaggcuggauuuugcaguuca

SEQ ID NO: 710467 - RNA, 22 nt, Human
cagagguuugaucgaguagguc

SEQ ID NO: 710468 - RNA, 22 nt, Human
cagcaaggguuauaucaaagau

SEQ ID NO: 710469 - RNA, 22 nt, Human
auuaguguucuuaucuucuagg

SEQ ID NO: 710470 - RNA, 22 nt, Human
uccaaaggcaaaacuguggugu

SEQ ID NO: 710471 - RNA, 22 nt, Human
augguggacucuugauucaggc

SEQ ID NO: 710472 - RNA, 22 nt, Human
ugcucuggguucuugcuguuac

SEQ ID NO: 710473 - RNA, 22 nt, Human
ugccaccaggagaaccagugca

SEQ ID NO: 710474 - RNA, 22 nt, Human
cucuuaaagcuuccaguuucaa

SEQ ID NO: 710475 - RNA, 22 nt, Human
ucuugaaguccuuacauuugau

SEQ ID NO: 710476 - RNA, 22 nt, Human
aagcagcagccugaaguacguc

SEQ ID NO: 710477 - RNA, 20 nt, Human
ggagagcagggaagacagua

SEQ ID NO: 710478 - RNA, 22 nt, Human
uacugucugcuucuuauagcuu

SEQ ID NO: 710479 - RNA, 20 nt, Human
gugggcagagcaccaccugg

SEQ ID NO: 710480 - RNA, 22 nt, Human
guggagcccugguagggacccc

SEQ ID NO: 710481 - RNA, 22 nt, Human
ccacugauccugacuuuggagc

SEQ ID NO: 710482 - RNA, 22 nt, Human
uucagaauauuuguuuuacaug

SEQ ID NO: 710483 - RNA, 22 nt, Human
uauuuaaaaagaggccagcugg

SEQ ID NO: 710484 - RNA, 22 nt, Human
caggcuccauuaaucauccugc

SEQ ID NO: 710485 - RNA, 22 nt, Human
uuugcacacauucuuagaaaug

SEQ ID NO: 710486 - RNA, 22 nt, Human
caaaugcagauucaggaguucu

SEQ ID NO: 710487 - RNA, 22 nt, Human
ccaggcagccugcuccauucug

SEQ ID NO: 710488 - RNA, 22 nt, Human
cuggggcauugggagaggccug

SEQ ID NO: 710489 - RNA, 22 nt, Human
cuuuguuguuaauuggcgcuua

SEQ ID NO: 710490 - RNA, 22 nt, Human
cccaggaaauagccaggaggug

SEQ ID NO: 710491 - RNA, 22 nt, Human
ucagcccaacccugcacaagga

SEQ ID NO: 710492 - RNA, 22 nt, Human
uucuuuccuugccucagugaag

SEQ ID NO: 710493 - RNA, 22 nt, Human
gaaaucuugcucauugugacaa

SEQ ID NO: 710494 - RNA, 21 nt, Human
ugcuucccugggccacacuga

SEQ ID NO: 710495 - RNA, 22 nt, Human
cucuggcuccauuucccuaugu

SEQ ID NO: 710496 - RNA, 22 nt, Human
cuuucaguuaguaccuaguggc

SEQ ID NO: 710497 - RNA, 18 nt, Human
ugaggccucugcugggcc

SEQ ID NO: 710498 - RNA, 22 nt, Human
gcuggagaggggucacucugag

SEQ ID NO: 710499 - RNA, 22 nt, Human
ugcauauacccgcauuuacaua

SEQ ID NO: 710500 - RNA, 22 nt, Human
uguagaaacuacacaugcaaca

SEQ ID NO: 710501 - RNA, 19 nt, Human
acaaauuguccucaucaag

SEQ ID NO: 710502 - RNA, 22 nt, Human
uugauacaugcucuagaguuga

SEQ ID NO: 710503 - RNA, 18 nt, Human
gagguagauaagauuuuc

SEQ ID NO: 710504 - RNA, 22 nt, Human
ugacagaguccagaaguagugu

SEQ ID NO: 710505 - RNA, 22 nt, Human
ucugccuggaugauggcagggc

SEQ ID NO: 710506 - RNA, 22 nt, Human
gccaggcauguccucugcagaa

SEQ ID NO: 710507 - RNA, 22 nt, Human
ggaagaaaaugggcaacaggug

SEQ ID NO: 710508 - RNA, 22 nt, Human
aaacacugucucugguauugaa

SEQ ID NO: 710509 - RNA, 22 nt, Human
aaguacauggaggauagcugcu

SEQ ID NO: 710510 - RNA, 19 nt, Human
agcuuccauauucucuagu

SEQ ID NO: 710511 - RNA, 22 nt, Human
uggcugcuagccagagcuucag

SEQ ID NO: 710512 - RNA, 22 nt, Human
uccaugaggcagggaggcuggc

SEQ ID NO: 710513 - RNA, 22 nt, Human
cauaauauacuacauugaugaa

SEQ ID NO: 710514 - RNA, 22 nt, Human
uggggccugugacggguccaga

SEQ ID NO: 710515 - RNA, 22 nt, Human
aagcuggcaugucaccugagaa

SEQ ID NO: 710516 - RNA, 22 nt, Human
cugcagcaguacucagcagcca

SEQ ID NO: 710517 - RNA, 22 nt, Human
gcaaggcuuugugaauuuuaaa

SEQ ID NO: 710518 - RNA, 22 nt, Human
gcagaccucaggacaucauuag

SEQ ID NO: 710519 - RNA, 22 nt, Human
cucuuuacucuguguuauuguu

SEQ ID NO: 710520 - RNA, 22 nt, Human
cagaggcaggaagaugggcagu

SEQ ID NO: 710521 - RNA, 22 nt, Human
uuccuucaguucagggaacccu

SEQ ID NO: 710522 - RNA, 22 nt, Human
ccaugcuaggaacucucaggga

SEQ ID NO: 710523 - RNA, 20 nt, Human
cugcccugcccuggguccug

SEQ ID NO: 710524 - RNA, 22 nt, Human
uuaucucucacuuuuaaggaca

SEQ ID NO: 710525 - RNA, 23 nt, Human
agcagcaaaaauuuaucuuucug

SEQ ID NO: 710526 - RNA, 21 nt, Human
agagcugggacuugccugaga

SEQ ID NO: 710527 - RNA, 22 nt, Human
ugcauuuuugauaacuguguac

SEQ ID NO: 710528 - RNA, 22 nt, Human
ugugugucuuugccuccucuca

SEQ ID NO: 710529 - RNA, 22 nt, Human
aacacaggggguuacaaauugu

SEQ ID NO: 710530 - RNA, 23 nt, Human
cuucuagagucagcuccaaguuu

SEQ ID NO: 710531 - RNA, 22 nt, Human
ggcugccuugacccuggcuccg

SEQ ID NO: 710532 - RNA, 22 nt, Human
uucugggacauugcagguauuc

SEQ ID NO: 710533 - RNA, 22 nt, Human
ggaguaaggcucagaggaaaug

SEQ ID NO: 710534 - RNA, 22 nt, Human
guguggcugaaaucaaggcagg

SEQ ID NO: 710535 - RNA, 18 nt, Human
uauucuguccuaugaagc

SEQ ID NO: 710536 - RNA, 22 nt, Human
gucuaaacuuagggaucgaaca

SEQ ID NO: 710537 - RNA, 22 nt, Human
gcaaggcugugcacuuugcauu

SEQ ID NO: 710538 - RNA, 22 nt, Human
cuguggcaggugucuggggcag

SEQ ID NO: 710539 - RNA, 22 nt, Human
cacccagcacagagggaggcga

SEQ ID NO: 710540 - RNA, 22 nt, Human
guuuaauaauguugaauuacua

SEQ ID NO: 710541 - RNA, 22 nt, Human
gucugccuggaggcagcugcug

SEQ ID NO: 710542 - RNA, 22 nt, Human
uggccagaaccugcaguaggcc

SEQ ID NO: 710543 - RNA, 22 nt, Human
ggagccaguuuagaccucaguu

SEQ ID NO: 710544 - RNA, 22 nt, Human
gaguacauguauagagauuaac

SEQ ID NO: 710545 - RNA, 22 nt, Human
ucuggguccccgaggaaggaga

SEQ ID NO: 710546 - RNA, 22 nt, Human
gaggaaaugguuguucaggugg

SEQ ID NO: 710547 - RNA, 22 nt, Human
uugcaggguuaaaguaagguag

SEQ ID NO: 710548 - RNA, 22 nt, Human
acaguuuaggaugagagaacac

SEQ ID NO: 710549 - RNA, 22 nt, Human
aguugugagaaacagaaugagc

SEQ ID NO: 710550 - RNA, 22 nt, Human
gugacuguuuuuaggaggagua

SEQ ID NO: 710551 - RNA, 23 nt, Human
gcuguacaggaaccaguuuggag

SEQ ID NO: 710552 - RNA, 22 nt, Human
acugucuucauaucugugucuc

SEQ ID NO: 710553 - RNA, 22 nt, Human
aguauauuuugauuguaugugu

SEQ ID NO: 710554 - RNA, 22 nt, Human
auggcagggaccaagcugucau

SEQ ID NO: 710555 - RNA, 22 nt, Human
ugaggccucauaaugagauuuc

SEQ ID NO: 710556 - RNA, 22 nt, Human
aggugggcaccaggcuuguggu

SEQ ID NO: 710557 - RNA, 22 nt, Human
uacaaaaguaauuacgguuuuu

SEQ ID NO: 710558 - RNA, 21 nt, Human
aaagauguuucuuuuccucac

SEQ ID NO: 710559 - RNA, 22 nt, Human
cggcuuccagcaggugcugcgc

SEQ ID NO: 710560 - RNA, 22 nt, Human
ucugcuguguccccugugcggg

SEQ ID NO: 710561 - RNA, 22 nt, Human
ucugggaacgaaggcuaauaug

SEQ ID NO: 710562 - RNA, 22 nt, Human
uggcugugguuuaucccaguuc

SEQ ID NO: 710563 - RNA, 22 nt, Human
uggugacacgaaguuugcuauc

SEQ ID NO: 710564 - RNA, 22 nt, Human
cagcuuuuuagaaucuagggca

SEQ ID NO: 710565 - RNA, 22 nt, Human
cauuguuauagcauuacacacc

SEQ ID NO: 710566 - RNA, 22 nt, Human
gucccugggaaaggagagggca

SEQ ID NO: 710567 - RNA, 22 nt, Human
acuggacagguucaugguuuua

SEQ ID NO: 710568 - RNA, 22 nt, Human
acaaagucaaauugcagccgcc

SEQ ID NO: 710569 - RNA, 19 nt, Human
ucguggggaggugggcagc

SEQ ID NO: 710570 - RNA, 22 nt, Human
aguccagggcuuagucagcggg

SEQ ID NO: 710571 - RNA, 22 nt, Human
aaauugucuuuaaucaggucau

SEQ ID NO: 710572 - RNA, 22 nt, Human
uuugacuucugggcauuuuggu

SEQ ID NO: 710573 - RNA, 22 nt, Human
ucagccaguauuugagugcuca

SEQ ID NO: 710574 - RNA, 22 nt, Human
auagaauguauuauaguacaga

SEQ ID NO: 710575 - RNA, 22 nt, Human
cccagccagccucuucccauau

SEQ ID NO: 710576 - RNA, 17 nt, Human
cucuguggagguguuua

SEQ ID NO: 710577 - RNA, 22 nt, Human
ugugcccaacgugcagguuugu

SEQ ID NO: 710578 - RNA, 22 nt, Human
gacaucaggaagacaugagagg

SEQ ID NO: 710579 - RNA, 22 nt, Human
uagcagcauguaagugaguaga

SEQ ID NO: 710580 - RNA, 22 nt, Human
auccagugagugcagcuguugu

SEQ ID NO: 710581 - RNA, 22 nt, Human
uuuaagcagagaaaugauguau

SEQ ID NO: 710582 - RNA, 22 nt, Human
uagcacaguucacuaugauaca

SEQ ID NO: 710583 - RNA, 22 nt, Human
agcauaaguugguacagccacu

SEQ ID NO: 710584 - RNA, 22 nt, Human
ggucccaggauugguugcgcag

SEQ ID NO: 710585 - RNA, 22 nt, Human
caccaggaccccacgguggguu

SEQ ID NO: 710586 - RNA, 17 nt, Human
auguggcuaagcugcug

SEQ ID NO: 710587 - RNA, 22 nt, Human
uucacaaugccuuguugauggu

SEQ ID NO: 710588 - RNA, 22 nt, Human
cagcucuuccuagccaugccac

SEQ ID NO: 710589 - RNA, 22 nt, Human
cuggagauacugcucuccauau

SEQ ID NO: 710590 - RNA, 22 nt, Human
uuacagaaguuucagcguuuua

SEQ ID NO: 710591 - RNA, 22 nt, Human
ucagccagcugugugcuucugc

SEQ ID NO: 710592 - RNA, 22 nt, Human
gaagguuuacugaagauuuaaa

SEQ ID NO: 710593 - RNA, 22 nt, Human
uggcugugucccuguccagagu

SEQ ID NO: 710594 - RNA, 22 nt, Human
agugcagacugaaaugaccuuc

SEQ ID NO: 710595 - RNA, 22 nt, Human
cuggcaggagcuguggccguag

SEQ ID NO: 710596 - RNA, 22 nt, Human
auuguuaaaguaauaaccaugg

SEQ ID NO: 710597 - RNA, 22 nt, Human
aggggcugccuggcuuggcacu

SEQ ID NO: 710598 - RNA, 22 nt, Human
ucuguccaggcuuacuauauau

SEQ ID NO: 710599 - RNA, 22 nt, Human
acaacaucagcugagaccuuca

SEQ ID NO: 710600 - RNA, 22 nt, Human
cucucccagucaggcucaggau

SEQ ID NO: 710601 - RNA, 22 nt, Human
cccuuuaauuccaacacaggaa

SEQ ID NO: 710602 - RNA, 22 nt, Human
uucaggagcuggcugcgaagga

SEQ ID NO: 710603 - RNA, 22 nt, Human
auggcagaaaggcaugugggcc

SEQ ID NO: 710604 - RNA, 22 nt, Human
cccugugauguagcuagaguag

SEQ ID NO: 710605 - RNA, 22 nt, Human
auggcccaggccuccuguggcu

SEQ ID NO: 710606 - RNA, 22 nt, Human
gccuccugagaagccacaggcu

SEQ ID NO: 710607 - RNA, 22 nt, Human
ugucuagugguuuauaaaauca

SEQ ID NO: 710608 - RNA, 22 nt, Human
caaaguuuaaaguagauuucag

SEQ ID NO: 710609 - RNA, 22 nt, Human
aaauacuggcaagugcuaauuc

SEQ ID NO: 710610 - RNA, 22 nt, Human
guggaaugaauagauuugcauu

SEQ ID NO: 710611 - RNA, 22 nt, Human
cuggcuuuuagugugaagacuu

SEQ ID NO: 710612 - RNA, 22 nt, Human
gggcaggcugagcaugucaccu

SEQ ID NO: 710613 - RNA, 21 nt, Human
ccucucucauuguaaugaagu

SEQ ID NO: 710614 - RNA, 21 nt, Human
uugauuuagcagaucuagcug

SEQ ID NO: 710615 - RNA, 22 nt, Human
ccugagccuggcucaugcacuc

SEQ ID NO: 710616 - RNA, 19 nt, Human
cugggagguguucagagaa

SEQ ID NO: 710617 - RNA, 22 nt, Human
gaauaauauugacuuugcaggc

SEQ ID NO: 710618 - RNA, 23 nt, Human
agaagcugggagccuggggaugg

SEQ ID NO: 710619 - RNA, 22 nt, Human
aauagcauuuuuaagggaauca

SEQ ID NO: 710620 - RNA, 22 nt, Human
ccagauaucacugccguguugu

SEQ ID NO: 710621 - RNA, 21 nt, Human
uaugugucuguggaaaacuag

SEQ ID NO: 710622 - RNA, 22 nt, Human
uuuauuuggcauccagggagaa

SEQ ID NO: 710623 - RNA, 23 nt, Human
aggaaguuaugaagggagaauag

SEQ ID NO: 710624 - RNA, 18 nt, Human
ggcuucucacugaccuca

SEQ ID NO: 710625 - RNA, 22 nt, Human
aagugugugggcaggcaguggu

SEQ ID NO: 710626 - RNA, 22 nt, Human
aguguuucuggaaucaguguuu

SEQ ID NO: 710627 - RNA, 22 nt, Human
aucagcaaaaaugccuucagaa

SEQ ID NO: 710628 - RNA, 23 nt, Human
accagcugcccugaacuuugugc

SEQ ID NO: 710629 - RNA, 22 nt, Human
aagcaauguguuaaugaaugag

SEQ ID NO: 710630 - RNA, 22 nt, Human
ucagagagguuaaauaucuugu

SEQ ID NO: 710631 - RNA, 22 nt, Human
auguuaaaugguuuauuauuaa

SEQ ID NO: 710632 - RNA, 22 nt, Human
acaggcacucucauuaaaauag

SEQ ID NO: 710633 - RNA, 23 nt, Human
acugaagaugucuuaguggcccu

SEQ ID NO: 710634 - RNA, 22 nt, Human
gguagacugucaaacacuagcc

SEQ ID NO: 710635 - RNA, 21 nt, Human
uggcuucauuugcaacccacu

SEQ ID NO: 710636 - RNA, 22 nt, Human
uaguuuuagucccauuuuacag

SEQ ID NO: 710637 - RNA, 22 nt, Human
gcagcuuuaaacauuggaaaua

SEQ ID NO: 710638 - RNA, 22 nt, Human
ugaggaugguguuggagagggc

SEQ ID NO: 710639 - RNA, 22 nt, Human
uaagaacuuggcagcaagaaau

SEQ ID NO: 710640 - RNA, 22 nt, Human
accagcucagagcaggcuccug

SEQ ID NO: 710641 - RNA, 22 nt, Human
cagaugaggggcauauaacaau

SEQ ID NO: 710642 - RNA, 22 nt, Human
auauggaaugguaaucuacaau

SEQ ID NO: 710643 - RNA, 22 nt, Human
uucuggaggccccuuccuucuc

SEQ ID NO: 710644 - RNA, 22 nt, Human
uaaacaucugaauccugcuucc

SEQ ID NO: 710645 - RNA, 22 nt, Human
cccugcaggggaccugcagccu

SEQ ID NO: 710646 - RNA, 22 nt, Human
gcagcugcaauaggcaucaagc

SEQ ID NO: 710647 - RNA, 22 nt, Human
gagacagaugcugcuggagcau

SEQ ID NO: 710648 - RNA, 22 nt, Human
acugaguuauggguaugccuug

SEQ ID NO: 710649 - RNA, 22 nt, Human
ucaguaauauucuuuaaaauac

SEQ ID NO: 710650 - RNA, 22 nt, Human
aaggaugaacauuaauacauca

SEQ ID NO: 710651 - RNA, 22 nt, Human
cuggcagugacauugcaggugc

SEQ ID NO: 710652 - RNA, 22 nt, Human
agggguaguaggauaacaaauu

SEQ ID NO: 710653 - RNA, 22 nt, Human
ucuguccagagguccuggagac

SEQ ID NO: 710654 - RNA, 22 nt, Human
aggcagcuucugauuagcagcg

SEQ ID NO: 710655 - RNA, 22 nt, Human
uccagagagauaguggcuaaua

SEQ ID NO: 710656 - RNA, 22 nt, Human
ugggcuccggcggccucaggcu

SEQ ID NO: 710657 - RNA, 22 nt, Human
uucuuuucuuggcaggaguaga

SEQ ID NO: 710658 - RNA, 22 nt, Human
cagagggaguuucugagguugc

SEQ ID NO: 710659 - RNA, 22 nt, Human
ggccucagaccggagcuggcca

SEQ ID NO: 710660 - RNA, 22 nt, Human
cuaggcugcagaugcauggaau

SEQ ID NO: 710661 - RNA, 22 nt, Human
cagaguggcgacccccucagcu

SEQ ID NO: 710662 - RNA, 22 nt, Human
aagagguggaacagcaauucgu

SEQ ID NO: 710663 - RNA, 22 nt, Human
ugcugccucagcuuccugggcu

SEQ ID NO: 710664 - RNA, 17 nt, Human
gucugggcuuuagagac

SEQ ID NO: 710665 - RNA, 22 nt, Human
guccccuggcccccagcgucgg

SEQ ID NO: 710666 - RNA, 22 nt, Human
ucaguaaaugaaugaauauaug

SEQ ID NO: 710667 - RNA, 17 nt, Human
cugugcucgagugaugg

SEQ ID NO: 710668 - RNA, 22 nt, Human
aagacauguuuuaagaauauuu

SEQ ID NO: 710669 - RNA, 22 nt, Human
auugcaaucuggugaaaacagu

SEQ ID NO: 710670 - RNA, 22 nt, Human
cucuggacuuguacauacucag

SEQ ID NO: 710671 - RNA, 22 nt, Human
agaaaccuccauuuauucacuc

SEQ ID NO: 710672 - RNA, 22 nt, Human
auugacuuaaaggcucugguua

SEQ ID NO: 710673 - RNA, 22 nt, Human
ugcagggcaucuuugaagugug

SEQ ID NO: 710674 - RNA, 22 nt, Human
ccuugggcuugggcauagcuuu

SEQ ID NO: 710675 - RNA, 22 nt, Human
agauuuuaguguagaggacuug

SEQ ID NO: 710676 - RNA, 22 nt, Human
aggaaccagacagaacugaaug

SEQ ID NO: 710677 - RNA, 22 nt, Human
gcauccaaaccauucaucagcc

SEQ ID NO: 710678 - RNA, 22 nt, Human
cuuccucuagccuaguaaugcc

SEQ ID NO: 710679 - RNA, 22 nt, Human
gacuccagcauauacuuuuagu

SEQ ID NO: 710680 - RNA, 22 nt, Human
cccucccaagcacucugacaua

SEQ ID NO: 710681 - RNA, 22 nt, Human
caugagaaugaagaagacuuaa

SEQ ID NO: 710682 - RNA, 22 nt, Human
ccaaaagcagcugucugugaau

SEQ ID NO: 710683 - RNA, 22 nt, Human
ucagguccucugggucccagcc

SEQ ID NO: 710684 - RNA, 22 nt, Human
auaaaggcaacaccaggguaug

SEQ ID NO: 710685 - RNA, 22 nt, Human
auacagaaaaugaugcagaguu

SEQ ID NO: 710686 - RNA, 18 nt, Human
gugagcagagagcaucac

SEQ ID NO: 710687 - RNA, 22 nt, Human
uagaagaucuuaaaagcugacu

SEQ ID NO: 710688 - RNA, 22 nt, Human
uuuuagcacuaagugauaugcu

SEQ ID NO: 710689 - RNA, 22 nt, Human
gagccucguggcggccacugcg

SEQ ID NO: 710690 - RNA, 22 nt, Human
gccugccugcugugugcaaguu

SEQ ID NO: 710691 - RNA, 22 nt, Human
uagacauacagugcaguacaua

SEQ ID NO: 710692 - RNA, 20 nt, Human
augcuuucuugugugcugcu

SEQ ID NO: 710693 - RNA, 22 nt, Human
gaguuauuaauggcugaguuug

SEQ ID NO: 710694 - RNA, 22 nt, Human
uggccagaguccagugagccuu

SEQ ID NO: 710695 - RNA, 22 nt, Human
uuaacuucaacacucucuugua

SEQ ID NO: 710696 - RNA, 22 nt, Human
ugucucaguauacgaaacacuu

SEQ ID NO: 710697 - RNA, 22 nt, Human
ggcuugucauguugauguucuu

SEQ ID NO: 710698 - RNA, 22 nt, Human
gauagcaacauagaacagaauu

SEQ ID NO: 710699 - RNA, 22 nt, Human
ccaggguggggcaggcccacug

SEQ ID NO: 710700 - RNA, 22 nt, Human
acagcuguggccacuugcaucc

SEQ ID NO: 710701 - RNA, 22 nt, Human
aaaaugcaugagaaugugcucg

SEQ ID NO: 710702 - RNA, 22 nt, Human
auuauuugacuugagaacaggu

SEQ ID NO: 710703 - RNA, 22 nt, Human
agauuuagcugugaacagcuug

SEQ ID NO: 710704 - RNA, 22 nt, Human
ggcuuccagcugggccuuggag

SEQ ID NO: 710705 - RNA, 22 nt, Human
auacuguuuugugacuuaucuu

SEQ ID NO: 710706 - RNA, 22 nt, Human
agaggggaaggaugugauguga

SEQ ID NO: 710707 - RNA, 22 nt, Human
agggcucagaacaaugagugua

SEQ ID NO: 710708 - RNA, 22 nt, Human
ugggaagggucaguuucuucau

SEQ ID NO: 710709 - RNA, 22 nt, Human
acacugugucuagcauuuuaca

SEQ ID NO: 710710 - RNA, 22 nt, Human
aggcagcugaccacaguaugau

SEQ ID NO: 710711 - RNA, 22 nt, Human
ugccgugucccauugugcucug

SEQ ID NO: 710712 - RNA, 22 nt, Human
ccuucgagauuuaaacacugau

SEQ ID NO: 710713 - RNA, 22 nt, Human
guuugccugugauguacauuuc

SEQ ID NO: 710714 - RNA, 22 nt, Human
uaaugaggaaauagagggaaug

SEQ ID NO: 710715 - RNA, 22 nt, Human
gcuguggccgucagggaaaugg

SEQ ID NO: 710716 - RNA, 22 nt, Human
ucccagaaucuuuggaagagca

SEQ ID NO: 710717 - RNA, 22 nt, Human
acaguggggucuuaauagaaca

SEQ ID NO: 710718 - RNA, 22 nt, Human
acaguagucuuaauuucaugua

SEQ ID NO: 710719 - RNA, 22 nt, Human
aggcccuguaagguguggagau

SEQ ID NO: 710720 - RNA, 21 nt, Human
caugucuuccacacuguagua

SEQ ID NO: 710721 - RNA, 22 nt, Human
uuuacaacguuccuggugcuaa

SEQ ID NO: 710722 - RNA, 22 nt, Human
cauggcaggaggcugcuggcag

SEQ ID NO: 710723 - RNA, 22 nt, Human
uuacacucugguugugggccuu

SEQ ID NO: 710724 - RNA, 22 nt, Human
uccuuaggaaaaugaugagggg

SEQ ID NO: 710725 - RNA, 22 nt, Human
uuauuguuuacuaguuugcaga

SEQ ID NO: 710726 - RNA, 22 nt, Human
aauauaugugguauugaccagc

SEQ ID NO: 710727 - RNA, 22 nt, Human
ggcacagaguuggcagagcugc

SEQ ID NO: 710728 - RNA, 23 nt, Human
ccuggcacacaguugacauggaa

SEQ ID NO: 710729 - RNA, 22 nt, Human
cuccacucaacaagcccagugu

SEQ ID NO: 710730 - RNA, 18 nt, Human
ggcucaggcuauccuaac

SEQ ID NO: 710731 - RNA, 22 nt, Human
aaagucugaaagauaagaguga

SEQ ID NO: 710732 - RNA, 23 nt, Human
auugaacagagagaaaaacaucc

SEQ ID NO: 710733 - RNA, 22 nt, Human
acauucuggaugucugaugaga

SEQ ID NO: 710734 - RNA, 22 nt, Human
gagacugcauuguccaaggguu

SEQ ID NO: 710735 - RNA, 22 nt, Human
aacucagucauaaagcgaaugc

SEQ ID NO: 710736 - RNA, 22 nt, Human
gcugcaggcgccugcggucucu

SEQ ID NO: 710737 - RNA, 22 nt, Human
gugggagaaauuagcucuaguu

SEQ ID NO: 710738 - RNA, 22 nt, Human
gggcuguaggagcuggaauggg

SEQ ID NO: 710739 - RNA, 22 nt, Human
cacacauuaauaucaaaggcuc

SEQ ID NO: 710740 - RNA, 22 nt, Human
ucaggaaagaguuagaugauua

SEQ ID NO: 710741 - RNA, 22 nt, Human
ugauacaaucaugagagaggac

SEQ ID NO: 710742 - RNA, 20 nt, Human
acaguuuauccaguuagcag

SEQ ID NO: 710743 - RNA, 22 nt, Human
acugugagaguuuuucuaggag

SEQ ID NO: 710744 - RNA, 22 nt, Human
uucacaggaggguggaugcaug

SEQ ID NO: 710745 - RNA, 23 nt, Human
uguguuuaccugaggaucuuguu

SEQ ID NO: 710746 - RNA, 22 nt, Human
cagggagaggcugguggaguaa

SEQ ID NO: 710747 - RNA, 19 nt, Human
agguaggcaguggcaugga

SEQ ID NO: 710748 - RNA, 22 nt, Human
auuugcuucugcuaaacaacuu

SEQ ID NO: 710749 - RNA, 22 nt, Human
guuuccuuuuucugcccucaau

SEQ ID NO: 710750 - RNA, 16 nt, Human
cagcuuuaugucagug

SEQ ID NO: 710751 - RNA, 17 nt, Human
agcugccagggagugug

SEQ ID NO: 710752 - RNA, 22 nt, Human
aaacccugcccuucccaagaug

SEQ ID NO: 710753 - RNA, 22 nt, Human
cuggccugaucucaugcugucc

SEQ ID NO: 710754 - RNA, 22 nt, Human
gcaaagcaagcugucagccuca

SEQ ID NO: 710755 - RNA, 22 nt, Human
ucucuaguauaauauagcaaaa

SEQ ID NO: 710756 - RNA, 22 nt, Human
ucaaaaggacagaagaccuaaa

SEQ ID NO: 710757 - RNA, 22 nt, Human
caggugaccuuuguccuaaguu

SEQ ID NO: 710758 - RNA, 22 nt, Human
caggaugguggcaugaucagaa

SEQ ID NO: 710759 - RNA, 22 nt, Human
ggagucugugucuugaagcagu

SEQ ID NO: 710760 - RNA, 19 nt, Human
ggggccugugauggucaca

SEQ ID NO: 710761 - RNA, 22 nt, Human
cacugcuuuaaggcugaguaac

SEQ ID NO: 710762 - RNA, 22 nt, Human
gauauacagagcauucuuugau

SEQ ID NO: 710763 - RNA, 22 nt, Human
gcuuucucuucacugauguuca

SEQ ID NO: 710764 - RNA, 22 nt, Human
augcuuuauacaaaacacuuaa

SEQ ID NO: 710765 - RNA, 22 nt, Human
aaguugcuagugcuuuucugag

SEQ ID NO: 710766 - RNA, 22 nt, Human
acacuguuuuagggaagaaaau

SEQ ID NO: 710767 - RNA, 22 nt, Human
cccacagguggaagccucggaa

SEQ ID NO: 710768 - RNA, 22 nt, Human
uaguuuagugaaugguuaaaga

SEQ ID NO: 710769 - RNA, 20 nt, Human
uaggcaauuaguagauaaca

SEQ ID NO: 710770 - RNA, 22 nt, Human
acaaucagcacugaguuuaucu

SEQ ID NO: 710771 - RNA, 22 nt, Human
gcugcagcagcugcaggguugu

SEQ ID NO: 710772 - RNA, 19 nt, Human
uggucucugucucuuugca

SEQ ID NO: 710773 - RNA, 22 nt, Human
uucuucaacaaggacacuguua

SEQ ID NO: 710774 - RNA, 22 nt, Human
uggguaggggacguggaagaaa

SEQ ID NO: 710775 - RNA, 22 nt, Human
ucugaaauacugcagguucucu

SEQ ID NO: 710776 - RNA, 22 nt, Human
agucacaguuucccugagagag

SEQ ID NO: 710777 - RNA, 22 nt, Human
aaaaaugaaacggcugguuggc

SEQ ID NO: 710778 - RNA, 17 nt, Human
gaauccuucucuguucu

SEQ ID NO: 710779 - RNA, 22 nt, Human
agcugcccccagggcugugcuu

SEQ ID NO: 710780 - RNA, 22 nt, Human
ccagaugucccucucagguuug

SEQ ID NO: 710781 - RNA, 22 nt, Human
agagaaaacucauugagguguc

SEQ ID NO: 710782 - RNA, 22 nt, Human
caggcuuggagggcaguggcau

SEQ ID NO: 710783 - RNA, 22 nt, Human
ucaauaaaauuguuuuccuauc

SEQ ID NO: 710784 - RNA, 22 nt, Human
cccugcacagccuggcucucuu

SEQ ID NO: 710785 - RNA, 22 nt, Human
aucaucauucuuggauaaagca

SEQ ID NO: 710786 - RNA, 22 nt, Human
uaaauugaucguuugggaugaa

SEQ ID NO: 710787 - RNA, 22 nt, Human
guuaaugugucugacacaaugg

SEQ ID NO: 710788 - RNA, 22 nt, Human
cgugcucuggacucguggcaca

SEQ ID NO: 710789 - RNA, 22 nt, Human
ucagggcaagucucagaagguu

SEQ ID NO: 710790 - RNA, 22 nt, Human
aaucagacuauuaaagucucuu

SEQ ID NO: 710791 - RNA, 22 nt, Human
ugcaguccaagagucuccuggu

SEQ ID NO: 710792 - RNA, 22 nt, Human
aaggccaggacaccaggggacu

SEQ ID NO: 710793 - RNA, 22 nt, Human
aguguucauuuauucauucacu

SEQ ID NO: 710794 - RNA, 22 nt, Human
cuuccuggccauugccauggca

SEQ ID NO: 710795 - RNA, 22 nt, Human
gucugggcuucagaguuagaga

SEQ ID NO: 710796 - RNA, 22 nt, Human
aggaagcccuugucauuucugu

SEQ ID NO: 710797 - RNA, 22 nt, Human
cgcugccaggauccccugccgg

SEQ ID NO: 710798 - RNA, 22 nt, Human
uagagguguucauucucuccau

SEQ ID NO: 710799 - RNA, 22 nt, Human
augccugucucagggucuguuu

SEQ ID NO: 710800 - RNA, 22 nt, Human
guggucagccccggugagcccu

SEQ ID NO: 710801 - RNA, 22 nt, Human
cuggccuggggccucagcugcu

SEQ ID NO: 710802 - RNA, 22 nt, Human
ugccugggggacuaaggccaaa

SEQ ID NO: 710803 - RNA, 19 nt, Human
gcaggguguugacuguccc

SEQ ID NO: 710804 - RNA, 22 nt, Human
caaauccagaucccagucguag

SEQ ID NO: 710805 - RNA, 22 nt, Human
agugcuguuagguuaauauagu

SEQ ID NO: 710806 - RNA, 22 nt, Human
ggccugugguuucuaguagguu

SEQ ID NO: 710807 - RNA, 22 nt, Human
acacugcuucucuggcagagcc

SEQ ID NO: 710808 - RNA, 22 nt, Human
ggcuggcacugaggagagcucu

SEQ ID NO: 710809 - RNA, 22 nt, Human
aucucuuagcagucuagugacc

SEQ ID NO: 710810 - RNA, 22 nt, Human
ucaggaaggcacuugguguguu

SEQ ID NO: 710811 - RNA, 22 nt, Human
auguuucauccacuggccuuuc

SEQ ID NO: 710812 - RNA, 22 nt, Human
agagccaaggcugagagcuauu

SEQ ID NO: 710813 - RNA, 22 nt, Human
uccagggcauccacgcgugggg

SEQ ID NO: 710814 - RNA, 22 nt, Human
aucauucucugcuugagcacuc

SEQ ID NO: 710815 - RNA, 22 nt, Human
caggaaagaaaugagaacacca

SEQ ID NO: 710816 - RNA, 22 nt, Human
uggugucucuuaguacauagau

SEQ ID NO: 710817 - RNA, 22 nt, Human
cauccuucaaaggcuacaauua

SEQ ID NO: 710818 - RNA, 22 nt, Human
aagaaaaucaguucuggucagu

SEQ ID NO: 710819 - RNA, 22 nt, Human
caggacaauuuugagccaccug

SEQ ID NO: 710820 - RNA, 22 nt, Human
aaaaacagaaugugucuaacuc

SEQ ID NO: 710821 - RNA, 22 nt, Human
uaguuuaggucguacaagcaaa

SEQ ID NO: 710822 - RNA, 21 nt, Human
aucucgggcuucucgcccagc

SEQ ID NO: 710823 - RNA, 22 nt, Human
ugggaaggacgugucaguggca

SEQ ID NO: 710824 - RNA, 22 nt, Human
guagaucucagacuuugaaauu

SEQ ID NO: 710825 - RNA, 22 nt, Human
uggaauguaaacucugugaggg

SEQ ID NO: 710826 - RNA, 22 nt, Human
guucacagucuacauaguaaag

SEQ ID NO: 710827 - RNA, 22 nt, Human
uacaggagagauuuaguaauca

SEQ ID NO: 710828 - RNA, 22 nt, Human
aggaggccaggcccucaagccu

SEQ ID NO: 710829 - RNA, 22 nt, Human
ugggcucaagugaugcuccugu

SEQ ID NO: 710830 - RNA, 22 nt, Human
gagcaccaaggcucugccaugg

SEQ ID NO: 710831 - RNA, 22 nt, Human
ggccugcuguguacugauguca

SEQ ID NO: 710832 - RNA, 22 nt, Human
ugaggaagggcacacggacccu

SEQ ID NO: 710833 - RNA, 22 nt, Human
ugcuuucucucuaccccacuuu

SEQ ID NO: 710834 - RNA, 22 nt, Human
augcagagacagauguggcaug

SEQ ID NO: 710835 - RNA, 22 nt, Human
cuucagccagcuggggaugcgg

SEQ ID NO: 710836 - RNA, 18 nt, Human
gcugccugcauuccucac

SEQ ID NO: 710837 - RNA, 22 nt, Human
uaggauacaaauucuguaauuu

SEQ ID NO: 710838 - RNA, 22 nt, Human
auguacacacacaucuuugcgu

SEQ ID NO: 710839 - RNA, 22 nt, Human
uccuuuaacuugauuauuuuca

SEQ ID NO: 710840 - RNA, 22 nt, Human
uuugcuuucccuuguagaaagu

SEQ ID NO: 710841 - RNA, 22 nt, Human
acuaaagcucacagaguugaac

SEQ ID NO: 710842 - RNA, 22 nt, Human
accaccccaaaugaaccucugu

SEQ ID NO: 710843 - RNA, 22 nt, Human
gaggccaugccuccugaucagu

SEQ ID NO: 710844 - RNA, 22 nt, Human
augaagggugucccugugagca

SEQ ID NO: 710845 - RNA, 22 nt, Human
gcccaaggucacacacaggaag

SEQ ID NO: 710846 - RNA, 22 nt, Human
cuggaggagcauggacuggagu

SEQ ID NO: 710847 - RNA, 22 nt, Human
gugaaggacugaaugaaaaugu

SEQ ID NO: 710848 - RNA, 19 nt, Human
ggacacagaaagcugcauu

SEQ ID NO: 710849 - RNA, 22 nt, Human
auggccagagaggccagccugg

SEQ ID NO: 710850 - RNA, 22 nt, Human
acacugaagagcacuuucaaag

SEQ ID NO: 710851 - RNA, 20 nt, Human
uacaggaccuucuuuguauc

SEQ ID NO: 710852 - RNA, 22 nt, Human
cggcagagcggcgagccccucc

SEQ ID NO: 710853 - RNA, 18 nt, Human
ucucucugaagaguuccc

SEQ ID NO: 710854 - RNA, 22 nt, Human
auaggaaagaaaauuauguagg

SEQ ID NO: 710855 - RNA, 22 nt, Human
auacagaaaaguggauagccag

SEQ ID NO: 710856 - RNA, 22 nt, Human
gucuggaaauuuaagguaugag

SEQ ID NO: 710857 - RNA, 22 nt, Human
acaugugaaaucucauaguuag

SEQ ID NO: 710858 - RNA, 22 nt, Human
uacccaggggcugagcagaggu

SEQ ID NO: 710859 - RNA, 22 nt, Human
ccuggaggagcgcugaccagcu

SEQ ID NO: 710860 - RNA, 22 nt, Human
auguagcuugucccacaucaua

SEQ ID NO: 710861 - RNA, 22 nt, Human
guuugaaaguucaacaggaaaa

SEQ ID NO: 710862 - RNA, 22 nt, Human
aaccagaaggaaucugagcuga

SEQ ID NO: 710863 - RNA, 22 nt, Human
gcuguggaugcuauggaucauc

SEQ ID NO: 710864 - RNA, 22 nt, Human
ugcuucagcacuuugagagccu

SEQ ID NO: 710865 - RNA, 22 nt, Human
ccaggcccuugcaagucccacc

SEQ ID NO: 710866 - RNA, 22 nt, Human
uaaccucugagcuccagcuucu

SEQ ID NO: 710867 - RNA, 22 nt, Human
gagggccaggcggagacaggcg

SEQ ID NO: 710868 - RNA, 22 nt, Human
ggaugcaggaguugaagaagga

SEQ ID NO: 710869 - RNA, 22 nt, Human
uaccuggauaucauucauucuc

SEQ ID NO: 710870 - RNA, 22 nt, Human
uuauaaagauuguuauguaucu

SEQ ID NO: 710871 - RNA, 20 nt, Human
auguggcuuuuugaccugcu

SEQ ID NO: 710872 - RNA, 22 nt, Human
uaccaaagauuaaauagcaaca

SEQ ID NO: 710873 - RNA, 22 nt, Human
acuaggagaaaacuuacacuga

SEQ ID NO: 710874 - RNA, 22 nt, Human
augggcagcagcugccauucau

SEQ ID NO: 710875 - RNA, 22 nt, Human
aucugggucacaguggcaucua

SEQ ID NO: 710876 - RNA, 22 nt, Human
caggagcagaggguggucagca

SEQ ID NO: 710877 - RNA, 22 nt, Human
cugcacagccugucugggggcc

SEQ ID NO: 710878 - RNA, 20 nt, Human
agugugcauuuagagucugc

SEQ ID NO: 710879 - RNA, 22 nt, Human
ggucccuagagugggaugacuu

SEQ ID NO: 710880 - RNA, 17 nt, Human
cagacagauauccuggg

SEQ ID NO: 710881 - RNA, 22 nt, Human
gcugugauguggagggugcuga

SEQ ID NO: 710882 - RNA, 22 nt, Human
uaaaugugcacagguuagaagg

SEQ ID NO: 710883 - RNA, 22 nt, Human
gggcuccagaguccauguucuu

SEQ ID NO: 710884 - RNA, 22 nt, Human
ugacauuuaaucccuaaauauu

SEQ ID NO: 710885 - RNA, 22 nt, Human
aagacgcacccuuugagggcac

SEQ ID NO: 710886 - RNA, 22 nt, Human
ucuccaaauaguuauauuuaga

SEQ ID NO: 710887 - RNA, 22 nt, Human
ugugucucuuuguccuagagcu

SEQ ID NO: 710888 - RNA, 22 nt, Human
cuggcuuuaccucacuggggcu

SEQ ID NO: 710889 - RNA, 22 nt, Human
cagaugaagaucauagaauagu

SEQ ID NO: 710890 - RNA, 22 nt, Human
aaaguauguuguggcuuuuaaa

SEQ ID NO: 710891 - RNA, 22 nt, Human
augagguuuugauuggcacagg

SEQ ID NO: 710892 - RNA, 17 nt, Human
uggggaugguucaugag

SEQ ID NO: 710893 - RNA, 22 nt, Human
agaagccauucccuguaggcuc

SEQ ID NO: 710894 - RNA, 22 nt, Human
ccacuguaaccauuaucaccau

SEQ ID NO: 710895 - RNA, 22 nt, Human
ugggggugacuaucucgggaau

SEQ ID NO: 710896 - RNA, 22 nt, Human
ccucaggcagugguauggaugg

SEQ ID NO: 710897 - RNA, 23 nt, Human
auccucucuccaucccacugugc

SEQ ID NO: 710898 - RNA, 22 nt, Human
aagaucagcucccgagucugag

SEQ ID NO: 710899 - RNA, 22 nt, Human
gcccaaggucccauggcagcac

SEQ ID NO: 710900 - RNA, 22 nt, Human
acaaggaccaugaggcagaccc

SEQ ID NO: 710901 - RNA, 19 nt, Human
agccagggugagaaggagc

SEQ ID NO: 710902 - RNA, 22 nt, Human
cacucugacuggcccugcagga

SEQ ID NO: 710903 - RNA, 20 nt, Human
uguauauuuucugguguaaa

SEQ ID NO: 710904 - RNA, 22 nt, Human
ucccuccagaauggugaggaag

SEQ ID NO: 710905 - RNA, 22 nt, Human
ucagaaauguaagcugaugacu

SEQ ID NO: 710906 - RNA, 22 nt, Human
uuagccuuagaagcuuagcaaa

SEQ ID NO: 710907 - RNA, 22 nt, Human
uucuuuuaaugucuggcuuuca

SEQ ID NO: 710908 - RNA, 22 nt, Human
ggcagcuaggggcagggaauuc

SEQ ID NO: 710909 - RNA, 22 nt, Human
ucuuucaaagcaaaaugaggcu

SEQ ID NO: 710910 - RNA, 22 nt, Human
gugugucagguacugugcuagg

SEQ ID NO: 710911 - RNA, 22 nt, Human
uagacacaaaucucagugacac

SEQ ID NO: 710912 - RNA, 22 nt, Human
cagacccugggccacagaggag

SEQ ID NO: 710913 - RNA, 22 nt, Human
ugaagccacacuagcuuguccu

SEQ ID NO: 710914 - RNA, 22 nt, Human
uuuacacuuuccugggaacauc

SEQ ID NO: 710915 - RNA, 22 nt, Human
uucaagauaauaggaaugaaaa

SEQ ID NO: 710916 - RNA, 22 nt, Human
uuacaagugucagguacuggca

SEQ ID NO: 710917 - RNA, 22 nt, Human
cagcuucuguuuauugugugcc

SEQ ID NO: 710918 - RNA, 22 nt, Human
cugccucucagccugaccgcca

SEQ ID NO: 710919 - RNA, 22 nt, Human
agucagugggcuuggcacagaa

SEQ ID NO: 710920 - RNA, 22 nt, Human
ccuuggaggacugcugcuucuu

SEQ ID NO: 710921 - RNA, 22 nt, Human
guucugucugagcaccacagga

SEQ ID NO: 710922 - RNA, 22 nt, Human
ugcccucucaaguugagucaga

SEQ ID NO: 710923 - RNA, 22 nt, Human
uuuguacacaaccugugguagu

SEQ ID NO: 710924 - RNA, 22 nt, Human
acauguggucaaucuguguagg

SEQ ID NO: 710925 - RNA, 22 nt, Human
uagacauuuggaguuuuaugac

SEQ ID NO: 710926 - RNA, 22 nt, Human
agaaauucuaagcaucaauagc

SEQ ID NO: 710927 - RNA, 22 nt, Human
gacuucugaauuccuaucaggu

SEQ ID NO: 710928 - RNA, 22 nt, Human
cccagcugauuuuugcagagau

SEQ ID NO: 710929 - RNA, 22 nt, Human
aacaaaugauuguugguuggag

SEQ ID NO: 710930 - RNA, 22 nt, Human
cagcccagagauguuaucuagu

SEQ ID NO: 710931 - RNA, 22 nt, Human
agccccucuccgcccugagucg

SEQ ID NO: 710932 - RNA, 22 nt, Human
gcacccagaggucagcagugcu

SEQ ID NO: 710933 - RNA, 22 nt, Human
uccaggacuagcauuucugaua

SEQ ID NO: 710934 - RNA, 22 nt, Human
gggcugagagcuggaaucugag

SEQ ID NO: 710935 - RNA, 22 nt, Human
cugcuuuaacaaggcugaucag

SEQ ID NO: 710936 - RNA, 22 nt, Human
uacaauguuccuagcaggaaag

SEQ ID NO: 710937 - RNA, 22 nt, Human
ugacagagagguaaguuaugaa

SEQ ID NO: 710938 - RNA, 22 nt, Human
auuuucugagcacgugacagca

SEQ ID NO: 710939 - RNA, 22 nt, Human
acuuugcacuaaguuacucauu

SEQ ID NO: 710940 - RNA, 22 nt, Human
uuuuauguaauccuuacugucg

SEQ ID NO: 710941 - RNA, 22 nt, Human
guuuuuucaugaguaguuaucu

SEQ ID NO: 710942 - RNA, 22 nt, Human
ccugagcuuuaaaagccaugua

SEQ ID NO: 710943 - RNA, 20 nt, Human
ugcccagcaagagugcaguu

SEQ ID NO: 710944 - RNA, 21 nt, Human
ucucuucccaucaggacacua

SEQ ID NO: 710945 - RNA, 22 nt, Human
aaauccagguaguuugguuuga

SEQ ID NO: 710946 - RNA, 22 nt, Human
ccauggcuaaguaucuguagaa

SEQ ID NO: 710947 - RNA, 18 nt, Human
caaauucucauugauuuc

SEQ ID NO: 710948 - RNA, 22 nt, Human
uuguuucuuugaaguuucuaga

SEQ ID NO: 710949 - RNA, 22 nt, Human
gacauguauuaguacauauggu

SEQ ID NO: 710950 - RNA, 22 nt, Human
caagaggcuaaacugggcuauu

SEQ ID NO: 710951 - RNA, 22 nt, Human
gcugcugucacggugcuaaggg

SEQ ID NO: 710952 - RNA, 22 nt, Human
ugagaggaacaggcaguagguu

SEQ ID NO: 710953 - RNA, 22 nt, Human
uaguucaccccucuuuauuuuc

SEQ ID NO: 710954 - RNA, 22 nt, Human
ugggggaacuguugcgcgcggg

SEQ ID NO: 710955 - RNA, 22 nt, Human
caaaggcuuccacugcauccuu

SEQ ID NO: 710956 - RNA, 22 nt, Human
auuugcaggugucgauuagucu

SEQ ID NO: 710957 - RNA, 22 nt, Human
ggugccaggcuguagucagggu

SEQ ID NO: 710958 - RNA, 22 nt, Human
gagaggcugaaaucacaggagc

SEQ ID NO: 710959 - RNA, 21 nt, Human
cacugcagccuugaccugggc

SEQ ID NO: 710960 - RNA, 22 nt, Human
gcacaggaugauggguugaggg

SEQ ID NO: 710961 - RNA, 21 nt, Human
ggcagcugaccgcgcggugca

SEQ ID NO: 710962 - RNA, 22 nt, Human
caguaccagucaccacauugau

SEQ ID NO: 710963 - RNA, 22 nt, Human
uacugcugauuagagcugaggu

SEQ ID NO: 710964 - RNA, 22 nt, Human
caugcauggucaugcugggacu

SEQ ID NO: 710965 - RNA, 22 nt, Human
aaucaguuagaaggaagagaau

SEQ ID NO: 710966 - RNA, 22 nt, Human
ucagggcucagugggauagguc

SEQ ID NO: 710967 - RNA, 22 nt, Human
uauaaaacagaaagcacuaccu

SEQ ID NO: 710968 - RNA, 22 nt, Human
ugugcucuugucugugacuaac

SEQ ID NO: 710969 - RNA, 22 nt, Human
acaaauuuguguaguuauggca

SEQ ID NO: 710970 - RNA, 22 nt, Human
ugaugaaacugagguuccaaga

SEQ ID NO: 710971 - RNA, 22 nt, Human
uguaccacucuacuaaggguuc

SEQ ID NO: 710972 - RNA, 18 nt, Human
cggaucaugcgcugaggc

SEQ ID NO: 710973 - RNA, 22 nt, Human
guaggaagcucugaggcuaguu

SEQ ID NO: 710974 - RNA, 22 nt, Human
guagcagagggcccagguaacu

SEQ ID NO: 710975 - RNA, 22 nt, Human
gcucccugguauugcugccacu

SEQ ID NO: 710976 - RNA, 22 nt, Human
uuaacugagaggaucugaguag

SEQ ID NO: 710977 - RNA, 23 nt, Human
uggcaccaggcauucuaggggua

SEQ ID NO: 710978 - RNA, 22 nt, Human
ccuuccaggcuggaggcuuggg

SEQ ID NO: 710979 - RNA, 18 nt, Human
caguaacuauguuguuac

SEQ ID NO: 710980 - RNA, 22 nt, Human
ugugcguggauuccuguacuca

SEQ ID NO: 710981 - RNA, 22 nt, Human
uguguggcaagcuguaugcuag

SEQ ID NO: 710982 - RNA, 21 nt, Human
ggccugagcaccuguccaccu

SEQ ID NO: 710983 - RNA, 22 nt, Human
uuuguacaugaaugugcaccca

SEQ ID NO: 710984 - RNA, 22 nt, Human
guacagagaagguuacauauga

SEQ ID NO: 710985 - RNA, 22 nt, Human
gcaaagcacacccucagaguuu

SEQ ID NO: 710986 - RNA, 22 nt, Human
acauaaguuauggauaaaaugu

SEQ ID NO: 710987 - RNA, 22 nt, Human
gcagggcuguuuagugaauagg

SEQ ID NO: 710988 - RNA, 22 nt, Human
gcacacacuguuuuccucacau

SEQ ID NO: 710989 - RNA, 22 nt, Human
aacagugucaggauuacagaua

SEQ ID NO: 710990 - RNA, 22 nt, Human
ugccaggaggaggugggacaga

SEQ ID NO: 710991 - RNA, 21 nt, Human
acagcagggcuggcaugacag

SEQ ID NO: 710992 - RNA, 22 nt, Human
cuggggaccgagcaagcucugg

SEQ ID NO: 710993 - RNA, 21 nt, Human
ccuggcugcacaguugcuggu

SEQ ID NO: 710994 - RNA, 22 nt, Human
aguuucuugaagacugauguuu

SEQ ID NO: 710995 - RNA, 22 nt, Human
cucccugaguuuguggcuaagu

SEQ ID NO: 710996 - RNA, 20 nt, Human
cccugagaccagagagcagc

SEQ ID NO: 710997 - RNA, 22 nt, Human
ugaggcuuggagaggucaggga

SEQ ID NO: 710998 - RNA, 22 nt, Human
agagcagaggcauggccguggg

SEQ ID NO: 710999 - RNA, 22 nt, Human
ugcagagaagaggacaguucua

SEQ ID NO: 711000 - RNA, 22 nt, Human
aggcucugugacaaucaagcug

SEQ ID NO: 711001 - RNA, 22 nt, Human
gugauguggggaccguccuggc

SEQ ID NO: 711002 - RNA, 22 nt, Human
acagggccauuggaggauuaua

SEQ ID NO: 711003 - RNA, 22 nt, Human
ucuuccuuucauucauguguua

SEQ ID NO: 711004 - RNA, 22 nt, Human
ucugcccugcagggagcaguaa

SEQ ID NO: 711005 - RNA, 22 nt, Human
cacugauuaagucugcuagagg

SEQ ID NO: 711006 - RNA, 22 nt, Human
gaaauauuguacuggagauguu

SEQ ID NO: 711007 - RNA, 22 nt, Human
uguguauguuuugagguugcua

SEQ ID NO: 711008 - RNA, 22 nt, Human
uucauuccugagcccauauuua

SEQ ID NO: 711009 - RNA, 20 nt, Human
aucugcugagaaugaaaggc

SEQ ID NO: 711010 - RNA, 22 nt, Human
ccugaagggacuccagagagca

SEQ ID NO: 711011 - RNA, 16 nt, Human
ucauccaugacagcuc

SEQ ID NO: 711012 - RNA, 22 nt, Human
uuuguucaacaggugaaauaga

SEQ ID NO: 711013 - RNA, 22 nt, Human
uauuugucuaagaggcugacag

SEQ ID NO: 711014 - RNA, 23 nt, Human
acauuucaauacugagggucuga

SEQ ID NO: 711015 - RNA, 22 nt, Human
cuggcucaauaaauauuagcug

SEQ ID NO: 711016 - RNA, 22 nt, Human
aggcuccuugcucacaggcuca

SEQ ID NO: 711017 - RNA, 22 nt, Human
aguaugaagaugaugaaaaaua

SEQ ID NO: 711018 - RNA, 20 nt, Human
gcccaagcgccggccgcaga

SEQ ID NO: 711019 - RNA, 19 nt, Human
auucucugguuugcuggcu

SEQ ID NO: 711020 - RNA, 22 nt, Human
ggcaggaauaaauuauggacuu

SEQ ID NO: 711021 - RNA, 22 nt, Human
gagcugggacauggguccucuc

SEQ ID NO: 711022 - RNA, 22 nt, Human
uuccagcacagaaguauacauu

SEQ ID NO: 711023 - RNA, 22 nt, Human
uuccccaggggcuccugccuuu

SEQ ID NO: 711024 - RNA, 22 nt, Human
uccaagaugguugguguggugg

SEQ ID NO: 711025 - RNA, 22 nt, Human
ucuuggaagccucaagauacuc

SEQ ID NO: 711026 - RNA, 22 nt, Human
uguauuuucugaggagcauuag

SEQ ID NO: 711027 - RNA, 22 nt, Human
ucugcaaacuuaaguugaaaua

SEQ ID NO: 711028 - RNA, 22 nt, Human
ucagaggaucaugucccuacuc

SEQ ID NO: 711029 - RNA, 22 nt, Human
aauguacacugaaagccuauca

SEQ ID NO: 711030 - RNA, 22 nt, Human
uaguuuuagcagcaaugggaug

SEQ ID NO: 711031 - RNA, 17 nt, Human
agcauuuguguuaacag

SEQ ID NO: 711032 - RNA, 22 nt, Human
ugaaucaaagcugaaguuuuca

SEQ ID NO: 711033 - RNA, 22 nt, Human
uacauauguaaacauguauaaa

SEQ ID NO: 711034 - RNA, 22 nt, Human
agcacuggaguuuagugggauu

SEQ ID NO: 711035 - RNA, 22 nt, Human
aauaauguaggaugauaaauga

SEQ ID NO: 711036 - RNA, 22 nt, Human
gauaaauggcugaagaaauagu

SEQ ID NO: 711037 - RNA, 22 nt, Human
auuugucauauauaauacucuu

SEQ ID NO: 711038 - RNA, 22 nt, Human
aaauuaguacauugcaaagucc

SEQ ID NO: 711039 - RNA, 22 nt, Human
gcacugugacagcaagagugag

SEQ ID NO: 711040 - RNA, 22 nt, Human
uagaaagcaguaucuccauuuu

SEQ ID NO: 711041 - RNA, 22 nt, Human
cagcuugaaauauuaggagaug

SEQ ID NO: 711042 - RNA, 22 nt, Human
cuuccugguuugaagcucgccg

SEQ ID NO: 711043 - RNA, 22 nt, Human
gaugugaggugguaaacaggga

SEQ ID NO: 711044 - RNA, 22 nt, Human
ucagucuugcuucucuuggguc

SEQ ID NO: 711045 - RNA, 22 nt, Human
aagauguuacucaaccaggaua

SEQ ID NO: 711046 - RNA, 22 nt, Human
ccugggcuggaguacagcagug

SEQ ID NO: 711047 - RNA, 22 nt, Human
cugggagauaugaggaucugga

SEQ ID NO: 711048 - RNA, 22 nt, Human
agccuggcuuagcucucucacu

SEQ ID NO: 711049 - RNA, 22 nt, Human
uagucuggacuucuuaguguca

SEQ ID NO: 711050 - RNA, 22 nt, Human
cagugggaagggcagaggcuuu

SEQ ID NO: 711051 - RNA, 21 nt, Human
acucugccagucuccugcacu

SEQ ID NO: 711052 - RNA, 22 nt, Human
ucugggaggggcugccauugcu

SEQ ID NO: 711053 - RNA, 22 nt, Human
auguaugauauuuccaguauca

SEQ ID NO: 711054 - RNA, 22 nt, Human
ugugcccuguuaaaugcacagu

SEQ ID NO: 711055 - RNA, 22 nt, Human
ggcuucugaaacuguauugaga

SEQ ID NO: 711056 - RNA, 22 nt, Human
ugagccagaguggagugugccu

SEQ ID NO: 711057 - RNA, 22 nt, Human
uggcuuccugcacagugucugc

SEQ ID NO: 711058 - RNA, 17 nt, Human
ggccuugggcugcucuu

SEQ ID NO: 711059 - RNA, 22 nt, Human
gcagagacuccacugucuugug

SEQ ID NO: 711060 - RNA, 22 nt, Human
ugcaaaggaggaugggaaagaa

SEQ ID NO: 711061 - RNA, 19 nt, Human
cuggcagccugucuguguc

SEQ ID NO: 711062 - RNA, 22 nt, Human
uauggcuuuucuuccuccccca

SEQ ID NO: 711063 - RNA, 22 nt, Human
agcugccagcaucccggaaggg

SEQ ID NO: 711064 - RNA, 22 nt, Human
caggcaagcaaggggucuugaa

SEQ ID NO: 711065 - RNA, 22 nt, Human
gugcagcugccgaucagauagg

SEQ ID NO: 711066 - RNA, 22 nt, Human
agaauugguuggggaaugugga

SEQ ID NO: 711067 - RNA, 22 nt, Human
uccaguccuagaaacuggagag

SEQ ID NO: 711068 - RNA, 22 nt, Human
aauugcuucauuaacauuuagg

SEQ ID NO: 711069 - RNA, 22 nt, Human
uauuacaagaaagggcaugaau

SEQ ID NO: 711070 - RNA, 22 nt, Human
auuaggcauauaugcuuuuaau

SEQ ID NO: 711071 - RNA, 22 nt, Human
acauggaaaacuaacugcuuuu

SEQ ID NO: 711072 - RNA, 21 nt, Human
aagccagcccacagugguuug

SEQ ID NO: 711073 - RNA, 22 nt, Human
ccugggcuguaccugugcgcgg

SEQ ID NO: 711074 - RNA, 22 nt, Human
uuuuccucuguuauuaguguga

SEQ ID NO: 711075 - RNA, 22 nt, Human
uugaguguaaggaauguggggc

SEQ ID NO: 711076 - RNA, 22 nt, Human
auuuccaugucgguauuuuaua

SEQ ID NO: 711077 - RNA, 22 nt, Human
cagcgcugggguaggagcaccu

SEQ ID NO: 711078 - RNA, 22 nt, Human
auguuaaauaaucccuuaaagc

SEQ ID NO: 711079 - RNA, 19 nt, Human
ucaaaggcaaggaggaacu

SEQ ID NO: 711080 - RNA, 22 nt, Human
cacauucuguccuugaacugca

SEQ ID NO: 711081 - RNA, 22 nt, Human
agugaauucugcacuacugaag

SEQ ID NO: 711082 - RNA, 22 nt, Human
cuuccucuguguccugggcuug

SEQ ID NO: 711083 - RNA, 20 nt, Human
gggugggagagucugagggu

SEQ ID NO: 711084 - RNA, 22 nt, Human
acuggcaggcugcuggccggcg

SEQ ID NO: 711085 - RNA, 22 nt, Human
ggcagagcuuguuccuucuguu

SEQ ID NO: 711086 - RNA, 22 nt, Human
ugcugaggucacggcggccaga

SEQ ID NO: 711087 - RNA, 22 nt, Human
gaaggcaggcuucugauuaggu

SEQ ID NO: 711088 - RNA, 21 nt, Human
auuguuaucauugugcugugu

SEQ ID NO: 711089 - RNA, 22 nt, Human
auuugcugauggcauuugagcu

SEQ ID NO: 711090 - RNA, 22 nt, Human
cugccugugauuuuucucuagu

SEQ ID NO: 711091 - RNA, 22 nt, Human
aaaucucaauuugaauuguagc

SEQ ID NO: 711092 - RNA, 22 nt, Human
gagcagaugugugccaggaugc

SEQ ID NO: 711093 - RNA, 22 nt, Human
acaaaugucuccucuuuuguua

SEQ ID NO: 711094 - RNA, 22 nt, Human
ggccacugcugcucugguggag

SEQ ID NO: 711095 - RNA, 22 nt, Human
gaggagagaacauuccuccaua

SEQ ID NO: 711096 - RNA, 22 nt, Human
cuggccugaggccgccuucaga

SEQ ID NO: 711097 - RNA, 21 nt, Human
uuuuaacaaggauuucccuag

SEQ ID NO: 711098 - RNA, 22 nt, Human
uagcagggaagaugaucagaau

SEQ ID NO: 711099 - RNA, 22 nt, Human
uaggacuuuggcgucagaacug

SEQ ID NO: 711100 - RNA, 22 nt, Human
cagcugccacaggacuuucuga

SEQ ID NO: 711101 - RNA, 22 nt, Human
aaaugucagaaaacauggagug

SEQ ID NO: 711102 - RNA, 22 nt, Human
aggcacaguuucauccccgggc

SEQ ID NO: 711103 - RNA, 22 nt, Human
aaggcagcucagcucauggcag

SEQ ID NO: 711104 - RNA, 19 nt, Human
ccugaggaaaagaugauug

SEQ ID NO: 711105 - RNA, 22 nt, Human
uucaacaugcuuuauuucuaaa

SEQ ID NO: 711106 - RNA, 22 nt, Human
agauuucccaaauacuuguuau

SEQ ID NO: 711107 - RNA, 22 nt, Human
ucaugaguggauuaauauggcu

SEQ ID NO: 711108 - RNA, 22 nt, Human
ucaaacaugaaagcuugauuuu

SEQ ID NO: 711109 - RNA, 22 nt, Human
ccaguguucccucggguucaug

SEQ ID NO: 711110 - RNA, 23 nt, Human
agagagcucacuauauagcauug

SEQ ID NO: 711111 - RNA, 22 nt, Human
cucucuggguccucuuuuauag

SEQ ID NO: 711112 - RNA, 22 nt, Human
ccagagagaaaauggagggcca

SEQ ID NO: 711113 - RNA, 22 nt, Human
caggccaagucccaagugcggg

SEQ ID NO: 711114 - RNA, 22 nt, Human
uggagcagcugaacagaguuga

SEQ ID NO: 711115 - RNA, 22 nt, Human
gcaauuauuaugugacuuuuac

SEQ ID NO: 711116 - RNA, 22 nt, Human
agcaggugguaggcagucagca

SEQ ID NO: 711117 - RNA, 22 nt, Human
ugaaacuuuugagguucuucca

SEQ ID NO: 711118 - RNA, 22 nt, Human
uuugggaacuuaauuaugucug

SEQ ID NO: 711119 - RNA, 23 nt, Human
aaugcuggaaauucaggcaugau

SEQ ID NO: 711120 - RNA, 22 nt, Human
ugacaauggauauuaguugugg

SEQ ID NO: 711121 - RNA, 22 nt, Human
cauuucuaccaaaugugacugg

SEQ ID NO: 711122 - RNA, 22 nt, Human
agagugaaggccagguuacagu

SEQ ID NO: 711123 - RNA, 22 nt, Human
cuucugauuagcaaguuuguau

SEQ ID NO: 711124 - RNA, 23 nt, Human
ucacagggcacuggcugggguug

SEQ ID NO: 711125 - RNA, 22 nt, Human
aaagugcaguccaugaaauuaa

SEQ ID NO: 711126 - RNA, 17 nt, Human
acagcaggcccggaggg

SEQ ID NO: 711127 - RNA, 22 nt, Human
gaggauggaggugugagcuaug

SEQ ID NO: 711128 - RNA, 21 nt, Human
ggcagccugacccccagagag

SEQ ID NO: 711129 - RNA, 22 nt, Human
gacagggcgagacucagucuca

SEQ ID NO: 711130 - RNA, 22 nt, Human
accuucaacucaaaguguccca

SEQ ID NO: 711131 - RNA, 22 nt, Human
gcugggagcccuggucugcucc

SEQ ID NO: 711132 - RNA, 22 nt, Human
aguggcagguguuucguggugc

SEQ ID NO: 711133 - RNA, 22 nt, Human
uucaugaauguuccaugugagu

SEQ ID NO: 711134 - RNA, 22 nt, Human
auacacuacuaagcacagauug

SEQ ID NO: 711135 - RNA, 22 nt, Human
uagaauauacacuacagcuuaa

SEQ ID NO: 711136 - RNA, 22 nt, Human
aggcagaggagaaugaucuucc

SEQ ID NO: 711137 - RNA, 22 nt, Human
uagaauugggccuaacuuccau

SEQ ID NO: 711138 - RNA, 22 nt, Human
ucuuugaaaagggagauagaaa

SEQ ID NO: 711139 - RNA, 18 nt, Human
cagaagcaggcagugcag

SEQ ID NO: 711140 - RNA, 22 nt, Human
gaugucuucucaacuguagacc

SEQ ID NO: 711141 - RNA, 22 nt, Human
caguacuuuucuggcuuucuac

SEQ ID NO: 711142 - RNA, 22 nt, Human
acaauucaagaugagauucagg

SEQ ID NO: 711143 - RNA, 22 nt, Human
ucagcacuuuuuaaagcagcau

SEQ ID NO: 711144 - RNA, 22 nt, Human
ucauucucagacucuuggccuc

SEQ ID NO: 711145 - RNA, 22 nt, Human
gaugaugagauaaggauaacuu

SEQ ID NO: 711146 - RNA, 22 nt, Human
uggcagauaaaauaauagggaa

SEQ ID NO: 711147 - RNA, 22 nt, Human
aaagucacuuccuucugucagc

SEQ ID NO: 711148 - RNA, 22 nt, Human
cccagagggaagggaaugaggu

SEQ ID NO: 711149 - RNA, 22 nt, Human
gaguguguucuuuaugcuguga

SEQ ID NO: 711150 - RNA, 22 nt, Human
guauuagguuggugcaaaauug

SEQ ID NO: 711151 - RNA, 22 nt, Human
ccacuguauuuuggaagcagau

SEQ ID NO: 711152 - RNA, 22 nt, Human
cauaacuggggacacuucucua

SEQ ID NO: 711153 - RNA, 22 nt, Human
ugaaggugucuuugugaacauc

SEQ ID NO: 711154 - RNA, 22 nt, Human
ucuuccucuagaucugaggccc

SEQ ID NO: 711155 - RNA, 22 nt, Human
guccccagcugugacgagagcc

SEQ ID NO: 711156 - RNA, 22 nt, Human
aggucauugaaguuauuuucuu

SEQ ID NO: 711157 - RNA, 20 nt, Human
cugugccuccugcuaguccu

SEQ ID NO: 711158 - RNA, 22 nt, Human
agaagccagaggcaguggguac

SEQ ID NO: 711159 - RNA, 22 nt, Human
caaauaagaaccacaggggagu

SEQ ID NO: 711160 - RNA, 23 nt, Human
ugccaggguuuguuugugguuca

SEQ ID NO: 711161 - RNA, 22 nt, Human
uuaaaauuauggcccauuugga

SEQ ID NO: 711162 - RNA, 22 nt, Human
ucuccuaggcuggagugcagug

SEQ ID NO: 711163 - RNA, 22 nt, Human
uacugucucugcccuggccagg

SEQ ID NO: 711164 - RNA, 22 nt, Human
cacagcuuguuuagugacucac

SEQ ID NO: 711165 - RNA, 22 nt, Human
gacacagaaugggugcucagua

SEQ ID NO: 711166 - RNA, 22 nt, Human
ccugcagcuccggauuucuggg

SEQ ID NO: 711167 - RNA, 20 nt, Human
augccucuaauuuugcaaac

SEQ ID NO: 711168 - RNA, 22 nt, Human
cccugcccugggcagaaguggg

SEQ ID NO: 711169 - RNA, 22 nt, Human
uacugccuggagcauuggugcu

SEQ ID NO: 711170 - RNA, 19 nt, Human
gucacauuugucucccagg

SEQ ID NO: 711171 - RNA, 22 nt, Human
agggcucccgugaggugacugc

SEQ ID NO: 711172 - RNA, 22 nt, Human
ugcucugucaagaaaagaugcc

SEQ ID NO: 711173 - RNA, 21 nt, Human
gaauugugccccuugguguug

SEQ ID NO: 711174 - RNA, 22 nt, Human
gccaggcacugcucuaagcccu

SEQ ID NO: 711175 - RNA, 22 nt, Human
aggcagcaugcucugcuucuac

SEQ ID NO: 711176 - RNA, 22 nt, Human
ccauaaucuggcuuugagagag

SEQ ID NO: 711177 - RNA, 22 nt, Human
cugagaggcggagcuugcagug

SEQ ID NO: 711178 - RNA, 22 nt, Human
cagccaggccuggugaccaaag

SEQ ID NO: 711179 - RNA, 22 nt, Human
agucagucaaaauauaaauugu

SEQ ID NO: 711180 - RNA, 22 nt, Human
gaccagcucucugaagaaagag

SEQ ID NO: 711181 - RNA, 22 nt, Human
auaaaccuaugcuaagcugugg

SEQ ID NO: 711182 - RNA, 22 nt, Human
uuuuuuauagcaaugaacccac

SEQ ID NO: 711183 - RNA, 22 nt, Human
aaugucugucugcacguugcuu

SEQ ID NO: 711184 - RNA, 22 nt, Human
ucagccagggcagagcagguga

SEQ ID NO: 711185 - RNA, 22 nt, Human
uccugggauuaagguggugauu

SEQ ID NO: 711186 - RNA, 22 nt, Human
auucuuuagccagcagguauau

SEQ ID NO: 711187 - RNA, 22 nt, Human
gcuacaggggucaguccuuugc

SEQ ID NO: 711188 - RNA, 22 nt, Human
ccaggguugcagggagccagca

SEQ ID NO: 711189 - RNA, 22 nt, Human
uaacuucucugcuaucauagga

SEQ ID NO: 711190 - RNA, 20 nt, Human
uggcuuuaaguuuuuugcua

SEQ ID NO: 711191 - RNA, 22 nt, Human
caauaacugcugaggagaagca

SEQ ID NO: 711192 - RNA, 23 nt, Human
acacuuucaaauaugcacagagc

SEQ ID NO: 711193 - RNA, 18 nt, Human
cccugaggcuagcaugcu

SEQ ID NO: 711194 - RNA, 19 nt, Human
uagggcuggccgggcggug

SEQ ID NO: 711195 - RNA, 22 nt, Human
uguugguaaauagcuuagcaau

SEQ ID NO: 711196 - RNA, 22 nt, Human
uuggaacaggauucaauuaaag

SEQ ID NO: 711197 - RNA, 22 nt, Human
ugagaaccaugaaaagcuguca

SEQ ID NO: 711198 - RNA, 22 nt, Human
uucuggggccaauugccacugc

SEQ ID NO: 711199 - RNA, 22 nt, Human
ugugcagauagugauuucagaa

SEQ ID NO: 711200 - RNA, 22 nt, Human
ugauggaaauuugggaagcuuu

SEQ ID NO: 711201 - RNA, 22 nt, Human
uuggcaggaggcuucaguuccu

SEQ ID NO: 711202 - RNA, 22 nt, Human
uagcauuuauuccagauuugga

SEQ ID NO: 711203 - RNA, 22 nt, Human
uaaaauagccagugccccucug

SEQ ID NO: 711204 - RNA, 22 nt, Human
aagauaauguucuagcugucag

SEQ ID NO: 711205 - RNA, 22 nt, Human
uuguaaaguucuuaggaagcuc

SEQ ID NO: 711206 - RNA, 19 nt, Human
gagcgcagagggcagggga

SEQ ID NO: 711207 - RNA, 22 nt, Human
guggccagaggauuuguucagu

SEQ ID NO: 711208 - RNA, 22 nt, Human
gugacgugaggggcuccuguug

SEQ ID NO: 711209 - RNA, 22 nt, Human
caguauguuugggagacaugac

SEQ ID NO: 711210 - RNA, 22 nt, Human
ggcuggguuugacuccuggcuu

SEQ ID NO: 711211 - RNA, 22 nt, Human
gauuucaccugaucuugucauc

SEQ ID NO: 711212 - RNA, 22 nt, Human
ucucagagcuucaguuauuuuc

SEQ ID NO: 711213 - RNA, 22 nt, Human
uaguccagccuuggguguagcc

SEQ ID NO: 711214 - RNA, 22 nt, Human
aggcaacauaacacgaaagucu

SEQ ID NO: 711215 - RNA, 22 nt, Human
ggguucagguuggccugagcac

SEQ ID NO: 711216 - RNA, 22 nt, Human
cauugaaagagauaaagccuuu

SEQ ID NO: 711217 - RNA, 22 nt, Human
aauuccaggggguaccauucau

SEQ ID NO: 711218 - RNA, 22 nt, Human
aggccaccacccuaucuccugg

SEQ ID NO: 711219 - RNA, 22 nt, Human
uaguggagaaguggagucugug

SEQ ID NO: 711220 - RNA, 22 nt, Human
ugcugccaagcccgugcuccug

SEQ ID NO: 711221 - RNA, 22 nt, Human
agugaacaaguuaagaacacua

SEQ ID NO: 711222 - RNA, 22 nt, Human
acagcagaguggagaugagcac

SEQ ID NO: 711223 - RNA, 22 nt, Human
gcucugcuggaaguucucugga

SEQ ID NO: 711224 - RNA, 22 nt, Human
cuauacagagcauccuuaacuu

SEQ ID NO: 711225 - RNA, 19 nt, Human
gcuaggguugguggcgugc

SEQ ID NO: 711226 - RNA, 22 nt, Human
ggacuugccuuuaguuaaaaua

SEQ ID NO: 711227 - RNA, 22 nt, Human
ugaggcaggaggauugcaggau

SEQ ID NO: 711228 - RNA, 22 nt, Human
acacagagugguuuguagaaua

SEQ ID NO: 711229 - RNA, 22 nt, Human
gaaccucuuugugcuucagcuu

SEQ ID NO: 711230 - RNA, 22 nt, Human
acucuucuugcugcucauuaau

SEQ ID NO: 711231 - RNA, 22 nt, Human
aucaaagagcuugacaauccua

SEQ ID NO: 711232 - RNA, 22 nt, Human
aaggcacuguacuaguuaguua

SEQ ID NO: 711233 - RNA, 22 nt, Human
gauauacaauccacaguugauu

SEQ ID NO: 711234 - RNA, 22 nt, Human
ucauggggugacagaagggagg

SEQ ID NO: 711235 - RNA, 22 nt, Human
agcccaggaaguugaggcuugc

SEQ ID NO: 711236 - RNA, 22 nt, Human
gaugguuuggaaugaaguagcu

SEQ ID NO: 711237 - RNA, 22 nt, Human
cagggcucacucggcuggcguc

SEQ ID NO: 711238 - RNA, 22 nt, Human
caucuuuagggaccauuauucu

SEQ ID NO: 711239 - RNA, 22 nt, Human
ucagggcaggacaguguaggcc

SEQ ID NO: 711240 - RNA, 22 nt, Human
gaaagcagcuaagucuuaugau

SEQ ID NO: 711241 - RNA, 22 nt, Human
ugucucugugagaucugacgau

SEQ ID NO: 711242 - RNA, 22 nt, Human
guucuuggaccagcagcauuga

SEQ ID NO: 711243 - RNA, 22 nt, Human
agugauggggcccugcacugau

SEQ ID NO: 711244 - RNA, 22 nt, Human
ucaaaagaaacaccauguuccu

SEQ ID NO: 711245 - RNA, 22 nt, Human
acuucauguaguccaucagguu

SEQ ID NO: 711246 - RNA, 22 nt, Human
agagcuuugggacauuugcuag

SEQ ID NO: 711247 - RNA, 22 nt, Human
gaagcccagggcguggccgggc

SEQ ID NO: 711248 - RNA, 22 nt, Human
ugcagucuuccagcugcacaaa

SEQ ID NO: 711249 - RNA, 22 nt, Human
aaagcugcccagcugccuguuu

SEQ ID NO: 711250 - RNA, 22 nt, Human
auguacauguuuaagugaagga

SEQ ID NO: 711251 - RNA, 22 nt, Human
cuggaauguauguaucuuaaga

SEQ ID NO: 711252 - RNA, 22 nt, Human
ucugagagucucugaggcagau

SEQ ID NO: 711253 - RNA, 22 nt, Human
gaaagcacauacuauaaaucac

SEQ ID NO: 711254 - RNA, 22 nt, Human
caaauggcuggcauccuucuac

SEQ ID NO: 711255 - RNA, 22 nt, Human
ugcaaggcuauucacauguauu

SEQ ID NO: 711256 - RNA, 22 nt, Human
uuacagauggaucuagcaaaau

SEQ ID NO: 711257 - RNA, 22 nt, Human
aagcauggcugagugcaauggu

SEQ ID NO: 711258 - RNA, 22 nt, Human
aaucauucuuauuucacagcaa

SEQ ID NO: 711259 - RNA, 22 nt, Human
gcugugcagagcacaggguccc

SEQ ID NO: 711260 - RNA, 22 nt, Human
cuggaagaggacacacgaauca

SEQ ID NO: 711261 - RNA, 22 nt, Human
ucaguguucagcggugugugca

SEQ ID NO: 711262 - RNA, 22 nt, Human
ucacaaagcuuugauaagcaga

SEQ ID NO: 711263 - RNA, 22 nt, Human
uuauuuaggaggaaacugaggu

SEQ ID NO: 711264 - RNA, 22 nt, Human
gugugcacagagcuccaguguu

SEQ ID NO: 711265 - RNA, 22 nt, Human
uuuguguuuucccauacuauug

SEQ ID NO: 711266 - RNA, 22 nt, Human
augacacuguccuaguaaggaa

SEQ ID NO: 711267 - RNA, 22 nt, Human
augaaugaugccaguugaaaug

SEQ ID NO: 711268 - RNA, 22 nt, Human
gcucagggagcgauuuaccaug

SEQ ID NO: 711269 - RNA, 22 nt, Human
guugaggagguucagggugguu

SEQ ID NO: 711270 - RNA, 22 nt, Human
uucagaggggcuaaguacuugc

SEQ ID NO: 711271 - RNA, 22 nt, Human
ugccaggcugcccuccagucug

SEQ ID NO: 711272 - RNA, 22 nt, Human
caacauucaaccaacauuuaug

SEQ ID NO: 711273 - RNA, 22 nt, Human
gcauuagaaacuauugcugcaa

SEQ ID NO: 711274 - RNA, 22 nt, Human
cauggcagggcugugggcaggu

SEQ ID NO: 711275 - RNA, 21 nt, Human
ccugagguuucuggccucugu

SEQ ID NO: 711276 - RNA, 23 nt, Human
ucucagaaaggagaaguaauuug

SEQ ID NO: 711277 - RNA, 22 nt, Human
aagcagcaacaaacuggauaaa

SEQ ID NO: 711278 - RNA, 18 nt, Human
ucuuuuccuuccacuucc

SEQ ID NO: 711279 - RNA, 22 nt, Human
aaagaguugaggcaguuaucca

SEQ ID NO: 711280 - RNA, 22 nt, Human
gaaauacaggaaugccacacag

SEQ ID NO: 711281 - RNA, 22 nt, Human
aagagugacuuuucagcuguga

SEQ ID NO: 711282 - RNA, 20 nt, Human
ugccuuuccuguuucaucuu

SEQ ID NO: 711283 - RNA, 22 nt, Human
aacacuggacaggaggcuaggu

SEQ ID NO: 711284 - RNA, 22 nt, Human
ugcauuaugcuugugcuguaua

SEQ ID NO: 711285 - RNA, 22 nt, Human
aagaacaugauggccaugugca

SEQ ID NO: 711286 - RNA, 22 nt, Human
uggucaaaugccaaucuguagu

SEQ ID NO: 711287 - RNA, 22 nt, Human
cuggcuccaucacugggugaug

SEQ ID NO: 711288 - RNA, 19 nt, Human
acucuacaguguguacaac

SEQ ID NO: 711289 - RNA, 22 nt, Human
gcccaaagucacucagcuagga

SEQ ID NO: 711290 - RNA, 19 nt, Human
uucagcaggcugaagcuuc

SEQ ID NO: 711291 - RNA, 22 nt, Human
uuucugcauauguauguaugga

SEQ ID NO: 711292 - RNA, 22 nt, Human
uuucuacagguugauggguuug

SEQ ID NO: 711293 - RNA, 21 nt, Human
cuuuucucuccgcaggacauu

SEQ ID NO: 711294 - RNA, 22 nt, Human
aauucaaugguuuuuaggauau

SEQ ID NO: 711295 - RNA, 22 nt, Human
uugauuugggaauggucuggca

SEQ ID NO: 711296 - RNA, 22 nt, Human
gcuucuacccacgagaugcaaa

SEQ ID NO: 711297 - RNA, 22 nt, Human
aagauauagauaaaacuaugca

SEQ ID NO: 711298 - RNA, 22 nt, Human
uagacacuguaugagcugggug

SEQ ID NO: 711299 - RNA, 22 nt, Human
ccccacccucgcuccauuucgg

SEQ ID NO: 711300 - RNA, 22 nt, Human
cuuaaacugaaagcuacaagau

SEQ ID NO: 711301 - RNA, 22 nt, Human
ucaaaggcccauugucccguug

SEQ ID NO: 711302 - RNA, 22 nt, Human
agcaacagcccugagguucaug

SEQ ID NO: 711303 - RNA, 22 nt, Human
uuauucaguucccuucacucuc

SEQ ID NO: 711304 - RNA, 22 nt, Human
uuucacagugcucuguaaguau

SEQ ID NO: 711305 - RNA, 21 nt, Human
gcuuucuguggacucugcacc

SEQ ID NO: 711306 - RNA, 22 nt, Human
uaacaggcugaucauauauccu

SEQ ID NO: 711307 - RNA, 22 nt, Human
augaggccagggugccaugaaa

SEQ ID NO: 711308 - RNA, 20 nt, Human
ugcuuugauggaaauacagc

SEQ ID NO: 711309 - RNA, 22 nt, Human
agguccaguugccagaauggcc

SEQ ID NO: 711310 - RNA, 19 nt, Human
gcaugcuugguggcuucug

SEQ ID NO: 711311 - RNA, 22 nt, Human
ucgggguagacgccagcucgga

SEQ ID NO: 711312 - RNA, 22 nt, Human
gaggcaccagccccgcuagccu

SEQ ID NO: 711313 - RNA, 22 nt, Human
acacugacaccugcccucaggu

SEQ ID NO: 711314 - RNA, 22 nt, Human
cuguagcugacaggaucacuua

SEQ ID NO: 711315 - RNA, 21 nt, Human
cuacagaaucgagcauucugg

SEQ ID NO: 711316 - RNA, 18 nt, Human
agggcucucugcuggguu

SEQ ID NO: 711317 - RNA, 22 nt, Human
cuguaacagcugucagagcagg

SEQ ID NO: 711318 - RNA, 22 nt, Human
gaacuuuaucaaaaguuguuua

SEQ ID NO: 711319 - RNA, 23 nt, Human
acagggcuggcagcugcaagacc

SEQ ID NO: 711320 - RNA, 22 nt, Human
gugugacccaaggacacucucu

SEQ ID NO: 711321 - RNA, 22 nt, Human
ugagaagcaguuucaguaagaa

SEQ ID NO: 711322 - RNA, 22 nt, Human
caguucucugugccucgcuggg

SEQ ID NO: 711323 - RNA, 22 nt, Human
acagggcagcaacuuugugccu

SEQ ID NO: 711324 - RNA, 22 nt, Human
cagacccuuuucugagaggacc

SEQ ID NO: 711325 - RNA, 22 nt, Human
cugagguggccucugccgggga

SEQ ID NO: 711326 - RNA, 22 nt, Human
ggcuccagaaaucauagagcag

SEQ ID NO: 711327 - RNA, 22 nt, Human
uggucaaauuuagucucuggaa

SEQ ID NO: 711328 - RNA, 22 nt, Human
cccugcagcuuuugcauaguca

SEQ ID NO: 711329 - RNA, 22 nt, Human
uaauuuaauuucaugccagccu

SEQ ID NO: 711330 - RNA, 22 nt, Human
ccucacugucacuuauaguggu

SEQ ID NO: 711331 - RNA, 22 nt, Human
gcugugcccagcuccagcucug

SEQ ID NO: 711332 - RNA, 22 nt, Human
guacauuucucccaacacuaaa

SEQ ID NO: 711333 - RNA, 22 nt, Human
gagagacagcagaacgugcagc

SEQ ID NO: 711334 - RNA, 22 nt, Human
auguuauuuauugaaacacuuu

SEQ ID NO: 711335 - RNA, 22 nt, Human
auucuucacaaauauauagaag

SEQ ID NO: 711336 - RNA, 22 nt, Human
auuaaaauuccaagguaugcca

SEQ ID NO: 711337 - RNA, 22 nt, Human
uuuuaaugugcucugcaaugau

SEQ ID NO: 711338 - RNA, 22 nt, Human
aggaaaggauuggcuucucugu

SEQ ID NO: 711339 - RNA, 22 nt, Human
guggccuugcucacauguccag

SEQ ID NO: 711340 - RNA, 22 nt, Human
aaaagguaguugccaaauaagg

SEQ ID NO: 711341 - RNA, 20 nt, Human
ucuuccagguacagucugca

SEQ ID NO: 711342 - RNA, 22 nt, Human
gaggcaggcacuguuaucagca

SEQ ID NO: 711343 - RNA, 22 nt, Human
gcugccacuuggucaugucaug

SEQ ID NO: 711344 - RNA, 22 nt, Human
cugcaggauuucaugggcugac

SEQ ID NO: 711345 - RNA, 22 nt, Human
uaucucuugcaugcuuuuuaga

SEQ ID NO: 711346 - RNA, 17 nt, Human
auuugugauguaacguc

SEQ ID NO: 711347 - RNA, 22 nt, Human
cuccaggacagauucagggcca

SEQ ID NO: 711348 - RNA, 22 nt, Human
gcuuuacauaaacauuuauuau

SEQ ID NO: 711349 - RNA, 22 nt, Human
uugcugaauugaauccuuuggu

SEQ ID NO: 711350 - RNA, 22 nt, Human
ccacaucagaaauguuuacuca

SEQ ID NO: 711351 - RNA, 22 nt, Human
cucagggaauuauuucuguccu

SEQ ID NO: 711352 - RNA, 22 nt, Human
aaucuuggaaguguccacuggu

SEQ ID NO: 711353 - RNA, 22 nt, Human
uacacaaaggcacucuguuguu

SEQ ID NO: 711354 - RNA, 22 nt, Human
ggauaagaaaauuguaauaacu

SEQ ID NO: 711355 - RNA, 22 nt, Human
gagcaucgcugagaucccagac

SEQ ID NO: 711356 - RNA, 21 nt, Human
gugcacaguccugcacacagg

SEQ ID NO: 711357 - RNA, 22 nt, Human
gagggucccugcucagggccag

SEQ ID NO: 711358 - RNA, 22 nt, Human
cucaacaugccuacucagucug

SEQ ID NO: 711359 - RNA, 22 nt, Human
acuguaacacucauacugaagu

SEQ ID NO: 711360 - RNA, 21 nt, Human
agcaggcaaaggugaagucuu

SEQ ID NO: 711361 - RNA, 22 nt, Human
ccagcccugccucucagggccc

SEQ ID NO: 711362 - RNA, 22 nt, Human
ugcuuccuucccguucuucucc

SEQ ID NO: 711363 - RNA, 22 nt, Human
uauagcuaaggucagacuguuu

SEQ ID NO: 711364 - RNA, 22 nt, Human
uggcacccaguggagcugugcu

SEQ ID NO: 711365 - RNA, 22 nt, Human
auggcagcaaaugucuggcugg

SEQ ID NO: 711366 - RNA, 22 nt, Human
gggaagggacuuguuuaagguc

SEQ ID NO: 711367 - RNA, 22 nt, Human
cucuuuuagagaugaaaauugg

SEQ ID NO: 711368 - RNA, 22 nt, Human
ucacaggagcccaggggagcug

SEQ ID NO: 711369 - RNA, 22 nt, Human
ggccagcaguauauagcuaauu

SEQ ID NO: 711370 - RNA, 22 nt, Human
agaugcuggggccccucggaug

SEQ ID NO: 711371 - RNA, 21 nt, Human
caaguguggauguggaaggua

SEQ ID NO: 711372 - RNA, 22 nt, Human
auguccaauuucagagucucau

SEQ ID NO: 711373 - RNA, 22 nt, Human
aggauacacggggauuuaugua

SEQ ID NO: 711374 - RNA, 22 nt, Human
cucuaaauccacgguauaguug

SEQ ID NO: 711375 - RNA, 22 nt, Human
ugucaagucuaguugcuggcuu

SEQ ID NO: 711376 - RNA, 22 nt, Human
ucaggaaagguuuguugaaugg

SEQ ID NO: 711377 - RNA, 22 nt, Human
gcucugggaaggaucguaguga

SEQ ID NO: 711378 - RNA, 22 nt, Human
ggcuggccuguguggccgccac

SEQ ID NO: 711379 - RNA, 22 nt, Human
cuucugugcgccucuauucccu

SEQ ID NO: 711380 - RNA, 22 nt, Human
ugaacucucucaagugacagaa

SEQ ID NO: 711381 - RNA, 22 nt, Human
ucucauaauagcauuucucacc

SEQ ID NO: 711382 - RNA, 22 nt, Human
agaaacugaauuauuucugagg

SEQ ID NO: 711383 - RNA, 23 nt, Human
cauggaaaacugaaagcugaccu

SEQ ID NO: 711384 - RNA, 22 nt, Human
ucagcacaggucuugcaaaaca

SEQ ID NO: 711385 - RNA, 22 nt, Human
aaauugugagcuauagaucuag

SEQ ID NO: 711386 - RNA, 22 nt, Human
augcagggagguaagaggugcc

SEQ ID NO: 711387 - RNA, 21 nt, Human
agcaacucugacuagaugagg

SEQ ID NO: 711388 - RNA, 22 nt, Human
uuauuuugagagaaugugugcu

SEQ ID NO: 711389 - RNA, 22 nt, Human
cuuggggcagcccaggcugagc

SEQ ID NO: 711390 - RNA, 22 nt, Human
ggcugcugacuucauccagcuu

SEQ ID NO: 711391 - RNA, 22 nt, Human
ggcuccaggagggccuuggcca

SEQ ID NO: 711392 - RNA, 22 nt, Human
agggcugagacuaaggccagau

SEQ ID NO: 711393 - RNA, 22 nt, Human
ucaguucuuuauuucacaguga

SEQ ID NO: 711394 - RNA, 22 nt, Human
gucagggcacagugacagcucc

SEQ ID NO: 711395 - RNA, 22 nt, Human
cucagauguguuggauggaaaa

SEQ ID NO: 711396 - RNA, 22 nt, Human
uugcaggguugaccaauaggcu

SEQ ID NO: 711397 - RNA, 22 nt, Human
ugcagaggagucagccugggca

SEQ ID NO: 711398 - RNA, 22 nt, Human
cagagguguacagagggaggcc

SEQ ID NO: 711399 - RNA, 22 nt, Human
auuuaccagcugugcacugaua

SEQ ID NO: 711400 - RNA, 22 nt, Human
ugcuagugcaggguuuucaguu

SEQ ID NO: 711401 - RNA, 22 nt, Human
caggcagggagcuggaaaggau

SEQ ID NO: 711402 - RNA, 22 nt, Human
cagcagagggagccauugaaau

SEQ ID NO: 711403 - RNA, 22 nt, Human
ggucucuuugcuucagcuacag

SEQ ID NO: 711404 - RNA, 22 nt, Human
uccccaggaaggcccuuccugg

SEQ ID NO: 711405 - RNA, 22 nt, Human
gugugcaguagagaaagagcag

SEQ ID NO: 711406 - RNA, 22 nt, Human
ugcacacacggagauaggcuuu

SEQ ID NO: 711407 - RNA, 22 nt, Human
agagauggccuuaggugggaau

SEQ ID NO: 711408 - RNA, 20 nt, Human
cacaugcuguguguuucucu

SEQ ID NO: 711409 - RNA, 22 nt, Human
gacuguggccuuggaccauggg

SEQ ID NO: 711410 - RNA, 22 nt, Human
uucuuggaugcccucaugccuu

SEQ ID NO: 711411 - RNA, 22 nt, Human
aggcugcuucagcugcagggag

SEQ ID NO: 711412 - RNA, 22 nt, Human
gucuagaauaucuagaaagauc

SEQ ID NO: 711413 - RNA, 22 nt, Human
ugccuggccagacccuauagag

SEQ ID NO: 711414 - RNA, 22 nt, Human
aaauugucauuucugugcccua

SEQ ID NO: 711415 - RNA, 19 nt, Human
uguguucaaacuccaucuc

SEQ ID NO: 711416 - RNA, 22 nt, Human
augacagauagucuucauuugc

SEQ ID NO: 711417 - RNA, 22 nt, Human
uauuaaagggaaguuaugcaug

SEQ ID NO: 711418 - RNA, 20 nt, Human
ucacagaugaaaguucaaga

SEQ ID NO: 711419 - RNA, 22 nt, Human
aggcuuuaagcaagcauauugu

SEQ ID NO: 711420 - RNA, 22 nt, Human
auucagcaaacauuuauugugu

SEQ ID NO: 711421 - RNA, 22 nt, Human
aaggccaaagacaccuacacag

SEQ ID NO: 711422 - RNA, 22 nt, Human
caagaaacaccaaugacugcug

SEQ ID NO: 711423 - RNA, 22 nt, Human
cacucugggcucuuguuucaga

SEQ ID NO: 711424 - RNA, 22 nt, Human
acuuccuggcugggugaccugg

SEQ ID NO: 711425 - RNA, 22 nt, Human
uucucaaaacucaggguaucug

SEQ ID NO: 711426 - RNA, 22 nt, Human
cugugagucuucagcaaguguu

SEQ ID NO: 711427 - RNA, 22 nt, Human
aggcugugcacagggcaccugc

SEQ ID NO: 711428 - RNA, 22 nt, Human
cagcuccacuugaguggggccu

SEQ ID NO: 711429 - RNA, 22 nt, Human
ugguggcaauguccuggagaag

SEQ ID NO: 711430 - RNA, 18 nt, Human
uggcuggcucugucaucu

SEQ ID NO: 711431 - RNA, 22 nt, Human
gcagcucacagucuccgccauc

SEQ ID NO: 711432 - RNA, 22 nt, Human
aagaggggugugugucaaccca

SEQ ID NO: 711433 - RNA, 21 nt, Human
ccaaaggcuauguaucuucug

SEQ ID NO: 711434 - RNA, 22 nt, Human
auuauaggcuugagccaccgug

SEQ ID NO: 711435 - RNA, 22 nt, Human
ucugugcaguucuugucuugac

SEQ ID NO: 711436 - RNA, 22 nt, Human
aggcauggggcugcagucaggu

SEQ ID NO: 711437 - RNA, 22 nt, Human
uggcucagcagguuagaaacua

SEQ ID NO: 711438 - RNA, 22 nt, Human
uauuuuacagacuacuuuagau

SEQ ID NO: 711439 - RNA, 22 nt, Human
cugaaccacuaauauuuugauu

SEQ ID NO: 711440 - RNA, 22 nt, Human
uguaaucauuacaguacaugga

SEQ ID NO: 711441 - RNA, 22 nt, Human
agccccuugcugcccucuagag

SEQ ID NO: 711442 - RNA, 22 nt, Human
cagugaggaagcugucuggacc

SEQ ID NO: 711443 - RNA, 22 nt, Human
ggcugccaggagaagcucagug

SEQ ID NO: 711444 - RNA, 22 nt, Human
caagcccacugcucagagccaa

SEQ ID NO: 711445 - RNA, 22 nt, Human
ucauugaaugagaugcaauaga

SEQ ID NO: 711446 - RNA, 22 nt, Human
ugcugucuguuuacuggcuaua

SEQ ID NO: 711447 - RNA, 22 nt, Human
guuugcauguauuaagucaaua

SEQ ID NO: 711448 - RNA, 22 nt, Human
caguuuuugccauuaagaguaa

SEQ ID NO: 711449 - RNA, 22 nt, Human
acuucagagacuuuauggucca

SEQ ID NO: 711450 - RNA, 22 nt, Human
uguaaaguccaagaucaaagag

SEQ ID NO: 711451 - RNA, 22 nt, Human
ggggccccuguggcuugaugcc

SEQ ID NO: 711452 - RNA, 22 nt, Human
gccaugccugugucuccaggcc

SEQ ID NO: 711453 - RNA, 23 nt, Human
acuuuauugaccccaggucaguu

SEQ ID NO: 711454 - RNA, 22 nt, Human
uuagggacaaauuugcagaacc

SEQ ID NO: 711455 - RNA, 22 nt, Human
uacaguucuuugaaggaucuag

SEQ ID NO: 711456 - RNA, 23 nt, Human
aaaguuugaagcaacaguaguug

SEQ ID NO: 711457 - RNA, 22 nt, Human
ccagcucaucucagugaaaugc

SEQ ID NO: 711458 - RNA, 22 nt, Human
auucacagggacaaugggagag

SEQ ID NO: 711459 - RNA, 22 nt, Human
gccuuuauaucccugauaucua

SEQ ID NO: 711460 - RNA, 22 nt, Human
aaauagcagcuuugacagcaca

SEQ ID NO: 711461 - RNA, 22 nt, Human
acaucagagggcucacaugauc

SEQ ID NO: 711462 - RNA, 22 nt, Human
ugguaggagauauggucuccga

SEQ ID NO: 711463 - RNA, 22 nt, Human
gccucagugauaugugggacaa

SEQ ID NO: 711464 - RNA, 22 nt, Human
ugcagccaccaccucugcugaa

SEQ ID NO: 711465 - RNA, 22 nt, Human
ucuuagcauuuguuaauaccca

SEQ ID NO: 711466 - RNA, 22 nt, Human
gugugcagucugcuaggcaggg

SEQ ID NO: 711467 - RNA, 22 nt, Human
auuuccuaauuuagggauagac

SEQ ID NO: 711468 - RNA, 19 nt, Human
ccagucuccuugcagcauc

SEQ ID NO: 711469 - RNA, 22 nt, Human
cagcuggggcagccacgugcgg

SEQ ID NO: 711470 - RNA, 22 nt, Human
gagcaguugggcucuaggaagu

SEQ ID NO: 711471 - RNA, 22 nt, Human
gggaacuguuuaacagggguuu

SEQ ID NO: 711472 - RNA, 22 nt, Human
gggagggagaggacaguucuau

SEQ ID NO: 711473 - RNA, 22 nt, Human
uugggagauggggagauaauau

SEQ ID NO: 711474 - RNA, 22 nt, Human
aggcccaguuauccuacuuguu

SEQ ID NO: 711475 - RNA, 17 nt, Human
acagaggcaggagugga

SEQ ID NO: 711476 - RNA, 22 nt, Human
ugauuacaacagagucauccau

SEQ ID NO: 711477 - RNA, 22 nt, Human
uucagcucuaguaagcagacac

SEQ ID NO: 711478 - RNA, 19 nt, Human
aaacacagauuucuuacca

SEQ ID NO: 711479 - RNA, 22 nt, Human
uuagaaguaaggucagauuucu

SEQ ID NO: 711480 - RNA, 22 nt, Human
ggagaggagcuauugggggcuc

SEQ ID NO: 711481 - RNA, 22 nt, Human
ugcuucuggcagauugagugag

SEQ ID NO: 711482 - RNA, 22 nt, Human
ucuucccuaaucaccaucuuca

SEQ ID NO: 711483 - RNA, 22 nt, Human
agagccuggacuuuucugagcc

SEQ ID NO: 711484 - RNA, 22 nt, Human
aaacuuuaagacaguccucaag

SEQ ID NO: 711485 - RNA, 22 nt, Human
cccaggugggcaccucgaggaa

SEQ ID NO: 711486 - RNA, 22 nt, Human
ugcauguuucuguauguuaaug

SEQ ID NO: 711487 - RNA, 21 nt, Human
ucagacuugagcucuucuaca

SEQ ID NO: 711488 - RNA, 22 nt, Human
guccuugaguaagucauggugg

SEQ ID NO: 711489 - RNA, 22 nt, Human
agucuuaauagagaaaaacugu

SEQ ID NO: 711490 - RNA, 22 nt, Human
uuaaagcaggcaucauuccuca

SEQ ID NO: 711491 - RNA, 22 nt, Human
gaugucuuucuaauacuggcuu

SEQ ID NO: 711492 - RNA, 22 nt, Human
cugcuggcuucuagucauucaa

SEQ ID NO: 711493 - RNA, 22 nt, Human
agagauggagagcacuggggcu

SEQ ID NO: 711494 - RNA, 22 nt, Human
auauguguaaaugcauuuguuu

SEQ ID NO: 711495 - RNA, 22 nt, Human
ccugggugacagagugagaccu

SEQ ID NO: 711496 - RNA, 22 nt, Human
gaguguuccagaaacuggcccu

SEQ ID NO: 711497 - RNA, 22 nt, Human
cagaaggcauagaugaaggccu

SEQ ID NO: 711498 - RNA, 22 nt, Human
cugguccaguggaugcugaggg

SEQ ID NO: 711499 - RNA, 20 nt, Human
gcucugggugguaaaugacu

SEQ ID NO: 711500 - RNA, 23 nt, Human
uccuuuaaugcuggaauggcuag

SEQ ID NO: 711501 - RNA, 22 nt, Human
ccccagguggauggcucgcaua

SEQ ID NO: 711502 - RNA, 21 nt, Human
agacuuugcuugcagagaguc

SEQ ID NO: 711503 - RNA, 22 nt, Human
aggaagaaacugagcucugaca

SEQ ID NO: 711504 - RNA, 22 nt, Human
uugguaaauaacaaucacagug

SEQ ID NO: 711505 - RNA, 22 nt, Human
cccagugcuaugccuauuacau

SEQ ID NO: 711506 - RNA, 22 nt, Human
cccagcuugcgggcggcaggag

SEQ ID NO: 711507 - RNA, 19 nt, Human
ugcuuugcucuuggacuca

SEQ ID NO: 711508 - RNA, 22 nt, Human
cucagcauucaauguccagucc

SEQ ID NO: 711509 - RNA, 22 nt, Human
ucuuggcuggucauuuaaaauc

SEQ ID NO: 711510 - RNA, 22 nt, Human
cugagguggcgccucucuuuaa

SEQ ID NO: 711511 - RNA, 22 nt, Human
cagcaacaugugguaguguagg

SEQ ID NO: 711512 - RNA, 22 nt, Human
uucugaaagccaauucauugaa

SEQ ID NO: 711513 - RNA, 22 nt, Human
aggaaggaagagacaccauuug

SEQ ID NO: 711514 - RNA, 22 nt, Human
gcagaugccagaucaugcaggg

SEQ ID NO: 711515 - RNA, 22 nt, Human
agcucugggguggagcccagga

SEQ ID NO: 711516 - RNA, 23 nt, Human
aaggaucucugagaucauggcuu

SEQ ID NO: 711517 - RNA, 22 nt, Human
uuccuucuagcccaaguauugg

SEQ ID NO: 711518 - RNA, 22 nt, Human
ucuuucuuauuaugcucaaugu

SEQ ID NO: 711519 - RNA, 22 nt, Human
ucuccugcucccaacugcugca

SEQ ID NO: 711520 - RNA, 22 nt, Human
ugggggagagugcaagcaugaa

SEQ ID NO: 711521 - RNA, 22 nt, Human
gagggaggugauacugaacgua

SEQ ID NO: 711522 - RNA, 22 nt, Human
agaacagcagcacgucaagcug

SEQ ID NO: 711523 - RNA, 22 nt, Human
aucuagaggagggcugcuggau

SEQ ID NO: 711524 - RNA, 22 nt, Human
uuaaaccacugaguggagacua

SEQ ID NO: 711525 - RNA, 22 nt, Human
gccacacugcuucuuugagccu

SEQ ID NO: 711526 - RNA, 22 nt, Human
acagacaaguaguucagacaag

SEQ ID NO: 711527 - RNA, 22 nt, Human
uccaggagggguaggcaguaug

SEQ ID NO: 711528 - RNA, 22 nt, Human
ggaggaagugcaguucuacuac

SEQ ID NO: 711529 - RNA, 22 nt, Human
ccaugaguagcgauuucauuuu

SEQ ID NO: 711530 - RNA, 22 nt, Human
uuacccagggaccaagagaaac

SEQ ID NO: 711531 - RNA, 22 nt, Human
cccagugggucacugcaucuca

SEQ ID NO: 711532 - RNA, 22 nt, Human
ucaguguggguaagcaugcugu

SEQ ID NO: 711533 - RNA, 22 nt, Human
caucucuguguccccagagcuu

SEQ ID NO: 711534 - RNA, 22 nt, Human
gccaguggcaugcggcagggac

SEQ ID NO: 711535 - RNA, 22 nt, Human
cucugaauggacacuccagugu

SEQ ID NO: 711536 - RNA, 22 nt, Human
gugcuugggggaaguaacagac

SEQ ID NO: 711537 - RNA, 22 nt, Human
gucuucugucugucuggcaugu

SEQ ID NO: 711538 - RNA, 17 nt, Human
aguuaguguagcagugc

SEQ ID NO: 711539 - RNA, 22 nt, Human
gaggugaguggaucacgagguc

SEQ ID NO: 711540 - RNA, 22 nt, Human
gggcagugacaaaggggaugaa

SEQ ID NO: 711541 - RNA, 22 nt, Human
uccccaggagcaaugauucagu

SEQ ID NO: 711542 - RNA, 22 nt, Human
cucagagaggcaguggaaguca

SEQ ID NO: 711543 - RNA, 21 nt, Human
uagggggcagugggaugcuua

SEQ ID NO: 711544 - RNA, 22 nt, Human
agcuuuggcccuggagguuacu

SEQ ID NO: 711545 - RNA, 22 nt, Human
uucuguguugugacauucuaga

SEQ ID NO: 711546 - RNA, 18 nt, Human
gccagagguacuacugau

SEQ ID NO: 711547 - RNA, 22 nt, Human
gggaagauaguguugagggccc

SEQ ID NO: 711548 - RNA, 22 nt, Human
augcuuggcguuucacuuccug

SEQ ID NO: 711549 - RNA, 22 nt, Human
augaggucauucuuggauuaca

SEQ ID NO: 711550 - RNA, 22 nt, Human
uuucugcuuucagagugagaca

SEQ ID NO: 711551 - RNA, 22 nt, Human
acaggcuucagauguauuaacu

SEQ ID NO: 711552 - RNA, 22 nt, Human
uggagcaggcaucuuucucucu

SEQ ID NO: 711553 - RNA, 22 nt, Human
augaacagaggaauagaauucu

SEQ ID NO: 711554 - RNA, 22 nt, Human
uaaaguguuguacaaauguaug

SEQ ID NO: 711555 - RNA, 22 nt, Human
gucucccaaccccugugcccag

SEQ ID NO: 711556 - RNA, 20 nt, Human
gcagggcaagggauaugaaa

SEQ ID NO: 711557 - RNA, 22 nt, Human
uaguuaaagauucuguuaagag

SEQ ID NO: 711558 - RNA, 22 nt, Human
gcacagagacaguccugagauc

SEQ ID NO: 711559 - RNA, 22 nt, Human
caugaccccccaaggccugcag

SEQ ID NO: 711560 - RNA, 22 nt, Human
aagauggaguaguguaaugguu

SEQ ID NO: 711561 - RNA, 22 nt, Human
cuagauaagguggcuuggaauu

SEQ ID NO: 711562 - RNA, 22 nt, Human
gacugugacuucugaagcaaua

SEQ ID NO: 711563 - RNA, 22 nt, Human
gggaaggaaaguuauuagcaga

SEQ ID NO: 711564 - RNA, 22 nt, Human
agcuacuucccuguaggaaaca

SEQ ID NO: 711565 - RNA, 21 nt, Human
ggagcuggggagcuggcccca

SEQ ID NO: 711566 - RNA, 22 nt, Human
gagcccagcuugcacauggagc

SEQ ID NO: 711567 - RNA, 22 nt, Human
uuuuucaucugauugauaacuc

SEQ ID NO: 711568 - RNA, 22 nt, Human
acauuugacauuuaguaucagc

SEQ ID NO: 711569 - RNA, 21 nt, Human
cauauuaaaucggugccuuua

SEQ ID NO: 711570 - RNA, 22 nt, Human
agacagaauuugucagauaaau

SEQ ID NO: 711571 - RNA, 22 nt, Human
gcuguggucccucuguccucau

SEQ ID NO: 711572 - RNA, 22 nt, Human
cagcuuuauuucacguguuugu

SEQ ID NO: 711573 - RNA, 22 nt, Human
ccugaggacacacgcugcagga

SEQ ID NO: 711574 - RNA, 22 nt, Human
cauuguuaauugguaucuuaca

SEQ ID NO: 711575 - RNA, 22 nt, Human
gaggguccccaugcagagcuca

SEQ ID NO: 711576 - RNA, 22 nt, Human
ggaagccagagugcugggcagg

SEQ ID NO: 711577 - RNA, 22 nt, Human
uaagucguggaugauucuucgg

SEQ ID NO: 711578 - RNA, 22 nt, Human
cuucuagauuuuuguaauuguu

SEQ ID NO: 711579 - RNA, 22 nt, Human
uuuccuaagguagugauaauuu

SEQ ID NO: 711580 - RNA, 19 nt, Human
cacaguccuauguuuauca

SEQ ID NO: 711581 - RNA, 22 nt, Human
ucuggagccacaaaccucagcu

SEQ ID NO: 711582 - RNA, 22 nt, Human
gaagagagagcccugggguccg

SEQ ID NO: 711583 - RNA, 22 nt, Human
aauagcauccuaaaacauacuu

SEQ ID NO: 711584 - RNA, 22 nt, Human
guggccucugugcuccugccua

SEQ ID NO: 711585 - RNA, 22 nt, Human
cagagggcuguguaaggauguu

SEQ ID NO: 711586 - RNA, 22 nt, Human
ccugagagagaagcgaccuggu

SEQ ID NO: 711587 - RNA, 22 nt, Human
gcagccacuaguuuuccuguuu

SEQ ID NO: 711588 - RNA, 22 nt, Human
acaugcacugguugagggguuu

SEQ ID NO: 711589 - RNA, 22 nt, Human
ucaagaauuuggauaagaaaug

SEQ ID NO: 711590 - RNA, 22 nt, Human
ggcucagaggccagcagguaga

SEQ ID NO: 711591 - RNA, 22 nt, Human
uauagccauuuccaguggcauc

SEQ ID NO: 711592 - RNA, 22 nt, Human
caggaugugaggaggccauuug

SEQ ID NO: 711593 - RNA, 22 nt, Human
gucuucaguggcaaauggaucu

SEQ ID NO: 711594 - RNA, 22 nt, Human
uuaaugucaacauuucugaaga

SEQ ID NO: 711595 - RNA, 22 nt, Human
ugugucuguuuugcucaccauu

SEQ ID NO: 711596 - RNA, 22 nt, Human
ucucuccuguguucugauguuu

SEQ ID NO: 711597 - RNA, 22 nt, Human
auguuuccgugagcauccuuga

SEQ ID NO: 711598 - RNA, 22 nt, Human
caaaaaacacagaugucugugu

SEQ ID NO: 711599 - RNA, 22 nt, Human
cuggcccauggugagcucuggg

SEQ ID NO: 711600 - RNA, 22 nt, Human
uugcuucuuagauauuccucuc

SEQ ID NO: 711601 - RNA, 22 nt, Human
ucauggaaggaugcccugcaag

SEQ ID NO: 711602 - RNA, 21 nt, Human
aggcucagcagguguauaaag

SEQ ID NO: 711603 - RNA, 21 nt, Human
aguccuugaaacucuuucuug

SEQ ID NO: 711604 - RNA, 22 nt, Human
uguggcugaucaaagcgcucag

SEQ ID NO: 711605 - RNA, 22 nt, Human
ucuuuacaagucacauuuucug

SEQ ID NO: 711606 - RNA, 22 nt, Human
guauuccugcaaauagcaguga

SEQ ID NO: 711607 - RNA, 22 nt, Human
agcugcagauucuaucuagaag

SEQ ID NO: 711608 - RNA, 22 nt, Human
ucagcaauccucccacaggugg

SEQ ID NO: 711609 - RNA, 22 nt, Human
agguucaaauuguugcaguuuc

SEQ ID NO: 711610 - RNA, 22 nt, Human
ugaaguuguuaagguugccauu

SEQ ID NO: 711611 - RNA, 22 nt, Human
gaguaauuuucuugauuucuua

SEQ ID NO: 711612 - RNA, 22 nt, Human
cugugccucccuuuacuuugag

SEQ ID NO: 711613 - RNA, 22 nt, Human
aaaggaggccacauggcuagga

SEQ ID NO: 711614 - RNA, 22 nt, Human
ccagaggagcaggcuggcucca

SEQ ID NO: 711615 - RNA, 22 nt, Human
gaggaagggacuuuauuaucug

SEQ ID NO: 711616 - RNA, 22 nt, Human
aagcaccuggguuauaucuuag

SEQ ID NO: 711617 - RNA, 22 nt, Human
ccuggcuuuagcugccuucccu

SEQ ID NO: 711618 - RNA, 22 nt, Human
auauuuaacuggucccaauaua

SEQ ID NO: 711619 - RNA, 22 nt, Human
acugagcaucagggcugggaac

SEQ ID NO: 711620 - RNA, 22 nt, Human
ugggcugcagagcccggccuuc

SEQ ID NO: 711621 - RNA, 17 nt, Human
uggaagugaggacacug

SEQ ID NO: 711622 - RNA, 22 nt, Human
uaauucuuguucagagguagua

SEQ ID NO: 711623 - RNA, 22 nt, Human
cugcccuguaucuucucccaau

SEQ ID NO: 711624 - RNA, 22 nt, Human
uuucccagagguaugaauaagu

SEQ ID NO: 711625 - RNA, 22 nt, Human
agugcuuuccuucuugugacau

SEQ ID NO: 711626 - RNA, 22 nt, Human
ccuuggagaccugggucugugc

SEQ ID NO: 711627 - RNA, 22 nt, Human
acagggaaagggacagcagcag

SEQ ID NO: 711628 - RNA, 22 nt, Human
uucucugggaacauaaaugaag

SEQ ID NO: 711629 - RNA, 22 nt, Human
uaagugucucucgaauuaugcu

SEQ ID NO: 711630 - RNA, 22 nt, Human
cagagccacugcauuuuacagc

SEQ ID NO: 711631 - RNA, 22 nt, Human
ucuuggagaauggcagagaagc

SEQ ID NO: 711632 - RNA, 22 nt, Human
uuucacaggaguccuuucuaua

SEQ ID NO: 711633 - RNA, 22 nt, Human
uguauguguccuaauucaagca

SEQ ID NO: 711634 - RNA, 21 nt, Human
aaauacagaugcaaaucuguu

SEQ ID NO: 711635 - RNA, 22 nt, Human
ugcacagacauacacauauaug

SEQ ID NO: 711636 - RNA, 23 nt, Human
agguggccaccagaauguuaagg

SEQ ID NO: 711637 - RNA, 22 nt, Human
cuuccugcaggacagccaucug

SEQ ID NO: 711638 - RNA, 22 nt, Human
ggugggaggacuguuugaggca

SEQ ID NO: 711639 - RNA, 20 nt, Human
cagaccugcacccacuucga

SEQ ID NO: 711640 - RNA, 22 nt, Human
guuucucuuaacacauaaagua

SEQ ID NO: 711641 - RNA, 22 nt, Human
ucuaacuugaacucaugacugu

SEQ ID NO: 711642 - RNA, 22 nt, Human
guccacagcuggccagggccuc

SEQ ID NO: 711643 - RNA, 22 nt, Human
aaagucauuuguauauacccuu

SEQ ID NO: 711644 - RNA, 22 nt, Human
ccaucugacugccacccaggcc

SEQ ID NO: 711645 - RNA, 22 nt, Human
ucaauuaagaggcuaaguuacu

SEQ ID NO: 711646 - RNA, 22 nt, Human
cugcuucacccugccugagaac

SEQ ID NO: 711647 - RNA, 22 nt, Human
ucaggaagugcugaggcugcuu

SEQ ID NO: 711648 - RNA, 22 nt, Human
ucuucuguccuaagucaaagca

SEQ ID NO: 711649 - RNA, 22 nt, Human
auugacaaaucugaacauacgg

SEQ ID NO: 711650 - RNA, 23 nt, Human
cuggucagaggcugcuggaaggg

SEQ ID NO: 711651 - RNA, 23 nt, Human
uggcucagggucucuuaugaagu

SEQ ID NO: 711652 - RNA, 22 nt, Human
ucucuuuguggccaggagagga

SEQ ID NO: 711653 - RNA, 22 nt, Human
ugggugaggagaggcugucuaa

SEQ ID NO: 711654 - RNA, 22 nt, Human
aguccaugguucugacucaucu

SEQ ID NO: 711655 - RNA, 22 nt, Human
ucugggaacacuuugugagcuc

SEQ ID NO: 711656 - RNA, 22 nt, Human
acagcauuuaaagaaaaugaac

SEQ ID NO: 711657 - RNA, 22 nt, Human
aacucaguuacauauuagaaua

SEQ ID NO: 711658 - RNA, 22 nt, Human
cucuggacagcccuccaggaag

SEQ ID NO: 711659 - RNA, 22 nt, Human
ucagagccccuccgcuguccca

SEQ ID NO: 711660 - RNA, 19 nt, Human
agggucaggacaaggacuu

SEQ ID NO: 711661 - RNA, 20 nt, Human
ucuugagaacaauuucuggc

SEQ ID NO: 711662 - RNA, 22 nt, Human
ggccucugaggacagccuuggc

SEQ ID NO: 711663 - RNA, 22 nt, Human
aggguggccaugagggagagau

SEQ ID NO: 711664 - RNA, 23 nt, Human
gcugacugugaaauucuggagcu

SEQ ID NO: 711665 - RNA, 22 nt, Human
ccuucagagguguagauugcgu

SEQ ID NO: 711666 - RNA, 22 nt, Human
guuauugacucucuuguggcuu

SEQ ID NO: 711667 - RNA, 22 nt, Human
ucuccuucgaggcccagcuccc

SEQ ID NO: 711668 - RNA, 22 nt, Human
uccagccuuccuuuucacucuc

SEQ ID NO: 711669 - RNA, 22 nt, Human
gacagcuucuagaaauggucac

SEQ ID NO: 711670 - RNA, 22 nt, Human
ggagaggggaacuuguugcuug

SEQ ID NO: 711671 - RNA, 22 nt, Human
acugucaggauggcagcuuguu

SEQ ID NO: 711672 - RNA, 22 nt, Human
ccugggguauauaggugaauau

SEQ ID NO: 711673 - RNA, 22 nt, Human
gccuggcugcucagccacucac

SEQ ID NO: 711674 - RNA, 22 nt, Human
cucucuggcacuucauugcugu

SEQ ID NO: 711675 - RNA, 22 nt, Human
uugaauuagacuuugcuacagg

SEQ ID NO: 711676 - RNA, 22 nt, Human
ugugcccagacugccucaguga

SEQ ID NO: 711677 - RNA, 22 nt, Human
auaaccuguuucagacauuugu

SEQ ID NO: 711678 - RNA, 22 nt, Human
uacaaucacccaaagagccaga

SEQ ID NO: 711679 - RNA, 22 nt, Human
ucagcccaguuaagaaccuguu

SEQ ID NO: 711680 - RNA, 22 nt, Human
uucugaaaacacacuuugcagc

SEQ ID NO: 711681 - RNA, 22 nt, Human
uggaauucccaaguaacuuuua

SEQ ID NO: 711682 - RNA, 22 nt, Human
gggauccauccgugcagcagag

SEQ ID NO: 711683 - RNA, 22 nt, Human
gcuuugccuguagcauuggccu

SEQ ID NO: 711684 - RNA, 22 nt, Human
cuugcaggcagggacacugucu

SEQ ID NO: 711685 - RNA, 22 nt, Human
auucaguuucauggcacagcua

SEQ ID NO: 711686 - RNA, 22 nt, Human
uacuuuucuguguggcagucac

SEQ ID NO: 711687 - RNA, 22 nt, Human
uggagcuggcuuguggaaguug

SEQ ID NO: 711688 - RNA, 21 nt, Human
ucaacccuugcgucaccaagc

SEQ ID NO: 711689 - RNA, 22 nt, Human
cagcagcuuuugcauucucauu

SEQ ID NO: 711690 - RNA, 22 nt, Human
aagauggcuuagaguccuggug

SEQ ID NO: 711691 - RNA, 22 nt, Human
gcaaacauguugugagauacca

SEQ ID NO: 711692 - RNA, 22 nt, Human
gccuccuggauuuuagugccau

SEQ ID NO: 711693 - RNA, 22 nt, Human
cuggggcuggugaggcaggcuc

SEQ ID NO: 711694 - RNA, 21 nt, Human
ggcuuuaugcucacccagccu

SEQ ID NO: 711695 - RNA, 22 nt, Human
aagcagcacaguaauauuggug

SEQ ID NO: 711696 - RNA, 22 nt, Human
aaacacuucuuaggucuuaagu

SEQ ID NO: 711697 - RNA, 22 nt, Human
gcuggcugagcacugguuuaua

SEQ ID NO: 711698 - RNA, 22 nt, Human
uguaugaaucucauuuguuuaa

SEQ ID NO: 711699 - RNA, 22 nt, Human
uaacaucuuuagcagcucgaac

SEQ ID NO: 711700 - RNA, 22 nt, Human
auucacaaagucacccuuacac

SEQ ID NO: 711701 - RNA, 22 nt, Human
uugagcaggauggcuaugcaca

SEQ ID NO: 711702 - RNA, 22 nt, Human
cccaggcugugcaaacuucaaa

SEQ ID NO: 711703 - RNA, 22 nt, Human
gucucugccuggggggaucaga

SEQ ID NO: 711704 - RNA, 22 nt, Human
ucuagaccuggcacugcccugu

SEQ ID NO: 711705 - RNA, 19 nt, Human
ccugggaggcggagguugc

SEQ ID NO: 711706 - RNA, 22 nt, Human
ugugcagaguugaagacaggag

SEQ ID NO: 711707 - RNA, 22 nt, Human
cagggacaugacuggucucugu

SEQ ID NO: 711708 - RNA, 22 nt, Human
aguggcaguuugggagcuacag

SEQ ID NO: 711709 - RNA, 21 nt, Human
ccauucuuagucaagugucuc

SEQ ID NO: 711710 - RNA, 21 nt, Human
agccaggguggacacuguaug

SEQ ID NO: 711711 - RNA, 19 nt, Human
uaaaucuguauucuucaaa

SEQ ID NO: 711712 - RNA, 22 nt, Human
ugggcaagcucuggguggacac

SEQ ID NO: 711713 - RNA, 22 nt, Human
uuccuugaccacugcauaauga

SEQ ID NO: 711714 - RNA, 22 nt, Human
aucuucugauuuauggagcaau

SEQ ID NO: 711715 - RNA, 22 nt, Human
cucugcuuggaacuggacagaa

SEQ ID NO: 711716 - RNA, 22 nt, Human
agcucugcuucuugggaagaug

SEQ ID NO: 711717 - RNA, 20 nt, Human
ccuccuggucaggugugcag

SEQ ID NO: 711718 - RNA, 22 nt, Human
ugugaaaucugaugaauugacc

SEQ ID NO: 711719 - RNA, 23 nt, Human
uauucagcagugggauuuguugu

SEQ ID NO: 711720 - RNA, 22 nt, Human
gagcagugacuggagcaugaga

SEQ ID NO: 711721 - RNA, 22 nt, Human
uggcuaaucuuaaggcuuuugc

SEQ ID NO: 711722 - RNA, 19 nt, Human
cucuuuccauuguauuugc

SEQ ID NO: 711723 - RNA, 22 nt, Human
caagaugccccugguagggauc

SEQ ID NO: 711724 - RNA, 22 nt, Human
uggagcagagaugggagcccaa

SEQ ID NO: 711725 - RNA, 22 nt, Human
uuuacaagaaaucaugaugcua

SEQ ID NO: 711726 - RNA, 22 nt, Human
ggcugaugagcuuagcuagaga

SEQ ID NO: 711727 - RNA, 22 nt, Human
gaggcucacugggcaaagacuc

SEQ ID NO: 711728 - RNA, 22 nt, Human
ccaggaggugcuggaagaaagc

SEQ ID NO: 711729 - RNA, 22 nt, Human
uccagagaucacacugggcagg

SEQ ID NO: 711730 - RNA, 22 nt, Human
auaaugcagcuuuucaauggcc

SEQ ID NO: 711731 - RNA, 22 nt, Human
agagaccuuuguuauucuagga

SEQ ID NO: 711732 - RNA, 22 nt, Human
gacuuuaugaagagaugaccaa

SEQ ID NO: 711733 - RNA, 22 nt, Human
agaggggacagccaccugcccg

SEQ ID NO: 711734 - RNA, 22 nt, Human
ugaguauuuuaaguucucaauc

SEQ ID NO: 711735 - RNA, 22 nt, Human
aaggcugugucagaagcucccu

SEQ ID NO: 711736 - RNA, 22 nt, Human
cacccagcagcacuuaagacua

SEQ ID NO: 711737 - RNA, 22 nt, Human
gagugucugaauuagagcacaa

SEQ ID NO: 711738 - RNA, 22 nt, Human
gugguccuggcaaccaugguga

SEQ ID NO: 711739 - RNA, 22 nt, Human
uugguuuugggauguacaaagg

SEQ ID NO: 711740 - RNA, 22 nt, Human
cuuccugaaucuuccauguaua

SEQ ID NO: 711741 - RNA, 22 nt, Human
cacacuagucuauccauuagcu

SEQ ID NO: 711742 - RNA, 22 nt, Human
uuauacacguuuauggagcuac

SEQ ID NO: 711743 - RNA, 22 nt, Human
cugaaacauugcaauaacaaag

SEQ ID NO: 711744 - RNA, 22 nt, Human
ggcuucagaggggagguagugc

SEQ ID NO: 711745 - RNA, 22 nt, Human
gcuugagaacuucaacucagug

SEQ ID NO: 711746 - RNA, 22 nt, Human
gccaagaguuuccagcugcaag

SEQ ID NO: 711747 - RNA, 22 nt, Human
gccugggagaaugaccuccaac

SEQ ID NO: 711748 - RNA, 22 nt, Human
guuugaaagaccaauuagauuu

SEQ ID NO: 711749 - RNA, 22 nt, Human
uggcagcuuccugcucauagga

SEQ ID NO: 711750 - RNA, 18 nt, Human
augucugugcacuggaua

SEQ ID NO: 711751 - RNA, 21 nt, Human
gaagagaguccucauccugag

SEQ ID NO: 711752 - RNA, 20 nt, Human
ccuaggcaugcugagucucc

SEQ ID NO: 711753 - RNA, 22 nt, Human
uauggcuggaauacugaaaggc

SEQ ID NO: 711754 - RNA, 22 nt, Human
aaggccagcuggagggaugagg

SEQ ID NO: 711755 - RNA, 22 nt, Human
uaaagguugaaaacugacugcc

SEQ ID NO: 711756 - RNA, 22 nt, Human
gcagagcugguacuugagccug

SEQ ID NO: 711757 - RNA, 22 nt, Human
aacagaggauguuugaaauuca

SEQ ID NO: 711758 - RNA, 22 nt, Human
uaguccauuuucacacugcuga

SEQ ID NO: 711759 - RNA, 22 nt, Human
acaaacuucccagacaagcucc

SEQ ID NO: 711760 - RNA, 22 nt, Human
guucacagaaauuguguaccuc

SEQ ID NO: 711761 - RNA, 22 nt, Human
agaaggggagaagcuaccagga

SEQ ID NO: 711762 - RNA, 22 nt, Human
aagcccuuggcgcacaccgggc

SEQ ID NO: 711763 - RNA, 22 nt, Human
uugcaaaagcaauugcaguuuu

SEQ ID NO: 711764 - RNA, 23 nt, Human
ggcucagaaaaaguccuggccuc

SEQ ID NO: 711765 - RNA, 22 nt, Human
ucccuugguuaaauauguagga

SEQ ID NO: 711766 - RNA, 19 nt, Human
ccugcugcaccacuuguua

SEQ ID NO: 711767 - RNA, 22 nt, Human
uccuucucuacaaauccaggca

SEQ ID NO: 711768 - RNA, 22 nt, Human
aggccugggcaagaaggggcgu

SEQ ID NO: 711769 - RNA, 22 nt, Human
guggcagcaaaauccugcauuc

SEQ ID NO: 711770 - RNA, 22 nt, Human
ccagguggugccucuguucgca

SEQ ID NO: 711771 - RNA, 22 nt, Human
augccaguaagucucagcuagg

SEQ ID NO: 711772 - RNA, 23 nt, Human
guacacauaguguaguuauauuu

SEQ ID NO: 711773 - RNA, 22 nt, Human
ugagacuuggcacugaggaacu

SEQ ID NO: 711774 - RNA, 22 nt, Human
auauaacucuuguucuuauagu

SEQ ID NO: 711775 - RNA, 22 nt, Human
agucaaauaagagagagauguu

SEQ ID NO: 711776 - RNA, 22 nt, Human
acagggagucugaggggauagu

SEQ ID NO: 711777 - RNA, 22 nt, Human
guggcagguuccguagacagca

SEQ ID NO: 711778 - RNA, 18 nt, Human
aaguaugccuauguuauu

SEQ ID NO: 711779 - RNA, 22 nt, Human
ugaggccaggacccccagcagg

SEQ ID NO: 711780 - RNA, 22 nt, Human
acagccagggcauugucgccga

SEQ ID NO: 711781 - RNA, 22 nt, Human
cugaggagagaucacguggugu

SEQ ID NO: 711782 - RNA, 21 nt, Human
uucuacaggaugaaugaaaac

SEQ ID NO: 711783 - RNA, 22 nt, Human
aggcaguuuaggcagcgauuua

SEQ ID NO: 711784 - RNA, 22 nt, Human
uuacauguacaaacaauucuua

SEQ ID NO: 711785 - RNA, 22 nt, Human
gccaaaggauucuauggagaua

SEQ ID NO: 711786 - RNA, 22 nt, Human
ugccuucuugaauaugguucuu

SEQ ID NO: 711787 - RNA, 22 nt, Human
uucacauuggugauauguuucu

SEQ ID NO: 711788 - RNA, 22 nt, Human
augcauauucuuagccccuccu

SEQ ID NO: 711789 - RNA, 22 nt, Human
cacagagaauacugcucuugcu

SEQ ID NO: 711790 - RNA, 22 nt, Human
gggcacugaacacccucuucgc

SEQ ID NO: 711791 - RNA, 20 nt, Human
aguggccacugcagagaugc

SEQ ID NO: 711792 - RNA, 22 nt, Human
ucagggaacaauguuauggcuu

SEQ ID NO: 711793 - RNA, 20 nt, Human
ugaaggccauuuguuccaga

SEQ ID NO: 711794 - RNA, 22 nt, Human
cguggcugguggaccugagggc

SEQ ID NO: 711795 - RNA, 21 nt, Human
gggugcuguggucaugcagga

SEQ ID NO: 711796 - RNA, 22 nt, Human
aaugcuaaaauggcacuaaagu

SEQ ID NO: 711797 - RNA, 22 nt, Human
aaucauugcuccuuucucuggu

SEQ ID NO: 711798 - RNA, 22 nt, Human
uagugcauaacauuuaaagguc

SEQ ID NO: 711799 - RNA, 18 nt, Human
cccucuccugcuaguggg

SEQ ID NO: 711800 - RNA, 22 nt, Human
uuuuuguggugcagacuaaagc

SEQ ID NO: 711801 - RNA, 22 nt, Human
auuguuaaacugaagcauuacu

SEQ ID NO: 711802 - RNA, 22 nt, Human
aggagccagaauccagacucgg

SEQ ID NO: 711803 - RNA, 22 nt, Human
uucagacuggcuacauuuucau

SEQ ID NO: 711804 - RNA, 22 nt, Human
acaaugaagggagacacuugcu

SEQ ID NO: 711805 - RNA, 22 nt, Human
ugucaaaaccagcaauuuuguu

SEQ ID NO: 711806 - RNA, 22 nt, Human
gcuauugugacagcuuuucgcc

SEQ ID NO: 711807 - RNA, 21 nt, Human
agcugagguaaggcaagagag

SEQ ID NO: 711808 - RNA, 22 nt, Human
gacccuccuacuacccuggaaa

SEQ ID NO: 711809 - RNA, 22 nt, Human
ugaggcaggagguugagaacug

SEQ ID NO: 711810 - RNA, 22 nt, Human
ccauaaaguaggaaacacuaca

SEQ ID NO: 711811 - RNA, 22 nt, Human
ugauaauguucgagaaugaaga

SEQ ID NO: 711812 - RNA, 22 nt, Human
aggggugaaagagggcccucaa

SEQ ID NO: 711813 - RNA, 22 nt, Human
uuuccauguuaucuugcagacu

SEQ ID NO: 711814 - RNA, 18 nt, Human
ggcuuugcugggguuucu

SEQ ID NO: 711815 - RNA, 21 nt, Human
uucucuggauaggccaguccu

SEQ ID NO: 711816 - RNA, 22 nt, Human
uuccuggggggauagauuucac

SEQ ID NO: 711817 - RNA, 22 nt, Human
uuucacagauccuacagcuugu

SEQ ID NO: 711818 - RNA, 22 nt, Human
ucaggaaauggugauuugguug

SEQ ID NO: 711819 - RNA, 22 nt, Human
aggcagcuaagauggauaauga

SEQ ID NO: 711820 - RNA, 22 nt, Human
ugcauccuuccauggguuucaa

SEQ ID NO: 711821 - RNA, 23 nt, Human
ugucaucuccagacucccagugc

SEQ ID NO: 711822 - RNA, 22 nt, Human
gucuggaguggggccugagaau

SEQ ID NO: 711823 - RNA, 22 nt, Human
cccuggagguggagguugcagg

SEQ ID NO: 711824 - RNA, 22 nt, Human
ucaaauucuauucuauacucag

SEQ ID NO: 711825 - RNA, 22 nt, Human
ggcccucuuuuauccaucauaa

SEQ ID NO: 711826 - RNA, 22 nt, Human
auugcuuuucagacaaugaggc

SEQ ID NO: 711827 - RNA, 21 nt, Human
cagaccauugcaugagcaggu

SEQ ID NO: 711828 - RNA, 22 nt, Human
aggcuucagccuagagcuggag

SEQ ID NO: 711829 - RNA, 22 nt, Human
gccuuauuuuacuuggauucug

SEQ ID NO: 711830 - RNA, 20 nt, Human
uucugcuuuugcuuagggac

SEQ ID NO: 711831 - RNA, 22 nt, Human
cagcuuucaucagugacacuca

SEQ ID NO: 711832 - RNA, 22 nt, Human
cugggagcugaggcugacgcug

SEQ ID NO: 711833 - RNA, 22 nt, Human
caggaagucgcagagcuggggg

SEQ ID NO: 711834 - RNA, 22 nt, Human
aggccagccucaggcagggacc

SEQ ID NO: 711835 - RNA, 22 nt, Human
ugacauuuaagccucugauuuc

SEQ ID NO: 711836 - RNA, 22 nt, Human
acugagguagggcacaccuagg

SEQ ID NO: 711837 - RNA, 22 nt, Human
uuaauccaauauccuggcuauu

SEQ ID NO: 711838 - RNA, 22 nt, Human
agaggaagcugagaugccucuu

SEQ ID NO: 711839 - RNA, 22 nt, Human
agcugccucccugugcuugucc

SEQ ID NO: 711840 - RNA, 22 nt, Human
ucucugggagccaggaugacac

SEQ ID NO: 711841 - RNA, 23 nt, Human
agggccuggcguggagugugugc

SEQ ID NO: 711842 - RNA, 22 nt, Human
aggucagcugcugauaggcagc

SEQ ID NO: 711843 - RNA, 22 nt, Human
aguuccauccuuccacugcccu

SEQ ID NO: 711844 - RNA, 22 nt, Human
cagcucuuuauugccaauauuc

SEQ ID NO: 711845 - RNA, 22 nt, Human
agggugcauguuugcaagagug

SEQ ID NO: 711846 - RNA, 22 nt, Human
ggcugcaggaugcccagccgug

SEQ ID NO: 711847 - RNA, 22 nt, Human
uggcauggcuacuggaauggcg

SEQ ID NO: 711848 - RNA, 22 nt, Human
cuggcccugucagcacagaauc

SEQ ID NO: 711849 - RNA, 22 nt, Human
accaaggcuaaaauaacauguu

SEQ ID NO: 711850 - RNA, 22 nt, Human
uagaaguugcucaauaaauguu

SEQ ID NO: 711851 - RNA, 22 nt, Human
uacacagauaugugaucaauca

SEQ ID NO: 711852 - RNA, 21 nt, Human
caggaacauucuuuacauuua

SEQ ID NO: 711853 - RNA, 22 nt, Human
cauucccacguguucuuugcuu

SEQ ID NO: 711854 - RNA, 22 nt, Human
auauuaaugggauuuagucagg

SEQ ID NO: 711855 - RNA, 22 nt, Human
ggcuggaauagagacugacugg

SEQ ID NO: 711856 - RNA, 22 nt, Human
ucuggccugaaaguccaugcuu

SEQ ID NO: 711857 - RNA, 21 nt, Human
agugucucuggaagcacgugu

SEQ ID NO: 711858 - RNA, 22 nt, Human
aucauguuaaauauuucaaucu

SEQ ID NO: 711859 - RNA, 22 nt, Human
gagccagacugccugaagcuca

SEQ ID NO: 711860 - RNA, 22 nt, Human
cuggaggaaaacaacugcagac

SEQ ID NO: 711861 - RNA, 22 nt, Human
agagguauuagauuugcauagg

SEQ ID NO: 711862 - RNA, 22 nt, Human
ccagggcucugcuucugccaug

SEQ ID NO: 711863 - RNA, 22 nt, Human
aaugacuguagucauauuaagg

SEQ ID NO: 711864 - RNA, 22 nt, Human
uugcccugcguuaccaucucuu

SEQ ID NO: 711865 - RNA, 20 nt, Human
ccagaggguagggccgcccc

SEQ ID NO: 711866 - RNA, 22 nt, Human
agaaucauuauauuuauuaagc

SEQ ID NO: 711867 - RNA, 22 nt, Human
ucacaaauguuugcaugugucu

SEQ ID NO: 711868 - RNA, 22 nt, Human
uguuucauuaguacugacaaua

SEQ ID NO: 711869 - RNA, 22 nt, Human
ucauugaauuucacagcuuuau

SEQ ID NO: 711870 - RNA, 22 nt, Human
uggaaggagcuaaggaccuggg

SEQ ID NO: 711871 - RNA, 22 nt, Human
ugaacuuagugggaauaucucu

SEQ ID NO: 711872 - RNA, 21 nt, Human
aucagaaguuuuggucaguag

SEQ ID NO: 711873 - RNA, 23 nt, Human
ucugagaagguuucagccagacu

SEQ ID NO: 711874 - RNA, 23 nt, Human
uuuuccagaaucgacucuguaga

SEQ ID NO: 711875 - RNA, 22 nt, Human
aauaugcacucugauuuagcag

SEQ ID NO: 711876 - RNA, 22 nt, Human
agaaaagaggcuuucuaagcau

SEQ ID NO: 711877 - RNA, 22 nt, Human
cuucuucaauagcaagcgcaua

SEQ ID NO: 711878 - RNA, 22 nt, Human
aggcagugcaugcaaaggucgg

SEQ ID NO: 711879 - RNA, 22 nt, Human
uuagggaaguguuauucucagg

SEQ ID NO: 711880 - RNA, 22 nt, Human
cugagcauccagcagguacugc

SEQ ID NO: 711881 - RNA, 22 nt, Human
gcuuugaagacuuuuccagggu

SEQ ID NO: 711882 - RNA, 22 nt, Human
cagggcugugcccaucuucccc

SEQ ID NO: 711883 - RNA, 22 nt, Human
aaaagggacuacucucagcucc

SEQ ID NO: 711884 - RNA, 22 nt, Human
cacuuugaagagcuuuuugaca

SEQ ID NO: 711885 - RNA, 22 nt, Human
auccacagucagaacgggccua

SEQ ID NO: 711886 - RNA, 22 nt, Human
acauuucucaucuaguagagua

SEQ ID NO: 711887 - RNA, 22 nt, Human
aggaguuuauccgagggcauaa

SEQ ID NO: 711888 - RNA, 22 nt, Human
uuggccagacacuaccccccuu

SEQ ID NO: 711889 - RNA, 22 nt, Human
augcauaugcaucuguguacau

SEQ ID NO: 711890 - RNA, 22 nt, Human
uggcuucagaucugccccggag

SEQ ID NO: 711891 - RNA, 22 nt, Human
gcacagcagcugcucaguugcu

SEQ ID NO: 711892 - RNA, 22 nt, Human
cucccagggucuaggcugcugg

SEQ ID NO: 711893 - RNA, 18 nt, Human
ucuccuggguaggggccu

SEQ ID NO: 711894 - RNA, 20 nt, Human
aucagaggauagggaagugg

SEQ ID NO: 711895 - RNA, 22 nt, Human
ggaaggaacaaacccugugugg

SEQ ID NO: 711896 - RNA, 22 nt, Human
cauauuuuaguugcugaacagc

SEQ ID NO: 711897 - RNA, 22 nt, Human
cugucccacaagcagugugcac

SEQ ID NO: 711898 - RNA, 20 nt, Human
aggcuccuccaggaugugug

SEQ ID NO: 711899 - RNA, 22 nt, Human
caguggcugagaguggacacug

SEQ ID NO: 711900 - RNA, 20 nt, Human
agggucaguagcacagagcu

SEQ ID NO: 711901 - RNA, 22 nt, Human
guggucccuucuggcccugguc

SEQ ID NO: 711902 - RNA, 21 nt, Human
gcugccaccgcgugcuccagg

SEQ ID NO: 711903 - RNA, 17 nt, Human
cucuuuauaaagaguua

SEQ ID NO: 711904 - RNA, 22 nt, Human
cagggguguuuuuggccaggag

SEQ ID NO: 711905 - RNA, 21 nt, Human
aaagagguuaauauuguaagu

SEQ ID NO: 711906 - RNA, 22 nt, Human
cuagcacugagaauagugcaua

SEQ ID NO: 711907 - RNA, 22 nt, Human
cuguggcugaacucugaagagg

SEQ ID NO: 711908 - RNA, 22 nt, Human
auuuucauuuugcagggugaga

SEQ ID NO: 711909 - RNA, 22 nt, Human
cucugacuuuaaauacaggaug

SEQ ID NO: 711910 - RNA, 18 nt, Human
aggagccuuugcacugga

SEQ ID NO: 711911 - RNA, 22 nt, Human
ugcucuguucaguguaucuugu

SEQ ID NO: 711912 - RNA, 22 nt, Human
aaaugucaaggugauagaugca

SEQ ID NO: 711913 - RNA, 22 nt, Human
aauguuuucucugugaacacau

SEQ ID NO: 711914 - RNA, 22 nt, Human
cucaggauuaaggaaucuaaau

SEQ ID NO: 711915 - RNA, 22 nt, Human
cauugaaaauguugcaggcugu

SEQ ID NO: 711916 - RNA, 22 nt, Human
uucauggaguugagaaggcuaa

SEQ ID NO: 711917 - RNA, 22 nt, Human
uggggagauuguuaaauuuaga

SEQ ID NO: 711918 - RNA, 22 nt, Human
aggcacaguggcucacaccugu

SEQ ID NO: 711919 - RNA, 22 nt, Human
cccagcugcaccucuauggccu

SEQ ID NO: 711920 - RNA, 22 nt, Human
uucugccugccccagagaggcc

SEQ ID NO: 711921 - RNA, 22 nt, Human
ucauccgugaagccaaagaaau

SEQ ID NO: 711922 - RNA, 22 nt, Human
uaauuauagccgcuauuuugcu

SEQ ID NO: 711923 - RNA, 22 nt, Human
gaacauugcuuuauuucuucua

SEQ ID NO: 711924 - RNA, 22 nt, Human
uaaacugcuucucucagucugu

SEQ ID NO: 711925 - RNA, 22 nt, Human
gaguuuggguggaaggagggua

SEQ ID NO: 711926 - RNA, 21 nt, Human
cugggcucaugguguuacaga

SEQ ID NO: 711927 - RNA, 22 nt, Human
guacagauuaauaauauacuga

SEQ ID NO: 711928 - RNA, 22 nt, Human
ucuucucuguggccugguggug

SEQ ID NO: 711929 - RNA, 22 nt, Human
uaaagugcuuccuaacccagag

SEQ ID NO: 711930 - RNA, 22 nt, Human
uuucucggcagagaugaugggc

SEQ ID NO: 711931 - RNA, 22 nt, Human
aacucagcauccugcacagaga

SEQ ID NO: 711932 - RNA, 20 nt, Human
aggaggggauagaaucaaag

SEQ ID NO: 711933 - RNA, 22 nt, Human
gaauguuuuucauuggugacuc

SEQ ID NO: 711934 - RNA, 22 nt, Human
ggccucugggguccugagccca

SEQ ID NO: 711935 - RNA, 22 nt, Human
gugggccaggccggagugcaga

SEQ ID NO: 711936 - RNA, 21 nt, Human
agcauucuuggccaguccacc

SEQ ID NO: 711937 - RNA, 22 nt, Human
gcugugugaaaacugggccugg

SEQ ID NO: 711938 - RNA, 22 nt, Human
ugaagcagcaaaugaugggaga

SEQ ID NO: 711939 - RNA, 19 nt, Human
gcagcugugggaagagcca

SEQ ID NO: 711940 - RNA, 19 nt, Human
gcuuuucuccuucaagcca

SEQ ID NO: 711941 - RNA, 22 nt, Human
uggccacacccaccuagaggag

SEQ ID NO: 711942 - RNA, 22 nt, Human
uucaagaugccagggacgcggc

SEQ ID NO: 711943 - RNA, 22 nt, Human
cauugaaacagauguacccaug

SEQ ID NO: 711944 - RNA, 22 nt, Human
cacuuaaaucuguugagaaaaa

SEQ ID NO: 711945 - RNA, 22 nt, Human
agcuccuguggcagcucuucug

SEQ ID NO: 711946 - RNA, 22 nt, Human
uaguguggccccaagaggaucu

SEQ ID NO: 711947 - RNA, 22 nt, Human
uuguuuccagcaaauaguccau

SEQ ID NO: 711948 - RNA, 22 nt, Human
agagagggcauagaaaaaggga

SEQ ID NO: 711949 - RNA, 22 nt, Human
ugagucucccaaguaguuggaa

SEQ ID NO: 711950 - RNA, 22 nt, Human
cagaggaagcuggguguggagu

SEQ ID NO: 711951 - RNA, 21 nt, Human
uucuccaggcaaccauuucag

SEQ ID NO: 711952 - RNA, 22 nt, Human
acugugcagguagaugccuggg

SEQ ID NO: 711953 - RNA, 22 nt, Human
uacauaguuccauuuacaggaa

SEQ ID NO: 711954 - RNA, 22 nt, Human
aggaauauuacuuugcuuuuau

SEQ ID NO: 711955 - RNA, 22 nt, Human
gcagcgaggugaugaaauagcu

SEQ ID NO: 711956 - RNA, 22 nt, Human
gagauuuucagcuugacuggga

SEQ ID NO: 711957 - RNA, 22 nt, Human
ucagccaguugccccaguuagu

SEQ ID NO: 711958 - RNA, 22 nt, Human
ggaacugaaugucucgguauaa

SEQ ID NO: 711959 - RNA, 22 nt, Human
uuggaaaauguauuucuagaag

SEQ ID NO: 711960 - RNA, 22 nt, Human
cauuuacagcagacugaugaaa

SEQ ID NO: 711961 - RNA, 22 nt, Human
gagccaggcaccuucuguguug

SEQ ID NO: 711962 - RNA, 23 nt, Human
ggcucccuccuagcuuucccaau

SEQ ID NO: 711963 - RNA, 22 nt, Human
gcagcugcaggcaggcuugcug

SEQ ID NO: 711964 - RNA, 22 nt, Human
aaagccacguggccuggggagc

SEQ ID NO: 711965 - RNA, 21 nt, Human
ucugaugguagaugagaugug

SEQ ID NO: 711966 - RNA, 22 nt, Human
ucuuuuauagugaauuuucuug

SEQ ID NO: 711967 - RNA, 22 nt, Human
uacagucuuuggaaagagauag

SEQ ID NO: 711968 - RNA, 22 nt, Human
ugcacacauguuuacaagcauc

SEQ ID NO: 711969 - RNA, 22 nt, Human
aucuuugcccagagacucagcc

SEQ ID NO: 711970 - RNA, 22 nt, Human
cuguacaaaagaaaguuccuau

SEQ ID NO: 711971 - RNA, 22 nt, Human
uucuggggcuaauacagagguc

SEQ ID NO: 711972 - RNA, 22 nt, Human
uaguuuaguaagaggagagcug

SEQ ID NO: 711973 - RNA, 22 nt, Human
agcagaaucuguccuuggaaga

SEQ ID NO: 711974 - RNA, 22 nt, Human
cccuuagcucaauuucuugccc

SEQ ID NO: 711975 - RNA, 22 nt, Human
uauucccauuccacuuaucaag

SEQ ID NO: 711976 - RNA, 22 nt, Human
agggauggagugcggcccggac

SEQ ID NO: 711977 - RNA, 22 nt, Human
gucugagggacagaguccuggc

SEQ ID NO: 711978 - RNA, 22 nt, Human
gagcccaggaaguggaggcuga

SEQ ID NO: 711979 - RNA, 22 nt, Human
ugaagaagccaauugguaggcu

SEQ ID NO: 711980 - RNA, 22 nt, Human
cagggugccuguccucagcaaa

SEQ ID NO: 711981 - RNA, 22 nt, Human
ccugugccauccugagcauccc

SEQ ID NO: 711982 - RNA, 22 nt, Human
aggcugccucgugagcucgcug

SEQ ID NO: 711983 - RNA, 20 nt, Human
uggagcugugguaaggagca

SEQ ID NO: 711984 - RNA, 22 nt, Human
uggaaagguaggauuucaagac

SEQ ID NO: 711985 - RNA, 22 nt, Human
cccuggcagagggggcaggugc

SEQ ID NO: 711986 - RNA, 22 nt, Human
ugccaagagguccaggugggaa

SEQ ID NO: 711987 - RNA, 22 nt, Human
cccacagggcugcugauggcag

SEQ ID NO: 711988 - RNA, 22 nt, Human
acguguucaauuuccaucugac

SEQ ID NO: 711989 - RNA, 22 nt, Human
ggaacauguagagggccuguag

SEQ ID NO: 711990 - RNA, 21 nt, Human
gguuacaacaguuaaacagag

SEQ ID NO: 711991 - RNA, 22 nt, Human
ugcaacaaggccucauuucuug

SEQ ID NO: 711992 - RNA, 22 nt, Human
cugucuggauauaccuuggcca

SEQ ID NO: 711993 - RNA, 22 nt, Human
ugcaggcucucugcugccagau

SEQ ID NO: 711994 - RNA, 22 nt, Human
aagggaggccagagguuuugca

SEQ ID NO: 711995 - RNA, 22 nt, Human
aauucugcuucaucagcucuuu

SEQ ID NO: 711996 - RNA, 22 nt, Human
cugcuuggcauugguaaagaau

SEQ ID NO: 711997 - RNA, 22 nt, Human
gaacuccagaugacucaggaac

SEQ ID NO: 711998 - RNA, 22 nt, Human
ucaggcccagagucacggaucc

SEQ ID NO: 711999 - RNA, 22 nt, Human
ccucaggcugcucacacuuguc

SEQ ID NO: 712000 - RNA, 22 nt, Human
cucccucccuacgugagcucac

SEQ ID NO: 712001 - RNA, 18 nt, Human
aagauucugcuucucucu

SEQ ID NO: 712002 - RNA, 22 nt, Human
ucugcucugagagggccaucag

SEQ ID NO: 712003 - RNA, 20 nt, Human
uccagggcccuggcuccucu

SEQ ID NO: 712004 - RNA, 22 nt, Human
agagccccugguggagugagaa

SEQ ID NO: 712005 - RNA, 22 nt, Human
uagauucuacagcucagcuguc

SEQ ID NO: 712006 - RNA, 21 nt, Human
aguccaggaggaggccagguu

SEQ ID NO: 712007 - RNA, 22 nt, Human
cacacauuucagaugcuacaau

SEQ ID NO: 712008 - RNA, 22 nt, Human
uguucuuacggaacuuaucuuu

SEQ ID NO: 712009 - RNA, 22 nt, Human
caaaugcaaaauauaacccugu

SEQ ID NO: 712010 - RNA, 22 nt, Human
ucuguggcugucuuuccagagg

SEQ ID NO: 712011 - RNA, 22 nt, Human
uauuauugacauuuacuuggug

SEQ ID NO: 712012 - RNA, 23 nt, Human
cugauuugagcagaauaaaauag

SEQ ID NO: 712013 - RNA, 22 nt, Human
ucugagcauugaauuuucuucc

SEQ ID NO: 712014 - RNA, 22 nt, Human
cagagccaggugguguuggggc

SEQ ID NO: 712015 - RNA, 22 nt, Human
uccucagcauuagcacagacau

SEQ ID NO: 712016 - RNA, 22 nt, Human
uuuugugacagaaagauuaagu

SEQ ID NO: 712017 - RNA, 22 nt, Human
uggcuuccaguaaucaggauuu

SEQ ID NO: 712018 - RNA, 22 nt, Human
ugagaaggaaacaauggcuuuu

SEQ ID NO: 712019 - RNA, 22 nt, Human
agaggccaggcagcccaaggug

SEQ ID NO: 712020 - RNA, 22 nt, Human
caguccugcuggccuucccugg

SEQ ID NO: 712021 - RNA, 22 nt, Human
ugccuguuauuguuggcuuagu

SEQ ID NO: 712022 - RNA, 22 nt, Human
uucaguuucguuaucuaugaga

SEQ ID NO: 712023 - RNA, 22 nt, Human
gccaggaggggagaguguguca

SEQ ID NO: 712024 - RNA, 22 nt, Human
cgucacuucuuagucuauuuuc

SEQ ID NO: 712025 - RNA, 22 nt, Human
cugucucaagacugcaggcacu

SEQ ID NO: 712026 - RNA, 22 nt, Human
cugaggcuuugugugcaugccu

SEQ ID NO: 712027 - RNA, 20 nt, Human
agaggcuuucuuguagucag

SEQ ID NO: 712028 - RNA, 22 nt, Human
cuauuacugacuucuguauuua

SEQ ID NO: 712029 - RNA, 22 nt, Human
ccagaugaggucaugcuggguu

SEQ ID NO: 712030 - RNA, 22 nt, Human
uuuacagcuagacauaccugag

SEQ ID NO: 712031 - RNA, 22 nt, Human
aaggccagaguacuagaggcug

SEQ ID NO: 712032 - RNA, 21 nt, Human
ucccagggccaggugccauca

SEQ ID NO: 712033 - RNA, 23 nt, Human
ucucagugcacgcaccaugccug

SEQ ID NO: 712034 - RNA, 22 nt, Human
agcuggcagucggccuugaugc

SEQ ID NO: 712035 - RNA, 22 nt, Human
ucuucagcucugaggcucuggc

SEQ ID NO: 712036 - RNA, 22 nt, Human
aaacugaaacaucaucauguug

SEQ ID NO: 712037 - RNA, 16 nt, Human
aggcgaagguucauuu

SEQ ID NO: 712038 - RNA, 22 nt, Human
aaugcauuaaaguuagagacuu

SEQ ID NO: 712039 - RNA, 22 nt, Human
uggucagugugacauuuuuuaa

SEQ ID NO: 712040 - RNA, 22 nt, Human
cacuggaaccaagacccagggc

SEQ ID NO: 712041 - RNA, 22 nt, Human
cucugcugagccagagucccca

SEQ ID NO: 712042 - RNA, 22 nt, Human
cucagcugcagccuggcuggca

SEQ ID NO: 712043 - RNA, 22 nt, Human
uuuguuaauucuuauguuagag

SEQ ID NO: 712044 - RNA, 22 nt, Human
ugggcaccuagcaacccuucuc

SEQ ID NO: 712045 - RNA, 21 nt, Human
uguucacauggagcagaaugu

SEQ ID NO: 712046 - RNA, 22 nt, Human
gagggagggaaaguuuaacacu

SEQ ID NO: 712047 - RNA, 22 nt, Human
augugcuugacuacucucuauu

SEQ ID NO: 712048 - RNA, 22 nt, Human
agcagcauggcugacuaaagac

SEQ ID NO: 712049 - RNA, 22 nt, Human
cuguguauugaaaaaggguuaa

SEQ ID NO: 712050 - RNA, 22 nt, Human
agucccagaugacccagcuacu

SEQ ID NO: 712051 - RNA, 22 nt, Human
caucuaccuccacccuauauau

SEQ ID NO: 712052 - RNA, 22 nt, Human
gacaaaacugagaucacacugu

SEQ ID NO: 712053 - RNA, 22 nt, Human
gggccuggcaugcagccccguu

SEQ ID NO: 712054 - RNA, 22 nt, Human
cagaaauuggaauagagaaaua

SEQ ID NO: 712055 - RNA, 18 nt, Human
cgugaguggaggcugcgg

SEQ ID NO: 712056 - RNA, 22 nt, Human
aaauggcaggcucuuugcuagu

SEQ ID NO: 712057 - RNA, 22 nt, Human
cagcuauuuaucuuucaugaua

SEQ ID NO: 712058 - RNA, 22 nt, Human
ucugucucaaguucuugcacuc

SEQ ID NO: 712059 - RNA, 22 nt, Human
cugucaccucugcccuuugccc

SEQ ID NO: 712060 - RNA, 22 nt, Human
aacagcuuugcuucuggagaca

SEQ ID NO: 712061 - RNA, 22 nt, Human
ugucuccauagaguagcuugau

SEQ ID NO: 712062 - RNA, 22 nt, Human
gagcaacacuccacauugcuag

SEQ ID NO: 712063 - RNA, 22 nt, Human
ugaauucuggcccucucacuua

SEQ ID NO: 712064 - RNA, 22 nt, Human
ucacagaacacaaaugccacuu

SEQ ID NO: 712065 - RNA, 22 nt, Human
ugcaaacaggagaguaaguaua

SEQ ID NO: 712066 - RNA, 22 nt, Human
acaguggaguugggguagcccu

SEQ ID NO: 712067 - RNA, 22 nt, Human
gucccuggaauggacucugcgc

SEQ ID NO: 712068 - RNA, 22 nt, Human
ucaggcugaaaggacuccaguu

SEQ ID NO: 712069 - RNA, 21 nt, Human
cagcaaggaagucgaguaggu

SEQ ID NO: 712070 - RNA, 22 nt, Human
auggccucuagcugagaccaau

SEQ ID NO: 712071 - RNA, 22 nt, Human
augcugugguagacagcauucc

SEQ ID NO: 712072 - RNA, 22 nt, Human
ggagaaggaauauuggaguagg

SEQ ID NO: 712073 - RNA, 23 nt, Human
cgugucugugggcgauccggccu

SEQ ID NO: 712074 - RNA, 22 nt, Human
ugagggaguguggauacaguag

SEQ ID NO: 712075 - RNA, 22 nt, Human
ggaggaggcaaguaccagaugc

SEQ ID NO: 712076 - RNA, 22 nt, Human
auuuaauuuacauuugacagag

SEQ ID NO: 712077 - RNA, 22 nt, Human
gugagagcucagcugcccuggg

SEQ ID NO: 712078 - RNA, 22 nt, Human
cuccugccaccgcgguguccug

SEQ ID NO: 712079 - RNA, 22 nt, Human
ugccucauaacacuccuggagu

SEQ ID NO: 712080 - RNA, 18 nt, Human
agggucagugucacuggc

SEQ ID NO: 712081 - RNA, 19 nt, Human
gacuacagggggaagaagu

SEQ ID NO: 712082 - RNA, 22 nt, Human
guacugaauaacaaagucuguc

SEQ ID NO: 712083 - RNA, 22 nt, Human
caggggcuguggcacauggugu

SEQ ID NO: 712084 - RNA, 22 nt, Human
cuguguagucagguggucccac

SEQ ID NO: 712085 - RNA, 22 nt, Human
aagauguugacuccuuugaugu

SEQ ID NO: 712086 - RNA, 22 nt, Human
ggagcagcuugcaugcucaggg

SEQ ID NO: 712087 - RNA, 22 nt, Human
acacacuuuugcuaaaaauugu

SEQ ID NO: 712088 - RNA, 22 nt, Human
uccugagauaggaguugaaggc

SEQ ID NO: 712089 - RNA, 22 nt, Human
uacaaugagcugagccagaggc

SEQ ID NO: 712090 - RNA, 22 nt, Human
cagucccagacccagaaggugg

SEQ ID NO: 712091 - RNA, 22 nt, Human
cugcaggagugaaagcaggccu

SEQ ID NO: 712092 - RNA, 22 nt, Human
auaucacagguguuuaccugau

SEQ ID NO: 712093 - RNA, 17 nt, Human
uuauuuuuugggcugag

SEQ ID NO: 712094 - RNA, 21 nt, Human
acagacaguccagagaaaaga

SEQ ID NO: 712095 - RNA, 22 nt, Human
gugaacauugaggcagaaagga

SEQ ID NO: 712096 - RNA, 22 nt, Human
cuacagcuggccuuggaaaacu

SEQ ID NO: 712097 - RNA, 22 nt, Human
uuaaaacugcaaauccuacuga

SEQ ID NO: 712098 - RNA, 22 nt, Human
cuuuucaugccagcccaucaca

SEQ ID NO: 712099 - RNA, 23 nt, Human
cuggccuccgacacuggccaaga

SEQ ID NO: 712100 - RNA, 21 nt, Human
aagaagcaauuuauuggaagg

SEQ ID NO: 712101 - RNA, 22 nt, Human
ccuggguccuggcagccuccug

SEQ ID NO: 712102 - RNA, 22 nt, Human
aucuuuacaguguaagugcaga

SEQ ID NO: 712103 - RNA, 22 nt, Human
gcucucugaggugcuggcagag

SEQ ID NO: 712104 - RNA, 22 nt, Human
cagggaggaugggcuguuuugc

SEQ ID NO: 712105 - RNA, 22 nt, Human
uucuuuguaaagccacaguccu

SEQ ID NO: 712106 - RNA, 22 nt, Human
uccucccuugggguuucguuau

SEQ ID NO: 712107 - RNA, 22 nt, Human
uagaagcacugacagaguuuga

SEQ ID NO: 712108 - RNA, 22 nt, Human
ggagaggaaaugccagcacuuc

SEQ ID NO: 712109 - RNA, 22 nt, Human
ucucuuuagugcuuagacgucu

SEQ ID NO: 712110 - RNA, 22 nt, Human
gagggguccaggaggcacuuac

SEQ ID NO: 712111 - RNA, 22 nt, Human
ugagcuccuggucacaauuauc

SEQ ID NO: 712112 - RNA, 22 nt, Human
acacacugaauuuuguggaaac

SEQ ID NO: 712113 - RNA, 22 nt, Human
uucacacagaaucugaggagcu

SEQ ID NO: 712114 - RNA, 22 nt, Human
ggcaccagggaaggaaggcugg

SEQ ID NO: 712115 - RNA, 22 nt, Human
aggcugccuagguucaacaccu

SEQ ID NO: 712116 - RNA, 22 nt, Human
uacaguuucuguccuuguggag

SEQ ID NO: 712117 - RNA, 22 nt, Human
ugcagggagggcccagcaaucu

SEQ ID NO: 712118 - RNA, 22 nt, Human
cuccacucaggugcuuaaguug

SEQ ID NO: 712119 - RNA, 18 nt, Human
auugcuuuuguaccaacc

SEQ ID NO: 712120 - RNA, 22 nt, Human
cucccaggccaugcucuagcca

SEQ ID NO: 712121 - RNA, 22 nt, Human
cauuaaauuccuuguucucaaa

SEQ ID NO: 712122 - RNA, 22 nt, Human
cacuugaaugaaagagacuccu

SEQ ID NO: 712123 - RNA, 22 nt, Human
uuuguuaaggaguauugcuucu

SEQ ID NO: 712124 - RNA, 22 nt, Human
gccaggagagcuccuucagguu

SEQ ID NO: 712125 - RNA, 22 nt, Human
acacugucucauaugaggggac

SEQ ID NO: 712126 - RNA, 22 nt, Human
ugcuccuuucauccaauucuca

SEQ ID NO: 712127 - RNA, 22 nt, Human
cuugcacagaacucuuagaggu

SEQ ID NO: 712128 - RNA, 18 nt, Human
agaaggagcuaugggcag

SEQ ID NO: 712129 - RNA, 22 nt, Human
caugaaauguguuaaucucuug

SEQ ID NO: 712130 - RNA, 22 nt, Human
uucuaacuaaagucuuuguuuu

SEQ ID NO: 712131 - RNA, 22 nt, Human
uauaccaaaauaucagaaaggg

SEQ ID NO: 712132 - RNA, 23 nt, Human
gcccaugcuguugggcccgagca

SEQ ID NO: 712133 - RNA, 22 nt, Human
gaggaguggaguugcuggguug

SEQ ID NO: 712134 - RNA, 22 nt, Human
acuuucaagaacuucuuuaaug

SEQ ID NO: 712135 - RNA, 22 nt, Human
uaagaagcaguucacaaguaaa

SEQ ID NO: 712136 - RNA, 22 nt, Human
ucucagggagggcgagucagcg

SEQ ID NO: 712137 - RNA, 22 nt, Human
aggauagaagccccauguucuu

SEQ ID NO: 712138 - RNA, 22 nt, Human
uuauuuccuaaaucucuuuguu

SEQ ID NO: 712139 - RNA, 22 nt, Human
cuggcuuucuauuuggugcuau

SEQ ID NO: 712140 - RNA, 18 nt, Human
uuccuucugauguauaug

SEQ ID NO: 712141 - RNA, 22 nt, Human
gagcugagccuggguggaccgc

SEQ ID NO: 712142 - RNA, 23 nt, Human
acugggaaguuuggagagacgca

SEQ ID NO: 712143 - RNA, 21 nt, Human
cugccaccugcuccaucagca

SEQ ID NO: 712144 - RNA, 22 nt, Human
uucucugagauagacuaagugg

SEQ ID NO: 712145 - RNA, 22 nt, Human
uagguucaugaaauuuucagga

SEQ ID NO: 712146 - RNA, 22 nt, Human
ucugggccagugauuuuuccag

SEQ ID NO: 712147 - RNA, 22 nt, Human
uaugagaaagucguaugucucc

SEQ ID NO: 712148 - RNA, 20 nt, Human
gcugaggauuccuggccccu

SEQ ID NO: 712149 - RNA, 22 nt, Human
cuuucucuugagcaagagcugu

SEQ ID NO: 712150 - RNA, 22 nt, Human
ucuccaaaucaaucaauaugaa

SEQ ID NO: 712151 - RNA, 20 nt, Human
uugaggcaugucuagaagua

SEQ ID NO: 712152 - RNA, 22 nt, Human
ccugggugucaugggcagcugg

SEQ ID NO: 712153 - RNA, 22 nt, Human
gccuccuguuaugccaugugcc

SEQ ID NO: 712154 - RNA, 22 nt, Human
uuuucugaccuaucuacauuua

SEQ ID NO: 712155 - RNA, 22 nt, Human
gcuuugugaauuauuacucaca

SEQ ID NO: 712156 - RNA, 22 nt, Human
uugcucagcacuggagccagcu

SEQ ID NO: 712157 - RNA, 22 nt, Human
gcuuccuugggaaaauuagaug

SEQ ID NO: 712158 - RNA, 22 nt, Human
gcugaaaugucuuuagcagugu

SEQ ID NO: 712159 - RNA, 22 nt, Human
cuggaaaguacagugugucaca

SEQ ID NO: 712160 - RNA, 20 nt, Human
ugaugcuggucugaauugca

SEQ ID NO: 712161 - RNA, 22 nt, Human
aagacaagcaucaaaucaggca

SEQ ID NO: 712162 - RNA, 22 nt, Human
cacagcagggaugaauggagug

SEQ ID NO: 712163 - RNA, 22 nt, Human
ggcaaggggucaggcugagaca

SEQ ID NO: 712164 - RNA, 22 nt, Human
ugucucugcuuuccuugcaggg

SEQ ID NO: 712165 - RNA, 22 nt, Human
caaauacuaaacauaagauuuu

SEQ ID NO: 712166 - RNA, 22 nt, Human
aaaguuuggauccagcaaaaga

SEQ ID NO: 712167 - RNA, 22 nt, Human
acugaaaaaguaugauucacug

SEQ ID NO: 712168 - RNA, 22 nt, Human
ucuuccuugccuugcuucauca

SEQ ID NO: 712169 - RNA, 22 nt, Human
ugcauuccacacccauagagau

SEQ ID NO: 712170 - RNA, 22 nt, Human
agugcccggggugccagacaca

SEQ ID NO: 712171 - RNA, 22 nt, Human
uguucuagcaacacaguuuugg

SEQ ID NO: 712172 - RNA, 22 nt, Human
gagguuuuaaguugaaggggga

SEQ ID NO: 712173 - RNA, 21 nt, Human
uuggcagucagaaaugugagg

SEQ ID NO: 712174 - RNA, 22 nt, Human
agugcagggggaaagggugucu

SEQ ID NO: 712175 - RNA, 22 nt, Human
cagcagaguaauucucaccucu

SEQ ID NO: 712176 - RNA, 22 nt, Human
accaugucauuuauuggccaaa

SEQ ID NO: 712177 - RNA, 22 nt, Human
guguaugcagaaacaugcaaag

SEQ ID NO: 712178 - RNA, 17 nt, Human
aggaaagucugcugucc

SEQ ID NO: 712179 - RNA, 22 nt, Human
cucuuuagucacagggcuucau

SEQ ID NO: 712180 - RNA, 22 nt, Human
gugggcuucccuuaagccagag

SEQ ID NO: 712181 - RNA, 22 nt, Human
uguucuaaauugcuagcuggaa

SEQ ID NO: 712182 - RNA, 22 nt, Human
ggaugggagcagaggacgacca

SEQ ID NO: 712183 - RNA, 21 nt, Human
ucagagaauggccuacucuca

SEQ ID NO: 712184 - RNA, 22 nt, Human
uccaggucccagacugggcagc

SEQ ID NO: 712185 - RNA, 22 nt, Human
cagcaacucuccugugcucaaa

SEQ ID NO: 712186 - RNA, 22 nt, Human
acccugggaccuggagguggau

SEQ ID NO: 712187 - RNA, 22 nt, Human
cauggcuuggagcaggaugaga

SEQ ID NO: 712188 - RNA, 22 nt, Human
uuucuucauagaccuugucuug

SEQ ID NO: 712189 - RNA, 19 nt, Human
aggcucugagcuccuggag

SEQ ID NO: 712190 - RNA, 22 nt, Human
ugcauuuuacuuaccuguuagu

SEQ ID NO: 712191 - RNA, 22 nt, Human
aaguucaaggaagccuccaguu

SEQ ID NO: 712192 - RNA, 22 nt, Human
gccgaacuugagggccaggcgg

SEQ ID NO: 712193 - RNA, 22 nt, Human
uuucugagaaauuaaacacuuu

SEQ ID NO: 712194 - RNA, 22 nt, Human
auucugggugacuacgugauca

SEQ ID NO: 712195 - RNA, 22 nt, Human
ccauuaaacuuguggacccagu

SEQ ID NO: 712196 - RNA, 19 nt, Human
ggcugcugaagagaauuac

SEQ ID NO: 712197 - RNA, 22 nt, Human
ucacuucugaagguaguuggca

SEQ ID NO: 712198 - RNA, 22 nt, Human
uucagagccacuucaagucuaa

SEQ ID NO: 712199 - RNA, 22 nt, Human
uucuuaacuggaaaaugucaga

SEQ ID NO: 712200 - RNA, 22 nt, Human
uuuccacacugcagccagcaaa

SEQ ID NO: 712201 - RNA, 22 nt, Human
ucagccagcucuuggacucuga

SEQ ID NO: 712202 - RNA, 22 nt, Human
ccagaggucucucuauacuggg

SEQ ID NO: 712203 - RNA, 22 nt, Human
gccuggaggguugagguuuugu

SEQ ID NO: 712204 - RNA, 22 nt, Human
ucuggagcuugaagcuuugguu

SEQ ID NO: 712205 - RNA, 19 nt, Human
agacaaugggguuggcagu

SEQ ID NO: 712206 - RNA, 22 nt, Human
cguuuaaccagcacgcuuggcc

SEQ ID NO: 712207 - RNA, 22 nt, Human
auauuugugguaaagguaagaa

SEQ ID NO: 712208 - RNA, 22 nt, Human
uauggaugaguuccugaggagu

SEQ ID NO: 712209 - RNA, 22 nt, Human
gcuggcucugaugggcuccagg

SEQ ID NO: 712210 - RNA, 21 nt, Human
auucagaguaauucaucuuua

SEQ ID NO: 712211 - RNA, 22 nt, Human
agcaggcuccuuccuucucugg

SEQ ID NO: 712212 - RNA, 22 nt, Human
ucagagaguuuucacuagggug

SEQ ID NO: 712213 - RNA, 22 nt, Human
gagagggguuugccauccuaug

SEQ ID NO: 712214 - RNA, 22 nt, Human
gagcacugauuuauuuuugucu

SEQ ID NO: 712215 - RNA, 22 nt, Human
ucacaagacugagcuugcuuga

SEQ ID NO: 712216 - RNA, 22 nt, Human
cauauuguaaaagguugaaucc

SEQ ID NO: 712217 - RNA, 22 nt, Human
caggaacacaaugagucucaaa

SEQ ID NO: 712218 - RNA, 22 nt, Human
ucagcaguggguccugagggug

SEQ ID NO: 712219 - RNA, 22 nt, Human
aacuucagagcugugugguuug

SEQ ID NO: 712220 - RNA, 22 nt, Human
ggagcuggcuacagagaacucc

SEQ ID NO: 712221 - RNA, 22 nt, Human
uccugggcuuuguuucucuccu

SEQ ID NO: 712222 - RNA, 22 nt, Human
auggcuucucgcuggcaccugu

SEQ ID NO: 712223 - RNA, 22 nt, Human
uaagaguuacugguuuagaacc

SEQ ID NO: 712224 - RNA, 22 nt, Human
aggagccugaaucagaggguga

SEQ ID NO: 712225 - RNA, 22 nt, Human
uucauauugcuuccguggagug

SEQ ID NO: 712226 - RNA, 22 nt, Human
gugaccagagcgggagauuggg

SEQ ID NO: 712227 - RNA, 22 nt, Human
gugcugaggugggugggcagcc

SEQ ID NO: 712228 - RNA, 22 nt, Human
agacaaauuuccugcaaugaag

SEQ ID NO: 712229 - RNA, 22 nt, Human
accagccccaccgggacugcag

SEQ ID NO: 712230 - RNA, 22 nt, Human
ggaggaguguggggcacucugc

SEQ ID NO: 712231 - RNA, 22 nt, Human
cccucucucaggcugacagccu

SEQ ID NO: 712232 - RNA, 22 nt, Human
aguaaaugaaagcaauuuuaga

SEQ ID NO: 712233 - RNA, 22 nt, Human
aauugcaauuuucuuaaggucu

SEQ ID NO: 712234 - RNA, 22 nt, Human
auguaacacccacuuuuauagc

SEQ ID NO: 712235 - RNA, 22 nt, Human
cucugagaugcuugaagaggau

SEQ ID NO: 712236 - RNA, 22 nt, Human
uggcacugggaugcuacuguua

SEQ ID NO: 712237 - RNA, 22 nt, Human
uacugugugacccuggguaggu

SEQ ID NO: 712238 - RNA, 20 nt, Human
acaaggaaccaggagguggc

SEQ ID NO: 712239 - RNA, 23 nt, Human
aagaguuuagagucuugcagagu

SEQ ID NO: 712240 - RNA, 18 nt, Human
auuucuacuacuauaaag

SEQ ID NO: 712241 - RNA, 22 nt, Human
uuuuuaguagagguggguuuca

SEQ ID NO: 712242 - RNA, 22 nt, Human
uuccccugucacagugguucuc

SEQ ID NO: 712243 - RNA, 22 nt, Human
auaauugaugaggcuuuggaca

SEQ ID NO: 712244 - RNA, 21 nt, Human
caucuuagguuguacauauau

SEQ ID NO: 712245 - RNA, 22 nt, Human
uugaaugaauucuacuuccaga

SEQ ID NO: 712246 - RNA, 22 nt, Human
uagucuaagaaaucuuuacuuu

SEQ ID NO: 712247 - RNA, 22 nt, Human
cucagcuaguaacguacauguc

SEQ ID NO: 712248 - RNA, 22 nt, Human
gcuuccaguccucagaggcugg

SEQ ID NO: 712249 - RNA, 22 nt, Human
aagcagaaaaacugagcuccaa

SEQ ID NO: 712250 - RNA, 22 nt, Human
acuggggauuagggacucagug

SEQ ID NO: 712251 - RNA, 23 nt, Human
ucucaguuccagaggcuacaagu

SEQ ID NO: 712252 - RNA, 22 nt, Human
uccacacuugcugucugcugag

SEQ ID NO: 712253 - RNA, 22 nt, Human
ggcaguagccagggacuggcag

SEQ ID NO: 712254 - RNA, 20 nt, Human
ggcucugcuugugagcagcc

SEQ ID NO: 712255 - RNA, 22 nt, Human
ggcugggagcuggacaggccgg

SEQ ID NO: 712256 - RNA, 22 nt, Human
cagacaaagcggaaacuguuua

SEQ ID NO: 712257 - RNA, 23 nt, Human
gaagucagcccuacagagagcag

SEQ ID NO: 712258 - RNA, 22 nt, Human
aaguacuucuagauggauaauc

SEQ ID NO: 712259 - RNA, 22 nt, Human
ggguccagguuuagucauuugu

SEQ ID NO: 712260 - RNA, 20 nt, Human
aggcugaguucuaugcacuu

SEQ ID NO: 712261 - RNA, 22 nt, Human
aacagcuguucgcagauguagg

SEQ ID NO: 712262 - RNA, 22 nt, Human
caggacacuacagaugggaggg

SEQ ID NO: 712263 - RNA, 22 nt, Human
uauguacauacaugugcauacg

SEQ ID NO: 712264 - RNA, 22 nt, Human
uucagcuugcuuagucuccuuc

SEQ ID NO: 712265 - RNA, 22 nt, Human
ggcagagucagaggugguucug

SEQ ID NO: 712266 - RNA, 22 nt, Human
ucaggaacccuggucuccugcu

SEQ ID NO: 712267 - RNA, 22 nt, Human
gcuggcuuccuucugcagcuag

SEQ ID NO: 712268 - RNA, 19 nt, Human
aguuaaugagcuuuugauc

SEQ ID NO: 712269 - RNA, 22 nt, Human
uaacacugugucugccauaucc

SEQ ID NO: 712270 - RNA, 22 nt, Human
uccuggagggaggcggugcuac

SEQ ID NO: 712271 - RNA, 22 nt, Human
uuuguagauagaaaaaugauua

SEQ ID NO: 712272 - RNA, 22 nt, Human
gagcuucccucugcagucccug

SEQ ID NO: 712273 - RNA, 22 nt, Human
ucauugcagaaauaaaggugaa

SEQ ID NO: 712274 - RNA, 22 nt, Human
ugccuuuuccaguuucuagggg

SEQ ID NO: 712275 - RNA, 22 nt, Human
uuagaaaggagcuuauuucuuu

SEQ ID NO: 712276 - RNA, 22 nt, Human
uuaaugcuugucuagaucuucu

SEQ ID NO: 712277 - RNA, 20 nt, Human
aucaucucaaagcugagguu

SEQ ID NO: 712278 - RNA, 20 nt, Human
agggucugcuggguaggaca

SEQ ID NO: 712279 - RNA, 22 nt, Human
caugcuucaugcaaaauucuga

SEQ ID NO: 712280 - RNA, 22 nt, Human
uuaauuaagagauacugcagua

SEQ ID NO: 712281 - RNA, 22 nt, Human
ucccucucuggcuggggugcgg

SEQ ID NO: 712282 - RNA, 22 nt, Human
gucacuguauccagguuccagc

SEQ ID NO: 712283 - RNA, 22 nt, Human
uccuggguccauggcagccgaa

SEQ ID NO: 712284 - RNA, 22 nt, Human
caguaauagauuugagaguggu

SEQ ID NO: 712285 - RNA, 22 nt, Human
accuugaugccuuuccaagaug

SEQ ID NO: 712286 - RNA, 19 nt, Human
ggccagccaccucgccugg

SEQ ID NO: 712287 - RNA, 23 nt, Human
ucaugcccaggcuccagauguca

SEQ ID NO: 712288 - RNA, 22 nt, Human
caugcacacacgugcauguacg

SEQ ID NO: 712289 - RNA, 22 nt, Human
uuuccucugcugccauugcccc

SEQ ID NO: 712290 - RNA, 22 nt, Human
ucuacacauuuguaaaggcauu

SEQ ID NO: 712291 - RNA, 22 nt, Human
uagcuuuaaugaguugguaaga

SEQ ID NO: 712292 - RNA, 22 nt, Human
uugcuuuaucucuuaugccuca

SEQ ID NO: 712293 - RNA, 22 nt, Human
auucagacuaugaacacgucag

SEQ ID NO: 712294 - RNA, 22 nt, Human
ggcacagcugaugcagacacac

SEQ ID NO: 712295 - RNA, 23 nt, Human
cagaugugcaacucuaggcaaug

SEQ ID NO: 712296 - RNA, 22 nt, Human
ggugagaggcagugcuguggaa

SEQ ID NO: 712297 - RNA, 22 nt, Human
acugggaaucucaggaacaugg

SEQ ID NO: 712298 - RNA, 22 nt, Human
guuuccuauggcugcugcagga

SEQ ID NO: 712299 - RNA, 22 nt, Human
gaaguauuacucugaauguauu

SEQ ID NO: 712300 - RNA, 22 nt, Human
uaggccuaguuacugcuuacuu

SEQ ID NO: 712301 - RNA, 22 nt, Human
agcagagaggagguggcccugu

SEQ ID NO: 712302 - RNA, 22 nt, Human
ugugugggugguaaggaaggcc

SEQ ID NO: 712303 - RNA, 17 nt, Human
ccuuucucuuucaucuc

SEQ ID NO: 712304 - RNA, 20 nt, Human
aaguuucaugcucuggggau

SEQ ID NO: 712305 - RNA, 22 nt, Human
acaggccauaaaggcaggcccu

SEQ ID NO: 712306 - RNA, 22 nt, Human
gcugcuggaacaaaucacccca

SEQ ID NO: 712307 - RNA, 22 nt, Human
gugugguggcccuccuucaggc

SEQ ID NO: 712308 - RNA, 22 nt, Human
gaauaauagcagaaauuagcag

SEQ ID NO: 712309 - RNA, 22 nt, Human
cacaaggacuggauggaguggg

SEQ ID NO: 712310 - RNA, 22 nt, Human
uucucugccucuagcuauauuc

SEQ ID NO: 712311 - RNA, 22 nt, Human
cagcuggcccuuugguagccuu

SEQ ID NO: 712312 - RNA, 21 nt, Human
uuacacacugcuucuagaaug

SEQ ID NO: 712313 - RNA, 22 nt, Human
cugcccagaagccagaugggca

SEQ ID NO: 712314 - RNA, 22 nt, Human
uaaauugagauuauuaggguaa

SEQ ID NO: 712315 - RNA, 22 nt, Human
agagccugggaauuugcauguu

SEQ ID NO: 712316 - RNA, 22 nt, Human
agcuggcccucgagagccaauu

SEQ ID NO: 712317 - RNA, 22 nt, Human
agcaggugaucgcgugugcucc

SEQ ID NO: 712318 - RNA, 17 nt, Human
gggcuuuagguggugua

SEQ ID NO: 712319 - RNA, 22 nt, Human
cugcuccuccccaucaggcagc

SEQ ID NO: 712320 - RNA, 19 nt, Human
caugagcugcucacuuccc

SEQ ID NO: 712321 - RNA, 22 nt, Human
aagcaucuuaaaaaguaucaga

SEQ ID NO: 712322 - RNA, 22 nt, Human
cauugcugcuuccaggcacagg

SEQ ID NO: 712323 - RNA, 22 nt, Human
uugcaacauuguaaguuuauau

SEQ ID NO: 712324 - RNA, 22 nt, Human
auaaaugugaauuagagcuuug

SEQ ID NO: 712325 - RNA, 22 nt, Human
acuuucuauucccacagagaua

SEQ ID NO: 712326 - RNA, 17 nt, Human
acaggcagaucaccuga

SEQ ID NO: 712327 - RNA, 22 nt, Human
gagcaaggaggguggggccuuu

SEQ ID NO: 712328 - RNA, 22 nt, Human
ccagagaaagugaagcaaaugu

SEQ ID NO: 712329 - RNA, 22 nt, Human
auuuguucagcauugaauuugg

SEQ ID NO: 712330 - RNA, 17 nt, Human
cuuugcagcagacaugu

SEQ ID NO: 712331 - RNA, 22 nt, Human
ccuggacacccauuccuuggcu

SEQ ID NO: 712332 - RNA, 18 nt, Human
acagggaugggguaagug

SEQ ID NO: 712333 - RNA, 22 nt, Human
aggcagcagccacaaggccuga

SEQ ID NO: 712334 - RNA, 22 nt, Human
aucacauuguuagcauagacug

SEQ ID NO: 712335 - RNA, 22 nt, Human
gccccucccagucaggagcacu

SEQ ID NO: 712336 - RNA, 21 nt, Human
gggagggauggaaaugauguu

SEQ ID NO: 712337 - RNA, 22 nt, Human
uggcaggguuggccaccuuacc

SEQ ID NO: 712338 - RNA, 22 nt, Human
ugaacagauggcccagcagagg

SEQ ID NO: 712339 - RNA, 22 nt, Human
ucucuaguugaggacugagcag

SEQ ID NO: 712340 - RNA, 22 nt, Human
uuugaaacucugaacauguuuc

SEQ ID NO: 712341 - RNA, 23 nt, Human
ucugcuucuguauuuuuucccau

SEQ ID NO: 712342 - RNA, 19 nt, Human
ggcuccuguggcugcagcc

SEQ ID NO: 712343 - RNA, 23 nt, Human
aggagccaggaaccagcuucccc

SEQ ID NO: 712344 - RNA, 22 nt, Human
uagaaagugguugagaguuuag

SEQ ID NO: 712345 - RNA, 22 nt, Human
aaugugguuaacccauuuaaga

SEQ ID NO: 712346 - RNA, 22 nt, Human
ucaccucuuuuuuaacaggcuu

SEQ ID NO: 712347 - RNA, 22 nt, Human
caguuuuuagauuaguuggugg

SEQ ID NO: 712348 - RNA, 22 nt, Human
cugcucuguuucuuagcugggu

SEQ ID NO: 712349 - RNA, 22 nt, Human
ugggaggacuugugggcuucau

SEQ ID NO: 712350 - RNA, 19 nt, Human
agcagggagugguuguggg

SEQ ID NO: 712351 - RNA, 22 nt, Human
uucuauaagacucauauuucuu

SEQ ID NO: 712352 - RNA, 19 nt, Human
uggaacaaacugcaaugac

SEQ ID NO: 712353 - RNA, 22 nt, Human
gugcauauaugugcagcaucaa

SEQ ID NO: 712354 - RNA, 22 nt, Human
cugcagggauugcuucuguaua

SEQ ID NO: 712355 - RNA, 22 nt, Human
uucucagaggagucgggagcug

SEQ ID NO: 712356 - RNA, 22 nt, Human
agagccugcaucaggcuugggg

SEQ ID NO: 712357 - RNA, 22 nt, Human
ucagaacaguucuuaauauugc

SEQ ID NO: 712358 - RNA, 21 nt, Human
cucuccagugguuccugauuc

SEQ ID NO: 712359 - RNA, 22 nt, Human
cccugcugcauggccuccacga

SEQ ID NO: 712360 - RNA, 22 nt, Human
ucuaacuuagggaauacuuuag

SEQ ID NO: 712361 - RNA, 22 nt, Human
uaacugugaaguaauuguggau

SEQ ID NO: 712362 - RNA, 22 nt, Human
uggcauccucucuucugagugc

SEQ ID NO: 712363 - RNA, 22 nt, Human
uuaccauagaaacuuccuuuuu

SEQ ID NO: 712364 - RNA, 22 nt, Human
ucccacagugguacagcccuga

SEQ ID NO: 712365 - RNA, 22 nt, Human
uaaaacuuaacuauccagauua

SEQ ID NO: 712366 - RNA, 22 nt, Human
uccagagcuaauucagcagcug

SEQ ID NO: 712367 - RNA, 22 nt, Human
ucuguuauacaacaaguaacag

SEQ ID NO: 712368 - RNA, 22 nt, Human
agcugaaauuuuacugaguaua

SEQ ID NO: 712369 - RNA, 22 nt, Human
ugcuguguuacugagauccggc

SEQ ID NO: 712370 - RNA, 22 nt, Human
acaggcucaguucacuggauuu

SEQ ID NO: 712371 - RNA, 22 nt, Human
cuauuauuagauaaucuacuug

SEQ ID NO: 712372 - RNA, 22 nt, Human
ggaauugguuucaagggaaagu

SEQ ID NO: 712373 - RNA, 22 nt, Human
uggcagaugugguuugagacag

SEQ ID NO: 712374 - RNA, 22 nt, Human
gaguaauucugguaaaucauug

SEQ ID NO: 712375 - RNA, 22 nt, Human
uuuuggaugagcccagauuucu

SEQ ID NO: 712376 - RNA, 22 nt, Human
cacugcagcaccaugcagggcu

SEQ ID NO: 712377 - RNA, 22 nt, Human
uauuacacagugaaagcaugga

SEQ ID NO: 712378 - RNA, 22 nt, Human
uaaagcuagccaaccacugucu

SEQ ID NO: 712379 - RNA, 22 nt, Human
uguguucaguaugacauucaca

SEQ ID NO: 712380 - RNA, 23 nt, Human
uucuaagguaugguuuauaccug

SEQ ID NO: 712381 - RNA, 22 nt, Human
ugcugcacucaccaacagauaa

SEQ ID NO: 712382 - RNA, 22 nt, Human
uggcuaguaggugaguagugcu

SEQ ID NO: 712383 - RNA, 22 nt, Human
ggcugcugaaguguggcaaucu

SEQ ID NO: 712384 - RNA, 22 nt, Human
agcucucuuccagauccacuug

SEQ ID NO: 712385 - RNA, 22 nt, Human
ggggagaguccuuuccaguucc

SEQ ID NO: 712386 - RNA, 22 nt, Human
gagacagccuacuccagucuca

SEQ ID NO: 712387 - RNA, 22 nt, Human
gcaaauaauauacuuugaucuc

SEQ ID NO: 712388 - RNA, 22 nt, Human
gugauuaaugccaaugggccuu

SEQ ID NO: 712389 - RNA, 22 nt, Human
gaggccacaguccugaggcauc

SEQ ID NO: 712390 - RNA, 20 nt, Human
cccuggagagaagcuccacg

SEQ ID NO: 712391 - RNA, 22 nt, Human
gaagaaacugaaagggguuggu

SEQ ID NO: 712392 - RNA, 22 nt, Human
uucucuccuacccaguauccau

SEQ ID NO: 712393 - RNA, 20 nt, Human
uggaccacccuccucuuugc

SEQ ID NO: 712394 - RNA, 22 nt, Human
agaugacagccaaggagaugaa

SEQ ID NO: 712395 - RNA, 22 nt, Human
ucuguucaugaaauaucuuuuu

SEQ ID NO: 712396 - RNA, 22 nt, Human
ucugcagagggagugcuggguc

SEQ ID NO: 712397 - RNA, 22 nt, Human
gauuucuugauaaguaguguga

SEQ ID NO: 712398 - RNA, 22 nt, Human
auucaguguuugcagcaacuuu

SEQ ID NO: 712399 - RNA, 22 nt, Human
aaauugucaguuaucugggaua

SEQ ID NO: 712400 - RNA, 22 nt, Human
aaugccuucccauuuauacuuu

SEQ ID NO: 712401 - RNA, 22 nt, Human
acuucaugcuuuagagagauga

SEQ ID NO: 712402 - RNA, 22 nt, Human
agaguuugggguaugauuguuu

SEQ ID NO: 712403 - RNA, 22 nt, Human
auucaaacaggaagaaaucauu

SEQ ID NO: 712404 - RNA, 22 nt, Human
aggcuccuuauggcuuuggggu

SEQ ID NO: 712405 - RNA, 22 nt, Human
ggggagcuugguuauucaugca

SEQ ID NO: 712406 - RNA, 22 nt, Human
gcugaggcaguccacccuugug

SEQ ID NO: 712407 - RNA, 22 nt, Human
aacaucugugaacuccgaaaau

SEQ ID NO: 712408 - RNA, 22 nt, Human
guuauguauugggaaauccaag

SEQ ID NO: 712409 - RNA, 22 nt, Human
cccccaccugaggacagucuua

SEQ ID NO: 712410 - RNA, 22 nt, Human
ugucuuuugccaaagaucaguu

SEQ ID NO: 712411 - RNA, 19 nt, Human
ccugggagucagcugaagg

SEQ ID NO: 712412 - RNA, 22 nt, Human
gguuugcacgauauuuccaugg

SEQ ID NO: 712413 - RNA, 22 nt, Human
aagcccuggaacuuuccuagcc

SEQ ID NO: 712414 - RNA, 22 nt, Human
ugucuucuguauucaagucuau

SEQ ID NO: 712415 - RNA, 22 nt, Human
agggucugaccaccaguaggga

SEQ ID NO: 712416 - RNA, 22 nt, Human
agcacagagcucggggaaugga

SEQ ID NO: 712417 - RNA, 22 nt, Human
uuggaacuggauuucauguagc

SEQ ID NO: 712418 - RNA, 22 nt, Human
gcagcuggcccugacacgcaga

SEQ ID NO: 712419 - RNA, 22 nt, Human
guuuauaugugugccacucuua

SEQ ID NO: 712420 - RNA, 22 nt, Human
ccauugaaggcacuugagcaga

SEQ ID NO: 712421 - RNA, 22 nt, Human
caggccucuccuuagucuggca

SEQ ID NO: 712422 - RNA, 23 nt, Human
cuuguuauaagaagacugucugg

SEQ ID NO: 712423 - RNA, 22 nt, Human
acucaggagggaucagcuauca

SEQ ID NO: 712424 - RNA, 22 nt, Human
uuaaaggcgauaaggcaguguu

SEQ ID NO: 712425 - RNA, 23 nt, Human
ugaugggaaggaacgacuaccac

SEQ ID NO: 712426 - RNA, 22 nt, Human
agugcccugucacuggaacuga

SEQ ID NO: 712427 - RNA, 22 nt, Human
uuucucuggcauuagguauaaa

SEQ ID NO: 712428 - RNA, 22 nt, Human
uauuuacuguauuugaaguuga

SEQ ID NO: 712429 - RNA, 20 nt, Human
uggcaggacuggcuccaccc

SEQ ID NO: 712430 - RNA, 22 nt, Human
acccuggguauuucccaaacuu

SEQ ID NO: 712431 - RNA, 22 nt, Human
ugaaagaaggguggaaaaugua

SEQ ID NO: 712432 - RNA, 22 nt, Human
cagccugcauuuguaucuguau

SEQ ID NO: 712433 - RNA, 22 nt, Human
gacacuuuaggccaccaugcaa

SEQ ID NO: 712434 - RNA, 22 nt, Human
auuugucuuugagugcccugcu

SEQ ID NO: 712435 - RNA, 22 nt, Human
ugcaggugaaaauuaugaggau

SEQ ID NO: 712436 - RNA, 22 nt, Human
ugagcaaggagcagucuuucuu

SEQ ID NO: 712437 - RNA, 22 nt, Human
guuguaaauacaguacugaaac

SEQ ID NO: 712438 - RNA, 22 nt, Human
ccauccugucuguggccucagg

SEQ ID NO: 712439 - RNA, 22 nt, Human
uuagccauggacugaauugacu

SEQ ID NO: 712440 - RNA, 22 nt, Human
caacuuuaaauggcuaugucug

SEQ ID NO: 712441 - RNA, 22 nt, Human
aauuccucuaucuuucuucaag

SEQ ID NO: 712442 - RNA, 22 nt, Human
cucaaauagaacugaucuauaa

SEQ ID NO: 712443 - RNA, 22 nt, Human
uaaaggcuuuauuuuccaguca

SEQ ID NO: 712444 - RNA, 22 nt, Human
acuagaaaguuuccagaguuau

SEQ ID NO: 712445 - RNA, 22 nt, Human
accagcugccaagggcuacacu

SEQ ID NO: 712446 - RNA, 23 nt, Human
ugcuccagguacagaacuccagg

SEQ ID NO: 712447 - RNA, 22 nt, Human
gugugagcaucaaagccuguca

SEQ ID NO: 712448 - RNA, 22 nt, Human
cucugugucugaagcccuauuu

SEQ ID NO: 712449 - RNA, 22 nt, Human
agaaaucuaagaugcucaagga

SEQ ID NO: 712450 - RNA, 22 nt, Human
aauuucuugggagcucagagaa

SEQ ID NO: 712451 - RNA, 22 nt, Human
uuucuugaaguccuaacccuca

SEQ ID NO: 712452 - RNA, 22 nt, Human
cuccugggcuaugucugcuugg

SEQ ID NO: 712453 - RNA, 22 nt, Human
caguuuaaggcaggacauggga

SEQ ID NO: 712454 - RNA, 21 nt, Human
uucugcuguucaccaccaccc

SEQ ID NO: 712455 - RNA, 22 nt, Human
ggaggcucuuauuuguucaaca

SEQ ID NO: 712456 - RNA, 22 nt, Human
agauacaacucagaaguguggu

SEQ ID NO: 712457 - RNA, 22 nt, Human
aggugcagcaugaguccaacgg

SEQ ID NO: 712458 - RNA, 22 nt, Human
cauguaguccuaaugcugguga

SEQ ID NO: 712459 - RNA, 22 nt, Human
ugcugccugugccaggaggguc

SEQ ID NO: 712460 - RNA, 22 nt, Human
auuuauauuuugggagcuccug

SEQ ID NO: 712461 - RNA, 22 nt, Human
guuccucagcccuuacuuagcc

SEQ ID NO: 712462 - RNA, 22 nt, Human
uaacagagauagaaauguaaag

SEQ ID NO: 712463 - RNA, 22 nt, Human
cugagcuuggcuuaucuccagc

SEQ ID NO: 712464 - RNA, 21 nt, Human
aguguguucuuggcauuaccu

SEQ ID NO: 712465 - RNA, 22 nt, Human
guggucaucauuaguauuauua

SEQ ID NO: 712466 - RNA, 22 nt, Human
agaagaaaugaggccguucugc

SEQ ID NO: 712467 - RNA, 22 nt, Human
ucaggcuguaaauggugugggu

SEQ ID NO: 712468 - RNA, 22 nt, Human
ucuccauaggcaguucauaaca

SEQ ID NO: 712469 - RNA, 22 nt, Human
agguccugggaguucuagugug

SEQ ID NO: 712470 - RNA, 22 nt, Human
uagcaauguguugacuugguca

SEQ ID NO: 712471 - RNA, 22 nt, Human
caugaaauguuagaauuagaca

SEQ ID NO: 712472 - RNA, 22 nt, Human
uggcccuguguccugcugccag

SEQ ID NO: 712473 - RNA, 22 nt, Human
auuucuuccucugucaguaacu

SEQ ID NO: 712474 - RNA, 21 nt, Human
ucugugcugccgucaacaucc

SEQ ID NO: 712475 - RNA, 22 nt, Human
agggacagucuacuguucacug

SEQ ID NO: 712476 - RNA, 22 nt, Human
aaccuguuuugguugcauuuca

SEQ ID NO: 712477 - RNA, 22 nt, Human
aaccugagauaauaggagagua

SEQ ID NO: 712478 - RNA, 22 nt, Human
gucccugggaugcccuucuggg

SEQ ID NO: 712479 - RNA, 23 nt, Human
ugaggcugauugauuuuugcuca

SEQ ID NO: 712480 - RNA, 22 nt, Human
cggggcaggagucccuguagag

SEQ ID NO: 712481 - RNA, 22 nt, Human
caucagaagaaagacaaaugau

SEQ ID NO: 712482 - RNA, 22 nt, Human
cugcuuuaacagaugauggugu

SEQ ID NO: 712483 - RNA, 22 nt, Human
cacauacuuguguguacauaug

SEQ ID NO: 712484 - RNA, 22 nt, Human
acuugaauaggaaagccacaaa

SEQ ID NO: 712485 - RNA, 22 nt, Human
aagaugugaaauugucucuggg

SEQ ID NO: 712486 - RNA, 19 nt, Human
uacaaugauguuaccuuug

SEQ ID NO: 712487 - RNA, 19 nt, Human
agccagcagcguagcaucu

SEQ ID NO: 712488 - RNA, 22 nt, Human
gagaaaugagugauucacuuuu

SEQ ID NO: 712489 - RNA, 21 nt, Human
ugggccaguagaaaggaaggc

SEQ ID NO: 712490 - RNA, 22 nt, Human
acacaguaggccaccaugucau

SEQ ID NO: 712491 - RNA, 22 nt, Human
uggcugccgacuggcucuuggc

SEQ ID NO: 712492 - RNA, 22 nt, Human
ucuguacacuucagcaugcauc

SEQ ID NO: 712493 - RNA, 22 nt, Human
auggccagccugguacuuggca

SEQ ID NO: 712494 - RNA, 22 nt, Human
ucaguuagggccucagaagaca

SEQ ID NO: 712495 - RNA, 22 nt, Human
uguacauuuagagcucaauaga

SEQ ID NO: 712496 - RNA, 22 nt, Human
aaagcauuauucuguggaaaaa

SEQ ID NO: 712497 - RNA, 22 nt, Human
aaagccagcaaggugaguuuca

SEQ ID NO: 712498 - RNA, 22 nt, Human
cagcagcccacgcgugcugucc

SEQ ID NO: 712499 - RNA, 22 nt, Human
ggccuugggaggagggucagaa

SEQ ID NO: 712500 - RNA, 22 nt, Human
aucacaguggcagggauuuggg

SEQ ID NO: 712501 - RNA, 23 nt, Human
aguguguaagguacuuugcugcu

SEQ ID NO: 712502 - RNA, 22 nt, Human
cugaggggucgugggagcccag

SEQ ID NO: 712503 - RNA, 19 nt, Human
gcagccaggugcucuaccu

SEQ ID NO: 712504 - RNA, 22 nt, Human
aaaguuuggauuagcaguuaga

SEQ ID NO: 712505 - RNA, 22 nt, Human
auugugaauagugccgcaguaa

SEQ ID NO: 712506 - RNA, 22 nt, Human
cuuggggauuuuaaagaccucu

SEQ ID NO: 712507 - RNA, 22 nt, Human
ugacauuuaucuucuacaauga

SEQ ID NO: 712508 - RNA, 22 nt, Human
ggaaggguucaggugggccugc

SEQ ID NO: 712509 - RNA, 22 nt, Human
augacaauacuucaauaagcug

SEQ ID NO: 712510 - RNA, 22 nt, Human
cacagacccagaagggaugaag

SEQ ID NO: 712511 - RNA, 22 nt, Human
uggcuccaucauccaugcaaga

SEQ ID NO: 712512 - RNA, 21 nt, Human
aacaugauauguguauggauu

SEQ ID NO: 712513 - RNA, 22 nt, Human
ucuguguccugcuagcugucuu

SEQ ID NO: 712514 - RNA, 19 nt, Human
uguguguuuauauauguau

SEQ ID NO: 712515 - RNA, 22 nt, Human
uuuaucuguuguaccugcauug

SEQ ID NO: 712516 - RNA, 22 nt, Human
caccugagcacuggggccgccc

SEQ ID NO: 712517 - RNA, 22 nt, Human
uucauguaccguguaccaggca

SEQ ID NO: 712518 - RNA, 22 nt, Human
aguggguacugggcaggcagag

SEQ ID NO: 712519 - RNA, 22 nt, Human
aggcaggcugcuauggaguaga

SEQ ID NO: 712520 - RNA, 22 nt, Human
uacacuguagguggcaggcagc

SEQ ID NO: 712521 - RNA, 22 nt, Human
ucugggcugguugugcuugcuu

SEQ ID NO: 712522 - RNA, 22 nt, Human
agaaaucuuugaaguguaaugu

SEQ ID NO: 712523 - RNA, 22 nt, Human
gcuacaggagcugucacaugcu

SEQ ID NO: 712524 - RNA, 19 nt, Human
cuucauucuucagcuuuug

SEQ ID NO: 712525 - RNA, 22 nt, Human
ccaggacugcagggggcgagga

SEQ ID NO: 712526 - RNA, 22 nt, Human
augaggcuaugaauggggagau

SEQ ID NO: 712527 - RNA, 22 nt, Human
gcugguccacauccugguacgu

SEQ ID NO: 712528 - RNA, 22 nt, Human
acaugcauggcugcuuaaauua

SEQ ID NO: 712529 - RNA, 22 nt, Human
cagauuuagaguggggcuugga

SEQ ID NO: 712530 - RNA, 21 nt, Human
guccucagcugaugggagcug

SEQ ID NO: 712531 - RNA, 22 nt, Human
ggcguggcagucaggaaaaggu

SEQ ID NO: 712532 - RNA, 21 nt, Human
ugggacagugauggcuccucc

SEQ ID NO: 712533 - RNA, 17 nt, Human
uggaaggcuucaauauu

SEQ ID NO: 712534 - RNA, 23 nt, Human
uugagcucaguagcucugcuggu

SEQ ID NO: 712535 - RNA, 23 nt, Human
cccuggagcuagucugagcgggg

SEQ ID NO: 712536 - RNA, 22 nt, Human
caaagucagggaagaguggcug

SEQ ID NO: 712537 - RNA, 22 nt, Human
agcuguguguuuccacugagcu

SEQ ID NO: 712538 - RNA, 22 nt, Human
aauaaguugccuguugaaucau

SEQ ID NO: 712539 - RNA, 22 nt, Human
ucacaugaguauuauuuuccaa

SEQ ID NO: 712540 - RNA, 22 nt, Human
agcaggcaccagggcucguccu

SEQ ID NO: 712541 - RNA, 21 nt, Human
ggguccugggaugggauccag

SEQ ID NO: 712542 - RNA, 22 nt, Human
uauuaagagauguaugaagaga

SEQ ID NO: 712543 - RNA, 22 nt, Human
auuauuugcuuggcucaucuaa

SEQ ID NO: 712544 - RNA, 22 nt, Human
cuucauuuggagaacugugcuu

SEQ ID NO: 712545 - RNA, 21 nt, Human
ugcuccuuagcugccccugcc

SEQ ID NO: 712546 - RNA, 22 nt, Human
uuaaaaauauguagggcccgau

SEQ ID NO: 712547 - RNA, 22 nt, Human
auuuccuauggauacaggcaga

SEQ ID NO: 712548 - RNA, 22 nt, Human
uggagucagaaugcgacaggcc

SEQ ID NO: 712549 - RNA, 22 nt, Human
cacaccagauggcagcguggga

SEQ ID NO: 712550 - RNA, 22 nt, Human
ugggcucugcugcguaccaguu

SEQ ID NO: 712551 - RNA, 22 nt, Human
cucugaccauucccuugauuuu

SEQ ID NO: 712552 - RNA, 21 nt, Human
uaucuacaguguccauucagu

SEQ ID NO: 712553 - RNA, 22 nt, Human
aagggcagagggaaucccacau

SEQ ID NO: 712554 - RNA, 20 nt, Human
agaggcuuccuugggaggag

SEQ ID NO: 712555 - RNA, 22 nt, Human
uauggaaagcucuuuuugauug

SEQ ID NO: 712556 - RNA, 22 nt, Human
uagaacuuagcacuagacuugu

SEQ ID NO: 712557 - RNA, 22 nt, Human
gcuuugcuuccuguucuagccu

SEQ ID NO: 712558 - RNA, 22 nt, Human
agagcacaaauuaguuggucuu

SEQ ID NO: 712559 - RNA, 22 nt, Human
agcuuuggagacugacuccauc

SEQ ID NO: 712560 - RNA, 22 nt, Human
cuggccacaugugugcugagca

SEQ ID NO: 712561 - RNA, 22 nt, Human
uacugaaacuuuucuucaacug

SEQ ID NO: 712562 - RNA, 22 nt, Human
agacucuggcaugcuaacuagu

SEQ ID NO: 712563 - RNA, 20 nt, Human
agaacuguuguuuggguccu

SEQ ID NO: 712564 - RNA, 22 nt, Human
ggugauucugugaggggcugac

SEQ ID NO: 712565 - RNA, 17 nt, Human
gaaagguccuagaaauc

SEQ ID NO: 712566 - RNA, 22 nt, Human
aggccugaaguguggagugggg

SEQ ID NO: 712567 - RNA, 22 nt, Human
augggcugggaauacacagggg

SEQ ID NO: 712568 - RNA, 22 nt, Human
uucauuuggccucugcuuaaaa

SEQ ID NO: 712569 - RNA, 22 nt, Human
uguuauuauguuuccagagccu

SEQ ID NO: 712570 - RNA, 22 nt, Human
ugaagcccugugucagcuucca

SEQ ID NO: 712571 - RNA, 22 nt, Human
cugaggagauccccccagaagu

SEQ ID NO: 712572 - RNA, 22 nt, Human
ucugcgcugccuugauccuugg

SEQ ID NO: 712573 - RNA, 22 nt, Human
acuucauguugcucuuggcuau

SEQ ID NO: 712574 - RNA, 22 nt, Human
ggguccuggaaucugcauuuua

SEQ ID NO: 712575 - RNA, 21 nt, Human
ucugccagcugaagaggugga

SEQ ID NO: 712576 - RNA, 22 nt, Human
cucaucuguauauagugaauga

SEQ ID NO: 712577 - RNA, 22 nt, Human
gcuggaccaggugugcacaggc

SEQ ID NO: 712578 - RNA, 22 nt, Human
cacauuuaaaaaauccacgauc

SEQ ID NO: 712579 - RNA, 22 nt, Human
ucucaggcaucuguguggcaca

SEQ ID NO: 712580 - RNA, 22 nt, Human
uuaggaagagcuuucaaucacu

SEQ ID NO: 712581 - RNA, 22 nt, Human
acauucuuucgaugucugauuu

SEQ ID NO: 712582 - RNA, 22 nt, Human
uagauucuguuuccucugguuu

SEQ ID NO: 712583 - RNA, 22 nt, Human
uuugcagucuggccugcuuugg

SEQ ID NO: 712584 - RNA, 22 nt, Human
ccugggcuuucaaaaccagccu

SEQ ID NO: 712585 - RNA, 22 nt, Human
aucugaagaaugaauggaauua

SEQ ID NO: 712586 - RNA, 22 nt, Human
ggccucugguucacagggagga

SEQ ID NO: 712587 - RNA, 22 nt, Human
aagguauauguacaauagacau

SEQ ID NO: 712588 - RNA, 22 nt, Human
guuacacacaauauauccuaaa

SEQ ID NO: 712589 - RNA, 22 nt, Human
aaugucuucaguguauacaugg

SEQ ID NO: 712590 - RNA, 22 nt, Human
gcaguaggggcuggagggcugu

SEQ ID NO: 712591 - RNA, 20 nt, Human
uuacacuuuguagcauuuuu

SEQ ID NO: 712592 - RNA, 22 nt, Human
ggaacacucgucaaauagcggg

SEQ ID NO: 712593 - RNA, 22 nt, Human
agggcgacaauggagagcguuu

SEQ ID NO: 712594 - RNA, 22 nt, Human
ccaguacaccucacuucccuuu

SEQ ID NO: 712595 - RNA, 22 nt, Human
gcaggcugaaacucggggucua

SEQ ID NO: 712596 - RNA, 17 nt, Human
ccagagaugccucaggc

SEQ ID NO: 712597 - RNA, 22 nt, Human
agacacagaaguugcuguuggg

SEQ ID NO: 712598 - RNA, 18 nt, Human
accugccuguucuucucu

SEQ ID NO: 712599 - RNA, 22 nt, Human
uucuggagccccaagaucugua

SEQ ID NO: 712600 - RNA, 22 nt, Human
ucuuauuauuguuguaaaagca

SEQ ID NO: 712601 - RNA, 22 nt, Human
ugacaaauacaauaagaucugu

SEQ ID NO: 712602 - RNA, 22 nt, Human
agauguguuucuaguuccugca

SEQ ID NO: 712603 - RNA, 22 nt, Human
ugacaaaacugcaauuacuuuu

SEQ ID NO: 712604 - RNA, 22 nt, Human
ugucucuucagcccauggcuuc

SEQ ID NO: 712605 - RNA, 22 nt, Human
uaggcagcgcuuggcugugcuu

SEQ ID NO: 712606 - RNA, 22 nt, Human
ggguuccaaacauagucuuccu

SEQ ID NO: 712607 - RNA, 22 nt, Human
ucacagaauugacaugggaauc

SEQ ID NO: 712608 - RNA, 22 nt, Human
ccagaggcuggggaaggauaca

SEQ ID NO: 712609 - RNA, 22 nt, Human
acagcuacaucaaacucagaag

SEQ ID NO: 712610 - RNA, 18 nt, Human
ugagacagcuaccacuug

SEQ ID NO: 712611 - RNA, 22 nt, Human
gcagcccaggacccuggacaga

SEQ ID NO: 712612 - RNA, 22 nt, Human
agaacaguuuguuggagacugu

SEQ ID NO: 712613 - RNA, 22 nt, Human
ugaacucucccccauugcccuc

SEQ ID NO: 712614 - RNA, 21 nt, Human
acucccugcauaagugauuua

SEQ ID NO: 712615 - RNA, 22 nt, Human
uuuaacacuaguuucuuuaacu

SEQ ID NO: 712616 - RNA, 22 nt, Human
aaucacauuugcccccauauuc

SEQ ID NO: 712617 - RNA, 22 nt, Human
aacccauguuggaagcuuauca

SEQ ID NO: 712618 - RNA, 22 nt, Human
gaugauuugaggauuucaugag

SEQ ID NO: 712619 - RNA, 22 nt, Human
ucuaaaaaagucuguucacuug

SEQ ID NO: 712620 - RNA, 22 nt, Human
ucugagcugggucuugacagcu

SEQ ID NO: 712621 - RNA, 22 nt, Human
uguacuugcuuauuagaaaucu

SEQ ID NO: 712622 - RNA, 22 nt, Human
uugauucuagaaucuucccucu

SEQ ID NO: 712623 - RNA, 22 nt, Human
cugcugugggcaggguagcugg

SEQ ID NO: 712624 - RNA, 22 nt, Human
uccugggucugggugucugagg

SEQ ID NO: 712625 - RNA, 22 nt, Human
auaaaguucugcuggcauauau

SEQ ID NO: 712626 - RNA, 22 nt, Human
gcugggcucaccaggccacuag

SEQ ID NO: 712627 - RNA, 22 nt, Human
auacaguauuaccuguucagga

SEQ ID NO: 712628 - RNA, 22 nt, Human
cacccuguacaaauggacaucu

SEQ ID NO: 712629 - RNA, 22 nt, Human
cuccuggcucgcccccagcuga

SEQ ID NO: 712630 - RNA, 22 nt, Human
ggucagccuuggauuugguagc

SEQ ID NO: 712631 - RNA, 22 nt, Human
uuccacucuucucuggacuuau

SEQ ID NO: 712632 - RNA, 22 nt, Human
agauggcuagauugcaagaacu

SEQ ID NO: 712633 - RNA, 18 nt, Human
agagcagcggcaucacac

SEQ ID NO: 712634 - RNA, 22 nt, Human
uaaggaauaucauaagaaguag

SEQ ID NO: 712635 - RNA, 18 nt, Human
gcccugguggagcuggug

SEQ ID NO: 712636 - RNA, 23 nt, Human
aaaugucuucuagcucuugagaa

SEQ ID NO: 712637 - RNA, 22 nt, Human
uuccaguccagggcuguuucca

SEQ ID NO: 712638 - RNA, 22 nt, Human
gugacaguggucacuuguaguu

SEQ ID NO: 712639 - RNA, 22 nt, Human
guguaaguaucuuuguaucuuu

SEQ ID NO: 712640 - RNA, 22 nt, Human
uguaggaguccaaucaggagac

SEQ ID NO: 712641 - RNA, 19 nt, Human
agaaguuagacauugcaau

SEQ ID NO: 712642 - RNA, 22 nt, Human
aaugcacauaaauauggucuua

SEQ ID NO: 712643 - RNA, 22 nt, Human
ugauauggaaggaagauguaca

SEQ ID NO: 712644 - RNA, 22 nt, Human
gccaccagggggugcaaggucc

SEQ ID NO: 712645 - RNA, 22 nt, Human
aaguaacacggaacuugaagca

SEQ ID NO: 712646 - RNA, 22 nt, Human
aagcagaggguauggccagguu

SEQ ID NO: 712647 - RNA, 22 nt, Human
agcuagccuaggcagagugcau

SEQ ID NO: 712648 - RNA, 22 nt, Human
uuucacuagaacguucuuguuu

SEQ ID NO: 712649 - RNA, 23 nt, Human
uaggcaggacucagauaugacag

SEQ ID NO: 712650 - RNA, 22 nt, Human
auggcugugagacaaagagcug

SEQ ID NO: 712651 - RNA, 22 nt, Human
uccauuuuguagguaugcuaca

SEQ ID NO: 712652 - RNA, 22 nt, Human
ucaucuugcugccauugcuuua

SEQ ID NO: 712653 - RNA, 22 nt, Human
uguuuuuaaaauguccugguua

SEQ ID NO: 712654 - RNA, 22 nt, Human
ucuggcuucaagucccagcucu

SEQ ID NO: 712655 - RNA, 22 nt, Human
ucuccccaaaggacucacucuc

SEQ ID NO: 712656 - RNA, 22 nt, Human
uuuuuauaggucagggcaaguc

SEQ ID NO: 712657 - RNA, 22 nt, Human
uucacccacuagagaacucagg

SEQ ID NO: 712658 - RNA, 23 nt, Human
aggcagugucucuuauccugucc

SEQ ID NO: 712659 - RNA, 22 nt, Human
auuugccuguaagacaaggccu

SEQ ID NO: 712660 - RNA, 22 nt, Human
ccugagagugguguacaggaga

SEQ ID NO: 712661 - RNA, 22 nt, Human
acagggcagagugaaaugcuau

SEQ ID NO: 712662 - RNA, 22 nt, Human
augucuuuuaugauuacgggau

SEQ ID NO: 712663 - RNA, 22 nt, Human
ugguuagucaguaccugagugu

SEQ ID NO: 712664 - RNA, 22 nt, Human
aguggcagagugcacucaggca

SEQ ID NO: 712665 - RNA, 22 nt, Human
cuguggcugcgcccugggggag

SEQ ID NO: 712666 - RNA, 22 nt, Human
cugcauguguuucugcuggguu

SEQ ID NO: 712667 - RNA, 22 nt, Human
ugaugggacugccagcugcuga

SEQ ID NO: 712668 - RNA, 20 nt, Human
uacagccuauucaccacaua

SEQ ID NO: 712669 - RNA, 22 nt, Human
ucagaauuuaaaauguguagau

SEQ ID NO: 712670 - RNA, 22 nt, Human
cuucagagaacuugaucgcugc

SEQ ID NO: 712671 - RNA, 21 nt, Human
ugcauuccuccauccaacagg

SEQ ID NO: 712672 - RNA, 22 nt, Human
agggcuuguggucguggcugug

SEQ ID NO: 712673 - RNA, 22 nt, Human
caaaguaacugccuuuccaauu

SEQ ID NO: 712674 - RNA, 22 nt, Human
gcccagguuggagagcaguggc

SEQ ID NO: 712675 - RNA, 22 nt, Human
ucccugcuugcucucagcccuu

SEQ ID NO: 712676 - RNA, 20 nt, Human
aaaguguaagcauauaauua

SEQ ID NO: 712677 - RNA, 22 nt, Human
uugagcuguauaccuaugacug

SEQ ID NO: 712678 - RNA, 22 nt, Human
ccaggcuguaagagugauguug

SEQ ID NO: 712679 - RNA, 22 nt, Human
aagauggucuugagauauuaua

SEQ ID NO: 712680 - RNA, 22 nt, Human
cagaucuuguacucauuauuga

SEQ ID NO: 712681 - RNA, 22 nt, Human
ucacagaauaaauugagaagac

SEQ ID NO: 712682 - RNA, 22 nt, Human
augccaggaacaaacaguggug

SEQ ID NO: 712683 - RNA, 22 nt, Human
ggaaguguuuccuugggcagca

SEQ ID NO: 712684 - RNA, 22 nt, Human
uccuucaaagcuccuagugagc

SEQ ID NO: 712685 - RNA, 22 nt, Human
gcuguacaaauuccacaagaga

SEQ ID NO: 712686 - RNA, 22 nt, Human
caggcugaggcaguaggguuug

SEQ ID NO: 712687 - RNA, 22 nt, Human
uucauucccuuauauuagcauu

SEQ ID NO: 712688 - RNA, 23 nt, Human
uaaauuaccuuuccagugcaggg

SEQ ID NO: 712689 - RNA, 22 nt, Human
augcauguauuaucuagaugag

SEQ ID NO: 712690 - RNA, 22 nt, Human
gaccacagguaugggcuuggca

SEQ ID NO: 712691 - RNA, 22 nt, Human
uaccaaaagcuuguuucauaca

SEQ ID NO: 712692 - RNA, 22 nt, Human
ggagagagagauuguguuuauu

SEQ ID NO: 712693 - RNA, 22 nt, Human
caggcauggaaaagcccagagg

SEQ ID NO: 712694 - RNA, 22 nt, Human
cagagguauugcaaaagccuag

SEQ ID NO: 712695 - RNA, 22 nt, Human
gcacaugaguuaagcuggggca

SEQ ID NO: 712696 - RNA, 22 nt, Human
gcucuguguauguggcaggugc

SEQ ID NO: 712697 - RNA, 22 nt, Human
acugccaggauggcacuagagg

SEQ ID NO: 712698 - RNA, 22 nt, Human
caggccagugugcuucccaggc

SEQ ID NO: 712699 - RNA, 18 nt, Human
ucuguggagagggcaguu

SEQ ID NO: 712700 - RNA, 22 nt, Human
gccuccucuugagggucaggga

SEQ ID NO: 712701 - RNA, 22 nt, Human
aagaacauguuaaaagauucac

SEQ ID NO: 712702 - RNA, 22 nt, Human
ucuggagaagcccagggagcug

SEQ ID NO: 712703 - RNA, 19 nt, Human
cccacaggaggacauaugg

SEQ ID NO: 712704 - RNA, 22 nt, Human
uaguuucauaugcaaaauagua

SEQ ID NO: 712705 - RNA, 22 nt, Human
acucagcuugcacacaucaaug

SEQ ID NO: 712706 - RNA, 22 nt, Human
gcagguggauuaucagaagugc

SEQ ID NO: 712707 - RNA, 22 nt, Human
aaagagaaaaugaucuguacau

SEQ ID NO: 712708 - RNA, 20 nt, Human
ucccucagcacuucuaccuc

SEQ ID NO: 712709 - RNA, 22 nt, Human
uucugcugagugggcaggugca

SEQ ID NO: 712710 - RNA, 22 nt, Human
acacauuaucucauuaaauacu

SEQ ID NO: 712711 - RNA, 22 nt, Human
aaacuccugcauacucagaagc

SEQ ID NO: 712712 - RNA, 21 nt, Human
uacaagauagagguaauauau

SEQ ID NO: 712713 - RNA, 22 nt, Human
acucucagggacagggucuggg

SEQ ID NO: 712714 - RNA, 22 nt, Human
ccagugcauugccgugucuagg

SEQ ID NO: 712715 - RNA, 22 nt, Human
ccugagcugcggggcagugcuc

SEQ ID NO: 712716 - RNA, 22 nt, Human
caaauguauguuuuccuaugua

SEQ ID NO: 712717 - RNA, 22 nt, Human
ugugcuuacuuugaauuauaua

SEQ ID NO: 712718 - RNA, 22 nt, Human
cccaggcagcccuucugacgca

SEQ ID NO: 712719 - RNA, 22 nt, Human
gggaauuauagcugucacaggc

SEQ ID NO: 712720 - RNA, 22 nt, Human
gggcagagagcuggaacuccuu

SEQ ID NO: 712721 - RNA, 22 nt, Human
gccacaggcuccagcaucagua

SEQ ID NO: 712722 - RNA, 22 nt, Human
uuaaaagaccuguugagguuag

SEQ ID NO: 712723 - RNA, 22 nt, Human
uuaaaggcugaucuuaauauua

SEQ ID NO: 712724 - RNA, 22 nt, Human
uuuacaacccaaguccagagag

SEQ ID NO: 712725 - RNA, 22 nt, Human
uuucuaguccucaugcaucauu

SEQ ID NO: 712726 - RNA, 22 nt, Human
uucaagguaugguagcugguca

SEQ ID NO: 712727 - RNA, 22 nt, Human
uucauugugauucuuggcuagc

SEQ ID NO: 712728 - RNA, 21 nt, Human
aaguuugggauucaguuucca

SEQ ID NO: 712729 - RNA, 22 nt, Human
uuugcauuccugccugcauuca

SEQ ID NO: 712730 - RNA, 18 nt, Human
uggaagcuggugagcaga

SEQ ID NO: 712731 - RNA, 22 nt, Human
gaagccagccuugucugccucu

SEQ ID NO: 712732 - RNA, 18 nt, Human
uagcacagagcaggaugu

SEQ ID NO: 712733 - RNA, 22 nt, Human
acuguguuaaauacagagaugg

SEQ ID NO: 712734 - RNA, 22 nt, Human
ggagcccaagucugcacucggc

SEQ ID NO: 712735 - RNA, 22 nt, Human
gccucaaaaguguuguagaggg

SEQ ID NO: 712736 - RNA, 22 nt, Human
cucagccaugucaugccuaccu

SEQ ID NO: 712737 - RNA, 22 nt, Human
augggccacacacgauugggug

SEQ ID NO: 712738 - RNA, 22 nt, Human
gauaaacacaaggugauuucau

SEQ ID NO: 712739 - RNA, 22 nt, Human
gagggaggggagcuccacccuc

SEQ ID NO: 712740 - RNA, 22 nt, Human
ucuguauauauuaaugaaauuc

SEQ ID NO: 712741 - RNA, 22 nt, Human
auauugaacccuacagacugua

SEQ ID NO: 712742 - RNA, 22 nt, Human
ccugagagugcgugccuccuua

SEQ ID NO: 712743 - RNA, 22 nt, Human
gcucugcugagauaucugggag

SEQ ID NO: 712744 - RNA, 22 nt, Human
cuuuaucagaaaacacauuagg

SEQ ID NO: 712745 - RNA, 22 nt, Human
ggucucgagccaggcagcugca

SEQ ID NO: 712746 - RNA, 22 nt, Human
cuucagcccagccuccgccucc

SEQ ID NO: 712747 - RNA, 22 nt, Human
acaccauacucauguugguucc

SEQ ID NO: 712748 - RNA, 22 nt, Human
ccugaggggcugcaggccagcu

SEQ ID NO: 712749 - RNA, 22 nt, Human
cauggaauuuucuaggcauaaa

SEQ ID NO: 712750 - RNA, 22 nt, Human
ugugccuucccucugcugauuu

SEQ ID NO: 712751 - RNA, 22 nt, Human
ccaaaguuuuuauaguuagcau

SEQ ID NO: 712752 - RNA, 19 nt, Human
ugugucucuguguagccug

SEQ ID NO: 712753 - RNA, 22 nt, Human
cuugcuuuaucugguuucucau

SEQ ID NO: 712754 - RNA, 22 nt, Human
uaucacaggugugauuuacauu

SEQ ID NO: 712755 - RNA, 22 nt, Human
ccagagaggcaaaacuccuucc

SEQ ID NO: 712756 - RNA, 22 nt, Human
cugcccugcuggagaucacagu

SEQ ID NO: 712757 - RNA, 22 nt, Human
uuuuugcaccaaccuaauagaa

SEQ ID NO: 712758 - RNA, 19 nt, Human
gaggcccaugagggugcuc

SEQ ID NO: 712759 - RNA, 22 nt, Human
caaacauuuguuggaaccccug

SEQ ID NO: 712760 - RNA, 22 nt, Human
ugucugccaccccaucaagcuc

SEQ ID NO: 712761 - RNA, 20 nt, Human
uagauguuuccugucauaaa

SEQ ID NO: 712762 - RNA, 22 nt, Human
cagggguggcugcagcagaggu

SEQ ID NO: 712763 - RNA, 22 nt, Human
uacagauauagagauuuauaga

SEQ ID NO: 712764 - RNA, 22 nt, Human
agucacaguucugcugucugag

SEQ ID NO: 712765 - RNA, 23 nt, Human
aaaggcaggccuaggacauauug

SEQ ID NO: 712766 - RNA, 22 nt, Human
ugcugaugcuguucuguuagga

SEQ ID NO: 712767 - RNA, 22 nt, Human
gggauggggucaacauguaccu

SEQ ID NO: 712768 - RNA, 22 nt, Human
cucaggaugcaauuccaucaag

SEQ ID NO: 712769 - RNA, 22 nt, Human
gugucccaggagaggagacaau

SEQ ID NO: 712770 - RNA, 22 nt, Human
aagcugugaaauagauuacaca

SEQ ID NO: 712771 - RNA, 22 nt, Human
ugggccagcugaagugccgccc

SEQ ID NO: 712772 - RNA, 22 nt, Human
ucauccuuuugcaugggaaggc

SEQ ID NO: 712773 - RNA, 22 nt, Human
augaauccagcaaacagugagg

SEQ ID NO: 712774 - RNA, 22 nt, Human
ggagaaggugcuggucacugug

SEQ ID NO: 712775 - RNA, 22 nt, Human
gucacacagggccuccaaauca

SEQ ID NO: 712776 - RNA, 22 nt, Human
aucaggauagucuguaaauugu

SEQ ID NO: 712777 - RNA, 22 nt, Human
ggagaggugaauggcugcucua

SEQ ID NO: 712778 - RNA, 19 nt, Human
ggugaccaccuggucagug

SEQ ID NO: 712779 - RNA, 22 nt, Human
ucagagagugcaaaauauagcu

SEQ ID NO: 712780 - RNA, 22 nt, Human
uuugcaaaugaagcucugagga

SEQ ID NO: 712781 - RNA, 22 nt, Human
aguuucuagcaaggauuguuga

SEQ ID NO: 712782 - RNA, 22 nt, Human
caggcugggcuccggagauaaa

SEQ ID NO: 712783 - RNA, 22 nt, Human
gcucaggcccagcggcuggugu

SEQ ID NO: 712784 - RNA, 22 nt, Human
uucuucagugccccucuaguag

SEQ ID NO: 712785 - RNA, 22 nt, Human
ccagacccugcucuggggcucu

SEQ ID NO: 712786 - RNA, 22 nt, Human
aagaguuucuuuauuaaccuuu

SEQ ID NO: 712787 - RNA, 22 nt, Human
gucaggacaggcucuggacuga

SEQ ID NO: 712788 - RNA, 17 nt, Human
ugcuucaucccgauccu

SEQ ID NO: 712789 - RNA, 22 nt, Human
cucagagggucuccuccagaau

SEQ ID NO: 712790 - RNA, 22 nt, Human
ucauccugucucacuuuuugcu

SEQ ID NO: 712791 - RNA, 22 nt, Human
aaugcuuuuugcgaaaugugca

SEQ ID NO: 712792 - RNA, 22 nt, Human
gagacaucauaaugaaguuucc

SEQ ID NO: 712793 - RNA, 22 nt, Human
agacagagauacuauguuguca

SEQ ID NO: 712794 - RNA, 22 nt, Human
uggcugaguucuccaggaguag

SEQ ID NO: 712795 - RNA, 22 nt, Human
ccuggaaggugaugguacagca

SEQ ID NO: 712796 - RNA, 22 nt, Human
gggcaggugaccucuuguccug

SEQ ID NO: 712797 - RNA, 22 nt, Human
gaggcugcuuugaugacaggag

SEQ ID NO: 712798 - RNA, 22 nt, Human
augcaugugugaauuauuugac

SEQ ID NO: 712799 - RNA, 22 nt, Human
ugaaaaacacuaauuggaaagc

SEQ ID NO: 712800 - RNA, 22 nt, Human
uugcauugaaaauauauuuuaa

SEQ ID NO: 712801 - RNA, 22 nt, Human
uguccucacaggaaugaacuuu

SEQ ID NO: 712802 - RNA, 22 nt, Human
auugaaagguuuugagcagaua

SEQ ID NO: 712803 - RNA, 22 nt, Human
aggaaugauaguaaaagagaau

SEQ ID NO: 712804 - RNA, 22 nt, Human
cagcagggaagcugugcuguuu

SEQ ID NO: 712805 - RNA, 22 nt, Human
acaggcucuggggcaggauggc

SEQ ID NO: 712806 - RNA, 22 nt, Human
guggguggaucaugaggucagg

SEQ ID NO: 712807 - RNA, 22 nt, Human
uggguuaagccucauucauagc

SEQ ID NO: 712808 - RNA, 22 nt, Human
aacaaaugauaccaguucucaa

SEQ ID NO: 712809 - RNA, 22 nt, Human
ugagcaggcgcagcaggagguc

SEQ ID NO: 712810 - RNA, 22 nt, Human
caugcugauucuuccugagcuu

SEQ ID NO: 712811 - RNA, 19 nt, Human
uguacauauagagcucagu

SEQ ID NO: 712812 - RNA, 22 nt, Human
cugcuguguuccuccugcaucu

SEQ ID NO: 712813 - RNA, 22 nt, Human
caggccugagacaucugagaua

SEQ ID NO: 712814 - RNA, 22 nt, Human
auggaguuuggggucaaauacu

SEQ ID NO: 712815 - RNA, 22 nt, Human
auuugcauaauagugauuugua

SEQ ID NO: 712816 - RNA, 22 nt, Human
uuugcaaauuucgucuccucag

SEQ ID NO: 712817 - RNA, 22 nt, Human
gcugcucugggucugcccagcu

SEQ ID NO: 712818 - RNA, 17 nt, Human
ucagagggaugagcagg

SEQ ID NO: 712819 - RNA, 22 nt, Human
ggcacagggagccgcaguugca

SEQ ID NO: 712820 - RNA, 22 nt, Human
gcucucagaagagccaggcuac

SEQ ID NO: 712821 - RNA, 19 nt, Human
agguggucuaggcuggaga

SEQ ID NO: 712822 - RNA, 22 nt, Human
caugcaugucagggauccugga

SEQ ID NO: 712823 - RNA, 22 nt, Human
uauguguacaucugguugagca

SEQ ID NO: 712824 - RNA, 22 nt, Human
ugugggcaggcccgggucugag

SEQ ID NO: 712825 - RNA, 22 nt, Human
cccagagccucauucuguuggg

SEQ ID NO: 712826 - RNA, 23 nt, Human
ccucucuuuuuaggugguguuug

SEQ ID NO: 712827 - RNA, 22 nt, Human
aacccgggaggcagagguugug

SEQ ID NO: 712828 - RNA, 22 nt, Human
aacaaaccuggguggagaaagg

SEQ ID NO: 712829 - RNA, 22 nt, Human
cugggucucaggaguucugagg

SEQ ID NO: 712830 - RNA, 22 nt, Human
aagagacuauggugucuaugaa

SEQ ID NO: 712831 - RNA, 19 nt, Human
aggagcacugccagcacca

SEQ ID NO: 712832 - RNA, 22 nt, Human
ugagaugguugaccagagagca

SEQ ID NO: 712833 - RNA, 18 nt, Human
cuuccucaucgcucuccc

SEQ ID NO: 712834 - RNA, 22 nt, Human
uuucacaacguuguggugagag

SEQ ID NO: 712835 - RNA, 22 nt, Human
uuacagaguucgcaccuggugg

SEQ ID NO: 712836 - RNA, 22 nt, Human
ugugugaagcacauguucaagg

SEQ ID NO: 712837 - RNA, 21 nt, Human
ugaggccugccagucucagaa

SEQ ID NO: 712838 - RNA, 22 nt, Human
ucuuuccaaguaauacuuccca

SEQ ID NO: 712839 - RNA, 22 nt, Human
ucuaagccaggacugagagacg

SEQ ID NO: 712840 - RNA, 22 nt, Human
aacuuguauauguuauucagag

SEQ ID NO: 712841 - RNA, 22 nt, Human
cuguuuaucccuuuggucagca

SEQ ID NO: 712842 - RNA, 22 nt, Human
cuggccacugguggucauaggc

SEQ ID NO: 712843 - RNA, 22 nt, Human
ugguguggggauaagcacucug

SEQ ID NO: 712844 - RNA, 22 nt, Human
ugugucugaacuaguugcucuc

SEQ ID NO: 712845 - RNA, 18 nt, Human
auuguuaauagaguacuu

SEQ ID NO: 712846 - RNA, 22 nt, Human
agauucaggacuggccacagcc

SEQ ID NO: 712847 - RNA, 22 nt, Human
ucagagaaguaagguggggugc

SEQ ID NO: 712848 - RNA, 16 nt, Human
gcacacagccagccuu

SEQ ID NO: 712849 - RNA, 22 nt, Human
cugcuguggccagccaggucaa

SEQ ID NO: 712850 - RNA, 21 nt, Human
uggcccuggccacggcugcca

SEQ ID NO: 712851 - RNA, 21 nt, Human
gccagcugcagggcuuccuug

SEQ ID NO: 712852 - RNA, 22 nt, Human
aacuuuucauugaaucauguca

SEQ ID NO: 712853 - RNA, 22 nt, Human
gaguccaguuguucacagaggc

SEQ ID NO: 712854 - RNA, 22 nt, Human
uacauacaagcauucaauuuua

SEQ ID NO: 712855 - RNA, 22 nt, Human
guguagcauauagcaagagcau

SEQ ID NO: 712856 - RNA, 22 nt, Human
aaggaggccuggcagaugaaga

SEQ ID NO: 712857 - RNA, 21 nt, Human
cucugcugagcuccauuuuca

SEQ ID NO: 712858 - RNA, 22 nt, Human
uguaggacauguacuuguaaca

SEQ ID NO: 712859 - RNA, 22 nt, Human
cuucccuucugcagaucuuugg

SEQ ID NO: 712860 - RNA, 22 nt, Human
ggucuggauuucugcuucuuuc

SEQ ID NO: 712861 - RNA, 22 nt, Human
uaauggcuaaaauucagaagaa

SEQ ID NO: 712862 - RNA, 22 nt, Human
cuccucccaauugccaagugcu

SEQ ID NO: 712863 - RNA, 22 nt, Human
auuucucuuagcaagacauuac

SEQ ID NO: 712864 - RNA, 20 nt, Human
ucccucaguuuccagcccug

SEQ ID NO: 712865 - RNA, 22 nt, Human
uagccaaagaagguauauuugu

SEQ ID NO: 712866 - RNA, 22 nt, Human
gguucaguggaauguguugacc

SEQ ID NO: 712867 - RNA, 22 nt, Human
gagaugcuauggcuauuccccu

SEQ ID NO: 712868 - RNA, 22 nt, Human
cuuguugcaaacauucacucca

SEQ ID NO: 712869 - RNA, 22 nt, Human
cccaggagacauauagaaggac

SEQ ID NO: 712870 - RNA, 22 nt, Human
uucucuuacauuuucucagccu

SEQ ID NO: 712871 - RNA, 22 nt, Human
ucucugaguuguaaaaaauagu

SEQ ID NO: 712872 - RNA, 18 nt, Human
uaggagagaauuuauuua

SEQ ID NO: 712873 - RNA, 22 nt, Human
auucauguggggagccuucugu

SEQ ID NO: 712874 - RNA, 22 nt, Human
cuuuacaaagcaauuuugucuc

SEQ ID NO: 712875 - RNA, 22 nt, Human
gcagcccaagccugagcauccu

SEQ ID NO: 712876 - RNA, 22 nt, Human
auucacaguuacugcugaacca

SEQ ID NO: 712877 - RNA, 22 nt, Human
ggcaaagcggcccuguggccag

SEQ ID NO: 712878 - RNA, 22 nt, Human
uaauggaaguuaaauaugguau

SEQ ID NO: 712879 - RNA, 22 nt, Human
cugcauguguuauauuugguuc

SEQ ID NO: 712880 - RNA, 22 nt, Human
cuuccuucaauauaauuuuuac

SEQ ID NO: 712881 - RNA, 22 nt, Human
agagcagguggcaacucuggga

SEQ ID NO: 712882 - RNA, 22 nt, Human
ggccucuggugccugaagcgcc

SEQ ID NO: 712883 - RNA, 22 nt, Human
ggcagcugcacguugucccguc

SEQ ID NO: 712884 - RNA, 19 nt, Human
ggaccagguccugggcagc

SEQ ID NO: 712885 - RNA, 22 nt, Human
ucugcuguaaccuucagaggua

SEQ ID NO: 712886 - RNA, 22 nt, Human
augcaugagaauaucccaugcu

SEQ ID NO: 712887 - RNA, 22 nt, Human
agcugcugcggaaagaugccac

SEQ ID NO: 712888 - RNA, 22 nt, Human
gagagagaagugggugucaccu

SEQ ID NO: 712889 - RNA, 22 nt, Human
uaggcagaauugugggcucuaa

SEQ ID NO: 712890 - RNA, 22 nt, Human
agugucagccugggcaaggaac

SEQ ID NO: 712891 - RNA, 22 nt, Human
ugcugcuuuuguauaucagaga

SEQ ID NO: 712892 - RNA, 22 nt, Human
ggagggagguuagauucaagcu

SEQ ID NO: 712893 - RNA, 22 nt, Human
uggccuggcagagcaaggccug

SEQ ID NO: 712894 - RNA, 22 nt, Human
aaacauugaccucauccuggca

SEQ ID NO: 712895 - RNA, 22 nt, Human
cuguccagucagaacgucauua

SEQ ID NO: 712896 - RNA, 22 nt, Human
ccagcccuacaguaucaccugu

SEQ ID NO: 712897 - RNA, 22 nt, Human
cugucuguuaucucaccagucc

SEQ ID NO: 712898 - RNA, 22 nt, Human
caggaaugccuucuucagccau

SEQ ID NO: 712899 - RNA, 22 nt, Human
agcugccuuauggaguaugaaa

SEQ ID NO: 712900 - RNA, 22 nt, Human
gcugccugggcaggaggcgcug

SEQ ID NO: 712901 - RNA, 22 nt, Human
ugagugaaaaauuugccuggag

SEQ ID NO: 712902 - RNA, 22 nt, Human
auucaguuagccacagcuauuc

SEQ ID NO: 712903 - RNA, 22 nt, Human
uguuccuguacugcuguggcuu

SEQ ID NO: 712904 - RNA, 22 nt, Human
uggaaggcuuggaauacuucca

SEQ ID NO: 712905 - RNA, 22 nt, Human
uuuacaacuuucuguucuguau

SEQ ID NO: 712906 - RNA, 22 nt, Human
gcucaagagagaugcaguucuu

SEQ ID NO: 712907 - RNA, 20 nt, Human
guauucuguauucugcucag

SEQ ID NO: 712908 - RNA, 22 nt, Human
uggcccugcugggucagagcug

SEQ ID NO: 712909 - RNA, 22 nt, Human
ggaaaaaugacacauaucucaa

SEQ ID NO: 712910 - RNA, 22 nt, Human
cuggguucuauuuuuggcuuca

SEQ ID NO: 712911 - RNA, 22 nt, Human
gaggcuggcagaaaagcacagg

SEQ ID NO: 712912 - RNA, 22 nt, Human
aaacaucauaggcaugcaugau

SEQ ID NO: 712913 - RNA, 22 nt, Human
uucugacaguaaucaguuugcu

SEQ ID NO: 712914 - RNA, 22 nt, Human
agauaauuugaguaaauuaauu

SEQ ID NO: 712915 - RNA, 22 nt, Human
gaggacagugugaucugccagc

SEQ ID NO: 712916 - RNA, 22 nt, Human
acaagccaauuacugugccagg

SEQ ID NO: 712917 - RNA, 22 nt, Human
gccaauuuaucuuacucgugcu

SEQ ID NO: 712918 - RNA, 22 nt, Human
cacuguggcaaccugugcccaa

SEQ ID NO: 712919 - RNA, 22 nt, Human
cuugggagacacaagaagacau

SEQ ID NO: 712920 - RNA, 22 nt, Human
ccugagagggggcccuagaaau

SEQ ID NO: 712921 - RNA, 22 nt, Human
uuguuaaaauauuggagaaagg

SEQ ID NO: 712922 - RNA, 22 nt, Human
uggcaguccccugugccuggaa

SEQ ID NO: 712923 - RNA, 22 nt, Human
cguucacaucguauuauuggga

SEQ ID NO: 712924 - RNA, 22 nt, Human
uaguuuagagaauuggggauga

SEQ ID NO: 712925 - RNA, 22 nt, Human
agugcuuucuugcuccaucagu

SEQ ID NO: 712926 - RNA, 22 nt, Human
cugcucuagguuccugcauaug

SEQ ID NO: 712927 - RNA, 22 nt, Human
uuccagccagauuugcuggguu

SEQ ID NO: 712928 - RNA, 22 nt, Human
ggcaggcaggagcgugcuuggg

SEQ ID NO: 712929 - RNA, 22 nt, Human
guggccuggcgagcuggcgcgg

SEQ ID NO: 712930 - RNA, 22 nt, Human
agcccaggcagagggaugcuug

SEQ ID NO: 712931 - RNA, 21 nt, Human
uucugagacucauuugaacuc

SEQ ID NO: 712932 - RNA, 20 nt, Human
auaaaacucuaaucuggccu

SEQ ID NO: 712933 - RNA, 22 nt, Human
augaaauuaaucaacacauaca

SEQ ID NO: 712934 - RNA, 22 nt, Human
aagacacuuucuaaauagaagu

SEQ ID NO: 712935 - RNA, 22 nt, Human
caugagcugcugggagccuguc

SEQ ID NO: 712936 - RNA, 22 nt, Human
gggcuggcaucaguugccgaga

SEQ ID NO: 712937 - RNA, 22 nt, Human
ccauuauccauuuugagucuua

SEQ ID NO: 712938 - RNA, 22 nt, Human
ccccaaggugcucacugucugg

SEQ ID NO: 712939 - RNA, 22 nt, Human
acagaugcaaggaaaugauugc

SEQ ID NO: 712940 - RNA, 22 nt, Human
uggcuuuaagaagacugacagc

SEQ ID NO: 712941 - RNA, 22 nt, Human
gagguggaaggcaggaacaaau

SEQ ID NO: 712942 - RNA, 22 nt, Human
uggcuucuuuccacuguccugu

SEQ ID NO: 712943 - RNA, 22 nt, Human
gcuggucagagagaaaggaggc

SEQ ID NO: 712944 - RNA, 22 nt, Human
uagacauuuuaagacauauacc

SEQ ID NO: 712945 - RNA, 21 nt, Human
ugauuuccaucuuaaaauaaa

SEQ ID NO: 712946 - RNA, 22 nt, Human
uaaacaauuccucucuaggcau

SEQ ID NO: 712947 - RNA, 22 nt, Human
uuauuuggauuuagcuuaucaa

SEQ ID NO: 712948 - RNA, 21 nt, Human
ggcaacagauauuuugcuuag

SEQ ID NO: 712949 - RNA, 22 nt, Human
gcaggcaccacggcucaggucu

SEQ ID NO: 712950 - RNA, 22 nt, Human
cuagaaaugcucaagagaaagu

SEQ ID NO: 712951 - RNA, 22 nt, Human
acucucagggcuccagggaaag

SEQ ID NO: 712952 - RNA, 22 nt, Human
aagcauaacuugcugcacauag

SEQ ID NO: 712953 - RNA, 19 nt, Human
guguacagcucagugaauu

SEQ ID NO: 712954 - RNA, 22 nt, Human
ccuuuuauacucuguccucugg

SEQ ID NO: 712955 - RNA, 22 nt, Human
cagagccagagaccugcugugc

SEQ ID NO: 712956 - RNA, 19 nt, Human
ucccaggaagcaaauguca

SEQ ID NO: 712957 - RNA, 22 nt, Human
cagagugggcugucagccacca

SEQ ID NO: 712958 - RNA, 22 nt, Human
gucaucuucgcagagugauuuu

SEQ ID NO: 712959 - RNA, 22 nt, Human
agaagaacuuagcuuucuaucu

SEQ ID NO: 712960 - RNA, 22 nt, Human
acugucuccucaucaugccugg

SEQ ID NO: 712961 - RNA, 22 nt, Human
auucaauaaauaugcuacaugg

SEQ ID NO: 712962 - RNA, 22 nt, Human
auuguaaguagaaauguuaugg

SEQ ID NO: 712963 - RNA, 22 nt, Human
cuugggugugaccuuggcauug

SEQ ID NO: 712964 - RNA, 20 nt, Human
cccagggaccugagcuccau

SEQ ID NO: 712965 - RNA, 21 nt, Human
aaaauguagacuuuucccuga

SEQ ID NO: 712966 - RNA, 22 nt, Human
cuaaauaaucccucuggucuua

SEQ ID NO: 712967 - RNA, 22 nt, Human
agcuggguggugcugagccuug

SEQ ID NO: 712968 - RNA, 22 nt, Human
gcugaauaggacugucaucucu

SEQ ID NO: 712969 - RNA, 22 nt, Human
ugggugggagcacccugucugg

SEQ ID NO: 712970 - RNA, 22 nt, Human
uuugaaguccaucuggcccagu

SEQ ID NO: 712971 - RNA, 22 nt, Human
guuauaaaaugcacaguuguuu

SEQ ID NO: 712972 - RNA, 19 nt, Human
uuacaucugcaacacuggu

SEQ ID NO: 712973 - RNA, 22 nt, Human
gccucaguugaucugugugagc

SEQ ID NO: 712974 - RNA, 22 nt, Human
caggcccugggcaggcacagag

SEQ ID NO: 712975 - RNA, 22 nt, Human
ucauuuauaaggaugcaauuaa

SEQ ID NO: 712976 - RNA, 22 nt, Human
uucuggcuuuaggcuuuucaag

SEQ ID NO: 712977 - RNA, 22 nt, Human
guggccagagugucauuuuauu

SEQ ID NO: 712978 - RNA, 22 nt, Human
agaaggcacucacacuggcacg

SEQ ID NO: 712979 - RNA, 22 nt, Human
uuucaaaguaaggauuuucauc

SEQ ID NO: 712980 - RNA, 18 nt, Human
uuuccaagaagagagcuc

SEQ ID NO: 712981 - RNA, 22 nt, Human
cuccuguggcuuucugauuuca

SEQ ID NO: 712982 - RNA, 22 nt, Human
aguguuagauucuuacucaguu

SEQ ID NO: 712983 - RNA, 22 nt, Human
gggggugguucuaaguccuaua

SEQ ID NO: 712984 - RNA, 22 nt, Human
gcaguucuacuuauccauagac

SEQ ID NO: 712985 - RNA, 20 nt, Human
cccugagacgacugagcucc

SEQ ID NO: 712986 - RNA, 17 nt, Human
aggagcuggggguggug

SEQ ID NO: 712987 - RNA, 22 nt, Human
cacacauugguuuuacuccuuu

SEQ ID NO: 712988 - RNA, 22 nt, Human
uuucucagucacaugaaccaau

SEQ ID NO: 712989 - RNA, 22 nt, Human
uacaauuuaguggugugugguu

SEQ ID NO: 712990 - RNA, 22 nt, Human
uguuaaacagcugucuucuuca

SEQ ID NO: 712991 - RNA, 22 nt, Human
uaacuguacaacugguuaguca

SEQ ID NO: 712992 - RNA, 22 nt, Human
uacauugugauguuucaauaca

SEQ ID NO: 712993 - RNA, 22 nt, Human
aguggcugauuacaaacugagu

SEQ ID NO: 712994 - RNA, 22 nt, Human
acuacagugugauaagaggggc

SEQ ID NO: 712995 - RNA, 22 nt, Human
acagaaaaguuuacuuuugcuc

SEQ ID NO: 712996 - RNA, 22 nt, Human
cagagggcuucagguucaggau

SEQ ID NO: 712997 - RNA, 22 nt, Human
gacacaaaguuugucagaaauu

SEQ ID NO: 712998 - RNA, 22 nt, Human
ccucccuuggccauagccagcc

SEQ ID NO: 712999 - RNA, 22 nt, Human
cuucagccucaucucagcccgu

SEQ ID NO: 713000 - RNA, 22 nt, Human
ucuucacaucauguuuuuuaau

SEQ ID NO: 713001 - RNA, 21 nt, Human
gcacucagucacuacucaaga

SEQ ID NO: 713002 - RNA, 22 nt, Human
cuaguguuuauuaaucaugagg

SEQ ID NO: 713003 - RNA, 19 nt, Human
ugccuggacaaaugugggg

SEQ ID NO: 713004 - RNA, 22 nt, Human
guccagcuccagggaggcaggc

SEQ ID NO: 713005 - RNA, 22 nt, Human
ucuuuuauuaggcugaaauggg

SEQ ID NO: 713006 - RNA, 22 nt, Human
ugacagacuacugccucuauug

SEQ ID NO: 713007 - RNA, 22 nt, Human
ggagggugcauuuuacccugug

SEQ ID NO: 713008 - RNA, 22 nt, Human
caucaucuugaaugacugugau

SEQ ID NO: 713009 - RNA, 22 nt, Human
uaccugucaaaagacauggaga

SEQ ID NO: 713010 - RNA, 22 nt, Human
cugcucuccccaggccagucug

SEQ ID NO: 713011 - RNA, 22 nt, Human
ggagggacccacugcggugacc

SEQ ID NO: 713012 - RNA, 22 nt, Human
ggagccaguauuuaguggucuu

SEQ ID NO: 713013 - RNA, 22 nt, Human
uggaagauaagagauugggaag

SEQ ID NO: 713014 - RNA, 22 nt, Human
uuucacucagcucucauugucu

SEQ ID NO: 713015 - RNA, 22 nt, Human
uguagcuuuauauuguguuggg

SEQ ID NO: 713016 - RNA, 22 nt, Human
aguauaaugaaaugugucagua

SEQ ID NO: 713017 - RNA, 22 nt, Human
cuuggagugaaugggggcaggu

SEQ ID NO: 713018 - RNA, 22 nt, Human
uuuaucuggacugugauauaaa

SEQ ID NO: 713019 - RNA, 22 nt, Human
uaccauaacguaaugaacuuga

SEQ ID NO: 713020 - RNA, 22 nt, Human
uuaacauacaucaugaacaaug

SEQ ID NO: 713021 - RNA, 22 nt, Human
aaauucaguuuuaauaaucacu

SEQ ID NO: 713022 - RNA, 19 nt, Human
aauauuuuagccucuuccu

SEQ ID NO: 713023 - RNA, 22 nt, Human
gccacagcaacaauaaugcagc

SEQ ID NO: 713024 - RNA, 21 nt, Human
cuuauucacuguuauuuauca

SEQ ID NO: 713025 - RNA, 22 nt, Human
auaagaugagaucagcuuucug

SEQ ID NO: 713026 - RNA, 22 nt, Human
uuuccuugccuccuguccuucu

SEQ ID NO: 713027 - RNA, 22 nt, Human
uaugcuccaaagacauguugcc

SEQ ID NO: 713028 - RNA, 22 nt, Human
agcagccaguucucugugguag

SEQ ID NO: 713029 - RNA, 22 nt, Human
ccagaauagaaggcagcuguca

SEQ ID NO: 713030 - RNA, 22 nt, Human
caugcacaagggaugaugaaau

SEQ ID NO: 713031 - RNA, 22 nt, Human
uguguguauaauaaugucugca

SEQ ID NO: 713032 - RNA, 19 nt, Human
gcugcagaggugaagaaga

SEQ ID NO: 713033 - RNA, 22 nt, Human
caccugccugguccuuagggcu

SEQ ID NO: 713034 - RNA, 22 nt, Human
agggucuugaggaucugaacug

SEQ ID NO: 713035 - RNA, 22 nt, Human
ucaguguuuccugugguacagc

SEQ ID NO: 713036 - RNA, 20 nt, Human
gagcugugcucucaggagcc

SEQ ID NO: 713037 - RNA, 22 nt, Human
ucugggaggucacauuggucuu

SEQ ID NO: 713038 - RNA, 22 nt, Human
ugacuuccugcacucaggugau

SEQ ID NO: 713039 - RNA, 22 nt, Human
gggcuggagccuggcggugguu

SEQ ID NO: 713040 - RNA, 22 nt, Human
cugaggcugggcauggggucca

SEQ ID NO: 713041 - RNA, 22 nt, Human
uacaaaguuugggguccucaaa

SEQ ID NO: 713042 - RNA, 22 nt, Human
aauuaauucaguuuuuaaggga

SEQ ID NO: 713043 - RNA, 22 nt, Human
ucugagcuccaugcaggaggcu

SEQ ID NO: 713044 - RNA, 22 nt, Human
cuguggaaucaucaggucuuac

SEQ ID NO: 713045 - RNA, 22 nt, Human
acauguacauacacauauguaa

SEQ ID NO: 713046 - RNA, 22 nt, Human
cugugcaguggggcucuggguu

SEQ ID NO: 713047 - RNA, 20 nt, Human
acauguacuaaugaauacag

SEQ ID NO: 713048 - RNA, 22 nt, Human
guacuuccagccaagugagaca

SEQ ID NO: 713049 - RNA, 22 nt, Human
uccuccagcccucuaggaaaau

SEQ ID NO: 713050 - RNA, 22 nt, Human
gcuggcugcuaggacagcuaca

SEQ ID NO: 713051 - RNA, 22 nt, Human
aagcaggcuugguguggccgcu

SEQ ID NO: 713052 - RNA, 22 nt, Human
aucaggaugacuauaaggcugc

SEQ ID NO: 713053 - RNA, 22 nt, Human
auuucuguuauaccuuucucag

SEQ ID NO: 713054 - RNA, 22 nt, Human
aguguauugauuggaacagccu

SEQ ID NO: 713055 - RNA, 22 nt, Human
uauucauguguuggaaaggaac

SEQ ID NO: 713056 - RNA, 22 nt, Human
gagugugggucucagcuuuaag

SEQ ID NO: 713057 - RNA, 22 nt, Human
caacuauagggagagugguuaa

SEQ ID NO: 713058 - RNA, 22 nt, Human
gugugagugaaaguaguuugau

SEQ ID NO: 713059 - RNA, 22 nt, Human
ugcuggaacuuagcaugcucuc

SEQ ID NO: 713060 - RNA, 23 nt, Human
uggucugaagccucagguuccuc

SEQ ID NO: 713061 - RNA, 22 nt, Human
uacacauguauuuauguguaca

SEQ ID NO: 713062 - RNA, 17 nt, Human
cucuuuugucuucuucc

SEQ ID NO: 713063 - RNA, 22 nt, Human
guggcuuuauaggaagaggaac

SEQ ID NO: 713064 - RNA, 22 nt, Human
uguguggcguugcguggcuagg

SEQ ID NO: 713065 - RNA, 22 nt, Human
auguccagaguguccuggaaag

SEQ ID NO: 713066 - RNA, 22 nt, Human
ucccaggacaggccacauggaa

SEQ ID NO: 713067 - RNA, 22 nt, Human
aagaguuagcucaauaacuuga

SEQ ID NO: 713068 - RNA, 22 nt, Human
cugcugacucauuuucaacacu

SEQ ID NO: 713069 - RNA, 22 nt, Human
gugcacaggugggaaaaugagu

SEQ ID NO: 713070 - RNA, 22 nt, Human
uugggcagaggccaggaggaug

SEQ ID NO: 713071 - RNA, 22 nt, Human
uggccaguagauaggcaggcaa

SEQ ID NO: 713072 - RNA, 22 nt, Human
uuuguggaacucucuucuugca

SEQ ID NO: 713073 - RNA, 22 nt, Human
agcagcaucucuuauugcagug

SEQ ID NO: 713074 - RNA, 20 nt, Human
caccuggauaugacccagcu

SEQ ID NO: 713075 - RNA, 22 nt, Human
cauauaaauacaacauguguua

SEQ ID NO: 713076 - RNA, 23 nt, Human
cugggccuauggucugaauccaa

SEQ ID NO: 713077 - RNA, 22 nt, Human
cuggucugcaaggccauauaga

SEQ ID NO: 713078 - RNA, 22 nt, Human
caaauaguuuuucauguauuau

SEQ ID NO: 713079 - RNA, 22 nt, Human
aguggcuguccuggcucuaacu

SEQ ID NO: 713080 - RNA, 22 nt, Human
accagcucagaagccagaaaga

SEQ ID NO: 713081 - RNA, 22 nt, Human
gcauucauauggaaggaaacua

SEQ ID NO: 713082 - RNA, 22 nt, Human
aggacuaauuucaggggauaua

SEQ ID NO: 713083 - RNA, 23 nt, Human
gggaucuguaaguugaagacaaa

SEQ ID NO: 713084 - RNA, 22 nt, Human
gcugcccacaaccccgugucua

SEQ ID NO: 713085 - RNA, 22 nt, Human
cccagcacucagcaggcucaua

SEQ ID NO: 713086 - RNA, 22 nt, Human
aggccagcaagaaagagagucu

SEQ ID NO: 713087 - RNA, 21 nt, Human
aguggggucucuguggaggcc

SEQ ID NO: 713088 - RNA, 19 nt, Human
aaacucauagacucauauu

SEQ ID NO: 713089 - RNA, 22 nt, Human
uucucucuuacugccaugcugu

SEQ ID NO: 713090 - RNA, 22 nt, Human
ccuggcugugcauugccggccc

SEQ ID NO: 713091 - RNA, 20 nt, Human
acugcuucuuucucugaccu

SEQ ID NO: 713092 - RNA, 22 nt, Human
auguuuagucauucagcuccuu

SEQ ID NO: 713093 - RNA, 22 nt, Human
ugaccucuguccugcagucugg

SEQ ID NO: 713094 - RNA, 22 nt, Human
ugucuggaugucuggagcaucg

SEQ ID NO: 713095 - RNA, 22 nt, Human
uaagugggugaagaggaaauau

SEQ ID NO: 713096 - RNA, 22 nt, Human
ugaaagcauuagucuaagguag

SEQ ID NO: 713097 - RNA, 22 nt, Human
cuuccuggaugaagcccagcau

SEQ ID NO: 713098 - RNA, 22 nt, Human
uugauuugauuguaauggcucu

SEQ ID NO: 713099 - RNA, 22 nt, Human
aaacuugagucacuucucuucc

SEQ ID NO: 713100 - RNA, 22 nt, Human
auuaaauguuccuuaaauuaua

SEQ ID NO: 713101 - RNA, 22 nt, Human
acucugugcuggggaccucauc

SEQ ID NO: 713102 - RNA, 22 nt, Human
agcccagccggauucccaguuc

SEQ ID NO: 713103 - RNA, 22 nt, Human
ucauggauuaaauuauuaaguu

SEQ ID NO: 713104 - RNA, 22 nt, Human
agaggaagccauugcuuacuga

SEQ ID NO: 713105 - RNA, 22 nt, Human
gggaugaauugagucagaaggg

SEQ ID NO: 713106 - RNA, 22 nt, Human
cauaaaguaggcaagcauucca

SEQ ID NO: 713107 - RNA, 22 nt, Human
ccugagcagggcucugcagggc

SEQ ID NO: 713108 - RNA, 22 nt, Human
ggucugaauuccagccccucug

SEQ ID NO: 713109 - RNA, 22 nt, Human
ccugugggcuugaguguagggu

SEQ ID NO: 713110 - RNA, 22 nt, Human
ccagucuccuaagagccccuga

SEQ ID NO: 713111 - RNA, 22 nt, Human
gagaggccauggggugggaugc

SEQ ID NO: 713112 - RNA, 22 nt, Human
gggcuggaagacaggaaaugcu

SEQ ID NO: 713113 - RNA, 22 nt, Human
agggcucagggcacgucaucca

SEQ ID NO: 713114 - RNA, 22 nt, Human
ccucugggcggagaucugcugc

SEQ ID NO: 713115 - RNA, 22 nt, Human
ccagccuucugggacucucauc

SEQ ID NO: 713116 - RNA, 21 nt, Human
ucucuggcgguguuuggcucc

SEQ ID NO: 713117 - RNA, 22 nt, Human
acaugauuaaaagauuuuaaag

SEQ ID NO: 713118 - RNA, 22 nt, Human
aguguguacauaauuguacgcc

SEQ ID NO: 713119 - RNA, 22 nt, Human
ggcuggcgggugggugaaagac

SEQ ID NO: 713120 - RNA, 22 nt, Human
ugcaguggaagagguggagauc

SEQ ID NO: 713121 - RNA, 22 nt, Human
uugaggaaaggaauuuauuuua

SEQ ID NO: 713122 - RNA, 22 nt, Human
aggccagaugucgggcuagaag

SEQ ID NO: 713123 - RNA, 22 nt, Human
uuauuauggcaguuuucuaggu

SEQ ID NO: 713124 - RNA, 22 nt, Human
uucuucugaaacauaaucaaua

SEQ ID NO: 713125 - RNA, 22 nt, Human
acuuccaggaggugucacugaa

SEQ ID NO: 713126 - RNA, 23 nt, Human
aaagaugugaguauucauauggc

SEQ ID NO: 713127 - RNA, 22 nt, Human
ggagccugggcauuaguaauuu

SEQ ID NO: 713128 - RNA, 22 nt, Human
aauaucugucucuaaugcauau

SEQ ID NO: 713129 - RNA, 22 nt, Human
aacaucugggcccugauuuugg

SEQ ID NO: 713130 - RNA, 22 nt, Human
ccaucagcaugggagcaugggc

SEQ ID NO: 713131 - RNA, 22 nt, Human
ccuccacugcuucccagcuuug

SEQ ID NO: 713132 - RNA, 22 nt, Human
cucuggcucugacaguugaucc

SEQ ID NO: 713133 - RNA, 22 nt, Human
cccaggcugguccugaacuccu

SEQ ID NO: 713134 - RNA, 22 nt, Human
agccuggcccugcugaacucug

SEQ ID NO: 713135 - RNA, 22 nt, Human
caaccucauagaaagaaaaugu

SEQ ID NO: 713136 - RNA, 22 nt, Human
ugggccugacucaccugccucc

SEQ ID NO: 713137 - RNA, 22 nt, Human
accagggcccgggagagcucuc

SEQ ID NO: 713138 - RNA, 22 nt, Human
caauguuugaguaggagcauaa

SEQ ID NO: 713139 - RNA, 21 nt, Human
agccagcaacacagcaucucc

SEQ ID NO: 713140 - RNA, 22 nt, Human
ucucagaauuguguccacuggg

SEQ ID NO: 713141 - RNA, 19 nt, Human
aacaucauggcucuuucca

SEQ ID NO: 713142 - RNA, 20 nt, Human
cuaaccuuaaccaucaccag

SEQ ID NO: 713143 - RNA, 22 nt, Human
uuccagagaguuauuccccugg

SEQ ID NO: 713144 - RNA, 22 nt, Human
aaguuacagucagagguuaaca

SEQ ID NO: 713145 - RNA, 22 nt, Human
gcuuuuauugucuuuacgacga

SEQ ID NO: 713146 - RNA, 22 nt, Human
uaauuacagguccaaaacaauc

SEQ ID NO: 713147 - RNA, 22 nt, Human
aggcugagccacggggcuggcu

SEQ ID NO: 713148 - RNA, 22 nt, Human
ucccagggugaaaugcaguagg

SEQ ID NO: 713149 - RNA, 22 nt, Human
uauagaaguaagcauugugaug

SEQ ID NO: 713150 - RNA, 22 nt, Human
uccagcccuccugggaucacag

SEQ ID NO: 713151 - RNA, 22 nt, Human
gggcacagagggucuugaagaa

SEQ ID NO: 713152 - RNA, 22 nt, Human
ugguuuaccccuguccuauauc

SEQ ID NO: 713153 - RNA, 22 nt, Human
aagggugguguaggagaucaaa

SEQ ID NO: 713154 - RNA, 22 nt, Human
cugaagaggacgcagcagcaag

SEQ ID NO: 713155 - RNA, 22 nt, Human
agagaagcauucuucucagggc

SEQ ID NO: 713156 - RNA, 22 nt, Human
uacauuagcucaucuauuuauu

SEQ ID NO: 713157 - RNA, 22 nt, Human
gcaggcugaguugggaaaccaa

SEQ ID NO: 713158 - RNA, 22 nt, Human
uucugagccucauucaugaggc

SEQ ID NO: 713159 - RNA, 22 nt, Human
agccaccucugugcaggccucg

SEQ ID NO: 713160 - RNA, 22 nt, Human
ucucagagauuuauggaaaacu

SEQ ID NO: 713161 - RNA, 22 nt, Human
ucagcccugaggacagaggcag

SEQ ID NO: 713162 - RNA, 22 nt, Human
caaggaaguuuuaggagaggaa

SEQ ID NO: 713163 - RNA, 22 nt, Human
ugcagaagcugcaggucagugg

SEQ ID NO: 713164 - RNA, 22 nt, Human
ccuacaguuauauucuugauug

SEQ ID NO: 713165 - RNA, 22 nt, Human
cucucuuugauguauaaauaau

SEQ ID NO: 713166 - RNA, 22 nt, Human
aaaguuuuagaacuaggaagca

SEQ ID NO: 713167 - RNA, 17 nt, Human
cagaaggaagcauggca

SEQ ID NO: 713168 - RNA, 22 nt, Human
guuguacaggcagggaaacuga

SEQ ID NO: 713169 - RNA, 22 nt, Human
gggucaagccguugcccaaggc

SEQ ID NO: 713170 - RNA, 22 nt, Human
uuucacauagaaagugauuuac

SEQ ID NO: 713171 - RNA, 22 nt, Human
uuuaaaguuuuugcacauucug

SEQ ID NO: 713172 - RNA, 22 nt, Human
aacugcauaauauaucaugcag

SEQ ID NO: 713173 - RNA, 22 nt, Human
cauucauauuugcaguauaccu

SEQ ID NO: 713174 - RNA, 22 nt, Human
auccaugaagguacuucucagg

SEQ ID NO: 713175 - RNA, 22 nt, Human
cuccacagguguacuguaccuu

SEQ ID NO: 713176 - RNA, 22 nt, Human
cccugccaaucccgucucucug

SEQ ID NO: 713177 - RNA, 22 nt, Human
gaagugaagguuacucuagauu

SEQ ID NO: 713178 - RNA, 22 nt, Human
ccugcagguaaggcuaacugcc

SEQ ID NO: 713179 - RNA, 21 nt, Human
ucucugagacacucuggagcc

SEQ ID NO: 713180 - RNA, 22 nt, Human
auugcuuacuaaucaucuucag

SEQ ID NO: 713181 - RNA, 22 nt, Human
aagggaggggauguaagccugg

SEQ ID NO: 713182 - RNA, 22 nt, Human
auggaagaacgcucaggguuac

SEQ ID NO: 713183 - RNA, 22 nt, Human
gcccucuguuauugcauccuua

SEQ ID NO: 713184 - RNA, 22 nt, Human
ggccugcuucucagugagcuug

SEQ ID NO: 713185 - RNA, 22 nt, Human
uaaaagacccucuagaguccca

SEQ ID NO: 713186 - RNA, 22 nt, Human
uauagugugugagagagugaaa

SEQ ID NO: 713187 - RNA, 23 nt, Human
gccugggacucaggaggagcuca

SEQ ID NO: 713188 - RNA, 22 nt, Human
ucauuuuuagcgcgcaaaaguu

SEQ ID NO: 713189 - RNA, 21 nt, Human
uuucgcauguguuaacuguga

SEQ ID NO: 713190 - RNA, 21 nt, Human
acacagaggcaucaucacuuu

SEQ ID NO: 713191 - RNA, 22 nt, Human
acucuuugucuguugccgcuua

SEQ ID NO: 713192 - RNA, 22 nt, Human
gcagcccagagcgcaggacccc

SEQ ID NO: 713193 - RNA, 22 nt, Human
gagaacacuuauggauuauucu

SEQ ID NO: 713194 - RNA, 20 nt, Human
uccucagaagacauuugggg

SEQ ID NO: 713195 - RNA, 22 nt, Human
gagagggcaaacuuguagcuaa

SEQ ID NO: 713196 - RNA, 21 nt, Human
uuugaaagcuacaucuauagc

SEQ ID NO: 713197 - RNA, 22 nt, Human
aaagagcacccucaaugucuga

SEQ ID NO: 713198 - RNA, 22 nt, Human
auguuaccuuguucuccaaaaa

SEQ ID NO: 713199 - RNA, 22 nt, Human
agugcacuggcaccaucucagc

SEQ ID NO: 713200 - RNA, 21 nt, Human
acuccaaacaaguuaagcugu

SEQ ID NO: 713201 - RNA, 22 nt, Human
ggugacuggagggacccaggcc

SEQ ID NO: 713202 - RNA, 22 nt, Human
uaaauuagggacuuuaguuaau

SEQ ID NO: 713203 - RNA, 22 nt, Human
gcagcuggauuucaagagggag

SEQ ID NO: 713204 - RNA, 22 nt, Human
aaucaggacccacucuacaguu

SEQ ID NO: 713205 - RNA, 22 nt, Human
aacuuuggcaagucagacuucu

SEQ ID NO: 713206 - RNA, 22 nt, Human
gccaggugagaggacugaggcu

SEQ ID NO: 713207 - RNA, 22 nt, Human
ugagcccuugacaucgcccacu

SEQ ID NO: 713208 - RNA, 22 nt, Human
uucaaaccuucacuugcagagu

SEQ ID NO: 713209 - RNA, 22 nt, Human
gccuauuuuauuaugcauguaa

SEQ ID NO: 713210 - RNA, 22 nt, Human
aguuucagaauuuaugcagaca

SEQ ID NO: 713211 - RNA, 22 nt, Human
auguaucaacaaauuguacagu

SEQ ID NO: 713212 - RNA, 22 nt, Human
ggcccagcugggcggggacacg

SEQ ID NO: 713213 - RNA, 22 nt, Human
agcuagccauguggcuccugug

SEQ ID NO: 713214 - RNA, 22 nt, Human
cuuuuuuaagguagcuccuccu

SEQ ID NO: 713215 - RNA, 22 nt, Human
gagcaggcucugccuguguguc

SEQ ID NO: 713216 - RNA, 22 nt, Human
aguggaggcacuaauuggauuu

SEQ ID NO: 713217 - RNA, 22 nt, Human
uggaggagaauuuauggucgaa

SEQ ID NO: 713218 - RNA, 22 nt, Human
ccuggggaaaagcaggcauuua

SEQ ID NO: 713219 - RNA, 22 nt, Human
ccugaggucagcgguucccaca

SEQ ID NO: 713220 - RNA, 22 nt, Human
uaucuguucaauggaagaugac

SEQ ID NO: 713221 - RNA, 22 nt, Human
cugucauuuaagacauucugga

SEQ ID NO: 713222 - RNA, 22 nt, Human
aaggcucugcaaaaccuccaag

SEQ ID NO: 713223 - RNA, 22 nt, Human
cacagaaaaaggcuugaaaauc

SEQ ID NO: 713224 - RNA, 22 nt, Human
uaacacauauuucaagaguagu

SEQ ID NO: 713225 - RNA, 22 nt, Human
aggguuaauugguguccugagg

SEQ ID NO: 713226 - RNA, 22 nt, Human
aaauguggguaaugggacugga

SEQ ID NO: 713227 - RNA, 22 nt, Human
aguucauggaagauucaaugga

SEQ ID NO: 713228 - RNA, 22 nt, Human
caggccaauaaaugugauggcc

SEQ ID NO: 713229 - RNA, 22 nt, Human
acaucuguuugagaaaaagaag

SEQ ID NO: 713230 - RNA, 22 nt, Human
uaacacauaagcugagaccaug

SEQ ID NO: 713231 - RNA, 22 nt, Human
uuuuaaaggcagauuauggcuu

SEQ ID NO: 713232 - RNA, 22 nt, Human
aaaaccacaauuacuuuugcac

SEQ ID NO: 713233 - RNA, 22 nt, Human
uugaggucccugccuugccuuc

SEQ ID NO: 713234 - RNA, 22 nt, Human
auuauguagcuaaaaauugugu

SEQ ID NO: 713235 - RNA, 22 nt, Human
aguccguggccagacucaagag

SEQ ID NO: 713236 - RNA, 22 nt, Human
auaguugagaucagauucaacu

SEQ ID NO: 713237 - RNA, 22 nt, Human
uccuggagaauccugccaccug

SEQ ID NO: 713238 - RNA, 23 nt, Human
agaggcaggaguggcuugcccgg

SEQ ID NO: 713239 - RNA, 22 nt, Human
uuagaucaauacuaaagaaguu

SEQ ID NO: 713240 - RNA, 22 nt, Human
ggcugcagagcugggugggccu

SEQ ID NO: 713241 - RNA, 18 nt, Human
uccaggcuggauugauga

SEQ ID NO: 713242 - RNA, 22 nt, Human
acuuaaaaccagacagcgucau

SEQ ID NO: 713243 - RNA, 22 nt, Human
gauugcuugauacccagucaau

SEQ ID NO: 713244 - RNA, 22 nt, Human
cagauuacuuuguagcagucag

SEQ ID NO: 713245 - RNA, 22 nt, Human
agauuuccugcacugccuuuga

SEQ ID NO: 713246 - RNA, 21 nt, Human
acuggaagugggucaggaagu

SEQ ID NO: 713247 - RNA, 22 nt, Human
gcugaggaagucagguggccca

SEQ ID NO: 713248 - RNA, 22 nt, Human
aggccaguguggcuggagcaca

SEQ ID NO: 713249 - RNA, 22 nt, Human
agcugggacucaacugucuggg

SEQ ID NO: 713250 - RNA, 22 nt, Human
ugcaggaggccccauggaaccg

SEQ ID NO: 713251 - RNA, 22 nt, Human
uuaaagcccagcauauacuagg

SEQ ID NO: 713252 - RNA, 22 nt, Human
acuguauuuuggguguauuuuc

SEQ ID NO: 713253 - RNA, 22 nt, Human
uuaacacauauuuaucaauugc

SEQ ID NO: 713254 - RNA, 22 nt, Human
gacaauaaagugauacauggga

SEQ ID NO: 713255 - RNA, 19 nt, Human
gaauuuuaggacuucagca

SEQ ID NO: 713256 - RNA, 22 nt, Human
aagcacagaccagaucuccagg

SEQ ID NO: 713257 - RNA, 22 nt, Human
gcugugagcugccugugucaca

SEQ ID NO: 713258 - RNA, 22 nt, Human
ugcuuuauucccuucugaugug

SEQ ID NO: 713259 - RNA, 22 nt, Human
acaugcaagcagccgugcagau

SEQ ID NO: 713260 - RNA, 22 nt, Human
uuucuuuugaauaguguguggu

SEQ ID NO: 713261 - RNA, 22 nt, Human
guggauuacaagacaguugaga

SEQ ID NO: 713262 - RNA, 22 nt, Human
agugcaugccuuccuguggaug

SEQ ID NO: 713263 - RNA, 22 nt, Human
agacggauuaccugaggucagg

SEQ ID NO: 713264 - RNA, 19 nt, Human
aggugcaggucacagggga

SEQ ID NO: 713265 - RNA, 22 nt, Human
auggcagacacaggcaggcaga

SEQ ID NO: 713266 - RNA, 22 nt, Human
ugagcuggagucgugagcaaag

SEQ ID NO: 713267 - RNA, 22 nt, Human
aguaaaucagaccucauuaugu

SEQ ID NO: 713268 - RNA, 22 nt, Human
ucucuggcuggcaccccaggga

SEQ ID NO: 713269 - RNA, 22 nt, Human
caggguugcaugcaucuguggg

SEQ ID NO: 713270 - RNA, 22 nt, Human
ccucacuggccagccaggggug

SEQ ID NO: 713271 - RNA, 22 nt, Human
ucaggcuuugcucuguugauuu

SEQ ID NO: 713272 - RNA, 22 nt, Human
gaauguuucauguguauguuag

SEQ ID NO: 713273 - RNA, 22 nt, Human
cugggaagaaauugugggaggc

SEQ ID NO: 713274 - RNA, 22 nt, Human
ucugcugucacucauuugcuuc

SEQ ID NO: 713275 - RNA, 22 nt, Human
gaggcccugaagacagcugggg

SEQ ID NO: 713276 - RNA, 22 nt, Human
uuccccuugauaaugcaguaag

SEQ ID NO: 713277 - RNA, 22 nt, Human
cuggccaacuugcuuguuggca

SEQ ID NO: 713278 - RNA, 22 nt, Human
cugggcugccagguaggcacac

SEQ ID NO: 713279 - RNA, 22 nt, Human
ugugacuggaguccagcccacu

SEQ ID NO: 713280 - RNA, 22 nt, Human
aggcugaggcagguggaucacu

SEQ ID NO: 713281 - RNA, 22 nt, Human
uuaaaagucugaugauuuacau

SEQ ID NO: 713282 - RNA, 22 nt, Human
uagaggcaaccaguguugagaa

SEQ ID NO: 713283 - RNA, 22 nt, Human
ccuccccugcucagaacucugg

SEQ ID NO: 713284 - RNA, 22 nt, Human
agacauuuccuagacaucaaug

SEQ ID NO: 713285 - RNA, 22 nt, Human
ucaggacagccagggugcagac

SEQ ID NO: 713286 - RNA, 22 nt, Human
uggcugcagaucaagggcaggc

SEQ ID NO: 713287 - RNA, 22 nt, Human
gagggaaagguuaauacaugau

SEQ ID NO: 713288 - RNA, 22 nt, Human
uuggcccuagaugauuaaguug

SEQ ID NO: 713289 - RNA, 22 nt, Human
aagcaucucauucuugccuguc

SEQ ID NO: 713290 - RNA, 22 nt, Human
auccaggcuggguguggcuacu

SEQ ID NO: 713291 - RNA, 22 nt, Human
augauucagcaauuuuauaucu

SEQ ID NO: 713292 - RNA, 22 nt, Human
ugguuuggguaguuauuauuau

SEQ ID NO: 713293 - RNA, 22 nt, Human
uaaauucuacaacuucaaagau

SEQ ID NO: 713294 - RNA, 22 nt, Human
uuucaucuucccagagaccuug

SEQ ID NO: 713295 - RNA, 21 nt, Human
gcagagaaugaacuuuggcuu

SEQ ID NO: 713296 - RNA, 22 nt, Human
aaguuuaguagggacagaugga

SEQ ID NO: 713297 - RNA, 22 nt, Human
uaaaugcagcaguuucuguucu

SEQ ID NO: 713298 - RNA, 22 nt, Human
agguuuucacaggaaguauguu

SEQ ID NO: 713299 - RNA, 22 nt, Human
cucaagucugauggguuagguu

SEQ ID NO: 713300 - RNA, 21 nt, Human
acuguuaagacguagcugggg

SEQ ID NO: 713301 - RNA, 22 nt, Human
caguagugaaaagcagcccagc

SEQ ID NO: 713302 - RNA, 22 nt, Human
uuuacuguguccaucugugacu

SEQ ID NO: 713303 - RNA, 22 nt, Human
gacccuggcagguagccucaca

SEQ ID NO: 713304 - RNA, 22 nt, Human
aaauacagaguugcuuaaaagc

SEQ ID NO: 713305 - RNA, 22 nt, Human
agucacaauaccgugugucagu

SEQ ID NO: 713306 - RNA, 22 nt, Human
uuaagcauggaagugaaauaau

SEQ ID NO: 713307 - RNA, 22 nt, Human
aguucugcaugaaaaaggacua

SEQ ID NO: 713308 - RNA, 19 nt, Human
gaaaggcugcugcuaccug

SEQ ID NO: 713309 - RNA, 22 nt, Human
uccuggaguuuguggugauaug

SEQ ID NO: 713310 - RNA, 22 nt, Human
ucucugguuauuaacuaacucc

SEQ ID NO: 713311 - RNA, 22 nt, Human
aaugugaaaccgcacagaauaa

SEQ ID NO: 713312 - RNA, 22 nt, Human
uggacucagugcugccauuccc

SEQ ID NO: 713313 - RNA, 22 nt, Human
ucaaagucucugcuucuguaac

SEQ ID NO: 713314 - RNA, 22 nt, Human
aauaauacuucguaaaguuguu

SEQ ID NO: 713315 - RNA, 22 nt, Human
ugaagaggccaaacuaucauug

SEQ ID NO: 713316 - RNA, 18 nt, Human
caugucugcgccacaagg

SEQ ID NO: 713317 - RNA, 22 nt, Human
gccagaaagaggaggaccuggg

SEQ ID NO: 713318 - RNA, 22 nt, Human
gggacuggaguagaggccggug

SEQ ID NO: 713319 - RNA, 22 nt, Human
caagacaugcaauugccacuuu

SEQ ID NO: 713320 - RNA, 22 nt, Human
acuaauuguauaguugauguaa

SEQ ID NO: 713321 - RNA, 22 nt, Human
cugccuggaaugccagcuucuc

SEQ ID NO: 713322 - RNA, 22 nt, Human
guccugggaggggcugguccug

SEQ ID NO: 713323 - RNA, 22 nt, Human
aagaaugucucuggugaggcgc

SEQ ID NO: 713324 - RNA, 22 nt, Human
agaggaauuucuggaaggaggc

SEQ ID NO: 713325 - RNA, 22 nt, Human
uaggacagagcugguuacaaug

SEQ ID NO: 713326 - RNA, 22 nt, Human
uguuaaaccaguuuugcaucau

SEQ ID NO: 713327 - RNA, 22 nt, Human
aaacacagggauauauauucca

SEQ ID NO: 713328 - RNA, 22 nt, Human
auguaacugaaggaaaugcaug

SEQ ID NO: 713329 - RNA, 22 nt, Human
ugaggcucagaaauguaaguuu

SEQ ID NO: 713330 - RNA, 22 nt, Human
cacugacuccaaaaauaaagaa

SEQ ID NO: 713331 - RNA, 22 nt, Human
uacagaaauugccaccagcucu

SEQ ID NO: 713332 - RNA, 23 nt, Human
agcaggaaaccgagggugauguu

SEQ ID NO: 713333 - RNA, 22 nt, Human
gcuucuauuauuuggagcugag

SEQ ID NO: 713334 - RNA, 22 nt, Human
uugcauugaaugcacauuuuua

SEQ ID NO: 713335 - RNA, 22 nt, Human
ccucuugccaaucagcuacaga

SEQ ID NO: 713336 - RNA, 22 nt, Human
agcaugcacaugacuggcuuaa

SEQ ID NO: 713337 - RNA, 22 nt, Human
ucugugcuuucccugccuucuu

SEQ ID NO: 713338 - RNA, 22 nt, Human
cuccagguuacuuagccuagcu

SEQ ID NO: 713339 - RNA, 22 nt, Human
aucucauaaacacacauauaug

SEQ ID NO: 713340 - RNA, 22 nt, Human
gcagaaacuuggagaagccagg

SEQ ID NO: 713341 - RNA, 22 nt, Human
uagugcuuaaaaguggaagaga

SEQ ID NO: 713342 - RNA, 22 nt, Human
guguguggaaaguuuuccaugg

SEQ ID NO: 713343 - RNA, 20 nt, Human
cgcauaguuuccaucauucc

SEQ ID NO: 713344 - RNA, 22 nt, Human
caaaaguaauugugguuuuugc

SEQ ID NO: 713345 - RNA, 22 nt, Human
gugcuuccuccuuaaacuguca

SEQ ID NO: 713346 - RNA, 22 nt, Human
auguguaugauaccuuugcuga

SEQ ID NO: 713347 - RNA, 22 nt, Human
uauacagugccucuuccauuag

SEQ ID NO: 713348 - RNA, 22 nt, Human
gagcaucugaugagauuggauu

SEQ ID NO: 713349 - RNA, 21 nt, Human
gcuuuagauuuagugagccag

SEQ ID NO: 713350 - RNA, 22 nt, Human
agggcaaggguugaagauaaga

SEQ ID NO: 713351 - RNA, 22 nt, Human
uucuaaucugggcuucugcagu

SEQ ID NO: 713352 - RNA, 21 nt, Human
agcacagcuuuaagccaugug

SEQ ID NO: 713353 - RNA, 22 nt, Human
uacacagauuuaaaagcaggga

SEQ ID NO: 713354 - RNA, 22 nt, Human
gcucugggugaacuuggagcaa

SEQ ID NO: 713355 - RNA, 22 nt, Human
ucugauaucgcacuaaacucug

SEQ ID NO: 713356 - RNA, 22 nt, Human
agguucgggcacuuacaaaugg

SEQ ID NO: 713357 - RNA, 22 nt, Human
aguggcagguguguaguauccc

SEQ ID NO: 713358 - RNA, 22 nt, Human
uucucuacuugagauuuuaaug

SEQ ID NO: 713359 - RNA, 22 nt, Human
uuuaaaugcuuuaagcaagggu

SEQ ID NO: 713360 - RNA, 22 nt, Human
uguguccauucaggcacugacc

SEQ ID NO: 713361 - RNA, 22 nt, Human
cucuuuaagcuccuaacagcca

SEQ ID NO: 713362 - RNA, 22 nt, Human
uccuuggaggucaacgggacgg

SEQ ID NO: 713363 - RNA, 22 nt, Human
augcccugggagugcuguacca

SEQ ID NO: 713364 - RNA, 22 nt, Human
uccagcuguaguggauuugaga

SEQ ID NO: 713365 - RNA, 22 nt, Human
uccuuggagguguucaucugcc

SEQ ID NO: 713366 - RNA, 22 nt, Human
acuggcucagaguuccuagaga

SEQ ID NO: 713367 - RNA, 22 nt, Human
gaaacagcacguuuggagagau

SEQ ID NO: 713368 - RNA, 22 nt, Human
gaggccuggucuaugagauguu

SEQ ID NO: 713369 - RNA, 14 nt, Human
uccagagcuuuccg

SEQ ID NO: 713370 - RNA, 22 nt, Human
acuucaugaacauguggccugu

SEQ ID NO: 713371 - RNA, 22 nt, Human
uucaaacaaaacuguucccaua

SEQ ID NO: 713372 - RNA, 22 nt, Human
auuccuugcucucaucaaccuu

SEQ ID NO: 713373 - RNA, 22 nt, Human
aaggccaccaccagcgaggggg

SEQ ID NO: 713374 - RNA, 22 nt, Human
auucauuccaggucagucagac

SEQ ID NO: 713375 - RNA, 22 nt, Human
auacaaguugcccaaaugauua

SEQ ID NO: 713376 - RNA, 22 nt, Human
guuuuccugaaacugauggugu

SEQ ID NO: 713377 - RNA, 22 nt, Human
agcugcccugguaagauugaug

SEQ ID NO: 713378 - RNA, 20 nt, Human
ucaauuuucuacaacauuug

SEQ ID NO: 713379 - RNA, 22 nt, Human
ugcucuagccuguaaaacauga

SEQ ID NO: 713380 - RNA, 22 nt, Human
ucacuguuuccuguacuggaca

SEQ ID NO: 713381 - RNA, 22 nt, Human
uuugcauuugcaaauaaugaaa

SEQ ID NO: 713382 - RNA, 22 nt, Human
ccugggcaacauagggagaccc

SEQ ID NO: 713383 - RNA, 22 nt, Human
gggcagcuagcccucuagccca

SEQ ID NO: 713384 - RNA, 22 nt, Human
ucauuuaauaauuuuugaguag

SEQ ID NO: 713385 - RNA, 22 nt, Human
cuguacucaagguaaaccagga

SEQ ID NO: 713386 - RNA, 22 nt, Human
ccucggagaaaggcagcuccac

SEQ ID NO: 713387 - RNA, 22 nt, Human
gauuucagggugcagaugauga

SEQ ID NO: 713388 - RNA, 22 nt, Human
aaagcagcaaauacuuuugcac

SEQ ID NO: 713389 - RNA, 22 nt, Human
caggagcuggauaggaccacaa

SEQ ID NO: 713390 - RNA, 22 nt, Human
ucuccacuauuuucuagcucuu

SEQ ID NO: 713391 - RNA, 22 nt, Human
acuuggccuuauuuccacagaa

SEQ ID NO: 713392 - RNA, 22 nt, Human
augauggagguguccuggauuu

SEQ ID NO: 713393 - RNA, 22 nt, Human
ucuucuucccaucccucaaaug

SEQ ID NO: 713394 - RNA, 22 nt, Human
aagcacagaugcaagggggacc

SEQ ID NO: 713395 - RNA, 22 nt, Human
gggugggacugaagucugaggg

SEQ ID NO: 713396 - RNA, 22 nt, Human
gaaagagaaccugggccuagau

SEQ ID NO: 713397 - RNA, 22 nt, Human
ucuuggaacccuaugugauuuc

SEQ ID NO: 713398 - RNA, 19 nt, Human
gugggccaggcagaaggcu

SEQ ID NO: 713399 - RNA, 22 nt, Human
cgugugcgugcauaugcacaag

SEQ ID NO: 713400 - RNA, 22 nt, Human
agaggcuggguacgggccaccu

SEQ ID NO: 713401 - RNA, 22 nt, Human
ugaacauuggcacaaggcagca

SEQ ID NO: 713402 - RNA, 22 nt, Human
uguaaggugcucauguauuucu

SEQ ID NO: 713403 - RNA, 22 nt, Human
ucacagaaacagaauggcacag

SEQ ID NO: 713404 - RNA, 20 nt, Human
auggaggaagggcaagagaa

SEQ ID NO: 713405 - RNA, 18 nt, Human
ccaauguuggccccaagg

SEQ ID NO: 713406 - RNA, 22 nt, Human
cccaggagguggagguugcagu

SEQ ID NO: 713407 - RNA, 22 nt, Human
cuccuggcacugucuugaccca

SEQ ID NO: 713408 - RNA, 22 nt, Human
gcaguggggcgcugggaguugg

SEQ ID NO: 713409 - RNA, 22 nt, Human
ccugugggcccuggacagagac

SEQ ID NO: 713410 - RNA, 23 nt, Human
uuuaacauuugaacauguggcca

SEQ ID NO: 713411 - RNA, 22 nt, Human
agcaguggaccucagugcuauu

SEQ ID NO: 713412 - RNA, 22 nt, Human
ugggugguuuaugaguggguuu

SEQ ID NO: 713413 - RNA, 22 nt, Human
ggcaggguaaaccgagguaagu

SEQ ID NO: 713414 - RNA, 22 nt, Human
uggcucaucuaucagaaagucc

SEQ ID NO: 713415 - RNA, 22 nt, Human
ucuggccuacuggaguccauga

SEQ ID NO: 713416 - RNA, 22 nt, Human
uauuggauugagacauuuuaga

SEQ ID NO: 713417 - RNA, 22 nt, Human
gcccuguguguuugcacugauu

SEQ ID NO: 713418 - RNA, 22 nt, Human
auacaugugugugcauacaugu

SEQ ID NO: 713419 - RNA, 21 nt, Human
auuuacaaaacagucccuucc

SEQ ID NO: 713420 - RNA, 16 nt, Human
agggguacaguucauc

SEQ ID NO: 713421 - RNA, 22 nt, Human
ugagcagcuacuguguucaggg

SEQ ID NO: 713422 - RNA, 23 nt, Human
uaguuacauuauugucagagcug

SEQ ID NO: 713423 - RNA, 19 nt, Human
gagguucacgcgcuggaug

SEQ ID NO: 713424 - RNA, 20 nt, Human
aaacagcuaaaccagcucuc

SEQ ID NO: 713425 - RNA, 22 nt, Human
uugacuucccagacuuguguuu

SEQ ID NO: 713426 - RNA, 22 nt, Human
uccauccauguaggaagauggu

SEQ ID NO: 713427 - RNA, 22 nt, Human
gguaggaguauuuugcagcagu

SEQ ID NO: 713428 - RNA, 22 nt, Human
caggcccugccuugagggaccu

SEQ ID NO: 713429 - RNA, 22 nt, Human
uguuuauuuucaggauggauug

SEQ ID NO: 713430 - RNA, 22 nt, Human
ucacauuuguucuugaaucuaa

SEQ ID NO: 713431 - RNA, 22 nt, Human
agggaugauuucagugucugcc

SEQ ID NO: 713432 - RNA, 22 nt, Human
accagcuggcccaugagcacgu

SEQ ID NO: 713433 - RNA, 22 nt, Human
augaguguuuagaaaacacugg

SEQ ID NO: 713434 - RNA, 22 nt, Human
auguucuauaucauuauuguga

SEQ ID NO: 713435 - RNA, 19 nt, Human
gacucacaccuuccgcugu

SEQ ID NO: 713436 - RNA, 22 nt, Human
ggccugagcagacagcaugaug

SEQ ID NO: 713437 - RNA, 22 nt, Human
ugagcccucuucccauuuuauu

SEQ ID NO: 713438 - RNA, 22 nt, Human
ucuucaaauacagucauauuga

SEQ ID NO: 713439 - RNA, 22 nt, Human
uaacacacugaaggugagaugg

SEQ ID NO: 713440 - RNA, 22 nt, Human
gcacugagcaccagccacagau

SEQ ID NO: 713441 - RNA, 22 nt, Human
gggcugauucgauggggguaga

SEQ ID NO: 713442 - RNA, 22 nt, Human
aaggaucaaguggauuuucuua

SEQ ID NO: 713443 - RNA, 22 nt, Human
ggcagugacuguucagacgucc

SEQ ID NO: 713444 - RNA, 22 nt, Human
ucugaggcuauguucaggcuaa

SEQ ID NO: 713445 - RNA, 22 nt, Human
gcuaugcaggagccuaaugaca

SEQ ID NO: 713446 - RNA, 22 nt, Human
cuguucuuuaguuccacugcaa

SEQ ID NO: 713447 - RNA, 22 nt, Human
augaagauucuauuuaucacuu

SEQ ID NO: 713448 - RNA, 22 nt, Human
agccucugugacucacagguca

SEQ ID NO: 713449 - RNA, 22 nt, Human
cccugcuuucaaccuucuagcu

SEQ ID NO: 713450 - RNA, 22 nt, Human
aggccaggcaacauucugaagu

SEQ ID NO: 713451 - RNA, 22 nt, Human
cuguaggagugggaauuuauug

SEQ ID NO: 713452 - RNA, 22 nt, Human
agcugagagccccugcccugug

SEQ ID NO: 713453 - RNA, 22 nt, Human
auguccuuuuaaaaugugagaa

SEQ ID NO: 713454 - RNA, 22 nt, Human
uuugugugaaaauauuuaaguu

SEQ ID NO: 713455 - RNA, 19 nt, Human
agagaccacagagcugccu

SEQ ID NO: 713456 - RNA, 22 nt, Human
uauucaugggaggucacaacuu

SEQ ID NO: 713457 - RNA, 22 nt, Human
caggaagcuggucagauccugu

SEQ ID NO: 713458 - RNA, 22 nt, Human
cagacagggguaaccuuccuca

SEQ ID NO: 713459 - RNA, 22 nt, Human
ccugccuguaagauggguacaa

SEQ ID NO: 713460 - RNA, 23 nt, Human
aggcccugccugucccucuuuuu

SEQ ID NO: 713461 - RNA, 18 nt, Human
accacaugauaucuugcc

SEQ ID NO: 713462 - RNA, 18 nt, Human
uggcugcuggaguagggu

SEQ ID NO: 713463 - RNA, 22 nt, Human
agcccagcggagcgggcccggg

SEQ ID NO: 713464 - RNA, 22 nt, Human
uggccagcagaguucacucucu

SEQ ID NO: 713465 - RNA, 22 nt, Human
uucaggagcuagggaugugaaa

SEQ ID NO: 713466 - RNA, 22 nt, Human
uauguauaaaugcaugugugga

SEQ ID NO: 713467 - RNA, 22 nt, Human
gaagccccaaacccucgccauc

SEQ ID NO: 713468 - RNA, 23 nt, Human
aagcccugaagguuucaggcccu

SEQ ID NO: 713469 - RNA, 22 nt, Human
gagagcugauagaugagcuacu

SEQ ID NO: 713470 - RNA, 22 nt, Human
cuuugcuuacuggugucugcau

SEQ ID NO: 713471 - RNA, 22 nt, Human
ucaguccaggggcugugauguc

SEQ ID NO: 713472 - RNA, 22 nt, Human
aagggcucuguugccauuucag

SEQ ID NO: 713473 - RNA, 22 nt, Human
ugcugcaggcagccccucuacu

SEQ ID NO: 713474 - RNA, 22 nt, Human
ucaagcucauuccucuaaccuc

SEQ ID NO: 713475 - RNA, 22 nt, Human
ugaaagguuauuuaggucugcu

SEQ ID NO: 713476 - RNA, 19 nt, Human
cagccucaaucccucgggc

SEQ ID NO: 713477 - RNA, 22 nt, Human
caguuauuaugaggucauuagg

SEQ ID NO: 713478 - RNA, 22 nt, Human
cugccucuggccucaggcccag

SEQ ID NO: 713479 - RNA, 22 nt, Human
ggagcccucaccggcgagugcc

SEQ ID NO: 713480 - RNA, 22 nt, Human
ucaucucucaggauaccagcag

SEQ ID NO: 713481 - RNA, 22 nt, Human
uauugucuguccgggucaaagc

SEQ ID NO: 713482 - RNA, 22 nt, Human
guggcugcucgggcuccggccc

SEQ ID NO: 713483 - RNA, 22 nt, Human
cagagucaauguccaagaagcu

SEQ ID NO: 713484 - RNA, 22 nt, Human
ucagcauucuuuacaaggauga

SEQ ID NO: 713485 - RNA, 22 nt, Human
uuauucagcagggacuuccuuu

SEQ ID NO: 713486 - RNA, 22 nt, Human
gcugggcuggaaggccaaggca

SEQ ID NO: 713487 - RNA, 22 nt, Human
cuguuucagcuacuguuccaug

SEQ ID NO: 713488 - RNA, 22 nt, Human
cccuggaggcggauguugcagu

SEQ ID NO: 713489 - RNA, 22 nt, Human
aguguuggaccgagguggagcc

SEQ ID NO: 713490 - RNA, 22 nt, Human
cugcacaguguuggaagcugcc

SEQ ID NO: 713491 - RNA, 22 nt, Human
ucuucagauaaagggagaguau

SEQ ID NO: 713492 - RNA, 22 nt, Human
uaggaugacugauagugauucc

SEQ ID NO: 713493 - RNA, 22 nt, Human
cugagcaugcuacaugcagcac

SEQ ID NO: 713494 - RNA, 22 nt, Human
gaggggccuggcgaggacaugu

SEQ ID NO: 713495 - RNA, 22 nt, Human
aacaacugaaaagcuuuuucug

SEQ ID NO: 713496 - RNA, 22 nt, Human
aacuucaccuuuuugccacacu

SEQ ID NO: 713497 - RNA, 22 nt, Human
uugcaaauuauauaagggaugc

SEQ ID NO: 713498 - RNA, 22 nt, Human
uauccauaguuuauagaucaag

SEQ ID NO: 713499 - RNA, 22 nt, Human
uguaugcuuugguuguuucucu

SEQ ID NO: 713500 - RNA, 22 nt, Human
cucaggagcuuccucagcccau

SEQ ID NO: 713501 - RNA, 19 nt, Human
gaauacagauaauaagcag

SEQ ID NO: 713502 - RNA, 22 nt, Human
aagagguuuaacugacucacag

SEQ ID NO: 713503 - RNA, 22 nt, Human
ucccugcuuggaaugacccuua

SEQ ID NO: 713504 - RNA, 22 nt, Human
gcccuguguauccccugugcuu

SEQ ID NO: 713505 - RNA, 22 nt, Human
cucuccagaauaugccgccgug

SEQ ID NO: 713506 - RNA, 22 nt, Human
uagaaacccugccuuaguagcu

SEQ ID NO: 713507 - RNA, 22 nt, Human
agagcagcuuuucggaaccacu

SEQ ID NO: 713508 - RNA, 22 nt, Human
augguuuaagggagaauauuga

SEQ ID NO: 713509 - RNA, 22 nt, Human
ugucuacugcugacacuaacag

SEQ ID NO: 713510 - RNA, 23 nt, Human
cauguacagaguuugauaaagug

SEQ ID NO: 713511 - RNA, 22 nt, Human
cugugccugcaggccacaucaa

SEQ ID NO: 713512 - RNA, 22 nt, Human
gcuucucgggccugaugucguc

SEQ ID NO: 713513 - RNA, 22 nt, Human
uagauuuguguuugggaugaga

SEQ ID NO: 713514 - RNA, 22 nt, Human
ucauugacaguuguuucaaaua

SEQ ID NO: 713515 - RNA, 22 nt, Human
ucugccuguggauacaugcucu

SEQ ID NO: 713516 - RNA, 22 nt, Human
acagcuugaaucuuaagcucuu

SEQ ID NO: 713517 - RNA, 22 nt, Human
cuccucagggcugguuacaugg

SEQ ID NO: 713518 - RNA, 22 nt, Human
cacccaggcaaggauucugcaa

SEQ ID NO: 713519 - RNA, 22 nt, Human
aauagcauguaaguuuaaaaga

SEQ ID NO: 713520 - RNA, 22 nt, Human
uuccuggggacuuaccgucauu

SEQ ID NO: 713521 - RNA, 19 nt, Human
ucugcccacaagaaaggga

SEQ ID NO: 713522 - RNA, 22 nt, Human
uaauguuuagaagcagacagcu

SEQ ID NO: 713523 - RNA, 22 nt, Human
aucguuuacccugagugauugc

SEQ ID NO: 713524 - RNA, 20 nt, Human
ugacaaaugaucugauuuuc

SEQ ID NO: 713525 - RNA, 22 nt, Human
uguuuuaugagccauauaaccu

SEQ ID NO: 713526 - RNA, 22 nt, Human
cagcuguguaugagagcaugcu

SEQ ID NO: 713527 - RNA, 22 nt, Human
cuugccugcuggagcagggcuc

SEQ ID NO: 713528 - RNA, 22 nt, Human
ugugcccugccuacaucaccuu

SEQ ID NO: 713529 - RNA, 22 nt, Human
cuuagcuagaggcaauuauguu

SEQ ID NO: 713530 - RNA, 22 nt, Human
caagggcaggagaggauggaug

SEQ ID NO: 713531 - RNA, 22 nt, Human
ucugaaauuccuuccagacuuu

SEQ ID NO: 713532 - RNA, 22 nt, Human
ucaggcagagcuguggagcucu

SEQ ID NO: 713533 - RNA, 22 nt, Human
ucccucugguccucgguggaga

SEQ ID NO: 713534 - RNA, 22 nt, Human
acucaggcuucaggcacagcug

SEQ ID NO: 713535 - RNA, 22 nt, Human
ucucagucagccuugauguccc

SEQ ID NO: 713536 - RNA, 22 nt, Human
uccuccagaccacuucugugcg

SEQ ID NO: 713537 - RNA, 22 nt, Human
aggcuggagggcaauggcaaga

SEQ ID NO: 713538 - RNA, 23 nt, Human
uccaccccagcugaggcuuagcc

SEQ ID NO: 713539 - RNA, 22 nt, Human
uagcucugaccaagagacugag

SEQ ID NO: 713540 - RNA, 22 nt, Human
acagggcuauauuccucagagc

SEQ ID NO: 713541 - RNA, 22 nt, Human
aaguaugacauuuaagacaauu

SEQ ID NO: 713542 - RNA, 20 nt, Human
gcucugugguuugagucucc

SEQ ID NO: 713543 - RNA, 22 nt, Human
gagagcugggcuuugggugaag

SEQ ID NO: 713544 - RNA, 22 nt, Human
ugaaaugcuguagagacuguau

SEQ ID NO: 713545 - RNA, 22 nt, Human
cagagcugguguuacaagucca

SEQ ID NO: 713546 - RNA, 22 nt, Human
ccugagaucagugcauuuggug

SEQ ID NO: 713547 - RNA, 22 nt, Human
cagggcugagaauuuagagaca

SEQ ID NO: 713548 - RNA, 22 nt, Human
auacauguuguaccauauguuu

SEQ ID NO: 713549 - RNA, 22 nt, Human
uugaaagauagugaagccagcc

SEQ ID NO: 713550 - RNA, 22 nt, Human
gggcuccaucacaggcuccauc

SEQ ID NO: 713551 - RNA, 22 nt, Human
gagcuggugcucuugucaagac

SEQ ID NO: 713552 - RNA, 22 nt, Human
uaggaaggccugucacuacuug

SEQ ID NO: 713553 - RNA, 22 nt, Human
gccaggcagccacccucugcga

SEQ ID NO: 713554 - RNA, 22 nt, Human
aaggcugguuccaucccuggug

SEQ ID NO: 713555 - RNA, 22 nt, Human
uuguuucaaauauuucagaaua

SEQ ID NO: 713556 - RNA, 22 nt, Human
agacccagaaagcagcugcauu

SEQ ID NO: 713557 - RNA, 22 nt, Human
uggcuucuggccaggcacagga

SEQ ID NO: 713558 - RNA, 22 nt, Human
uagcaaugcucuaugaugaaaa

SEQ ID NO: 713559 - RNA, 22 nt, Human
uugaagcaggaaaauuucuauu

SEQ ID NO: 713560 - RNA, 22 nt, Human
cagguuuaguuccacacagcuc

SEQ ID NO: 713561 - RNA, 22 nt, Human
acuuggcaaguaucuauaaagu

SEQ ID NO: 713562 - RNA, 22 nt, Human
aaaagagucuuaggcagucaua

SEQ ID NO: 713563 - RNA, 22 nt, Human
uagucagauauaugacuuacgu

SEQ ID NO: 713564 - RNA, 22 nt, Human
gccaccagggggcuccagugag

SEQ ID NO: 713565 - RNA, 22 nt, Human
uuugagguuagcuagcagauca

SEQ ID NO: 713566 - RNA, 22 nt, Human
ucucacagugcaggucugucuc

SEQ ID NO: 713567 - RNA, 20 nt, Human
agacaugguagugauucagg

SEQ ID NO: 713568 - RNA, 19 nt, Human
cugucccucccagguauga

SEQ ID NO: 713569 - RNA, 22 nt, Human
ccugcuuaacauugccaugaca

SEQ ID NO: 713570 - RNA, 22 nt, Human
cugaagagacuggagggggcau

SEQ ID NO: 713571 - RNA, 22 nt, Human
acucccuugugaacucauucuu

SEQ ID NO: 713572 - RNA, 22 nt, Human
gaggggcuggcacgauggcugc

SEQ ID NO: 713573 - RNA, 22 nt, Human
acugugcaaugaguaauaaacu

SEQ ID NO: 713574 - RNA, 22 nt, Human
uccaugcagagaacugaaguac

SEQ ID NO: 713575 - RNA, 22 nt, Human
aaagguuagacagcucugcaua

SEQ ID NO: 713576 - RNA, 22 nt, Human
aagauguuaaauugggggcauu

SEQ ID NO: 713577 - RNA, 22 nt, Human
uucucagauuccccuuuuaaua

SEQ ID NO: 713578 - RNA, 22 nt, Human
agcaaacauucagcagauuggc

SEQ ID NO: 713579 - RNA, 22 nt, Human
gccagcucuguggcuguacuug

SEQ ID NO: 713580 - RNA, 22 nt, Human
uucauucauucaugaauguuaa

SEQ ID NO: 713581 - RNA, 22 nt, Human
aucaggauucaccccagagcug

SEQ ID NO: 713582 - RNA, 22 nt, Human
aggcugcucugcgaagucagcu

SEQ ID NO: 713583 - RNA, 22 nt, Human
ccaggagccacucaggcccaca

SEQ ID NO: 713584 - RNA, 22 nt, Human
ugccagggcugcuacuggcuga

SEQ ID NO: 713585 - RNA, 22 nt, Human
ugaucagcaucuucccagcucg

SEQ ID NO: 713586 - RNA, 22 nt, Human
gaauuuuucuggaagcaauuau

SEQ ID NO: 713587 - RNA, 22 nt, Human
ucucuguaucagcaccugcugg

SEQ ID NO: 713588 - RNA, 22 nt, Human
auaaaguggagguaguauucau

SEQ ID NO: 713589 - RNA, 22 nt, Human
caaaugcauaguuuauaagaag

SEQ ID NO: 713590 - RNA, 22 nt, Human
guuuccuguuucucagcagccc

SEQ ID NO: 713591 - RNA, 22 nt, Human
gucaggcccuggcagccgugac

SEQ ID NO: 713592 - RNA, 22 nt, Human
cugggcucaagaagucuucccu

SEQ ID NO: 713593 - RNA, 22 nt, Human
auccacucucccauucaugcau

SEQ ID NO: 713594 - RNA, 19 nt, Human
augucccaccgccccugag

SEQ ID NO: 713595 - RNA, 22 nt, Human
gccuggcuaauuuugguauuuu

SEQ ID NO: 713596 - RNA, 22 nt, Human
ucaguuuauggucuaguucaug

SEQ ID NO: 713597 - RNA, 22 nt, Human
cuauugaauuaacuauuaaagu

SEQ ID NO: 713598 - RNA, 22 nt, Human
ugagcucuucuaacuaauugug

SEQ ID NO: 713599 - RNA, 22 nt, Human
aaaugguaaugucuuucuguuu

SEQ ID NO: 713600 - RNA, 22 nt, Human
ugcuccagcaccaagagcucca

SEQ ID NO: 713601 - RNA, 22 nt, Human
uggccugucuuguugugcuaga

SEQ ID NO: 713602 - RNA, 22 nt, Human
uauuuccuguggauacuuuuag

SEQ ID NO: 713603 - RNA, 22 nt, Human
uugagaauguguuuugcuaagu

SEQ ID NO: 713604 - RNA, 22 nt, Human
guagcagcagagcagguccucc

SEQ ID NO: 713605 - RNA, 22 nt, Human
cagagccaucaugauauggagu

SEQ ID NO: 713606 - RNA, 22 nt, Human
uuuuaugugcuggacuggcagu

SEQ ID NO: 713607 - RNA, 21 nt, Human
cagugccccagcuacaaaagg

SEQ ID NO: 713608 - RNA, 22 nt, Human
ugaggugguucaagagccuugu

SEQ ID NO: 713609 - RNA, 22 nt, Human
cugaagccaugugcucacuggu

SEQ ID NO: 713610 - RNA, 22 nt, Human
agagccugagaggauaaugggg

SEQ ID NO: 713611 - RNA, 22 nt, Human
aagacaauccuggacagucagc

SEQ ID NO: 713612 - RNA, 22 nt, Human
aauguguuauuucagaauccag

SEQ ID NO: 713613 - RNA, 17 nt, Human
acaugggcugagacucc

SEQ ID NO: 713614 - RNA, 21 nt, Human
ucagagaacccggcaggcaag

SEQ ID NO: 713615 - RNA, 22 nt, Human
gcuuccaggcuuccuaccuuug

SEQ ID NO: 713616 - RNA, 22 nt, Human
ugagcagacucugcagagccac

SEQ ID NO: 713617 - RNA, 22 nt, Human
cugggccucauccucagaguuu

SEQ ID NO: 713618 - RNA, 23 nt, Human
uuucacagaaggauuguagggcc

SEQ ID NO: 713619 - RNA, 22 nt, Human
gucaguaggaaccuagggucaa

SEQ ID NO: 713620 - RNA, 22 nt, Human
uagauuuaagacccugaauuug

SEQ ID NO: 713621 - RNA, 22 nt, Human
uuuggcuuaacuuacaugauau

SEQ ID NO: 713622 - RNA, 20 nt, Human
ucuggacucuaagguauauu

SEQ ID NO: 713623 - RNA, 22 nt, Human
cagcuuuccccgugccucagcc

SEQ ID NO: 713624 - RNA, 22 nt, Human
gcacugggaaugcugaugggcu

SEQ ID NO: 713625 - RNA, 22 nt, Human
agacgagggcccccaggacagc

SEQ ID NO: 713626 - RNA, 22 nt, Human
cacauaaucaccaaguccuuuc

SEQ ID NO: 713627 - RNA, 22 nt, Human
uucugggaggccuuugugucug

SEQ ID NO: 713628 - RNA, 22 nt, Human
ucugagguccuacuauaagugg

SEQ ID NO: 713629 - RNA, 22 nt, Human
ucucugggucucaguuuguaca

SEQ ID NO: 713630 - RNA, 22 nt, Human
caauaguaaauuacggaggaga

SEQ ID NO: 713631 - RNA, 23 nt, Human
ggagaggggugugggcaucuuua

SEQ ID NO: 713632 - RNA, 20 nt, Human
ucaaagaagauucagcucaa

SEQ ID NO: 713633 - RNA, 22 nt, Human
gcugcuguacuuggggggugcu

SEQ ID NO: 713634 - RNA, 22 nt, Human
uguuaacuaauggucuaacauu

SEQ ID NO: 713635 - RNA, 18 nt, Human
ugaaacaagaauggugca

SEQ ID NO: 713636 - RNA, 22 nt, Human
augggcugaaagaguaagcugu

SEQ ID NO: 713637 - RNA, 22 nt, Human
cugacugugagagcaggaaugg

SEQ ID NO: 713638 - RNA, 22 nt, Human
uacuauuuauggagugguuauu

SEQ ID NO: 713639 - RNA, 22 nt, Human
uucuuugugcauccaauuuucu

SEQ ID NO: 713640 - RNA, 22 nt, Human
aguggcugaauauauuuuacua

SEQ ID NO: 713641 - RNA, 22 nt, Human
ugaggcaggaugcuugcacagg

SEQ ID NO: 713642 - RNA, 22 nt, Human
uuccagagcuuugcgcuuggaa

SEQ ID NO: 713643 - RNA, 22 nt, Human
acauauuuccaugcagcauguc

SEQ ID NO: 713644 - RNA, 23 nt, Human
gcuucugccauuugcuagcugug

SEQ ID NO: 713645 - RNA, 22 nt, Human
cuguuuguuggcuauugacagu

SEQ ID NO: 713646 - RNA, 19 nt, Human
ccucugcuccaguuuccuu

SEQ ID NO: 713647 - RNA, 22 nt, Human
gccagcagggcccaaaugcugg

SEQ ID NO: 713648 - RNA, 22 nt, Human
cagcaaaacagccguugccugg

SEQ ID NO: 713649 - RNA, 22 nt, Human
gggcuccagccagcuccuugug

SEQ ID NO: 713650 - RNA, 22 nt, Human
gaggcagagaccuucaggaccu

SEQ ID NO: 713651 - RNA, 18 nt, Human
gucugccaacaacuauca

SEQ ID NO: 713652 - RNA, 20 nt, Human
uggucuggagccagugagga

SEQ ID NO: 713653 - RNA, 22 nt, Human
ugcuagaaaucugaaacuagca

SEQ ID NO: 713654 - RNA, 22 nt, Human
aauucaguaaucauuaaugaug

SEQ ID NO: 713655 - RNA, 22 nt, Human
cacaauuuggacuucacugguu

SEQ ID NO: 713656 - RNA, 19 nt, Human
ugaggcacaugauaagaac

SEQ ID NO: 713657 - RNA, 22 nt, Human
ugggaagggaguuucuuggagu

SEQ ID NO: 713658 - RNA, 22 nt, Human
agauaugacuagaagcucauuu

SEQ ID NO: 713659 - RNA, 21 nt, Human
gcugggccuguacuugcccug

SEQ ID NO: 713660 - RNA, 22 nt, Human
agucuggaguagagccuagaaa

SEQ ID NO: 713661 - RNA, 22 nt, Human
cuuuacaggaaaagguggcugu

SEQ ID NO: 713662 - RNA, 22 nt, Human
ucugcugguuccgaauuaggcc

SEQ ID NO: 713663 - RNA, 22 nt, Human
cugcugcaaucuggcuuccaug

SEQ ID NO: 713664 - RNA, 22 nt, Human
uaauauaccaaacuguaauuuu

SEQ ID NO: 713665 - RNA, 22 nt, Human
gcuccugucuuggggcacuggc

SEQ ID NO: 713666 - RNA, 16 nt, Human
gcuggaguccuggagc

SEQ ID NO: 713667 - RNA, 18 nt, Human
auggcucaggaauggcuu

SEQ ID NO: 713668 - RNA, 22 nt, Human
ccaggcacucacggggcacugg

SEQ ID NO: 713669 - RNA, 22 nt, Human
gguuucaacucagcuaguaagg

SEQ ID NO: 713670 - RNA, 22 nt, Human
agcuguuuaugcacuccugccu

SEQ ID NO: 713671 - RNA, 22 nt, Human
cugcccugggauggucugugcg

SEQ ID NO: 713672 - RNA, 22 nt, Human
aggcagcuggaaaacuccaggc

SEQ ID NO: 713673 - RNA, 22 nt, Human
ccaaggagcaaggcucaacaag

SEQ ID NO: 713674 - RNA, 21 nt, Human
acagucuccccagaucucucc

SEQ ID NO: 713675 - RNA, 22 nt, Human
ggugggugcagggggcuucuua

SEQ ID NO: 713676 - RNA, 22 nt, Human
ccucagacuugauaauuggguu

SEQ ID NO: 713677 - RNA, 22 nt, Human
agaggaggccaggcccacaccu

SEQ ID NO: 713678 - RNA, 22 nt, Human
ggccucugcccucacuccuguc

SEQ ID NO: 713679 - RNA, 22 nt, Human
agggagcaaagguuucaggguu

SEQ ID NO: 713680 - RNA, 22 nt, Human
gccuggcuccuaagagcacaac

SEQ ID NO: 713681 - RNA, 20 nt, Human
ugcacauggcagccaucuag

SEQ ID NO: 713682 - RNA, 17 nt, Human
cuccuggccaccccucu

SEQ ID NO: 713683 - RNA, 22 nt, Human
accugagccuagggagguugag

SEQ ID NO: 713684 - RNA, 22 nt, Human
aagccaggugugcccaggaucc

SEQ ID NO: 713685 - RNA, 22 nt, Human
cagaguguugaccauaagccca

SEQ ID NO: 713686 - RNA, 22 nt, Human
ucucagaggugcccuggcaucu

SEQ ID NO: 713687 - RNA, 22 nt, Human
aaauugcuugagauuagucucc

SEQ ID NO: 713688 - RNA, 21 nt, Human
cccuaacucuaaaggauccau

SEQ ID NO: 713689 - RNA, 22 nt, Human
gggagcugcggucuugcgaaga

SEQ ID NO: 713690 - RNA, 22 nt, Human
uacugucuauacacuugauuac

SEQ ID NO: 713691 - RNA, 22 nt, Human
accucccucgccguccacucug

SEQ ID NO: 713692 - RNA, 22 nt, Human
cccagaguggagggugcagaau

SEQ ID NO: 713693 - RNA, 22 nt, Human
uguuuucuguguagagaucaca

SEQ ID NO: 713694 - RNA, 22 nt, Human
ugaauaauuccuuuuugucaag

SEQ ID NO: 713695 - RNA, 18 nt, Human
uuaauguggcuuacuaug

SEQ ID NO: 713696 - RNA, 22 nt, Human
gagguuccccauuguacuggcu

SEQ ID NO: 713697 - RNA, 22 nt, Human
ucccugggguaucgcugaggca

SEQ ID NO: 713698 - RNA, 22 nt, Human
gggaccugaggagggguuucag

SEQ ID NO: 713699 - RNA, 22 nt, Human
caguuuaggagagacgcguucu

SEQ ID NO: 713700 - RNA, 22 nt, Human
agccauaucaagcauucuucac

SEQ ID NO: 713701 - RNA, 22 nt, Human
uucagacaggcagcugggcugg

SEQ ID NO: 713702 - RNA, 22 nt, Human
aucagcuuaauucucaacaggu

SEQ ID NO: 713703 - RNA, 22 nt, Human
agcugcccagcuaggaagaagg

SEQ ID NO: 713704 - RNA, 22 nt, Human
uggugggagugagggcaugcca

SEQ ID NO: 713705 - RNA, 22 nt, Human
guggcuucuggcugggccucag

SEQ ID NO: 713706 - RNA, 22 nt, Human
uucacaggauauaugugcaggg

SEQ ID NO: 713707 - RNA, 22 nt, Human
acuggcagugucguuuacauga

SEQ ID NO: 713708 - RNA, 20 nt, Human
caggaugauuggacacgaug

SEQ ID NO: 713709 - RNA, 23 nt, Human
acuauaaaguuguucugauuuac

SEQ ID NO: 713710 - RNA, 22 nt, Human
auuugcaaagucguaucuguga

SEQ ID NO: 713711 - RNA, 21 nt, Human
agcugcuccagggagcucagg

SEQ ID NO: 713712 - RNA, 22 nt, Human
aaagauguuaauagcaccauuu

SEQ ID NO: 713713 - RNA, 22 nt, Human
aaaguauauuuacuuacuguga

SEQ ID NO: 713714 - RNA, 22 nt, Human
acaggccuagcuaaugcuuucc

SEQ ID NO: 713715 - RNA, 22 nt, Human
aucuuuuuugucuuggucacug

SEQ ID NO: 713716 - RNA, 22 nt, Human
acaaugcagccuauggauccag

SEQ ID NO: 713717 - RNA, 22 nt, Human
auucaucagcuaauggacauuu

SEQ ID NO: 713718 - RNA, 22 nt, Human
gaucugaaccuugccuguuggg

SEQ ID NO: 713719 - RNA, 22 nt, Human
uuacagcaaagugcgcagaccu

SEQ ID NO: 713720 - RNA, 22 nt, Human
aagaugugaacagaaccacagg

SEQ ID NO: 713721 - RNA, 22 nt, Human
aauauuuaugacaggaaguagc

SEQ ID NO: 713722 - RNA, 22 nt, Human
uucagugugaagcuucugaaag

SEQ ID NO: 713723 - RNA, 22 nt, Human
ggacaggguuggggcauauaaa

SEQ ID NO: 713724 - RNA, 22 nt, Human
aggaagauguguuuagcagguu

SEQ ID NO: 713725 - RNA, 19 nt, Human
aauugccugucucugccag

SEQ ID NO: 713726 - RNA, 23 nt, Human
gaaucaguggcuaacaaggaaac

SEQ ID NO: 713727 - RNA, 22 nt, Human
ugacccuuagugaacauuagaa

SEQ ID NO: 713728 - RNA, 22 nt, Human
cacauacauucauguuacucua

SEQ ID NO: 713729 - RNA, 22 nt, Human
ccccaggacguggcccucauag

SEQ ID NO: 713730 - RNA, 22 nt, Human
ucucuucuuuggggugggcuca

SEQ ID NO: 713731 - RNA, 22 nt, Human
auguacaggucuuggcaaaggg

SEQ ID NO: 713732 - RNA, 23 nt, Human
auaaauuacuaucucccuagagc

SEQ ID NO: 713733 - RNA, 20 nt, Human
acagcagccuugcuagaaac

SEQ ID NO: 713734 - RNA, 22 nt, Human
cacgggagacgugaucuuggac

SEQ ID NO: 713735 - RNA, 22 nt, Human
uacaggacagauguuuacagga

SEQ ID NO: 713736 - RNA, 22 nt, Human
cagcauuucaggaggcugaggu

SEQ ID NO: 713737 - RNA, 17 nt, Human
auuuagcaaguagacag

SEQ ID NO: 713738 - RNA, 22 nt, Human
gcagucauggaaaaauguauac

SEQ ID NO: 713739 - RNA, 22 nt, Human
ggucuggaugcugagguuccca

SEQ ID NO: 713740 - RNA, 21 nt, Human
aacaaagggaugcucaucuuu

SEQ ID NO: 713741 - RNA, 22 nt, Human
aagugauacguguuuauuucca

SEQ ID NO: 713742 - RNA, 22 nt, Human
auucugcucauuuuauuuccag

SEQ ID NO: 713743 - RNA, 22 nt, Human
aaaucuuucccuuuacuaucca

SEQ ID NO: 713744 - RNA, 22 nt, Human
ucuccucuccuuucauguuguu

SEQ ID NO: 713745 - RNA, 22 nt, Human
ucuggcuugaacaauuagguaa

SEQ ID NO: 713746 - RNA, 18 nt, Human
gaacuuuuggcuuugugu

SEQ ID NO: 713747 - RNA, 22 nt, Human
agugcuuugaacgaaaggcuga

SEQ ID NO: 713748 - RNA, 19 nt, Human
gcuaggcuggccuugaggg

SEQ ID NO: 713749 - RNA, 22 nt, Human
ucacagcaaaugcugcuucuca

SEQ ID NO: 713750 - RNA, 22 nt, Human
uagguuuaggagugaaggugaa

SEQ ID NO: 713751 - RNA, 22 nt, Human
uagacauuggccauuccugugg

SEQ ID NO: 713752 - RNA, 22 nt, Human
uuguuaaaggcaaaacaagcac

SEQ ID NO: 713753 - RNA, 22 nt, Human
cacugagcaagucaguacagca

SEQ ID NO: 713754 - RNA, 17 nt, Human
gacagcugggcgcacgc

SEQ ID NO: 713755 - RNA, 22 nt, Human
gcucgcagaucaccugggggcg

SEQ ID NO: 713756 - RNA, 17 nt, Human
ugcgaugucuguguuug

SEQ ID NO: 713757 - RNA, 22 nt, Human
ccacuggagacuggucucugug

SEQ ID NO: 713758 - RNA, 22 nt, Human
ucaggaagugccuaggcuggcc

SEQ ID NO: 713759 - RNA, 22 nt, Human
ggagaggcgaugagucacagcc

SEQ ID NO: 713760 - RNA, 22 nt, Human
aagcugagccaguggcaagugc

SEQ ID NO: 713761 - RNA, 22 nt, Human
gacuuugauuaaaucaagcaaa

SEQ ID NO: 713762 - RNA, 22 nt, Human
ugauuagauugagucaaccuug

SEQ ID NO: 713763 - RNA, 22 nt, Human
cugugcaguggcagcguguggg

SEQ ID NO: 713764 - RNA, 22 nt, Human
ugccaggcccucccacagauua

SEQ ID NO: 713765 - RNA, 22 nt, Human
acacaguaguuugucauugcua

SEQ ID NO: 713766 - RNA, 20 nt, Human
cuggggagcugcucccacga

SEQ ID NO: 713767 - RNA, 22 nt, Human
cucagcagugacaagagaguau

SEQ ID NO: 713768 - RNA, 22 nt, Human
ucuagcaagcucgugcucaagg

SEQ ID NO: 713769 - RNA, 22 nt, Human
auucagaauggcaaacuucuag

SEQ ID NO: 713770 - RNA, 18 nt, Human
gcagcuagccaggggggc

SEQ ID NO: 713771 - RNA, 18 nt, Human
aaaaugcaggcgacaugg

SEQ ID NO: 713772 - RNA, 22 nt, Human
uccugccuaccuugcggaggug

SEQ ID NO: 713773 - RNA, 22 nt, Human
aaccaagaggguuuuccuugaa

SEQ ID NO: 713774 - RNA, 17 nt, Human
agguguggucaagggag

SEQ ID NO: 713775 - RNA, 22 nt, Human
ggggaaauuguggcugacagug

SEQ ID NO: 713776 - RNA, 22 nt, Human
gaugcacuuucuuuucaacagu

SEQ ID NO: 713777 - RNA, 22 nt, Human
accacaguuuaguccaaugaca

SEQ ID NO: 713778 - RNA, 22 nt, Human
uccaggucaucuuggagagcug

SEQ ID NO: 713779 - RNA, 21 nt, Human
ggauuuuaaaaacugcaccug

SEQ ID NO: 713780 - RNA, 22 nt, Human
auacaucaugcuccauauauuu

SEQ ID NO: 713781 - RNA, 22 nt, Human
ugccuguguggucugcgcauua

SEQ ID NO: 713782 - RNA, 22 nt, Human
gggcuguguaucaguuaucuau

SEQ ID NO: 713783 - RNA, 20 nt, Human
uucaaagacccucaggucca

SEQ ID NO: 713784 - RNA, 22 nt, Human
cuggagggauguaggguguauu

SEQ ID NO: 713785 - RNA, 22 nt, Human
cuggccagcugacagcagggcu

SEQ ID NO: 713786 - RNA, 22 nt, Human
aguuuucuuucgcaaagguaca

SEQ ID NO: 713787 - RNA, 22 nt, Human
uuucagaaacgauuaugaacac

SEQ ID NO: 713788 - RNA, 22 nt, Human
uaccucuggacauuguggagca

SEQ ID NO: 713789 - RNA, 22 nt, Human
ucugguggcacgugucuugcau

SEQ ID NO: 713790 - RNA, 22 nt, Human
gucaggauuuuaaaaucccagu

SEQ ID NO: 713791 - RNA, 22 nt, Human
ccugcucuagacucugggaagg

SEQ ID NO: 713792 - RNA, 22 nt, Human
caggaggaaaguuccacucaac

SEQ ID NO: 713793 - RNA, 22 nt, Human
cucugggugucuuaggagcuca

SEQ ID NO: 713794 - RNA, 22 nt, Human
aaugcuacagaagugaucuugg

SEQ ID NO: 713795 - RNA, 22 nt, Human
ucagccucucugaguccagacc

SEQ ID NO: 713796 - RNA, 22 nt, Human
gccuuuggauauauucagggau

SEQ ID NO: 713797 - RNA, 22 nt, Human
auuucugauaguaaaggucuuu

SEQ ID NO: 713798 - RNA, 21 nt, Human
ggccaacauggucucaucucu

SEQ ID NO: 713799 - RNA, 22 nt, Human
cugcagcuggagcaucuucuca

SEQ ID NO: 713800 - RNA, 22 nt, Human
ccagaggagggcucugaugagg

SEQ ID NO: 713801 - RNA, 22 nt, Human
uggccugccugggagcagcagg

SEQ ID NO: 713802 - RNA, 22 nt, Human
uuguccugcaaccucacauggc

SEQ ID NO: 713803 - RNA, 23 nt, Human
ucauuccacaaauacuuaucuag

SEQ ID NO: 713804 - RNA, 22 nt, Human
ugagcacagcucgcaccagcuu

SEQ ID NO: 713805 - RNA, 22 nt, Human
ucccagggauccuccgggucgc

SEQ ID NO: 713806 - RNA, 22 nt, Human
ugagccaaggccucaagaauuu

SEQ ID NO: 713807 - RNA, 22 nt, Human
aaagcuaguaauauuuuaaucc

SEQ ID NO: 713808 - RNA, 22 nt, Human
gggccccugggaauucugugau

SEQ ID NO: 713809 - RNA, 22 nt, Human
agaaagggagcguggaucaauu

SEQ ID NO: 713810 - RNA, 22 nt, Human
uuccaggaugggcuguccuacu

SEQ ID NO: 713811 - RNA, 22 nt, Human
auauccagcagcaggugaguau

SEQ ID NO: 713812 - RNA, 22 nt, Human
gcagcuggucuggccuagagua

SEQ ID NO: 713813 - RNA, 22 nt, Human
aguacaugcagaacuaacagau

SEQ ID NO: 713814 - RNA, 23 nt, Human
uguguauguaucuaugcauaggu

SEQ ID NO: 713815 - RNA, 22 nt, Human
ugagccaggaguuugaggcugu

SEQ ID NO: 713816 - RNA, 22 nt, Human
gaaaugaugucugugcugccac

SEQ ID NO: 713817 - RNA, 22 nt, Human
gaacuucuucaacauaauggac

SEQ ID NO: 713818 - RNA, 20 nt, Human
cuuguuaaauaugcagguag

SEQ ID NO: 713819 - RNA, 22 nt, Human
cucuccuugcagauggcugccu

SEQ ID NO: 713820 - RNA, 22 nt, Human
acuccacaccacgggggccgcc

SEQ ID NO: 713821 - RNA, 22 nt, Human
cugaaggagcauagucaguuuu

SEQ ID NO: 713822 - RNA, 22 nt, Human
uauaaagagucucaaagaaguu

SEQ ID NO: 713823 - RNA, 22 nt, Human
uacuuuggguuuagaauaaacu

SEQ ID NO: 713824 - RNA, 22 nt, Human
aggaacugaugagcagccaggg

SEQ ID NO: 713825 - RNA, 22 nt, Human
aaaguuggauuucauccucaug

SEQ ID NO: 713826 - RNA, 22 nt, Human
uccagaccuagggcaccccagu

SEQ ID NO: 713827 - RNA, 22 nt, Human
cagaggccuuucuacagugaua

SEQ ID NO: 713828 - RNA, 22 nt, Human
guugaugaaaaugaauugcaug

SEQ ID NO: 713829 - RNA, 22 nt, Human
agagcagaguggcuguagcuug

SEQ ID NO: 713830 - RNA, 22 nt, Human
gcuguggggagagaacacacaa

SEQ ID NO: 713831 - RNA, 22 nt, Human
gggaaggcagugggaggaacug

SEQ ID NO: 713832 - RNA, 22 nt, Human
ugcagggccagacuggguugga

SEQ ID NO: 713833 - RNA, 22 nt, Human
ugcuuugaaagauaauacuguc

SEQ ID NO: 713834 - RNA, 19 nt, Human
acaaagcugugagcagcuu

SEQ ID NO: 713835 - RNA, 22 nt, Human
agaguccaugaagacagcugag

SEQ ID NO: 713836 - RNA, 22 nt, Human
aagugauuucugccugcauguu

SEQ ID NO: 713837 - RNA, 22 nt, Human
gcuggagccuucugcucuguug

SEQ ID NO: 713838 - RNA, 22 nt, Human
gcaguccuuaggagaggaagua

SEQ ID NO: 713839 - RNA, 22 nt, Human
aaacacaauguuucuuuguucu

SEQ ID NO: 713840 - RNA, 22 nt, Human
agaggcaacauggggaacagau

SEQ ID NO: 713841 - RNA, 22 nt, Human
gggccacggaaggaccaguggg

SEQ ID NO: 713842 - RNA, 22 nt, Human
ucagaaacacucuucuucuguc

SEQ ID NO: 713843 - RNA, 23 nt, Human
ggucagugaguucguuucucugg

SEQ ID NO: 713844 - RNA, 22 nt, Human
ugaaaacuccaaguuucaucag

SEQ ID NO: 713845 - RNA, 23 nt, Human
ugacagagcacagugggggagau

SEQ ID NO: 713846 - RNA, 22 nt, Human
ucaguugccuccauagucaucc

SEQ ID NO: 713847 - RNA, 22 nt, Human
ucaguguuagacaaguuuggaa

SEQ ID NO: 713848 - RNA, 22 nt, Human
uccuggacuggcucagcacccu

SEQ ID NO: 713849 - RNA, 22 nt, Human
uuagugucuucuucauccucug

SEQ ID NO: 713850 - RNA, 22 nt, Human
ggagcuguagaucagcuaaucu

SEQ ID NO: 713851 - RNA, 22 nt, Human
ugccaaauuagaguucccaggc

SEQ ID NO: 713852 - RNA, 22 nt, Human
aaagugcagcugaaaacauccu

SEQ ID NO: 713853 - RNA, 22 nt, Human
gucaggaaaaauugauaauuuu

SEQ ID NO: 713854 - RNA, 22 nt, Human
ucacaguaucagguggagugga

SEQ ID NO: 713855 - RNA, 22 nt, Human
uguaaacauaccagagccaagu

SEQ ID NO: 713856 - RNA, 21 nt, Human
cugucuggccgcgggcuccgc

SEQ ID NO: 713857 - RNA, 22 nt, Human
auaaugcgaggagaaaaugaag

SEQ ID NO: 713858 - RNA, 22 nt, Human
ugcaggugccaucgcugcucau

SEQ ID NO: 713859 - RNA, 22 nt, Human
gccucagcucccagcccaggcu

SEQ ID NO: 713860 - RNA, 22 nt, Human
uuccaguucccaugaggauuaa

SEQ ID NO: 713861 - RNA, 22 nt, Human
ucaggagggcuaagacuguagc

SEQ ID NO: 713862 - RNA, 22 nt, Human
aaguuccuuagccuuagggcuu

SEQ ID NO: 713863 - RNA, 22 nt, Human
cuaaagacacaauaaguagcuu

SEQ ID NO: 713864 - RNA, 22 nt, Human
ucacuugacccuucucuagccu

SEQ ID NO: 713865 - RNA, 22 nt, Human
agaugaguagguagcauuagua

SEQ ID NO: 713866 - RNA, 22 nt, Human
acugcacacuuagcaucuggga

SEQ ID NO: 713867 - RNA, 22 nt, Human
ucuuucucucuaaucaagcaca

SEQ ID NO: 713868 - RNA, 22 nt, Human
ggaaaaggccauuguuucucug

SEQ ID NO: 713869 - RNA, 22 nt, Human
acccaggccauuggcaagaguc

SEQ ID NO: 713870 - RNA, 22 nt, Human
cuuccaaacccaggguaugggc

SEQ ID NO: 713871 - RNA, 21 nt, Human
aggagaccggcuuguuugugc

SEQ ID NO: 713872 - RNA, 21 nt, Human
caauaaacugcacauugagac

SEQ ID NO: 713873 - RNA, 22 nt, Human
cuuccagguccuucuugagaag

SEQ ID NO: 713874 - RNA, 22 nt, Human
ucagcugcauaagucaccuugc

SEQ ID NO: 713875 - RNA, 22 nt, Human
acucaugguagcacaggcugug

SEQ ID NO: 713876 - RNA, 22 nt, Human
ccaggcucugagccucacucuu

SEQ ID NO: 713877 - RNA, 22 nt, Human
uggcucagcuuacuuuugaggg

SEQ ID NO: 713878 - RNA, 22 nt, Human
uguauuuucugaagauaaucaa

SEQ ID NO: 713879 - RNA, 22 nt, Human
auagaucauugauacuugcauc

SEQ ID NO: 713880 - RNA, 22 nt, Human
aucucuguaaaccauaaauuga

SEQ ID NO: 713881 - RNA, 22 nt, Human
uccugaauccaggagaguaggg

SEQ ID NO: 713882 - RNA, 22 nt, Human
gugacucuacuuaagauuaagc

SEQ ID NO: 713883 - RNA, 22 nt, Human
aaaguaaccuaguaauaguguc

SEQ ID NO: 713884 - RNA, 22 nt, Human
uucuuucugaauacaguugagu

SEQ ID NO: 713885 - RNA, 22 nt, Human
uuuauuuggcaucucugccaag

SEQ ID NO: 713886 - RNA, 22 nt, Human
uugaagcagagaaauacuugaa

SEQ ID NO: 713887 - RNA, 22 nt, Human
ucugggaagacggauggacccu

SEQ ID NO: 713888 - RNA, 22 nt, Human
agccaacuccagccccugcagc

SEQ ID NO: 713889 - RNA, 22 nt, Human
acagacagauuuugucugaugu

SEQ ID NO: 713890 - RNA, 22 nt, Human
gguccugucugacaucacugcu

SEQ ID NO: 713891 - RNA, 22 nt, Human
aggccagcccugggcugagaga

SEQ ID NO: 713892 - RNA, 22 nt, Human
aaagcaauaguaaugguaauag

SEQ ID NO: 713893 - RNA, 22 nt, Human
ugcuuucaccuguuugcaccca

SEQ ID NO: 713894 - RNA, 22 nt, Human
ucccagugagguccuggcuguc

SEQ ID NO: 713895 - RNA, 22 nt, Human
uuagaaaaauguucaguaguuu

SEQ ID NO: 713896 - RNA, 22 nt, Human
agaauugcuggaauuugcuuua

SEQ ID NO: 713897 - RNA, 22 nt, Human
cagcccaguaccaagcaguugg

SEQ ID NO: 713898 - RNA, 22 nt, Human
acuccagaggcagcugugcuga

SEQ ID NO: 713899 - RNA, 22 nt, Human
agcccagcaaagggagguucag

SEQ ID NO: 713900 - RNA, 22 nt, Human
uuacacuaagcuacuucuauau

SEQ ID NO: 713901 - RNA, 22 nt, Human
cauccguugugcuguugcucuc

SEQ ID NO: 713902 - RNA, 22 nt, Human
agcagugggugacagagcugag

SEQ ID NO: 713903 - RNA, 22 nt, Human
gccagaggggcucgaaggcgcg

SEQ ID NO: 713904 - RNA, 23 nt, Human
uggcuggcgccugccucacccug

SEQ ID NO: 713905 - RNA, 22 nt, Human
aacauuucugagaauaucaguu

SEQ ID NO: 713906 - RNA, 16 nt, Human
ccagaggccuggccuc

SEQ ID NO: 713907 - RNA, 22 nt, Human
gucuugaucuccugaccuugug

SEQ ID NO: 713908 - RNA, 22 nt, Human
cugugggagaggugccuggauu

SEQ ID NO: 713909 - RNA, 22 nt, Human
uaaagcaauuugagcaaguucu

SEQ ID NO: 713910 - RNA, 22 nt, Human
gcuggcuggaaugggagaagaa

SEQ ID NO: 713911 - RNA, 22 nt, Human
gaagauaacuuuaaaaaguggc

SEQ ID NO: 713912 - RNA, 22 nt, Human
cagacugggcugguggaaagcu

SEQ ID NO: 713913 - RNA, 22 nt, Human
uccaggucuggccugcuaggca

SEQ ID NO: 713914 - RNA, 22 nt, Human
guccagccugaagagugggggc

SEQ ID NO: 713915 - RNA, 19 nt, Human
uccagcugguaugcccaga

SEQ ID NO: 713916 - RNA, 22 nt, Human
guuaacaaauguaaagcaauua

SEQ ID NO: 713917 - RNA, 22 nt, Human
aagcacagugggcagagcagcc

SEQ ID NO: 713918 - RNA, 22 nt, Human
ucucagagcuucagaaagcacc

SEQ ID NO: 713919 - RNA, 22 nt, Human
gcugugagaaacagggaguguc

SEQ ID NO: 713920 - RNA, 22 nt, Human
aaauauuauugcuuaaggggag

SEQ ID NO: 713921 - RNA, 22 nt, Human
uuggaaaacuuacacagagcug

SEQ ID NO: 713922 - RNA, 22 nt, Human
caggaaggcccaccuguccugu

SEQ ID NO: 713923 - RNA, 22 nt, Human
cuggcagguggauggggacucc

SEQ ID NO: 713924 - RNA, 22 nt, Human
cgcgguggcggccuccagcgcc

SEQ ID NO: 713925 - RNA, 22 nt, Human
guuauguaaucuaacacucagu

SEQ ID NO: 713926 - RNA, 22 nt, Human
gaggccacagucaguguucauc

SEQ ID NO: 713927 - RNA, 22 nt, Human
ggagccuuccagacugcccaca

SEQ ID NO: 713928 - RNA, 22 nt, Human
ugaaagaagugucacauugcca

SEQ ID NO: 713929 - RNA, 23 nt, Human
gcaggaguuccuggacuccagga

SEQ ID NO: 713930 - RNA, 18 nt, Human
ugucaguaaagugacaga

SEQ ID NO: 713931 - RNA, 17 nt, Human
caucuuuaaaauccuga

SEQ ID NO: 713932 - RNA, 22 nt, Human
gccaggcuccccggaucccugg

SEQ ID NO: 713933 - RNA, 22 nt, Human
ucuuguccuaagagcuggauuc

SEQ ID NO: 713934 - RNA, 22 nt, Human
ggcagugacuggggacccccaa

SEQ ID NO: 713935 - RNA, 22 nt, Human
uccugaagccugagugaugacu

SEQ ID NO: 713936 - RNA, 22 nt, Human
uacagccuucaucuuugccuug

SEQ ID NO: 713937 - RNA, 22 nt, Human
auucaucuaugacucuaaugug

SEQ ID NO: 713938 - RNA, 22 nt, Human
gagugucuguggggcauggaca

SEQ ID NO: 713939 - RNA, 22 nt, Human
cugccaugcaguuagucccuca

SEQ ID NO: 713940 - RNA, 22 nt, Human
gagccagaaaagcugccugacu

SEQ ID NO: 713941 - RNA, 22 nt, Human
cucucugugguggcugucccau

SEQ ID NO: 713942 - RNA, 22 nt, Human
aagacugugucuauggcuacuc

SEQ ID NO: 713943 - RNA, 22 nt, Human
accagcagcugccagaguggag

SEQ ID NO: 713944 - RNA, 22 nt, Human
uagauucucagaauuuuagaaa

SEQ ID NO: 713945 - RNA, 22 nt, Human
ggcaggguggcccuccagugag

SEQ ID NO: 713946 - RNA, 22 nt, Human
ccaggagauuuuuccauagcac

SEQ ID NO: 713947 - RNA, 20 nt, Human
cugcugugauucccuccucc

SEQ ID NO: 713948 - RNA, 22 nt, Human
ucaggcaggaagccccugcaca

SEQ ID NO: 713949 - RNA, 19 nt, Human
ucugggguguggccuggca

SEQ ID NO: 713950 - RNA, 22 nt, Human
cuauacuacuauacagauguaa

SEQ ID NO: 713951 - RNA, 19 nt, Human
ccagaggcagcuucuguaa

SEQ ID NO: 713952 - RNA, 22 nt, Human
uuucagucuguaaaggugagga

SEQ ID NO: 713953 - RNA, 22 nt, Human
gcaauacaguugaagagauuga

SEQ ID NO: 713954 - RNA, 22 nt, Human
ucucuccuuaucauuguguuua

SEQ ID NO: 713955 - RNA, 22 nt, Human
cagugcaguuucccagaugcug

SEQ ID NO: 713956 - RNA, 22 nt, Human
uuuucugaaguuuaagacauuu

SEQ ID NO: 713957 - RNA, 22 nt, Human
acagcuacucugcagauaaauc

SEQ ID NO: 713958 - RNA, 17 nt, Human
gaacagcagaggggaca

SEQ ID NO: 713959 - RNA, 22 nt, Human
aggccagcuucuacccucuguu

SEQ ID NO: 713960 - RNA, 18 nt, Human
gggcacuggggacuggag

SEQ ID NO: 713961 - RNA, 22 nt, Human
gcaaagaaagccaaggucuaac

SEQ ID NO: 713962 - RNA, 19 nt, Human
aucugccuguuaucacaua

SEQ ID NO: 713963 - RNA, 22 nt, Human
cuuccucugcggcgccgggcgc

SEQ ID NO: 713964 - RNA, 22 nt, Human
ugagaauauuguuuuagugagg

SEQ ID NO: 713965 - RNA, 21 nt, Human
agcuggugucagagcucuggg

SEQ ID NO: 713966 - RNA, 22 nt, Human
cagaagaggacuggguagcuca

SEQ ID NO: 713967 - RNA, 22 nt, Human
gcuucugcaggguccucgcugu

SEQ ID NO: 713968 - RNA, 22 nt, Human
acauucuucagcuuugucaggc

SEQ ID NO: 713969 - RNA, 19 nt, Human
aaaccuguuaguagagcac

SEQ ID NO: 713970 - RNA, 22 nt, Human
agcaugcauuuuuggacugugc

SEQ ID NO: 713971 - RNA, 22 nt, Human
uggagagaugucuguucaaggu

SEQ ID NO: 713972 - RNA, 22 nt, Human
agcagcaggugcuucuggaucu

SEQ ID NO: 713973 - RNA, 22 nt, Human
ccuuccaggugcaggcaagccu

SEQ ID NO: 713974 - RNA, 22 nt, Human
ucagccugcuccaagugcugcc

SEQ ID NO: 713975 - RNA, 22 nt, Human
ggcugccuccucgagacaggau

SEQ ID NO: 713976 - RNA, 21 nt, Human
uccuuccuugagguccuuucc

SEQ ID NO: 713977 - RNA, 22 nt, Human
aaagucuccacugggaaccaaa

SEQ ID NO: 713978 - RNA, 22 nt, Human
agcucuccacacauaggacuag

SEQ ID NO: 713979 - RNA, 22 nt, Human
ucucuggggaaaaggcugauac

SEQ ID NO: 713980 - RNA, 22 nt, Human
ucagagucaacuguugccuguu

SEQ ID NO: 713981 - RNA, 20 nt, Human
uuugaacuuuguacucuguu

SEQ ID NO: 713982 - RNA, 22 nt, Human
gcucagaggcacgaccucuugg

SEQ ID NO: 713983 - RNA, 22 nt, Human
aguuacuugagacguuuaugaa

SEQ ID NO: 713984 - RNA, 17 nt, Human
ccuuagggcaguguggu

SEQ ID NO: 713985 - RNA, 19 nt, Human
gucuguguauuuguugcug

SEQ ID NO: 713986 - RNA, 22 nt, Human
cagaacuucauauugacguuag

SEQ ID NO: 713987 - RNA, 22 nt, Human
guuauucugcacaccuuuaaaa

SEQ ID NO: 713988 - RNA, 22 nt, Human
gcuccaggcagcauaguggaug

SEQ ID NO: 713989 - RNA, 22 nt, Human
ggcucccucaccaccaucacau

SEQ ID NO: 713990 - RNA, 22 nt, Human
aggccugggacgggagccguga

SEQ ID NO: 713991 - RNA, 22 nt, Human
ugggcuuaggucggaggcggcc

SEQ ID NO: 713992 - RNA, 22 nt, Human
cugugaugacaggcagggccaa

SEQ ID NO: 713993 - RNA, 19 nt, Human
ucccuggcgccucucgggc

SEQ ID NO: 713994 - RNA, 22 nt, Human
cauggcuucgcgcguccccgcu

SEQ ID NO: 713995 - RNA, 22 nt, Human
ugagccagauaagggcucacgc

SEQ ID NO: 713996 - RNA, 18 nt, Human
ggagcugggccccacucc

SEQ ID NO: 713997 - RNA, 22 nt, Human
uuaaagcaccuccuuggaugug

SEQ ID NO: 713998 - RNA, 22 nt, Human
agcacagcuuagcaccuggcac

SEQ ID NO: 713999 - RNA, 22 nt, Human
cuggcugggagcgagcugcuca

SEQ ID NO: 714000 - RNA, 22 nt, Human
acaggggcaggcaggacccuuu

SEQ ID NO: 714001 - RNA, 18 nt, Human
cugcuuacaaaaauaccc

SEQ ID NO: 714002 - RNA, 22 nt, Human
gucccugcccuccugggacuca

SEQ ID NO: 714003 - RNA, 22 nt, Human
aagagcauaugguucucaaagc

SEQ ID NO: 714004 - RNA, 22 nt, Human
gugugccuaugaguggugaaca

SEQ ID NO: 714005 - RNA, 22 nt, Human
uacaguuuuucacugaagaugu

SEQ ID NO: 714006 - RNA, 22 nt, Human
uucaacauuugaaaugaaugaa

SEQ ID NO: 714007 - RNA, 22 nt, Human
agaaaaguuuucugagacugac

SEQ ID NO: 714008 - RNA, 22 nt, Human
agagguuucuuaggggcuuccu

SEQ ID NO: 714009 - RNA, 22 nt, Human
caagagcugcaaauagcgugac

SEQ ID NO: 714010 - RNA, 22 nt, Human
ugcagcuggauuuaucuuuucc

SEQ ID NO: 714011 - RNA, 22 nt, Human
gugcacagaagcagaagcuaga

SEQ ID NO: 714012 - RNA, 22 nt, Human
ugauucaaauauuguguaugau

SEQ ID NO: 714013 - RNA, 22 nt, Human
uauuuguauguguguacauaua

SEQ ID NO: 714014 - RNA, 21 nt, Human
gggcagcacgucauuccugug

SEQ ID NO: 714015 - RNA, 22 nt, Human
agguuggcugcucuuuuccuaa

SEQ ID NO: 714016 - RNA, 22 nt, Human
caaaugaauuucccugcaaaug

SEQ ID NO: 714017 - RNA, 22 nt, Human
cagcuacacuucuggguguguc

SEQ ID NO: 714018 - RNA, 22 nt, Human
gccugcagggugaugggcugcc

SEQ ID NO: 714019 - RNA, 22 nt, Human
aaacugaggcucccgagggugu

SEQ ID NO: 714020 - RNA, 22 nt, Human
acagggcauuuccucuaugugu

SEQ ID NO: 714021 - RNA, 22 nt, Human
aucaagaauguucauucuucua

SEQ ID NO: 714022 - RNA, 23 nt, Human
uguaaaaugggguaguguuacca

SEQ ID NO: 714023 - RNA, 22 nt, Human
cgauggaauuggaaagaggaau

SEQ ID NO: 714024 - RNA, 22 nt, Human
cagacucugaugcagccuugug

SEQ ID NO: 714025 - RNA, 22 nt, Human
aggaggccgcugaugggcuccc

SEQ ID NO: 714026 - RNA, 22 nt, Human
gaaaccucuuagccucucuuug

SEQ ID NO: 714027 - RNA, 22 nt, Human
aauccauuuacucuuuacaaga

SEQ ID NO: 714028 - RNA, 22 nt, Human
uuccuggugaccucacugguag

SEQ ID NO: 714029 - RNA, 22 nt, Human
gggcagagguucaacuucaaca

SEQ ID NO: 714030 - RNA, 22 nt, Human
aacaguaaagacagaauuuauc

SEQ ID NO: 714031 - RNA, 22 nt, Human
gcuccugggcccugggcuaacu

SEQ ID NO: 714032 - RNA, 20 nt, Human
ucauuguguugccaauuccc

SEQ ID NO: 714033 - RNA, 23 nt, Human
ucaguacucugcuggguauagag

SEQ ID NO: 714034 - RNA, 22 nt, Human
caggcagcugaggacuuugcua

SEQ ID NO: 714035 - RNA, 22 nt, Human
uaaagccacgcuggaaaucagg

SEQ ID NO: 714036 - RNA, 22 nt, Human
ucaggcaggcagagggcaaaug

SEQ ID NO: 714037 - RNA, 22 nt, Human
cuuuacagaauaagaauacugg

SEQ ID NO: 714038 - RNA, 23 nt, Human
auggucagaauuuuccagcugag

SEQ ID NO: 714039 - RNA, 22 nt, Human
uccaagagaauacuggagagua

SEQ ID NO: 714040 - RNA, 22 nt, Human
aggggccugguuggccucuguu

SEQ ID NO: 714041 - RNA, 22 nt, Human
ugccaucugcacccaccugccc

SEQ ID NO: 714042 - RNA, 17 nt, Human
gccucugcuugugucau

SEQ ID NO: 714043 - RNA, 22 nt, Human
uuccauaaaggugauaguauac

SEQ ID NO: 714044 - RNA, 22 nt, Human
acuggccaggagcuggaaauac

SEQ ID NO: 714045 - RNA, 22 nt, Human
gauggaggaaaaguuggaaugc

SEQ ID NO: 714046 - RNA, 20 nt, Human
cuguguagugcucagguaag

SEQ ID NO: 714047 - RNA, 22 nt, Human
cuucaguguucccaucuguaaa

SEQ ID NO: 714048 - RNA, 22 nt, Human
agcugguuagcaaucuaaguga

SEQ ID NO: 714049 - RNA, 22 nt, Human
ucaggagggaguguggauagag

SEQ ID NO: 714050 - RNA, 22 nt, Human
guccagggcuaaaucagguucc

SEQ ID NO: 714051 - RNA, 22 nt, Human
uuucagccagugaugcugaaga

SEQ ID NO: 714052 - RNA, 22 nt, Human
gccuggagaaaggaagguggga

SEQ ID NO: 714053 - RNA, 22 nt, Human
gucuggggaagucagggcauca

SEQ ID NO: 714054 - RNA, 22 nt, Human
gccagccagaguccaucugaga

SEQ ID NO: 714055 - RNA, 21 nt, Human
uucacaguggauaacuuucug

SEQ ID NO: 714056 - RNA, 23 nt, Human
agaugaaagcuucccaucacagu

SEQ ID NO: 714057 - RNA, 22 nt, Human
agucaucucagguagcauuuac

SEQ ID NO: 714058 - RNA, 22 nt, Human
auugcacuccagcccugcugac

SEQ ID NO: 714059 - RNA, 22 nt, Human
uagccccagcuacucggaagcu

SEQ ID NO: 714060 - RNA, 22 nt, Human
auaaggcagugacuucaucuau

SEQ ID NO: 714061 - RNA, 22 nt, Human
auaugcagagagcaugaauagg

SEQ ID NO: 714062 - RNA, 22 nt, Human
agggccaaguccaggaccucgg

SEQ ID NO: 714063 - RNA, 22 nt, Human
auugaaagauaggcuacugugg

SEQ ID NO: 714064 - RNA, 17 nt, Human
gagccacccugugcgag

SEQ ID NO: 714065 - RNA, 22 nt, Human
cauuugcaagagauaaauguuu

SEQ ID NO: 714066 - RNA, 22 nt, Human
cagggcagccaggccccguggg

SEQ ID NO: 714067 - RNA, 22 nt, Human
caggauggugugagugugagga

SEQ ID NO: 714068 - RNA, 22 nt, Human
guguguaaaccuccaaucuggg

SEQ ID NO: 714069 - RNA, 22 nt, Human
ucuuccagcaaugugaaaucac

SEQ ID NO: 714070 - RNA, 22 nt, Human
ggcccugaagugauugugaguu

SEQ ID NO: 714071 - RNA, 22 nt, Human
auuccacaugaaaggagcugaa

SEQ ID NO: 714072 - RNA, 22 nt, Human
auguucuuguucaaaugucagu

SEQ ID NO: 714073 - RNA, 22 nt, Human
uaagaacuucggacauguuauc

SEQ ID NO: 714074 - RNA, 22 nt, Human
ucugugauaguuuuucagcuau

SEQ ID NO: 714075 - RNA, 22 nt, Human
uaacauuacggacaucugucag

SEQ ID NO: 714076 - RNA, 22 nt, Human
gaagcuguguugauggcaugga

SEQ ID NO: 714077 - RNA, 22 nt, Human
guaaacaucagccacucuauuu

SEQ ID NO: 714078 - RNA, 22 nt, Human
aaaggcacagaagggaaaccaa

SEQ ID NO: 714079 - RNA, 22 nt, Human
aggcccugggagcagagaugca

SEQ ID NO: 714080 - RNA, 22 nt, Human
gagccugccucuagucucuaga

SEQ ID NO: 714081 - RNA, 21 nt, Human
ccaggggcaaauugucguuuc

SEQ ID NO: 714082 - RNA, 22 nt, Human
ccagagccugcugagccccauu

SEQ ID NO: 714083 - RNA, 22 nt, Human
agggcugaagggaggugcucau

SEQ ID NO: 714084 - RNA, 22 nt, Human
guuugucaggagguugaaguca

SEQ ID NO: 714085 - RNA, 22 nt, Human
aggagccaaauuuuagacucug

SEQ ID NO: 714086 - RNA, 22 nt, Human
ggcuguggggccggguacagug

SEQ ID NO: 714087 - RNA, 22 nt, Human
uuguguggauaauauuacuuga

SEQ ID NO: 714088 - RNA, 22 nt, Human
uagaaguucaugcgaauuauuu

SEQ ID NO: 714089 - RNA, 22 nt, Human
cuucagcaccucagcuggagag

SEQ ID NO: 714090 - RNA, 22 nt, Human
acccacagaaccugugacaaca

SEQ ID NO: 714091 - RNA, 22 nt, Human
ucagguaaguguaauauauaga

SEQ ID NO: 714092 - RNA, 22 nt, Human
uccuuuugcugggaucaucagg

SEQ ID NO: 714093 - RNA, 22 nt, Human
accauuuaaggaaaauguauca

SEQ ID NO: 714094 - RNA, 22 nt, Human
gcugggacugagacagugaccu

SEQ ID NO: 714095 - RNA, 22 nt, Human
auacagcuuaugcauauaucuc

SEQ ID NO: 714096 - RNA, 22 nt, Human
gaggaagaagggauuagaacuc

SEQ ID NO: 714097 - RNA, 22 nt, Human
cuccagguagcuaaguccuggg

SEQ ID NO: 714098 - RNA, 22 nt, Human
cuggccugggagcugcuagcgu

SEQ ID NO: 714099 - RNA, 22 nt, Human
guacauuuaggauucauugaaa

SEQ ID NO: 714100 - RNA, 22 nt, Human
guugcagacacuccacagucga

SEQ ID NO: 714101 - RNA, 22 nt, Human
gagaggggcccaagccacauag

SEQ ID NO: 714102 - RNA, 22 nt, Human
ggucagugacuuuuuucugugg

SEQ ID NO: 714103 - RNA, 22 nt, Human
auucuucuugagucuuggacuc

SEQ ID NO: 714104 - RNA, 22 nt, Human
aauagcugauuagccuacaaua

SEQ ID NO: 714105 - RNA, 22 nt, Human
acaguuucuccauuuacaccuu

SEQ ID NO: 714106 - RNA, 22 nt, Human
aacagcaggcaccaaggcuaug

SEQ ID NO: 714107 - RNA, 22 nt, Human
uuuaguguggcacugauguuca

SEQ ID NO: 714108 - RNA, 22 nt, Human
ggccaggcugguuccuugaccu

SEQ ID NO: 714109 - RNA, 22 nt, Human
auaucagaaauaguaagcagag

SEQ ID NO: 714110 - RNA, 22 nt, Human
aaguugguaggagacagaaggu

SEQ ID NO: 714111 - RNA, 22 nt, Human
gaaauguaauucucuugaagau

SEQ ID NO: 714112 - RNA, 23 nt, Human
ucugugccaguuuccaugucugu

SEQ ID NO: 714113 - RNA, 22 nt, Human
uuccugugauauuagccacugu

SEQ ID NO: 714114 - RNA, 22 nt, Human
aggagcuggccuagaaaggaga

SEQ ID NO: 714115 - RNA, 22 nt, Human
uacuguauuugauaagugaagu

SEQ ID NO: 714116 - RNA, 23 nt, Human
ucagcagcagaagugcugggaug

SEQ ID NO: 714117 - RNA, 22 nt, Human
ucuggcaccacugagucugcag

SEQ ID NO: 714118 - RNA, 22 nt, Human
acagagcucccagccaucuccu

SEQ ID NO: 714119 - RNA, 18 nt, Human
cugcuucugucugccagu

SEQ ID NO: 714120 - RNA, 22 nt, Human
gcacagcaauuucuauaagcuc

SEQ ID NO: 714121 - RNA, 21 nt, Human
ucuugaaaauuguagcaguuu

SEQ ID NO: 714122 - RNA, 17 nt, Human
guccugggaggagagag

SEQ ID NO: 714123 - RNA, 22 nt, Human
aacuuacaaggaugauagcugc

SEQ ID NO: 714124 - RNA, 23 nt, Human
cgugcuuccaggcccagcugagc

SEQ ID NO: 714125 - RNA, 22 nt, Human
gcagagcagcaaauggaaagga

SEQ ID NO: 714126 - RNA, 22 nt, Human
cucugcuguucuuauguguccu

SEQ ID NO: 714127 - RNA, 22 nt, Human
ucuuuagugaccaucucauucu

SEQ ID NO: 714128 - RNA, 22 nt, Human
gugggcuggagcaaugauuuca

SEQ ID NO: 714129 - RNA, 22 nt, Human
cagggcacuuaaauugccucgu

SEQ ID NO: 714130 - RNA, 22 nt, Human
auagaaauguauuuuggacuag

SEQ ID NO: 714131 - RNA, 22 nt, Human
uggaggcccacacuggguagau

SEQ ID NO: 714132 - RNA, 22 nt, Human
acuguacaugcaucuugucuau

SEQ ID NO: 714133 - RNA, 22 nt, Human
caaggaaaaagcgagcucgggg

SEQ ID NO: 714134 - RNA, 22 nt, Human
agagacagaggcaauauagcuu

SEQ ID NO: 714135 - RNA, 22 nt, Human
aggauccuguauggagaagcug

SEQ ID NO: 714136 - RNA, 22 nt, Human
uaagcauucaaugcuuagcacu

SEQ ID NO: 714137 - RNA, 22 nt, Human
aagggcucucugcauugaaauu

SEQ ID NO: 714138 - RNA, 22 nt, Human
cuuggggaugcaaagccagugu

SEQ ID NO: 714139 - RNA, 22 nt, Human
gaauugcuaggcugcauguguc

SEQ ID NO: 714140 - RNA, 22 nt, Human
aggagucuguugaaaugucuau

SEQ ID NO: 714141 - RNA, 21 nt, Human
cugggcuuucucucaaagaca

SEQ ID NO: 714142 - RNA, 22 nt, Human
ucuuagcaaauacuacuuagaa

SEQ ID NO: 714143 - RNA, 22 nt, Human
ugcugcucucagccaccaggaa

SEQ ID NO: 714144 - RNA, 22 nt, Human
guuagggaucaggaacaagagc

SEQ ID NO: 714145 - RNA, 22 nt, Human
cugcccuguggcucugagucau

SEQ ID NO: 714146 - RNA, 21 nt, Human
gaaaauacaaugagcuugacc

SEQ ID NO: 714147 - RNA, 17 nt, Human
gugaagagucauugaau

SEQ ID NO: 714148 - RNA, 20 nt, Human
caggaaccaaagaggacucc

SEQ ID NO: 714149 - RNA, 22 nt, Human
ccuggagcacucucccuggcug

SEQ ID NO: 714150 - RNA, 22 nt, Human
ugauaugugaagcuauuaguuc

SEQ ID NO: 714151 - RNA, 22 nt, Human
accugagaccuaaucugacugu

SEQ ID NO: 714152 - RNA, 20 nt, Human
gugcagcacuuggggguagg

SEQ ID NO: 714153 - RNA, 22 nt, Human
guggcaguagacagugcaucua

SEQ ID NO: 714154 - RNA, 19 nt, Human
agaagcccagaucccagcc

SEQ ID NO: 714155 - RNA, 22 nt, Human
acauauugagcucuaaaaguac

SEQ ID NO: 714156 - RNA, 20 nt, Human
gugugugcuccaugcaugcu

SEQ ID NO: 714157 - RNA, 22 nt, Human
uacacaguaaaugguaaauaca

SEQ ID NO: 714158 - RNA, 17 nt, Human
agaacuguaguagcucc

SEQ ID NO: 714159 - RNA, 22 nt, Human
gaggagccuggccccacaucca

SEQ ID NO: 714160 - RNA, 22 nt, Human
ccucccugggugacgggcuccu

SEQ ID NO: 714161 - RNA, 22 nt, Human
gaggucuggaccaagucgcccc

SEQ ID NO: 714162 - RNA, 22 nt, Human
uaagauuacagugagaaauaaa

SEQ ID NO: 714163 - RNA, 22 nt, Human
agcagcacacgggagaaagaca

SEQ ID NO: 714164 - RNA, 22 nt, Human
caaccugaugaauugaauuuaa

SEQ ID NO: 714165 - RNA, 22 nt, Human
auuuuugcccugcaguacauaa

SEQ ID NO: 714166 - RNA, 22 nt, Human
augaggcccaggaaucuguauu

SEQ ID NO: 714167 - RNA, 22 nt, Human
caucaaauaggaauauuuggca

SEQ ID NO: 714168 - RNA, 22 nt, Human
uucugcauuucuaauaaguucc

SEQ ID NO: 714169 - RNA, 22 nt, Human
gggggaagacugggcuagugau

SEQ ID NO: 714170 - RNA, 22 nt, Human
aggccaaguuacuugggaaagc

SEQ ID NO: 714171 - RNA, 22 nt, Human
uauuucaccucacccaggagaa

SEQ ID NO: 714172 - RNA, 22 nt, Human
gcacagccacguaaugugguca

SEQ ID NO: 714173 - RNA, 22 nt, Human
gaggccaggggccuggagauga

SEQ ID NO: 714174 - RNA, 22 nt, Human
guuuaaccauugcauauccaua

SEQ ID NO: 714175 - RNA, 21 nt, Human
aggaaaggaaguccccagggu

SEQ ID NO: 714176 - RNA, 23 nt, Human
ugccaaaguuuaccuaacacugg

SEQ ID NO: 714177 - RNA, 22 nt, Human
caaaucacaaugugagacugag

SEQ ID NO: 714178 - RNA, 22 nt, Human
uugggcacggacagguggggau

SEQ ID NO: 714179 - RNA, 23 nt, Human
aggagaagagauuuccacaugca

SEQ ID NO: 714180 - RNA, 22 nt, Human
uuccugagaaauuuguaccugg

SEQ ID NO: 714181 - RNA, 22 nt, Human
gaggaagaagcaaaccagcuaa

SEQ ID NO: 714182 - RNA, 22 nt, Human
ugcauuguuugauaggugaauu

SEQ ID NO: 714183 - RNA, 22 nt, Human
gcuucuguauuuauuguccuuu

SEQ ID NO: 714184 - RNA, 22 nt, Human
auauguauugagugccaacugu

SEQ ID NO: 714185 - RNA, 22 nt, Human
gcuugaguuuugggacaaagcc

SEQ ID NO: 714186 - RNA, 22 nt, Human
ggccugcugacccaaguccugu

SEQ ID NO: 714187 - RNA, 22 nt, Human
gggcucugugguugugcuuugu

SEQ ID NO: 714188 - RNA, 22 nt, Human
uaguguuuaguacauaugcaua

SEQ ID NO: 714189 - RNA, 22 nt, Human
ccccucuugugggcucagguca

SEQ ID NO: 714190 - RNA, 22 nt, Human
ggcaaagccuuccagcuguuac

SEQ ID NO: 714191 - RNA, 22 nt, Human
auucaguuccuugugauuguag

SEQ ID NO: 714192 - RNA, 22 nt, Human
agaccuggaguggggccucagg

SEQ ID NO: 714193 - RNA, 22 nt, Human
ucacuguauuugcugaugcaua

SEQ ID NO: 714194 - RNA, 19 nt, Human
gcagaugaugaggcugguc

SEQ ID NO: 714195 - RNA, 22 nt, Human
cccugaggaaaggguggagggc

SEQ ID NO: 714196 - RNA, 22 nt, Human
agcagaguuucucaacaucagc

SEQ ID NO: 714197 - RNA, 21 nt, Human
agcuuccagagcacauuccau

SEQ ID NO: 714198 - RNA, 22 nt, Human
ucugugucuguuacuucacugc

SEQ ID NO: 714199 - RNA, 22 nt, Human
gcugggcuccaggccaggguga

SEQ ID NO: 714200 - RNA, 22 nt, Human
auuucuggacugaaaaggaagu

SEQ ID NO: 714201 - RNA, 17 nt, Human
uguaagcaggugagaga

SEQ ID NO: 714202 - RNA, 22 nt, Human
ucagggaaauucaagggagauu

SEQ ID NO: 714203 - RNA, 22 nt, Human
gugggagcauggucccagugcc

SEQ ID NO: 714204 - RNA, 22 nt, Human
caggcucgguccaguggcaccc

SEQ ID NO: 714205 - RNA, 22 nt, Human
agcuguuuucuaaugcauuuga

SEQ ID NO: 714206 - RNA, 22 nt, Human
ucuguggagugaccugggcuuu

SEQ ID NO: 714207 - RNA, 22 nt, Human
ccuggucccauugcggcugccu

SEQ ID NO: 714208 - RNA, 22 nt, Human
gggcagaggggcgcuucccucu

SEQ ID NO: 714209 - RNA, 19 nt, Human
uuucagacauuucaaauuu

SEQ ID NO: 714210 - RNA, 22 nt, Human
acuagaaagcaaaagccauuuc

SEQ ID NO: 714211 - RNA, 22 nt, Human
acguguguuuaacaaaccugca

SEQ ID NO: 714212 - RNA, 22 nt, Human
gcaggaguuaaaauauguaaug

SEQ ID NO: 714213 - RNA, 22 nt, Human
cuuuuagcuguuuccauggcaa

SEQ ID NO: 714214 - RNA, 22 nt, Human
uguggcagucucacuggagggc

SEQ ID NO: 714215 - RNA, 22 nt, Human
ccucuuugacuauaguaguuaa

SEQ ID NO: 714216 - RNA, 22 nt, Human
uugauacaggcucuauuucauc

SEQ ID NO: 714217 - RNA, 22 nt, Human
ccucccugggugcugggauugc

SEQ ID NO: 714218 - RNA, 21 nt, Human
gacauccaugugaguggcagu

SEQ ID NO: 714219 - RNA, 21 nt, Human
ggucuuccaaauaaggagaaa

SEQ ID NO: 714220 - RNA, 22 nt, Human
uucaggaagugcugccuggugu

SEQ ID NO: 714221 - RNA, 22 nt, Human
cacaauuuuucuuagguccugg

SEQ ID NO: 714222 - RNA, 22 nt, Human
gauauguaugaggaguauguau

SEQ ID NO: 714223 - RNA, 22 nt, Human
ugagaaaaguacauggagaagc

SEQ ID NO: 714224 - RNA, 19 nt, Human
uccaggagcaaagccaguu

SEQ ID NO: 714225 - RNA, 22 nt, Human
caaacuuacuguguuuaaagag

SEQ ID NO: 714226 - RNA, 22 nt, Human
aagaaacugaaaguggcuucau

SEQ ID NO: 714227 - RNA, 22 nt, Human
caggggccaaggguccagaccu

SEQ ID NO: 714228 - RNA, 22 nt, Human
acagaggccucggccugcccag

SEQ ID NO: 714229 - RNA, 22 nt, Human
gcaaauacauguugagcaccua

SEQ ID NO: 714230 - RNA, 22 nt, Human
cagaggcaggauaagaacugcg

SEQ ID NO: 714231 - RNA, 20 nt, Human
auaaaauaacugccacaaga

SEQ ID NO: 714232 - RNA, 22 nt, Human
cacaguggcaaaggggcuuggg

SEQ ID NO: 714233 - RNA, 19 nt, Human
agcccccagacagcaggcc

SEQ ID NO: 714234 - RNA, 22 nt, Human
ccugggcucaagugauccuccu

SEQ ID NO: 714235 - RNA, 22 nt, Human
gugcaaacaucauagaguguac

SEQ ID NO: 714236 - RNA, 22 nt, Human
guacaauagcaguuuucccuuu

SEQ ID NO: 714237 - RNA, 22 nt, Human
gcuauuguuuauuuugaaucua

SEQ ID NO: 714238 - RNA, 22 nt, Human
aacaacagcugcuaaagaguug

SEQ ID NO: 714239 - RNA, 22 nt, Human
aagggcugggucugguuaaccc

SEQ ID NO: 714240 - RNA, 22 nt, Human
aaauuaagggugagaagaguug

SEQ ID NO: 714241 - RNA, 22 nt, Human
gacuccagaaucuggacggucc

SEQ ID NO: 714242 - RNA, 22 nt, Human
acaagguuugguaccacaucca

SEQ ID NO: 714243 - RNA, 21 nt, Human
ugucuccuguuggcacauggc

SEQ ID NO: 714244 - RNA, 22 nt, Human
ucugggcaguucggauccucug

SEQ ID NO: 714245 - RNA, 22 nt, Human
auuuucagugaucauagcacac

SEQ ID NO: 714246 - RNA, 22 nt, Human
uacaaugacucucaguuuggcu

SEQ ID NO: 714247 - RNA, 20 nt, Human
aggagggaccuggauuggcg

SEQ ID NO: 714248 - RNA, 22 nt, Human
gcugagguuuucugccugcuca

SEQ ID NO: 714249 - RNA, 22 nt, Human
auuuaauuugugucuuuagcug

SEQ ID NO: 714250 - RNA, 22 nt, Human
gcacagggccuggcacauaaga

SEQ ID NO: 714251 - RNA, 20 nt, Human
cccaggagcugugccccauc

SEQ ID NO: 714252 - RNA, 22 nt, Human
aaaaggaggcaaacagccuaga

SEQ ID NO: 714253 - RNA, 20 nt, Human
aggguggggacguucugacu

SEQ ID NO: 714254 - RNA, 22 nt, Human
uccccacacuuucacuccuggc

SEQ ID NO: 714255 - RNA, 22 nt, Human
cugagggaacuugggcaagucu

SEQ ID NO: 714256 - RNA, 22 nt, Human
ugauugcuucuuugcuaucugu

SEQ ID NO: 714257 - RNA, 22 nt, Human
uuggaaagggaggaauguagac

SEQ ID NO: 714258 - RNA, 22 nt, Human
uggcucugcgucuguucguggg

SEQ ID NO: 714259 - RNA, 22 nt, Human
agggcagcacagcugugcuccu

SEQ ID NO: 714260 - RNA, 22 nt, Human
auguacaccaggugaagaugaa

SEQ ID NO: 714261 - RNA, 22 nt, Human
aucuggaggcauuacucugucu

SEQ ID NO: 714262 - RNA, 20 nt, Human
uuuuuccuucucuacaggca

SEQ ID NO: 714263 - RNA, 22 nt, Human
aacaaaggccguuaauaaccac

SEQ ID NO: 714264 - RNA, 22 nt, Human
cuucaaggaagccacguuggga

SEQ ID NO: 714265 - RNA, 20 nt, Human
ggcaagcaacugagggagga

SEQ ID NO: 714266 - RNA, 22 nt, Human
uuucaguuguccuguuaauagc

SEQ ID NO: 714267 - RNA, 22 nt, Human
ucacauacacuaggauauuuuu

SEQ ID NO: 714268 - RNA, 22 nt, Human
ucagggcugacugcuacucucc

SEQ ID NO: 714269 - RNA, 22 nt, Human
aguaaacuguggguacagaugu

SEQ ID NO: 714270 - RNA, 22 nt, Human
caugggcugcugacaggggcuc

SEQ ID NO: 714271 - RNA, 22 nt, Human
aaguucaagucugcaucuuuuu

SEQ ID NO: 714272 - RNA, 22 nt, Human
ggcugggcucgcugauuggcug

SEQ ID NO: 714273 - RNA, 18 nt, Human
ccuacaucauugugagag

SEQ ID NO: 714274 - RNA, 22 nt, Human
acucaucuauuagauaucuguu

SEQ ID NO: 714275 - RNA, 22 nt, Human
cucucugucuuggcauuugguc

SEQ ID NO: 714276 - RNA, 22 nt, Human
gagcagaucucaggccuucugu

SEQ ID NO: 714277 - RNA, 22 nt, Human
agucugaagauauucuugcagg

SEQ ID NO: 714278 - RNA, 22 nt, Human
ggcuuucuagaucuagcucugu

SEQ ID NO: 714279 - RNA, 22 nt, Human
uugcugaucugaaacguuacug

SEQ ID NO: 714280 - RNA, 22 nt, Human
aaauauguaaccaaggugaagu

SEQ ID NO: 714281 - RNA, 22 nt, Human
gaagagcugcacacuggggacu

SEQ ID NO: 714282 - RNA, 22 nt, Human
gcuuucaaggaauuugguauuu

SEQ ID NO: 714283 - RNA, 22 nt, Human
ucacagcaccaggaucucucca

SEQ ID NO: 714284 - RNA, 22 nt, Human
gaaggagagggucaaggauaau

SEQ ID NO: 714285 - RNA, 22 nt, Human
gcaguacacacauauguauucg

SEQ ID NO: 714286 - RNA, 22 nt, Human
uuucacagaaaggauaacauua

SEQ ID NO: 714287 - RNA, 19 nt, Human
ccucacccugcagaggagg

SEQ ID NO: 714288 - RNA, 22 nt, Human
aagcagcaugauuguaauacua

SEQ ID NO: 714289 - RNA, 22 nt, Human
uaauacacacucucauuccuaa

SEQ ID NO: 714290 - RNA, 22 nt, Human
uaacacaugucugggaugugaa

SEQ ID NO: 714291 - RNA, 22 nt, Human
agcuggccuucggugucacugg

SEQ ID NO: 714292 - RNA, 22 nt, Human
ggcuucugaaccaggcccugga

SEQ ID NO: 714293 - RNA, 21 nt, Human
uggguggaagcgggaggccgc

SEQ ID NO: 714294 - RNA, 22 nt, Human
auggcugugagcaggcagcuuc

SEQ ID NO: 714295 - RNA, 22 nt, Human
uuauucuuggaucugagucucu

SEQ ID NO: 714296 - RNA, 22 nt, Human
uucccuuccucacucuacuugu

SEQ ID NO: 714297 - RNA, 22 nt, Human
ggaggggugagaauggcugccu

SEQ ID NO: 714298 - RNA, 22 nt, Human
cgccucagccguggucaucuuc

SEQ ID NO: 714299 - RNA, 19 nt, Human
ccaggucuggggccagauu

SEQ ID NO: 714300 - RNA, 22 nt, Human
agugauuuugcuuugaagugac

SEQ ID NO: 714301 - RNA, 22 nt, Human
ugccacacaauuacugcugcua

SEQ ID NO: 714302 - RNA, 22 nt, Human
ggcaccaucagcugugcagggg

SEQ ID NO: 714303 - RNA, 23 nt, Human
gccaugaguucccuuucacuugu

SEQ ID NO: 714304 - RNA, 22 nt, Human
aggugagggugccagugcaugg

SEQ ID NO: 714305 - RNA, 22 nt, Human
auuccacuuauaugaaguaacg

SEQ ID NO: 714306 - RNA, 22 nt, Human
acuuugaaggggaacauuuuaa

SEQ ID NO: 714307 - RNA, 22 nt, Human
ggcugagacaaccugggaccca

SEQ ID NO: 714308 - RNA, 22 nt, Human
uuagcaguuuccauuuugguca

SEQ ID NO: 714309 - RNA, 22 nt, Human
gaagcccauuuguacagcacau

SEQ ID NO: 714310 - RNA, 22 nt, Human
caguggucugugcuucuguaca

SEQ ID NO: 714311 - RNA, 22 nt, Human
cuggcugugucuuggaggagcu

SEQ ID NO: 714312 - RNA, 22 nt, Human
gacugugggcuccuugagggca

SEQ ID NO: 714313 - RNA, 22 nt, Human
ccaggcugcucacaagcugccc

SEQ ID NO: 714314 - RNA, 22 nt, Human
ugugggaaaugggaguggaaga

SEQ ID NO: 714315 - RNA, 22 nt, Human
agauacaugucaagagacuuau

SEQ ID NO: 714316 - RNA, 22 nt, Human
uauacagcuauggcaagacaaa

SEQ ID NO: 714317 - RNA, 22 nt, Human
gucuaaacaaaaaugcaccuuu

SEQ ID NO: 714318 - RNA, 22 nt, Human
gcauuuggaacuugguugagau

SEQ ID NO: 714319 - RNA, 22 nt, Human
gugucauuaaccaccaugcaaa

SEQ ID NO: 714320 - RNA, 22 nt, Human
aaucaguuaggguguuaaugag

SEQ ID NO: 714321 - RNA, 22 nt, Human
auccugucuaugaguagauaau

SEQ ID NO: 714322 - RNA, 22 nt, Human
gggcacagcccagugggguccc

SEQ ID NO: 714323 - RNA, 22 nt, Human
cagugagauaccacagagcaaa

SEQ ID NO: 714324 - RNA, 22 nt, Human
ggaccugcauuuuaacaagauc

SEQ ID NO: 714325 - RNA, 22 nt, Human
cacauaaguggguuccauugca

SEQ ID NO: 714326 - RNA, 22 nt, Human
acuguggccaaagccucuggga

SEQ ID NO: 714327 - RNA, 22 nt, Human
aggcuggagugcuggagugcug

SEQ ID NO: 714328 - RNA, 22 nt, Human
aggccagcucuacccuuggacu

SEQ ID NO: 714329 - RNA, 22 nt, Human
gcuccucucccagagcugcagg

SEQ ID NO: 714330 - RNA, 22 nt, Human
cagaaaccucccugaauauuuu

SEQ ID NO: 714331 - RNA, 22 nt, Human
acagccauagaugcuuauguaa

SEQ ID NO: 714332 - RNA, 22 nt, Human
uuucagaccuggaugugggggc

SEQ ID NO: 714333 - RNA, 22 nt, Human
gugugccaccagucaaggugaa

SEQ ID NO: 714334 - RNA, 22 nt, Human
ccccucuuguacuagacaguuu

SEQ ID NO: 714335 - RNA, 22 nt, Human
agccaaucauccucagacucuc

SEQ ID NO: 714336 - RNA, 18 nt, Human
ccucugccuuuguagagc

SEQ ID NO: 714337 - RNA, 22 nt, Human
agggcgcugaaauacuaacaug

SEQ ID NO: 714338 - RNA, 22 nt, Human
ugaaaccauucucagguacacu

SEQ ID NO: 714339 - RNA, 22 nt, Human
uggcucugggcaccguguccac

SEQ ID NO: 714340 - RNA, 22 nt, Human
ucuaacauugaauggcugauua

SEQ ID NO: 714341 - RNA, 22 nt, Human
aacaaauggaacacaaaucuuu

SEQ ID NO: 714342 - RNA, 22 nt, Human
ucacccaggguguuuggugucu

SEQ ID NO: 714343 - RNA, 21 nt, Human
cuggagcuuggugagaagugu

SEQ ID NO: 714344 - RNA, 22 nt, Human
ugcugccuuuguggggucacug

SEQ ID NO: 714345 - RNA, 22 nt, Human
uccuucuacacugccucugaga

SEQ ID NO: 714346 - RNA, 22 nt, Human
cucugcaggccuugaguguggu

SEQ ID NO: 714347 - RNA, 22 nt, Human
uuugcuugacccuugugcugaa

SEQ ID NO: 714348 - RNA, 22 nt, Human
auaagguaugaaaaguaaaugg

SEQ ID NO: 714349 - RNA, 22 nt, Human
cuuuacugccaugcauuuauaa

SEQ ID NO: 714350 - RNA, 22 nt, Human
uacuuuggaagaguucauacag

SEQ ID NO: 714351 - RNA, 23 nt, Human
ggcuccugcuucaugucccaccu

SEQ ID NO: 714352 - RNA, 23 nt, Human
augcaggacuuauaagguaaggu

SEQ ID NO: 714353 - RNA, 22 nt, Human
ucuagaaaaaaacugcugugga

SEQ ID NO: 714354 - RNA, 22 nt, Human
ugucucuuggauugcuugcucu

SEQ ID NO: 714355 - RNA, 22 nt, Human
cacaccugugagucucggcuug

SEQ ID NO: 714356 - RNA, 22 nt, Human
uuuaauaucucacacuuccaug

SEQ ID NO: 714357 - RNA, 22 nt, Human
ggagugaagcaaauaaugcugg

SEQ ID NO: 714358 - RNA, 22 nt, Human
ucaguggagcuaagcaugagau

SEQ ID NO: 714359 - RNA, 18 nt, Human
gcuuugcacucauguugu

SEQ ID NO: 714360 - RNA, 21 nt, Human
uccugggggguaggugaguuu

SEQ ID NO: 714361 - RNA, 22 nt, Human
cucugagcucgugcaguacuuc

SEQ ID NO: 714362 - RNA, 22 nt, Human
acccugagggugcuggguuucu

SEQ ID NO: 714363 - RNA, 22 nt, Human
aaccacauggcucaguggacau

SEQ ID NO: 714364 - RNA, 22 nt, Human
auguauguuaguguauuaucua

SEQ ID NO: 714365 - RNA, 22 nt, Human
gacagucccccagcagcaaacc

SEQ ID NO: 714366 - RNA, 22 nt, Human
uuauuuccugacacagcugauu

SEQ ID NO: 714367 - RNA, 22 nt, Human
ugugagaagggugaggcuuuua

SEQ ID NO: 714368 - RNA, 22 nt, Human
augaaagugaagguuuacuaag

SEQ ID NO: 714369 - RNA, 22 nt, Human
acuguggauaagucagagaugu

SEQ ID NO: 714370 - RNA, 22 nt, Human
cauguuggcugaggcuguauuu

SEQ ID NO: 714371 - RNA, 22 nt, Human
uuaagcaacacacauuaauuau

SEQ ID NO: 714372 - RNA, 22 nt, Human
agcaccauugcaaauauggcag

SEQ ID NO: 714373 - RNA, 22 nt, Human
ccagccucaucgccugccuguc

SEQ ID NO: 714374 - RNA, 22 nt, Human
ggcgugggaaguggggcuucug

SEQ ID NO: 714375 - RNA, 22 nt, Human
ccagcagcugacaccaguccca

SEQ ID NO: 714376 - RNA, 21 nt, Human
acugagggccagagaggaccu

SEQ ID NO: 714377 - RNA, 22 nt, Human
uuaauuuuaaccuguuuguguc

SEQ ID NO: 714378 - RNA, 22 nt, Human
uaccugcacagccagccaugug

SEQ ID NO: 714379 - RNA, 22 nt, Human
ugccucccucucugccacugga

SEQ ID NO: 714380 - RNA, 22 nt, Human
agagugggccucugagucccag

SEQ ID NO: 714381 - RNA, 22 nt, Human
uuucacaacugcuuauuugaga

SEQ ID NO: 714382 - RNA, 22 nt, Human
ucaggacaacauguugcuaauc

SEQ ID NO: 714383 - RNA, 22 nt, Human
ugguggggucaucgucagaugc

SEQ ID NO: 714384 - RNA, 22 nt, Human
uauuacagcuuugauuaucugg

SEQ ID NO: 714385 - RNA, 22 nt, Human
uggaggcauuugauguucauaa

SEQ ID NO: 714386 - RNA, 22 nt, Human
aggcucugggaagcagugaguu

SEQ ID NO: 714387 - RNA, 22 nt, Human
agaaguauuuggcuaaaagaca

SEQ ID NO: 714388 - RNA, 20 nt, Human
ggaagcuguggguccccagg

SEQ ID NO: 714389 - RNA, 22 nt, Human
cucaacauuuaacagugaaaaa

SEQ ID NO: 714390 - RNA, 22 nt, Human
agggcugagaaugacagggccg

SEQ ID NO: 714391 - RNA, 17 nt, Human
ccagcccucgcgcuuuu

SEQ ID NO: 714392 - RNA, 22 nt, Human
cccagcccagcguucgaggggu

SEQ ID NO: 714393 - RNA, 23 nt, Human
acugagcaauguuuacauacuug

SEQ ID NO: 714394 - RNA, 22 nt, Human
aauaaacugcucaauugcauca

SEQ ID NO: 714395 - RNA, 22 nt, Human
uuauuagaucuguuagggaucc

SEQ ID NO: 714396 - RNA, 22 nt, Human
aauacagcagauggagacaaau

SEQ ID NO: 714397 - RNA, 22 nt, Human
aagaucaagaucagagaacagc

SEQ ID NO: 714398 - RNA, 22 nt, Human
agugauggugagugagaagcuc

SEQ ID NO: 714399 - RNA, 22 nt, Human
agagcugaauucaagugcuggc

SEQ ID NO: 714400 - RNA, 22 nt, Human
uguccagcggccuggcugcuga

SEQ ID NO: 714401 - RNA, 22 nt, Human
acagcagagaacuuuagagggu

SEQ ID NO: 714402 - RNA, 22 nt, Human
guguuccauguuugagguaguu

SEQ ID NO: 714403 - RNA, 16 nt, Human
acuuccaggggagccc

SEQ ID NO: 714404 - RNA, 22 nt, Human
agcccacuguuuucauuucucu

SEQ ID NO: 714405 - RNA, 22 nt, Human
aagucauuaucucuucuaaucu

SEQ ID NO: 714406 - RNA, 22 nt, Human
acaaaauuguguuaaacuuuau

SEQ ID NO: 714407 - RNA, 22 nt, Human
ccagggcuccauugcucauccu

SEQ ID NO: 714408 - RNA, 22 nt, Human
uugaauaauguguauguuguua

SEQ ID NO: 714409 - RNA, 22 nt, Human
caaaaguaccuugugugcuuug

SEQ ID NO: 714410 - RNA, 23 nt, Human
agcuggaaauggccgagcucugc

SEQ ID NO: 714411 - RNA, 22 nt, Human
cugggagguggagguugcauug

SEQ ID NO: 714412 - RNA, 22 nt, Human
cauuauguucaguagcuuaaaa

SEQ ID NO: 714413 - RNA, 22 nt, Human
ucacuugaccucuugaacuccu

SEQ ID NO: 714414 - RNA, 22 nt, Human
uuugaaugagaauuauugucau

SEQ ID NO: 714415 - RNA, 22 nt, Human
ccacuuugaaccacugaggugg

SEQ ID NO: 714416 - RNA, 22 nt, Human
uaauuucuaauucauuuucagu

SEQ ID NO: 714417 - RNA, 17 nt, Human
ggucugugucuagggaa

SEQ ID NO: 714418 - RNA, 22 nt, Human
acugcugauuauugaaguagag

SEQ ID NO: 714419 - RNA, 22 nt, Human
agcauuuucugagaguauagau

SEQ ID NO: 714420 - RNA, 22 nt, Human
uuucaguuacugcuauaucauu

SEQ ID NO: 714421 - RNA, 22 nt, Human
aucaaaucauugcauuaauguu

SEQ ID NO: 714422 - RNA, 22 nt, Human
aggcuguggaugcuuaacaaau

SEQ ID NO: 714423 - RNA, 22 nt, Human
gcuucuguggugaggucaccuu

SEQ ID NO: 714424 - RNA, 22 nt, Human
ccagcucuggcuucuugcuggg

SEQ ID NO: 714425 - RNA, 22 nt, Human
uacacauguccaaggugucacc

SEQ ID NO: 714426 - RNA, 22 nt, Human
aaagaacuuauccuagaauuug

SEQ ID NO: 714427 - RNA, 22 nt, Human
ucccacagucucacaaugcaua

SEQ ID NO: 714428 - RNA, 22 nt, Human
ugcagauacaguauguggaagc

SEQ ID NO: 714429 - RNA, 22 nt, Human
aaacucuggauuggaguccagc

SEQ ID NO: 714430 - RNA, 22 nt, Human
gagcaaggcggcaucucucuga

SEQ ID NO: 714431 - RNA, 22 nt, Human
auuguaucuugucauuaugcau

SEQ ID NO: 714432 - RNA, 22 nt, Human
cuggaaagaccugcuugcuuuu

SEQ ID NO: 714433 - RNA, 22 nt, Human
acugcugauuuuaggacuguua

SEQ ID NO: 714434 - RNA, 22 nt, Human
uaugcgugccucugucugucug

SEQ ID NO: 714435 - RNA, 22 nt, Human
gcacagaacagagaaauagcca

SEQ ID NO: 714436 - RNA, 22 nt, Human
ggcgcaggccuuggauccuggu

SEQ ID NO: 714437 - RNA, 22 nt, Human
acagagcaacuuuauuucaugg

SEQ ID NO: 714438 - RNA, 22 nt, Human
cacacagugggaaaaccugaag

SEQ ID NO: 714439 - RNA, 22 nt, Human
uguaaaacaaaauuuguggaga

SEQ ID NO: 714440 - RNA, 22 nt, Human
agagggcccauguugggcugcu

SEQ ID NO: 714441 - RNA, 22 nt, Human
ugcaagagcuguggcaaaagca

SEQ ID NO: 714442 - RNA, 22 nt, Human
guccugggaaggaagccaggga

SEQ ID NO: 714443 - RNA, 19 nt, Human
gcugggagcagacccuccc

SEQ ID NO: 714444 - RNA, 22 nt, Human
agauauuuugugugauguuuca

SEQ ID NO: 714445 - RNA, 22 nt, Human
ccucugugccucaguuucaugu

SEQ ID NO: 714446 - RNA, 22 nt, Human
uggcugugugccaggcugucug

SEQ ID NO: 714447 - RNA, 22 nt, Human
uauguacaugauuucauuugcu

SEQ ID NO: 714448 - RNA, 22 nt, Human
auucugggccccaucccagacc

SEQ ID NO: 714449 - RNA, 22 nt, Human
acaucugagcaacagaacacua

SEQ ID NO: 714450 - RNA, 22 nt, Human
aagccaguguccagaaugggca

SEQ ID NO: 714451 - RNA, 22 nt, Human
aaacauugagugccuuugguau

SEQ ID NO: 714452 - RNA, 22 nt, Human
uguaaauaaugcauguaaauca

SEQ ID NO: 714453 - RNA, 22 nt, Human
gugcacacucuuggggcacuuu

SEQ ID NO: 714454 - RNA, 22 nt, Human
cauccugacccaugggagggga

SEQ ID NO: 714455 - RNA, 22 nt, Human
accuucagacaucaacuaucuc

SEQ ID NO: 714456 - RNA, 22 nt, Human
ggaagccaggccaaugagaaca

SEQ ID NO: 714457 - RNA, 22 nt, Human
ugcuuaauccaaccuggcugac

SEQ ID NO: 714458 - RNA, 22 nt, Human
ugcacagauagugauagauagc

SEQ ID NO: 714459 - RNA, 22 nt, Human
cuggcuucugggccagggcaga

SEQ ID NO: 714460 - RNA, 22 nt, Human
caugcaugccuggcucacagag

SEQ ID NO: 714461 - RNA, 22 nt, Human
agcuggugugccacuguugggg

SEQ ID NO: 714462 - RNA, 22 nt, Human
agccuagguuuccgauucucuu

SEQ ID NO: 714463 - RNA, 22 nt, Human
cacugugucagaguaugaugau

SEQ ID NO: 714464 - RNA, 22 nt, Human
acacugguguaguuuucugcag

SEQ ID NO: 714465 - RNA, 22 nt, Human
aauuucaaugcacucaugguug

SEQ ID NO: 714466 - RNA, 22 nt, Human
ccuggcacaugauagaugcuca

SEQ ID NO: 714467 - RNA, 22 nt, Human
ucuauuugcugguugcuucugu

SEQ ID NO: 714468 - RNA, 22 nt, Human
auggauaauggugauaguugca

SEQ ID NO: 714469 - RNA, 22 nt, Human
uuuuauucauagggauggagag

SEQ ID NO: 714470 - RNA, 22 nt, Human
cagacacaccaggcccauucug

SEQ ID NO: 714471 - RNA, 21 nt, Human
ugaaaugagaaugcugagcac

SEQ ID NO: 714472 - RNA, 22 nt, Human
cuaguuaguucugggucauccu

SEQ ID NO: 714473 - RNA, 22 nt, Human
ggcucaggaugagccuucucau

SEQ ID NO: 714474 - RNA, 22 nt, Human
ugucucugagaugacucccacc

SEQ ID NO: 714475 - RNA, 22 nt, Human
gugcaaaagcaauugcaguuuu

SEQ ID NO: 714476 - RNA, 22 nt, Human
uuauaggccaucuaaguaauuu

SEQ ID NO: 714477 - RNA, 22 nt, Human
gggaggagcuuggagauucacu

SEQ ID NO: 714478 - RNA, 22 nt, Human
ucugaggcuucagacuguacug

SEQ ID NO: 714479 - RNA, 22 nt, Human
ucuggcucucauacucgccagu

SEQ ID NO: 714480 - RNA, 22 nt, Human
ugcuugggcggccagcauggcg

SEQ ID NO: 714481 - RNA, 22 nt, Human
acacugcuaaacaguaaagaug

SEQ ID NO: 714482 - RNA, 22 nt, Human
agcagcaggcuagggaacugcu

SEQ ID NO: 714483 - RNA, 22 nt, Human
aguagcaguuuggcugaauuua

SEQ ID NO: 714484 - RNA, 22 nt, Human
ucuucacaggagccugccugcc

SEQ ID NO: 714485 - RNA, 22 nt, Human
aaaggcuggaaacugaagauaa

SEQ ID NO: 714486 - RNA, 22 nt, Human
cuucuuaaauuggauugcuauu

SEQ ID NO: 714487 - RNA, 22 nt, Human
uccucaggaucuaggagugcuu

SEQ ID NO: 714488 - RNA, 22 nt, Human
auauucugccucacuacaguug

SEQ ID NO: 714489 - RNA, 22 nt, Human
ucaguuuagaguuauuuaaucu

SEQ ID NO: 714490 - RNA, 22 nt, Human
acagccuggacuggcucucugc

SEQ ID NO: 714491 - RNA, 22 nt, Human
uucacaauuaacuuuauacuua

SEQ ID NO: 714492 - RNA, 22 nt, Human
aagcaacuccuaggaggaaagg

SEQ ID NO: 714493 - RNA, 22 nt, Human
ugagucugauuuuucuagcauu

SEQ ID NO: 714494 - RNA, 22 nt, Human
cagucagaggucuucuaaaaca

SEQ ID NO: 714495 - RNA, 22 nt, Human
gcuggcuuuauggggcuugugg

SEQ ID NO: 714496 - RNA, 22 nt, Human
uccaugcagaggagcugguggc

SEQ ID NO: 714497 - RNA, 22 nt, Human
uccucagggcggccuccgucuu

SEQ ID NO: 714498 - RNA, 19 nt, Human
gaggaacuggcuugguucc

SEQ ID NO: 714499 - RNA, 22 nt, Human
gcaguguucuaaauugggugug

SEQ ID NO: 714500 - RNA, 22 nt, Human
aaugcuuugucugcuccagacu

SEQ ID NO: 714501 - RNA, 22 nt, Human
uccgguccggguacuccucucu

SEQ ID NO: 714502 - RNA, 18 nt, Human
gcccaugguaaaugcugu

SEQ ID NO: 714503 - RNA, 22 nt, Human
cuggaagggaaaucucuuggca

SEQ ID NO: 714504 - RNA, 22 nt, Human
uuacagaugggguugcaauaaa

SEQ ID NO: 714505 - RNA, 22 nt, Human
acuuccaaauaccaucacauug

SEQ ID NO: 714506 - RNA, 22 nt, Human
aggucugguguugaugaauucc

SEQ ID NO: 714507 - RNA, 22 nt, Human
aagaaagugaugagcuacagau

SEQ ID NO: 714508 - RNA, 22 nt, Human
aaucuucuuucuuaacaguaca

SEQ ID NO: 714509 - RNA, 22 nt, Human
aggcuguggugggcuuugagcc

SEQ ID NO: 714510 - RNA, 23 nt, Human
uuacaaguucugaaauuuccuuc

SEQ ID NO: 714511 - RNA, 22 nt, Human
uacaucaugaaagcauacauca

SEQ ID NO: 714512 - RNA, 22 nt, Human
aauugcuugucuucuucccuac

SEQ ID NO: 714513 - RNA, 22 nt, Human
ucucaguggaucucagaauuuu

SEQ ID NO: 714514 - RNA, 22 nt, Human
guagcagaaucagugcuacaga

SEQ ID NO: 714515 - RNA, 22 nt, Human
aaagucaguuggccagaucacu

SEQ ID NO: 714516 - RNA, 19 nt, Human
ggccuggcuaucccugcug

SEQ ID NO: 714517 - RNA, 22 nt, Human
agacugaaacaaucugcaggca

SEQ ID NO: 714518 - RNA, 22 nt, Human
gaagcuaaaccacagcuaagaa

SEQ ID NO: 714519 - RNA, 22 nt, Human
uuacaugaugauuucauaaaca

SEQ ID NO: 714520 - RNA, 22 nt, Human
auacaacugcucucagauaagu

SEQ ID NO: 714521 - RNA, 22 nt, Human
agguaugccaauuaggucaagu

SEQ ID NO: 714522 - RNA, 19 nt, Human
gcaggugagccguggcucc

SEQ ID NO: 714523 - RNA, 22 nt, Human
aaguuuacuggggagaucaccu

SEQ ID NO: 714524 - RNA, 22 nt, Human
ucccagaaucuccagugcuaca

SEQ ID NO: 714525 - RNA, 22 nt, Human
gcucaaaggccagguagcagca

SEQ ID NO: 714526 - RNA, 22 nt, Human
cccucugcugccuggcuggguc

SEQ ID NO: 714527 - RNA, 22 nt, Human
ugugaggcuggcaggggccagg

SEQ ID NO: 714528 - RNA, 17 nt, Human
ucugaggugaggaugca

SEQ ID NO: 714529 - RNA, 22 nt, Human
gugcagugagcagugcagcacc

SEQ ID NO: 714530 - RNA, 22 nt, Human
uggcuggauaucaggcaagggg

SEQ ID NO: 714531 - RNA, 22 nt, Human
uugcaucacaguaucucuguaa

SEQ ID NO: 714532 - RNA, 22 nt, Human
gagcaucuccuaccuacuccuu

SEQ ID NO: 714533 - RNA, 19 nt, Human
auggcucugggaucacugc

SEQ ID NO: 714534 - RNA, 22 nt, Human
caaguuacauuagaaaucaugc

SEQ ID NO: 714535 - RNA, 22 nt, Human
uuuguacagugauguuguaugc

SEQ ID NO: 714536 - RNA, 22 nt, Human
agaauauugaaaguucuugaca

SEQ ID NO: 714537 - RNA, 22 nt, Human
gagcugguccacaaucugcagg

SEQ ID NO: 714538 - RNA, 22 nt, Human
uguuuucaucacagaauguaac

SEQ ID NO: 714539 - RNA, 22 nt, Human
ugaacacauaaggcuuuccugu

SEQ ID NO: 714540 - RNA, 22 nt, Human
agacagacacaugguaacagau

SEQ ID NO: 714541 - RNA, 20 nt, Human
aguguuuagaauacuauuau

SEQ ID NO: 714542 - RNA, 22 nt, Human
uaucuuuaaugcuuggagguua

SEQ ID NO: 714543 - RNA, 22 nt, Human
gcucugggccauccuggccggg

SEQ ID NO: 714544 - RNA, 22 nt, Human
acagaauuaucaggaaauguua

SEQ ID NO: 714545 - RNA, 22 nt, Human
uaaguguugguaauuacaauga

SEQ ID NO: 714546 - RNA, 22 nt, Human
auuuuccucaagccucuggaag

SEQ ID NO: 714547 - RNA, 22 nt, Human
agcagaggacaguucuuaggaa

SEQ ID NO: 714548 - RNA, 22 nt, Human
acaauguuuugaaacaucuagg

SEQ ID NO: 714549 - RNA, 22 nt, Human
guggccagccagggugcugaug

SEQ ID NO: 714550 - RNA, 22 nt, Human
uaauuucaauagcuugcauaau

SEQ ID NO: 714551 - RNA, 22 nt, Human
agacuaaauaguuacagguagg

SEQ ID NO: 714552 - RNA, 22 nt, Human
caguggagugggacuggucuga

SEQ ID NO: 714553 - RNA, 22 nt, Human
uaggaugaucuuguagagagau

SEQ ID NO: 714554 - RNA, 22 nt, Human
uccaggagggggagccgugccg

SEQ ID NO: 714555 - RNA, 22 nt, Human
guaggcagguggaggagugaag

SEQ ID NO: 714556 - RNA, 22 nt, Human
agggggugggaagucuagaauc

SEQ ID NO: 714557 - RNA, 22 nt, Human
uguuuaacuaguuuucacacuu

SEQ ID NO: 714558 - RNA, 22 nt, Human
cagcaaauacuacuaguuuuua

SEQ ID NO: 714559 - RNA, 22 nt, Human
cccaggaaagaaaguauauggu

SEQ ID NO: 714560 - RNA, 22 nt, Human
guggcagaguugcugacuagaa

SEQ ID NO: 714561 - RNA, 22 nt, Human
aaccauguacuuuauucuguuu

SEQ ID NO: 714562 - RNA, 23 nt, Human
aagcauucgccuucacccuccuc

SEQ ID NO: 714563 - RNA, 22 nt, Human
uugaccuauguuucuucaucug

SEQ ID NO: 714564 - RNA, 22 nt, Human
cuggaucugaacaucgguauca

SEQ ID NO: 714565 - RNA, 22 nt, Human
ggccuuccuggcggcucagggu

SEQ ID NO: 714566 - RNA, 22 nt, Human
augagugauggguacauuggcu

SEQ ID NO: 714567 - RNA, 22 nt, Human
aggauccugcgcuuugggggag

SEQ ID NO: 714568 - RNA, 22 nt, Human
ccuuuggggcuuuacuguggaa

SEQ ID NO: 714569 - RNA, 22 nt, Human
cuguggcuucuagguccccgau

SEQ ID NO: 714570 - RNA, 22 nt, Human
aacacauggguguuuauuguac

SEQ ID NO: 714571 - RNA, 22 nt, Human
uacaguuccaggaucauagggu

SEQ ID NO: 714572 - RNA, 23 nt, Human
ugcuggagaagcaaaguucugag

SEQ ID NO: 714573 - RNA, 22 nt, Human
cuuuuuauagcuauguccuaug

SEQ ID NO: 714574 - RNA, 22 nt, Human
ggcagcucugugucugggaagc

SEQ ID NO: 714575 - RNA, 22 nt, Human
ucuuugaauccuuuacaucuga

SEQ ID NO: 714576 - RNA, 22 nt, Human
uuacaaagguaguuuugucuau

SEQ ID NO: 714577 - RNA, 22 nt, Human
cugugggagaagcuagcacagg

SEQ ID NO: 714578 - RNA, 22 nt, Human
ccaggccucuggcugcuuaguc

SEQ ID NO: 714579 - RNA, 22 nt, Human
ucugaggccuugggacagaagu

SEQ ID NO: 714580 - RNA, 22 nt, Human
caccaugacugguugagagagg

SEQ ID NO: 714581 - RNA, 22 nt, Human
uccaggaccaaagacacaugua

SEQ ID NO: 714582 - RNA, 22 nt, Human
ccuuuucuaaucuuaagaaugu

SEQ ID NO: 714583 - RNA, 22 nt, Human
aaagugcaaucaguuagaccau

SEQ ID NO: 714584 - RNA, 22 nt, Human
ggcucccugccuguccucaguc

SEQ ID NO: 714585 - RNA, 22 nt, Human
ucuuagcagacuuggcuacugu

SEQ ID NO: 714586 - RNA, 22 nt, Human
uuggcgucuuuuccauggaaag

SEQ ID NO: 714587 - RNA, 22 nt, Human
uacauagcaaggaaaugacaga

SEQ ID NO: 714588 - RNA, 22 nt, Human
ugacacagauuagagacauacc

SEQ ID NO: 714589 - RNA, 22 nt, Human
uauuucuguuuauuuguacauc

SEQ ID NO: 714590 - RNA, 22 nt, Human
gagcucauacccucuucucuuu

SEQ ID NO: 714591 - RNA, 22 nt, Human
uggcugaggucuggggcuucug

SEQ ID NO: 714592 - RNA, 22 nt, Human
ccacuguggaaagcaguucaga

SEQ ID NO: 714593 - RNA, 22 nt, Human
caugugggaagaggccagcugg

SEQ ID NO: 714594 - RNA, 22 nt, Human
cagggcuuggaucuguggucag

SEQ ID NO: 714595 - RNA, 22 nt, Human
ucagcuccagaguugcacagug

SEQ ID NO: 714596 - RNA, 22 nt, Human
cccucaugccagacagcaugca

SEQ ID NO: 714597 - RNA, 21 nt, Human
gcucuggccuacuguucccuc

SEQ ID NO: 714598 - RNA, 22 nt, Human
acuggcacuauguuggagaaau

SEQ ID NO: 714599 - RNA, 22 nt, Human
gcaguaggagaagaggaugcuu

SEQ ID NO: 714600 - RNA, 22 nt, Human
ugacugaggccugauaacaguu

SEQ ID NO: 714601 - RNA, 22 nt, Human
ccuuccagccccaucucaucgu

SEQ ID NO: 714602 - RNA, 22 nt, Human
ccaggccccagggcuggcuuuc

SEQ ID NO: 714603 - RNA, 22 nt, Human
aggaaggagggcagauauuaag

SEQ ID NO: 714604 - RNA, 22 nt, Human
acuugcuugggccaucucgcuu

SEQ ID NO: 714605 - RNA, 22 nt, Human
gacucucaagcacaaguccacc

SEQ ID NO: 714606 - RNA, 22 nt, Human
aaucagcaaaugcuuacucagg

SEQ ID NO: 714607 - RNA, 22 nt, Human
ggugcugccuauagucugaaac

SEQ ID NO: 714608 - RNA, 22 nt, Human
gagcuagggguagucaggagac

SEQ ID NO: 714609 - RNA, 22 nt, Human
auagugggaauuacgauauacu

SEQ ID NO: 714610 - RNA, 22 nt, Human
aaugaggcuugcauugugaacu

SEQ ID NO: 714611 - RNA, 22 nt, Human
gucccucacuggaccauaugaa

SEQ ID NO: 714612 - RNA, 19 nt, Human
agcaggcagguggcccagg

SEQ ID NO: 714613 - RNA, 22 nt, Human
accugucaucccggcugcaccg

SEQ ID NO: 714614 - RNA, 22 nt, Human
agggagaagguuuagcugugag

SEQ ID NO: 714615 - RNA, 22 nt, Human
ggagcagagcauuucacagccu

SEQ ID NO: 714616 - RNA, 21 nt, Human
ccaaagaacugccauuuguca

SEQ ID NO: 714617 - RNA, 18 nt, Human
uccagcaggucugaggug

SEQ ID NO: 714618 - RNA, 22 nt, Human
uuggaacagaaacagacaaaua

SEQ ID NO: 714619 - RNA, 22 nt, Human
uucauucugggcucuaaggaac

SEQ ID NO: 714620 - RNA, 22 nt, Human
ccaggagucuggaugagguguc

SEQ ID NO: 714621 - RNA, 20 nt, Human
uccagcccagcagccugaca

SEQ ID NO: 714622 - RNA, 17 nt, Human
uccaugagacaugaaga

SEQ ID NO: 714623 - RNA, 22 nt, Human
ggcuucaagucguauauuuggg

SEQ ID NO: 714624 - RNA, 22 nt, Human
uuuccuggaccaacugagauug

SEQ ID NO: 714625 - RNA, 22 nt, Human
ggcuccagaggccuuaccugca

SEQ ID NO: 714626 - RNA, 22 nt, Human
aagagccaggacagauccagcu

SEQ ID NO: 714627 - RNA, 22 nt, Human
aaggcaauguuagcaacauaau

SEQ ID NO: 714628 - RNA, 23 nt, Human
aaguuaguuucaauaaagcaauu

SEQ ID NO: 714629 - RNA, 22 nt, Human
ucuguacaccaggggccauucu

SEQ ID NO: 714630 - RNA, 16 nt, Human
agaggcuguaauggaa

SEQ ID NO: 714631 - RNA, 22 nt, Human
gcuuaaaucccaaugcuagacc

SEQ ID NO: 714632 - RNA, 22 nt, Human
uccucagaagaaccccuagauu

SEQ ID NO: 714633 - RNA, 20 nt, Human
augauuuugcacuaacuuca

SEQ ID NO: 714634 - RNA, 20 nt, Human
cugaacacagaauaagcaca

SEQ ID NO: 714635 - RNA, 22 nt, Human
gguaccaugagaugccacuaau

SEQ ID NO: 714636 - RNA, 19 nt, Human
ucaagauggauggcuccca

SEQ ID NO: 714637 - RNA, 22 nt, Human
cagagccaacgccaccugccca

SEQ ID NO: 714638 - RNA, 22 nt, Human
acaguguaauaugggagucagu

SEQ ID NO: 714639 - RNA, 22 nt, Human
ccacugugcccagccucauggg

SEQ ID NO: 714640 - RNA, 19 nt, Human
uguacaaggauuaugcagg

SEQ ID NO: 714641 - RNA, 22 nt, Human
cagcuucuuugggauucuuuau

SEQ ID NO: 714642 - RNA, 22 nt, Human
uccagaggcaaaaagguaugga

SEQ ID NO: 714643 - RNA, 22 nt, Human
auaauguguucaucuuacaauu

SEQ ID NO: 714644 - RNA, 20 nt, Human
gcuguuaguugggggcuccc

SEQ ID NO: 714645 - RNA, 19 nt, Human
gggagcugucugcccgugg

SEQ ID NO: 714646 - RNA, 20 nt, Human
uccagccacuuccgcugguc

SEQ ID NO: 714647 - RNA, 22 nt, Human
cuggagaggccccaagauauuu

SEQ ID NO: 714648 - RNA, 22 nt, Human
auucaguguggacccauuuaaa

SEQ ID NO: 714649 - RNA, 22 nt, Human
cauguauauuucuguaugugca

SEQ ID NO: 714650 - RNA, 22 nt, Human
ugagcaggggagagcgaaugug

SEQ ID NO: 714651 - RNA, 19 nt, Human
ugcagccacgugagagacu

SEQ ID NO: 714652 - RNA, 22 nt, Human
cagaaauggucuguucagcuua

SEQ ID NO: 714653 - RNA, 22 nt, Human
ugggaugccggcaggaggcaau

SEQ ID NO: 714654 - RNA, 22 nt, Human
uaauauuucuacccugcugccu

SEQ ID NO: 714655 - RNA, 22 nt, Human
agcugcaggaaguagaagcgga

SEQ ID NO: 714656 - RNA, 22 nt, Human
uggagaaggacagccugagaaa

SEQ ID NO: 714657 - RNA, 22 nt, Human
caaggcuucacguccccagugc

SEQ ID NO: 714658 - RNA, 22 nt, Human
uuuagaguugaguauucauugg

SEQ ID NO: 714659 - RNA, 22 nt, Human
uggaaugagcuggcuaauaacc

SEQ ID NO: 714660 - RNA, 22 nt, Human
cucuccucugaaguggugaccc

SEQ ID NO: 714661 - RNA, 22 nt, Human
uccuggaguauuucuguggugu

SEQ ID NO: 714662 - RNA, 22 nt, Human
aacuagagcuuccagcuucuug

SEQ ID NO: 714663 - RNA, 22 nt, Human
ucagcagacaguuagcuauauu

SEQ ID NO: 714664 - RNA, 22 nt, Human
uccugagguggauugagcagag

SEQ ID NO: 714665 - RNA, 22 nt, Human
uaucauuguguuauuucuucca

SEQ ID NO: 714666 - RNA, 22 nt, Human
auaaugcauuuagaauaauuca

SEQ ID NO: 714667 - RNA, 22 nt, Human
aauuuguuacacagcaauauaa

SEQ ID NO: 714668 - RNA, 22 nt, Human
caucugaauaucccaggcauau

SEQ ID NO: 714669 - RNA, 22 nt, Human
uguuuacugcauucuauuugcu

SEQ ID NO: 714670 - RNA, 22 nt, Human
cacauuccuggugcucagcagc

SEQ ID NO: 714671 - RNA, 22 nt, Human
gggaccuggggacuccuuguuc

SEQ ID NO: 714672 - RNA, 18 nt, Human
uuaaguuuuacugcuuua

SEQ ID NO: 714673 - RNA, 19 nt, Human
acuguagcacugcaguaua

SEQ ID NO: 714674 - RNA, 22 nt, Human
ugcucugaaggggaagggaugg

SEQ ID NO: 714675 - RNA, 22 nt, Human
cagaugugccuccagggcuuug

SEQ ID NO: 714676 - RNA, 22 nt, Human
gagguacagaguguuccaaugu

SEQ ID NO: 714677 - RNA, 22 nt, Human
auagaauagcauagaaaauuga

SEQ ID NO: 714678 - RNA, 19 nt, Human
uccuucagucagaucuggg

SEQ ID NO: 714679 - RNA, 22 nt, Human
aggcuggaguguagcagugcag

SEQ ID NO: 714680 - RNA, 22 nt, Human
auaccuguguauccacaagcgu

SEQ ID NO: 714681 - RNA, 22 nt, Human
cacacaugugagcagagaggcg

SEQ ID NO: 714682 - RNA, 22 nt, Human
ucuguggcuaucauacugaagg

SEQ ID NO: 714683 - RNA, 23 nt, Human
auacauacagucuuacugacuuu

SEQ ID NO: 714684 - RNA, 22 nt, Human
aggcucagauccuuguguccug

SEQ ID NO: 714685 - RNA, 22 nt, Human
uggcaguagagcuggaacuuga

SEQ ID NO: 714686 - RNA, 22 nt, Human
ggcuagaacuuuacacuuugca

SEQ ID NO: 714687 - RNA, 22 nt, Human
uugaggcagguccggguccuuc

SEQ ID NO: 714688 - RNA, 22 nt, Human
uauuaugaucccagcccuggag

SEQ ID NO: 714689 - RNA, 22 nt, Human
agaggcccuggcuagagcagcu

SEQ ID NO: 714690 - RNA, 22 nt, Human
caggguggcaggcaccauggcc

SEQ ID NO: 714691 - RNA, 22 nt, Human
gaaggcugaugacagauucugc

SEQ ID NO: 714692 - RNA, 22 nt, Human
uguguacaucucuucucacauu

SEQ ID NO: 714693 - RNA, 22 nt, Human
uuuucaguugugcucucuaguu

SEQ ID NO: 714694 - RNA, 22 nt, Human
ccuggggcuccagagcagcgga

SEQ ID NO: 714695 - RNA, 22 nt, Human
ggagccagcucccuccuuguga

SEQ ID NO: 714696 - RNA, 22 nt, Human
cauuuucaugaguuucuguuca

SEQ ID NO: 714697 - RNA, 23 nt, Human
ugaagcccagugauuuuguuuca

SEQ ID NO: 714698 - RNA, 22 nt, Human
caucacagguccugaugacauu

SEQ ID NO: 714699 - RNA, 22 nt, Human
ucuaaggacaaggucuuggaga

SEQ ID NO: 714700 - RNA, 22 nt, Human
uaggaagcugagcagcauuccu

SEQ ID NO: 714701 - RNA, 22 nt, Human
uucccacaggaugagagcugag

SEQ ID NO: 714702 - RNA, 22 nt, Human
augucacagcucccauuccucc

SEQ ID NO: 714703 - RNA, 22 nt, Human
gaggcugcugagagcccuguuu

SEQ ID NO: 714704 - RNA, 22 nt, Human
aacuucaagcuucgucccuucg

SEQ ID NO: 714705 - RNA, 23 nt, Human
cauuucaacgaauuuuccuucug

SEQ ID NO: 714706 - RNA, 22 nt, Human
gucugcccucacgccagcuggg

SEQ ID NO: 714707 - RNA, 22 nt, Human
aucuggcuugacuuugcgacuu

SEQ ID NO: 714708 - RNA, 22 nt, Human
agaacagccaauaaaagagggg

SEQ ID NO: 714709 - RNA, 22 nt, Human
agucauauggcuauuuaguggg

SEQ ID NO: 714710 - RNA, 22 nt, Human
uaagaaauuuaguuauagaaug

SEQ ID NO: 714711 - RNA, 22 nt, Human
augucuuggguuucaguuuacu

SEQ ID NO: 714712 - RNA, 22 nt, Human
ucuucagaggaagucagucuuu

SEQ ID NO: 714713 - RNA, 19 nt, Human
ggaagagaggaaaggugga

SEQ ID NO: 714714 - RNA, 22 nt, Human
cugauacaaugcuaauaaauuu

SEQ ID NO: 714715 - RNA, 22 nt, Human
cugagcugucaggaauggaaag

SEQ ID NO: 714716 - RNA, 22 nt, Human
cuguggucaccaggcuggggcc

SEQ ID NO: 714717 - RNA, 22 nt, Human
ucugggccuauagaagucuacc

SEQ ID NO: 714718 - RNA, 22 nt, Human
cagagggcccccuggccacagu

SEQ ID NO: 714719 - RNA, 22 nt, Human
uucucagaaaagcaagcuuucu

SEQ ID NO: 714720 - RNA, 22 nt, Human
aggaaaaaccuguuaaugguag

SEQ ID NO: 714721 - RNA, 22 nt, Human
gcagggaagggaaacagagacc

SEQ ID NO: 714722 - RNA, 22 nt, Human
ggcaggugcugggagcaucuca

SEQ ID NO: 714723 - RNA, 19 nt, Human
guacagugguaagcuauga

SEQ ID NO: 714724 - RNA, 22 nt, Human
uaaaugauaauaaugcuagugu

SEQ ID NO: 714725 - RNA, 22 nt, Human
aggcuggcggugacugcucuga

SEQ ID NO: 714726 - RNA, 20 nt, Human
uggcaucucucaauuguagg

SEQ ID NO: 714727 - RNA, 22 nt, Human
caggaaaugcguaguugaacuu

SEQ ID NO: 714728 - RNA, 22 nt, Human
caauagcagcuucugaaugcaa

SEQ ID NO: 714729 - RNA, 20 nt, Human
cuggggacagcaauggcugu

SEQ ID NO: 714730 - RNA, 22 nt, Human
ggcuccaggagaugcugggcag

SEQ ID NO: 714731 - RNA, 18 nt, Human
uacuuuauucccccucca

SEQ ID NO: 714732 - RNA, 22 nt, Human
gcaggguauaauacuuagguga

SEQ ID NO: 714733 - RNA, 22 nt, Human
cuuauguaaacuacagauaaua

SEQ ID NO: 714734 - RNA, 22 nt, Human
ggcaaacagacuugaccaucuu

SEQ ID NO: 714735 - RNA, 22 nt, Human
ucaggcugcaucuguaagggug

SEQ ID NO: 714736 - RNA, 20 nt, Human
agucacaugcauacacaagu

SEQ ID NO: 714737 - RNA, 22 nt, Human
agugcuuugugcucucacugca

SEQ ID NO: 714738 - RNA, 22 nt, Human
caggauuaaggugaggggagua

SEQ ID NO: 714739 - RNA, 23 nt, Human
uuucucauccagagagucagucc

SEQ ID NO: 714740 - RNA, 20 nt, Human
gggcuggauaauucuuugcu

SEQ ID NO: 714741 - RNA, 22 nt, Human
uaacguuugauaacuucuguuc

SEQ ID NO: 714742 - RNA, 22 nt, Human
ugccuguguggggucugccgcc

SEQ ID NO: 714743 - RNA, 21 nt, Human
uuagcaguuguugauuuccag

SEQ ID NO: 714744 - RNA, 22 nt, Human
uauaugcaauuuuuuagugcaa

SEQ ID NO: 714745 - RNA, 22 nt, Human
guccugugugacuucccaaaug

SEQ ID NO: 714746 - RNA, 22 nt, Human
gagcccagcucuaccucagacu

SEQ ID NO: 714747 - RNA, 22 nt, Human
uucuuuccaaccagauauuggu

SEQ ID NO: 714748 - RNA, 22 nt, Human
ucagaagacuacuaggacacau

SEQ ID NO: 714749 - RNA, 22 nt, Human
ugacaaagacaaagauaugucc

SEQ ID NO: 714750 - RNA, 22 nt, Human
auguuuacugguuuauagaaua

SEQ ID NO: 714751 - RNA, 22 nt, Human
uaaaguguguauauacauaugg

SEQ ID NO: 714752 - RNA, 22 nt, Human
cccagaggugcuucagaggugc

SEQ ID NO: 714753 - RNA, 22 nt, Human
gcugagccuagcugucuccugu

SEQ ID NO: 714754 - RNA, 22 nt, Human
uauuaauaagugacuacuagcu

SEQ ID NO: 714755 - RNA, 22 nt, Human
ucucugggccuguuuucucauc

SEQ ID NO: 714756 - RNA, 22 nt, Human
guaaccugucggaaagccuugu

SEQ ID NO: 714757 - RNA, 22 nt, Human
cugcagguugagcagccagguu

SEQ ID NO: 714758 - RNA, 22 nt, Human
aggacuuuagagccagaaagac

SEQ ID NO: 714759 - RNA, 19 nt, Human
cacuaagaugagauauagc

SEQ ID NO: 714760 - RNA, 22 nt, Human
cagguggccuugccaucuccug

SEQ ID NO: 714761 - RNA, 18 nt, Human
ccucccucauuuucccag

SEQ ID NO: 714762 - RNA, 22 nt, Human
aggcaccucagcugagccuggg

SEQ ID NO: 714763 - RNA, 22 nt, Human
gauauguauugaaugaucauuu

SEQ ID NO: 714764 - RNA, 22 nt, Human
acauguguacuuuuaaggaugu

SEQ ID NO: 714765 - RNA, 22 nt, Human
ugaggacauuaggaagugaagg

SEQ ID NO: 714766 - RNA, 22 nt, Human
uauugcugccauuuuccaaugu

SEQ ID NO: 714767 - RNA, 22 nt, Human
gguaaauuuuauguuauguaua

SEQ ID NO: 714768 - RNA, 22 nt, Human
aucacaguuacucaaauaauga

SEQ ID NO: 714769 - RNA, 22 nt, Human
cugcuuugauuagaagaguaca

SEQ ID NO: 714770 - RNA, 22 nt, Human
gcaugcagugcaauucaaugua

SEQ ID NO: 714771 - RNA, 22 nt, Human
gcugcuccagcugugcugcaga

SEQ ID NO: 714772 - RNA, 22 nt, Human
uaccugaauuaccaaaagcuuu

SEQ ID NO: 714773 - RNA, 22 nt, Human
auguccaguacuucuaaauggu

SEQ ID NO: 714774 - RNA, 22 nt, Human
uggagguguauaagguagcuuc

SEQ ID NO: 714775 - RNA, 22 nt, Human
gcugaggccaguuuaaugagga

SEQ ID NO: 714776 - RNA, 22 nt, Human
ucuaaggagccaggacuauuag

SEQ ID NO: 714777 - RNA, 18 nt, Human
acugggccagcaggcagg

SEQ ID NO: 714778 - RNA, 22 nt, Human
cucccucuguccgaggccggcu

SEQ ID NO: 714779 - RNA, 22 nt, Human
gcuucagcuuugucuccuuggg

SEQ ID NO: 714780 - RNA, 22 nt, Human
aauauaguucugguauuguuaa

SEQ ID NO: 714781 - RNA, 22 nt, Human
uuagaagugaaauagcuguaca

SEQ ID NO: 714782 - RNA, 22 nt, Human
ggcacagggggcugaggacuag

SEQ ID NO: 714783 - RNA, 22 nt, Human
ugcagcagggaccucuauguga

SEQ ID NO: 714784 - RNA, 20 nt, Human
aaaagcagccagagauggua

SEQ ID NO: 714785 - RNA, 22 nt, Human
augugugguuuguaaaugauuu

SEQ ID NO: 714786 - RNA, 22 nt, Human
uggcaauguuagcaaagcauuu

SEQ ID NO: 714787 - RNA, 22 nt, Human
uucucacaggaaguaggacuuu

SEQ ID NO: 714788 - RNA, 22 nt, Human
caugauagguauuuaauuaaau

SEQ ID NO: 714789 - RNA, 22 nt, Human
ugugaagaucaggguccuagag

SEQ ID NO: 714790 - RNA, 22 nt, Human
uuauuuguaucaaggacgguug

SEQ ID NO: 714791 - RNA, 22 nt, Human
gugaaguucaagcuugccaucu

SEQ ID NO: 714792 - RNA, 22 nt, Human
agacaggugcucgcccaagucc

SEQ ID NO: 714793 - RNA, 22 nt, Human
aacaucuuuuuguuugcugaaa

SEQ ID NO: 714794 - RNA, 22 nt, Human
aucagcuucauaaaguugguca

SEQ ID NO: 714795 - RNA, 22 nt, Human
uucucagacuuccagcaccagc

SEQ ID NO: 714796 - RNA, 22 nt, Human
auugucucugaauuuucagcug

SEQ ID NO: 714797 - RNA, 22 nt, Human
uuucagucaugaguuguuuuca

SEQ ID NO: 714798 - RNA, 22 nt, Human
uugucaucauccucuuuggggu

SEQ ID NO: 714799 - RNA, 22 nt, Human
uaguauuuaaucacuuuugucu

SEQ ID NO: 714800 - RNA, 22 nt, Human
acugucaccaucagagcgggaa

SEQ ID NO: 714801 - RNA, 22 nt, Human
ucguuuuagguggacauugugu

SEQ ID NO: 714802 - RNA, 22 nt, Human
augaaauguauucagauaugua

SEQ ID NO: 714803 - RNA, 19 nt, Human
agaaucaucuugaagugau

SEQ ID NO: 714804 - RNA, 22 nt, Human
aagaaugagcucaaagaucuua

SEQ ID NO: 714805 - RNA, 22 nt, Human
ccucuccuugcacccgucccgc

SEQ ID NO: 714806 - RNA, 22 nt, Human
uccaguucuaggucacucucug

SEQ ID NO: 714807 - RNA, 22 nt, Human
uuguggcuucuacgcccacagg

SEQ ID NO: 714808 - RNA, 22 nt, Human
ugguaaggauuguagaaacgaa

SEQ ID NO: 714809 - RNA, 15 nt, Human
uaacuuuuuugggcu

SEQ ID NO: 714810 - RNA, 22 nt, Human
cugcagggcagaagggcauaga

SEQ ID NO: 714811 - RNA, 19 nt, Human
ccucugccagcccgccucu

SEQ ID NO: 714812 - RNA, 21 nt, Human
ucagggcagcugcucuucaga

SEQ ID NO: 714813 - RNA, 22 nt, Human
agggcagcagcggcccaggccu

SEQ ID NO: 714814 - RNA, 22 nt, Human
ugagaugaauaacuccugcuaa

SEQ ID NO: 714815 - RNA, 22 nt, Human
gaagaacuuuagggcagaauuu

SEQ ID NO: 714816 - RNA, 22 nt, Human
uuuggucuuuuguaaguuaucu

SEQ ID NO: 714817 - RNA, 22 nt, Human
uccuuuggagcuugacugguag

SEQ ID NO: 714818 - RNA, 22 nt, Human
gguggacaaaugaaugacugaa

SEQ ID NO: 714819 - RNA, 22 nt, Human
uuuacauggaauauugucuugu

SEQ ID NO: 714820 - RNA, 22 nt, Human
uuaaaguauagaggacaaaaac

SEQ ID NO: 714821 - RNA, 22 nt, Human
gaggggcguccugagugggccu

SEQ ID NO: 714822 - RNA, 22 nt, Human
uggcuccuaggauggugccugg

SEQ ID NO: 714823 - RNA, 22 nt, Human
uucuaaucccagcucuacuacu

SEQ ID NO: 714824 - RNA, 21 nt, Human
uguggucuuuuaguuccauca

SEQ ID NO: 714825 - RNA, 22 nt, Human
uggcucagcugacucggcuucu

SEQ ID NO: 714826 - RNA, 22 nt, Human
aaggccuucuaccaaggcuggg

SEQ ID NO: 714827 - RNA, 19 nt, Human
ugcuccaggccuugccgca

SEQ ID NO: 714828 - RNA, 22 nt, Human
uugguuuagagagugugguuac

SEQ ID NO: 714829 - RNA, 22 nt, Human
auggaauuucuccggcuccacc

SEQ ID NO: 714830 - RNA, 22 nt, Human
uuucucugaggcuggccucccu

SEQ ID NO: 714831 - RNA, 22 nt, Human
cagacuuuugacauuaauacag

SEQ ID NO: 714832 - RNA, 22 nt, Human
aacuacagcucuugucuuucug

SEQ ID NO: 714833 - RNA, 22 nt, Human
agcagcagaucaaacaggcuug

SEQ ID NO: 714834 - RNA, 22 nt, Human
cccaggcuggagugcaauggug

SEQ ID NO: 714835 - RNA, 20 nt, Human
gauggcuuuagaagcuggua

SEQ ID NO: 714836 - RNA, 22 nt, Human
aacacaugaaaguuggugagua

SEQ ID NO: 714837 - RNA, 22 nt, Human
acagugcuggcuacaacccugg

SEQ ID NO: 714838 - RNA, 22 nt, Human
cuuaauguggaccugguuucua

SEQ ID NO: 714839 - RNA, 22 nt, Human
auaacauggaguuugucauuua

SEQ ID NO: 714840 - RNA, 22 nt, Human
gcugaaggaggcucugguacua

SEQ ID NO: 714841 - RNA, 22 nt, Human
gcuggccccgagugcuacgcuc

SEQ ID NO: 714842 - RNA, 22 nt, Human
uaauauauuucugcuaagcuca

SEQ ID NO: 714843 - RNA, 22 nt, Human
guccagagguccaggaucaagg

SEQ ID NO: 714844 - RNA, 22 nt, Human
augguuuguaacccaauacucc

SEQ ID NO: 714845 - RNA, 20 nt, Human
aaggcacuaugucugcuagc

SEQ ID NO: 714846 - RNA, 22 nt, Human
auacaugugugagcgaagaugu

SEQ ID NO: 714847 - RNA, 22 nt, Human
gucugccccacaggcucaguug

SEQ ID NO: 714848 - RNA, 22 nt, Human
augcugggaagacaagguggag

SEQ ID NO: 714849 - RNA, 22 nt, Human
auuccuuguauaucuacaugca

SEQ ID NO: 714850 - RNA, 21 nt, Human
ccuggcacuggccugcugagc

SEQ ID NO: 714851 - RNA, 22 nt, Human
auguguaaaaggcauguuuuau

SEQ ID NO: 714852 - RNA, 19 nt, Human
cguaccugacacagaacag

SEQ ID NO: 714853 - RNA, 22 nt, Human
ggcaggcuccguguuccauucc

SEQ ID NO: 714854 - RNA, 22 nt, Human
aucagcaagauguaauuucuau

SEQ ID NO: 714855 - RNA, 22 nt, Human
ggccucagugggccgcugcagg

SEQ ID NO: 714856 - RNA, 22 nt, Human
uggaggacaggacuggacagcc

SEQ ID NO: 714857 - RNA, 22 nt, Human
ugaguaaaagugaaucuuaugu

SEQ ID NO: 714858 - RNA, 22 nt, Human
uauuuccaccuauuauuuucug

SEQ ID NO: 714859 - RNA, 22 nt, Human
cagauggauuuuguaggcugau

SEQ ID NO: 714860 - RNA, 22 nt, Human
uucuuuuaauguucugaaguuu

SEQ ID NO: 714861 - RNA, 22 nt, Human
gcaaaugaguuguaacauaaaa

SEQ ID NO: 714862 - RNA, 22 nt, Human
gcccuggagggccagcgacugg

SEQ ID NO: 714863 - RNA, 21 nt, Human
uccaaaaaggagcguccuucu

SEQ ID NO: 714864 - RNA, 22 nt, Human
uggcagaguucgcugugccuuu

SEQ ID NO: 714865 - RNA, 22 nt, Human
aagaggccucaccucacugccc

SEQ ID NO: 714866 - RNA, 22 nt, Human
auauaguaagcagucuguaaau

SEQ ID NO: 714867 - RNA, 22 nt, Human
ccugggucccaucccagaguga

SEQ ID NO: 714868 - RNA, 22 nt, Human
ucuguuuccucuuguguaaagu

SEQ ID NO: 714869 - RNA, 22 nt, Human
cuugcaggcccagccuuacaag

SEQ ID NO: 714870 - RNA, 22 nt, Human
gugcacaaucuucauauggcgu

SEQ ID NO: 714871 - RNA, 22 nt, Human
ccuggcaggcuggggacagugc

SEQ ID NO: 714872 - RNA, 22 nt, Human
uccagccaagccuugguagcug

SEQ ID NO: 714873 - RNA, 22 nt, Human
agaagacagagucuacauucua

SEQ ID NO: 714874 - RNA, 22 nt, Human
cccugguucagguuucucugaa

SEQ ID NO: 714875 - RNA, 22 nt, Human
ugccagagaagacccagucacu

SEQ ID NO: 714876 - RNA, 22 nt, Human
gaguaggguuuccagguuagag

SEQ ID NO: 714877 - RNA, 22 nt, Human
ccugugugaagguuaggcaggu

SEQ ID NO: 714878 - RNA, 23 nt, Human
uucauacagaaacaucacuucau

SEQ ID NO: 714879 - RNA, 22 nt, Human
ugcuggggagugauugaccauc

SEQ ID NO: 714880 - RNA, 21 nt, Human
ucuaaugacauccucugacaa

SEQ ID NO: 714881 - RNA, 22 nt, Human
ucucugcccaaguuucucaagu

SEQ ID NO: 714882 - RNA, 22 nt, Human
uauuucaggcuauauuucuugu

SEQ ID NO: 714883 - RNA, 22 nt, Human
agggggucguccggaagaccug

SEQ ID NO: 714884 - RNA, 22 nt, Human
ugaccuuucaacccuucuuggc

SEQ ID NO: 714885 - RNA, 22 nt, Human
ggaguucacugugcaggcucug

SEQ ID NO: 714886 - RNA, 22 nt, Human
cacacaggaaaauuggaauuaa

SEQ ID NO: 714887 - RNA, 22 nt, Human
uguguaaaaugagccuaaaguc

SEQ ID NO: 714888 - RNA, 21 nt, Human
aaguggagaagaaaagcugga

SEQ ID NO: 714889 - RNA, 22 nt, Human
cacagccuuuaggguacacaca

SEQ ID NO: 714890 - RNA, 22 nt, Human
ucagaacauuaaggauuugaag

SEQ ID NO: 714891 - RNA, 22 nt, Human
ucugugucacugaggccugugu

SEQ ID NO: 714892 - RNA, 22 nt, Human
agggcagcugugagccacugug

SEQ ID NO: 714893 - RNA, 22 nt, Human
cacaggcugcccgcagcuggga

SEQ ID NO: 714894 - RNA, 22 nt, Human
uccuccuuguuuugucucugcu

SEQ ID NO: 714895 - RNA, 22 nt, Human
gucagagcugugcaaggcugag

SEQ ID NO: 714896 - RNA, 22 nt, Human
uucucucuguuauggauuuuac

SEQ ID NO: 714897 - RNA, 22 nt, Human
cugcaggagcaagccugggaga

SEQ ID NO: 714898 - RNA, 22 nt, Human
cuagugaacgugguacuaugga

SEQ ID NO: 714899 - RNA, 22 nt, Human
cugugccuggggggcagagcug

SEQ ID NO: 714900 - RNA, 22 nt, Human
uggcagagucugggcuugggca

SEQ ID NO: 714901 - RNA, 22 nt, Human
ugguaaggucuucacucagauu

SEQ ID NO: 714902 - RNA, 22 nt, Human
guuccuaagcuguggcccugga

SEQ ID NO: 714903 - RNA, 22 nt, Human
ucaggcugcccguucagggcuc

SEQ ID NO: 714904 - RNA, 22 nt, Human
cauagaauggauugacaagauu

SEQ ID NO: 714905 - RNA, 22 nt, Human
auguuaacugaagccauucucg

SEQ ID NO: 714906 - RNA, 22 nt, Human
gaggagguggagucaugcagag

SEQ ID NO: 714907 - RNA, 22 nt, Human
aguauuuagcauagugguuagu

SEQ ID NO: 714908 - RNA, 22 nt, Human
uugcaaauuauuuuagucccuu

SEQ ID NO: 714909 - RNA, 22 nt, Human
ugcuccagcuggagaugggggc

SEQ ID NO: 714910 - RNA, 22 nt, Human
agggcauuggcacagaucugcu

SEQ ID NO: 714911 - RNA, 22 nt, Human
ugaggguggccuuguguggacu

SEQ ID NO: 714912 - RNA, 22 nt, Human
ucaguuccuguugcacagcauc

SEQ ID NO: 714913 - RNA, 22 nt, Human
uccagaaacugcugagauaaga

SEQ ID NO: 714914 - RNA, 18 nt, Human
aagggcuggccuuuggag

SEQ ID NO: 714915 - RNA, 22 nt, Human
cagcaggcugcgauugcucauu

SEQ ID NO: 714916 - RNA, 22 nt, Human
auaaugcgccucagaaaacaga

SEQ ID NO: 714917 - RNA, 22 nt, Human
cuggcucaauuuguacugcugu

SEQ ID NO: 714918 - RNA, 22 nt, Human
aguguguccagaaaucuguauu

SEQ ID NO: 714919 - RNA, 22 nt, Human
uuugcauaggauggacauuuua

SEQ ID NO: 714920 - RNA, 22 nt, Human
aauuuucugccuagcaaaaacu

SEQ ID NO: 714921 - RNA, 22 nt, Human
aaguuugaugaguuucuggagg

SEQ ID NO: 714922 - RNA, 22 nt, Human
agucccaguucgguucuuccuc

SEQ ID NO: 714923 - RNA, 22 nt, Human
ggugcucaagagggcauccucu

SEQ ID NO: 714924 - RNA, 19 nt, Human
agcaggcuaggcugccucu

SEQ ID NO: 714925 - RNA, 22 nt, Human
agcacagaauggcuuggaagcc

SEQ ID NO: 714926 - RNA, 22 nt, Human
uaagauaaguggguugagaugg

SEQ ID NO: 714927 - RNA, 22 nt, Human
ggcuagaagucagaggucaaga

SEQ ID NO: 714928 - RNA, 22 nt, Human
cuggccuuggaagggagcccgu

SEQ ID NO: 714929 - RNA, 22 nt, Human
uaaaugacauucuuaagucuug

SEQ ID NO: 714930 - RNA, 22 nt, Human
caauauauaggaacaacuuagg

SEQ ID NO: 714931 - RNA, 22 nt, Human
cuuccucacggugcaacaggaa

SEQ ID NO: 714932 - RNA, 22 nt, Human
gcccaggagaggccagggcuga

SEQ ID NO: 714933 - RNA, 22 nt, Human
agggcagagcacugaauuggga

SEQ ID NO: 714934 - RNA, 22 nt, Human
gggcacugacagggucccaacu

SEQ ID NO: 714935 - RNA, 20 nt, Human
accagguggcugaugacacc

SEQ ID NO: 714936 - RNA, 22 nt, Human
uucucuaggaguucugggauca

SEQ ID NO: 714937 - RNA, 22 nt, Human
uugaaaguagcagcugcauaug

SEQ ID NO: 714938 - RNA, 22 nt, Human
uggagguguggagucaaaggga

SEQ ID NO: 714939 - RNA, 22 nt, Human
uucuaagcucugaaauaaaucu

SEQ ID NO: 714940 - RNA, 22 nt, Human
ucacagacaauuguuuuggugu

SEQ ID NO: 714941 - RNA, 22 nt, Human
uuuaucugugguaaauaacauu

SEQ ID NO: 714942 - RNA, 22 nt, Human
cagaagggcagcacugggaagg

SEQ ID NO: 714943 - RNA, 22 nt, Human
auauaaagagcuuaguauagug

SEQ ID NO: 714944 - RNA, 22 nt, Human
gugagaaauggaacuucauacg

SEQ ID NO: 714945 - RNA, 22 nt, Human
ugagggugggccugcaggaaga

SEQ ID NO: 714946 - RNA, 22 nt, Human
aagcagcauaauugcuauuuua

SEQ ID NO: 714947 - RNA, 22 nt, Human
gcugcucuuuucagagaugaga

SEQ ID NO: 714948 - RNA, 22 nt, Human
cugcaucucugcuagucaguca

SEQ ID NO: 714949 - RNA, 22 nt, Human
gcguggggcagcccagggcuuc

SEQ ID NO: 714950 - RNA, 22 nt, Human
ucugacuuggugcuaccagcca

SEQ ID NO: 714951 - RNA, 22 nt, Human
gagugccagauggaccucuugg

SEQ ID NO: 714952 - RNA, 22 nt, Human
ugggcucauguuucuuugagga

SEQ ID NO: 714953 - RNA, 22 nt, Human
uucuuggaaauacauucaauaa

SEQ ID NO: 714954 - RNA, 22 nt, Human
cugugccaggcccgggugggug

SEQ ID NO: 714955 - RNA, 22 nt, Human
ucaguucucucaugccugcccu

SEQ ID NO: 714956 - RNA, 22 nt, Human
gggcugaaaggccgccucagau

SEQ ID NO: 714957 - RNA, 22 nt, Human
ggccugcuggcuccagcgcccg

SEQ ID NO: 714958 - RNA, 20 nt, Human
gcaggcuccgggcuugggag

SEQ ID NO: 714959 - RNA, 22 nt, Human
uagugcuuuauuguuccugaaa

SEQ ID NO: 714960 - RNA, 22 nt, Human
aucuauacccaucaugauuuaa

SEQ ID NO: 714961 - RNA, 22 nt, Human
cagcuccugaggacugcuggga

SEQ ID NO: 714962 - RNA, 23 nt, Human
auuuuuugucuuuguaacuagau

SEQ ID NO: 714963 - RNA, 22 nt, Human
aacuuuuucugggauggagggu

SEQ ID NO: 714964 - RNA, 22 nt, Human
ugagagaggggacugccugcuu

SEQ ID NO: 714965 - RNA, 22 nt, Human
ccuggacuguguccugugguca

SEQ ID NO: 714966 - RNA, 22 nt, Human
cuuugauuccaggcacauguuu

SEQ ID NO: 714967 - RNA, 22 nt, Human
cugagcagccccaccagccauu

SEQ ID NO: 714968 - RNA, 22 nt, Human
acagugcugaucuagacugacc

SEQ ID NO: 714969 - RNA, 22 nt, Human
uuggaugaagucuagcuuuagu

SEQ ID NO: 714970 - RNA, 22 nt, Human
agaagaaacugucggggauauu

SEQ ID NO: 714971 - RNA, 22 nt, Human
ugaggaugagaugagauaacac

SEQ ID NO: 714972 - RNA, 22 nt, Human
augcuguguuugagaaccuagg

SEQ ID NO: 714973 - RNA, 22 nt, Human
ucucccacagucucccauggcu

SEQ ID NO: 714974 - RNA, 22 nt, Human
gcccuguccuccugacugagug

SEQ ID NO: 714975 - RNA, 22 nt, Human
ugaggccucugugccauccagg

SEQ ID NO: 714976 - RNA, 22 nt, Human
uauacacaaacaagggguuaag

SEQ ID NO: 714977 - RNA, 22 nt, Human
aggcuggcuuugguagcauggu

SEQ ID NO: 714978 - RNA, 22 nt, Human
gcagcugccuauucagggcuug

SEQ ID NO: 714979 - RNA, 22 nt, Human
gagguccagagcagguucagug

SEQ ID NO: 714980 - RNA, 22 nt, Human
gaucuguuauaaucucuuuuau

SEQ ID NO: 714981 - RNA, 22 nt, Human
caggauccccaggucgccgucc

SEQ ID NO: 714982 - RNA, 22 nt, Human
aauagcauguucaugauaaaau

SEQ ID NO: 714983 - RNA, 20 nt, Human
uggagugcuguguugagaag

SEQ ID NO: 714984 - RNA, 23 nt, Human
ugguggcagaaguagcagaugac

SEQ ID NO: 714985 - RNA, 22 nt, Human
guaagcaucugucucuucugca

SEQ ID NO: 714986 - RNA, 22 nt, Human
uggcacuggcgcaggauggcgg

SEQ ID NO: 714987 - RNA, 22 nt, Human
cagcccugcggagguguauacu

SEQ ID NO: 714988 - RNA, 22 nt, Human
ggcuggagauaugucuggaaca

SEQ ID NO: 714989 - RNA, 22 nt, Human
uaguuucuggguuggcuucuac

SEQ ID NO: 714990 - RNA, 22 nt, Human
acucacaggacucugcauauag

SEQ ID NO: 714991 - RNA, 21 nt, Human
gauaaagcagcuugccuaagg

SEQ ID NO: 714992 - RNA, 22 nt, Human
ugagacagcagauuagcaauga

SEQ ID NO: 714993 - RNA, 22 nt, Human
ugaguguguauuauguaucagg

SEQ ID NO: 714994 - RNA, 22 nt, Human
cggucugaucuggaaauagggc

SEQ ID NO: 714995 - RNA, 22 nt, Human
ccagcuccuucugucuguggag

SEQ ID NO: 714996 - RNA, 22 nt, Human
ugcagaaaucacauuuaacccu

SEQ ID NO: 714997 - RNA, 22 nt, Human
gcucccugacucaguuccugag

SEQ ID NO: 714998 - RNA, 22 nt, Human
agaugugguuauucucuuccuu

SEQ ID NO: 714999 - RNA, 22 nt, Human
gcagagccaggagagacccuug

SEQ ID NO: 715000 - RNA, 22 nt, Human
uaugagauaauagauguguaaa

SEQ ID NO: 715001 - RNA, 22 nt, Human
uaaguuccuggaaggcaaggau

SEQ ID NO: 715002 - RNA, 22 nt, Human
agguggggaaaccagcgauccc

SEQ ID NO: 715003 - RNA, 21 nt, Human
aauucccagaaacagcacaag

SEQ ID NO: 715004 - RNA, 22 nt, Human
ucucuuaggagaaauucauaaa

SEQ ID NO: 715005 - RNA, 21 nt, Human
gcugcugccccuagugaggcc

SEQ ID NO: 715006 - RNA, 23 nt, Human
ucaaacauauugugagacacagg

SEQ ID NO: 715007 - RNA, 22 nt, Human
aaaggcaugccuccauuucuau

SEQ ID NO: 715008 - RNA, 22 nt, Human
ucacuuuugaucccuaugcagu

SEQ ID NO: 715009 - RNA, 22 nt, Human
cugcaucugcauaaucaacuuc

SEQ ID NO: 715010 - RNA, 22 nt, Human
uaacaucuaagggagagaaagu

SEQ ID NO: 715011 - RNA, 22 nt, Human
cuuccugggacaccuaacucua

SEQ ID NO: 715012 - RNA, 22 nt, Human
uggggagagaccggaauguuuc

SEQ ID NO: 715013 - RNA, 22 nt, Human
ccugccaggacauugcuugaag

SEQ ID NO: 715014 - RNA, 22 nt, Human
gaugaugggauccagcaaugua

SEQ ID NO: 715015 - RNA, 22 nt, Human
ucacuugaaccugggaggcaga

SEQ ID NO: 715016 - RNA, 22 nt, Human
gggcuuggccccagaagagcua

SEQ ID NO: 715017 - RNA, 21 nt, Human
gcucucugcaugguggcucag

SEQ ID NO: 715018 - RNA, 22 nt, Human
ccauuggagaguuuuaagaagg

SEQ ID NO: 715019 - RNA, 20 nt, Human
uuuagcacauuguacaaaac

SEQ ID NO: 715020 - RNA, 22 nt, Human
uucuuaaucccacaaaucuuca

SEQ ID NO: 715021 - RNA, 22 nt, Human
agggcagccucucagccuaggu

SEQ ID NO: 715022 - RNA, 22 nt, Human
uaguuuuuucaacaaauggugc

SEQ ID NO: 715023 - RNA, 22 nt, Human
ucacagaaguugaauuugcaug

SEQ ID NO: 715024 - RNA, 22 nt, Human
guauucuugaguggcaacuagg

SEQ ID NO: 715025 - RNA, 22 nt, Human
cuuuggaaggaacaggauucuc

SEQ ID NO: 715026 - RNA, 22 nt, Human
uaugagaacugacagagugcca

SEQ ID NO: 715027 - RNA, 22 nt, Human
acaggccugacacacagagggc

SEQ ID NO: 715028 - RNA, 22 nt, Human
gucagcagugucagcucugggg

SEQ ID NO: 715029 - RNA, 22 nt, Human
aaggggauuuaagguaagaaga

SEQ ID NO: 715030 - RNA, 22 nt, Human
accaaggagacaaagguguauu

SEQ ID NO: 715031 - RNA, 22 nt, Human
agcaaauaaagacaauuauguc

SEQ ID NO: 715032 - RNA, 22 nt, Human
gauuaauucaggaucaggaaau

SEQ ID NO: 715033 - RNA, 22 nt, Human
ugcuuucauugccugcgguuuu

SEQ ID NO: 715034 - RNA, 22 nt, Human
cucaggagagucuuauaucucc

SEQ ID NO: 715035 - RNA, 22 nt, Human
uucuuuuacauuaagauuucag

SEQ ID NO: 715036 - RNA, 22 nt, Human
ucugcuggugaugaccucauaa

SEQ ID NO: 715037 - RNA, 22 nt, Human
ggcaggcaucauguggucauua

SEQ ID NO: 715038 - RNA, 22 nt, Human
aagaugugucucaucagggugu

SEQ ID NO: 715039 - RNA, 22 nt, Human
agacuuuaaugugcaaaugaaa

SEQ ID NO: 715040 - RNA, 22 nt, Human
ggaagagaaaugagucaagacu

SEQ ID NO: 715041 - RNA, 22 nt, Human
aggcuucaccagacucuuaauc

SEQ ID NO: 715042 - RNA, 22 nt, Human
agcuggcagcucucagggguac

SEQ ID NO: 715043 - RNA, 22 nt, Human
uggccugauuuugcuaagagaa

SEQ ID NO: 715044 - RNA, 22 nt, Human
uccugccuugccugggacauca

SEQ ID NO: 715045 - RNA, 20 nt, Human
uauuacacacaaugagcagu

SEQ ID NO: 715046 - RNA, 22 nt, Human
accucagcuauuucaaaacaga

SEQ ID NO: 715047 - RNA, 22 nt, Human
gcagggagggccuuucaugaca

SEQ ID NO: 715048 - RNA, 22 nt, Human
guauugcaauuacucuucuucu

SEQ ID NO: 715049 - RNA, 22 nt, Human
ugcagagggacagccacagcuc

SEQ ID NO: 715050 - RNA, 22 nt, Human
augaccaguguugcuggccccg

SEQ ID NO: 715051 - RNA, 22 nt, Human
uauguguauugagcauuguuac

SEQ ID NO: 715052 - RNA, 22 nt, Human
uaugacuauagggcuuaguguu

SEQ ID NO: 715053 - RNA, 22 nt, Human
ggcugaaaccguuauccacuga

SEQ ID NO: 715054 - RNA, 22 nt, Human
aagagggaggugcgggugcaga

SEQ ID NO: 715055 - RNA, 22 nt, Human
gugcaugcacacaugugugagg

SEQ ID NO: 715056 - RNA, 22 nt, Human
ccugucuguuugcccauucuug

SEQ ID NO: 715057 - RNA, 22 nt, Human
gaucuugagcaaguugcauccc

SEQ ID NO: 715058 - RNA, 22 nt, Human
ugcaggugugguuccucagcca

SEQ ID NO: 715059 - RNA, 22 nt, Human
cuggaggggccauccacagucu

SEQ ID NO: 715060 - RNA, 22 nt, Human
uuucugcagucucucagaagcc

SEQ ID NO: 715061 - RNA, 17 nt, Human
ucagggaaugagguugu

SEQ ID NO: 715062 - RNA, 22 nt, Human
auauuacacacgguaucacggg

SEQ ID NO: 715063 - RNA, 22 nt, Human
aacaaguaaguuuauauauauu

SEQ ID NO: 715064 - RNA, 22 nt, Human
cacuucucugauaaucucaguu

SEQ ID NO: 715065 - RNA, 22 nt, Human
gaccagcuacuuguacaguuca

SEQ ID NO: 715066 - RNA, 22 nt, Human
ccucaggcugucuuccuucugg

SEQ ID NO: 715067 - RNA, 22 nt, Human
uagugugguaaauaaauguuuu

SEQ ID NO: 715068 - RNA, 22 nt, Human
ccggggacuuaaagugaaggaa

SEQ ID NO: 715069 - RNA, 22 nt, Human
ugcucugggggaagccagcugu

SEQ ID NO: 715070 - RNA, 22 nt, Human
auggccaaaucuaaacuguugg

SEQ ID NO: 715071 - RNA, 22 nt, Human
cuaucuuucgauucuagcuuaa

SEQ ID NO: 715072 - RNA, 22 nt, Human
aucugccuggucuuugaugcag

SEQ ID NO: 715073 - RNA, 22 nt, Human
ugugcacauauacucauauucc

SEQ ID NO: 715074 - RNA, 22 nt, Human
caggaggugaaggagaaccagu

SEQ ID NO: 715075 - RNA, 22 nt, Human
aggccagcugccacccgguccg

SEQ ID NO: 715076 - RNA, 22 nt, Human
cccaggucugugccagcucuga

SEQ ID NO: 715077 - RNA, 22 nt, Human
agggacaguauccaucucacag

SEQ ID NO: 715078 - RNA, 22 nt, Human
augagguggucuucaguagguc

SEQ ID NO: 715079 - RNA, 22 nt, Human
ugcccugccaagacugaguggu

SEQ ID NO: 715080 - RNA, 22 nt, Human
ccagagccucuuaugaagaucg

SEQ ID NO: 715081 - RNA, 22 nt, Human
agugccuggaccccaugacaua

SEQ ID NO: 715082 - RNA, 22 nt, Human
guggcagagagcaagugucuga

SEQ ID NO: 715083 - RNA, 22 nt, Human
gcucccugugcucugagugaua

SEQ ID NO: 715084 - RNA, 22 nt, Human
ugcuuuauugcaucaguguggg

SEQ ID NO: 715085 - RNA, 22 nt, Human
acugugcuuucucuggaggcau

SEQ ID NO: 715086 - RNA, 22 nt, Human
ggcuggaaguccaagaucaagg

SEQ ID NO: 715087 - RNA, 22 nt, Human
acauagcucagcauaaucgugg

SEQ ID NO: 715088 - RNA, 20 nt, Human
acuuuacagagaagacugac

SEQ ID NO: 715089 - RNA, 22 nt, Human
uucuagcaugccuuuuagcaca

SEQ ID NO: 715090 - RNA, 22 nt, Human
caaaagauacuugcaucuaacu

SEQ ID NO: 715091 - RNA, 22 nt, Human
auaugaaguuacagguaagaaa

SEQ ID NO: 715092 - RNA, 22 nt, Human
cagaggcuaagaugagugggug

SEQ ID NO: 715093 - RNA, 22 nt, Human
uuugacuccugccuucuccugu

SEQ ID NO: 715094 - RNA, 22 nt, Human
aaacagaugaguuauaauagcc

SEQ ID NO: 715095 - RNA, 22 nt, Human
aagaggcagcccgcugaggcug

SEQ ID NO: 715096 - RNA, 22 nt, Human
ggacauuuuucuuccuacaaug

SEQ ID NO: 715097 - RNA, 22 nt, Human
uagcagcacagaaagccuggag

SEQ ID NO: 715098 - RNA, 22 nt, Human
uuuaaaauuuagaccucuccac

SEQ ID NO: 715099 - RNA, 22 nt, Human
guauaucucuuacauacacaca

SEQ ID NO: 715100 - RNA, 22 nt, Human
uguuuauuacaguucuuggaau

SEQ ID NO: 715101 - RNA, 22 nt, Human
uguacacaaccuacagucugcu

SEQ ID NO: 715102 - RNA, 22 nt, Human
aacacuucucaucacugcaagc

SEQ ID NO: 715103 - RNA, 22 nt, Human
ugagcauggugggugcagagca

SEQ ID NO: 715104 - RNA, 22 nt, Human
ggucugaaucacugugccuauc

SEQ ID NO: 715105 - RNA, 22 nt, Human
cuuucaguuacaguuacacaca

SEQ ID NO: 715106 - RNA, 22 nt, Human
gggccaagggugcguggcagga

SEQ ID NO: 715107 - RNA, 21 nt, Human
uuuauucucagauacagggag

SEQ ID NO: 715108 - RNA, 22 nt, Human
uuguacaaguuuugagcuuaag

SEQ ID NO: 715109 - RNA, 19 nt, Human
ggcugggcccuguuucucc

SEQ ID NO: 715110 - RNA, 22 nt, Human
ucucuggcacauaauaaggucu

SEQ ID NO: 715111 - RNA, 22 nt, Human
uauauuguuggugggaauauaa

SEQ ID NO: 715112 - RNA, 22 nt, Human
agagagaagcaaucaguggcca

SEQ ID NO: 715113 - RNA, 22 nt, Human
ucucugaagagcucagacuagu

SEQ ID NO: 715114 - RNA, 22 nt, Human
uugcccuggggcuggccuggca

SEQ ID NO: 715115 - RNA, 22 nt, Human
gauggugcaggugaagugcugg

SEQ ID NO: 715116 - RNA, 22 nt, Human
ucuguguugauaauuuuggaga

SEQ ID NO: 715117 - RNA, 23 nt, Human
gugugcaggauuauuugcagaca

SEQ ID NO: 715118 - RNA, 22 nt, Human
cucacagauauuugcuucaggu

SEQ ID NO: 715119 - RNA, 17 nt, Human
uccuggauccauggugg

SEQ ID NO: 715120 - RNA, 22 nt, Human
caccucucagcuaggaguaagu

SEQ ID NO: 715121 - RNA, 19 nt, Human
gaauguuucugucucuucu

SEQ ID NO: 715122 - RNA, 20 nt, Human
ucacaugcauauucguuucu

SEQ ID NO: 715123 - RNA, 22 nt, Human
ccagcugaggcagccacacagg

SEQ ID NO: 715124 - RNA, 22 nt, Human
cuuuauguguacuuuccauuuu

SEQ ID NO: 715125 - RNA, 22 nt, Human
uacagugauagagaguagcuau

SEQ ID NO: 715126 - RNA, 22 nt, Human
uccuguguuacugccuggagcg

SEQ ID NO: 715127 - RNA, 22 nt, Human
aaaagggcaaaaccaucaugga

SEQ ID NO: 715128 - RNA, 22 nt, Human
uucaaaugguuagacuguuagc

SEQ ID NO: 715129 - RNA, 22 nt, Human
cagggcuuugugugccugggga

SEQ ID NO: 715130 - RNA, 22 nt, Human
ucagccucauuuucugcucugu

SEQ ID NO: 715131 - RNA, 22 nt, Human
uggccaccccuuucucugcacu

SEQ ID NO: 715132 - RNA, 22 nt, Human
ugaacuuuuucucuacgggcca

SEQ ID NO: 715133 - RNA, 22 nt, Human
aaccuuuauuugguacuauucu

SEQ ID NO: 715134 - RNA, 18 nt, Human
ucucuuuuccccucauug

SEQ ID NO: 715135 - RNA, 22 nt, Human
acauuugauaauuauaaagaca

SEQ ID NO: 715136 - RNA, 22 nt, Human
ccaguggacaauuucugaggaa

SEQ ID NO: 715137 - RNA, 22 nt, Human
caguugcagaggcagagugcua

SEQ ID NO: 715138 - RNA, 22 nt, Human
agagcugauuugauuacagugc

SEQ ID NO: 715139 - RNA, 22 nt, Human
uuuguacuggaagaacaugcaa

SEQ ID NO: 715140 - RNA, 22 nt, Human
gggcaaggcagaagaguuggag

SEQ ID NO: 715141 - RNA, 22 nt, Human
uacacauuacauaauacuaucu

SEQ ID NO: 715142 - RNA, 22 nt, Human
gccuccccaaagugcugacagc

SEQ ID NO: 715143 - RNA, 20 nt, Human
uuugaauguaaagcauguca

SEQ ID NO: 715144 - RNA, 22 nt, Human
ugaaaaacuuuaauccauaaag

SEQ ID NO: 715145 - RNA, 22 nt, Human
gcugaggucaggagcugugggg

SEQ ID NO: 715146 - RNA, 22 nt, Human
agcuggucuuaaauguguccag

SEQ ID NO: 715147 - RNA, 22 nt, Human
acucucccacguucgacucuaa

SEQ ID NO: 715148 - RNA, 22 nt, Human
uggcagagagagugcagucgac

SEQ ID NO: 715149 - RNA, 22 nt, Human
cagauuaguugugcuauggccu

SEQ ID NO: 715150 - RNA, 22 nt, Human
cacaggagcuguggggcagugu

SEQ ID NO: 715151 - RNA, 22 nt, Human
acccaugugcucuuuuguaccc

SEQ ID NO: 715152 - RNA, 22 nt, Human
uuagaaccacugaagacucaca

SEQ ID NO: 715153 - RNA, 22 nt, Human
uucugaauuucuguguaucuua

SEQ ID NO: 715154 - RNA, 22 nt, Human
gaacagcauguaagaagcuacu

SEQ ID NO: 715155 - RNA, 22 nt, Human
gacuagggaaucauucuuggau

SEQ ID NO: 715156 - RNA, 22 nt, Human
ugugccaggcacuugcccaggc

SEQ ID NO: 715157 - RNA, 22 nt, Human
gcuuuaagucucaguuuguuag

SEQ ID NO: 715158 - RNA, 22 nt, Human
ucagggcagccuaaggcaccuc

SEQ ID NO: 715159 - RNA, 22 nt, Human
guggacaugcauacauauguuu

SEQ ID NO: 715160 - RNA, 22 nt, Human
aggucacacuuggaucauagaa

SEQ ID NO: 715161 - RNA, 22 nt, Human
aacacaaucuuccaguuugcug

SEQ ID NO: 715162 - RNA, 18 nt, Human
aggcccuggccucgaaca

SEQ ID NO: 715163 - RNA, 22 nt, Human
gaauuuaaaggccagaccugag

SEQ ID NO: 715164 - RNA, 22 nt, Human
cccuccauuaaaacagaccuau

SEQ ID NO: 715165 - RNA, 22 nt, Human
gggcccuggauuuaagcaugga

SEQ ID NO: 715166 - RNA, 22 nt, Human
auugucuuuaaccucugagggg

SEQ ID NO: 715167 - RNA, 18 nt, Human
cugggcucgagagauccu

SEQ ID NO: 715168 - RNA, 22 nt, Human
ugcagguacuugacaacuuggg

SEQ ID NO: 715169 - RNA, 22 nt, Human
aguucacucuuuaugagaaagu

SEQ ID NO: 715170 - RNA, 22 nt, Human
agccugccucagacucaggaua

SEQ ID NO: 715171 - RNA, 22 nt, Human
ugucugaaacuuaugauauacu

SEQ ID NO: 715172 - RNA, 22 nt, Human
ugcucuguccagugcaccauca

SEQ ID NO: 715173 - RNA, 22 nt, Human
gaggcagcaaaauauaucauaa

SEQ ID NO: 715174 - RNA, 21 nt, Human
augugcuuagcugcugguagu

SEQ ID NO: 715175 - RNA, 22 nt, Human
agagagcauugaggaaaucuuc

SEQ ID NO: 715176 - RNA, 22 nt, Human
aagucagaaaucaucuagugua

SEQ ID NO: 715177 - RNA, 22 nt, Human
ugcugccucugcugauauggcc

SEQ ID NO: 715178 - RNA, 22 nt, Human
uagauaacagcacuggccucgc

SEQ ID NO: 715179 - RNA, 22 nt, Human
auuguaaaaguauucuaagauu

SEQ ID NO: 715180 - RNA, 19 nt, Human
auagucuuuccaauuauac

SEQ ID NO: 715181 - RNA, 22 nt, Human
agagguggccaugggcgcugga

SEQ ID NO: 715182 - RNA, 22 nt, Human
cuucucauucaagcaaaacaga

SEQ ID NO: 715183 - RNA, 22 nt, Human
uguaaagguaggugcaaaauga

SEQ ID NO: 715184 - RNA, 22 nt, Human
ccagcuggcccagcugugcucc

SEQ ID NO: 715185 - RNA, 16 nt, Human
ugccugcucugaucuc

SEQ ID NO: 715186 - RNA, 22 nt, Human
ugugcagagcggggaagagcac

SEQ ID NO: 715187 - RNA, 22 nt, Human
ggaaaaauagaguauacuuuaa

SEQ ID NO: 715188 - RNA, 22 nt, Human
cccaggucccgccccagcucua

SEQ ID NO: 715189 - RNA, 22 nt, Human
auacaagugauauaauuguuuc

SEQ ID NO: 715190 - RNA, 20 nt, Human
ggcauccuuuuggucacagc

SEQ ID NO: 715191 - RNA, 22 nt, Human
agaaaagguugaaaguaggauu

SEQ ID NO: 715192 - RNA, 22 nt, Human
augucuucuguggagacaggua

SEQ ID NO: 715193 - RNA, 22 nt, Human
augguccuuauggccgugauau

SEQ ID NO: 715194 - RNA, 22 nt, Human
caccaggaugggcagguagguc

SEQ ID NO: 715195 - RNA, 23 nt, Human
gaacccagcucugccacuugcca

SEQ ID NO: 715196 - RNA, 22 nt, Human
ggggcucacaccucccuaaggg

SEQ ID NO: 715197 - RNA, 22 nt, Human
gcagagauccaggguauagguu

SEQ ID NO: 715198 - RNA, 22 nt, Human
ucugaggaccuacugaagaguu

SEQ ID NO: 715199 - RNA, 22 nt, Human
gaacacugacauuuuccugacu

SEQ ID NO: 715200 - RNA, 22 nt, Human
cauucaaaagcuccauguuugu

SEQ ID NO: 715201 - RNA, 22 nt, Human
uguccaggcuaaagugcagugg

SEQ ID NO: 715202 - RNA, 22 nt, Human
ccugagcagcucugaggggcga

SEQ ID NO: 715203 - RNA, 22 nt, Human
auuccugagacuuaucuguuuc

SEQ ID NO: 715204 - RNA, 22 nt, Human
ccagcccaaagucaccccggga

SEQ ID NO: 715205 - RNA, 22 nt, Human
acuucauguuucuauuagcuca

SEQ ID NO: 715206 - RNA, 22 nt, Human
ugcagaaacagaguuuugccau

SEQ ID NO: 715207 - RNA, 21 nt, Human
uuuguccaccuguguucacca

SEQ ID NO: 715208 - RNA, 22 nt, Human
ggcuguggcagcuggaaguggu

SEQ ID NO: 715209 - RNA, 23 nt, Human
ugagcucuauggaggacugaacc

SEQ ID NO: 715210 - RNA, 22 nt, Human
uucauucuuugaaucugaggua

SEQ ID NO: 715211 - RNA, 22 nt, Human
ggcucagguugggucacaugac

SEQ ID NO: 715212 - RNA, 22 nt, Human
aaauaucuuaggaguauaugag

SEQ ID NO: 715213 - RNA, 22 nt, Human
aagcaauguuagaggccuuagg

SEQ ID NO: 715214 - RNA, 22 nt, Human
cuggcaguggaggaagaaaacu

SEQ ID NO: 715215 - RNA, 22 nt, Human
caauuucucgaacucuaaucca

SEQ ID NO: 715216 - RNA, 21 nt, Human
cugcccuagauggcucuggaa

SEQ ID NO: 715217 - RNA, 22 nt, Human
ggucucaaggaauauaaugagu

SEQ ID NO: 715218 - RNA, 22 nt, Human
augaaauauucuuugguaagaa

SEQ ID NO: 715219 - RNA, 23 nt, Human
caggcucccggaccaggauccgc

SEQ ID NO: 715220 - RNA, 23 nt, Human
uucuggauguucuagucugagag

SEQ ID NO: 715221 - RNA, 22 nt, Human
gcacacagaauugauucacugu

SEQ ID NO: 715222 - RNA, 22 nt, Human
uccuaacugcccugggcaaggu

SEQ ID NO: 715223 - RNA, 18 nt, Human
uccugggaaaggcauaca

SEQ ID NO: 715224 - RNA, 22 nt, Human
cuacugaugauguugguugugg

SEQ ID NO: 715225 - RNA, 22 nt, Human
ucugcauugucccagaagugac

SEQ ID NO: 715226 - RNA, 22 nt, Human
gucugccucuauugccuaccug

SEQ ID NO: 715227 - RNA, 22 nt, Human
ucuggcucucaacaaauauuua

SEQ ID NO: 715228 - RNA, 22 nt, Human
ccaugcugugacacaguaguua

SEQ ID NO: 715229 - RNA, 22 nt, Human
cacagagaccccuucuggggcc

SEQ ID NO: 715230 - RNA, 22 nt, Human
aaugauugucauuccaaaaagu

SEQ ID NO: 715231 - RNA, 22 nt, Human
acaauguguuuuuauacauuug

SEQ ID NO: 715232 - RNA, 20 nt, Human
acuaugaaguuagcccucca

SEQ ID NO: 715233 - RNA, 22 nt, Human
aauccuggcugcguuggccagc

SEQ ID NO: 715234 - RNA, 18 nt, Human
agagggaaagcaggcuga

SEQ ID NO: 715235 - RNA, 22 nt, Human
cuggguccuggugcugaguucu

SEQ ID NO: 715236 - RNA, 22 nt, Human
uugcauuuaaguagauguuaca

SEQ ID NO: 715237 - RNA, 22 nt, Human
ccgggagcaggcgccaccgcca

SEQ ID NO: 715238 - RNA, 22 nt, Human
auuccaguucuccucucuaaag

SEQ ID NO: 715239 - RNA, 22 nt, Human
aagcugugcaggaacugcuugc

SEQ ID NO: 715240 - RNA, 22 nt, Human
ucugucuccucugaggugccag

SEQ ID NO: 715241 - RNA, 21 nt, Human
acagccaggaacaugaggggc

SEQ ID NO: 715242 - RNA, 22 nt, Human
cagagccaaaugcugugguuau

SEQ ID NO: 715243 - RNA, 22 nt, Human
uugacaaucccuguuagaagug

SEQ ID NO: 715244 - RNA, 22 nt, Human
aggccaagugcugggacaggug

SEQ ID NO: 715245 - RNA, 20 nt, Human
aauuuuaucuccauccuuug

SEQ ID NO: 715246 - RNA, 22 nt, Human
uucuuccucagcagggcugccu

SEQ ID NO: 715247 - RNA, 22 nt, Human
caugcauaugucaaaaaagcua

SEQ ID NO: 715248 - RNA, 22 nt, Human
uuauuccauuauuucacuuagg

SEQ ID NO: 715249 - RNA, 22 nt, Human
ucaaugcaacuuccaccuccca

SEQ ID NO: 715250 - RNA, 22 nt, Human
gggaaggagguggcuugaagug

SEQ ID NO: 715251 - RNA, 22 nt, Human
ucucaguguguuuucucucaga

SEQ ID NO: 715252 - RNA, 22 nt, Human
gagugcuggaggugugaguggg

SEQ ID NO: 715253 - RNA, 22 nt, Human
uauggcuaauucuuuacugacc

SEQ ID NO: 715254 - RNA, 22 nt, Human
auggcccaaacugcaauuacuu

SEQ ID NO: 715255 - RNA, 22 nt, Human
aaacuguaaguuugaggggaaa

SEQ ID NO: 715256 - RNA, 22 nt, Human
uuccaugugaguacacugugau

SEQ ID NO: 715257 - RNA, 22 nt, Human
aauauuucuggugcuucucacu

SEQ ID NO: 715258 - RNA, 22 nt, Human
cacaggccugggguugagcggg

SEQ ID NO: 715259 - RNA, 21 nt, Human
aggugcaggccucaagcccca

SEQ ID NO: 715260 - RNA, 22 nt, Human
aagcccugacuaugaagacaua

SEQ ID NO: 715261 - RNA, 20 nt, Human
cagaaagaagguagauuuuu

SEQ ID NO: 715262 - RNA, 21 nt, Human
aggggacagaguagcuccagg

SEQ ID NO: 715263 - RNA, 22 nt, Human
uggaggcaacugaagauguagu

SEQ ID NO: 715264 - RNA, 22 nt, Human
cccugcagugugaccucaccua

SEQ ID NO: 715265 - RNA, 22 nt, Human
gaucugaaucaauagaauaacu

SEQ ID NO: 715266 - RNA, 22 nt, Human
ggacagcauucuacuguaggca

SEQ ID NO: 715267 - RNA, 22 nt, Human
cuucaagucgccaaaugcugaa

SEQ ID NO: 715268 - RNA, 22 nt, Human
gacaggugcuaagggaccuggc

SEQ ID NO: 715269 - RNA, 22 nt, Human
acaaggcaguacaaugaugaca

SEQ ID NO: 715270 - RNA, 22 nt, Human
agagacaaugccaaugcacacg

SEQ ID NO: 715271 - RNA, 23 nt, Human
gaaguucuuucuucucaugcugu

SEQ ID NO: 715272 - RNA, 22 nt, Human
cuggagcagguuuaggaguccc

SEQ ID NO: 715273 - RNA, 22 nt, Human
uaaauucacuccugguagaccu

SEQ ID NO: 715274 - RNA, 22 nt, Human
ugcuugaaagggguuucccagu

SEQ ID NO: 715275 - RNA, 22 nt, Human
uuugcaaaugcucugcagagcu

SEQ ID NO: 715276 - RNA, 22 nt, Human
cagagagagucugucccugaag

SEQ ID NO: 715277 - RNA, 22 nt, Human
ucagguccaagauggccaucca

SEQ ID NO: 715278 - RNA, 22 nt, Human
gacaaggcaaccagggaggcuu

SEQ ID NO: 715279 - RNA, 22 nt, Human
acaguuuuuucaacauuggaau

SEQ ID NO: 715280 - RNA, 22 nt, Human
uauugcugaggauugaggcuug

SEQ ID NO: 715281 - RNA, 19 nt, Human
uuugcagugguuccuuugu

SEQ ID NO: 715282 - RNA, 21 nt, Human
uccugcagaaugccuuccuac

SEQ ID NO: 715283 - RNA, 21 nt, Human
aaucaagaguacugguguggc

SEQ ID NO: 715284 - RNA, 22 nt, Human
uaccagcaaugcuagucaacuc

SEQ ID NO: 715285 - RNA, 22 nt, Human
gcagagccaugggagguuuuug

SEQ ID NO: 715286 - RNA, 22 nt, Human
ggcugcaggaacgacggagggg

SEQ ID NO: 715287 - RNA, 22 nt, Human
gagugcuggggugcagagaggu

SEQ ID NO: 715288 - RNA, 22 nt, Human
agacaacaccaaaugcuagugu

SEQ ID NO: 715289 - RNA, 22 nt, Human
uguuaucacuuagacaugcuag

SEQ ID NO: 715290 - RNA, 22 nt, Human
gaggccacagcuaucagggaca

SEQ ID NO: 715291 - RNA, 22 nt, Human
ugggccuguuucccuucagggc

SEQ ID NO: 715292 - RNA, 22 nt, Human
uguaaauggucagauaaaccua

SEQ ID NO: 715293 - RNA, 22 nt, Human
cugggucuggugucaggcgacg

SEQ ID NO: 715294 - RNA, 22 nt, Human
ggcugcaguugugugaaggccg

SEQ ID NO: 715295 - RNA, 20 nt, Human
aguguuugcucacagucucc

SEQ ID NO: 715296 - RNA, 22 nt, Human
gcagcaacgcggcccuacugcu

SEQ ID NO: 715297 - RNA, 22 nt, Human
ucuuuguacaggaaggcacugu

SEQ ID NO: 715298 - RNA, 21 nt, Human
uucugagcacucaucacuguc

SEQ ID NO: 715299 - RNA, 22 nt, Human
aaguccaguuuuuccagguggu

SEQ ID NO: 715300 - RNA, 22 nt, Human
gcuggcugcagauuuuagaggu

SEQ ID NO: 715301 - RNA, 22 nt, Human
auuccuugcacaucagauaguu

SEQ ID NO: 715302 - RNA, 22 nt, Human
uaggagacauugaucccaagaa

SEQ ID NO: 715303 - RNA, 22 nt, Human
ggaggagcacuucugagcucag

SEQ ID NO: 715304 - RNA, 22 nt, Human
caagaguuuaaaucaauggcca

SEQ ID NO: 715305 - RNA, 22 nt, Human
ccuccuggguucaagcgauucu

SEQ ID NO: 715306 - RNA, 22 nt, Human
uggccgggccgggcgccuccac

SEQ ID NO: 715307 - RNA, 22 nt, Human
agcugugugcauuugggucuca

SEQ ID NO: 715308 - RNA, 22 nt, Human
gcuggagcuugagaggacaggg

SEQ ID NO: 715309 - RNA, 22 nt, Human
ccugaguggagggauucugcag

SEQ ID NO: 715310 - RNA, 22 nt, Human
ugggcuguggagcaccuuugca

SEQ ID NO: 715311 - RNA, 22 nt, Human
uuagucuucuuccuuauauguu

SEQ ID NO: 715312 - RNA, 22 nt, Human
ugcugccuggagccuuuuguuu

SEQ ID NO: 715313 - RNA, 22 nt, Human
cucagccugugaagagcagagg

SEQ ID NO: 715314 - RNA, 22 nt, Human
uagcagaggcuacugcuccuug

SEQ ID NO: 715315 - RNA, 22 nt, Human
cagaagcuuugcucauaaccau

SEQ ID NO: 715316 - RNA, 22 nt, Human
cagggcccaagacacaaugagg

SEQ ID NO: 715317 - RNA, 22 nt, Human
gaccuggguaaggggcugacaa

SEQ ID NO: 715318 - RNA, 22 nt, Human
agaacucucgcuggaucagacu

SEQ ID NO: 715319 - RNA, 22 nt, Human
aaugucuuuaaagugcaauaga

SEQ ID NO: 715320 - RNA, 22 nt, Human
ccagaugguuugcaugggaggg

SEQ ID NO: 715321 - RNA, 22 nt, Human
agugcucacucuccacagugcc

SEQ ID NO: 715322 - RNA, 22 nt, Human
aggcagggcugggauuagacuc

SEQ ID NO: 715323 - RNA, 22 nt, Human
aaaggcauggaacagauucucc

SEQ ID NO: 715324 - RNA, 22 nt, Human
uaagauaauaaguaugucuaug

SEQ ID NO: 715325 - RNA, 22 nt, Human
uggaccccagacaagccagggu

SEQ ID NO: 715326 - RNA, 22 nt, Human
gucaugccagcggagcucggga

SEQ ID NO: 715327 - RNA, 22 nt, Human
uaucugcaucugcauguguauu

SEQ ID NO: 715328 - RNA, 22 nt, Human
uccaugucuucaugugucuaac

SEQ ID NO: 715329 - RNA, 22 nt, Human
ugcccucugccuccucugcaga

SEQ ID NO: 715330 - RNA, 20 nt, Human
cucaguaaaagcacaggguc

SEQ ID NO: 715331 - RNA, 22 nt, Human
agcugcucuuugaaggacacuu

SEQ ID NO: 715332 - RNA, 22 nt, Human
gcugcuguguuggagagggacu

SEQ ID NO: 715333 - RNA, 18 nt, Human
ggcagugcagucucaggg

SEQ ID NO: 715334 - RNA, 22 nt, Human
aaguggcauguauaagaaagaa

SEQ ID NO: 715335 - RNA, 22 nt, Human
cugacauuuacugagcacuuac

SEQ ID NO: 715336 - RNA, 21 nt, Human
auggaaauuggcaaaugcuac

SEQ ID NO: 715337 - RNA, 22 nt, Human
aaguguguauuguuuaugcugc

SEQ ID NO: 715338 - RNA, 22 nt, Human
cuguggggccaaauucuccucu

SEQ ID NO: 715339 - RNA, 22 nt, Human
cagauuuaagagauaaacagug

SEQ ID NO: 715340 - RNA, 22 nt, Human
cuccaggcccacgucgaggagg

SEQ ID NO: 715341 - RNA, 22 nt, Human
ugcuucuagacacugcaauuga

SEQ ID NO: 715342 - RNA, 22 nt, Human
gagucaguaauggauaugucau

SEQ ID NO: 715343 - RNA, 22 nt, Human
uccugggcacaagugagucucc

SEQ ID NO: 715344 - RNA, 22 nt, Human
cagagcugcacauucuaugaug

SEQ ID NO: 715345 - RNA, 22 nt, Human
cagggugagugggaagcagcgu

SEQ ID NO: 715346 - RNA, 20 nt, Human
agacaguggggagcuccuag

SEQ ID NO: 715347 - RNA, 22 nt, Human
caacuuuagaccccaaguagcu

SEQ ID NO: 715348 - RNA, 22 nt, Human
caaagauaugacauggaaaaug

SEQ ID NO: 715349 - RNA, 22 nt, Human
aacacuuuccugccuuucugau

SEQ ID NO: 715350 - RNA, 22 nt, Human
cccagaggggucgucugagggg

SEQ ID NO: 715351 - RNA, 22 nt, Human
ugcccaaggauccauuggcugg

SEQ ID NO: 715352 - RNA, 22 nt, Human
uuguauaagaaguuggcagaua

SEQ ID NO: 715353 - RNA, 20 nt, Human
ucucgcacucggagcagccg

SEQ ID NO: 715354 - RNA, 22 nt, Human
cccugagucaucauugcggaag

SEQ ID NO: 715355 - RNA, 22 nt, Human
ccuggagcuuggucacgcugcg

SEQ ID NO: 715356 - RNA, 22 nt, Human
uucuauguggauauagaacugc

SEQ ID NO: 715357 - RNA, 22 nt, Human
aaguauuucagcgguucuuugu

SEQ ID NO: 715358 - RNA, 22 nt, Human
cuuuacagcuuagugguaugga

SEQ ID NO: 715359 - RNA, 22 nt, Human
uuucacaauuuuaaggagcaaa

SEQ ID NO: 715360 - RNA, 22 nt, Human
aacaccuucuccuugcaggcca

SEQ ID NO: 715361 - RNA, 22 nt, Human
aaugucaugggaauuuauucau

SEQ ID NO: 715362 - RNA, 22 nt, Human
ugcuuaauguacgugaguguac

SEQ ID NO: 715363 - RNA, 22 nt, Human
aagaaaugcugauguuggaugg

SEQ ID NO: 715364 - RNA, 19 nt, Human
aacuacagcgcacuguccu

SEQ ID NO: 715365 - RNA, 22 nt, Human
gggcagguuggcaucccgggca

SEQ ID NO: 715366 - RNA, 22 nt, Human
cagagcagccuccagggggagc

SEQ ID NO: 715367 - RNA, 22 nt, Human
ucagugcagaauagugaugcau

SEQ ID NO: 715368 - RNA, 22 nt, Human
auguguuuugguaauuucugcu

SEQ ID NO: 715369 - RNA, 23 nt, Human
agaccugcaucugauaggcccug

SEQ ID NO: 715370 - RNA, 22 nt, Human
ggaggggcauaguucaccauca

SEQ ID NO: 715371 - RNA, 22 nt, Human
caguaauaagcuggagggugug

SEQ ID NO: 715372 - RNA, 22 nt, Human
cgaggcaggcaggcggaggaua

SEQ ID NO: 715373 - RNA, 17 nt, Human
ggcuucagggagcuggg

SEQ ID NO: 715374 - RNA, 22 nt, Human
caucauuuuguauccaagggga

SEQ ID NO: 715375 - RNA, 22 nt, Human
gaaacguuggcauaaguuuaug

SEQ ID NO: 715376 - RNA, 22 nt, Human
ugaaaauuuccaucaguuauau

SEQ ID NO: 715377 - RNA, 22 nt, Human
aggauggaauuagguagcaagu

SEQ ID NO: 715378 - RNA, 18 nt, Human
aggacuccugggaguugg

SEQ ID NO: 715379 - RNA, 22 nt, Human
gaacuguguacauuguagauaa

SEQ ID NO: 715380 - RNA, 22 nt, Human
ggcccagcgaggccaccuacag

SEQ ID NO: 715381 - RNA, 22 nt, Human
agcuuccuacaaccaucucaga

SEQ ID NO: 715382 - RNA, 22 nt, Human
acagggcuggggcacuuggcug

SEQ ID NO: 715383 - RNA, 22 nt, Human
gcuccaggcagagccucuuucg

SEQ ID NO: 715384 - RNA, 22 nt, Human
aagaacuuuaaagcacuuauga

SEQ ID NO: 715385 - RNA, 22 nt, Human
ggacugggaaucagggagaugc

SEQ ID NO: 715386 - RNA, 22 nt, Human
cccauuuaaacacaagcuuuca

SEQ ID NO: 715387 - RNA, 22 nt, Human
cuccucagcugggaggaguccc

SEQ ID NO: 715388 - RNA, 22 nt, Human
ugcagaggcuggcucgccgggu

SEQ ID NO: 715389 - RNA, 18 nt, Human
auaaagugcuaauaaugg

SEQ ID NO: 715390 - RNA, 22 nt, Human
uuucucucagccuguagaaacu

SEQ ID NO: 715391 - RNA, 22 nt, Human
ucugccaggcauugugcugcuc

SEQ ID NO: 715392 - RNA, 22 nt, Human
uuugaaguggaaaaggauuuaa

SEQ ID NO: 715393 - RNA, 20 nt, Human
aggcccugugcaucuuguuu

SEQ ID NO: 715394 - RNA, 22 nt, Human
cggagaggugggggcagcaucu

SEQ ID NO: 715395 - RNA, 22 nt, Human
ggaaacacaugaucagacaucu

SEQ ID NO: 715396 - RNA, 21 nt, Human
ucccuugggaaacuuucuuga

SEQ ID NO: 715397 - RNA, 22 nt, Human
acauggcaggaaucauguguuu

SEQ ID NO: 715398 - RNA, 22 nt, Human
aaaaguauuuauggcuauguaa

SEQ ID NO: 715399 - RNA, 22 nt, Human
uuuaauugcauuuaaagaugga

SEQ ID NO: 715400 - RNA, 22 nt, Human
gcggagggcgagcccgcggagc

SEQ ID NO: 715401 - RNA, 22 nt, Human
uacauugagcacguacuaugug

SEQ ID NO: 715402 - RNA, 22 nt, Human
aaucaggagugugcacuuugau

SEQ ID NO: 715403 - RNA, 22 nt, Human
ugguggucauagcagaggccgu

SEQ ID NO: 715404 - RNA, 22 nt, Human
gaaaaagugaccuugguagcua

SEQ ID NO: 715405 - RNA, 22 nt, Human
aagacauuagaaucagccuguu

SEQ ID NO: 715406 - RNA, 22 nt, Human
ugcuuuauggagcccaucucau

SEQ ID NO: 715407 - RNA, 22 nt, Human
caggaagucuuugcccaggcca

SEQ ID NO: 715408 - RNA, 22 nt, Human
agcuggcacuagcguuuccaag

SEQ ID NO: 715409 - RNA, 22 nt, Human
aucacaauguacguuaaaaugu

SEQ ID NO: 715410 - RNA, 22 nt, Human
agccucuccagagccuggcaga

SEQ ID NO: 715411 - RNA, 22 nt, Human
cagcacuguucccagaccacug

SEQ ID NO: 715412 - RNA, 22 nt, Human
agcugagauuguuuccauuucu

SEQ ID NO: 715413 - RNA, 22 nt, Human
caggcagaggcuuuucauggcu

SEQ ID NO: 715414 - RNA, 22 nt, Human
auuuguagugaagugaaaauaa

SEQ ID NO: 715415 - RNA, 22 nt, Human
uugacuuuaaagcuuugucucu

SEQ ID NO: 715416 - RNA, 18 nt, Human
acaaaugugucacaggaa

SEQ ID NO: 715417 - RNA, 22 nt, Human
uguuuauugcagugcugggcug

SEQ ID NO: 715418 - RNA, 22 nt, Human
guaguguguaggcacugugcuc

SEQ ID NO: 715419 - RNA, 22 nt, Human
cuguuucagaacuucuuaaaaa

SEQ ID NO: 715420 - RNA, 22 nt, Human
uggcuggcaaggcuggagucag

SEQ ID NO: 715421 - RNA, 17 nt, Human
uagcugccccgaaugcu

SEQ ID NO: 715422 - RNA, 22 nt, Human
cccagcagauggcuaugugcua

SEQ ID NO: 715423 - RNA, 22 nt, Human
uggcuggcaguaggcuaguggc

SEQ ID NO: 715424 - RNA, 22 nt, Human
accugagaaugggggcaugugu

SEQ ID NO: 715425 - RNA, 22 nt, Human
gaggcugccccuuccucagcug

SEQ ID NO: 715426 - RNA, 22 nt, Human
auguagaccuuucuuugugauu

SEQ ID NO: 715427 - RNA, 22 nt, Human
aagcauggagcaauagaaugac

SEQ ID NO: 715428 - RNA, 20 nt, Human
gagauggacagaugaagggg

SEQ ID NO: 715429 - RNA, 22 nt, Human
uguuuacaagccacuuguuaag

SEQ ID NO: 715430 - RNA, 22 nt, Human
ugauuccacucugaggaucgua

SEQ ID NO: 715431 - RNA, 22 nt, Human
uguuucaugaaacauguuuagg

SEQ ID NO: 715432 - RNA, 22 nt, Human
ucccuaggagaauugccgcagc

SEQ ID NO: 715433 - RNA, 18 nt, Human
ggcugagguugacuagaa

SEQ ID NO: 715434 - RNA, 22 nt, Human
acuugucuuuguaaaauagaaa

SEQ ID NO: 715435 - RNA, 22 nt, Human
ccacauuucuucacuuguccca

SEQ ID NO: 715436 - RNA, 22 nt, Human
uauuauggggggaacaucacuc

SEQ ID NO: 715437 - RNA, 22 nt, Human
uccuucaguuaaagaucucaca

SEQ ID NO: 715438 - RNA, 22 nt, Human
cuuuggauuuuuaucaggcaau

SEQ ID NO: 715439 - RNA, 22 nt, Human
aagaaacaaccacugcucuccu

SEQ ID NO: 715440 - RNA, 18 nt, Human
gucacuguguuucugagc

SEQ ID NO: 715441 - RNA, 22 nt, Human
aggcuggagugcaguggcguga

SEQ ID NO: 715442 - RNA, 22 nt, Human
agggagaacaguugcagcagac

SEQ ID NO: 715443 - RNA, 22 nt, Human
ggaggcuccaugagcuccugca

SEQ ID NO: 715444 - RNA, 22 nt, Human
acucacaagugaugugaauggc

SEQ ID NO: 715445 - RNA, 22 nt, Human
uuccuggggcuccagcuaccag

SEQ ID NO: 715446 - RNA, 22 nt, Human
uccugagagucaagaaugcagg

SEQ ID NO: 715447 - RNA, 22 nt, Human
acagaugaggaaacagggucag

SEQ ID NO: 715448 - RNA, 19 nt, Human
ccuguguugggagugugag

SEQ ID NO: 715449 - RNA, 22 nt, Human
auggcaguggaaugggaugagu

SEQ ID NO: 715450 - RNA, 22 nt, Human
cuggccaggcuugggacagaca

SEQ ID NO: 715451 - RNA, 22 nt, Human
uaagcaaugagauaaucauggg

SEQ ID NO: 715452 - RNA, 22 nt, Human
ugcugggccuuuaccuccaggg

SEQ ID NO: 715453 - RNA, 22 nt, Human
gcucccacaaccuucuugcucc

SEQ ID NO: 715454 - RNA, 22 nt, Human
ggccaaggcucuugagggcuga

SEQ ID NO: 715455 - RNA, 22 nt, Human
uacaaaggcagguuucccagga

SEQ ID NO: 715456 - RNA, 22 nt, Human
uuucaaacauuccugggagacu

SEQ ID NO: 715457 - RNA, 22 nt, Human
aguccggggucuggacaccugg

SEQ ID NO: 715458 - RNA, 22 nt, Human
cugaguucuaggcugccaccuu

SEQ ID NO: 715459 - RNA, 22 nt, Human
aaagucuuaauguaaguuuagu

SEQ ID NO: 715460 - RNA, 20 nt, Human
cuugccaguucccuggcaga

SEQ ID NO: 715461 - RNA, 20 nt, Human
uuuacauuuugaaacaguga

SEQ ID NO: 715462 - RNA, 22 nt, Human
caucucauccugcccuaaaaca

SEQ ID NO: 715463 - RNA, 22 nt, Human
cugcaccauccuucaugcucug

SEQ ID NO: 715464 - RNA, 20 nt, Human
ugcaggcuucgcucuaggag

SEQ ID NO: 715465 - RNA, 22 nt, Human
cugcagggagcagauggcgugu

SEQ ID NO: 715466 - RNA, 22 nt, Human
ugggaagaggcgggaggcuguu

SEQ ID NO: 715467 - RNA, 22 nt, Human
gcaggccuaagagaaggcauug

SEQ ID NO: 715468 - RNA, 22 nt, Human
caggcagcucugcuuuuccuaa

SEQ ID NO: 715469 - RNA, 22 nt, Human
auuugcagaagggagggggacc

SEQ ID NO: 715470 - RNA, 22 nt, Human
agaaauagucacauuggaggaa

SEQ ID NO: 715471 - RNA, 22 nt, Human
acagagacugggagcaagaggc

SEQ ID NO: 715472 - RNA, 22 nt, Human
gcugaggaggugugguuaggug

SEQ ID NO: 715473 - RNA, 22 nt, Human
uguacaauguggccaguguuaa

SEQ ID NO: 715474 - RNA, 22 nt, Human
cugaagcuugauaaacuauaaa

SEQ ID NO: 715475 - RNA, 22 nt, Human
uguuuugucuaaucuaaauucu

SEQ ID NO: 715476 - RNA, 22 nt, Human
ccugagaauaauucuccauagc

SEQ ID NO: 715477 - RNA, 22 nt, Human
uuggaucauggaaugucugcuu

SEQ ID NO: 715478 - RNA, 22 nt, Human
guuucucuguaccucuguccca

SEQ ID NO: 715479 - RNA, 22 nt, Human
aaggggaaaaaguguuaggagu

SEQ ID NO: 715480 - RNA, 22 nt, Human
ugguuaaaaugcagauucagua

SEQ ID NO: 715481 - RNA, 22 nt, Human
acaguacagugcagaggaagau

SEQ ID NO: 715482 - RNA, 22 nt, Human
ccagggccaagagaccucgagg

SEQ ID NO: 715483 - RNA, 22 nt, Human
auuuucucuuuguauaugcuag

SEQ ID NO: 715484 - RNA, 22 nt, Human
uggcucucuuguaagguaguag

SEQ ID NO: 715485 - RNA, 19 nt, Human
ggccagcugucuccugcua

SEQ ID NO: 715486 - RNA, 22 nt, Human
uugaugaguuauccauuugacu

SEQ ID NO: 715487 - RNA, 22 nt, Human
gugugaaaaugugcacaauaug

SEQ ID NO: 715488 - RNA, 22 nt, Human
aauugagugcagccagcccagu

SEQ ID NO: 715489 - RNA, 22 nt, Human
agugacugggcagggcagggcc

SEQ ID NO: 715490 - RNA, 22 nt, Human
uacauuauuucaucagucaucu

SEQ ID NO: 715491 - RNA, 22 nt, Human
cuggcugaggcagagccugggg

SEQ ID NO: 715492 - RNA, 21 nt, Human
uauuucuuugacucucucccu

SEQ ID NO: 715493 - RNA, 22 nt, Human
ucaccaggcaacuauguacucc

SEQ ID NO: 715494 - RNA, 22 nt, Human
guuaaaugcagauucugacuca

SEQ ID NO: 715495 - RNA, 22 nt, Human
gggcagugggaccaggcaccag

SEQ ID NO: 715496 - RNA, 22 nt, Human
guacaaaugaaaauagaccacu

SEQ ID NO: 715497 - RNA, 22 nt, Human
uuuagcaauaucauaaggaaga

SEQ ID NO: 715498 - RNA, 22 nt, Human
acagaguaucuaucaggaguau

SEQ ID NO: 715499 - RNA, 22 nt, Human
ucaggcagaguggaagcugcaa

SEQ ID NO: 715500 - RNA, 22 nt, Human
gccaccugccaacuugcuggaa

SEQ ID NO: 715501 - RNA, 22 nt, Human
aacagauaauuucuaaguuacu

SEQ ID NO: 715502 - RNA, 22 nt, Human
cacagcauucacagaaagacau

SEQ ID NO: 715503 - RNA, 22 nt, Human
aaaggcagugugauacuguggu

SEQ ID NO: 715504 - RNA, 22 nt, Human
guugaauaucguguucuuguuu

SEQ ID NO: 715505 - RNA, 22 nt, Human
uugccaggagacaaagugggcc

SEQ ID NO: 715506 - RNA, 22 nt, Human
gcccaggccggagagcagugcu

SEQ ID NO: 715507 - RNA, 22 nt, Human
agggccagcugaugagaaugag

SEQ ID NO: 715508 - RNA, 22 nt, Human
acccaugaguguaucuuuaaaa

SEQ ID NO: 715509 - RNA, 20 nt, Human
aagggcagagggaacagacu

SEQ ID NO: 715510 - RNA, 19 nt, Human
ucagaacucagaaugugua

SEQ ID NO: 715511 - RNA, 22 nt, Human
uaauuuuacuuccugagcaccu

SEQ ID NO: 715512 - RNA, 21 nt, Human
ggcugcuggggguuggcacag

SEQ ID NO: 715513 - RNA, 22 nt, Human
ggaggggagucucccaaagccg

SEQ ID NO: 715514 - RNA, 22 nt, Human
uugaagcagcucaggaggcuua

SEQ ID NO: 715515 - RNA, 22 nt, Human
ccuaggcccauuaauuccccuu

SEQ ID NO: 715516 - RNA, 22 nt, Human
acaauguuuuuguucaaagagu

SEQ ID NO: 715517 - RNA, 20 nt, Human
accuggagagauuauuacca

SEQ ID NO: 715518 - RNA, 15 nt, Human
gccccaggaaucaaa

SEQ ID NO: 715519 - RNA, 22 nt, Human
agugcccugggccuuccaggac

SEQ ID NO: 715520 - RNA, 22 nt, Human
uggcugcugcuuggucuucuuc

SEQ ID NO: 715521 - RNA, 23 nt, Human
uaggggcuggcguggagccugcg

SEQ ID NO: 715522 - RNA, 22 nt, Human
ugcccuggcucuccacuaguuu

SEQ ID NO: 715523 - RNA, 22 nt, Human
agcuucuugggcuuuacacaaa

SEQ ID NO: 715524 - RNA, 22 nt, Human
uauggguaggguuugauaagau

SEQ ID NO: 715525 - RNA, 22 nt, Human
uggcccugucugcacacaggau

SEQ ID NO: 715526 - RNA, 22 nt, Human
gcugaagcugacacauagugcu

SEQ ID NO: 715527 - RNA, 22 nt, Human
acagagagaauuggguuuacag

SEQ ID NO: 715528 - RNA, 22 nt, Human
ggcucucuccuuggcuuucaga

SEQ ID NO: 715529 - RNA, 22 nt, Human
agagcuggagcagccccacugg

SEQ ID NO: 715530 - RNA, 22 nt, Human
auauucuggguuagauauguuu

SEQ ID NO: 715531 - RNA, 22 nt, Human
uccaggagucuagccucaggcc

SEQ ID NO: 715532 - RNA, 22 nt, Human
ggguggccuuaggcaagucacu

SEQ ID NO: 715533 - RNA, 22 nt, Human
uuucauaauacuguacaugaaa

SEQ ID NO: 715534 - RNA, 22 nt, Human
ggagaggauguuuuaguaacuu

SEQ ID NO: 715535 - RNA, 22 nt, Human
cagagaacuccaguggcuggcg

SEQ ID NO: 715536 - RNA, 22 nt, Human
ugcugccuaacagaacucuuuc

SEQ ID NO: 715537 - RNA, 22 nt, Human
caagggaagaggacagggaccu

SEQ ID NO: 715538 - RNA, 22 nt, Human
cccuggagggauuucucaauca

SEQ ID NO: 715539 - RNA, 22 nt, Human
gcuggagguuucaccugaguuu

SEQ ID NO: 715540 - RNA, 22 nt, Human
gaauuacaaagugagacaagcu

SEQ ID NO: 715541 - RNA, 22 nt, Human
caggguuucaccauguuagcag

SEQ ID NO: 715542 - RNA, 22 nt, Human
agaggccagaaggcgcaccccg

SEQ ID NO: 715543 - RNA, 22 nt, Human
cuggccuggagccucugggugg

SEQ ID NO: 715544 - RNA, 22 nt, Human
acagagaccaguuacagcgucc

SEQ ID NO: 715545 - RNA, 22 nt, Human
ugucuccaacucacuguauacu

SEQ ID NO: 715546 - RNA, 22 nt, Human
caaauucaaauuucaucagugu

SEQ ID NO: 715547 - RNA, 22 nt, Human
auaaaaguuuccaaucaugccu

SEQ ID NO: 715548 - RNA, 22 nt, Human
ggaagaggcugguagugcccgu

SEQ ID NO: 715549 - RNA, 22 nt, Human
aaaugccucauuuucucucacu

SEQ ID NO: 715550 - RNA, 22 nt, Human
gcucuggauccggcugggucug

SEQ ID NO: 715551 - RNA, 22 nt, Human
caggcucccuaagucagcagcc

SEQ ID NO: 715552 - RNA, 22 nt, Human
uuccuuccugucuuccuuacug

SEQ ID NO: 715553 - RNA, 22 nt, Human
ggccagcucuuguccacggagg

SEQ ID NO: 715554 - RNA, 22 nt, Human
ggucagagcuggagagauaggg

SEQ ID NO: 715555 - RNA, 22 nt, Human
ggguuaaagagcccaauguaug

SEQ ID NO: 715556 - RNA, 22 nt, Human
acaggcugcugggcuccgugcu

SEQ ID NO: 715557 - RNA, 22 nt, Human
acacauguauaugcuugugugu

SEQ ID NO: 715558 - RNA, 22 nt, Human
uuuacagaugaggauacugagg

SEQ ID NO: 715559 - RNA, 22 nt, Human
aggcagagaaaaaccagauaug

SEQ ID NO: 715560 - RNA, 22 nt, Human
acagaugaggcuggcgagggca

SEQ ID NO: 715561 - RNA, 22 nt, Human
ugcagagaaaguguagacaggc

SEQ ID NO: 715562 - RNA, 22 nt, Human
cacugagagaugugucacagca

SEQ ID NO: 715563 - RNA, 22 nt, Human
cuucacaaagcucucuuuaugu

SEQ ID NO: 715564 - RNA, 19 nt, Human
gguuaauguuaggauacuu

SEQ ID NO: 715565 - RNA, 21 nt, Human
ucuggcaggcacgggcccagc

SEQ ID NO: 715566 - RNA, 20 nt, Human
uccaagggcagcagaaucag

SEQ ID NO: 715567 - RNA, 22 nt, Human
auauggcuguugguagccaaca

SEQ ID NO: 715568 - RNA, 22 nt, Human
aggccaagcucccagagaagcu

SEQ ID NO: 715569 - RNA, 22 nt, Human
acucuuuaacagacuuugaucu

SEQ ID NO: 715570 - RNA, 22 nt, Human
uaacaucuuauuggcaaagaua

SEQ ID NO: 715571 - RNA, 22 nt, Human
auuuguauauuuaagaggguag

SEQ ID NO: 715572 - RNA, 22 nt, Human
agcaucuggauggaaagcaagg

SEQ ID NO: 715573 - RNA, 20 nt, Human
ggcaggugcuguccccuccu

SEQ ID NO: 715574 - RNA, 22 nt, Human
uacaagcugacccugaagauga

SEQ ID NO: 715575 - RNA, 22 nt, Human
ucuagcagggaaagcagagaau

SEQ ID NO: 715576 - RNA, 22 nt, Human
uuucacagauauaagauuucac

SEQ ID NO: 715577 - RNA, 22 nt, Human
uacagagaacucauagaaagaa

SEQ ID NO: 715578 - RNA, 22 nt, Human
aggugggguucagucucagccg

SEQ ID NO: 715579 - RNA, 22 nt, Human
aggaggaaagaaggcccccagc

SEQ ID NO: 715580 - RNA, 22 nt, Human
ugccucagaguugucccuacca

SEQ ID NO: 715581 - RNA, 22 nt, Human
ucagagguaagggcugagagga

SEQ ID NO: 715582 - RNA, 22 nt, Human
agggaggaaggauguuccaaag

SEQ ID NO: 715583 - RNA, 22 nt, Human
cucugcccgugccuuucccagu

SEQ ID NO: 715584 - RNA, 22 nt, Human
gaaaauguuuccuguuauuugc

SEQ ID NO: 715585 - RNA, 22 nt, Human
uagauuaacaguuuuguugaag

SEQ ID NO: 715586 - RNA, 22 nt, Human
cauuacagaauauguaaugauc

SEQ ID NO: 715587 - RNA, 22 nt, Human
uugaagcauuugcuauagcauu

SEQ ID NO: 715588 - RNA, 22 nt, Human
aaaguacaauauugagauugau

SEQ ID NO: 715589 - RNA, 22 nt, Human
auugaaaaugacauuugugccc

SEQ ID NO: 715590 - RNA, 22 nt, Human
auguggggacaaaaugauggcc

SEQ ID NO: 715591 - RNA, 22 nt, Human
agggcuagaguugagaugggga

SEQ ID NO: 715592 - RNA, 22 nt, Human
ugguccuugcuauagagugaua

SEQ ID NO: 715593 - RNA, 22 nt, Human
ucucagagaacaguuggugcuu

SEQ ID NO: 715594 - RNA, 22 nt, Human
accccaggucaucugagagucc

SEQ ID NO: 715595 - RNA, 22 nt, Human
agggcagccauugagggauucu

SEQ ID NO: 715596 - RNA, 22 nt, Human
acugaggucuaucaugagccag

SEQ ID NO: 715597 - RNA, 22 nt, Human
ucuccagggacugaggcuggag

SEQ ID NO: 715598 - RNA, 22 nt, Human
uucacagugcugcaccuggcuu

SEQ ID NO: 715599 - RNA, 22 nt, Human
ugcuucuguucuuucaccuacg

SEQ ID NO: 715600 - RNA, 17 nt, Human
aacugcuuuuuuuagcc

SEQ ID NO: 715601 - RNA, 22 nt, Human
ucugcaggccucgacaaggcca

SEQ ID NO: 715602 - RNA, 22 nt, Human
aaugcugcaagaggugaaaaga

SEQ ID NO: 715603 - RNA, 22 nt, Human
uagaguguccaacacauaggag

SEQ ID NO: 715604 - RNA, 19 nt, Human
aaagugaaugcuguuuucu

SEQ ID NO: 715605 - RNA, 22 nt, Human
uauaggaaauuuaucuccuggg

SEQ ID NO: 715606 - RNA, 22 nt, Human
ggucacaugagaugcugcccuc

SEQ ID NO: 715607 - RNA, 22 nt, Human
gauaaauuaucagggguuuaaa

SEQ ID NO: 715608 - RNA, 22 nt, Human
ucucugguggcuccaucaguag

SEQ ID NO: 715609 - RNA, 22 nt, Human
aggaaaaucgagucuggaggca

SEQ ID NO: 715610 - RNA, 22 nt, Human
ucacacaugcuaagccagagau

SEQ ID NO: 715611 - RNA, 22 nt, Human
gugcauuuaggucacaugaugu

SEQ ID NO: 715612 - RNA, 22 nt, Human
cuguuggaugugacacuguuag

SEQ ID NO: 715613 - RNA, 19 nt, Human
ggcuggcaagugacagugu

SEQ ID NO: 715614 - RNA, 22 nt, Human
cucuguacaggagacaucucua

SEQ ID NO: 715615 - RNA, 22 nt, Human
gcaguggcuaggagucuggcgu

SEQ ID NO: 715616 - RNA, 22 nt, Human
agugaugugggagaguauagcu

SEQ ID NO: 715617 - RNA, 22 nt, Human
uauggguaagaucuuuuguauu

SEQ ID NO: 715618 - RNA, 22 nt, Human
cugucccagauguucucagcac

SEQ ID NO: 715619 - RNA, 22 nt, Human
auuacaguaaaugcuacaggca

SEQ ID NO: 715620 - RNA, 21 nt, Human
agcauucaaaagaugccauaa

SEQ ID NO: 715621 - RNA, 22 nt, Human
agcguguggagaacuaagcaga

SEQ ID NO: 715622 - RNA, 22 nt, Human
gaucuguuugccuagagauuua

SEQ ID NO: 715623 - RNA, 23 nt, Human
aaaggcacagcauugucuagcag

SEQ ID NO: 715624 - RNA, 22 nt, Human
ggcuaggcgggcacauggugga

SEQ ID NO: 715625 - RNA, 22 nt, Human
cagggccauuggcguggcuguc

SEQ ID NO: 715626 - RNA, 22 nt, Human
gacaucauagggugggaggaaa

SEQ ID NO: 715627 - RNA, 22 nt, Human
uagcccaugaugguggaaggca

SEQ ID NO: 715628 - RNA, 22 nt, Human
cacagcuucuccuugauaucgc

SEQ ID NO: 715629 - RNA, 22 nt, Human
cuuccagaguugcguucucggu

SEQ ID NO: 715630 - RNA, 22 nt, Human
uuucuuuuccaauaucccuacu

SEQ ID NO: 715631 - RNA, 22 nt, Human
uuucucccuuuauaagacugua

SEQ ID NO: 715632 - RNA, 22 nt, Human
agcacuauuccaaugauccaau

SEQ ID NO: 715633 - RNA, 22 nt, Human
ucagcuuuccuugcuuuagauu

SEQ ID NO: 715634 - RNA, 22 nt, Human
aguaaagcauugucuucagagu

SEQ ID NO: 715635 - RNA, 22 nt, Human
ucacugaagacugggcucuaaa

SEQ ID NO: 715636 - RNA, 22 nt, Human
guccaggcugaccccuagagga

SEQ ID NO: 715637 - RNA, 22 nt, Human
uuagcuuuagagccauuacugg

SEQ ID NO: 715638 - RNA, 22 nt, Human
agggccccaguaagauuacaug

SEQ ID NO: 715639 - RNA, 23 nt, Human
ucuguacaauugagaagagaaca

SEQ ID NO: 715640 - RNA, 22 nt, Human
acuuccugggcaugcagagucc

SEQ ID NO: 715641 - RNA, 22 nt, Human
acucagcucaggagcuggcugg

SEQ ID NO: 715642 - RNA, 22 nt, Human
gugcauuauucuuaccuuucuu

SEQ ID NO: 715643 - RNA, 22 nt, Human
aauguaaagcucaggucaggag

SEQ ID NO: 715644 - RNA, 22 nt, Human
gggucaggccucaaggugggcu

SEQ ID NO: 715645 - RNA, 22 nt, Human
aagauguugcauuagaauaccu

SEQ ID NO: 715646 - RNA, 22 nt, Human
gagguggcuccaggagcaaugc

SEQ ID NO: 715647 - RNA, 22 nt, Human
aagcagcuucccuggcuccugg

SEQ ID NO: 715648 - RNA, 22 nt, Human
auuucagacuguguuggaaaau

SEQ ID NO: 715649 - RNA, 22 nt, Human
agacauuuuacauucuuccauu

SEQ ID NO: 715650 - RNA, 22 nt, Human
uccuguccacagcccugaccuc

SEQ ID NO: 715651 - RNA, 22 nt, Human
aaaagaugaaauggugucuugg

SEQ ID NO: 715652 - RNA, 22 nt, Human
cagcacuucagcauucagauuu

SEQ ID NO: 715653 - RNA, 17 nt, Human
cgugagcagcaggugcc

SEQ ID NO: 715654 - RNA, 22 nt, Human
ucauucuuuaccaaguugucac

SEQ ID NO: 715655 - RNA, 22 nt, Human
uaaagcaauuacucaguggcuu

SEQ ID NO: 715656 - RNA, 22 nt, Human
cagcaggcccagaguuucaugg

SEQ ID NO: 715657 - RNA, 22 nt, Human
cccaggcuggcacugcugaagu

SEQ ID NO: 715658 - RNA, 22 nt, Human
cccuugggcuuccacccagccc

SEQ ID NO: 715659 - RNA, 22 nt, Human
agggaugguggagguugcaagu

SEQ ID NO: 715660 - RNA, 22 nt, Human
agagccuggucugagauaggac

SEQ ID NO: 715661 - RNA, 22 nt, Human
gacagggaggagcagagcuucu

SEQ ID NO: 715662 - RNA, 22 nt, Human
cuaaaguccuuaucaaguguaa

SEQ ID NO: 715663 - RNA, 22 nt, Human
cuggcagcuuauuagaaaugca

SEQ ID NO: 715664 - RNA, 22 nt, Human
uacagagagcuccggacauuca

SEQ ID NO: 715665 - RNA, 22 nt, Human
caggcugccaaggcuggggagg

SEQ ID NO: 715666 - RNA, 22 nt, Human
agcagcaauaauaaaguaauac

SEQ ID NO: 715667 - RNA, 22 nt, Human
ugcauuugaguugggagcaggc

SEQ ID NO: 715668 - RNA, 22 nt, Human
augugaaauauuaagccgagga

SEQ ID NO: 715669 - RNA, 22 nt, Human
uccagagccugcgcacuggcug

SEQ ID NO: 715670 - RNA, 22 nt, Human
cauccagggcagccauggccug

SEQ ID NO: 715671 - RNA, 22 nt, Human
cacaagcuccuuauguggagaa

SEQ ID NO: 715672 - RNA, 22 nt, Human
gcagauggcugagccugcagau

SEQ ID NO: 715673 - RNA, 22 nt, Human
ccuucucuaccaugugaggaaa

SEQ ID NO: 715674 - RNA, 22 nt, Human
agcagggcucuguggagggugg

SEQ ID NO: 715675 - RNA, 22 nt, Human
ggggagaauuaccaaaagcgcu

SEQ ID NO: 715676 - RNA, 22 nt, Human
gauuggagaguggaacaugcug

SEQ ID NO: 715677 - RNA, 22 nt, Human
ugcaugcacguaucugcgugug

SEQ ID NO: 715678 - RNA, 22 nt, Human
cugugagaugaccaacugacug

SEQ ID NO: 715679 - RNA, 22 nt, Human
ucucaggaaauaggauuugagu

SEQ ID NO: 715680 - RNA, 22 nt, Human
cagugccugugggcuucuucca

SEQ ID NO: 715681 - RNA, 22 nt, Human
ccauaaucguguguuaaauaau

SEQ ID NO: 715682 - RNA, 22 nt, Human
gugcucacugugagacguccug

SEQ ID NO: 715683 - RNA, 22 nt, Human
cauuuacauuuaagguuaauau

SEQ ID NO: 715684 - RNA, 22 nt, Human
uucucccugguauuuacuuagu

SEQ ID NO: 715685 - RNA, 22 nt, Human
ugcccuggcauuggguuggaua

SEQ ID NO: 715686 - RNA, 22 nt, Human
uuaugaaguuccuguuacagug

SEQ ID NO: 715687 - RNA, 22 nt, Human
acucauguaagcggaauguagu

SEQ ID NO: 715688 - RNA, 22 nt, Human
ucaguugccaguauuuuauaua

SEQ ID NO: 715689 - RNA, 22 nt, Human
ugucagcaguaucucuaucuca

SEQ ID NO: 715690 - RNA, 22 nt, Human
uugacagcaaagauugugccua

SEQ ID NO: 715691 - RNA, 22 nt, Human
acccagagucagacagccaugg

SEQ ID NO: 715692 - RNA, 23 nt, Human
ugagaagccgccgggcagccugg

SEQ ID NO: 715693 - RNA, 22 nt, Human
uauguacucaucaacuauugaa

SEQ ID NO: 715694 - RNA, 23 nt, Human
cagaugagguuggcagcaugguc

SEQ ID NO: 715695 - RNA, 22 nt, Human
guucacaggguuaggaaucacu

SEQ ID NO: 715696 - RNA, 22 nt, Human
ugucuuuuggagcaucuuucuu

SEQ ID NO: 715697 - RNA, 22 nt, Human
uuugaacaagagcuucacauua

SEQ ID NO: 715698 - RNA, 22 nt, Human
gagauuuauugacuuaacagua

SEQ ID NO: 715699 - RNA, 17 nt, Human
gguggccugcaguggcu

SEQ ID NO: 715700 - RNA, 22 nt, Human
cagauuuaccuaacuccaaguu

SEQ ID NO: 715701 - RNA, 23 nt, Human
ggagcugcuguugggggagcugc

SEQ ID NO: 715702 - RNA, 22 nt, Human
agcagcuggaacauaugaagaa

SEQ ID NO: 715703 - RNA, 22 nt, Human
agaaagaggaugcagaucucau

SEQ ID NO: 715704 - RNA, 22 nt, Human
cugggcugcuguccacuagggu

SEQ ID NO: 715705 - RNA, 22 nt, Human
gagagguggugaggacuugucu

SEQ ID NO: 715706 - RNA, 22 nt, Human
ucagaagcauguggggagccug

SEQ ID NO: 715707 - RNA, 22 nt, Human
ggagggcucccugggaguggau

SEQ ID NO: 715708 - RNA, 22 nt, Human
agaaguuauccaccuuagaugc

SEQ ID NO: 715709 - RNA, 22 nt, Human
cagugggagcaaauacacucau

SEQ ID NO: 715710 - RNA, 22 nt, Human
ggaguagcugcauuccgagcac

SEQ ID NO: 715711 - RNA, 22 nt, Human
ccuguggcuuccacgaccuaau

SEQ ID NO: 715712 - RNA, 22 nt, Human
uacauguauugauuucucuucu

SEQ ID NO: 715713 - RNA, 22 nt, Human
cuucuguguuuuacuauaugua

SEQ ID NO: 715714 - RNA, 22 nt, Human
uuuaauguuugagucaguauau

SEQ ID NO: 715715 - RNA, 23 nt, Human
auccuguuguaggcaguaauuag

SEQ ID NO: 715716 - RNA, 22 nt, Human
ugaacagucauuuagaaugugc

SEQ ID NO: 715717 - RNA, 22 nt, Human
auacggguuguuaaaaaaucau

SEQ ID NO: 715718 - RNA, 23 nt, Human
ccagggagguugauugguuaccc

SEQ ID NO: 715719 - RNA, 22 nt, Human
ucugucugagugguguuagagu

SEQ ID NO: 715720 - RNA, 22 nt, Human
aagauuacuacggaacaugacc

SEQ ID NO: 715721 - RNA, 22 nt, Human
uuuuucuugugcuggaucuaau

SEQ ID NO: 715722 - RNA, 22 nt, Human
uuaaaugacgggacuggguuuu

SEQ ID NO: 715723 - RNA, 22 nt, Human
gucccagggaugcagacaugag

SEQ ID NO: 715724 - RNA, 22 nt, Human
gcugggcaccucucccagauug

SEQ ID NO: 715725 - RNA, 22 nt, Human
aagccaaugauacgggugaucu

SEQ ID NO: 715726 - RNA, 22 nt, Human
uaaugucuagaucagaccucga

SEQ ID NO: 715727 - RNA, 23 nt, Human
uuuuaauuuggacauaagaagau

SEQ ID NO: 715728 - RNA, 22 nt, Human
aggauuugaaauauuuaguaaa

SEQ ID NO: 715729 - RNA, 22 nt, Human
aagucagaaauaucugccauca

SEQ ID NO: 715730 - RNA, 22 nt, Human
aucauacagccuuuguuagugu

SEQ ID NO: 715731 - RNA, 22 nt, Human
cugcugugugaccauggacagg

SEQ ID NO: 715732 - RNA, 22 nt, Human
acuaaauuugucaaugacacuu

SEQ ID NO: 715733 - RNA, 22 nt, Human
agcuggcaaggcaauuuggauu

SEQ ID NO: 715734 - RNA, 22 nt, Human
ugcaggcugcaccccugcccug

SEQ ID NO: 715735 - RNA, 22 nt, Human
agacuguuaauuucaauuaaaa

SEQ ID NO: 715736 - RNA, 22 nt, Human
ucucaggagccacagcgggagu

SEQ ID NO: 715737 - RNA, 21 nt, Human
ggccuuggcgggggccgaauu

SEQ ID NO: 715738 - RNA, 18 nt, Human
uacuguggaucagggguu

SEQ ID NO: 715739 - RNA, 22 nt, Human
uggcugccuuucaccucaucuc

SEQ ID NO: 715740 - RNA, 22 nt, Human
aaaugucuacuccuguguuuau

SEQ ID NO: 715741 - RNA, 23 nt, Human
gccaucugguauuuccugacuuc

SEQ ID NO: 715742 - RNA, 22 nt, Human
uucaugugaauauauuugucuu

SEQ ID NO: 715743 - RNA, 22 nt, Human
cggcagggcuccaugcauuucu

SEQ ID NO: 715744 - RNA, 19 nt, Human
ucuccaaaaccaaucacua

SEQ ID NO: 715745 - RNA, 22 nt, Human
acaauagaaauaauuaagcaca

SEQ ID NO: 715746 - RNA, 22 nt, Human
aggaaacuaauuaguagaauaa

SEQ ID NO: 715747 - RNA, 22 nt, Human
acugccaaugguaguuugaugg

SEQ ID NO: 715748 - RNA, 22 nt, Human
ggcggagguugcaguaagccga

SEQ ID NO: 715749 - RNA, 22 nt, Human
ucccagaacccugccagguccu

SEQ ID NO: 715750 - RNA, 22 nt, Human
auucaaguacaguuuucuucuu

SEQ ID NO: 715751 - RNA, 22 nt, Human
ugaaguuagaacuaugaggaua

SEQ ID NO: 715752 - RNA, 22 nt, Human
gcugugggccauggccaaguga

SEQ ID NO: 715753 - RNA, 22 nt, Human
caggagagauaugaguccccac

SEQ ID NO: 715754 - RNA, 21 nt, Human
uccuggccagggcacuaggca

SEQ ID NO: 715755 - RNA, 22 nt, Human
gauggguauuggcagaagaggg

SEQ ID NO: 715756 - RNA, 23 nt, Human
acaugggagggacauggaggcug

SEQ ID NO: 715757 - RNA, 16 nt, Human
cuacccagugagaagg

SEQ ID NO: 715758 - RNA, 22 nt, Human
aagcaauucacaguucacuuaa

SEQ ID NO: 715759 - RNA, 22 nt, Human
ccugggagccaagccucugugu

SEQ ID NO: 715760 - RNA, 22 nt, Human
uacagggacauggaacaggcuc

SEQ ID NO: 715761 - RNA, 22 nt, Human
uucagcaaauggacuguucagg

SEQ ID NO: 715762 - RNA, 22 nt, Human
uaguaucuuucuauauuuccca

SEQ ID NO: 715763 - RNA, 20 nt, Human
uccagcugggaacagcugau

SEQ ID NO: 715764 - RNA, 22 nt, Human
gccugcagccccucugcaguag

SEQ ID NO: 715765 - RNA, 22 nt, Human
gagcaggcuugcagagaagggg

SEQ ID NO: 715766 - RNA, 22 nt, Human
uuuaaugggauccaucugguua

SEQ ID NO: 715767 - RNA, 22 nt, Human
cauguauagcaaauauuuguuc

SEQ ID NO: 715768 - RNA, 22 nt, Human
cugcagcuuauuugcuguguga

SEQ ID NO: 715769 - RNA, 22 nt, Human
aggcagggaccaguuguuuucu

SEQ ID NO: 715770 - RNA, 20 nt, Human
gcugcuuucaaaugacacgu

SEQ ID NO: 715771 - RNA, 22 nt, Human
uguuuagacucaaaauugaaag

SEQ ID NO: 715772 - RNA, 22 nt, Human
uaaaacuuugaaggugcucagu

SEQ ID NO: 715773 - RNA, 22 nt, Human
uacaaguaaauuguagauacca

SEQ ID NO: 715774 - RNA, 23 nt, Human
agucaguguaaguuuggaaugca

SEQ ID NO: 715775 - RNA, 22 nt, Human
ggcaggggugaggccacucuga

SEQ ID NO: 715776 - RNA, 22 nt, Human
uccuggagaaacucagagaucu

SEQ ID NO: 715777 - RNA, 22 nt, Human
ggagaaggcgaagucauucuuu

SEQ ID NO: 715778 - RNA, 22 nt, Human
accagaagcuggagcacaagga

SEQ ID NO: 715779 - RNA, 22 nt, Human
gacauuggcuguucauugggau

SEQ ID NO: 715780 - RNA, 22 nt, Human
gggcagcaaaucugagucuggu

SEQ ID NO: 715781 - RNA, 22 nt, Human
aaguuuagggaagucugagcgc

SEQ ID NO: 715782 - RNA, 22 nt, Human
uuaugcauauagcagauacgag

SEQ ID NO: 715783 - RNA, 22 nt, Human
guuuuuccugcugacuuggguc

SEQ ID NO: 715784 - RNA, 22 nt, Human
uucugcauucaaauuaugugag

SEQ ID NO: 715785 - RNA, 20 nt, Human
ugauuuucugaaacagcaca

SEQ ID NO: 715786 - RNA, 23 nt, Human
ucucagugaaucucagaauucgc

SEQ ID NO: 715787 - RNA, 22 nt, Human
acacauuagugcucugucucau

SEQ ID NO: 715788 - RNA, 22 nt, Human
uccugcagaucaaagccuuuga

SEQ ID NO: 715789 - RNA, 22 nt, Human
uacaaaguauauuucuagcugu

SEQ ID NO: 715790 - RNA, 22 nt, Human
guccugagggcccaggcauucu

SEQ ID NO: 715791 - RNA, 22 nt, Human
uuacacguguguguaucuguau

SEQ ID NO: 715792 - RNA, 22 nt, Human
aggccugaaggaagaugagcug

SEQ ID NO: 715793 - RNA, 19 nt, Human
uuauucugucagagcacac

SEQ ID NO: 715794 - RNA, 22 nt, Human
agcagagugccccaucacaagg

SEQ ID NO: 715795 - RNA, 22 nt, Human
auugagaguguauagcugaucu

SEQ ID NO: 715796 - RNA, 22 nt, Human
gcucucucccuaggcaagugag

SEQ ID NO: 715797 - RNA, 20 nt, Human
uacaggagugaguggguggg

SEQ ID NO: 715798 - RNA, 22 nt, Human
ugugugcacugccuuuugugga

SEQ ID NO: 715799 - RNA, 22 nt, Human
agagugaaguaauuguuaggau

SEQ ID NO: 715800 - RNA, 23 nt, Human
guuuuacaggugagaaaauggag

SEQ ID NO: 715801 - RNA, 22 nt, Human
gcagcuguguaaugagcccaca

SEQ ID NO: 715802 - RNA, 22 nt, Human
agagcuggcugguagcccugau

SEQ ID NO: 715803 - RNA, 22 nt, Human
agacacagauuuuggaaaagau

SEQ ID NO: 715804 - RNA, 22 nt, Human
cucagcagagaccagggaggaa

SEQ ID NO: 715805 - RNA, 22 nt, Human
caaugaaagcaacugccuauaa

SEQ ID NO: 715806 - RNA, 22 nt, Human
ucaaucacguguuccauguucu

SEQ ID NO: 715807 - RNA, 22 nt, Human
guggccauuuggaaggcaagua

SEQ ID NO: 715808 - RNA, 22 nt, Human
acaguggaagaagcacugaacu

SEQ ID NO: 715809 - RNA, 22 nt, Human
acagugugugggaaaugugacu

SEQ ID NO: 715810 - RNA, 22 nt, Human
ccagggucacaaauaacugcag

SEQ ID NO: 715811 - RNA, 20 nt, Human
caguccugccccuuggggac

SEQ ID NO: 715812 - RNA, 22 nt, Human
caggccacgccccggcguguga

SEQ ID NO: 715813 - RNA, 21 nt, Human
ugcaggaguguaaugugaccc

SEQ ID NO: 715814 - RNA, 22 nt, Human
auguguauuuuguacuauuggg

SEQ ID NO: 715815 - RNA, 22 nt, Human
gcuuccagcaccagcagagggg

SEQ ID NO: 715816 - RNA, 22 nt, Human
acccaggauaaucuguguaucu

SEQ ID NO: 715817 - RNA, 22 nt, Human
aucuuucagagcuccaucaggg

SEQ ID NO: 715818 - RNA, 22 nt, Human
ugaaggugaaugucuaugggga

SEQ ID NO: 715819 - RNA, 22 nt, Human
aagaauaucuguuuuauuuagg

SEQ ID NO: 715820 - RNA, 22 nt, Human
gcucucuuuccauguggaggau

SEQ ID NO: 715821 - RNA, 22 nt, Human
auggaacaucagguuaagaaau

SEQ ID NO: 715822 - RNA, 22 nt, Human
aguguuguaugggaugacugcu

SEQ ID NO: 715823 - RNA, 21 nt, Human
gcuccagaacucuaugcuaac

SEQ ID NO: 715824 - RNA, 22 nt, Human
acagugagauccaagggcaggc

SEQ ID NO: 715825 - RNA, 22 nt, Human
uacaagugugcaccaccauguc

SEQ ID NO: 715826 - RNA, 22 nt, Human
agcaggcacaagaaagggaggu

SEQ ID NO: 715827 - RNA, 22 nt, Human
cuucuuguuuuagcccucauac

SEQ ID NO: 715828 - RNA, 22 nt, Human
ccauucuuucagugucucaugu

SEQ ID NO: 715829 - RNA, 18 nt, Human
agcagagagugaauggga

SEQ ID NO: 715830 - RNA, 22 nt, Human
gagucugaugucccccaggcca

SEQ ID NO: 715831 - RNA, 22 nt, Human
ggagccugugggaugagaugug

SEQ ID NO: 715832 - RNA, 22 nt, Human
acaguggauauauuaaaugaga

SEQ ID NO: 715833 - RNA, 22 nt, Human
ggcgcuggccacgguggcucug

SEQ ID NO: 715834 - RNA, 22 nt, Human
accaggcccaccgcaugcuccu

SEQ ID NO: 715835 - RNA, 23 nt, Human
ucuggcuuccaguggguucaacc

SEQ ID NO: 715836 - RNA, 18 nt, Human
auacagagaccucaagga

SEQ ID NO: 715837 - RNA, 22 nt, Human
acucuguacuuucuuguugugu

SEQ ID NO: 715838 - RNA, 22 nt, Human
ugaacauuccugaaugaagcau

SEQ ID NO: 715839 - RNA, 22 nt, Human
uguuaucagagagaggugcugu

SEQ ID NO: 715840 - RNA, 18 nt, Human
gccagagggcccaagguc

SEQ ID NO: 715841 - RNA, 20 nt, Human
aucugcuugccuguccucgg

SEQ ID NO: 715842 - RNA, 22 nt, Human
cucauggauauaagaacuguuu

SEQ ID NO: 715843 - RNA, 22 nt, Human
agccuccaguagcugaagagac

SEQ ID NO: 715844 - RNA, 22 nt, Human
uuccagagguucucagcccugu

SEQ ID NO: 715845 - RNA, 22 nt, Human
cuaguucugccauucaguguca

SEQ ID NO: 715846 - RNA, 22 nt, Human
gaucugggcuggagacugagaa

SEQ ID NO: 715847 - RNA, 22 nt, Human
uuacacuucuaaaaaaagcagg

SEQ ID NO: 715848 - RNA, 22 nt, Human
gcacagagcuggcccuccaggc

SEQ ID NO: 715849 - RNA, 19 nt, Human
uuuaugucauugaggucau

SEQ ID NO: 715850 - RNA, 22 nt, Human
uucacuguacugacugucuuau

SEQ ID NO: 715851 - RNA, 22 nt, Human
gcuucugggcaccugaacagga

SEQ ID NO: 715852 - RNA, 22 nt, Human
cagggcacagaucggggcgcac

SEQ ID NO: 715853 - RNA, 22 nt, Human
uuugggcugguuugccaugccc

SEQ ID NO: 715854 - RNA, 22 nt, Human
cucauaaugugacuguauuuga

SEQ ID NO: 715855 - RNA, 20 nt, Human
uuugacaccuugggagagac

SEQ ID NO: 715856 - RNA, 22 nt, Human
gcaguguugagccagcuggggg

SEQ ID NO: 715857 - RNA, 22 nt, Human
gcccacaggggaccugguggcu

SEQ ID NO: 715858 - RNA, 22 nt, Human
ucucucuucagagauaccuugc

SEQ ID NO: 715859 - RNA, 21 nt, Human
guucuugcaggauuuccuucc

SEQ ID NO: 715860 - RNA, 17 nt, Human
uaaagaucagccaugua

SEQ ID NO: 715861 - RNA, 22 nt, Human
ugaaggaaugaguauacuguuu

SEQ ID NO: 715862 - RNA, 22 nt, Human
ucacauuguucuuaguuuaccu

SEQ ID NO: 715863 - RNA, 22 nt, Human
guguggcugccagccaagaggc

SEQ ID NO: 715864 - RNA, 22 nt, Human
ucucugggccucaguuuucuca

SEQ ID NO: 715865 - RNA, 21 nt, Human
ucugcccuccaggagcucaua

SEQ ID NO: 715866 - RNA, 22 nt, Human
ccuuucuacagaugccucuugc

SEQ ID NO: 715867 - RNA, 22 nt, Human
uuuagaggggaaaguggcuggu

SEQ ID NO: 715868 - RNA, 22 nt, Human
cugcucucuguuccccuggauc

SEQ ID NO: 715869 - RNA, 22 nt, Human
acccuccacuuuaucugucuuu

SEQ ID NO: 715870 - RNA, 22 nt, Human
aaaggcucuaacaaggagagag

SEQ ID NO: 715871 - RNA, 21 nt, Human
cucaaaugccaguuuuauuua

SEQ ID NO: 715872 - RNA, 22 nt, Human
cauuuguauguuccuccuuagg

SEQ ID NO: 715873 - RNA, 22 nt, Human
ucuuaaagccaagcauaaacca

SEQ ID NO: 715874 - RNA, 22 nt, Human
auagcuguuagauuggggucga

SEQ ID NO: 715875 - RNA, 22 nt, Human
uggcugccagcuccucgccuug

SEQ ID NO: 715876 - RNA, 22 nt, Human
ucagggagggaccugaggcugg

SEQ ID NO: 715877 - RNA, 22 nt, Human
cuggcacauuguaauauauaca

SEQ ID NO: 715878 - RNA, 22 nt, Human
cacuuaagcaguuaauuuaucu

SEQ ID NO: 715879 - RNA, 22 nt, Human
acagcaggagccuucauaugcu

SEQ ID NO: 715880 - RNA, 22 nt, Human
gauauuuuuaguauuucugccu

SEQ ID NO: 715881 - RNA, 17 nt, Human
cccugccaccaggaagc

SEQ ID NO: 715882 - RNA, 22 nt, Human
uguacacguggccaucuuuaca

SEQ ID NO: 715883 - RNA, 22 nt, Human
caaauuccucagaaucagaaaa

SEQ ID NO: 715884 - RNA, 22 nt, Human
ggugcccagcaagcuuucaaug

SEQ ID NO: 715885 - RNA, 22 nt, Human
aaacuuuuccugcucuuguccu

SEQ ID NO: 715886 - RNA, 22 nt, Human
gccuggcugagguggggaggca

SEQ ID NO: 715887 - RNA, 22 nt, Human
cuuaaagucuauccuuucuaga

SEQ ID NO: 715888 - RNA, 23 nt, Human
ucuccuggcugcacuguggccac

SEQ ID NO: 715889 - RNA, 22 nt, Human
cugauucccuggugccuccguu

SEQ ID NO: 715890 - RNA, 22 nt, Human
gcacugaaugccaaaguguagg

SEQ ID NO: 715891 - RNA, 22 nt, Human
ucaaauacauggucaaucaacu

SEQ ID NO: 715892 - RNA, 22 nt, Human
cagcccaggcucagauguuggg

SEQ ID NO: 715893 - RNA, 22 nt, Human
uucuccagacccuccugcagac

SEQ ID NO: 715894 - RNA, 22 nt, Human
auuacucugucugccucugacc

SEQ ID NO: 715895 - RNA, 22 nt, Human
aucugcuuccuccuuagggaaa

SEQ ID NO: 715896 - RNA, 22 nt, Human
cuuaaaaucuggcaguuagcua

SEQ ID NO: 715897 - RNA, 22 nt, Human
acucucuugggggagagcagag

SEQ ID NO: 715898 - RNA, 22 nt, Human
augcuauaaacucuaggucauu

SEQ ID NO: 715899 - RNA, 22 nt, Human
caccugccaaauggggaugcug

SEQ ID NO: 715900 - RNA, 22 nt, Human
ugugagaguauaaucucucugu

SEQ ID NO: 715901 - RNA, 19 nt, Human
gcacacaguagggcuggca

SEQ ID NO: 715902 - RNA, 22 nt, Human
uucagcaaggcaugugcaggag

SEQ ID NO: 715903 - RNA, 22 nt, Human
gauaauguggauuuauugugau

SEQ ID NO: 715904 - RNA, 22 nt, Human
cagcagcugguugaauccuucu

SEQ ID NO: 715905 - RNA, 22 nt, Human
guacaguaaauguaaauggauu

SEQ ID NO: 715906 - RNA, 22 nt, Human
aaaugagguuaauacagugcuu

SEQ ID NO: 715907 - RNA, 22 nt, Human
uccauauuaacuaaaacuagaa

SEQ ID NO: 715908 - RNA, 22 nt, Human
uaaauguguguagccaucugug

SEQ ID NO: 715909 - RNA, 22 nt, Human
aggcaggugggucacuugaguc

SEQ ID NO: 715910 - RNA, 22 nt, Human
gcaggcaggcuuccuugaacug

SEQ ID NO: 715911 - RNA, 22 nt, Human
uaaggcagccucaggguagggu

SEQ ID NO: 715912 - RNA, 22 nt, Human
uccuggagcugacuccguuuga

SEQ ID NO: 715913 - RNA, 22 nt, Human
uauuuauaccaggugaucggag

SEQ ID NO: 715914 - RNA, 22 nt, Human
gcucaggaaauaguuuaguguu

SEQ ID NO: 715915 - RNA, 22 nt, Human
gccuggagugcaguggcgugau

SEQ ID NO: 715916 - RNA, 22 nt, Human
augcaaaucuuaaguaugugug

SEQ ID NO: 715917 - RNA, 22 nt, Human
gagaagcaauuuccaacugugc

SEQ ID NO: 715918 - RNA, 22 nt, Human
uggccacccagcugacgccuuc

SEQ ID NO: 715919 - RNA, 22 nt, Human
agagaccuuccugacuccagag

SEQ ID NO: 715920 - RNA, 22 nt, Human
cagcccugccauggagccuccu

SEQ ID NO: 715921 - RNA, 22 nt, Human
cagucuaccuuucagacauuga

SEQ ID NO: 715922 - RNA, 22 nt, Human
ucagcagacuaggcagauuacu

SEQ ID NO: 715923 - RNA, 22 nt, Human
gauuuauaaagguugcacugga

SEQ ID NO: 715924 - RNA, 22 nt, Human
gagucacauuaauuuaauuuua

SEQ ID NO: 715925 - RNA, 22 nt, Human
ugcccagcaauaaaccagaaga

SEQ ID NO: 715926 - RNA, 21 nt, Human
ccaggcaugacugcagagagc

SEQ ID NO: 715927 - RNA, 19 nt, Human
gaaagucauagagcuuguc

SEQ ID NO: 715928 - RNA, 22 nt, Human
uucuagaugcuuauaggcauau

SEQ ID NO: 715929 - RNA, 23 nt, Human
aagcacagaaugguuuaggaguu

SEQ ID NO: 715930 - RNA, 22 nt, Human
ugcuucuggcuuaucucgugcc

SEQ ID NO: 715931 - RNA, 22 nt, Human
acuuuacaaacuccucacuguu

SEQ ID NO: 715932 - RNA, 22 nt, Human
acuguggcaaagaagcaggcuc

SEQ ID NO: 715933 - RNA, 22 nt, Human
ucucugugugggagaucuuuuu

SEQ ID NO: 715934 - RNA, 22 nt, Human
gggaagaguaacuagcccaugu

SEQ ID NO: 715935 - RNA, 22 nt, Human
ccucacugaagaggugacauuu

SEQ ID NO: 715936 - RNA, 22 nt, Human
gcauuuaaauuugaacuucaga

SEQ ID NO: 715937 - RNA, 22 nt, Human
agucagugaaggcauugcucaa

SEQ ID NO: 715938 - RNA, 22 nt, Human
uggaaacacccacgcaugcaua

SEQ ID NO: 715939 - RNA, 22 nt, Human
uggcaugaguauaggcuucuca

SEQ ID NO: 715940 - RNA, 22 nt, Human
cucugggagaggacacuuggag

SEQ ID NO: 715941 - RNA, 22 nt, Human
ugcccacaggaagacaccagcg

SEQ ID NO: 715942 - RNA, 22 nt, Human
ucaaaugcugccuuugugugcc

SEQ ID NO: 715943 - RNA, 22 nt, Human
ugaggaagugguuguaugguuu

SEQ ID NO: 715944 - RNA, 22 nt, Human
gcucucucuuggggauucagca

SEQ ID NO: 715945 - RNA, 22 nt, Human
uccaggccacugcagaggcucu

SEQ ID NO: 715946 - RNA, 22 nt, Human
ucugauauaaaagugacauuca

SEQ ID NO: 715947 - RNA, 22 nt, Human
uacaggaaagaaauuugaacuc

SEQ ID NO: 715948 - RNA, 22 nt, Human
auaaaaucagaguuggauugga

SEQ ID NO: 715949 - RNA, 22 nt, Human
gcucucuuugugccacuuaagg

SEQ ID NO: 715950 - RNA, 22 nt, Human
ggaaaucaugggagaguuggaa

SEQ ID NO: 715951 - RNA, 22 nt, Human
acaggcaaggccagugagaaau

SEQ ID NO: 715952 - RNA, 22 nt, Human
augacaaaaugaaugcagcuag

SEQ ID NO: 715953 - RNA, 22 nt, Human
uacaguauauacuguguguaga

SEQ ID NO: 715954 - RNA, 19 nt, Human
uucuccagggacuuaggga

SEQ ID NO: 715955 - RNA, 22 nt, Human
cagcagagguuggaacaguucu

SEQ ID NO: 715956 - RNA, 22 nt, Human
gagaggugaaaggauaguuuga

SEQ ID NO: 715957 - RNA, 22 nt, Human
gccuggggaacuugauccuguc

SEQ ID NO: 715958 - RNA, 22 nt, Human
uccagacucacucaugugacua

SEQ ID NO: 715959 - RNA, 22 nt, Human
cccaaagggugucagcagcaag

SEQ ID NO: 715960 - RNA, 22 nt, Human
cccaggaggccaagguugcagu

SEQ ID NO: 715961 - RNA, 22 nt, Human
cuggacagaaaaggccacugga

SEQ ID NO: 715962 - RNA, 22 nt, Human
cuguaacuuagcaugguuacua

SEQ ID NO: 715963 - RNA, 20 nt, Human
agccaaaggagaacagugcu

SEQ ID NO: 715964 - RNA, 22 nt, Human
gcugcccugacaagcuacuccc

SEQ ID NO: 715965 - RNA, 22 nt, Human
uggcucugccccauaccccugc

SEQ ID NO: 715966 - RNA, 22 nt, Human
caggacccaucagccaggcacu

SEQ ID NO: 715967 - RNA, 22 nt, Human
guaaaggcucugauaaguacug

SEQ ID NO: 715968 - RNA, 22 nt, Human
augcaccacaucacuucugcuc

SEQ ID NO: 715969 - RNA, 22 nt, Human
auugagaaaauucgagcaaguu

SEQ ID NO: 715970 - RNA, 22 nt, Human
cacuacuugaaagaauuacaga

SEQ ID NO: 715971 - RNA, 18 nt, Human
uuugcaaaggaaguaugg

SEQ ID NO: 715972 - RNA, 22 nt, Human
acuaaagucagacugcauugau

SEQ ID NO: 715973 - RNA, 22 nt, Human
agaaaugacaagacugaucagg

SEQ ID NO: 715974 - RNA, 22 nt, Human
uucucugaucuugcuagacuga

SEQ ID NO: 715975 - RNA, 22 nt, Human
agcagcaccuguccucgcugcu

SEQ ID NO: 715976 - RNA, 20 nt, Human
auuuggcaugaaguauugau

SEQ ID NO: 715977 - RNA, 22 nt, Human
agccugucugucuccaaagcug

SEQ ID NO: 715978 - RNA, 22 nt, Human
agcagcaacuuauuuuucuuau

SEQ ID NO: 715979 - RNA, 22 nt, Human
uaugucuuaauccuuccuuagg

SEQ ID NO: 715980 - RNA, 22 nt, Human
ugacagaaauaguucuuaauuu

SEQ ID NO: 715981 - RNA, 17 nt, Human
ccucuuccucucagcug

SEQ ID NO: 715982 - RNA, 22 nt, Human
aggcuucaagguucuuggcagg

SEQ ID NO: 715983 - RNA, 22 nt, Human
uguuacaauauuaucaacugag

SEQ ID NO: 715984 - RNA, 22 nt, Human
gauuuucugagccuucaaauuu

SEQ ID NO: 715985 - RNA, 18 nt, Human
agcuguuguugacucugu

SEQ ID NO: 715986 - RNA, 22 nt, Human
cuuuaucuaggguaagaaaacc

SEQ ID NO: 715987 - RNA, 22 nt, Human
gagacagagaucuugcugaguc

SEQ ID NO: 715988 - RNA, 22 nt, Human
ugucagcauugaugaaaugugg

SEQ ID NO: 715989 - RNA, 22 nt, Human
caggggaguuuuaugcaacaga

SEQ ID NO: 715990 - RNA, 22 nt, Human
uucaaaucagaccgaaggcaac

SEQ ID NO: 715991 - RNA, 23 nt, Human
cuuuuaacuagaguaucagcugc

SEQ ID NO: 715992 - RNA, 22 nt, Human
ggccagguaagagugcagccgc

SEQ ID NO: 715993 - RNA, 22 nt, Human
acugcacacacagaauuuaggg

SEQ ID NO: 715994 - RNA, 22 nt, Human
gcaaauauucaagacuuuucca

SEQ ID NO: 715995 - RNA, 22 nt, Human
ucugagguuuucauguuuucug

SEQ ID NO: 715996 - RNA, 22 nt, Human
ugggcugagcagugaagcucau

SEQ ID NO: 715997 - RNA, 22 nt, Human
agcuggaacccgggugggcagc

SEQ ID NO: 715998 - RNA, 22 nt, Human
ggaggcucagugaggaaaugga

SEQ ID NO: 715999 - RNA, 22 nt, Human
ccuuuucuguguggguaauuua

SEQ ID NO: 716000 - RNA, 19 nt, Human
ucucuggcaguucagagca

SEQ ID NO: 716001 - RNA, 20 nt, Human
gggcagcuccccucauucug

SEQ ID NO: 716002 - RNA, 22 nt, Human
agggcucagagcaaaagggcac

SEQ ID NO: 716003 - RNA, 22 nt, Human
ugcguaguacgaauuugugccu

SEQ ID NO: 716004 - RNA, 22 nt, Human
augaaggcuguguagauggaug

SEQ ID NO: 716005 - RNA, 22 nt, Human
uucacaguauagguuuccagcg

SEQ ID NO: 716006 - RNA, 22 nt, Human
agacaggccacucuggucuggu

SEQ ID NO: 716007 - RNA, 22 nt, Human
gggaggcgccgaggguagcuaa

SEQ ID NO: 716008 - RNA, 22 nt, Human
ggcccucccugagccagguggg

SEQ ID NO: 716009 - RNA, 22 nt, Human
agauggguaacuggagucugcu

SEQ ID NO: 716010 - RNA, 22 nt, Human
gcugggucuggcugugagccgg

SEQ ID NO: 716011 - RNA, 22 nt, Human
acucagcacagcacugggaacc

SEQ ID NO: 716012 - RNA, 22 nt, Human
ugccagggacccugucggcccu

SEQ ID NO: 716013 - RNA, 22 nt, Human
gcuggcaguuuccucaccgagg

SEQ ID NO: 716014 - RNA, 22 nt, Human
agggcugcaggcaagauauggc

SEQ ID NO: 716015 - RNA, 23 nt, Human
aacgacagcuacaggcaucccac

SEQ ID NO: 716016 - RNA, 22 nt, Human
uaggaaauuggaaacucuucac

SEQ ID NO: 716017 - RNA, 22 nt, Human
cagggagcucugggccggacuc

SEQ ID NO: 716018 - RNA, 18 nt, Human
uuuuccuuccaccuugaa

SEQ ID NO: 716019 - RNA, 22 nt, Human
guuauaaaugacugcaaaaguu

SEQ ID NO: 716020 - RNA, 22 nt, Human
cuuuuaagggauaauaagaugu

SEQ ID NO: 716021 - RNA, 23 nt, Human
auugugagauuacuaucacacug

SEQ ID NO: 716022 - RNA, 22 nt, Human
agagagccugaguggcagcuau

SEQ ID NO: 716023 - RNA, 22 nt, Human
ucaagagaagugcuccacagua

SEQ ID NO: 716024 - RNA, 22 nt, Human
aaugccuugccugcuacaacuu

SEQ ID NO: 716025 - RNA, 22 nt, Human
aaugggagguaguaugggaggu

SEQ ID NO: 716026 - RNA, 21 nt, Human
uauuugcugccaucuuugagg

SEQ ID NO: 716027 - RNA, 22 nt, Human
ucugcugccaugcagagcagua

SEQ ID NO: 716028 - RNA, 22 nt, Human
aucaaguuuucuuaguugacug

SEQ ID NO: 716029 - RNA, 22 nt, Human
acagaugaguuaaagcagagug

SEQ ID NO: 716030 - RNA, 17 nt, Human
agaaaagagaccagcag

SEQ ID NO: 716031 - RNA, 22 nt, Human
cagcagagaccaagugauuuga

SEQ ID NO: 716032 - RNA, 22 nt, Human
uggcagagugcggcauccccug

SEQ ID NO: 716033 - RNA, 22 nt, Human
cccuggaggcaaagguugcagu

SEQ ID NO: 716034 - RNA, 15 nt, Human
ggaacauuucuguuu

SEQ ID NO: 716035 - RNA, 22 nt, Human
guuauuuuaucucugagagguu

SEQ ID NO: 716036 - RNA, 22 nt, Human
uucuggaaauguugcugaggcc

SEQ ID NO: 716037 - RNA, 22 nt, Human
gaauaauuuugaucagaaggga

SEQ ID NO: 716038 - RNA, 22 nt, Human
gagugccaagagaagaggcugg

SEQ ID NO: 716039 - RNA, 22 nt, Human
aagaacaugaacacaauguuua

SEQ ID NO: 716040 - RNA, 20 nt, Human
gggaugagaguccuagcucu

SEQ ID NO: 716041 - RNA, 22 nt, Human
agauauucugccuaacagguuu

SEQ ID NO: 716042 - RNA, 21 nt, Human
ucuauaacuauagugacagau

SEQ ID NO: 716043 - RNA, 22 nt, Human
cacagcagaaauaugaaggcag

SEQ ID NO: 716044 - RNA, 22 nt, Human
aaaaguuauugaugcaggacaa

SEQ ID NO: 716045 - RNA, 22 nt, Human
cucugugccucaguuuucuucu

SEQ ID NO: 716046 - RNA, 22 nt, Human
uccauuuucaucucauguauaa

SEQ ID NO: 716047 - RNA, 22 nt, Human
uggcucugaccagguagaggag

SEQ ID NO: 716048 - RNA, 22 nt, Human
cccugaggcccuccuggggucu

SEQ ID NO: 716049 - RNA, 18 nt, Human
gugcugugggcaguggcc

SEQ ID NO: 716050 - RNA, 22 nt, Human
gacagcugggaggaugacauaa

SEQ ID NO: 716051 - RNA, 22 nt, Human
aaaggagauaaagggcccuuca

SEQ ID NO: 716052 - RNA, 22 nt, Human
auggaaaaggcugauuucauua

SEQ ID NO: 716053 - RNA, 22 nt, Human
gcacagccuugcccugugcccu

SEQ ID NO: 716054 - RNA, 22 nt, Human
agcugucuccagauacaggauu

SEQ ID NO: 716055 - RNA, 18 nt, Human
uacaggaagggguucucg

SEQ ID NO: 716056 - RNA, 22 nt, Human
ggcccuguuagagcucccacaa

SEQ ID NO: 716057 - RNA, 22 nt, Human
ccugccuggcugucagcagagc

SEQ ID NO: 716058 - RNA, 22 nt, Human
uaggcagggauuaggguugauu

SEQ ID NO: 716059 - RNA, 22 nt, Human
gggaggaaggcuugggugagua

SEQ ID NO: 716060 - RNA, 22 nt, Human
uagguucacuuagcugugggaa

SEQ ID NO: 716061 - RNA, 22 nt, Human
gcaauacugagauuauuguacu

SEQ ID NO: 716062 - RNA, 22 nt, Human
ggagccuggcaaugcugcgucc

SEQ ID NO: 716063 - RNA, 22 nt, Human
acaaggcugcugugauugggaa

SEQ ID NO: 716064 - RNA, 22 nt, Human
aucuuccaggugccggggguca

SEQ ID NO: 716065 - RNA, 18 nt, Human
aggagaaagggaccaggg

SEQ ID NO: 716066 - RNA, 22 nt, Human
ucaucugucccaggcuuuuuuc

SEQ ID NO: 716067 - RNA, 22 nt, Human
cuuuuucugauguuccaugauu

SEQ ID NO: 716068 - RNA, 22 nt, Human
aaagaauuuguacacccuacua

SEQ ID NO: 716069 - RNA, 22 nt, Human
caguggcauacuuggcugauau

SEQ ID NO: 716070 - RNA, 22 nt, Human
gagggcagaaaauuaugcggug

SEQ ID NO: 716071 - RNA, 20 nt, Human
cucugggcugcguugcaaac

SEQ ID NO: 716072 - RNA, 22 nt, Human
aaaggaagaugccaggacucug

SEQ ID NO: 716073 - RNA, 22 nt, Human
agcuggucagaguggggauaga

SEQ ID NO: 716074 - RNA, 18 nt, Human
acauuuaggagagucaau

SEQ ID NO: 716075 - RNA, 18 nt, Human
gagaaggccacuuguuuu

SEQ ID NO: 716076 - RNA, 22 nt, Human
aguacacaagacacauuuaaaa

SEQ ID NO: 716077 - RNA, 22 nt, Human
ugcuuacaacuuuauugaggaa

SEQ ID NO: 716078 - RNA, 22 nt, Human
cuggccaggcucucacgugguc

SEQ ID NO: 716079 - RNA, 22 nt, Human
uuugucauguuuuguaaugucu

SEQ ID NO: 716080 - RNA, 22 nt, Human
aaugaguucugguucauuuuau

SEQ ID NO: 716081 - RNA, 22 nt, Human
ucagauuucuagcguuuggcca

SEQ ID NO: 716082 - RNA, 16 nt, Human
cagcccugaggaagaa

SEQ ID NO: 716083 - RNA, 22 nt, Human
aguguuuaaguuacacacauau

SEQ ID NO: 716084 - RNA, 22 nt, Human
caggcuugagggcaggcccagu

SEQ ID NO: 716085 - RNA, 22 nt, Human
gauuucagccccgcucccagcu

SEQ ID NO: 716086 - RNA, 22 nt, Human
aaaugucugucucaugaggaaa

SEQ ID NO: 716087 - RNA, 23 nt, Human
uaugagaacccauacgcugucuu

SEQ ID NO: 716088 - RNA, 22 nt, Human
auuagaaaauacaugggcuguc

SEQ ID NO: 716089 - RNA, 22 nt, Human
guuucaauuugaaugcgaggcu

SEQ ID NO: 716090 - RNA, 22 nt, Human
agcugccuaguagauugauugg

SEQ ID NO: 716091 - RNA, 22 nt, Human
ucucagccucaccucuauggag

SEQ ID NO: 716092 - RNA, 22 nt, Human
caugaacagcuaacauuuuggg

SEQ ID NO: 716093 - RNA, 22 nt, Human
uggagcccaggagaggauaaac

SEQ ID NO: 716094 - RNA, 22 nt, Human
uccagggcaggugcugggcucu

SEQ ID NO: 716095 - RNA, 22 nt, Human
uuaggaaaauggaguccuuuua

SEQ ID NO: 716096 - RNA, 22 nt, Human
ggccucuguuuggagccaggau

SEQ ID NO: 716097 - RNA, 22 nt, Human
cagagacaggaucucgaagacu

SEQ ID NO: 716098 - RNA, 22 nt, Human
ucucuggaagcgcagaucuguu

SEQ ID NO: 716099 - RNA, 22 nt, Human
acacaucuauauugcaucugca

SEQ ID NO: 716100 - RNA, 22 nt, Human
aagcccaguuucacacugagac

SEQ ID NO: 716101 - RNA, 22 nt, Human
gagcuuuaggagaaggagguca

SEQ ID NO: 716102 - RNA, 22 nt, Human
uuuggcuugcacuggcaccaac

SEQ ID NO: 716103 - RNA, 22 nt, Human
ugcugcaggcaauagaaaaccu

SEQ ID NO: 716104 - RNA, 22 nt, Human
caagggaccugagauggucucu

SEQ ID NO: 716105 - RNA, 22 nt, Human
aagauuuucagcuaauggugca

SEQ ID NO: 716106 - RNA, 22 nt, Human
cccccuggcaggcuggccucuc

SEQ ID NO: 716107 - RNA, 23 nt, Human
cuguggcaaguccugcaccugcc

SEQ ID NO: 716108 - RNA, 22 nt, Human
agcauccacucacugggagagg

SEQ ID NO: 716109 - RNA, 22 nt, Human
agugucugcuuugagucaggug

SEQ ID NO: 716110 - RNA, 16 nt, Human
aggcuccaagagcugu

SEQ ID NO: 716111 - RNA, 22 nt, Human
gaauuguaugcugucuugauag

SEQ ID NO: 716112 - RNA, 22 nt, Human
aagcuuuucucaguguccuugg

SEQ ID NO: 716113 - RNA, 22 nt, Human
uggaaucaguuacaugugguug

SEQ ID NO: 716114 - RNA, 22 nt, Human
gaggugggguuuuguucuugaa

SEQ ID NO: 716115 - RNA, 22 nt, Human
gugagccauucuacuccuaacc

SEQ ID NO: 716116 - RNA, 22 nt, Human
uucacauaaugauacaaagcuu

SEQ ID NO: 716117 - RNA, 22 nt, Human
ccucugaggugagcccagcugg

SEQ ID NO: 716118 - RNA, 22 nt, Human
gagcacaguaaagcagugucac

SEQ ID NO: 716119 - RNA, 22 nt, Human
acagaaugcguagugcauguug

SEQ ID NO: 716120 - RNA, 22 nt, Human
agagaaggaaagcugacauggg

SEQ ID NO: 716121 - RNA, 22 nt, Human
ucagauuucuucuugcaacggc

SEQ ID NO: 716122 - RNA, 22 nt, Human
cauuucuagacaaguccuggag

SEQ ID NO: 716123 - RNA, 21 nt, Human
gggaucugaggcaagucuccu

SEQ ID NO: 716124 - RNA, 22 nt, Human
agaagugguguguggccgagcu

SEQ ID NO: 716125 - RNA, 22 nt, Human
ccuggccaguuuccaggcccug

SEQ ID NO: 716126 - RNA, 22 nt, Human
agugggugauaagaccaaggag

SEQ ID NO: 716127 - RNA, 23 nt, Human
ucucaagaggaagcagggcucau

SEQ ID NO: 716128 - RNA, 22 nt, Human
agccaggguaagguacuuagua

SEQ ID NO: 716129 - RNA, 22 nt, Human
cuacagaagccguggucaggaa

SEQ ID NO: 716130 - RNA, 22 nt, Human
cuuccaauagcaacaaagauua

SEQ ID NO: 716131 - RNA, 21 nt, Human
uggcagguucaaaggccuauc

SEQ ID NO: 716132 - RNA, 17 nt, Human
cagcuuuaugcuacugu

SEQ ID NO: 716133 - RNA, 22 nt, Human
uccagggccaugaaguugcaca

SEQ ID NO: 716134 - RNA, 22 nt, Human
gauaccagacagggagggagaa

SEQ ID NO: 716135 - RNA, 22 nt, Human
ucacuuaaaaauucuaguuaug

SEQ ID NO: 716136 - RNA, 22 nt, Human
cccagggaagccauuucugacu

SEQ ID NO: 716137 - RNA, 20 nt, Human
agguccugggacuggcagag

SEQ ID NO: 716138 - RNA, 22 nt, Human
ggcagcugaccuagcaccaucc

SEQ ID NO: 716139 - RNA, 22 nt, Human
gggcacugagaauuuuccacuu

SEQ ID NO: 716140 - RNA, 22 nt, Human
ucagagaguuggaaagaauuaa

SEQ ID NO: 716141 - RNA, 22 nt, Human
ccaggaugacccccacuuuccu

SEQ ID NO: 716142 - RNA, 22 nt, Human
uacacugugagguuuccaaggg

SEQ ID NO: 716143 - RNA, 20 nt, Human
acucaaaucaccugccucaa

SEQ ID NO: 716144 - RNA, 22 nt, Human
aaucauaauuuugugaauguag

SEQ ID NO: 716145 - RNA, 20 nt, Human
uuuauucagccuacccucuu

SEQ ID NO: 716146 - RNA, 22 nt, Human
gccacugucauacccuggcaau

SEQ ID NO: 716147 - RNA, 22 nt, Human
uucuucuccuaaggagaguccu

SEQ ID NO: 716148 - RNA, 22 nt, Human
aggggaagauuauacuuuugaa

SEQ ID NO: 716149 - RNA, 22 nt, Human
gagacagaucucggcuccaugc

SEQ ID NO: 716150 - RNA, 22 nt, Human
uucccacacaauuaagucauuu

SEQ ID NO: 716151 - RNA, 21 nt, Human
ggugcucgcugaugaggagug

SEQ ID NO: 716152 - RNA, 18 nt, Human
uccaggucccaggggaag

SEQ ID NO: 716153 - RNA, 22 nt, Human
cucuuuacugcuacuacaaaga

SEQ ID NO: 716154 - RNA, 22 nt, Human
agccacagguguuggccagugu

SEQ ID NO: 716155 - RNA, 22 nt, Human
aucucuccuucagcugaggccc

SEQ ID NO: 716156 - RNA, 21 nt, Human
acagcagacaggcuuaggacc

SEQ ID NO: 716157 - RNA, 17 nt, Human
ccugagugggagaggaa

SEQ ID NO: 716158 - RNA, 22 nt, Human
ucucagaaauacuauguuguca

SEQ ID NO: 716159 - RNA, 22 nt, Human
ugaugaaaauguucagcaauua

SEQ ID NO: 716160 - RNA, 22 nt, Human
ucagccagaggcuucuugguuu

SEQ ID NO: 716161 - RNA, 22 nt, Human
uuuguucugaaaacucaagucc

SEQ ID NO: 716162 - RNA, 22 nt, Human
uccagggaucuuuagagucuuu

SEQ ID NO: 716163 - RNA, 22 nt, Human
uggugcaaaacuaauugcgguu

SEQ ID NO: 716164 - RNA, 22 nt, Human
aagagcugcacauauuuauauc

SEQ ID NO: 716165 - RNA, 22 nt, Human
ccugggacucggccaggacaga

SEQ ID NO: 716166 - RNA, 22 nt, Human
cugagguaugugggacuagccu

SEQ ID NO: 716167 - RNA, 22 nt, Human
cugcuagcccaggaugcaggga

SEQ ID NO: 716168 - RNA, 22 nt, Human
gcugucugcugggucgcucagg

SEQ ID NO: 716169 - RNA, 22 nt, Human
aguagcaauggcucugagcuau

SEQ ID NO: 716170 - RNA, 22 nt, Human
uaauuccuagaaauuauucuca

SEQ ID NO: 716171 - RNA, 22 nt, Human
ucuuccuggauggggguugaug

SEQ ID NO: 716172 - RNA, 22 nt, Human
auuucaaggcuauuaauauaaa

SEQ ID NO: 716173 - RNA, 22 nt, Human
accagggcugggauaggucagg

SEQ ID NO: 716174 - RNA, 22 nt, Human
uuugauucuaaguucugucaac

SEQ ID NO: 716175 - RNA, 22 nt, Human
agacauaggauuccacauagca

SEQ ID NO: 716176 - RNA, 22 nt, Human
aagaaggcuucagagcccagga

SEQ ID NO: 716177 - RNA, 22 nt, Human
aaaauggguuucuucaaccuca

SEQ ID NO: 716178 - RNA, 22 nt, Human
cugucccucaguucugggcaaa

SEQ ID NO: 716179 - RNA, 21 nt, Human
gccugagcaugucuucagguc

SEQ ID NO: 716180 - RNA, 22 nt, Human
ccacugccagcuuuguccuccc

SEQ ID NO: 716181 - RNA, 22 nt, Human
ugcuggcuacugauggcaggcc

SEQ ID NO: 716182 - RNA, 22 nt, Human
agccaggcgggucuuugcuccu

SEQ ID NO: 716183 - RNA, 22 nt, Human
auuucagggagucauuuacaca

SEQ ID NO: 716184 - RNA, 22 nt, Human
auucugcuaguuaauaucucuc

SEQ ID NO: 716185 - RNA, 21 nt, Human
ccuuuacaauuuugcauuccu

SEQ ID NO: 716186 - RNA, 22 nt, Human
gcugccaguaguuggagcucca

SEQ ID NO: 716187 - RNA, 22 nt, Human
cauuauggaagugaagagcucu

SEQ ID NO: 716188 - RNA, 22 nt, Human
aucauguugcucaaaauuaaac

SEQ ID NO: 716189 - RNA, 22 nt, Human
ggcuguggggaccaacaggacu

SEQ ID NO: 716190 - RNA, 22 nt, Human
guguguauuuaaaggauaguug

SEQ ID NO: 716191 - RNA, 22 nt, Human
cucugccaucucacuggguccu

SEQ ID NO: 716192 - RNA, 22 nt, Human
aguguucagugauugucaaccg

SEQ ID NO: 716193 - RNA, 22 nt, Human
uguggccugggagcugaggucu

SEQ ID NO: 716194 - RNA, 22 nt, Human
cugggcaguuuuacaucauugc

SEQ ID NO: 716195 - RNA, 21 nt, Human
ugcuggugagcucauguggcu

SEQ ID NO: 716196 - RNA, 22 nt, Human
aaaucaguuagugguaggauug

SEQ ID NO: 716197 - RNA, 22 nt, Human
ucagcacuauacauuuugaaua

SEQ ID NO: 716198 - RNA, 22 nt, Human
ucauccugcacuggcuccuccu

SEQ ID NO: 716199 - RNA, 22 nt, Human
cuuuccucuggcacugucuggu

SEQ ID NO: 716200 - RNA, 22 nt, Human
acagauaaggcaguuaagaguu

SEQ ID NO: 716201 - RNA, 20 nt, Human
uuugucuguuaaguguuucu

SEQ ID NO: 716202 - RNA, 17 nt, Human
auuucccagcagugcua

SEQ ID NO: 716203 - RNA, 22 nt, Human
ucgaaggaaccucaauuuucgu

SEQ ID NO: 716204 - RNA, 22 nt, Human
ugcagcugauuaaagggcagac

SEQ ID NO: 716205 - RNA, 22 nt, Human
auacuuucugaccaauuaauug

SEQ ID NO: 716206 - RNA, 22 nt, Human
cugugccaguguauuccuguga

SEQ ID NO: 716207 - RNA, 22 nt, Human
accuucaagaaacauuuccuug

SEQ ID NO: 716208 - RNA, 22 nt, Human
ggugagaggccugagagcugga

SEQ ID NO: 716209 - RNA, 22 nt, Human
cuggcucacuagcccugcccug

SEQ ID NO: 716210 - RNA, 22 nt, Human
cucagacccccagagcugcuaa

SEQ ID NO: 716211 - RNA, 22 nt, Human
uucuaacuggugcagugcugca

SEQ ID NO: 716212 - RNA, 22 nt, Human
gccaccuguuucagaugugguu

SEQ ID NO: 716213 - RNA, 19 nt, Human
guggcagcagauuuggugu

SEQ ID NO: 716214 - RNA, 22 nt, Human
gagcuggcaggaggcuccccga

SEQ ID NO: 716215 - RNA, 22 nt, Human
uuauuauugugguugcauuauc

SEQ ID NO: 716216 - RNA, 22 nt, Human
cugucauuucuuuagcaauggg

SEQ ID NO: 716217 - RNA, 22 nt, Human
uggcauguuugcuugugcauau

SEQ ID NO: 716218 - RNA, 22 nt, Human
auguuucaccaguuuuauaaga

SEQ ID NO: 716219 - RNA, 22 nt, Human
cugugucuguggaauagcgaau

SEQ ID NO: 716220 - RNA, 20 nt, Human
aaauuguguuugugagcucc

SEQ ID NO: 716221 - RNA, 22 nt, Human
acguuuucuagagaauaugcag

SEQ ID NO: 716222 - RNA, 22 nt, Human
ugaaaugagagcacagaauaaa

SEQ ID NO: 716223 - RNA, 22 nt, Human
cuauuuggccagaagaggguca

SEQ ID NO: 716224 - RNA, 22 nt, Human
ucagcaggcaccggaaguguuu

SEQ ID NO: 716225 - RNA, 22 nt, Human
cacugggaccuaggacugagcu

SEQ ID NO: 716226 - RNA, 22 nt, Human
gaccagucauuacucaugcccu

SEQ ID NO: 716227 - RNA, 22 nt, Human
uaccuugggcuauuaucuuuga

SEQ ID NO: 716228 - RNA, 22 nt, Human
ccacagggcacagacaggaagc

SEQ ID NO: 716229 - RNA, 22 nt, Human
acucacagucccuguaggagug

SEQ ID NO: 716230 - RNA, 22 nt, Human
uucagcagagaaauuacauaau

SEQ ID NO: 716231 - RNA, 22 nt, Human
gaggggaaaguucugcacaagg

SEQ ID NO: 716232 - RNA, 22 nt, Human
agugggcaaaacagcucagagc

SEQ ID NO: 716233 - RNA, 21 nt, Human
agauuguauggaggugagagg

SEQ ID NO: 716234 - RNA, 22 nt, Human
accuggcugagaacgugcagcu

SEQ ID NO: 716235 - RNA, 22 nt, Human
gccacauuagcccucaccaucu

SEQ ID NO: 716236 - RNA, 22 nt, Human
uuaguacaagagauuaauuacu

SEQ ID NO: 716237 - RNA, 22 nt, Human
aacugaacauaaugaaagccaa

SEQ ID NO: 716238 - RNA, 22 nt, Human
aaacagcuuguaagguguaauu

SEQ ID NO: 716239 - RNA, 22 nt, Human
cuguacaggagacgucugugca

SEQ ID NO: 716240 - RNA, 22 nt, Human
gaaauaaccucaugcaccauga

SEQ ID NO: 716241 - RNA, 22 nt, Human
gagggaaacagauggguugugg

SEQ ID NO: 716242 - RNA, 22 nt, Human
gaaugaaaaccuuggcucaaau

SEQ ID NO: 716243 - RNA, 22 nt, Human
gcugagugaaaguuugcugugu

SEQ ID NO: 716244 - RNA, 22 nt, Human
agucagaguuuugaggugugac

SEQ ID NO: 716245 - RNA, 20 nt, Human
ugcagcuucucaucuucaaa

SEQ ID NO: 716246 - RNA, 23 nt, Human
ugugucauaaaauuaaaacuuca

SEQ ID NO: 716247 - RNA, 22 nt, Human
caagucaacucaaauuguuauc

SEQ ID NO: 716248 - RNA, 22 nt, Human
uccuagaacagcccaccuggaa

SEQ ID NO: 716249 - RNA, 22 nt, Human
auucucaaaacauaacuucacu

SEQ ID NO: 716250 - RNA, 22 nt, Human
caacuuuaauuugggugucaga

SEQ ID NO: 716251 - RNA, 22 nt, Human
cacaguaucuuuugaguaagca

SEQ ID NO: 716252 - RNA, 22 nt, Human
agaguuuguugaauuuacuugg

SEQ ID NO: 716253 - RNA, 22 nt, Human
auugucuuacauacuguggagg

SEQ ID NO: 716254 - RNA, 22 nt, Human
acagcagcgugaaguguguuau

SEQ ID NO: 716255 - RNA, 22 nt, Human
guuauucaacuugugucucuua

SEQ ID NO: 716256 - RNA, 20 nt, Human
gagauccucaucuguaaagu

SEQ ID NO: 716257 - RNA, 22 nt, Human
auuacaguggacagcuaugcac

SEQ ID NO: 716258 - RNA, 20 nt, Human
uuuauucacagagaagaguu

SEQ ID NO: 716259 - RNA, 22 nt, Human
cacaggaaugaacagggaaaga

SEQ ID NO: 716260 - RNA, 22 nt, Human
gcagguggaagcagcagacuca

SEQ ID NO: 716261 - RNA, 22 nt, Human
gagucaggaugcaaggggaugg

SEQ ID NO: 716262 - RNA, 23 nt, Human
ugauugaaaugaggaguauuugu

SEQ ID NO: 716263 - RNA, 22 nt, Human
acucagaaugucacugagggac

SEQ ID NO: 716264 - RNA, 22 nt, Human
acagggcucccagcaggucugu

SEQ ID NO: 716265 - RNA, 20 nt, Human
uguuugugccagcuuuguca

SEQ ID NO: 716266 - RNA, 22 nt, Human
ugggauagauugauggauagag

SEQ ID NO: 716267 - RNA, 22 nt, Human
cugggaugugaggagcgccucu

SEQ ID NO: 716268 - RNA, 19 nt, Human
auacaagacuagcauuuac

SEQ ID NO: 716269 - RNA, 22 nt, Human
uaggccacggaaagcagguugc

SEQ ID NO: 716270 - RNA, 22 nt, Human
auccaguaugagguagggcuug

SEQ ID NO: 716271 - RNA, 22 nt, Human
uuggcagggcaucagacacgug

SEQ ID NO: 716272 - RNA, 22 nt, Human
gacuggcucacuccacuccuau

SEQ ID NO: 716273 - RNA, 22 nt, Human
ucagaaauacuaucagcuuuug

SEQ ID NO: 716274 - RNA, 22 nt, Human
aggggcucaaagugugcaggga

SEQ ID NO: 716275 - RNA, 22 nt, Human
cuccucuggcuuccuggaggca

SEQ ID NO: 716276 - RNA, 22 nt, Human
gccugccccuuccugggcaggg

SEQ ID NO: 716277 - RNA, 22 nt, Human
ugugaauagauugaagcuuugg

SEQ ID NO: 716278 - RNA, 22 nt, Human
ccucaggcaagucacuuaacau

SEQ ID NO: 716279 - RNA, 22 nt, Human
gacagcugaacaggugggauaa

SEQ ID NO: 716280 - RNA, 22 nt, Human
ccucuauagaugugugcaucua

SEQ ID NO: 716281 - RNA, 22 nt, Human
agaaaucucaguaucucaggga

SEQ ID NO: 716282 - RNA, 22 nt, Human
aggucagacagggugucuuucu

SEQ ID NO: 716283 - RNA, 22 nt, Human
aaugagcuucuauaaucuuguc

SEQ ID NO: 716284 - RNA, 22 nt, Human
auguacauucuaaguaugugua

SEQ ID NO: 716285 - RNA, 22 nt, Human
gggguccuggaggccagcugga

SEQ ID NO: 716286 - RNA, 22 nt, Human
cuggccaauauagggaaaucuu

SEQ ID NO: 716287 - RNA, 22 nt, Human
caucucaugggcaugccaagcu

SEQ ID NO: 716288 - RNA, 22 nt, Human
acaucuuuuuggaaacggcuga

SEQ ID NO: 716289 - RNA, 22 nt, Human
ugcaugcauguuuuuacccaca

SEQ ID NO: 716290 - RNA, 22 nt, Human
auuucucauuaagaucuuccaa

SEQ ID NO: 716291 - RNA, 22 nt, Human
gcagggcuccacuguggccaag

SEQ ID NO: 716292 - RNA, 22 nt, Human
ugugugugcacgugcgcgcgag

SEQ ID NO: 716293 - RNA, 22 nt, Human
gaggcauuaaagggaaucuucu

SEQ ID NO: 716294 - RNA, 22 nt, Human
aauugcaacagguagacuuuuc

SEQ ID NO: 716295 - RNA, 22 nt, Human
cugcuccacaccguccauacuc

SEQ ID NO: 716296 - RNA, 22 nt, Human
uacauguaauuuucauaguaag

SEQ ID NO: 716297 - RNA, 19 nt, Human
uuugauaucugaauuaugc

SEQ ID NO: 716298 - RNA, 22 nt, Human
acaaacuaaaauucuuuauuga

SEQ ID NO: 716299 - RNA, 17 nt, Human
ugcaggcuccugucccu

SEQ ID NO: 716300 - RNA, 22 nt, Human
acugcauugagguuucauacuu

SEQ ID NO: 716301 - RNA, 21 nt, Human
uggaccaggaaggugguggug

SEQ ID NO: 716302 - RNA, 22 nt, Human
gagagacccagacaccaugcau

SEQ ID NO: 716303 - RNA, 22 nt, Human
uacagagaugugaaaagcucua

SEQ ID NO: 716304 - RNA, 22 nt, Human
uuugagcagagaaaggacauga

SEQ ID NO: 716305 - RNA, 22 nt, Human
uuccugaaaauacagggagaga

SEQ ID NO: 716306 - RNA, 22 nt, Human
uuucuucaauugcuaacaagga

SEQ ID NO: 716307 - RNA, 22 nt, Human
gugagcaguggccaggguccua

SEQ ID NO: 716308 - RNA, 22 nt, Human
uuucagaggaggaaggcaguua

SEQ ID NO: 716309 - RNA, 22 nt, Human
aggaacugggcucagcaaacau

SEQ ID NO: 716310 - RNA, 19 nt, Human
cucuggccucuggaugcug

SEQ ID NO: 716311 - RNA, 22 nt, Human
cagaggccuauccaguguccau

SEQ ID NO: 716312 - RNA, 17 nt, Human
ucugugauaguguagau

SEQ ID NO: 716313 - RNA, 23 nt, Human
ugaggaaguaauuguaaaggucu

SEQ ID NO: 716314 - RNA, 22 nt, Human
uuggaaggaauuaaggucauga

SEQ ID NO: 716315 - RNA, 22 nt, Human
uugcuuccucuaguuucuugaa

SEQ ID NO: 716316 - RNA, 20 nt, Human
ucucuggccagaaacaacag

SEQ ID NO: 716317 - RNA, 22 nt, Human
gagagcugcauucucagacaca

SEQ ID NO: 716318 - RNA, 22 nt, Human
ugacuauuuuuuauagauucca

SEQ ID NO: 716319 - RNA, 22 nt, Human
aauuucuaauugaaucucucuu

SEQ ID NO: 716320 - RNA, 22 nt, Human
auuggcacugcacaugauugcu

SEQ ID NO: 716321 - RNA, 23 nt, Human
aaguacauauauuuagauaguga

SEQ ID NO: 716322 - RNA, 22 nt, Human
auuccuuggcauucuggacuug

SEQ ID NO: 716323 - RNA, 22 nt, Human
guugaaauccuaacccccuagu

SEQ ID NO: 716324 - RNA, 22 nt, Human
cugcuccuggucauccuccacu

SEQ ID NO: 716325 - RNA, 22 nt, Human
uguaugcagggcuuguaugcag

SEQ ID NO: 716326 - RNA, 22 nt, Human
agguacauuugauaaaaauagc

SEQ ID NO: 716327 - RNA, 22 nt, Human
uagugcuuggcccuaccagaua

SEQ ID NO: 716328 - RNA, 22 nt, Human
caguaaauaguggagauguggg

SEQ ID NO: 716329 - RNA, 22 nt, Human
ucacauuugauaaugcccauug

SEQ ID NO: 716330 - RNA, 22 nt, Human
aggagcugggcugcugcuggga

SEQ ID NO: 716331 - RNA, 22 nt, Human
ugauuuuacuuagcaugauguu

SEQ ID NO: 716332 - RNA, 22 nt, Human
gagcugugaaaagugccugggg

SEQ ID NO: 716333 - RNA, 22 nt, Human
uuagggaaggcugcugucagcu

SEQ ID NO: 716334 - RNA, 22 nt, Human
gcccaggaugguguguaguggu

SEQ ID NO: 716335 - RNA, 17 nt, Human
aggcuccuccuaagguc

SEQ ID NO: 716336 - RNA, 22 nt, Human
ucuuuggcugccugaagcccaa

SEQ ID NO: 716337 - RNA, 22 nt, Human
ugcauaguucuccuuccuccuc

SEQ ID NO: 716338 - RNA, 22 nt, Human
acccucagaguaggcacugcug

SEQ ID NO: 716339 - RNA, 22 nt, Human
cauccauagccucaauaaauag

SEQ ID NO: 716340 - RNA, 22 nt, Human
uacuugcuuggauuucaccaga

SEQ ID NO: 716341 - RNA, 22 nt, Human
uaguuucuucaccuguaaaaug

SEQ ID NO: 716342 - RNA, 22 nt, Human
uucagugucacaagagcaagcc

SEQ ID NO: 716343 - RNA, 22 nt, Human
uuuaaauucugucugccgcuua

SEQ ID NO: 716344 - RNA, 22 nt, Human
uauucagugcgggaacucagcc

SEQ ID NO: 716345 - RNA, 22 nt, Human
cagcaaggccauuggaugcagu

SEQ ID NO: 716346 - RNA, 22 nt, Human
cagaggcuagacugugcuuccu

SEQ ID NO: 716347 - RNA, 22 nt, Human
ucuguggcaugguaucuggagg

SEQ ID NO: 716348 - RNA, 22 nt, Human
ccaguguucaucaagaaaaugu

SEQ ID NO: 716349 - RNA, 22 nt, Human
auaucacagcucuuucauugcu

SEQ ID NO: 716350 - RNA, 22 nt, Human
acaaggcugaacagugaagccg

SEQ ID NO: 716351 - RNA, 22 nt, Human
cugagcccuugcuuaugcuucc

SEQ ID NO: 716352 - RNA, 22 nt, Human
uuauuuccuagggaauuugccu

SEQ ID NO: 716353 - RNA, 22 nt, Human
uuuccuuccaaaugcccgggag

SEQ ID NO: 716354 - RNA, 22 nt, Human
auuacagugccaccucgugguc

SEQ ID NO: 716355 - RNA, 15 nt, Human
ugcagagguaccugg

SEQ ID NO: 716356 - RNA, 22 nt, Human
uaagaauuguguugaauagagu

SEQ ID NO: 716357 - RNA, 22 nt, Human
uaguaugggaagaacuuuguag

SEQ ID NO: 716358 - RNA, 22 nt, Human
auccacagaaggaacuugaaag

SEQ ID NO: 716359 - RNA, 22 nt, Human
agaucaaagccaugagagauuu

SEQ ID NO: 716360 - RNA, 22 nt, Human
uguuugcaacaacuagauggag

SEQ ID NO: 716361 - RNA, 22 nt, Human
agggaggaucugcuccuugucu

SEQ ID NO: 716362 - RNA, 22 nt, Human
ccagcugcagguguuccagaug

SEQ ID NO: 716363 - RNA, 22 nt, Human
cuugaugacucaggaggaggag

SEQ ID NO: 716364 - RNA, 22 nt, Human
ugauggaagagcuaacaauauc

SEQ ID NO: 716365 - RNA, 22 nt, Human
aggccucagcucagugugacag

SEQ ID NO: 716366 - RNA, 22 nt, Human
uuaacauuugugaagcauuuag

SEQ ID NO: 716367 - RNA, 22 nt, Human
uucagggagagcgggacgggug

SEQ ID NO: 716368 - RNA, 22 nt, Human
uaaaugcuaucgcauaaaaccu

SEQ ID NO: 716369 - RNA, 22 nt, Human
uuucuuguuucauggugucuca

SEQ ID NO: 716370 - RNA, 22 nt, Human
caaggcagcuauugucuccaua

SEQ ID NO: 716371 - RNA, 22 nt, Human
ucugcauuuuuaacaagauccc

SEQ ID NO: 716372 - RNA, 22 nt, Human
ggccugagcuugggcagcguau

SEQ ID NO: 716373 - RNA, 22 nt, Human
ugggaaggauacguuacaagau

SEQ ID NO: 716374 - RNA, 22 nt, Human
ucagguggcugguugcuggcua

SEQ ID NO: 716375 - RNA, 22 nt, Human
cccacaggcccugcugccuuga

SEQ ID NO: 716376 - RNA, 22 nt, Human
ucugggaagauguuucaaaggu

SEQ ID NO: 716377 - RNA, 22 nt, Human
aagcugccauagaacgagaggu

SEQ ID NO: 716378 - RNA, 22 nt, Human
agcaaagcuuccauaaagcagc

SEQ ID NO: 716379 - RNA, 17 nt, Human
ugagagcagggcugggc

SEQ ID NO: 716380 - RNA, 22 nt, Human
cagagguuaccuagagcaagaa

SEQ ID NO: 716381 - RNA, 22 nt, Human
gggcucugcgcucagcuccagc

SEQ ID NO: 716382 - RNA, 18 nt, Human
agcugguggggagacagc

SEQ ID NO: 716383 - RNA, 22 nt, Human
uguaagaaaaguaaauagugac

SEQ ID NO: 716384 - RNA, 22 nt, Human
cguguggucccggcaaggcaag

SEQ ID NO: 716385 - RNA, 22 nt, Human
cauuacuucucaugcuucaugc

SEQ ID NO: 716386 - RNA, 22 nt, Human
aucuaggauuugaaugcacagu

SEQ ID NO: 716387 - RNA, 22 nt, Human
gggcucuggauggagccugcag

SEQ ID NO: 716388 - RNA, 22 nt, Human
cauguguuaaucuuucugcaaa

SEQ ID NO: 716389 - RNA, 17 nt, Human
uuuucuccugcccauuc

SEQ ID NO: 716390 - RNA, 22 nt, Human
gcauuucugugcauacacauga

SEQ ID NO: 716391 - RNA, 22 nt, Human
gagcuccagcaucucugccaaa

SEQ ID NO: 716392 - RNA, 22 nt, Human
cacugcuuuuucuccucacugg

SEQ ID NO: 716393 - RNA, 22 nt, Human
uauaaagaauccagaagagaca

SEQ ID NO: 716394 - RNA, 22 nt, Human
aaacugauaaaauaaguacauu

SEQ ID NO: 716395 - RNA, 22 nt, Human
aagcauuuuaguaaugaacuug

SEQ ID NO: 716396 - RNA, 22 nt, Human
cacauucuugaguuacagucua

SEQ ID NO: 716397 - RNA, 22 nt, Human
uucuacaugguugcucagaggg

SEQ ID NO: 716398 - RNA, 22 nt, Human
cagagauggggccagcugcucc

SEQ ID NO: 716399 - RNA, 22 nt, Human
aauacagagaauguuauuugga

SEQ ID NO: 716400 - RNA, 22 nt, Human
cccaggaaaagcagugccagca

SEQ ID NO: 716401 - RNA, 22 nt, Human
gugcucuccuggcugcccugac

SEQ ID NO: 716402 - RNA, 22 nt, Human
accuccagcuuuuuagagacau

SEQ ID NO: 716403 - RNA, 22 nt, Human
auccuuccagaguuauucucaa

SEQ ID NO: 716404 - RNA, 22 nt, Human
cguggccacccaguggugcgug

SEQ ID NO: 716405 - RNA, 22 nt, Human
ggcagcaguuacaaaugugcag

SEQ ID NO: 716406 - RNA, 22 nt, Human
acagcaggcaugaagaaauguu

SEQ ID NO: 716407 - RNA, 22 nt, Human
aguacaguagggugcuguuagu

SEQ ID NO: 716408 - RNA, 22 nt, Human
uggcuucauucuguaguuaaaa

SEQ ID NO: 716409 - RNA, 20 nt, Human
agucacaguaucagucuuag

SEQ ID NO: 716410 - RNA, 22 nt, Human
uggccugaguugucugcaggcc

SEQ ID NO: 716411 - RNA, 22 nt, Human
agucaugacuccauuggucaag

SEQ ID NO: 716412 - RNA, 22 nt, Human
gggcgaggacugacucugggca

SEQ ID NO: 716413 - RNA, 22 nt, Human
uuucaagagcaggaaaaagguc

SEQ ID NO: 716414 - RNA, 22 nt, Human
gcacaggaggccgaugcucaug

SEQ ID NO: 716415 - RNA, 22 nt, Human
ucagaggagcugcagaacgcug

SEQ ID NO: 716416 - RNA, 22 nt, Human
ccccagcacucugacucuuacc

SEQ ID NO: 716417 - RNA, 22 nt, Human
ugcuggcuguauaugugagagu

SEQ ID NO: 716418 - RNA, 21 nt, Human
acagaguaguugaaacagaga

SEQ ID NO: 716419 - RNA, 22 nt, Human
uacauacauguauguguguauu

SEQ ID NO: 716420 - RNA, 18 nt, Human
ucccucagaauuauagaa

SEQ ID NO: 716421 - RNA, 22 nt, Human
cuucuugcaauuuucaucuuau

SEQ ID NO: 716422 - RNA, 23 nt, Human
ggccuggcccagggcccugauga

SEQ ID NO: 716423 - RNA, 22 nt, Human
gggcugcugcccaggaggcacc

SEQ ID NO: 716424 - RNA, 22 nt, Human
gcuguucagggcacucaugggc

SEQ ID NO: 716425 - RNA, 22 nt, Human
ucccagaggcaguugguaacuu

SEQ ID NO: 716426 - RNA, 22 nt, Human
gucacacagguugaaaugcagu

SEQ ID NO: 716427 - RNA, 22 nt, Human
ccugggaaggugaggcccugga

SEQ ID NO: 716428 - RNA, 22 nt, Human
ucaguuucuccaucgcuccagu

SEQ ID NO: 716429 - RNA, 22 nt, Human
agggacacgagguccugcuggg

SEQ ID NO: 716430 - RNA, 22 nt, Human
aagcucagcagccaggcccugu

SEQ ID NO: 716431 - RNA, 22 nt, Human
uucaaacaguguagaauauaug

SEQ ID NO: 716432 - RNA, 22 nt, Human
gucaggacaagguggucuccag

SEQ ID NO: 716433 - RNA, 22 nt, Human
gugcaaaaguaauggcaguuuu

SEQ ID NO: 716434 - RNA, 22 nt, Human
cagaggcauauaauugcugggg

SEQ ID NO: 716435 - RNA, 22 nt, Human
gcaagagcgcucucuuucauua

SEQ ID NO: 716436 - RNA, 22 nt, Human
acagagauggcuuuucagaggc

SEQ ID NO: 716437 - RNA, 22 nt, Human
aaugugucauuucccacaggug

SEQ ID NO: 716438 - RNA, 22 nt, Human
uuuacagaauguugaauuuggg

SEQ ID NO: 716439 - RNA, 22 nt, Human
gcagcuggugcaaaugucacuc

SEQ ID NO: 716440 - RNA, 22 nt, Human
uacauuaaggauauggacauga

SEQ ID NO: 716441 - RNA, 22 nt, Human
uggagagucucaaggcaggaaa

SEQ ID NO: 716442 - RNA, 22 nt, Human
agaaaaggcuugaagagguuuu

SEQ ID NO: 716443 - RNA, 22 nt, Human
gugggcagauuauagaugaugc

SEQ ID NO: 716444 - RNA, 22 nt, Human
auacaguagacaaucucaugaa

SEQ ID NO: 716445 - RNA, 23 nt, Human
ccagcgcucacucagagcauguu

SEQ ID NO: 716446 - RNA, 22 nt, Human
ucucugggguagggcccaggac

SEQ ID NO: 716447 - RNA, 22 nt, Human
uuuaggauaacuccaguuuucc

SEQ ID NO: 716448 - RNA, 22 nt, Human
cccaguggggagcugagguuca

SEQ ID NO: 716449 - RNA, 22 nt, Human
uaguacaguuuuggcacaugga

SEQ ID NO: 716450 - RNA, 22 nt, Human
uacagcuugauguuuguguguu

SEQ ID NO: 716451 - RNA, 22 nt, Human
aucuacaggauuuuacagaguu

SEQ ID NO: 716452 - RNA, 22 nt, Human
ucaguuuucucaucuguaauuu

SEQ ID NO: 716453 - RNA, 21 nt, Human
uucagcaguccucuagagaua

SEQ ID NO: 716454 - RNA, 22 nt, Human
cauucccugucucuucaauccu

SEQ ID NO: 716455 - RNA, 22 nt, Human
uccccaaguaaagauccugaga

SEQ ID NO: 716456 - RNA, 20 nt, Human
aacauuguuuguaaaagcag

SEQ ID NO: 716457 - RNA, 22 nt, Human
acauugaagugucuggccuccu

SEQ ID NO: 716458 - RNA, 22 nt, Human
gugaaauuguauuuggcauuga

SEQ ID NO: 716459 - RNA, 23 nt, Human
gaggcagcuccugcagugcccug

SEQ ID NO: 716460 - RNA, 19 nt, Human
ucaaguccuaggcccacaa

SEQ ID NO: 716461 - RNA, 22 nt, Human
aagguauaucugauccaugagg

SEQ ID NO: 716462 - RNA, 22 nt, Human
aucuuuuuaucuguuuggaaca

SEQ ID NO: 716463 - RNA, 22 nt, Human
cacaaaugugcagaaaugugag

SEQ ID NO: 716464 - RNA, 22 nt, Human
uuuagagaggcucuguaaaaug

SEQ ID NO: 716465 - RNA, 23 nt, Human
gcucugagggcuuaucccuccca

SEQ ID NO: 716466 - RNA, 22 nt, Human
gcucaaugcucaaugcugcaaa

SEQ ID NO: 716467 - RNA, 22 nt, Human
cucuuuucaaaauuucacugca

SEQ ID NO: 716468 - RNA, 22 nt, Human
ugagaauuuuuggcagaaacaa

SEQ ID NO: 716469 - RNA, 22 nt, Human
ucagaggugcaagaaguucuga

SEQ ID NO: 716470 - RNA, 22 nt, Human
auuguauuagcacaauacaauu

SEQ ID NO: 716471 - RNA, 22 nt, Human
cuacauguagguuuccuuaauu

SEQ ID NO: 716472 - RNA, 22 nt, Human
uucaggauuauacucucuuccc

SEQ ID NO: 716473 - RNA, 22 nt, Human
agggagaggagcguuucacauc

SEQ ID NO: 716474 - RNA, 22 nt, Human
augcugagacuggagcagcugg

SEQ ID NO: 716475 - RNA, 22 nt, Human
aaggagggaaagcagugcuucu

SEQ ID NO: 716476 - RNA, 22 nt, Human
acagcagaccacuacuaguagg

SEQ ID NO: 716477 - RNA, 22 nt, Human
aagaaaccaacccugccagcac

SEQ ID NO: 716478 - RNA, 22 nt, Human
cacuuuaaaacugacagcccuu

SEQ ID NO: 716479 - RNA, 22 nt, Human
cuggcugcuugggacagccaug

SEQ ID NO: 716480 - RNA, 22 nt, Human
gaaaauuuagaacugaacuucu

SEQ ID NO: 716481 - RNA, 22 nt, Human
ugauucuagguccauuauuugc

SEQ ID NO: 716482 - RNA, 22 nt, Human
ucccaggaaaacacucgaggac

SEQ ID NO: 716483 - RNA, 22 nt, Human
agcugcagcccuccugcauggc

SEQ ID NO: 716484 - RNA, 22 nt, Human
ugauugacuuuagaauagcacu

SEQ ID NO: 716485 - RNA, 23 nt, Human
caaauguaguguguccaccccug

SEQ ID NO: 716486 - RNA, 22 nt, Human
uuagggcaggcaugagagaacu

SEQ ID NO: 716487 - RNA, 19 nt, Human
uccuggcacaguggaacca

SEQ ID NO: 716488 - RNA, 22 nt, Human
aaagcaugauuagauagaugau

SEQ ID NO: 716489 - RNA, 21 nt, Human
ccuucuccacagggucuccgg

SEQ ID NO: 716490 - RNA, 22 nt, Human
uuccucagcucagcgagagaga

SEQ ID NO: 716491 - RNA, 22 nt, Human
cagggucaggaggaucuggcuu

SEQ ID NO: 716492 - RNA, 22 nt, Human
gccagcagggcggagccaucua

SEQ ID NO: 716493 - RNA, 21 nt, Human
uguccuggucacugcucuccc

SEQ ID NO: 716494 - RNA, 22 nt, Human
ggcuaggcaggcucagagccua

SEQ ID NO: 716495 - RNA, 22 nt, Human
guacaaguucuacucuauaaau

SEQ ID NO: 716496 - RNA, 20 nt, Human
accaggccccgggcccugca

SEQ ID NO: 716497 - RNA, 22 nt, Human
caaugugugcuuacaggccagu

SEQ ID NO: 716498 - RNA, 22 nt, Human
acaugcaaaugugcaugcaugu

SEQ ID NO: 716499 - RNA, 22 nt, Human
cccacccacucugaccagaagc

SEQ ID NO: 716500 - RNA, 22 nt, Human
agccagcuggagaccacuguuu

SEQ ID NO: 716501 - RNA, 22 nt, Human
uauucugcuucccguggcacaa

SEQ ID NO: 716502 - RNA, 22 nt, Human
uagcucaaagguuaagugugga

SEQ ID NO: 716503 - RNA, 22 nt, Human
gcacagcuccgcuuccucacac

SEQ ID NO: 716504 - RNA, 22 nt, Human
ucauauaaguuuaaaacuaucu

SEQ ID NO: 716505 - RNA, 22 nt, Human
gcaucuucacacaaagccagug

SEQ ID NO: 716506 - RNA, 22 nt, Human
uauuuaucgagugucuacuaug

SEQ ID NO: 716507 - RNA, 22 nt, Human
aaaugcugcagcuaguguguuu

SEQ ID NO: 716508 - RNA, 22 nt, Human
gcugggagcaaguacucaucuu

SEQ ID NO: 716509 - RNA, 22 nt, Human
agcaguguucaaugauacacug

SEQ ID NO: 716510 - RNA, 22 nt, Human
ucacaucaacauuauagcauga

SEQ ID NO: 716511 - RNA, 22 nt, Human
uggcucugaucagauguccagu

SEQ ID NO: 716512 - RNA, 22 nt, Human
agagucaguuaugucaagugcu

SEQ ID NO: 716513 - RNA, 22 nt, Human
gccuggaguucagccaaguccc

SEQ ID NO: 716514 - RNA, 22 nt, Human
ugcuggcaucuuaauguucugu

SEQ ID NO: 716515 - RNA, 22 nt, Human
cacacagaaccgcucgccacuu

SEQ ID NO: 716516 - RNA, 23 nt, Human
cccagaccuugugcugcccuugg

SEQ ID NO: 716517 - RNA, 22 nt, Human
acaaugcaauaggagcuagaaa

SEQ ID NO: 716518 - RNA, 22 nt, Human
acacuuuagaaaaaagaauggu

SEQ ID NO: 716519 - RNA, 22 nt, Human
gagccugggacugggggucaug

SEQ ID NO: 716520 - RNA, 22 nt, Human
ucauugaagugacugaaagauu

SEQ ID NO: 716521 - RNA, 22 nt, Human
cggcuggguagaggugccgggu

SEQ ID NO: 716522 - RNA, 22 nt, Human
gcagccucaaacuccccagcuc

SEQ ID NO: 716523 - RNA, 22 nt, Human
ggguggagguggguuuugagau

SEQ ID NO: 716524 - RNA, 22 nt, Human
uccuggaggacagaggcaucuc

SEQ ID NO: 716525 - RNA, 21 nt, Human
uagcacagcuguagacaguuu

SEQ ID NO: 716526 - RNA, 22 nt, Human
aggugggaacccagcagggccc

SEQ ID NO: 716527 - RNA, 22 nt, Human
gcucccugaaaagaacaaaguc

SEQ ID NO: 716528 - RNA, 22 nt, Human
cagcuccugggccaucuccuag

SEQ ID NO: 716529 - RNA, 21 nt, Human
cucugcugucuaccagcuguu

SEQ ID NO: 716530 - RNA, 22 nt, Human
uucuaccuacccucugcauaca

SEQ ID NO: 716531 - RNA, 22 nt, Human
gcuguguggcugugccgucacg

SEQ ID NO: 716532 - RNA, 22 nt, Human
agagcccucuucacugccccuu

SEQ ID NO: 716533 - RNA, 22 nt, Human
aaggagcucccggcagaccagg

SEQ ID NO: 716534 - RNA, 22 nt, Human
ccucagagacaguaacuggaau

SEQ ID NO: 716535 - RNA, 22 nt, Human
guuuauuaacugucaagugauu

SEQ ID NO: 716536 - RNA, 22 nt, Human
aaaccucuggguuccgugguuu

SEQ ID NO: 716537 - RNA, 20 nt, Human
ugaaaaggucaggagacaug

SEQ ID NO: 716538 - RNA, 22 nt, Human
cagcauggagacaaagugggca

SEQ ID NO: 716539 - RNA, 22 nt, Human
cguuuauuuugaagauuccacu

SEQ ID NO: 716540 - RNA, 22 nt, Human
ucucccacuggccuuguaugau

SEQ ID NO: 716541 - RNA, 22 nt, Human
cugggccacuccagaugcccac

SEQ ID NO: 716542 - RNA, 23 nt, Human
ugggucucuaguacaggcaggca

SEQ ID NO: 716543 - RNA, 22 nt, Human
auauguuuuucacagguuuaag

SEQ ID NO: 716544 - RNA, 18 nt, Human
cugggucuccaggcugcc

SEQ ID NO: 716545 - RNA, 19 nt, Human
gauuuaaacguggcucuau

SEQ ID NO: 716546 - RNA, 23 nt, Human
gaccuggcuuugaaucuugacuc

SEQ ID NO: 716547 - RNA, 22 nt, Human
ggcugugcgucauccggcugca

SEQ ID NO: 716548 - RNA, 22 nt, Human
cucagugugaaugcucaguaaa

SEQ ID NO: 716549 - RNA, 22 nt, Human
ugacaggaugaugagcaggggg

SEQ ID NO: 716550 - RNA, 22 nt, Human
gaagugggcuuuguggucagcu

SEQ ID NO: 716551 - RNA, 22 nt, Human
ucacuugauccuucccugaaau

SEQ ID NO: 716552 - RNA, 22 nt, Human
cagggagccugaauguuccagg

SEQ ID NO: 716553 - RNA, 22 nt, Human
uagucaaauggcagggauauuu

SEQ ID NO: 716554 - RNA, 22 nt, Human
cugagccagcuggcaugugcua

SEQ ID NO: 716555 - RNA, 21 nt, Human
ggucaguggcuuucuugcacc

SEQ ID NO: 716556 - RNA, 22 nt, Human
ugaguucaaagacagguauagg

SEQ ID NO: 716557 - RNA, 23 nt, Human
ugaguguguucccugugagauuu

SEQ ID NO: 716558 - RNA, 22 nt, Human
ugcaggugucugggggcaacag

SEQ ID NO: 716559 - RNA, 22 nt, Human
uuccaugaaggagacugagaag

SEQ ID NO: 716560 - RNA, 22 nt, Human
cuggagaagagguaguauguag

SEQ ID NO: 716561 - RNA, 22 nt, Human
auucagagauuguuauucagac

SEQ ID NO: 716562 - RNA, 22 nt, Human
cagccaggagcucccccugcuc

SEQ ID NO: 716563 - RNA, 20 nt, Human
cugccuggaggccucuaccu

SEQ ID NO: 716564 - RNA, 22 nt, Human
uuuuggucaacaguacaugcgg

SEQ ID NO: 716565 - RNA, 22 nt, Human
auucaguuaaaaacuguacuuc

SEQ ID NO: 716566 - RNA, 17 nt, Human
auucuuugaugucucug

SEQ ID NO: 716567 - RNA, 22 nt, Human
guuuugaaaugaaagaaccaag

SEQ ID NO: 716568 - RNA, 22 nt, Human
ucucuugacugcuaaaauuaga

SEQ ID NO: 716569 - RNA, 22 nt, Human
aucauggaagccuaucuugaga

SEQ ID NO: 716570 - RNA, 22 nt, Human
cagggcaggacagauacauuac

SEQ ID NO: 716571 - RNA, 23 nt, Human
uuaggcacuuaguagggccagag

SEQ ID NO: 716572 - RNA, 22 nt, Human
gaggaaaauaacaacuaagggc

SEQ ID NO: 716573 - RNA, 22 nt, Human
uguauuaacauuaauaaaaugg

SEQ ID NO: 716574 - RNA, 22 nt, Human
gucuuuuucuacgauagcgccu

SEQ ID NO: 716575 - RNA, 22 nt, Human
cacuguauuauuaggaaugaca

SEQ ID NO: 716576 - RNA, 22 nt, Human
gaggcuaagguucugccagaag

SEQ ID NO: 716577 - RNA, 22 nt, Human
aaaguucaugguguuauagaaa

SEQ ID NO: 716578 - RNA, 21 nt, Human
agaaaaacacgauauaagccc

SEQ ID NO: 716579 - RNA, 22 nt, Human
uuaaggaaggagucuuaaaugg

SEQ ID NO: 716580 - RNA, 22 nt, Human
caggcuggaguuaccuuuaggg

SEQ ID NO: 716581 - RNA, 22 nt, Human
ucaggauggcuucugcaucaaa

SEQ ID NO: 716582 - RNA, 22 nt, Human
guucuucaggccauccucccag

SEQ ID NO: 716583 - RNA, 22 nt, Human
ucacugaaagaaugacauuaug

SEQ ID NO: 716584 - RNA, 22 nt, Human
gcccuccuuugcuucuccuagu

SEQ ID NO: 716585 - RNA, 22 nt, Human
accccacagcauacaaaggcac

SEQ ID NO: 716586 - RNA, 22 nt, Human
uuuguucauuuugagcucauca

SEQ ID NO: 716587 - RNA, 22 nt, Human
uccuucagcugcuaggaaauga

SEQ ID NO: 716588 - RNA, 19 nt, Human
uuuacagggaauggagacc

SEQ ID NO: 716589 - RNA, 22 nt, Human
ucugcagaagccauggccuugc

SEQ ID NO: 716590 - RNA, 22 nt, Human
cccacacacauuuaugauagga

SEQ ID NO: 716591 - RNA, 22 nt, Human
accagagcuggcagaguaucaa

SEQ ID NO: 716592 - RNA, 22 nt, Human
acuggauggugucaugagcagc

SEQ ID NO: 716593 - RNA, 22 nt, Human
uaggcuggaggaagcagugccu

SEQ ID NO: 716594 - RNA, 17 nt, Human
cucugggucuccugcuu

SEQ ID NO: 716595 - RNA, 22 nt, Human
uucauguaggcugcaaugcaca

SEQ ID NO: 716596 - RNA, 22 nt, Human
uuugcaaacacuuaagaagaga

SEQ ID NO: 716597 - RNA, 22 nt, Human
ggaggagacccugugucaguuu

SEQ ID NO: 716598 - RNA, 22 nt, Human
uaugucacauuguaacagugug

SEQ ID NO: 716599 - RNA, 21 nt, Human
cagggccaauccugaccucua

SEQ ID NO: 716600 - RNA, 22 nt, Human
aguguaucaugguuggcagaca

SEQ ID NO: 716601 - RNA, 22 nt, Human
gagagcuggguucaaguagcug

SEQ ID NO: 716602 - RNA, 22 nt, Human
augcgagugaugcagaguggcu

SEQ ID NO: 716603 - RNA, 22 nt, Human
uaacagaaaggcucaggugcuc

SEQ ID NO: 716604 - RNA, 22 nt, Human
uugcuuugguagcagcuauaga

SEQ ID NO: 716605 - RNA, 22 nt, Human
acguguguuggucagggggccc

SEQ ID NO: 716606 - RNA, 22 nt, Human
uucucugggguucaguaucucu

SEQ ID NO: 716607 - RNA, 22 nt, Human
acaagagucugcauuucuaaca

SEQ ID NO: 716608 - RNA, 22 nt, Human
gucucacacagaguagauuuug

SEQ ID NO: 716609 - RNA, 18 nt, Human
ggcagaugacaggagaga

SEQ ID NO: 716610 - RNA, 22 nt, Human
gcacaugagcugcugggauggg

SEQ ID NO: 716611 - RNA, 22 nt, Human
ggguggagccaguugacucugu

SEQ ID NO: 716612 - RNA, 22 nt, Human
caggcauggugagaacucagcc

SEQ ID NO: 716613 - RNA, 22 nt, Human
uacuauacucuccauuuuauag

SEQ ID NO: 716614 - RNA, 22 nt, Human
cccagagcugagggggcacguu

SEQ ID NO: 716615 - RNA, 22 nt, Human
caucacaaaaugauuauucccu

SEQ ID NO: 716616 - RNA, 22 nt, Human
cuggcucugucacccuuucucc

SEQ ID NO: 716617 - RNA, 18 nt, Human
ugauucugugaugugguc

SEQ ID NO: 716618 - RNA, 22 nt, Human
gcuugcaugauuggagugggug

SEQ ID NO: 716619 - RNA, 22 nt, Human
cccagacuccucuggcuggugg

SEQ ID NO: 716620 - RNA, 22 nt, Human
aaggccuugccugacagcacca

SEQ ID NO: 716621 - RNA, 22 nt, Human
cagcuguugcagcacugagaga

SEQ ID NO: 716622 - RNA, 21 nt, Human
auauuucucauaagguuaugg

SEQ ID NO: 716623 - RNA, 21 nt, Human
gcuggcuuuauucugcguuug

SEQ ID NO: 716624 - RNA, 22 nt, Human
ugaggcuugucucagauggggg

SEQ ID NO: 716625 - RNA, 22 nt, Human
cucagaaaggguugcugagggc

SEQ ID NO: 716626 - RNA, 18 nt, Human
ucaaaauauuucugugga

SEQ ID NO: 716627 - RNA, 22 nt, Human
cugcugugugcuuacuuggguu

SEQ ID NO: 716628 - RNA, 22 nt, Human
acacuaaugagaaaggaauuaa

SEQ ID NO: 716629 - RNA, 22 nt, Human
cuuaugcugagaaugaaagaau

SEQ ID NO: 716630 - RNA, 22 nt, Human
uaagacaauucuucagucacaa

SEQ ID NO: 716631 - RNA, 23 nt, Human
uggcauagugaggggcacagaga

SEQ ID NO: 716632 - RNA, 20 nt, Human
ccugugcuuaucacuugcug

SEQ ID NO: 716633 - RNA, 22 nt, Human
auagaaaggucuuuggcagaca

SEQ ID NO: 716634 - RNA, 20 nt, Human
aacacugaggccuacucuuc

SEQ ID NO: 716635 - RNA, 19 nt, Human
uggccagguacugucugcu

SEQ ID NO: 716636 - RNA, 22 nt, Human
aacuauauaaucugaaagugaa

SEQ ID NO: 716637 - RNA, 22 nt, Human
aacuacaauauguauguaugua

SEQ ID NO: 716638 - RNA, 22 nt, Human
cuuagaaaugcagauucucagg

SEQ ID NO: 716639 - RNA, 22 nt, Human
gccucugcaccaguacugugcc

SEQ ID NO: 716640 - RNA, 23 nt, Human
ugggccaguucuguugaaagcca

SEQ ID NO: 716641 - RNA, 22 nt, Human
aucagaauggagcccacauggu

SEQ ID NO: 716642 - RNA, 22 nt, Human
uugugucuggaaugcguggagc

SEQ ID NO: 716643 - RNA, 22 nt, Human
agcacugggaacgcauggggcc

SEQ ID NO: 716644 - RNA, 22 nt, Human
ugggccacaguucaccaauccc

SEQ ID NO: 716645 - RNA, 22 nt, Human
uucuauaugacuucuaggcagg

SEQ ID NO: 716646 - RNA, 22 nt, Human
acugggaguucuccaugucccu

SEQ ID NO: 716647 - RNA, 22 nt, Human
gagucacauacuauguaauaga

SEQ ID NO: 716648 - RNA, 22 nt, Human
uccaggagucagacagauggug

SEQ ID NO: 716649 - RNA, 22 nt, Human
caggcauguggcccagggguga

SEQ ID NO: 716650 - RNA, 22 nt, Human
cugcugggcuccucaugugacu

SEQ ID NO: 716651 - RNA, 21 nt, Human
caauuacagauggcucagggg

SEQ ID NO: 716652 - RNA, 22 nt, Human
caggcacacauccgugagagau

SEQ ID NO: 716653 - RNA, 22 nt, Human
gauacagacaccacucuuuucc

SEQ ID NO: 716654 - RNA, 22 nt, Human
uggaacacaagucauugagggg

SEQ ID NO: 716655 - RNA, 22 nt, Human
guucauauuuaacuaagauagg

SEQ ID NO: 716656 - RNA, 22 nt, Human
gccaagcucuuuaaaggccaaa

SEQ ID NO: 716657 - RNA, 22 nt, Human
gaagaaauguguucaagguagg

SEQ ID NO: 716658 - RNA, 22 nt, Human
agucucugggcaugguugugac

SEQ ID NO: 716659 - RNA, 22 nt, Human
uccuagaagauggaucagagaa

SEQ ID NO: 716660 - RNA, 22 nt, Human
auguagcaugaggcacugugcc

SEQ ID NO: 716661 - RNA, 22 nt, Human
agcugagcauuugauccaccuc

SEQ ID NO: 716662 - RNA, 22 nt, Human
caguauuuguucccuaucaaug

SEQ ID NO: 716663 - RNA, 22 nt, Human
uagauguuuugauauuugcuga

SEQ ID NO: 716664 - RNA, 22 nt, Human
ugccagcaguagcaguaggcca

SEQ ID NO: 716665 - RNA, 22 nt, Human
uccuucagugucccgcucaggu

SEQ ID NO: 716666 - RNA, 22 nt, Human
uugacagaugugaaagugagca

SEQ ID NO: 716667 - RNA, 22 nt, Human
guuauucaauggcuuauaagga

SEQ ID NO: 716668 - RNA, 22 nt, Human
cuguuguauuuccaacuaugua

SEQ ID NO: 716669 - RNA, 22 nt, Human
guguugcucuguuuggggguug

SEQ ID NO: 716670 - RNA, 22 nt, Human
cauuuguuaaccaguguggauu

SEQ ID NO: 716671 - RNA, 22 nt, Human
cucuuuuucaccucugucagcg

SEQ ID NO: 716672 - RNA, 22 nt, Human
ccacuggaagaugcugagguca

SEQ ID NO: 716673 - RNA, 18 nt, Human
ggaaaaggagugucuagc

SEQ ID NO: 716674 - RNA, 22 nt, Human
aaguuuaggccaaauuagauuu

SEQ ID NO: 716675 - RNA, 22 nt, Human
ccuggcugaggggccaaggacc

SEQ ID NO: 716676 - RNA, 22 nt, Human
gccuggaguagcauggcaagcc

SEQ ID NO: 716677 - RNA, 22 nt, Human
uauacuauuauugucaguuuau

SEQ ID NO: 716678 - RNA, 22 nt, Human
guggcccagcccuacagaggac

SEQ ID NO: 716679 - RNA, 22 nt, Human
agguaaggcuguaagcuaagcc

SEQ ID NO: 716680 - RNA, 22 nt, Human
aacuuaaacaagcucccaaguu

SEQ ID NO: 716681 - RNA, 22 nt, Human
ccugcacaugugugcgccugua

SEQ ID NO: 716682 - RNA, 22 nt, Human
ggcagcuguggacgucgucauu

SEQ ID NO: 716683 - RNA, 22 nt, Human
caggagucccucuggccagcau

SEQ ID NO: 716684 - RNA, 22 nt, Human
gccuuuggugacaggcaugugu

SEQ ID NO: 716685 - RNA, 22 nt, Human
guauuuuucauuccaagugaga

SEQ ID NO: 716686 - RNA, 22 nt, Human
agugcugaacauagaauggaca

SEQ ID NO: 716687 - RNA, 22 nt, Human
uuuauauguuuguacaauuaag

SEQ ID NO: 716688 - RNA, 22 nt, Human
agacaacuagaaaacuagacag

SEQ ID NO: 716689 - RNA, 22 nt, Human
gagggaccuuuacacagacauu

SEQ ID NO: 716690 - RNA, 22 nt, Human
aaacucuauaggcagaagcaau

SEQ ID NO: 716691 - RNA, 23 nt, Human
agggaagggggcuuauuccacag

SEQ ID NO: 716692 - RNA, 18 nt, Human
ggaugcugugugcuccuu

SEQ ID NO: 716693 - RNA, 22 nt, Human
gaggccacgugcuuauguuucu

SEQ ID NO: 716694 - RNA, 22 nt, Human
acauuucucccugcaugccugc

SEQ ID NO: 716695 - RNA, 22 nt, Human
ggcagcuguaagaugagugaau

SEQ ID NO: 716696 - RNA, 22 nt, Human
cucucuggacuugaguaucagc

SEQ ID NO: 716697 - RNA, 22 nt, Human
ucugugacucauaucuguagau

SEQ ID NO: 716698 - RNA, 22 nt, Human
cagcccuggccucuucgcuuuc

SEQ ID NO: 716699 - RNA, 19 nt, Human
aggcugcccagucucugcc

SEQ ID NO: 716700 - RNA, 22 nt, Human
ucugucacucccugaugaugaa

SEQ ID NO: 716701 - RNA, 22 nt, Human
uauacacauuuuuaccuauagu

SEQ ID NO: 716702 - RNA, 22 nt, Human
uaccaguaauaguaugugagau

SEQ ID NO: 716703 - RNA, 19 nt, Human
aaguucucagaguucaaag

SEQ ID NO: 716704 - RNA, 22 nt, Human
gauaaaguagauuuguucuaga

SEQ ID NO: 716705 - RNA, 22 nt, Human
guggcagucuuuggcaaugaca

SEQ ID NO: 716706 - RNA, 22 nt, Human
uuacacuuuaaauccagcuugu

SEQ ID NO: 716707 - RNA, 22 nt, Human
auucauucuugguaugaacagc

SEQ ID NO: 716708 - RNA, 22 nt, Human
guuacaaaggaagcuucacugc

SEQ ID NO: 716709 - RNA, 22 nt, Human
agucuuagaacuacagugccua

SEQ ID NO: 716710 - RNA, 22 nt, Human
accagcauccuuccuauuaaca

SEQ ID NO: 716711 - RNA, 22 nt, Human
gugcauuugugcaugcacaugu

SEQ ID NO: 716712 - RNA, 22 nt, Human
gcagggaugcugaggcucagug

SEQ ID NO: 716713 - RNA, 22 nt, Human
ccacagaggacaacugccuggc

SEQ ID NO: 716714 - RNA, 22 nt, Human
caggggcucccugggugccagu

SEQ ID NO: 716715 - RNA, 19 nt, Human
aggcuuggauuguggccaa

SEQ ID NO: 716716 - RNA, 22 nt, Human
gacacaggggggcgcuagaaga

SEQ ID NO: 716717 - RNA, 22 nt, Human
uguggagcucagaaguagcagu

SEQ ID NO: 716718 - RNA, 22 nt, Human
guccagccccugacucccaggc

SEQ ID NO: 716719 - RNA, 22 nt, Human
aaggcccuggcaggaagcagga

SEQ ID NO: 716720 - RNA, 21 nt, Human
uucuuucugaaucugaaguau

SEQ ID NO: 716721 - RNA, 22 nt, Human
caugcagauuugcugagauaau

SEQ ID NO: 716722 - RNA, 22 nt, Human
agcagguguauauaaggcugag

SEQ ID NO: 716723 - RNA, 22 nt, Human
augcugaaggugaauugacaau

SEQ ID NO: 716724 - RNA, 23 nt, Human
ccaggaagaggccauccacaguc

SEQ ID NO: 716725 - RNA, 22 nt, Human
uaaaugcaagggaaaggcaaga

SEQ ID NO: 716726 - RNA, 17 nt, Human
ggcugugccaggugaga

SEQ ID NO: 716727 - RNA, 22 nt, Human
gcuggagaaacugcagcugagg

SEQ ID NO: 716728 - RNA, 22 nt, Human
ggaggccaggaugggaacucaa

SEQ ID NO: 716729 - RNA, 22 nt, Human
aagauuucucuccuggaaagca

SEQ ID NO: 716730 - RNA, 22 nt, Human
aguggcuggcauaggaacagac

SEQ ID NO: 716731 - RNA, 22 nt, Human
cucagacuugcuuuuuauggaa

SEQ ID NO: 716732 - RNA, 20 nt, Human
aggagcugaauuagaggguu

SEQ ID NO: 716733 - RNA, 22 nt, Human
uguguuuacuucuaugcaguuu

SEQ ID NO: 716734 - RNA, 22 nt, Human
cccauuuuugugugaguaauga

SEQ ID NO: 716735 - RNA, 22 nt, Human
ugccuucucuucccugggagcu

SEQ ID NO: 716736 - RNA, 18 nt, Human
acccaguuugaaggaaag

SEQ ID NO: 716737 - RNA, 22 nt, Human
aggaugggccugggauaugcuu

SEQ ID NO: 716738 - RNA, 23 nt, Human
uuucaacaaugcuuagagaaaac

SEQ ID NO: 716739 - RNA, 22 nt, Human
gccuggcagugaugucuuuugg

SEQ ID NO: 716740 - RNA, 22 nt, Human
ccucccuggccagagcagcagc

SEQ ID NO: 716741 - RNA, 22 nt, Human
cacccacauuccaucacucugc

SEQ ID NO: 716742 - RNA, 22 nt, Human
auuuauugagacuuaacaaccc

SEQ ID NO: 716743 - RNA, 20 nt, Human
ggcaggugcucgcuuggucu

SEQ ID NO: 716744 - RNA, 17 nt, Human
ccaggagagaugcuugu

SEQ ID NO: 716745 - RNA, 22 nt, Human
ugaagccagcuuuggaagacac

SEQ ID NO: 716746 - RNA, 22 nt, Human
uugucaagaaaaauggaugaag

SEQ ID NO: 716747 - RNA, 22 nt, Human
auggcucugagaaccugagcua

SEQ ID NO: 716748 - RNA, 22 nt, Human
ugucagaggcucagggucucag

SEQ ID NO: 716749 - RNA, 19 nt, Human
cagcugccuuuucuuugca

SEQ ID NO: 716750 - RNA, 22 nt, Human
agggagagguugaaaccucagu

SEQ ID NO: 716751 - RNA, 22 nt, Human
uuaauuuauguccaaaccagau

SEQ ID NO: 716752 - RNA, 22 nt, Human
cccuggugguacggcacuggca

SEQ ID NO: 716753 - RNA, 22 nt, Human
gugcugaggccaaugucagggu

SEQ ID NO: 716754 - RNA, 22 nt, Human
ucuccuaauuaaaugcucuuau

SEQ ID NO: 716755 - RNA, 22 nt, Human
cacugcuauuauuagacaaugu

SEQ ID NO: 716756 - RNA, 22 nt, Human
cuguauaugugcauacacacac

SEQ ID NO: 716757 - RNA, 18 nt, Human
guuaauuuugaaguucau

SEQ ID NO: 716758 - RNA, 22 nt, Human
ggagacacuggaaaguauuaca

SEQ ID NO: 716759 - RNA, 22 nt, Human
ucauuucuuaacuagagugaac

SEQ ID NO: 716760 - RNA, 22 nt, Human
ugauucaacuuucuugaaugca

SEQ ID NO: 716761 - RNA, 22 nt, Human
agguauuuuauagauaaguaaa

SEQ ID NO: 716762 - RNA, 17 nt, Human
ccucagcuucuuuccuc

SEQ ID NO: 716763 - RNA, 22 nt, Human
ugagcccagaagcccacucggc

SEQ ID NO: 716764 - RNA, 22 nt, Human
aucuuuucuguuugcuaugucu

SEQ ID NO: 716765 - RNA, 21 nt, Human
augauacugaagcacaacuau

SEQ ID NO: 716766 - RNA, 22 nt, Human
ugaagcagauggucuggucauu

SEQ ID NO: 716767 - RNA, 22 nt, Human
caugcuauauaggaagagcacu

SEQ ID NO: 716768 - RNA, 22 nt, Human
caggcccugggcaggaucagcc

SEQ ID NO: 716769 - RNA, 22 nt, Human
ggucccuggaagucccucuucu

SEQ ID NO: 716770 - RNA, 22 nt, Human
guucuacuuucugugucuuuga

SEQ ID NO: 716771 - RNA, 22 nt, Human
gcagagugaggaagagcuucca

SEQ ID NO: 716772 - RNA, 22 nt, Human
auuuagacuucuugcagguaau

SEQ ID NO: 716773 - RNA, 22 nt, Human
ggagcugcacgcucugaagccu

SEQ ID NO: 716774 - RNA, 22 nt, Human
cuggugaauauuggaggcauug

SEQ ID NO: 716775 - RNA, 22 nt, Human
gaugaggucuacauuguuaaaa

SEQ ID NO: 716776 - RNA, 22 nt, Human
ggugaggcguccccaccauggg

SEQ ID NO: 716777 - RNA, 22 nt, Human
aguacaauuauauuuagauggu

SEQ ID NO: 716778 - RNA, 22 nt, Human
uagaggagcggcgagcugagcu

SEQ ID NO: 716779 - RNA, 22 nt, Human
ggcauuuaguuuucauauucug

SEQ ID NO: 716780 - RNA, 22 nt, Human
agcugccucugcugguuuagaa

SEQ ID NO: 716781 - RNA, 22 nt, Human
gcugagcugaggcagggcuggg

SEQ ID NO: 716782 - RNA, 22 nt, Human
uggagacugugcuaagggaguu

SEQ ID NO: 716783 - RNA, 22 nt, Human
gagggaaaauaaaauugcagua

SEQ ID NO: 716784 - RNA, 17 nt, Human
cuguggccaccuggaug

SEQ ID NO: 716785 - RNA, 22 nt, Human
ugcugcagcagugcgggcagcu

SEQ ID NO: 716786 - RNA, 22 nt, Human
aucugaaacucugacauugucu

SEQ ID NO: 716787 - RNA, 22 nt, Human
auuguauacaagcuuaauuguu

SEQ ID NO: 716788 - RNA, 22 nt, Human
aaaauuguaggaacugaaucaa

SEQ ID NO: 716789 - RNA, 20 nt, Human
caucauuuuaaaaucucucc

SEQ ID NO: 716790 - RNA, 22 nt, Human
cuccagugcuucuagaaaauac

SEQ ID NO: 716791 - RNA, 20 nt, Human
gguagcugcugcaguuggua

SEQ ID NO: 716792 - RNA, 22 nt, Human
uguauucucucaauauuucaua

SEQ ID NO: 716793 - RNA, 22 nt, Human
ugagcugucuaugguccugucu

SEQ ID NO: 716794 - RNA, 22 nt, Human
cagacagguagggacagaacau

SEQ ID NO: 716795 - RNA, 22 nt, Human
acaugcacucucacugugcucu

SEQ ID NO: 716796 - RNA, 22 nt, Human
ucacaaauauuuuaacaguagg

SEQ ID NO: 716797 - RNA, 22 nt, Human
aagcacacaucucuggcugggu

SEQ ID NO: 716798 - RNA, 22 nt, Human
augacaguucuuuagagaugua

SEQ ID NO: 716799 - RNA, 22 nt, Human
auguguauacuugugcuuacuc

SEQ ID NO: 716800 - RNA, 22 nt, Human
aaacagcugcacugcugauguc

SEQ ID NO: 716801 - RNA, 23 nt, Human
uccaggagaaccccugucugucc

SEQ ID NO: 716802 - RNA, 22 nt, Human
uuauggcuucugugaagaauuu

SEQ ID NO: 716803 - RNA, 22 nt, Human
aguccuuccggcagauuucacu

SEQ ID NO: 716804 - RNA, 22 nt, Human
cagcucuuuuucacacaacaug

SEQ ID NO: 716805 - RNA, 22 nt, Human
ugcaaggcccagacaagagcuc

SEQ ID NO: 716806 - RNA, 22 nt, Human
aaugacauggagcaucuuuuca

SEQ ID NO: 716807 - RNA, 22 nt, Human
agcagacauaucucaugucaca

SEQ ID NO: 716808 - RNA, 22 nt, Human
agggcucugagcuggaccaccu

SEQ ID NO: 716809 - RNA, 22 nt, Human
cugugcugggugugcuuaugau

SEQ ID NO: 716810 - RNA, 22 nt, Human
ugacagggugauuaugagagcu

SEQ ID NO: 716811 - RNA, 22 nt, Human
ccugagggcgccgagcucccag

SEQ ID NO: 716812 - RNA, 22 nt, Human
ugaguccaagagccagugggaa

SEQ ID NO: 716813 - RNA, 22 nt, Human
augacaauggacauaguuaaaa

SEQ ID NO: 716814 - RNA, 22 nt, Human
aguguuuagucaaguaagacgc

SEQ ID NO: 716815 - RNA, 22 nt, Human
gggcacuguggggcccaugcug

SEQ ID NO: 716816 - RNA, 22 nt, Human
uucugucauuuagcauugucau

SEQ ID NO: 716817 - RNA, 22 nt, Human
ugccugaaugaucagucagauu

SEQ ID NO: 716818 - RNA, 19 nt, Human
gcucagagacaccuguugc

SEQ ID NO: 716819 - RNA, 22 nt, Human
uuccucucaacaugccugccgg

SEQ ID NO: 716820 - RNA, 22 nt, Human
uucucacauucagaacuuuuau

SEQ ID NO: 716821 - RNA, 22 nt, Human
ucauucuugaucacuaguuagu

SEQ ID NO: 716822 - RNA, 22 nt, Human
gacuggccuggggcugggcaca

SEQ ID NO: 716823 - RNA, 22 nt, Human
gugccugcaggugccggcuuca

SEQ ID NO: 716824 - RNA, 22 nt, Human
ucacuguaaacuaggucagucc

SEQ ID NO: 716825 - RNA, 22 nt, Human
aaauagcagccuuuaguuaaca

SEQ ID NO: 716826 - RNA, 22 nt, Human
augacauugacagaccugcugc

SEQ ID NO: 716827 - RNA, 22 nt, Human
cagugucucccccagguucugu

SEQ ID NO: 716828 - RNA, 22 nt, Human
gcaagcugaugugauagugaaa

SEQ ID NO: 716829 - RNA, 22 nt, Human
ugaacauugucacauuccuagc

SEQ ID NO: 716830 - RNA, 22 nt, Human
cacauacaaggcacacuggagg

SEQ ID NO: 716831 - RNA, 22 nt, Human
uugacaguauagcuuuaccuau

SEQ ID NO: 716832 - RNA, 22 nt, Human
uugagacacuuugggcaucacu

SEQ ID NO: 716833 - RNA, 22 nt, Human
caagugucuucaaaggcuaaaa

SEQ ID NO: 716834 - RNA, 22 nt, Human
acaggauggagauaauagaaaa

SEQ ID NO: 716835 - RNA, 23 nt, Human
cugcccugaucuugaucuauugu

SEQ ID NO: 716836 - RNA, 22 nt, Human
ucauccaugucagagcauguau

SEQ ID NO: 716837 - RNA, 22 nt, Human
uuauucugucaaacuuauacau

SEQ ID NO: 716838 - RNA, 22 nt, Human
caggugggccaugaaaaaugac

SEQ ID NO: 716839 - RNA, 22 nt, Human
uggagcugccuggcaccuacag

SEQ ID NO: 716840 - RNA, 22 nt, Human
guugaaagaugucuugguuccc

SEQ ID NO: 716841 - RNA, 22 nt, Human
ccuggcaggcaagaggaaggga

SEQ ID NO: 716842 - RNA, 22 nt, Human
uccauuauacuucugauucaaa

SEQ ID NO: 716843 - RNA, 22 nt, Human
augucacaggcaacaagauugc

SEQ ID NO: 716844 - RNA, 22 nt, Human
acagaauaagguuuaucucucc

SEQ ID NO: 716845 - RNA, 22 nt, Human
uggcuucacaauuucauaacua

SEQ ID NO: 716846 - RNA, 22 nt, Human
gcugcccaauuacagggccgug

SEQ ID NO: 716847 - RNA, 22 nt, Human
ggaggccuugccugcaggcaca

SEQ ID NO: 716848 - RNA, 22 nt, Human
cccaggagguggagguugcagc

SEQ ID NO: 716849 - RNA, 22 nt, Human
gaggggagcaugaucuagauug

SEQ ID NO: 716850 - RNA, 22 nt, Human
uacaucuauacugaucuacauu

SEQ ID NO: 716851 - RNA, 20 nt, Human
cuuaaacacagagauagauu

SEQ ID NO: 716852 - RNA, 22 nt, Human
agcccagggaguugauuagcau

SEQ ID NO: 716853 - RNA, 22 nt, Human
aaagccagcucugagcugcacc

SEQ ID NO: 716854 - RNA, 22 nt, Human
ugaaggcccagccacagaaugg

SEQ ID NO: 716855 - RNA, 22 nt, Human
auugaacuuaacaguaaguggc

SEQ ID NO: 716856 - RNA, 22 nt, Human
ucacagcauugucacaaggcug

SEQ ID NO: 716857 - RNA, 22 nt, Human
aggcuggcccaccucuugucuu

SEQ ID NO: 716858 - RNA, 22 nt, Human
uuuuuauaacucuuuugugaca

SEQ ID NO: 716859 - RNA, 22 nt, Human
uagcagaagaacaacaugaucu

SEQ ID NO: 716860 - RNA, 19 nt, Human
ugcugcuguccuugcaggg

SEQ ID NO: 716861 - RNA, 19 nt, Human
auacaguaagguguuugcc

SEQ ID NO: 716862 - RNA, 22 nt, Human
agcugagggcaggaugggguga

SEQ ID NO: 716863 - RNA, 22 nt, Human
ucuuaacagugcuacagagcag

SEQ ID NO: 716864 - RNA, 22 nt, Human
uucagaaagguuaaucuggauu

SEQ ID NO: 716865 - RNA, 21 nt, Human
aagcuucccugcucuccaggg

SEQ ID NO: 716866 - RNA, 22 nt, Human
gcugcccuguuuagccaggguu

SEQ ID NO: 716867 - RNA, 22 nt, Human
ccaggcucugacauagauggga

SEQ ID NO: 716868 - RNA, 22 nt, Human
gcuggcccagcgcccagggcag

SEQ ID NO: 716869 - RNA, 22 nt, Human
aucugcauguccccauggaucc

SEQ ID NO: 716870 - RNA, 22 nt, Human
augcuguuauucuaauguguga

SEQ ID NO: 716871 - RNA, 22 nt, Human
auguuauaguuauaaaaugagg

SEQ ID NO: 716872 - RNA, 22 nt, Human
caggcaugagccaggccccucc

SEQ ID NO: 716873 - RNA, 22 nt, Human
aagauacaucauucaggaguga

SEQ ID NO: 716874 - RNA, 22 nt, Human
ucauugucuugauaugauuguc

SEQ ID NO: 716875 - RNA, 22 nt, Human
ucucucuugucaccccaucugc

SEQ ID NO: 716876 - RNA, 22 nt, Human
uuugaaaggaaguuaauacuuu

SEQ ID NO: 716877 - RNA, 22 nt, Human
cuucuggaggcuccagggaggu

SEQ ID NO: 716878 - RNA, 22 nt, Human
uaaggcacccuucugaguagag

SEQ ID NO: 716879 - RNA, 22 nt, Human
acuuuacauuugaucucucuaa

SEQ ID NO: 716880 - RNA, 18 nt, Human
auauucaagaagacagag

SEQ ID NO: 716881 - RNA, 22 nt, Human
ucuuucuugcaaggaugcagga

SEQ ID NO: 716882 - RNA, 18 nt, Human
uuugaaggauggccugga

SEQ ID NO: 716883 - RNA, 23 nt, Human
uagauguauuaagugcauuuuca

SEQ ID NO: 716884 - RNA, 22 nt, Human
uggaacaaacauggugauggcu

SEQ ID NO: 716885 - RNA, 22 nt, Human
gcaguggauggccagcaggggc

SEQ ID NO: 716886 - RNA, 22 nt, Human
auauuuguuuggcagaguucag

SEQ ID NO: 716887 - RNA, 22 nt, Human
ccuguacauggccaucuuuacc

SEQ ID NO: 716888 - RNA, 22 nt, Human
agaugugagaaucaagugacca

SEQ ID NO: 716889 - RNA, 22 nt, Human
gggagccaaggagagaggccuu

SEQ ID NO: 716890 - RNA, 22 nt, Human
ugccugcaucuuggaggcccca

SEQ ID NO: 716891 - RNA, 22 nt, Human
cagaggaagcagacacaucuug

SEQ ID NO: 716892 - RNA, 22 nt, Human
aggcacuucauggguucaagga

SEQ ID NO: 716893 - RNA, 22 nt, Human
agcagguggccuccugucuguc

SEQ ID NO: 716894 - RNA, 21 nt, Human
uggcugaguggaugcaugaau

SEQ ID NO: 716895 - RNA, 22 nt, Human
aucuugugcugacaaaacacau

SEQ ID NO: 716896 - RNA, 22 nt, Human
acaguguuucacuuaaccguuu

SEQ ID NO: 716897 - RNA, 22 nt, Human
ucauuaaauguuuguugugcca

SEQ ID NO: 716898 - RNA, 22 nt, Human
uguggcugggcuaauaggcaaa

SEQ ID NO: 716899 - RNA, 22 nt, Human
gacaugcugaauaacuauauga

SEQ ID NO: 716900 - RNA, 21 nt, Human
agcagccauggaugguaugua

SEQ ID NO: 716901 - RNA, 22 nt, Human
aagggggcacagucacuguaau

SEQ ID NO: 716902 - RNA, 22 nt, Human
acuucaaaugugacaaugugaa

SEQ ID NO: 716903 - RNA, 22 nt, Human
gccuggugaaaggcagagagcg

SEQ ID NO: 716904 - RNA, 22 nt, Human
agcuucuucugauuugucaguc

SEQ ID NO: 716905 - RNA, 22 nt, Human
uucuguuacauggggcacagug

SEQ ID NO: 716906 - RNA, 22 nt, Human
auaugccauuagcuagaaauaa

SEQ ID NO: 716907 - RNA, 22 nt, Human
uuucauuauacagcuucauaaa

SEQ ID NO: 716908 - RNA, 22 nt, Human
cugccugugugugccugcagaa

SEQ ID NO: 716909 - RNA, 22 nt, Human
uccguauuugacuauugcaccg

SEQ ID NO: 716910 - RNA, 22 nt, Human
augaaaugaaguuggccuggcu

SEQ ID NO: 716911 - RNA, 22 nt, Human
cuacagcagagaccagccacau

SEQ ID NO: 716912 - RNA, 22 nt, Human
cugggccuccacgggccaucac

SEQ ID NO: 716913 - RNA, 22 nt, Human
ccuugcucaagcuagugacggg

SEQ ID NO: 716914 - RNA, 22 nt, Human
uccucugguccugcagcagauc

SEQ ID NO: 716915 - RNA, 22 nt, Human
auuggaaauacaguagaaaaau

SEQ ID NO: 716916 - RNA, 22 nt, Human
ugagcugggcugggcugagcug

SEQ ID NO: 716917 - RNA, 22 nt, Human
uguguucaagauuaguucuagu

SEQ ID NO: 716918 - RNA, 22 nt, Human
ugugaaaugcuauuuccaugag

SEQ ID NO: 716919 - RNA, 22 nt, Human
gcauuuccugugcuuggcauau

SEQ ID NO: 716920 - RNA, 22 nt, Human
cuacaguagaguaggccucuga

SEQ ID NO: 716921 - RNA, 22 nt, Human
ugcucacugaacucuugcuguc

SEQ ID NO: 716922 - RNA, 22 nt, Human
uuuacaguuaagaaauguuacc

SEQ ID NO: 716923 - RNA, 17 nt, Human
ucucaggcacguguggc

SEQ ID NO: 716924 - RNA, 22 nt, Human
cauggcuuuuagcccuacauga

SEQ ID NO: 716925 - RNA, 22 nt, Human
caaagguauucucauuuuggaa

SEQ ID NO: 716926 - RNA, 22 nt, Human
ucuggcaggcaaucggcucugg

SEQ ID NO: 716927 - RNA, 22 nt, Human
uuucagagucuggcugcagccu

SEQ ID NO: 716928 - RNA, 22 nt, Human
ucucccucauuccugcuuccau

SEQ ID NO: 716929 - RNA, 20 nt, Human
gaacagucuucugagccaca

SEQ ID NO: 716930 - RNA, 22 nt, Human
agagccaggcggcugggcaccu

SEQ ID NO: 716931 - RNA, 22 nt, Human
gucccugcaucaccacgggacu

SEQ ID NO: 716932 - RNA, 20 nt, Human
gaaacauuggcagcaacuga

SEQ ID NO: 716933 - RNA, 21 nt, Human
uaauaauuccacuacagagua

SEQ ID NO: 716934 - RNA, 22 nt, Human
cagggcagugaagaacacacgu

SEQ ID NO: 716935 - RNA, 20 nt, Human
ucaguuuaaauccuggcuuu

SEQ ID NO: 716936 - RNA, 22 nt, Human
caggcuaaagcuuugagcaugu

SEQ ID NO: 716937 - RNA, 22 nt, Human
agcugaagcaacaacaggaugg

SEQ ID NO: 716938 - RNA, 22 nt, Human
guggauggacaugggcaagagg

SEQ ID NO: 716939 - RNA, 22 nt, Human
gcucugggguuggaaagugauc

SEQ ID NO: 716940 - RNA, 22 nt, Human
uccaagaucaagguguuggcag

SEQ ID NO: 716941 - RNA, 22 nt, Human
ccucugccugcacaucauccug

SEQ ID NO: 716942 - RNA, 22 nt, Human
uaaaggaaucaguuuuagagau

SEQ ID NO: 716943 - RNA, 22 nt, Human
aauuucucgguuuugauauugu

SEQ ID NO: 716944 - RNA, 22 nt, Human
aagcccuguuaggcacugggga

SEQ ID NO: 716945 - RNA, 22 nt, Human
uggcccuggcugaguuagauuu

SEQ ID NO: 716946 - RNA, 22 nt, Human
uggcugguuuuggugagcuccg

SEQ ID NO: 716947 - RNA, 22 nt, Human
ccuugggacccugcuggagguu

SEQ ID NO: 716948 - RNA, 20 nt, Human
auguuaaauagcauuuagag

SEQ ID NO: 716949 - RNA, 22 nt, Human
auugacuuccauagcuaccugg

SEQ ID NO: 716950 - RNA, 22 nt, Human
cacagcuggugacagagcccag

SEQ ID NO: 716951 - RNA, 22 nt, Human
ggaagcugugcucucaggccuc

SEQ ID NO: 716952 - RNA, 22 nt, Human
aggcacugagaggcuguguugc

SEQ ID NO: 716953 - RNA, 22 nt, Human
uucacaguggcuuaggcuaugg

SEQ ID NO: 716954 - RNA, 23 nt, Human
acugugggcaccacagagagugu

SEQ ID NO: 716955 - RNA, 22 nt, Human
uguggacucgcauggcugaggc

SEQ ID NO: 716956 - RNA, 22 nt, Human
aggucucaaucucaggugguca

SEQ ID NO: 716957 - RNA, 22 nt, Human
acugaagcuuggguggaacuua

SEQ ID NO: 716958 - RNA, 22 nt, Human
augaggcucucaggggagcugu

SEQ ID NO: 716959 - RNA, 21 nt, Human
gguuaaaagacacaucuguuu

SEQ ID NO: 716960 - RNA, 22 nt, Human
ccacugugagcaugaacaggac

SEQ ID NO: 716961 - RNA, 21 nt, Human
uccucuccaugaucuguuugu

SEQ ID NO: 716962 - RNA, 22 nt, Human
agggccuggaacugugggcagg

SEQ ID NO: 716963 - RNA, 22 nt, Human
cagcagccuggccccuccucgg

SEQ ID NO: 716964 - RNA, 22 nt, Human
cagcacauagcaugcuugucag

SEQ ID NO: 716965 - RNA, 22 nt, Human
caagcagauauuuuagucaaga

SEQ ID NO: 716966 - RNA, 22 nt, Human
agacaggagagggaacugccgg

SEQ ID NO: 716967 - RNA, 22 nt, Human
gaguggagcaaaagagguagau

SEQ ID NO: 716968 - RNA, 22 nt, Human
gccuagggguaagaguacuggc

SEQ ID NO: 716969 - RNA, 22 nt, Human
agaccccauaccucagcaggua

SEQ ID NO: 716970 - RNA, 22 nt, Human
gucaggauuggggucaugaguc

SEQ ID NO: 716971 - RNA, 22 nt, Human
uggcucuccagagccuauggua

SEQ ID NO: 716972 - RNA, 23 nt, Human
uuuagucaguugacagccauaua

SEQ ID NO: 716973 - RNA, 22 nt, Human
ugaggguagcuggaucacggag

SEQ ID NO: 716974 - RNA, 22 nt, Human
ugcuuuuuccccuucuggcgag

SEQ ID NO: 716975 - RNA, 22 nt, Human
ucacugcagacaaccucaguca

SEQ ID NO: 716976 - RNA, 22 nt, Human
aacagcuauuagaacuucaugg

SEQ ID NO: 716977 - RNA, 22 nt, Human
acccaggagcucugggguccuc

SEQ ID NO: 716978 - RNA, 20 nt, Human
ugacaaagaguaagaggagg

SEQ ID NO: 716979 - RNA, 22 nt, Human
cugggcaccuuugcagcaggcu

SEQ ID NO: 716980 - RNA, 22 nt, Human
aucuccaguuagcaguacugau

SEQ ID NO: 716981 - RNA, 22 nt, Human
ccccagagagcaccaugaagcc

SEQ ID NO: 716982 - RNA, 22 nt, Human
cccaguguuacgugacagccug

SEQ ID NO: 716983 - RNA, 22 nt, Human
uaggccaccaggguuccauuua

SEQ ID NO: 716984 - RNA, 22 nt, Human
gcugcagacuucucaucucauu

SEQ ID NO: 716985 - RNA, 22 nt, Human
auucugcagguggaggauggca

SEQ ID NO: 716986 - RNA, 22 nt, Human
ugguccuggagaguguuccaua

SEQ ID NO: 716987 - RNA, 19 nt, Human
uguguguauuucaguucuu

SEQ ID NO: 716988 - RNA, 22 nt, Human
aucaagaguuauauuucauagu

SEQ ID NO: 716989 - RNA, 22 nt, Human
uccucagucacgguagcacauu

SEQ ID NO: 716990 - RNA, 22 nt, Human
aggcucugagucuggugucugc

SEQ ID NO: 716991 - RNA, 22 nt, Human
cagagucuggacugcaggcucc

SEQ ID NO: 716992 - RNA, 22 nt, Human
uucagcaacucaaaccuauuag

SEQ ID NO: 716993 - RNA, 22 nt, Human
agcauagaauaagcugaaguca

SEQ ID NO: 716994 - RNA, 22 nt, Human
gcaauaaaguagcagcucauca

SEQ ID NO: 716995 - RNA, 22 nt, Human
ggccaccuggguucgacugggc

SEQ ID NO: 716996 - RNA, 22 nt, Human
ucugcaacgcacugcaaaaccu

SEQ ID NO: 716997 - RNA, 22 nt, Human
uuauggaauaaccuuucugaaa

SEQ ID NO: 716998 - RNA, 22 nt, Human
aaaggccaauaaagacaagcug

SEQ ID NO: 716999 - RNA, 21 nt, Human
cucacaggaugcaguguuacu

SEQ ID NO: 717000 - RNA, 22 nt, Human
gacagcagggacauguaggaag

SEQ ID NO: 717001 - RNA, 22 nt, Human
ugcuggaggccugacuguguuu

SEQ ID NO: 717002 - RNA, 22 nt, Human
acuguggcaaaagaacauugga

SEQ ID NO: 717003 - RNA, 22 nt, Human
gcaaugauauugaagugaugaa

SEQ ID NO: 717004 - RNA, 22 nt, Human
ggccuuggguauagguggguau

SEQ ID NO: 717005 - RNA, 22 nt, Human
gcacccuguuuauccugaguuc

SEQ ID NO: 717006 - RNA, 22 nt, Human
agagccagcauuugggcccugc

SEQ ID NO: 717007 - RNA, 22 nt, Human
augugcaaauccaaugugaaug

SEQ ID NO: 717008 - RNA, 22 nt, Human
uguccugggaaugggaugcagu

SEQ ID NO: 717009 - RNA, 22 nt, Human
uuucaguuugaaggaaaggcca

SEQ ID NO: 717010 - RNA, 22 nt, Human
uggcccugccgcacuauccuca

SEQ ID NO: 717011 - RNA, 22 nt, Human
aacaauguaaucuacucugcuc

SEQ ID NO: 717012 - RNA, 22 nt, Human
uugcauugauguuccuucuugc

SEQ ID NO: 717013 - RNA, 22 nt, Human
aagagaugcuuuacaucggaug

SEQ ID NO: 717014 - RNA, 22 nt, Human
cuggguguagauggaaguuugg

SEQ ID NO: 717015 - RNA, 22 nt, Human
gggaggaaaugugcagcgaauu

SEQ ID NO: 717016 - RNA, 22 nt, Human
ggagcuguaacgagccauugcu

SEQ ID NO: 717017 - RNA, 18 nt, Human
ugcaaauggcuguuugau

SEQ ID NO: 717018 - RNA, 22 nt, Human
uugaauucauuucucauugagu

SEQ ID NO: 717019 - RNA, 19 nt, Human
ggccuugcucuguggcagc

SEQ ID NO: 717020 - RNA, 22 nt, Human
gaggucugggauggggccugaa

SEQ ID NO: 717021 - RNA, 23 nt, Human
aacauacuguuuaauauucacag

SEQ ID NO: 717022 - RNA, 22 nt, Human
agucuauuuuugguucuucggg

SEQ ID NO: 717023 - RNA, 22 nt, Human
auuucuguauccugcugucaga

SEQ ID NO: 717024 - RNA, 22 nt, Human
acagagucucagggaugaaagc

SEQ ID NO: 717025 - RNA, 22 nt, Human
uuuccacacaggcucuacuacu

SEQ ID NO: 717026 - RNA, 22 nt, Human
guacugaacuuaaaaauccccu

SEQ ID NO: 717027 - RNA, 22 nt, Human
aacauguaccuacaaucagaau

SEQ ID NO: 717028 - RNA, 22 nt, Human
aagcucagaguagcucagcguc

SEQ ID NO: 717029 - RNA, 22 nt, Human
ugauuuccccagucuugcugcu

SEQ ID NO: 717030 - RNA, 22 nt, Human
caggagacaaguuagcagcuga

SEQ ID NO: 717031 - RNA, 22 nt, Human
cagugaggugcccagccugccc

SEQ ID NO: 717032 - RNA, 22 nt, Human
agaugcauggaaaucucauuac

SEQ ID NO: 717033 - RNA, 22 nt, Human
auugauaucaguuugcugauug

SEQ ID NO: 717034 - RNA, 22 nt, Human
uaggacaggcuaaaagggauaa

SEQ ID NO: 717035 - RNA, 22 nt, Human
gagauaaauuuuugauaaauau

SEQ ID NO: 717036 - RNA, 22 nt, Human
acagaggaaggcugagcugccc

SEQ ID NO: 717037 - RNA, 22 nt, Human
uggggccagcggggaggacuca

SEQ ID NO: 717038 - RNA, 22 nt, Human
gcaaacagaaaugcaggacgcu

SEQ ID NO: 717039 - RNA, 22 nt, Human
gugcucugccuggggucauggc

SEQ ID NO: 717040 - RNA, 22 nt, Human
acaagguuuaaauagccaucag

SEQ ID NO: 717041 - RNA, 22 nt, Human
acuuauuagacaucuucauugu

SEQ ID NO: 717042 - RNA, 22 nt, Human
acauauauguaaaguacuuugu

SEQ ID NO: 717043 - RNA, 22 nt, Human
auuaggauguguauauuguguu

SEQ ID NO: 717044 - RNA, 22 nt, Human
cuggccaguguggcucugaucu

SEQ ID NO: 717045 - RNA, 22 nt, Human
gcuggcuggaggagggagguug

SEQ ID NO: 717046 - RNA, 19 nt, Human
ggcauccacagcuggagag

SEQ ID NO: 717047 - RNA, 22 nt, Human
aggucaggagguuaagagucuu

SEQ ID NO: 717048 - RNA, 22 nt, Human
ugggaagguacacgggaaagag

SEQ ID NO: 717049 - RNA, 22 nt, Human
uugcauuguaggauguuagaag

SEQ ID NO: 717050 - RNA, 22 nt, Human
augaggcaggagugcaguggca

SEQ ID NO: 717051 - RNA, 22 nt, Human
uuuguuaaaaugcagauucugu

SEQ ID NO: 717052 - RNA, 22 nt, Human
agggcugguauguccaugaaag

SEQ ID NO: 717053 - RNA, 19 nt, Human
aagcuccagcagauccuuu

SEQ ID NO: 717054 - RNA, 22 nt, Human
uagaaucaagcaguagagcaga

SEQ ID NO: 717055 - RNA, 22 nt, Human
cugcccauaaacuuuccaccug

SEQ ID NO: 717056 - RNA, 22 nt, Human
gggcuggagacaagugagccgc

SEQ ID NO: 717057 - RNA, 22 nt, Human
agcccuggaagccacaguccua

SEQ ID NO: 717058 - RNA, 22 nt, Human
uucaaagugcauguuccucaga

SEQ ID NO: 717059 - RNA, 22 nt, Human
cccugggagaaguugagggcug

SEQ ID NO: 717060 - RNA, 22 nt, Human
ccuggagcuuuuccaguugaca

SEQ ID NO: 717061 - RNA, 22 nt, Human
acugggccagaucagagcaacu

SEQ ID NO: 717062 - RNA, 22 nt, Human
gggaagagaccguacccuggcc

SEQ ID NO: 717063 - RNA, 22 nt, Human
uccaggcaaaaggaacugcuug

SEQ ID NO: 717064 - RNA, 22 nt, Human
uuuccagguaucaagcuucagg

SEQ ID NO: 717065 - RNA, 22 nt, Human
cuuguauugcaaacuggccagg

SEQ ID NO: 717066 - RNA, 17 nt, Human
uccagagaggcuucccu

SEQ ID NO: 717067 - RNA, 22 nt, Human
aaacaaacaauuaguugugugg

SEQ ID NO: 717068 - RNA, 22 nt, Human
cugggcagcuccauaccaccca

SEQ ID NO: 717069 - RNA, 22 nt, Human
cuggcucccagcuuucagggag

SEQ ID NO: 717070 - RNA, 22 nt, Human
ucuugcacuucaugaauauguu

SEQ ID NO: 717071 - RNA, 22 nt, Human
ccagauagggaugagagugcua

SEQ ID NO: 717072 - RNA, 22 nt, Human
gcucuuuguauuuuggaaucaa

SEQ ID NO: 717073 - RNA, 22 nt, Human
ccugagcuggaagagcuugugc

SEQ ID NO: 717074 - RNA, 22 nt, Human
gugcaugugcauccauguguac

SEQ ID NO: 717075 - RNA, 22 nt, Human
ugcccucuuaggucugcgcagc

SEQ ID NO: 717076 - RNA, 22 nt, Human
ugaucuuuucuauuuaugguag

SEQ ID NO: 717077 - RNA, 22 nt, Human
ggacaggguaaguacuagugug

SEQ ID NO: 717078 - RNA, 22 nt, Human
gugcuuccucugccaacacucu

SEQ ID NO: 717079 - RNA, 22 nt, Human
ugccugggguuggcaaacugcu

SEQ ID NO: 717080 - RNA, 22 nt, Human
uguaguaagugcgcaauaaaua

SEQ ID NO: 717081 - RNA, 22 nt, Human
auauucucugcugcuuuugugu

SEQ ID NO: 717082 - RNA, 18 nt, Human
uggcuucagaguaaaaug

SEQ ID NO: 717083 - RNA, 22 nt, Human
ggaugcugggagacagcaggca

SEQ ID NO: 717084 - RNA, 21 nt, Human
ccauccacugagugguucccu

SEQ ID NO: 717085 - RNA, 20 nt, Human
agcugcucucauccagaccu

SEQ ID NO: 717086 - RNA, 22 nt, Human
gcagggguagagauugcuggug

SEQ ID NO: 717087 - RNA, 22 nt, Human
caggagaaacauaauuuucugg

SEQ ID NO: 717088 - RNA, 22 nt, Human
acacuucucauuugauacuaac

SEQ ID NO: 717089 - RNA, 22 nt, Human
augcaguggcuucagugucagu

SEQ ID NO: 717090 - RNA, 22 nt, Human
agcauuugauauguuuaaaaag

SEQ ID NO: 717091 - RNA, 22 nt, Human
ggcuggaggagaauggguguga

SEQ ID NO: 717092 - RNA, 22 nt, Human
ucuagcugaggguaggagaccu

SEQ ID NO: 717093 - RNA, 22 nt, Human
accucccagcucugagcuuggg

SEQ ID NO: 717094 - RNA, 22 nt, Human
ucagucuuugcuuaugacaaua

SEQ ID NO: 717095 - RNA, 22 nt, Human
cuuagaaaucgaacucagguua

SEQ ID NO: 717096 - RNA, 18 nt, Human
uauuucccaauggaaaca

SEQ ID NO: 717097 - RNA, 22 nt, Human
gccuccugaaaggaagagcucc

SEQ ID NO: 717098 - RNA, 22 nt, Human
uuccuagaaugguuagaaaaua

SEQ ID NO: 717099 - RNA, 22 nt, Human
gauuucccuauaguuuucucuu

SEQ ID NO: 717100 - RNA, 22 nt, Human
aggcucuggcuacuacagagcu

SEQ ID NO: 717101 - RNA, 22 nt, Human
ucaagaguuggucaaauccaaa

SEQ ID NO: 717102 - RNA, 19 nt, Human
uccaggcauccuucaggcu

SEQ ID NO: 717103 - RNA, 22 nt, Human
uuuuccuuagcuucucugcgag

SEQ ID NO: 717104 - RNA, 22 nt, Human
uugcugaaguuaaugcuugcaa

SEQ ID NO: 717105 - RNA, 22 nt, Human
cagggacccgcacagguagcau

SEQ ID NO: 717106 - RNA, 22 nt, Human
aguggcauuuuaauggauguca

SEQ ID NO: 717107 - RNA, 22 nt, Human
ggcuccugggaugggacugagc

SEQ ID NO: 717108 - RNA, 22 nt, Human
ugcacacagccagugaguggca

SEQ ID NO: 717109 - RNA, 22 nt, Human
uauuaucauugguaauaugguc

SEQ ID NO: 717110 - RNA, 22 nt, Human
caucuuugcacccucaaaaccu

SEQ ID NO: 717111 - RNA, 22 nt, Human
cuggcuuucucugugguguuca

SEQ ID NO: 717112 - RNA, 22 nt, Human
uaaugcuucuguuaggaucuuc

SEQ ID NO: 717113 - RNA, 22 nt, Human
cucuccaggcugggacaggacc

SEQ ID NO: 717114 - RNA, 23 nt, Human
gccucuggagccccagugcucag

SEQ ID NO: 717115 - RNA, 22 nt, Human
ucuccaggcuuaaucucagcuu

SEQ ID NO: 717116 - RNA, 22 nt, Human
ucugccgugcgaggucccacca

SEQ ID NO: 717117 - RNA, 22 nt, Human
ccuucagccucaagauccuuca

SEQ ID NO: 717118 - RNA, 22 nt, Human
caagaugaaacuacagggagga

SEQ ID NO: 717119 - RNA, 22 nt, Human
ugcagcauuauguagcuguuuu

SEQ ID NO: 717120 - RNA, 22 nt, Human
agcacuuguagacuagaauuuu

SEQ ID NO: 717121 - RNA, 22 nt, Human
caggcuuaggagucagccugcu

SEQ ID NO: 717122 - RNA, 22 nt, Human
ugcacaaaggcucccugcugag

SEQ ID NO: 717123 - RNA, 22 nt, Human
ccacaggcugcugcaggucccg

SEQ ID NO: 717124 - RNA, 22 nt, Human
ucccugggaccggcagcucaca

SEQ ID NO: 717125 - RNA, 22 nt, Human
ucuagggagcucuagcaguggu

SEQ ID NO: 717126 - RNA, 22 nt, Human
uccaggagcauccaggugaagc

SEQ ID NO: 717127 - RNA, 22 nt, Human
uuuaaggaaaaaauguacuuag

SEQ ID NO: 717128 - RNA, 19 nt, Human
aagcagcccuggcaagagc

SEQ ID NO: 717129 - RNA, 20 nt, Human
gccagcuggucccaauuaug

SEQ ID NO: 717130 - RNA, 22 nt, Human
uuaauacaagcauaugcacaca

SEQ ID NO: 717131 - RNA, 21 nt, Human
uuugccuucacgaagcauccu

SEQ ID NO: 717132 - RNA, 22 nt, Human
gaccagcuggugaaaaccaauu

SEQ ID NO: 717133 - RNA, 22 nt, Human
ccagggcaucacauccaguguu

SEQ ID NO: 717134 - RNA, 22 nt, Human
uauuugcugacagugcuggagc

SEQ ID NO: 717135 - RNA, 22 nt, Human
cugggucucuuaccaugugacu

SEQ ID NO: 717136 - RNA, 22 nt, Human
ugcugccuuucugaauggugga

SEQ ID NO: 717137 - RNA, 22 nt, Human
agucugaaccagauggcaaggu

SEQ ID NO: 717138 - RNA, 22 nt, Human
uucuguuuauaauuugcaguug

SEQ ID NO: 717139 - RNA, 22 nt, Human
gcacagguugcaaaaguucaca

SEQ ID NO: 717140 - RNA, 22 nt, Human
cugaaauaaaguugcuaaaauu

SEQ ID NO: 717141 - RNA, 22 nt, Human
aauuaaaagauaacccaugagu

SEQ ID NO: 717142 - RNA, 22 nt, Human
cucagagucugcauuucuguca

SEQ ID NO: 717143 - RNA, 22 nt, Human
cugugcuggugaaacccacaga

SEQ ID NO: 717144 - RNA, 22 nt, Human
acagcugugaagcaagcacucu

SEQ ID NO: 717145 - RNA, 22 nt, Human
agcuggcauuacaggagcaugc

SEQ ID NO: 717146 - RNA, 22 nt, Human
aguaaacauagaauguucuucc

SEQ ID NO: 717147 - RNA, 22 nt, Human
gcacagcacagcaacauguuuu

SEQ ID NO: 717148 - RNA, 22 nt, Human
ccagcagagugggguuuagagu

SEQ ID NO: 717149 - RNA, 22 nt, Human
cucccucucuaaggcaaagaga

SEQ ID NO: 717150 - RNA, 22 nt, Human
guguuuagugugcagacaugca

SEQ ID NO: 717151 - RNA, 22 nt, Human
ccagggcauguaacuaauggug

SEQ ID NO: 717152 - RNA, 22 nt, Human
uaggaagagcuauaggucccca

SEQ ID NO: 717153 - RNA, 22 nt, Human
gaggcagcggcucacagagaaa

SEQ ID NO: 717154 - RNA, 20 nt, Human
auguucuucauuuaauguuc

SEQ ID NO: 717155 - RNA, 17 nt, Human
aggucugagaguaucug

SEQ ID NO: 717156 - RNA, 22 nt, Human
aaacuguauuccauccucauca

SEQ ID NO: 717157 - RNA, 22 nt, Human
gacaucuggaggagaugaaugg

SEQ ID NO: 717158 - RNA, 22 nt, Human
aauuauauguuaaucuucaauu

SEQ ID NO: 717159 - RNA, 22 nt, Human
cuggcagcgguuugcagccugg

SEQ ID NO: 717160 - RNA, 22 nt, Human
cuuauucuacuccacaagcucu

SEQ ID NO: 717161 - RNA, 22 nt, Human
ucaggagacuuaugucacagug

SEQ ID NO: 717162 - RNA, 22 nt, Human
uaaggcaggacuggauagcuau

SEQ ID NO: 717163 - RNA, 22 nt, Human
caagcuuguuucuccugggggu

SEQ ID NO: 717164 - RNA, 22 nt, Human
uacaguagaauuuuuaguaacu

SEQ ID NO: 717165 - RNA, 22 nt, Human
accucuggccuucaggcaucau

SEQ ID NO: 717166 - RNA, 22 nt, Human
ggcagcaaguggugggagacuu

SEQ ID NO: 717167 - RNA, 22 nt, Human
ucaguguggaaaauccuuuggc

SEQ ID NO: 717168 - RNA, 18 nt, Human
ucagcuggguuucugggu

SEQ ID NO: 717169 - RNA, 22 nt, Human
cagacagcugcuuucuugcugu

SEQ ID NO: 717170 - RNA, 22 nt, Human
agucuucacucuucacuacuau

SEQ ID NO: 717171 - RNA, 22 nt, Human
gccagagaaugaaaaucagauu

SEQ ID NO: 717172 - RNA, 22 nt, Human
agcugguucauucauucauggu

SEQ ID NO: 717173 - RNA, 22 nt, Human
cauucacaauggauugcuucaa

SEQ ID NO: 717174 - RNA, 21 nt, Human
aaggccugcuuacugcuaguu

SEQ ID NO: 717175 - RNA, 22 nt, Human
gggugggguguaucggauccua

SEQ ID NO: 717176 - RNA, 19 nt, Human
ccuguacauuauucucccc

SEQ ID NO: 717177 - RNA, 22 nt, Human
auggaugaguccuugagacaca

SEQ ID NO: 717178 - RNA, 22 nt, Human
ggcgccagcccaggccgucgug

SEQ ID NO: 717179 - RNA, 17 nt, Human
cuuuuaauuuacuuccc

SEQ ID NO: 717180 - RNA, 22 nt, Human
ucaaggaagucuuauugcacag

SEQ ID NO: 717181 - RNA, 22 nt, Human
agacacuggugaagaaaucagg

SEQ ID NO: 717182 - RNA, 22 nt, Human
auuuuugagcugugaacauagc

SEQ ID NO: 717183 - RNA, 22 nt, Human
uauaggaaacauacgugacuag

SEQ ID NO: 717184 - RNA, 22 nt, Human
uucugagggcuaauguacugua

SEQ ID NO: 717185 - RNA, 22 nt, Human
aagacauuguggagauguugcu

SEQ ID NO: 717186 - RNA, 22 nt, Human
aguuagaauauaauuauguuaa

SEQ ID NO: 717187 - RNA, 20 nt, Human
agcuccugaggguuacuuuc

SEQ ID NO: 717188 - RNA, 22 nt, Human
uguguuuauaguguaucuucca

SEQ ID NO: 717189 - RNA, 22 nt, Human
auuuccaugccuuagcuuaagg

SEQ ID NO: 717190 - RNA, 22 nt, Human
ccaaauaauauuucagaaccau

SEQ ID NO: 717191 - RNA, 22 nt, Human
agccaggcuacuccuugcugac

SEQ ID NO: 717192 - RNA, 22 nt, Human
gccaggaugacuauacaacagc

SEQ ID NO: 717193 - RNA, 22 nt, Human
cagagcagugggguuggucaga

SEQ ID NO: 717194 - RNA, 22 nt, Human
uuuuaguuguacugucaacagu

SEQ ID NO: 717195 - RNA, 22 nt, Human
aauugcuuguuucuuuaacuga

SEQ ID NO: 717196 - RNA, 22 nt, Human
gucaauaauuuuauggagagaa

SEQ ID NO: 717197 - RNA, 22 nt, Human
ugcaggcuggauuugcuuuugu

SEQ ID NO: 717198 - RNA, 22 nt, Human
uuuccugccuggaccucugcuu

SEQ ID NO: 717199 - RNA, 22 nt, Human
cuagagcuguucugugcacuca

SEQ ID NO: 717200 - RNA, 22 nt, Human
uuguggaaauacagacuccaag

SEQ ID NO: 717201 - RNA, 23 nt, Human
ugggauggauucaccagugugcu

SEQ ID NO: 717202 - RNA, 22 nt, Human
aguuuuucugcuggucucacua

SEQ ID NO: 717203 - RNA, 22 nt, Human
acaauacuuaccaauguuuuug

SEQ ID NO: 717204 - RNA, 22 nt, Human
gaaaauacaaauagccuugaaa

SEQ ID NO: 717205 - RNA, 22 nt, Human
uugcugauucaugauuugagaa

SEQ ID NO: 717206 - RNA, 22 nt, Human
accuggagcuuccaacucaacu

SEQ ID NO: 717207 - RNA, 22 nt, Human
ggauugagagcacugguagcug

SEQ ID NO: 717208 - RNA, 18 nt, Human
gaggaucagaaaucugua

SEQ ID NO: 717209 - RNA, 22 nt, Human
uguagcucuccagccagcaagg

SEQ ID NO: 717210 - RNA, 22 nt, Human
ggucugccacaagauuuuugag

SEQ ID NO: 717211 - RNA, 22 nt, Human
gcuuuuuuagguaagacccagg

SEQ ID NO: 717212 - RNA, 22 nt, Human
aagauuuucucaacuguauuug

SEQ ID NO: 717213 - RNA, 23 nt, Human
ucuucaugcccaggccuuggugc

SEQ ID NO: 717214 - RNA, 22 nt, Human
cucccaggacucagaggagaag

SEQ ID NO: 717215 - RNA, 22 nt, Human
aucuucaguuuucagugagcca

SEQ ID NO: 717216 - RNA, 20 nt, Human
ggguggaguugcggucugug

SEQ ID NO: 717217 - RNA, 22 nt, Human
augagucacucagcagaaaagg

SEQ ID NO: 717218 - RNA, 22 nt, Human
acucagagugcaucuccuauuu

SEQ ID NO: 717219 - RNA, 22 nt, Human
gggauaggaaacuuagguacac

SEQ ID NO: 717220 - RNA, 22 nt, Human
uguguauauguaaauauaguug

SEQ ID NO: 717221 - RNA, 22 nt, Human
uuaugcaaggacuuauuacagu

SEQ ID NO: 717222 - RNA, 22 nt, Human
aguucucauugcaugagacaga

SEQ ID NO: 717223 - RNA, 22 nt, Human
ugggugagcggcugcacacccg

SEQ ID NO: 717224 - RNA, 19 nt, Human
gucccugggcagaggcacc

SEQ ID NO: 717225 - RNA, 22 nt, Human
uucuuagugguagucaucuuug

SEQ ID NO: 717226 - RNA, 22 nt, Human
aagcacagguugaggauuauuc

SEQ ID NO: 717227 - RNA, 22 nt, Human
ugccuacccugcccgcagacac

SEQ ID NO: 717228 - RNA, 17 nt, Human
uggcuucccugggccac

SEQ ID NO: 717229 - RNA, 23 nt, Human
augaggucagccauaagacggaa

SEQ ID NO: 717230 - RNA, 22 nt, Human
gacuucaaaagcugacauucau

SEQ ID NO: 717231 - RNA, 22 nt, Human
ucuucagauggccaguuguccc

SEQ ID NO: 717232 - RNA, 22 nt, Human
cucagccagugaucuuuccuuu

SEQ ID NO: 717233 - RNA, 22 nt, Human
acugucugcccugagaugccag

SEQ ID NO: 717234 - RNA, 22 nt, Human
aguauuuagagacacaagacgg

SEQ ID NO: 717235 - RNA, 22 nt, Human
cugugucucauccgccucuggc

SEQ ID NO: 717236 - RNA, 22 nt, Human
auuaauguguagccaacuuaau

SEQ ID NO: 717237 - RNA, 17 nt, Human
caguccucugcucuaag

SEQ ID NO: 717238 - RNA, 22 nt, Human
aaaaguaauugcaauuuuguag

SEQ ID NO: 717239 - RNA, 22 nt, Human
ugugucugcccuuaguacaucu

SEQ ID NO: 717240 - RNA, 22 nt, Human
ucccaccaggugaccauuucau

SEQ ID NO: 717241 - RNA, 22 nt, Human
uuauuguggacuacuguucugg

SEQ ID NO: 717242 - RNA, 22 nt, Human
cagccagugguugaagaugcag

SEQ ID NO: 717243 - RNA, 22 nt, Human
ucaagcaacagaacugugagac

SEQ ID NO: 717244 - RNA, 22 nt, Human
gaacaguauuuccaggaauccc

SEQ ID NO: 717245 - RNA, 22 nt, Human
uccaggaguggggcagaggucu

SEQ ID NO: 717246 - RNA, 22 nt, Human
caguggcaaugggacagagcac

SEQ ID NO: 717247 - RNA, 21 nt, Human
ucucugggcccuccugugggg

SEQ ID NO: 717248 - RNA, 22 nt, Human
ugcagggcuuccucuuggaguu

SEQ ID NO: 717249 - RNA, 22 nt, Human
acccugaagaaacuucuaagug

SEQ ID NO: 717250 - RNA, 20 nt, Human
gugaagggagucaggugugc

SEQ ID NO: 717251 - RNA, 22 nt, Human
ugacagugcggguacaucauag

SEQ ID NO: 717252 - RNA, 22 nt, Human
uggcucauggaauuagcuauua

SEQ ID NO: 717253 - RNA, 22 nt, Human
ccaggacagugaacauguaaga

SEQ ID NO: 717254 - RNA, 22 nt, Human
cuccugggcugggaacucagcc

SEQ ID NO: 717255 - RNA, 22 nt, Human
uggcuuccuggacagaugcggu

SEQ ID NO: 717256 - RNA, 22 nt, Human
agauauggccucauacagacau

SEQ ID NO: 717257 - RNA, 22 nt, Human
gucacuuucacacuuuauugcu

SEQ ID NO: 717258 - RNA, 22 nt, Human
ggagcugcuuugaucugaagaa

SEQ ID NO: 717259 - RNA, 22 nt, Human
cuugcugggguaagucugugcu

SEQ ID NO: 717260 - RNA, 22 nt, Human
guggcagaggcugugaggaugc

SEQ ID NO: 717261 - RNA, 22 nt, Human
uuccuucuaauuuuacaccuga

SEQ ID NO: 717262 - RNA, 22 nt, Human
ugggacucacucuuuuggccag

SEQ ID NO: 717263 - RNA, 22 nt, Human
aauucacaguucugcaccuuac

SEQ ID NO: 717264 - RNA, 22 nt, Human
aauguacaucucaguguaguac

SEQ ID NO: 717265 - RNA, 22 nt, Human
gcuuugcaggaaaccagugcau

SEQ ID NO: 717266 - RNA, 22 nt, Human
uggguccuggaaggcgacaggu

SEQ ID NO: 717267 - RNA, 22 nt, Human
uggcagcaaaaccagaaucaga

SEQ ID NO: 717268 - RNA, 22 nt, Human
cccagcucuuuuagcggcaucu

SEQ ID NO: 717269 - RNA, 22 nt, Human
ugggcucuagacuuuagugugg

SEQ ID NO: 717270 - RNA, 22 nt, Human
auaacuucagggcugugacaga

SEQ ID NO: 717271 - RNA, 18 nt, Human
ccugucugggguccccac

SEQ ID NO: 717272 - RNA, 22 nt, Human
gcuccaggaagggaaaucucca

SEQ ID NO: 717273 - RNA, 22 nt, Human
aagauguugggugccuccggaa

SEQ ID NO: 717274 - RNA, 22 nt, Human
ccagcaucuaugugcuguugau

SEQ ID NO: 717275 - RNA, 22 nt, Human
uagugucucuuccuguuugaaa

SEQ ID NO: 717276 - RNA, 22 nt, Human
ggcugugcuuuguuagguuguc

SEQ ID NO: 717277 - RNA, 22 nt, Human
auuuaugacaaccaaagaguga

SEQ ID NO: 717278 - RNA, 20 nt, Human
ccaaggauuggcaagcagca

SEQ ID NO: 717279 - RNA, 22 nt, Human
cgcgcugcagacagcggaggcc

SEQ ID NO: 717280 - RNA, 19 nt, Human
uucuccaggcugcagaggg

SEQ ID NO: 717281 - RNA, 22 nt, Human
cuguccaccuuugauaggcucu

SEQ ID NO: 717282 - RNA, 20 nt, Human
agaaucugacccagagagac

SEQ ID NO: 717283 - RNA, 20 nt, Human
aggguucccuuguucagcag

SEQ ID NO: 717284 - RNA, 16 nt, Human
gcaggaguaccacuug

SEQ ID NO: 717285 - RNA, 22 nt, Human
aaagacuuucaccuagcaaaga

SEQ ID NO: 717286 - RNA, 22 nt, Human
ucagcaggcgguuccuuguggg

SEQ ID NO: 717287 - RNA, 22 nt, Human
auaugcauuuaccuggcauaua

SEQ ID NO: 717288 - RNA, 22 nt, Human
aaauucagcauccugcacugga

SEQ ID NO: 717289 - RNA, 22 nt, Human
ucugaaauuguuaguaaaaaug

SEQ ID NO: 717290 - RNA, 22 nt, Human
gcaggggaguggcaggcccgga

SEQ ID NO: 717291 - RNA, 22 nt, Human
ccagaggagcauggccuugaga

SEQ ID NO: 717292 - RNA, 22 nt, Human
cauuuacuguugaaucccuagc

SEQ ID NO: 717293 - RNA, 22 nt, Human
auuuccagcagcauauuugucu

SEQ ID NO: 717294 - RNA, 19 nt, Human
ccagcccauaguccaucac

SEQ ID NO: 717295 - RNA, 22 nt, Human
acuuuguuuccauauuuguagc

SEQ ID NO: 717296 - RNA, 22 nt, Human
uuucuucuugaguaaccagauu

SEQ ID NO: 717297 - RNA, 22 nt, Human
aggggagcgacauuccgugccg

SEQ ID NO: 717298 - RNA, 18 nt, Human
ugagaggcuauuuuuugc

SEQ ID NO: 717299 - RNA, 22 nt, Human
aucuaagauguauugagcacuu

SEQ ID NO: 717300 - RNA, 22 nt, Human
cugggggcaauggucagagugu

SEQ ID NO: 717301 - RNA, 22 nt, Human
gugucccagccccacaggccug

SEQ ID NO: 717302 - RNA, 22 nt, Human
agaggcugagaaacccucuucu

SEQ ID NO: 717303 - RNA, 22 nt, Human
ugcaggugccucuugagcuugu

SEQ ID NO: 717304 - RNA, 22 nt, Human
aagucugaucauuucuucuaua

SEQ ID NO: 717305 - RNA, 22 nt, Human
augccacuguacucaacaauag

SEQ ID NO: 717306 - RNA, 22 nt, Human
uacauuguacuuacaaauagug

SEQ ID NO: 717307 - RNA, 22 nt, Human
agcauuugaaaacuauuuaauu

SEQ ID NO: 717308 - RNA, 22 nt, Human
auucugaguuagagucagccag

SEQ ID NO: 717309 - RNA, 22 nt, Human
cuugagaaucuucucugaagag

SEQ ID NO: 717310 - RNA, 22 nt, Human
caggcacaaaaggaccccagca

SEQ ID NO: 717311 - RNA, 22 nt, Human
aaacauugaugggaaguuuaau

SEQ ID NO: 717312 - RNA, 22 nt, Human
gcuguucauagaaauggucuca

SEQ ID NO: 717313 - RNA, 22 nt, Human
agaaaggguucucugaggugcu

SEQ ID NO: 717314 - RNA, 22 nt, Human
agcaugaaaacaugaaacagca

SEQ ID NO: 717315 - RNA, 22 nt, Human
acagggcuuagaaaucuguugc

SEQ ID NO: 717316 - RNA, 20 nt, Human
aaguuggcuccuccuagcaa

SEQ ID NO: 717317 - RNA, 22 nt, Human
ccaccccaaaugaagaccucuc

SEQ ID NO: 717318 - RNA, 22 nt, Human
cagcaggcagccauuucacugu

SEQ ID NO: 717319 - RNA, 22 nt, Human
uucugcuaccuuucuguaccuu

SEQ ID NO: 717320 - RNA, 22 nt, Human
aaauuccagaaacucaguauau

SEQ ID NO: 717321 - RNA, 22 nt, Human
ucuggaagaacggggcaugcug

SEQ ID NO: 717322 - RNA, 22 nt, Human
guggagaggagcagcuaccuca

SEQ ID NO: 717323 - RNA, 22 nt, Human
aaacugcaggucaugacccauu

SEQ ID NO: 717324 - RNA, 22 nt, Human
caggguuucuguugagaagucc

SEQ ID NO: 717325 - RNA, 22 nt, Human
aagacugaguucaaaucacagc

SEQ ID NO: 717326 - RNA, 18 nt, Human
auguggcuagugcuacug

SEQ ID NO: 717327 - RNA, 22 nt, Human
uagagucuaguguauacaaagu

SEQ ID NO: 717328 - RNA, 22 nt, Human
uggaaauguauuugggcaugcc

SEQ ID NO: 717329 - RNA, 22 nt, Human
uccauguguuuuccuguccaca

SEQ ID NO: 717330 - RNA, 22 nt, Human
ucuugcuaggagcuauggaaga

SEQ ID NO: 717331 - RNA, 22 nt, Human
auccaggcugcuaugaggauga

SEQ ID NO: 717332 - RNA, 22 nt, Human
uuauuauguggaugaaagaugu

SEQ ID NO: 717333 - RNA, 22 nt, Human
cuucagaauccagaaucagaau

SEQ ID NO: 717334 - RNA, 22 nt, Human
ccugggccuggcgggucggcuc

SEQ ID NO: 717335 - RNA, 22 nt, Human
aacaaaguuucaggaagauaga

SEQ ID NO: 717336 - RNA, 19 nt, Human
uccaugcccaggcaccaag

SEQ ID NO: 717337 - RNA, 22 nt, Human
ugagaacggauacuaagggcug

SEQ ID NO: 717338 - RNA, 22 nt, Human
uauaaccuuuucuuuauccucc

SEQ ID NO: 717339 - RNA, 22 nt, Human
ugcagaaauucagaaagcauaa

SEQ ID NO: 717340 - RNA, 22 nt, Human
caugcagugguaaaaagucagg

SEQ ID NO: 717341 - RNA, 22 nt, Human
auuuaucaccaguuagcugacu

SEQ ID NO: 717342 - RNA, 22 nt, Human
gcccaggaggucaaguagcuau

SEQ ID NO: 717343 - RNA, 22 nt, Human
caggacugauguuccuccagcc

SEQ ID NO: 717344 - RNA, 22 nt, Human
cuacauuucccagcugccuucc

SEQ ID NO: 717345 - RNA, 22 nt, Human
gugcccaggcccaaggcaccac

SEQ ID NO: 717346 - RNA, 22 nt, Human
agugggaccggugcuauuccag

SEQ ID NO: 717347 - RNA, 22 nt, Human
aaucauaauuguauacauucau

SEQ ID NO: 717348 - RNA, 22 nt, Human
aggcagaggaaggguggauuug

SEQ ID NO: 717349 - RNA, 22 nt, Human
cagcacauaguagguauucacu

SEQ ID NO: 717350 - RNA, 22 nt, Human
auggcccugccaggaggaacaa

SEQ ID NO: 717351 - RNA, 22 nt, Human
uaaaacaccuguagugucugcc

SEQ ID NO: 717352 - RNA, 23 nt, Human
uucagacugccuucagcauuguc

SEQ ID NO: 717353 - RNA, 22 nt, Human
gaagaacaccugcugcccagug

SEQ ID NO: 717354 - RNA, 22 nt, Human
auguugcacaaaguccauccau

SEQ ID NO: 717355 - RNA, 22 nt, Human
gagcacaggcugcugugaacug

SEQ ID NO: 717356 - RNA, 22 nt, Human
aagcagguuaugaaauauagaa

SEQ ID NO: 717357 - RNA, 22 nt, Human
cagcccucucugggccccaagg

SEQ ID NO: 717358 - RNA, 22 nt, Human
gucauugcaguggcaaaucaca

SEQ ID NO: 717359 - RNA, 22 nt, Human
ucuucacauucacguaacauag

SEQ ID NO: 717360 - RNA, 19 nt, Human
caguaucauugcacauagu

SEQ ID NO: 717361 - RNA, 22 nt, Human
aaaaaugaauucuucaguggca

SEQ ID NO: 717362 - RNA, 22 nt, Human
ucuuuaagaguucauuugcaug

SEQ ID NO: 717363 - RNA, 22 nt, Human
uuuaauauccaguggauacaaa

SEQ ID NO: 717364 - RNA, 22 nt, Human
gcugucucgccugacacuggcu

SEQ ID NO: 717365 - RNA, 22 nt, Human
gggauggaggguagagcaagug

SEQ ID NO: 717366 - RNA, 22 nt, Human
cagccagaucagggcagggguu

SEQ ID NO: 717367 - RNA, 22 nt, Human
gaacuaaaugaaauuacuggug

SEQ ID NO: 717368 - RNA, 22 nt, Human
uacuguguugugcugaaaggga

SEQ ID NO: 717369 - RNA, 22 nt, Human
aacucuacuugggacuccucug

SEQ ID NO: 717370 - RNA, 22 nt, Human
gucugagcgcuggagcuugugu

SEQ ID NO: 717371 - RNA, 22 nt, Human
uagaacucuggucuucucaucc

SEQ ID NO: 717372 - RNA, 22 nt, Human
uggcacugaagcuggaaagccu

SEQ ID NO: 717373 - RNA, 23 nt, Human
cagucugcagcccacuugggcag

SEQ ID NO: 717374 - RNA, 22 nt, Human
cccucacuguccuugggcccuu

SEQ ID NO: 717375 - RNA, 22 nt, Human
ccagcuccaggacugggagcug

SEQ ID NO: 717376 - RNA, 22 nt, Human
cuggcccagagagcagagcuua

SEQ ID NO: 717377 - RNA, 22 nt, Human
gcugagucagauugcagucuug

SEQ ID NO: 717378 - RNA, 19 nt, Human
ucucagaauuggcaaucau

SEQ ID NO: 717379 - RNA, 22 nt, Human
ucugcugcagcaggauucucug

SEQ ID NO: 717380 - RNA, 22 nt, Human
uucuuuucuuuaggcauugugu

SEQ ID NO: 717381 - RNA, 23 nt, Human
ggauaaaucucagcuucuuccau

SEQ ID NO: 717382 - RNA, 22 nt, Human
gcauaauauacaugcuugaucc

SEQ ID NO: 717383 - RNA, 22 nt, Human
agugggaggcggcugacgggcg

SEQ ID NO: 717384 - RNA, 21 nt, Human
cuguccucagauguggacgag

SEQ ID NO: 717385 - RNA, 22 nt, Human
agcaagacucagcaggauacca

SEQ ID NO: 717386 - RNA, 22 nt, Human
gccuuugcugugacaaugcugg

SEQ ID NO: 717387 - RNA, 22 nt, Human
aucuucaacuugaucauuugaa

SEQ ID NO: 717388 - RNA, 22 nt, Human
accaggaggccuggagcacaaa

SEQ ID NO: 717389 - RNA, 22 nt, Human
aaagguuuauugcuaugguugu

SEQ ID NO: 717390 - RNA, 21 nt, Human
uuacuuuugcaccaaccuaau

SEQ ID NO: 717391 - RNA, 22 nt, Human
ccagagucaggagcucauguga

SEQ ID NO: 717392 - RNA, 22 nt, Human
ucaggcaggcucagaggaaaac

SEQ ID NO: 717393 - RNA, 22 nt, Human
aacaagaagggaaggcaugauu

SEQ ID NO: 717394 - RNA, 22 nt, Human
gcuccucuauuccccacauuuu

SEQ ID NO: 717395 - RNA, 22 nt, Human
uuauuuagucuagaugaauuuu

SEQ ID NO: 717396 - RNA, 22 nt, Human
uggacaacugguuuuugacaaa

SEQ ID NO: 717397 - RNA, 22 nt, Human
uagggcugccauuugcuuuucu

SEQ ID NO: 717398 - RNA, 21 nt, Human
cuugucuugcuuagaauagac

SEQ ID NO: 717399 - RNA, 22 nt, Human
uuaaaagagcagcccagcauau

SEQ ID NO: 717400 - RNA, 22 nt, Human
uucaugcacuauuucuucuagc

SEQ ID NO: 717401 - RNA, 22 nt, Human
ucaggaaaguguucucagagga

SEQ ID NO: 717402 - RNA, 22 nt, Human
uuaaagaggcaugggaauguau

SEQ ID NO: 717403 - RNA, 22 nt, Human
aguggcuuggcugcacuacagg

SEQ ID NO: 717404 - RNA, 22 nt, Human
ugggcuuugagcucggucaccu

SEQ ID NO: 717405 - RNA, 22 nt, Human
aguuuuauguucacagaaggau

SEQ ID NO: 717406 - RNA, 22 nt, Human
ucaauuacuaaccaaauaaugu

SEQ ID NO: 717407 - RNA, 19 nt, Human
gaucagagugucagcuugu

SEQ ID NO: 717408 - RNA, 22 nt, Human
aaaaguaauugcaguuuuguca

SEQ ID NO: 717409 - RNA, 22 nt, Human
agccaggcuaaaugagccauga

SEQ ID NO: 717410 - RNA, 22 nt, Human
ggagcccugcccuaggcagcuc

SEQ ID NO: 717411 - RNA, 22 nt, Human
ugcuguguuccucaguuucaug

SEQ ID NO: 717412 - RNA, 22 nt, Human
aucacauuacaaaggacuccag

SEQ ID NO: 717413 - RNA, 22 nt, Human
aagauucuugacuagaaugauu

SEQ ID NO: 717414 - RNA, 22 nt, Human
aagaagcauucuuucauugguu

SEQ ID NO: 717415 - RNA, 22 nt, Human
cgcgcucauuuccgccuccuuc

SEQ ID NO: 717416 - RNA, 22 nt, Human
aggggcaaaugugagccuggaa

SEQ ID NO: 717417 - RNA, 20 nt, Human
gcuugcuuugucugaugggc

SEQ ID NO: 717418 - RNA, 22 nt, Human
uaaagucagggagauugaggcu

SEQ ID NO: 717419 - RNA, 22 nt, Human
aagagcagccuccaggggugga

SEQ ID NO: 717420 - RNA, 23 nt, Human
uggggccaagugaggaagggucu

SEQ ID NO: 717421 - RNA, 22 nt, Human
gagguacaugaggauacacagg

SEQ ID NO: 717422 - RNA, 22 nt, Human
uaguuucugguucuugcucugg

SEQ ID NO: 717423 - RNA, 22 nt, Human
uaugcacauucacacaaaaaug

SEQ ID NO: 717424 - RNA, 22 nt, Human
uggcuucugggacuugugagca

SEQ ID NO: 717425 - RNA, 22 nt, Human
gaguuguucaacgugugugaaa

SEQ ID NO: 717426 - RNA, 22 nt, Human
ugucuucgcuacaaugaaaagg

SEQ ID NO: 717427 - RNA, 22 nt, Human
uaugaaggauacaccucugauu

SEQ ID NO: 717428 - RNA, 22 nt, Human
aaauugucucuauuuugauucg

SEQ ID NO: 717429 - RNA, 20 nt, Human
gcuguggccgugccagacuc

SEQ ID NO: 717430 - RNA, 22 nt, Human
gaggaaggauuuaguuugaggg

SEQ ID NO: 717431 - RNA, 22 nt, Human
acugcugugaucugauguaauu

SEQ ID NO: 717432 - RNA, 22 nt, Human
aguauugugacucaaguauucu

SEQ ID NO: 717433 - RNA, 22 nt, Human
gaucuugagcaaguuguguaac

SEQ ID NO: 717434 - RNA, 22 nt, Human
uaaugacauuguauccacagag

SEQ ID NO: 717435 - RNA, 22 nt, Human
cucugagcagaggccguggcua

SEQ ID NO: 717436 - RNA, 22 nt, Human
acaugugcagacagcaagcagg

SEQ ID NO: 717437 - RNA, 22 nt, Human
aucuguaaaugcaaauguagcu

SEQ ID NO: 717438 - RNA, 22 nt, Human
cucagaguggggcucccugagg

SEQ ID NO: 717439 - RNA, 22 nt, Human
ggcggccugugggucggccuca

SEQ ID NO: 717440 - RNA, 22 nt, Human
aagcauuugugaaauucagaug

SEQ ID NO: 717441 - RNA, 22 nt, Human
cccgggagguggagacugcagu

SEQ ID NO: 717442 - RNA, 22 nt, Human
agaagugcuccagugaguuggg

SEQ ID NO: 717443 - RNA, 22 nt, Human
cccaguaaucggagaguacuua

SEQ ID NO: 717444 - RNA, 22 nt, Human
uguggaugagggagugaacaaa

SEQ ID NO: 717445 - RNA, 22 nt, Human
cugagaguauuggcaggcuugg

SEQ ID NO: 717446 - RNA, 22 nt, Human
ugccugcucuugagacuuacaa

SEQ ID NO: 717447 - RNA, 22 nt, Human
uuccacucuccagucaauuuca

SEQ ID NO: 717448 - RNA, 22 nt, Human
auuuaagacugacuucaccagu

SEQ ID NO: 717449 - RNA, 22 nt, Human
agacaauacauuuauucccuuu

SEQ ID NO: 717450 - RNA, 22 nt, Human
guucauucugaaaagcagcuug

SEQ ID NO: 717451 - RNA, 22 nt, Human
cagcuuccaucuccacugcccu

SEQ ID NO: 717452 - RNA, 22 nt, Human
gcuaaaucuccuacaaugcaca

SEQ ID NO: 717453 - RNA, 20 nt, Human
acuguuggaaguggagaaug

SEQ ID NO: 717454 - RNA, 23 nt, Human
aaauaugucugagggcaaagaau

SEQ ID NO: 717455 - RNA, 22 nt, Human
cuuucaaugugccugccuuggg

SEQ ID NO: 717456 - RNA, 22 nt, Human
uuuuaaaucuccaguugacccc

SEQ ID NO: 717457 - RNA, 22 nt, Human
aggucugccucacucacuucug

SEQ ID NO: 717458 - RNA, 19 nt, Human
gggugaggaagagcguugc

SEQ ID NO: 717459 - RNA, 22 nt, Human
aagguagauguugucaugccca

SEQ ID NO: 717460 - RNA, 22 nt, Human
uacaccugcugagccuguccuc

SEQ ID NO: 717461 - RNA, 22 nt, Human
ucugucugcaccuaagcacagu

SEQ ID NO: 717462 - RNA, 22 nt, Human
auuagaaugcaggguucauugu

SEQ ID NO: 717463 - RNA, 22 nt, Human
ucucacacuaaugcucuaucag

SEQ ID NO: 717464 - RNA, 19 nt, Human
ucaguggaugaacauguuu

SEQ ID NO: 717465 - RNA, 22 nt, Human
gccucuguggcucagccuugcu

SEQ ID NO: 717466 - RNA, 21 nt, Human
ucagcagcaucugccuagagu

SEQ ID NO: 717467 - RNA, 22 nt, Human
cagggugccaaagaacaaauau

SEQ ID NO: 717468 - RNA, 22 nt, Human
agagcuagaaggaagcauuucu

SEQ ID NO: 717469 - RNA, 22 nt, Human
auucugggcgccuauggcugca

SEQ ID NO: 717470 - RNA, 22 nt, Human
cacugcucgcugcagcauggcc

SEQ ID NO: 717471 - RNA, 22 nt, Human
cgcaggcuggcgcggaguggca

SEQ ID NO: 717472 - RNA, 22 nt, Human
cagaaacuauguaagaaaguga

SEQ ID NO: 717473 - RNA, 22 nt, Human
agggucagggagugaguauuua

SEQ ID NO: 717474 - RNA, 22 nt, Human
ccaguguuugaugggauuuuca

SEQ ID NO: 717475 - RNA, 22 nt, Human
ggcagggagagcaugcugauaa

SEQ ID NO: 717476 - RNA, 22 nt, Human
cuguuaaucugcuugcaugaug

SEQ ID NO: 717477 - RNA, 22 nt, Human
uguuuauaauaugcagugagca

SEQ ID NO: 717478 - RNA, 21 nt, Human
gugugaguagcaugugucuca

SEQ ID NO: 717479 - RNA, 22 nt, Human
uccugcacaccuugagcuugga

SEQ ID NO: 717480 - RNA, 22 nt, Human
ucaccacugaacagaccuuugg

SEQ ID NO: 717481 - RNA, 22 nt, Human
ugugaggaacccggaauguggg

SEQ ID NO: 717482 - RNA, 22 nt, Human
ggcuggagaagggugguugaca

SEQ ID NO: 717483 - RNA, 22 nt, Human
ggcuggucccggguccuccggc

SEQ ID NO: 717484 - RNA, 22 nt, Human
aauauccauugggagcaaaugg

SEQ ID NO: 717485 - RNA, 22 nt, Human
cuccaaauacaauauuguuguu

SEQ ID NO: 717486 - RNA, 22 nt, Human
uuccaauuguucuuuggaaucu

SEQ ID NO: 717487 - RNA, 22 nt, Human
ucacugucugaaagaaauggcc

SEQ ID NO: 717488 - RNA, 22 nt, Human
gguuuauugaaggccaccccac

SEQ ID NO: 717489 - RNA, 22 nt, Human
cugucuuuucauacuuucccuc

SEQ ID NO: 717490 - RNA, 22 nt, Human
cgcggcgcgcccccgggugugu

SEQ ID NO: 717491 - RNA, 22 nt, Human
guacauuucucuuguucuuauu

SEQ ID NO: 717492 - RNA, 22 nt, Human
ggcagcauauauucagugggca

SEQ ID NO: 717493 - RNA, 22 nt, Human
uuuagacacacuuuguauauuu

SEQ ID NO: 717494 - RNA, 22 nt, Human
caaaugcaggucauaaccugag

SEQ ID NO: 717495 - RNA, 23 nt, Human
cucagggauagaaaggaagacag

SEQ ID NO: 717496 - RNA, 22 nt, Human
uccaagcuacugaagguuuggg

SEQ ID NO: 717497 - RNA, 22 nt, Human
gugugcugcccaacucgcagau

SEQ ID NO: 717498 - RNA, 22 nt, Human
gacacaugucagacggacaccc

SEQ ID NO: 717499 - RNA, 22 nt, Human
cgcagggccgcgagcgggacca

SEQ ID NO: 717500 - RNA, 22 nt, Human
ucaggaaggcgccccaucagga

SEQ ID NO: 717501 - RNA, 22 nt, Human
aggaccugagaguuggaaaucc

SEQ ID NO: 717502 - RNA, 22 nt, Human
aguaaaauuguauuggaaaaca

SEQ ID NO: 717503 - RNA, 22 nt, Human
uggacagcgaaagugccuggga

SEQ ID NO: 717504 - RNA, 22 nt, Human
gagcugugauuggugucucacu

SEQ ID NO: 717505 - RNA, 22 nt, Human
acuugauuuuuauaauaaaugg

SEQ ID NO: 717506 - RNA, 22 nt, Human
ugaaccaggaggcagccagcac

SEQ ID NO: 717507 - RNA, 22 nt, Human
uagaaacaugagagaaacucuu

SEQ ID NO: 717508 - RNA, 22 nt, Human
cuggagcugccagacgggcaca

SEQ ID NO: 717509 - RNA, 22 nt, Human
ccgcgcgcgugggcguccaggg

SEQ ID NO: 717510 - RNA, 20 nt, Human
auccuggaauccaaauggag

SEQ ID NO: 717511 - RNA, 22 nt, Human
caugucuuccuugcacacacac

SEQ ID NO: 717512 - RNA, 22 nt, Human
gauuucuguaacacuucagaua

SEQ ID NO: 717513 - RNA, 22 nt, Human
ucuuucugcacuuaguggggcu

SEQ ID NO: 717514 - RNA, 22 nt, Human
ccugagcaaaggcccagaggga

SEQ ID NO: 717515 - RNA, 22 nt, Human
ccuggagaccugauggcagcgg

SEQ ID NO: 717516 - RNA, 22 nt, Human
gaagugcaaaaccacaugguaa

SEQ ID NO: 717517 - RNA, 18 nt, Human
ucugagguggacgaggag

SEQ ID NO: 717518 - RNA, 22 nt, Human
ugaaguuuaagguuagauaagu

SEQ ID NO: 717519 - RNA, 22 nt, Human
auuaaauguuggacguauacau

SEQ ID NO: 717520 - RNA, 22 nt, Human
gaggcugggaaguccaagauca

SEQ ID NO: 717521 - RNA, 22 nt, Human
ggcacugaaguggguguugggu

SEQ ID NO: 717522 - RNA, 22 nt, Human
uucuucauucccuuacuuccga

SEQ ID NO: 717523 - RNA, 22 nt, Human
ggaaggggugucgcccauggau

SEQ ID NO: 717524 - RNA, 22 nt, Human
gggaaggcugccugagggaugg

SEQ ID NO: 717525 - RNA, 22 nt, Human
agcugguaugaacaggauagga

SEQ ID NO: 717526 - RNA, 22 nt, Human
aaggcacucauucaaggagaua

SEQ ID NO: 717527 - RNA, 22 nt, Human
ggagggggacugacacugauuu

SEQ ID NO: 717528 - RNA, 22 nt, Human
agggcucugggguggcagagau

SEQ ID NO: 717529 - RNA, 22 nt, Human
ggagaugcaauguagaaucugg

SEQ ID NO: 717530 - RNA, 22 nt, Human
ugagccugggagauggaggcug

SEQ ID NO: 717531 - RNA, 21 nt, Human
acaguuuuaaggagcacaugg

SEQ ID NO: 717532 - RNA, 22 nt, Human
cagcugugagcagccaguugcc

SEQ ID NO: 717533 - RNA, 22 nt, Human
gccuggagagcacugugcgcuu

SEQ ID NO: 717534 - RNA, 22 nt, Human
guauuuucaugauuucagacca

SEQ ID NO: 717535 - RNA, 22 nt, Human
gccugcccugaaagaggugaag

SEQ ID NO: 717536 - RNA, 22 nt, Human
ccaggucuuguuugacaucaau

SEQ ID NO: 717537 - RNA, 22 nt, Human
aagcagcuuuugaagagugagg

SEQ ID NO: 717538 - RNA, 22 nt, Human
gcugggagaggcccugaaguga

SEQ ID NO: 717539 - RNA, 22 nt, Human
cagucacauggaugauggauag

SEQ ID NO: 717540 - RNA, 22 nt, Human
uuccuugagaugacugucuugu

SEQ ID NO: 717541 - RNA, 22 nt, Human
acugaacacuuuugaaagauua

SEQ ID NO: 717542 - RNA, 20 nt, Human
uccagguaacaucucucugg

SEQ ID NO: 717543 - RNA, 22 nt, Human
cuaaaugccuuuccuaccuaac

SEQ ID NO: 717544 - RNA, 22 nt, Human
ccacagggauaggaauggggcu

SEQ ID NO: 717545 - RNA, 22 nt, Human
gcuggccagggcugcucgcgga

SEQ ID NO: 717546 - RNA, 22 nt, Human
gcuuagucaauuauaaauaggc

SEQ ID NO: 717547 - RNA, 21 nt, Human
cuggaggguagaguugggcug

SEQ ID NO: 717548 - RNA, 22 nt, Human
ccucagcagacacgcuucucac

SEQ ID NO: 717549 - RNA, 22 nt, Human
uguggacugugcugccacagug

SEQ ID NO: 717550 - RNA, 22 nt, Human
cuguaaauaugaagaauauaug

SEQ ID NO: 717551 - RNA, 22 nt, Human
caguuucuucaucaguuaagca

SEQ ID NO: 717552 - RNA, 22 nt, Human
gagggggaaagucccuggaguc

SEQ ID NO: 717553 - RNA, 22 nt, Human
gagcagcaguuguuacaaugau

SEQ ID NO: 717554 - RNA, 22 nt, Human
agagaaacccuucaguguuuug

SEQ ID NO: 717555 - RNA, 22 nt, Human
ggagcugaugacgucaccaugg

SEQ ID NO: 717556 - RNA, 22 nt, Human
caguguuuuguuacuugggcac

SEQ ID NO: 717557 - RNA, 22 nt, Human
uaaaucacauuuucuuuguguu

SEQ ID NO: 717558 - RNA, 22 nt, Human
cucuucaggauggcuugugaug

SEQ ID NO: 717559 - RNA, 22 nt, Human
uaccaugaucaggcucauccuu

SEQ ID NO: 717560 - RNA, 22 nt, Human
ugucccucugaggcuucccugg

SEQ ID NO: 717561 - RNA, 22 nt, Human
uucuggaaguguuagaaucugg

SEQ ID NO: 717562 - RNA, 22 nt, Human
ccugucugagccagggugggca

SEQ ID NO: 717563 - RNA, 18 nt, Human
ugauggaggagggcuggu

SEQ ID NO: 717564 - RNA, 20 nt, Human
cucuccucacccgugucagg

SEQ ID NO: 717565 - RNA, 22 nt, Human
uugaggucuucagcugacaccu

SEQ ID NO: 717566 - RNA, 22 nt, Human
gacagcugcauccucagacaca

SEQ ID NO: 717567 - RNA, 22 nt, Human
ucaagcaaguguuugguguaaa

SEQ ID NO: 717568 - RNA, 22 nt, Human
uuacaaaguucugaguucaaac

SEQ ID NO: 717569 - RNA, 17 nt, Human
gaaaggaggcaacacug

SEQ ID NO: 717570 - RNA, 22 nt, Human
ugcuugauuaagccuuguuugc

SEQ ID NO: 717571 - RNA, 22 nt, Human
gugcuguuuugagugcuacccc

SEQ ID NO: 717572 - RNA, 22 nt, Human
ugcacugauguuuugccaagga

SEQ ID NO: 717573 - RNA, 22 nt, Human
gccugugaccccuccaucugcu

SEQ ID NO: 717574 - RNA, 22 nt, Human
uccgggagcugaacgucuugcg

SEQ ID NO: 717575 - RNA, 22 nt, Human
cagguggguguaugaaugcaaa

SEQ ID NO: 717576 - RNA, 22 nt, Human
ucuuuagcuagaaauacucuaa

SEQ ID NO: 717577 - RNA, 22 nt, Human
ugacuuuaaagcucacucuuuu

SEQ ID NO: 717578 - RNA, 22 nt, Human
cccuguuaaugucaaccugccu

SEQ ID NO: 717579 - RNA, 22 nt, Human
ucucuuucuuuguaugucuauu

SEQ ID NO: 717580 - RNA, 22 nt, Human
uucaucauuacagucauguuau

SEQ ID NO: 717581 - RNA, 17 nt, Human
ccugcccagagacagau

SEQ ID NO: 717582 - RNA, 22 nt, Human
aaaugcagauugucauucagga

SEQ ID NO: 717583 - RNA, 22 nt, Human
uucugucacagugcugguauca

SEQ ID NO: 717584 - RNA, 22 nt, Human
aaaugucugagacuucugaacu

SEQ ID NO: 717585 - RNA, 18 nt, Human
ugaggcugaauauggggc

SEQ ID NO: 717586 - RNA, 23 nt, Human
uuuggcuccauggguggcucauu

SEQ ID NO: 717587 - RNA, 22 nt, Human
ugggccacugcugcggaaggcg

SEQ ID NO: 717588 - RNA, 20 nt, Human
agaauucuuacccuuugaug

SEQ ID NO: 717589 - RNA, 22 nt, Human
agcugccucucuugagguuacg

SEQ ID NO: 717590 - RNA, 22 nt, Human
gcaaaggcuagagacacaggga

SEQ ID NO: 717591 - RNA, 22 nt, Human
caggaggcuccuagggcucugu

SEQ ID NO: 717592 - RNA, 22 nt, Human
gagcaggccuggggugaggccu

SEQ ID NO: 717593 - RNA, 22 nt, Human
aggccuuccucggagacaggga

SEQ ID NO: 717594 - RNA, 20 nt, Human
ucagcucugugccugggaug

SEQ ID NO: 717595 - RNA, 22 nt, Human
aagauguugcaagggacucuuc

SEQ ID NO: 717596 - RNA, 22 nt, Human
gagaagcagguuuagcagacaa

SEQ ID NO: 717597 - RNA, 22 nt, Human
uuggggagguugccacauucca

SEQ ID NO: 717598 - RNA, 22 nt, Human
gagcugggaagauagcuugagc

SEQ ID NO: 717599 - RNA, 22 nt, Human
cugugaggccuuuggccagaua

SEQ ID NO: 717600 - RNA, 22 nt, Human
uaaaugcucagaccuuauucca

SEQ ID NO: 717601 - RNA, 19 nt, Human
gagguggguccccgcagcc

SEQ ID NO: 717602 - RNA, 22 nt, Human
gcucaguuauccgugugugacu

SEQ ID NO: 717603 - RNA, 22 nt, Human
aaaggccacacagagcagggag

SEQ ID NO: 717604 - RNA, 22 nt, Human
gaauacuuuuguuaggaaaacg

SEQ ID NO: 717605 - RNA, 22 nt, Human
ccuuccagguuuuggcuccauu

SEQ ID NO: 717606 - RNA, 22 nt, Human
agcgagguuuugcagauacagc

SEQ ID NO: 717607 - RNA, 22 nt, Human
uccagacucuuuaaguucauuu

SEQ ID NO: 717608 - RNA, 22 nt, Human
uauuugucuuucuuauaagaau

SEQ ID NO: 717609 - RNA, 22 nt, Human
cccaggcucuuaugugacuugc

SEQ ID NO: 717610 - RNA, 22 nt, Human
uuagggacagcucuguagguga

SEQ ID NO: 717611 - RNA, 22 nt, Human
cagguggcugagcugaccuuug

SEQ ID NO: 717612 - RNA, 21 nt, Human
agguuccagcagccagagaau

SEQ ID NO: 717613 - RNA, 22 nt, Human
acuguaauguuuuaaagcagag

SEQ ID NO: 717614 - RNA, 22 nt, Human
uauacagaaccgccugaagucu

SEQ ID NO: 717615 - RNA, 22 nt, Human
cuccugugcaugcaucucccua

SEQ ID NO: 717616 - RNA, 22 nt, Human
uuauuguaggccuauuguagaa

SEQ ID NO: 717617 - RNA, 22 nt, Human
aggccagccuuguaaaugccuc

SEQ ID NO: 717618 - RNA, 22 nt, Human
uagcccagcaugagcagagcug

SEQ ID NO: 717619 - RNA, 22 nt, Human
cagcugagcaucacuagucugg

SEQ ID NO: 717620 - RNA, 22 nt, Human
cagcaguaauuagugcugcaug

SEQ ID NO: 717621 - RNA, 22 nt, Human
ccauccugcauugcuauucaga

SEQ ID NO: 717622 - RNA, 22 nt, Human
gcugaggauauagcaggaacaa

SEQ ID NO: 717623 - RNA, 23 nt, Human
cagaggguuccauggagcauggu

SEQ ID NO: 717624 - RNA, 22 nt, Human
auauauacaacuagauuaaaag

SEQ ID NO: 717625 - RNA, 22 nt, Human
uauuuauaaucugccaaagaga

SEQ ID NO: 717626 - RNA, 22 nt, Human
caaaauaccacgacuuguuuua

SEQ ID NO: 717627 - RNA, 23 nt, Human
agagaaagggauaacacguugaa

SEQ ID NO: 717628 - RNA, 22 nt, Human
aguuuacaguucucaucgcaac

SEQ ID NO: 717629 - RNA, 22 nt, Human
gaauugaauucauuuacucaaa

SEQ ID NO: 717630 - RNA, 22 nt, Human
uuguuuuggagaugagcuaaaa

SEQ ID NO: 717631 - RNA, 22 nt, Human
agugguaacuaaguccugcuua

SEQ ID NO: 717632 - RNA, 22 nt, Human
uuuauucaucaucuguucauau

SEQ ID NO: 717633 - RNA, 22 nt, Human
uucuuucuuuguaguccugaac

SEQ ID NO: 717634 - RNA, 22 nt, Human
gaacaaacagucaggacagucu

SEQ ID NO: 717635 - RNA, 22 nt, Human
aguggcugcuggaguggagaug

SEQ ID NO: 717636 - RNA, 22 nt, Human
augaagacuauuugaaggugcc

SEQ ID NO: 717637 - RNA, 22 nt, Human
aggucacauggauaaugaucag

SEQ ID NO: 717638 - RNA, 22 nt, Human
uucccucucacuuaaagcuugg

SEQ ID NO: 717639 - RNA, 22 nt, Human
cugugcccuuuguccucgucuc

SEQ ID NO: 717640 - RNA, 22 nt, Human
cagauaacugaaauaucauacc

SEQ ID NO: 717641 - RNA, 21 nt, Human
uuugauucuuccucuccccag

SEQ ID NO: 717642 - RNA, 22 nt, Human
aagcuuccugcaugggacugcu

SEQ ID NO: 717643 - RNA, 19 nt, Human
ggccacuccuggugacugg

SEQ ID NO: 717644 - RNA, 22 nt, Human
auuuuagagcuccaaguacagc

SEQ ID NO: 717645 - RNA, 22 nt, Human
gucaggauuauuuuauuaaaag

SEQ ID NO: 717646 - RNA, 22 nt, Human
ucuaugaaugacacagauaaua

SEQ ID NO: 717647 - RNA, 22 nt, Human
aaauuuuaaggcuggaacuuaa

SEQ ID NO: 717648 - RNA, 22 nt, Human
gcuugaaaauucauagguauuu

SEQ ID NO: 717649 - RNA, 22 nt, Human
aguauguagugcaaucagucag

SEQ ID NO: 717650 - RNA, 22 nt, Human
ccaaaguccauaguuuacuuua

SEQ ID NO: 717651 - RNA, 22 nt, Human
ucuggagaaggaagagucuuug

SEQ ID NO: 717652 - RNA, 22 nt, Human
ugcaucaaccuaauaucagcuc

SEQ ID NO: 717653 - RNA, 20 nt, Human
cugggcucaagugauccucc

SEQ ID NO: 717654 - RNA, 22 nt, Human
acaugucuccacccaucuuaaa

SEQ ID NO: 717655 - RNA, 22 nt, Human
ugucugaagcacugggcguugc

SEQ ID NO: 717656 - RNA, 22 nt, Human
ucugggagggagccucagaauc

SEQ ID NO: 717657 - RNA, 22 nt, Human
cccuggagggcagacagaugcc

SEQ ID NO: 717658 - RNA, 22 nt, Human
ugccugggccuucccaccucug

SEQ ID NO: 717659 - RNA, 22 nt, Human
aucaggauguuuggcugucaua

SEQ ID NO: 717660 - RNA, 22 nt, Human
uguaugugcaauguuuauaugu

SEQ ID NO: 717661 - RNA, 20 nt, Human
uuugagaccagucugcccaa

SEQ ID NO: 717662 - RNA, 22 nt, Human
cacagaauaauucacauggcuc

SEQ ID NO: 717663 - RNA, 22 nt, Human
guuuacaugcagaaaaucaaug

SEQ ID NO: 717664 - RNA, 19 nt, Human
uccugaagauuuccucagc

SEQ ID NO: 717665 - RNA, 22 nt, Human
caagauggacauaaggagagaa

SEQ ID NO: 717666 - RNA, 22 nt, Human
augaaugcugggacaaauauau

SEQ ID NO: 717667 - RNA, 22 nt, Human
uucugaaugauagucuugaacu

SEQ ID NO: 717668 - RNA, 23 nt, Human
ucauugugacugugccacauaac

SEQ ID NO: 717669 - RNA, 22 nt, Human
aucagugcuucauagcccuggu

SEQ ID NO: 717670 - RNA, 22 nt, Human
cuggcacaaaagaaaacugcca

SEQ ID NO: 717671 - RNA, 22 nt, Human
agggacacaugugauuauuuau

SEQ ID NO: 717672 - RNA, 22 nt, Human
cugagcaguagagggucucuuu

SEQ ID NO: 717673 - RNA, 22 nt, Human
aauaacagauuuucaagcugug

SEQ ID NO: 717674 - RNA, 22 nt, Human
uuauacauguguuuugagauga

SEQ ID NO: 717675 - RNA, 22 nt, Human
uauugguguacuuauagcagag

SEQ ID NO: 717676 - RNA, 22 nt, Human
gaccaccagagguccgugggua

SEQ ID NO: 717677 - RNA, 17 nt, Human
uguuugguugauuggug

SEQ ID NO: 717678 - RNA, 22 nt, Human
uuucacauggaagcucucgaga

SEQ ID NO: 717679 - RNA, 22 nt, Human
uccuggagugucuuccccaagg

SEQ ID NO: 717680 - RNA, 21 nt, Human
aucagaaucucuagauuugga

SEQ ID NO: 717681 - RNA, 22 nt, Human
auuccuuggaacagaugcgaag

SEQ ID NO: 717682 - RNA, 22 nt, Human
gccgagcacagugcagcugccu

SEQ ID NO: 717683 - RNA, 22 nt, Human
auucuagaacagagguuucuaa

SEQ ID NO: 717684 - RNA, 22 nt, Human
ugcagcaccacaccuggcuaau

SEQ ID NO: 717685 - RNA, 22 nt, Human
uaauccuggugaguuugaaaaa

SEQ ID NO: 717686 - RNA, 22 nt, Human
ccugggcucaagcgaucuuguc

SEQ ID NO: 717687 - RNA, 22 nt, Human
ucuucaugucaugguauauuga

SEQ ID NO: 717688 - RNA, 23 nt, Human
aaugggugcaacuauccaugaca

SEQ ID NO: 717689 - RNA, 22 nt, Human
ccagaggugagggggauucuug

SEQ ID NO: 717690 - RNA, 21 nt, Human
ucaggcugucugcugguucca

SEQ ID NO: 717691 - RNA, 22 nt, Human
aggugccagaugcacagcugaa

SEQ ID NO: 717692 - RNA, 22 nt, Human
cuagagaggcagauguccugug

SEQ ID NO: 717693 - RNA, 22 nt, Human
uguguuuugaacucaucuacug

SEQ ID NO: 717694 - RNA, 22 nt, Human
gagaccucuugguaucgcuagg

SEQ ID NO: 717695 - RNA, 20 nt, Human
agaagcugauacugauggaa

SEQ ID NO: 717696 - RNA, 22 nt, Human
accacugggcgggcagccugcu

SEQ ID NO: 717697 - RNA, 22 nt, Human
gugcaggggccuccccuugcug

SEQ ID NO: 717698 - RNA, 22 nt, Human
aucugcuucgcgccaauuucau

SEQ ID NO: 717699 - RNA, 22 nt, Human
aggaucuuauguaauaauuaug

SEQ ID NO: 717700 - RNA, 22 nt, Human
gaucccauguaggagaauguua

SEQ ID NO: 717701 - RNA, 22 nt, Human
ugccuggguguaaagggccaac

SEQ ID NO: 717702 - RNA, 22 nt, Human
ggagccuggccuggcucugugu

SEQ ID NO: 717703 - RNA, 22 nt, Human
auaccuuuaggcauuuugcauc

SEQ ID NO: 717704 - RNA, 22 nt, Human
ugaaaugaagggcuuguucugg

SEQ ID NO: 717705 - RNA, 21 nt, Human
ucugucugguuuuagaguggc

SEQ ID NO: 717706 - RNA, 22 nt, Human
gcuggggccugaacagucagcu

SEQ ID NO: 717707 - RNA, 22 nt, Human
accucuuaauauugcaccuucu

SEQ ID NO: 717708 - RNA, 23 nt, Human
ugagcaagugaccaacugucugu

SEQ ID NO: 717709 - RNA, 22 nt, Human
agccagagagccccagguucua

SEQ ID NO: 717710 - RNA, 22 nt, Human
cuccagggaaaggggcguccgc

SEQ ID NO: 717711 - RNA, 22 nt, Human
aucucuaauuuaaaaaguaaca

SEQ ID NO: 717712 - RNA, 22 nt, Human
ccugaggaccagcacccaucug

SEQ ID NO: 717713 - RNA, 22 nt, Human
ccaggugucaugcgugugaccc

SEQ ID NO: 717714 - RNA, 22 nt, Human
agcaugcugggucauuuuugcc

SEQ ID NO: 717715 - RNA, 22 nt, Human
aggcuguguucugguucuuagc

SEQ ID NO: 717716 - RNA, 20 nt, Human
ucugcucagcccucaguggc

SEQ ID NO: 717717 - RNA, 22 nt, Human
gggaaauuguaacaagucuguu

SEQ ID NO: 717718 - RNA, 22 nt, Human
gcccagagagaugaagugaugg

SEQ ID NO: 717719 - RNA, 22 nt, Human
acagacagaggcuccaugagga

SEQ ID NO: 717720 - RNA, 22 nt, Human
cuguccugaaagggagauuggg

SEQ ID NO: 717721 - RNA, 22 nt, Human
uuccugggaggcuguguacuug

SEQ ID NO: 717722 - RNA, 22 nt, Human
ggaggcagaacuucccgucagu

SEQ ID NO: 717723 - RNA, 22 nt, Human
ugcauggacucaucagacaaga

SEQ ID NO: 717724 - RNA, 20 nt, Human
gacauucauaguuauuacca

SEQ ID NO: 717725 - RNA, 22 nt, Human
gcacacaugcaugcacaggagu

SEQ ID NO: 717726 - RNA, 22 nt, Human
gcugucugcaagccaggaaaug

SEQ ID NO: 717727 - RNA, 22 nt, Human
gguggguauugaauacaggugu

SEQ ID NO: 717728 - RNA, 22 nt, Human
gcaggucuagaagcugccucug

SEQ ID NO: 717729 - RNA, 22 nt, Human
acauuucagauguaaugugaug

SEQ ID NO: 717730 - RNA, 22 nt, Human
cucaagucccgcaguguuccuc

SEQ ID NO: 717731 - RNA, 19 nt, Human
ucugagguggaacuggggg

SEQ ID NO: 717732 - RNA, 22 nt, Human
gaccucucaggaaucucacaug

SEQ ID NO: 717733 - RNA, 22 nt, Human
ugcuccugcugcaugcaucucc

SEQ ID NO: 717734 - RNA, 22 nt, Human
aggugcacugucuaauuagguc

SEQ ID NO: 717735 - RNA, 22 nt, Human
ggcuucacugacugguucuagg

SEQ ID NO: 717736 - RNA, 22 nt, Human
aggcagugaugagucaugaaua

SEQ ID NO: 717737 - RNA, 22 nt, Human
uccuggaucagcgggggcaggc

SEQ ID NO: 717738 - RNA, 19 nt, Human
agcugcuggcccagggacc

SEQ ID NO: 717739 - RNA, 22 nt, Human
ucuaacuauacaaagaaaacau

SEQ ID NO: 717740 - RNA, 22 nt, Human
guguaaauuuguacuuguaaau

SEQ ID NO: 717741 - RNA, 22 nt, Human
uugcuguagcucauuucacucu

SEQ ID NO: 717742 - RNA, 22 nt, Human
ucuccuuucuggagccugcuca

SEQ ID NO: 717743 - RNA, 22 nt, Human
cgcugugugcagacugaaaaug

SEQ ID NO: 717744 - RNA, 22 nt, Human
ucccagggcuuuucucaugcuu

SEQ ID NO: 717745 - RNA, 22 nt, Human
gggaggcucugcucagcccccg

SEQ ID NO: 717746 - RNA, 20 nt, Human
gggcagccucgggagugggu

SEQ ID NO: 717747 - RNA, 22 nt, Human
gucacaguguaucucuucagcu

SEQ ID NO: 717748 - RNA, 22 nt, Human
cuggaaggcggagguuguagug

SEQ ID NO: 717749 - RNA, 22 nt, Human
uagauacuuauaaucuuccaag

SEQ ID NO: 717750 - RNA, 22 nt, Human
ccugggcuccacuccaagagca

SEQ ID NO: 717751 - RNA, 22 nt, Human
cccaggcuggccuccgcagugc

SEQ ID NO: 717752 - RNA, 22 nt, Human
agccuucucugaaauucuguuu

SEQ ID NO: 717753 - RNA, 22 nt, Human
acugcucucugcaaguagaugg

SEQ ID NO: 717754 - RNA, 22 nt, Human
gcacauggacaauggaggugca

SEQ ID NO: 717755 - RNA, 22 nt, Human
uuccugaaaauacagggagacc

SEQ ID NO: 717756 - RNA, 22 nt, Human
ccuaaggaaagccaaagaggcc

SEQ ID NO: 717757 - RNA, 22 nt, Human
uuccagagaaaagguuuauuuc

SEQ ID NO: 717758 - RNA, 22 nt, Human
uuuuaauacugcuauuguagga

SEQ ID NO: 717759 - RNA, 22 nt, Human
ugcagguucugaccagccaacu

SEQ ID NO: 717760 - RNA, 22 nt, Human
aaguuucauguggagguagacu

SEQ ID NO: 717761 - RNA, 22 nt, Human
cacugccuggaaggagagacau

SEQ ID NO: 717762 - RNA, 22 nt, Human
ggcaucuccaaaacaugaacuc

SEQ ID NO: 717763 - RNA, 22 nt, Human
ugacagugcaugugacaaagga

SEQ ID NO: 717764 - RNA, 22 nt, Human
uagauuuuaggagauuuuacug

SEQ ID NO: 717765 - RNA, 22 nt, Human
gauguguguuuauacauauauu

SEQ ID NO: 717766 - RNA, 22 nt, Human
auggggugaccaugagcauuua

SEQ ID NO: 717767 - RNA, 22 nt, Human
aaaucugggucaagguggagug

SEQ ID NO: 717768 - RNA, 22 nt, Human
ggcugucugugguggagcguug

SEQ ID NO: 717769 - RNA, 22 nt, Human
uacacauaggaggguaauaaaa

SEQ ID NO: 717770 - RNA, 22 nt, Human
gccagggaaacugcagaccagc

SEQ ID NO: 717771 - RNA, 22 nt, Human
ugaaacacaagccugguuagug

SEQ ID NO: 717772 - RNA, 22 nt, Human
caaggaggcagugggacuugaa

SEQ ID NO: 717773 - RNA, 22 nt, Human
cuggccacugauuccuccccug

SEQ ID NO: 717774 - RNA, 22 nt, Human
gaaaacugugauuagaaugccu

SEQ ID NO: 717775 - RNA, 22 nt, Human
cucagaggcaagcaaggagcug

SEQ ID NO: 717776 - RNA, 22 nt, Human
aaugaacaucaaaugccuacca

SEQ ID NO: 717777 - RNA, 22 nt, Human
uaacaguauccccauuugcaag

SEQ ID NO: 717778 - RNA, 20 nt, Human
cggacuuucuucucagggca

SEQ ID NO: 717779 - RNA, 22 nt, Human
aacaagauguuuugauauaugu

SEQ ID NO: 717780 - RNA, 22 nt, Human
aaaaaccucaauuacuuuugca

SEQ ID NO: 717781 - RNA, 22 nt, Human
ugaggauuggcaaaacucaggg

SEQ ID NO: 717782 - RNA, 22 nt, Human
augacaaaagaagacaugaggu

SEQ ID NO: 717783 - RNA, 22 nt, Human
uaacaacuugcuuuuaucuuag

SEQ ID NO: 717784 - RNA, 22 nt, Human
cccacaggcaggugcaugggcu

SEQ ID NO: 717785 - RNA, 22 nt, Human
cacagcuaugagcagccuagcu

SEQ ID NO: 717786 - RNA, 23 nt, Human
ugcagggcaaguuagagacccca

SEQ ID NO: 717787 - RNA, 20 nt, Human
ugcagcuucaccugugucau

SEQ ID NO: 717788 - RNA, 22 nt, Human
caagcugccaccagaagagcau

SEQ ID NO: 717789 - RNA, 21 nt, Human
acagaugggaugagcacacug

SEQ ID NO: 717790 - RNA, 22 nt, Human
agaggccaccuucucuugagaa

SEQ ID NO: 717791 - RNA, 22 nt, Human
augcuuccacuguucugcucuc

SEQ ID NO: 717792 - RNA, 22 nt, Human
cagggcuugguuggaaccaccc

SEQ ID NO: 717793 - RNA, 22 nt, Human
gagggggagaugugcacacacu

SEQ ID NO: 717794 - RNA, 22 nt, Human
ccuuagcaacugucauagagca

SEQ ID NO: 717795 - RNA, 22 nt, Human
cacugaagccacuggaagagga

SEQ ID NO: 717796 - RNA, 22 nt, Human
agugugugcuguuccccggagg

SEQ ID NO: 717797 - RNA, 22 nt, Human
uauuaugagccaggugcugucu

SEQ ID NO: 717798 - RNA, 22 nt, Human
ggggaagaggcgugauggaucc

SEQ ID NO: 717799 - RNA, 22 nt, Human
ucuuaacauauuauuuuagcac

SEQ ID NO: 717800 - RNA, 22 nt, Human
ccaguguuuaggaauaaaaugu

SEQ ID NO: 717801 - RNA, 22 nt, Human
augaagcaggcacagcuucagg

SEQ ID NO: 717802 - RNA, 22 nt, Human
gcugacuguccgcugcucccgg

SEQ ID NO: 717803 - RNA, 22 nt, Human
aauuacuuaagagaaacuuuga

SEQ ID NO: 717804 - RNA, 22 nt, Human
gcucuggcacuggcgcgggaug

SEQ ID NO: 717805 - RNA, 22 nt, Human
agggcucuguuggggucagcac

SEQ ID NO: 717806 - RNA, 22 nt, Human
agcgcgcugucagacuggcucg

SEQ ID NO: 717807 - RNA, 22 nt, Human
agaaccaguuuaagauuugggu

SEQ ID NO: 717808 - RNA, 22 nt, Human
aagauacaaaugucaauauugg

SEQ ID NO: 717809 - RNA, 22 nt, Human
ucucagggccccaaaggcuagu

SEQ ID NO: 717810 - RNA, 22 nt, Human
ugguggcagcugagugucaggu

SEQ ID NO: 717811 - RNA, 21 nt, Human
ccagguacauggagaaugugg

SEQ ID NO: 717812 - RNA, 22 nt, Human
gcugagaguguaggauguuuac

SEQ ID NO: 717813 - RNA, 22 nt, Human
ucacuaaguuacauuuaguauu

SEQ ID NO: 717814 - RNA, 22 nt, Human
guuuaagaaaauucauguuguu

SEQ ID NO: 717815 - RNA, 22 nt, Human
gcagugugaugcuuccagccac

SEQ ID NO: 717816 - RNA, 22 nt, Human
aaucuaagccaccaguaguuuc

SEQ ID NO: 717817 - RNA, 22 nt, Human
aaaauauguauaacucuucugc

SEQ ID NO: 717818 - RNA, 22 nt, Human
ugacagucugcaguuuuaaaaa

SEQ ID NO: 717819 - RNA, 22 nt, Human
aauuaauggaaaguaaggaagg

SEQ ID NO: 717820 - RNA, 22 nt, Human
gucugcccucacaugcacucuu

SEQ ID NO: 717821 - RNA, 19 nt, Human
uaguacaaaagcagccaua

SEQ ID NO: 717822 - RNA, 22 nt, Human
acauucugaaugccugacagua

SEQ ID NO: 717823 - RNA, 22 nt, Human
acuucacacagcaaauuuaucu

SEQ ID NO: 717824 - RNA, 22 nt, Human
uggaaugucauaccauaaaaga

SEQ ID NO: 717825 - RNA, 22 nt, Human
guacacacaaucucuggucagu

SEQ ID NO: 717826 - RNA, 22 nt, Human
agccuaggguucugaugucacu

SEQ ID NO: 717827 - RNA, 19 nt, Human
agcuggagauuggagggca

SEQ ID NO: 717828 - RNA, 22 nt, Human
cugcugucaaaaaucacuccau

SEQ ID NO: 717829 - RNA, 22 nt, Human
acugcacagaauuaugguuggu

SEQ ID NO: 717830 - RNA, 22 nt, Human
ccagggucucugcugccugaga

SEQ ID NO: 717831 - RNA, 22 nt, Human
gcagggaccuaugacgauggaa

SEQ ID NO: 717832 - RNA, 22 nt, Human
agugcauguucacuggcauggu

SEQ ID NO: 717833 - RNA, 22 nt, Human
cugccuagauuugaauccuggc

SEQ ID NO: 717834 - RNA, 22 nt, Human
ccuggucaccccucucucugca

SEQ ID NO: 717835 - RNA, 22 nt, Human
ggaaucagagcagaggcuguua

SEQ ID NO: 717836 - RNA, 23 nt, Human
gcaugcaacuugcaguaguauuc

SEQ ID NO: 717837 - RNA, 22 nt, Human
cuucucuggcuccucagcgccc

SEQ ID NO: 717838 - RNA, 21 nt, Human
uaucaaggcacuuuuuaaaga

SEQ ID NO: 717839 - RNA, 22 nt, Human
aggucugagcucagggccuggc

SEQ ID NO: 717840 - RNA, 22 nt, Human
uuuaaauaggacuccugggggu

SEQ ID NO: 717841 - RNA, 22 nt, Human
uccucaguaaggcauggcuuug

SEQ ID NO: 717842 - RNA, 22 nt, Human
gcuggugcauuagcugcaguuc

SEQ ID NO: 717843 - RNA, 23 nt, Human
cacaccuguuaagaagagugccu

SEQ ID NO: 717844 - RNA, 22 nt, Human
cuuuuuguuguauaagcccuuu

SEQ ID NO: 717845 - RNA, 22 nt, Human
uuugugaaaugaagucacaacu

SEQ ID NO: 717846 - RNA, 22 nt, Human
gugucacaggcccagcucuuca

SEQ ID NO: 717847 - RNA, 22 nt, Human
caguuuauaguuguuaugugug

SEQ ID NO: 717848 - RNA, 22 nt, Human
ucacugaaccagggaucucuag

SEQ ID NO: 717849 - RNA, 22 nt, Human
aagggcugcauuugauguguca

SEQ ID NO: 717850 - RNA, 22 nt, Human
aaggccuucucuugugucugug

SEQ ID NO: 717851 - RNA, 20 nt, Human
aggcccugccagggacggag

SEQ ID NO: 717852 - RNA, 22 nt, Human
gauaauauuagaagauacaaau

SEQ ID NO: 717853 - RNA, 22 nt, Human
aauacuuugccaaguucgaaga

SEQ ID NO: 717854 - RNA, 22 nt, Human
auugaggcagcauaguucaggg

SEQ ID NO: 717855 - RNA, 22 nt, Human
gcuagaaacuguuuaaucucuu

SEQ ID NO: 717856 - RNA, 22 nt, Human
gagucgagcagaaagccgucgg

SEQ ID NO: 717857 - RNA, 22 nt, Human
ggcccugagucuagcugcucuu

SEQ ID NO: 717858 - RNA, 22 nt, Human
uaaaggcuuuuagugaugguaa

SEQ ID NO: 717859 - RNA, 22 nt, Human
acuaaguaguuucacauauaau

SEQ ID NO: 717860 - RNA, 22 nt, Human
acagcagcgucaacuuaaaauu

SEQ ID NO: 717861 - RNA, 22 nt, Human
cagcaucguguggaaaguggua

SEQ ID NO: 717862 - RNA, 22 nt, Human
acagaucuacauugucugaccc

SEQ ID NO: 717863 - RNA, 22 nt, Human
ugagcaucuuuuuacagguuua

SEQ ID NO: 717864 - RNA, 22 nt, Human
agacaauuucaaaguaauauua

SEQ ID NO: 717865 - RNA, 22 nt, Human
agaguuuguacuuuacccugag

SEQ ID NO: 717866 - RNA, 22 nt, Human
gcacccagagggcagggucucc

SEQ ID NO: 717867 - RNA, 20 nt, Human
uacaguguauguauuuaggc

SEQ ID NO: 717868 - RNA, 22 nt, Human
uguuucuugggugcucacauca

SEQ ID NO: 717869 - RNA, 21 nt, Human
aaccugagacccacgggacua

SEQ ID NO: 717870 - RNA, 22 nt, Human
caagggcucuaagucacaagau

SEQ ID NO: 717871 - RNA, 23 nt, Human
uuaguguaaggcaggcacaguug

SEQ ID NO: 717872 - RNA, 22 nt, Human
gacauggauacuugauaagggg

SEQ ID NO: 717873 - RNA, 21 nt, Human
aaagaaaucucccauugguag

SEQ ID NO: 717874 - RNA, 23 nt, Human
gccaaguagggggaaagcccgug

SEQ ID NO: 717875 - RNA, 22 nt, Human
aggagcuggaguccaggcaagu

SEQ ID NO: 717876 - RNA, 22 nt, Human
uagcaucuuuuucugucuucua

SEQ ID NO: 717877 - RNA, 23 nt, Human
ucucccucaugccuaggccuggg

SEQ ID NO: 717878 - RNA, 22 nt, Human
uguuagaaguuaaucacuaauu

SEQ ID NO: 717879 - RNA, 22 nt, Human
caauuuuauugguccaaauaca

SEQ ID NO: 717880 - RNA, 22 nt, Human
uugcaaauaaacaaguauacau

SEQ ID NO: 717881 - RNA, 22 nt, Human
acaucuguaaucuagucaaccc

SEQ ID NO: 717882 - RNA, 22 nt, Human
cugugaccuccaggaaggggug

SEQ ID NO: 717883 - RNA, 22 nt, Human
uuaaaauagccagugccccucu

SEQ ID NO: 717884 - RNA, 22 nt, Human
uaaggcagcauaauuaggccac

SEQ ID NO: 717885 - RNA, 22 nt, Human
ugagaggucaaagggcauggag

SEQ ID NO: 717886 - RNA, 22 nt, Human
caauagcuauguaaccugaaga

SEQ ID NO: 717887 - RNA, 22 nt, Human
acacuaaucuuuuauuugguuu

SEQ ID NO: 717888 - RNA, 22 nt, Human
gugacuguaauuaccuuagcaa

SEQ ID NO: 717889 - RNA, 22 nt, Human
uguuucuaucuggaucaauaga

SEQ ID NO: 717890 - RNA, 22 nt, Human
cucagcuccaggugugcaucuu

SEQ ID NO: 717891 - RNA, 22 nt, Human
ucuguccauucagccauccauc

SEQ ID NO: 717892 - RNA, 23 nt, Human
agcuuuuagguggaaauggcacu

SEQ ID NO: 717893 - RNA, 22 nt, Human
ugagagauuuucaugagugcuu

SEQ ID NO: 717894 - RNA, 22 nt, Human
gaucaugugauuugaaguaaug

SEQ ID NO: 717895 - RNA, 22 nt, Human
uggaccugcguaggugcugggc

SEQ ID NO: 717896 - RNA, 22 nt, Human
acaucacaguaguuaagccaga

SEQ ID NO: 717897 - RNA, 20 nt, Human
aggaacuggaagggaggaaa

SEQ ID NO: 717898 - RNA, 22 nt, Human
cuagaauuuuaauuggguauau

SEQ ID NO: 717899 - RNA, 21 nt, Human
uaaagcuagaaccuuagcuuu

SEQ ID NO: 717900 - RNA, 22 nt, Human
acugggccaacuauuuguucua

SEQ ID NO: 717901 - RNA, 22 nt, Human
uuguucagaaguuuaaagaauu

SEQ ID NO: 717902 - RNA, 22 nt, Human
gggcugaucgcuugagcucagg

SEQ ID NO: 717903 - RNA, 22 nt, Human
agcaggggucucugcuaaugaa

SEQ ID NO: 717904 - RNA, 22 nt, Human
ucacagaagguggccauagcug

SEQ ID NO: 717905 - RNA, 22 nt, Human
acugggcuuaugcuguggagua

SEQ ID NO: 717906 - RNA, 19 nt, Human
cuguacagguugcuucugg

SEQ ID NO: 717907 - RNA, 22 nt, Human
acuguuuugugccuuaguuucc

SEQ ID NO: 717908 - RNA, 22 nt, Human
caggaggaaacuggauucacuu

SEQ ID NO: 717909 - RNA, 22 nt, Human
gagccagccuucuucugagguc

SEQ ID NO: 717910 - RNA, 22 nt, Human
aaugucuuuauuucagguuuac

SEQ ID NO: 717911 - RNA, 22 nt, Human
uccaggccccugccugggccug

SEQ ID NO: 717912 - RNA, 22 nt, Human
aaacucuggggguggagcccag

SEQ ID NO: 717913 - RNA, 17 nt, Human
cucagaguugcuuuguc

SEQ ID NO: 717914 - RNA, 18 nt, Human
ugcagccuguagucuugu

SEQ ID NO: 717915 - RNA, 20 nt, Human
acugccuugguucaguaggu

SEQ ID NO: 717916 - RNA, 22 nt, Human
agaggucauaucucagaagaga

SEQ ID NO: 717917 - RNA, 22 nt, Human
uuacagauacauuucuuuuguu

SEQ ID NO: 717918 - RNA, 22 nt, Human
uacacauacauugcuuacaagg

SEQ ID NO: 717919 - RNA, 22 nt, Human
gcaggaagcauagaagaaugcc

SEQ ID NO: 717920 - RNA, 23 nt, Human
auccagccuggggguuuaaccac

SEQ ID NO: 717921 - RNA, 22 nt, Human
auuuccaccggcucaggaaguu

SEQ ID NO: 717922 - RNA, 22 nt, Human
aaagcagucucagacuuaagca

SEQ ID NO: 717923 - RNA, 22 nt, Human
gcucugacuuccugcgcuccag

SEQ ID NO: 717924 - RNA, 21 nt, Human
ucacacacguuuccaagggca

SEQ ID NO: 717925 - RNA, 22 nt, Human
acuuugcaauacuuaauacaaa

SEQ ID NO: 717926 - RNA, 22 nt, Human
ccauuuggcaagaaagagucau

SEQ ID NO: 717927 - RNA, 18 nt, Human
ccugaggugggaggaagg

SEQ ID NO: 717928 - RNA, 22 nt, Human
acuuccuguguuggucuugcug

SEQ ID NO: 717929 - RNA, 22 nt, Human
gccccaggggaggugcccugca

SEQ ID NO: 717930 - RNA, 22 nt, Human
auuauuauuguugauguuaggg

SEQ ID NO: 717931 - RNA, 23 nt, Human
uccagggauuaaugaagucaguc

SEQ ID NO: 717932 - RNA, 23 nt, Human
uaucucagaggaauguaguuacu

SEQ ID NO: 717933 - RNA, 22 nt, Human
agacacagaacacaaaagcaua

SEQ ID NO: 717934 - RNA, 22 nt, Human
auucagcugacuuugauucauu

SEQ ID NO: 717935 - RNA, 22 nt, Human
ugugcccauuccacuugaguac

SEQ ID NO: 717936 - RNA, 22 nt, Human
cugacucccaaagaggacgcgu

SEQ ID NO: 717937 - RNA, 23 nt, Human
agugaauucaguuuaaaacagag

SEQ ID NO: 717938 - RNA, 20 nt, Human
acuggagccaucucagccua

SEQ ID NO: 717939 - RNA, 22 nt, Human
uuauucugugaacaugguuaau

SEQ ID NO: 717940 - RNA, 22 nt, Human
aaauggcuccaguugacuuuuu

SEQ ID NO: 717941 - RNA, 22 nt, Human
ugugggacagggacagcaagag

SEQ ID NO: 717942 - RNA, 22 nt, Human
uucaaacuguguaauuuauaaa

SEQ ID NO: 717943 - RNA, 23 nt, Human
uaugugugggucuacuagaaguc

SEQ ID NO: 717944 - RNA, 22 nt, Human
uagaaacauucaguugcagucc

SEQ ID NO: 717945 - RNA, 22 nt, Human
ccugcacagccggaccccugcu

SEQ ID NO: 717946 - RNA, 21 nt, Human
ugggagagcguugcuguccuc

SEQ ID NO: 717947 - RNA, 22 nt, Human
ucuggggauaagacccagguau

SEQ ID NO: 717948 - RNA, 22 nt, Human
cauuuauauaaaauguccagaa

SEQ ID NO: 717949 - RNA, 21 nt, Human
agugugugauaggcaggaaga

SEQ ID NO: 717950 - RNA, 22 nt, Human
aagcccuggcaaugucagauga

SEQ ID NO: 717951 - RNA, 22 nt, Human
uacagauacagaucuagauaca

SEQ ID NO: 717952 - RNA, 22 nt, Human
caaagugcuggaauuauagggg

SEQ ID NO: 717953 - RNA, 22 nt, Human
aguggguggcgcagaggaggaa

SEQ ID NO: 717954 - RNA, 22 nt, Human
aguggagguuacagcuguacau

SEQ ID NO: 717955 - RNA, 22 nt, Human
cagcagaucaauguagaauauu

SEQ ID NO: 717956 - RNA, 22 nt, Human
caguccugucuuuaugacuuca

SEQ ID NO: 717957 - RNA, 22 nt, Human
augggaagguuuugagagcggg

SEQ ID NO: 717958 - RNA, 22 nt, Human
cacaguccuacagagaucagag

SEQ ID NO: 717959 - RNA, 22 nt, Human
uccagggaugguaaugagcagu

SEQ ID NO: 717960 - RNA, 22 nt, Human
uuuuccuuugaaaggugagggc

SEQ ID NO: 717961 - RNA, 22 nt, Human
cagcuucuuacgagcugguacu

SEQ ID NO: 717962 - RNA, 22 nt, Human
ccaggccucccuuuuccagcca

SEQ ID NO: 717963 - RNA, 22 nt, Human
agcccucugcaaacaccugaua

SEQ ID NO: 717964 - RNA, 18 nt, Human
gcuuucuguagaaaaggg

SEQ ID NO: 717965 - RNA, 22 nt, Human
acagcagccagccacugugagc

SEQ ID NO: 717966 - RNA, 22 nt, Human
cuggacacacuggagucuggca

SEQ ID NO: 717967 - RNA, 22 nt, Human
ccucaaaucuuuagaguuauuu

SEQ ID NO: 717968 - RNA, 22 nt, Human
uuuguguuggaagaaaugcuac

SEQ ID NO: 717969 - RNA, 22 nt, Human
cagagccugcugccuucugaag

SEQ ID NO: 717970 - RNA, 18 nt, Human
ugucucaggcugaaacag

SEQ ID NO: 717971 - RNA, 22 nt, Human
uuccaaaugcccaucuacacag

SEQ ID NO: 717972 - RNA, 22 nt, Human
ucuuaagaaagugacaaauagg

SEQ ID NO: 717973 - RNA, 22 nt, Human
ggagcucauaacaagguagcca

SEQ ID NO: 717974 - RNA, 22 nt, Human
augaaggacaacaggggagcag

SEQ ID NO: 717975 - RNA, 22 nt, Human
ugucauugguacaaauugauug

SEQ ID NO: 717976 - RNA, 22 nt, Human
caggcucccugccagggccggc

SEQ ID NO: 717977 - RNA, 22 nt, Human
caagggaaggcuaagggcaaca

SEQ ID NO: 717978 - RNA, 22 nt, Human
auggcucucuccuuacugcugc

SEQ ID NO: 717979 - RNA, 22 nt, Human
caggggcugagaaggaacgucc

SEQ ID NO: 717980 - RNA, 22 nt, Human
uggaacacaucucgcugcaggg

SEQ ID NO: 717981 - RNA, 22 nt, Human
aaucauguuuacgugacauguc

SEQ ID NO: 717982 - RNA, 22 nt, Human
ugucuauucaauauccauuucu

SEQ ID NO: 717983 - RNA, 22 nt, Human
uacuccagacauucuguccucg

SEQ ID NO: 717984 - RNA, 22 nt, Human
cuccuacaguguuugaguccag

SEQ ID NO: 717985 - RNA, 22 nt, Human
acauacauauguuuaaaugcau

SEQ ID NO: 717986 - RNA, 22 nt, Human
acaugcauauacuuaaauaugu

SEQ ID NO: 717987 - RNA, 22 nt, Human
gauacacacccuugauaggacu

SEQ ID NO: 717988 - RNA, 22 nt, Human
gcccagcuccauucuuggugag

SEQ ID NO: 717989 - RNA, 22 nt, Human
ccaggugugauuuggcaguguc

SEQ ID NO: 717990 - RNA, 22 nt, Human
agagguauauauucuccauauu

SEQ ID NO: 717991 - RNA, 22 nt, Human
uuggaaagauuauuauuaugaa

SEQ ID NO: 717992 - RNA, 22 nt, Human
agggccaccucucuggguuccc

SEQ ID NO: 717993 - RNA, 22 nt, Human
acacugugacaaaggcuguucu

SEQ ID NO: 717994 - RNA, 22 nt, Human
cagcaggauuugaaaggaagag

SEQ ID NO: 717995 - RNA, 18 nt, Human
uggagggcuugcugcagc

SEQ ID NO: 717996 - RNA, 22 nt, Human
ugggagagcacugcagccccgg

SEQ ID NO: 717997 - RNA, 22 nt, Human
acaugcuaugagagauuacuuc

SEQ ID NO: 717998 - RNA, 22 nt, Human
acuguaaauuacauaagaacag

SEQ ID NO: 717999 - RNA, 22 nt, Human
cuggcagcuucaggacacucgg

SEQ ID NO: 718000 - RNA, 18 nt, Human
uagaggggaagaccuuua

SEQ ID NO: 718001 - RNA, 22 nt, Human
auauuguguguacaaguaguua

SEQ ID NO: 718002 - RNA, 22 nt, Human
gugggcagagcaagggaacuca

SEQ ID NO: 718003 - RNA, 20 nt, Human
ggacugaaaacacaaaccug

SEQ ID NO: 718004 - RNA, 22 nt, Human
cauuugcauaugaagaaguaag

SEQ ID NO: 718005 - RNA, 22 nt, Human
cacccaggacaggccagaugug

SEQ ID NO: 718006 - RNA, 22 nt, Human
aguauaugccagagagauagcu

SEQ ID NO: 718007 - RNA, 22 nt, Human
agaguuggcccacguguaggcg

SEQ ID NO: 718008 - RNA, 22 nt, Human
auuucccagggcccucauaguu

SEQ ID NO: 718009 - RNA, 22 nt, Human
ccagcucuaaacggcucugugg

SEQ ID NO: 718010 - RNA, 22 nt, Human
aguccgccugcugccguggcag

SEQ ID NO: 718011 - RNA, 22 nt, Human
uccucagauaccuggcagauca

SEQ ID NO: 718012 - RNA, 22 nt, Human
cagucucugucaucucauggga

SEQ ID NO: 718013 - RNA, 22 nt, Human
cuacagaaacacuggacaugug

SEQ ID NO: 718014 - RNA, 22 nt, Human
ucagagaggcaauacuguuuaa

SEQ ID NO: 718015 - RNA, 22 nt, Human
accaggcagucaccguccagga

SEQ ID NO: 718016 - RNA, 22 nt, Human
uuaauuacaaaacacauagguu

SEQ ID NO: 718017 - RNA, 22 nt, Human
caugagugaguaucucaagaua

SEQ ID NO: 718018 - RNA, 22 nt, Human
ugcugccagagagacagggacu

SEQ ID NO: 718019 - RNA, 22 nt, Human
auaaguguguaaggcauucugu

SEQ ID NO: 718020 - RNA, 22 nt, Human
agucuggccuugccuugucgag

SEQ ID NO: 718021 - RNA, 22 nt, Human
uuuguaaaauuagggaauucaa

SEQ ID NO: 718022 - RNA, 18 nt, Human
uccucagccucaccuagc

SEQ ID NO: 718023 - RNA, 22 nt, Human
gcacugcagccucagauggugg

SEQ ID NO: 718024 - RNA, 21 nt, Human
ugcaauauauauuugccugaa

SEQ ID NO: 718025 - RNA, 22 nt, Human
caggaagggaaaauaguucggg

SEQ ID NO: 718026 - RNA, 22 nt, Human
cugggaaggggaagguccucuc

SEQ ID NO: 718027 - RNA, 22 nt, Human
uucugggcaccaccacagacuu

SEQ ID NO: 718028 - RNA, 22 nt, Human
guuauacuuaugugcaaaaaua

SEQ ID NO: 718029 - RNA, 22 nt, Human
uucaaauuaccacauuugcuua

SEQ ID NO: 718030 - RNA, 22 nt, Human
guguuaauggcuaugaacugau

SEQ ID NO: 718031 - RNA, 21 nt, Human
cucuggaggcaagggagagug

SEQ ID NO: 718032 - RNA, 22 nt, Human
uggcccuguucuguaccucaua

SEQ ID NO: 718033 - RNA, 22 nt, Human
ggccaccuccgugaaggaauga

SEQ ID NO: 718034 - RNA, 22 nt, Human
gacacugaagucacuaagcagg

SEQ ID NO: 718035 - RNA, 22 nt, Human
aagauacauaaagguagagucu

SEQ ID NO: 718036 - RNA, 22 nt, Human
uaacaacaugcaauuuaaccuu

SEQ ID NO: 718037 - RNA, 23 nt, Human
aaaugcagggucgcagguuacag

SEQ ID NO: 718038 - RNA, 22 nt, Human
cagguuuacaaaguaaagugug

SEQ ID NO: 718039 - RNA, 22 nt, Human
cuuaacaagcccaacuuucauu

SEQ ID NO: 718040 - RNA, 22 nt, Human
uucaggagaauuccaagaagua

SEQ ID NO: 718041 - RNA, 22 nt, Human
aaaauaucagcaaagggugaca

SEQ ID NO: 718042 - RNA, 22 nt, Human
cugccugcugauuaguauuguc

SEQ ID NO: 718043 - RNA, 22 nt, Human
aucaaaaccuugacuuuuaaug

SEQ ID NO: 718044 - RNA, 22 nt, Human
uuccuucuggagcccggggagc

SEQ ID NO: 718045 - RNA, 22 nt, Human
cugcccucgggcccucccauag

SEQ ID NO: 718046 - RNA, 22 nt, Human
auguaaguauucaaaauauuuc

SEQ ID NO: 718047 - RNA, 22 nt, Human
uccugagugagagcugggaggu

SEQ ID NO: 718048 - RNA, 22 nt, Human
ugaggggccgcccaagcacuuc

SEQ ID NO: 718049 - RNA, 22 nt, Human
aaugcaaacuucuuguuacuug

SEQ ID NO: 718050 - RNA, 22 nt, Human
ugucccugguggaggcuggcag

SEQ ID NO: 718051 - RNA, 22 nt, Human
ucagaagcaggagugugcacaa

SEQ ID NO: 718052 - RNA, 22 nt, Human
uuuaaccaguuuacaaagaauu

SEQ ID NO: 718053 - RNA, 22 nt, Human
ggugcccugccaggaugugcca

SEQ ID NO: 718054 - RNA, 22 nt, Human
ggggucugcugcggagcagaga

SEQ ID NO: 718055 - RNA, 22 nt, Human
uccagaggcuccaaagggagau

SEQ ID NO: 718056 - RNA, 21 nt, Human
ucuuuucucagcuuugugguu

SEQ ID NO: 718057 - RNA, 23 nt, Human
ucugggcauaucuagucacaucg

SEQ ID NO: 718058 - RNA, 22 nt, Human
cuucccuuucuggugacuucuc

SEQ ID NO: 718059 - RNA, 18 nt, Human
gcuccuggagucugacuc

SEQ ID NO: 718060 - RNA, 22 nt, Human
cuucaguuagaguuuacaaagu

SEQ ID NO: 718061 - RNA, 22 nt, Human
uccuuuggacacauuuuuuaua

SEQ ID NO: 718062 - RNA, 22 nt, Human
uacuguuuucuuuauaguacag

SEQ ID NO: 718063 - RNA, 22 nt, Human
gagaaagcuucuuucccacagg

SEQ ID NO: 718064 - RNA, 22 nt, Human
uggucugagcggggccauucag

SEQ ID NO: 718065 - RNA, 22 nt, Human
ugccugcuuguuuaccuacucc

SEQ ID NO: 718066 - RNA, 22 nt, Human
cagcacacagugacucgcaccu

SEQ ID NO: 718067 - RNA, 22 nt, Human
ugcagaagacacaagguaacgu

SEQ ID NO: 718068 - RNA, 22 nt, Human
ggcaggaaaacaaugagccagg

SEQ ID NO: 718069 - RNA, 22 nt, Human
uguggaagaaacaagacacuuu

SEQ ID NO: 718070 - RNA, 22 nt, Human
gucuuccuaauuugcuauuagg

SEQ ID NO: 718071 - RNA, 22 nt, Human
auggaucacagugccgugggug

SEQ ID NO: 718072 - RNA, 22 nt, Human
gaagcccacguuuggugaugua

SEQ ID NO: 718073 - RNA, 22 nt, Human
auguuaaauagccauuuguuug

SEQ ID NO: 718074 - RNA, 22 nt, Human
ugcuggagcaucugagagcauc

SEQ ID NO: 718075 - RNA, 22 nt, Human
aaauugcauugagcugcuuauu

SEQ ID NO: 718076 - RNA, 22 nt, Human
uauugacaggugccugcagaca

SEQ ID NO: 718077 - RNA, 22 nt, Human
uaauguuugagauguuggauuu

SEQ ID NO: 718078 - RNA, 22 nt, Human
uggguuaacaguuuauaccaga

SEQ ID NO: 718079 - RNA, 22 nt, Human
ggcuccauccaaggccuucuag

SEQ ID NO: 718080 - RNA, 22 nt, Human
uuugcugaacuaaaauucugaa

SEQ ID NO: 718081 - RNA, 22 nt, Human
aaagacauuagcuuagauguca

SEQ ID NO: 718082 - RNA, 22 nt, Human
uagucaacuagugagcauaugg

SEQ ID NO: 718083 - RNA, 22 nt, Human
auaauccugcuuuuucacuauu

SEQ ID NO: 718084 - RNA, 22 nt, Human
uuuguaacauuauggacugcuu

SEQ ID NO: 718085 - RNA, 23 nt, Human
uaugugcauauguguaagaauac

SEQ ID NO: 718086 - RNA, 22 nt, Human
acugagaaagaccacauggaga

SEQ ID NO: 718087 - RNA, 22 nt, Human
ugagaagcauuaggaagaacau

SEQ ID NO: 718088 - RNA, 23 nt, Human
ugauggccgcccuuugcccuguc

SEQ ID NO: 718089 - RNA, 22 nt, Human
cccagagaucuuguccuuucca

SEQ ID NO: 718090 - RNA, 22 nt, Human
ccugaggcuuaaucugucccaa

SEQ ID NO: 718091 - RNA, 22 nt, Human
ucuaggaggcggagauugcagu

SEQ ID NO: 718092 - RNA, 22 nt, Human
uuugugcagguauaggcggaga

SEQ ID NO: 718093 - RNA, 23 nt, Human
ucugauguucucuuaugcuguag

SEQ ID NO: 718094 - RNA, 22 nt, Human
cuggcacauagucagcacucaa

SEQ ID NO: 718095 - RNA, 22 nt, Human
aauuggaaaaagacuuaauugc

SEQ ID NO: 718096 - RNA, 22 nt, Human
gggagcaggagccugccugcca

SEQ ID NO: 718097 - RNA, 21 nt, Human
ugcagccauucagcccuaugc

SEQ ID NO: 718098 - RNA, 23 nt, Human
gggauauggaccuuggaggaguc

SEQ ID NO: 718099 - RNA, 22 nt, Human
acagugagcccacuccaggaga

SEQ ID NO: 718100 - RNA, 22 nt, Human
ggagguucugauuugucacaac

SEQ ID NO: 718101 - RNA, 22 nt, Human
aagaaaugugaauauugaauag

SEQ ID NO: 718102 - RNA, 22 nt, Human
cagcauuuaaugcagugcuucc

SEQ ID NO: 718103 - RNA, 22 nt, Human
cagccacagcugggugccugac

SEQ ID NO: 718104 - RNA, 22 nt, Human
uccuggccuccguucucugcau

SEQ ID NO: 718105 - RNA, 22 nt, Human
gcccaccuaaccugcucaccuu

SEQ ID NO: 718106 - RNA, 22 nt, Human
uagugucucggggcccaggauu

SEQ ID NO: 718107 - RNA, 22 nt, Human
acccaggagcaggcugggcagu

SEQ ID NO: 718108 - RNA, 22 nt, Human
augaccagccgagauaaacaga

SEQ ID NO: 718109 - RNA, 22 nt, Human
caaggacacucccugcugggca

SEQ ID NO: 718110 - RNA, 22 nt, Human
uaagcaaaggauuuugaucuuu

SEQ ID NO: 718111 - RNA, 23 nt, Human
aggaaguuaaggcagacagacag

SEQ ID NO: 718112 - RNA, 22 nt, Human
uagggcagccuuauagcuccca

SEQ ID NO: 718113 - RNA, 22 nt, Human
ucuaacauuguuuuucacagau

SEQ ID NO: 718114 - RNA, 22 nt, Human
ucccuaaacucugaacugauuc

SEQ ID NO: 718115 - RNA, 22 nt, Human
caacaauaugcugaguuuuuca

SEQ ID NO: 718116 - RNA, 22 nt, Human
aacaacuugcguucagagaugu

SEQ ID NO: 718117 - RNA, 22 nt, Human
cucacagguucugcagcucaca

SEQ ID NO: 718118 - RNA, 22 nt, Human
caagagcuacccugugccauau

SEQ ID NO: 718119 - RNA, 22 nt, Human
aaauucauauguugaaaugcua

SEQ ID NO: 718120 - RNA, 22 nt, Human
gacucugugggaggaggcucag

SEQ ID NO: 718121 - RNA, 22 nt, Human
aaauccuaagcagaggaauuua

SEQ ID NO: 718122 - RNA, 22 nt, Human
agcucugggccaggaacccuaa

SEQ ID NO: 718123 - RNA, 22 nt, Human
ugcucugguaacucacuuccau

SEQ ID NO: 718124 - RNA, 22 nt, Human
cucucaggcuugggucguggca

SEQ ID NO: 718125 - RNA, 22 nt, Human
cacagggccuugugugacugca

SEQ ID NO: 718126 - RNA, 18 nt, Human
cugacccuuuuacauucc

SEQ ID NO: 718127 - RNA, 22 nt, Human
agagcugagaauguggcuuccu

SEQ ID NO: 718128 - RNA, 22 nt, Human
caggaaaugaaagcuagcuaau

SEQ ID NO: 718129 - RNA, 22 nt, Human
uuuucuaacuuuacacucgaaa

SEQ ID NO: 718130 - RNA, 22 nt, Human
aggccacagguggaagccagag

SEQ ID NO: 718131 - RNA, 22 nt, Human
cagcccuggcccaggugccuua

SEQ ID NO: 718132 - RNA, 23 nt, Human
cagcacaguacauuuccugucuc

SEQ ID NO: 718133 - RNA, 22 nt, Human
cucuaaauccaaauaagugucc

SEQ ID NO: 718134 - RNA, 22 nt, Human
aggaauuuuguauggauacugu

SEQ ID NO: 718135 - RNA, 19 nt, Human
ugcaagcuuuuucuuguua

SEQ ID NO: 718136 - RNA, 22 nt, Human
aggggacauuuagcaaugacua

SEQ ID NO: 718137 - RNA, 22 nt, Human
cauuaacaauuguuuaugcugu

SEQ ID NO: 718138 - RNA, 22 nt, Human
ugaugggaaaaugaggccuggg

SEQ ID NO: 718139 - RNA, 22 nt, Human
cggagcagagccacucgggccg

SEQ ID NO: 718140 - RNA, 22 nt, Human
ugucauggugcuauuuaauuag

SEQ ID NO: 718141 - RNA, 22 nt, Human
uguuccuaaauaugaauggaga

SEQ ID NO: 718142 - RNA, 22 nt, Human
cuggaagaguccuaaacagaua

SEQ ID NO: 718143 - RNA, 22 nt, Human
uucuguggucucccaugucugu

SEQ ID NO: 718144 - RNA, 22 nt, Human
uuccuaaugucuacuuuaguuc

SEQ ID NO: 718145 - RNA, 22 nt, Human
uuucaagcauaacugggaagag

SEQ ID NO: 718146 - RNA, 22 nt, Human
uuagccaggggagcagcuuguc

SEQ ID NO: 718147 - RNA, 22 nt, Human
acugccugaugugguucuaaau

SEQ ID NO: 718148 - RNA, 22 nt, Human
auugucucuuaaauguggaaau

SEQ ID NO: 718149 - RNA, 22 nt, Human
aggagcugcuuaaaugguuggu

SEQ ID NO: 718150 - RNA, 22 nt, Human
agucuggguggcugagcuacag

SEQ ID NO: 718151 - RNA, 22 nt, Human
ucccccacucuaaaggagccuu

SEQ ID NO: 718152 - RNA, 22 nt, Human
ugccaccccucugcacccucag

SEQ ID NO: 718153 - RNA, 22 nt, Human
uccucuucugcccaucagaggc

SEQ ID NO: 718154 - RNA, 22 nt, Human
gcuucaugcuugcuccaaagcu

SEQ ID NO: 718155 - RNA, 22 nt, Human
uuuguuaaauauuuauugagug

SEQ ID NO: 718156 - RNA, 22 nt, Human
cuggggugugcucagagcaggg

SEQ ID NO: 718157 - RNA, 22 nt, Human
ucagaagaagguauauuuauac

SEQ ID NO: 718158 - RNA, 22 nt, Human
uuuuuguucccagagaauuugu

SEQ ID NO: 718159 - RNA, 22 nt, Human
ggauucuacugaucagcaccac

SEQ ID NO: 718160 - RNA, 22 nt, Human
ccugagccgagcgcucuuucuc

SEQ ID NO: 718161 - RNA, 22 nt, Human
cugcagcagccuccagccuugg

SEQ ID NO: 718162 - RNA, 22 nt, Human
ggcaggcagccuccauccacag

SEQ ID NO: 718163 - RNA, 22 nt, Human
auggcaguacguugaaaauuuu

SEQ ID NO: 718164 - RNA, 22 nt, Human
uugcccagaguccacagcguac

SEQ ID NO: 718165 - RNA, 22 nt, Human
ccaggacccugcaaacccuguu

SEQ ID NO: 718166 - RNA, 22 nt, Human
cagcagaguuuggcuucuaaug

SEQ ID NO: 718167 - RNA, 22 nt, Human
guugaaagaucauguggcugcc

SEQ ID NO: 718168 - RNA, 22 nt, Human
uuaagugucauaauuuccaaga

SEQ ID NO: 718169 - RNA, 22 nt, Human
gccugagugcaucugcagacau

SEQ ID NO: 718170 - RNA, 22 nt, Human
gggcaugcaggacuguggcaga

SEQ ID NO: 718171 - RNA, 22 nt, Human
ucuuucaaugagcauucuuucc

SEQ ID NO: 718172 - RNA, 22 nt, Human
auggccaggguggcacuguggu

SEQ ID NO: 718173 - RNA, 22 nt, Human
accaggcagagcugggccuuaa

SEQ ID NO: 718174 - RNA, 22 nt, Human
aguguacauucuguuugaggua

SEQ ID NO: 718175 - RNA, 22 nt, Human
ugcuuaaaaugaugauuauuuu

SEQ ID NO: 718176 - RNA, 22 nt, Human
uucagacuucuugacuggcuuu

SEQ ID NO: 718177 - RNA, 22 nt, Human
aaaugcaccuugcugugagacu

SEQ ID NO: 718178 - RNA, 22 nt, Human
aauccauugcugugcugccagg

SEQ ID NO: 718179 - RNA, 22 nt, Human
acugggaauggagccugggccu

SEQ ID NO: 718180 - RNA, 22 nt, Human
uucauauauaugcacuacguac

SEQ ID NO: 718181 - RNA, 22 nt, Human
cagaauguauucucauaaagcc

SEQ ID NO: 718182 - RNA, 22 nt, Human
uuugggaacucuaucauggaaa

SEQ ID NO: 718183 - RNA, 22 nt, Human
caaucacucugcaacauuccug

SEQ ID NO: 718184 - RNA, 22 nt, Human
uucaagcagggauuggugaugg

SEQ ID NO: 718185 - RNA, 22 nt, Human
acugcucaaggaucugguaggg

SEQ ID NO: 718186 - RNA, 22 nt, Human
uuugacaucaauacccuagaau

SEQ ID NO: 718187 - RNA, 22 nt, Human
uggcagcaauuagcuagagcug

SEQ ID NO: 718188 - RNA, 22 nt, Human
gugggcaggguugcuuucuccg

SEQ ID NO: 718189 - RNA, 22 nt, Human
aauauuuuaggcuuuccaggcu

SEQ ID NO: 718190 - RNA, 22 nt, Human
uauuuauucuuuguacugccuu

SEQ ID NO: 718191 - RNA, 22 nt, Human
ucucucuucaacccuuaacuag

SEQ ID NO: 718192 - RNA, 22 nt, Human
ucuuucuguaagcuccauggaa

SEQ ID NO: 718193 - RNA, 22 nt, Human
agaagaaagauugaagguuccu

SEQ ID NO: 718194 - RNA, 22 nt, Human
ggagcugggguuggcaucuucc

SEQ ID NO: 718195 - RNA, 22 nt, Human
ucuuggcuaguaccuuccugcc

SEQ ID NO: 718196 - RNA, 22 nt, Human
ucagaacaggacuggcugccau

SEQ ID NO: 718197 - RNA, 22 nt, Human
gaucauuugcaggaaacauuaa

SEQ ID NO: 718198 - RNA, 22 nt, Human
uaugcuuuuaaccuguaacuga

SEQ ID NO: 718199 - RNA, 20 nt, Human
ggccuuggguuucgccuguu

SEQ ID NO: 718200 - RNA, 19 nt, Human
gcugcagaguauucuuggg

SEQ ID NO: 718201 - RNA, 22 nt, Human
auguccagccaaccacuggauu

SEQ ID NO: 718202 - RNA, 22 nt, Human
guggccagcaagugcugccucu

SEQ ID NO: 718203 - RNA, 17 nt, Human
gcacaaaucaauuacua

SEQ ID NO: 718204 - RNA, 22 nt, Human
aggcccuucuugguggcucagg

SEQ ID NO: 718205 - RNA, 22 nt, Human
augcaaaauaaggcagaaacau

SEQ ID NO: 718206 - RNA, 22 nt, Human
gcuccuucaggugguagcuguu

SEQ ID NO: 718207 - RNA, 22 nt, Human
cccagagauguccugagugaua

SEQ ID NO: 718208 - RNA, 22 nt, Human
gacuuuaaagccugacauuuua

SEQ ID NO: 718209 - RNA, 23 nt, Human
uuacaaggaagugcacagauggg

SEQ ID NO: 718210 - RNA, 22 nt, Human
cauuucugggagacaugcuaga

SEQ ID NO: 718211 - RNA, 22 nt, Human
cugggcuugaguuccugcucgu

SEQ ID NO: 718212 - RNA, 22 nt, Human
gugggcaguucaauucugggag

SEQ ID NO: 718213 - RNA, 22 nt, Human
agucaaauaagacugucauaag

SEQ ID NO: 718214 - RNA, 22 nt, Human
auaaaaggaaagccuguuguga

SEQ ID NO: 718215 - RNA, 22 nt, Human
aaucagcagaagagaggucuua

SEQ ID NO: 718216 - RNA, 22 nt, Human
uuaauucagucaaagaaaccau

SEQ ID NO: 718217 - RNA, 22 nt, Human
ccagcaucuguccuuucccuca

SEQ ID NO: 718218 - RNA, 22 nt, Human
acagcauugcuccaucucaaga

SEQ ID NO: 718219 - RNA, 22 nt, Human
ugugugccccagaugaguagcu

SEQ ID NO: 718220 - RNA, 22 nt, Human
gacuguacuugagagaggaacu

SEQ ID NO: 718221 - RNA, 22 nt, Human
cacaaggaccucagauggauga

SEQ ID NO: 718222 - RNA, 22 nt, Human
cagagcuggguuugggaaaccu

SEQ ID NO: 718223 - RNA, 22 nt, Human
gagcgggaggaacggcucgggc

SEQ ID NO: 718224 - RNA, 22 nt, Human
cagugcugggcagaggagagcg

SEQ ID NO: 718225 - RNA, 22 nt, Human
cacauccuaucagucacgguuu

SEQ ID NO: 718226 - RNA, 22 nt, Human
cugaaagguauaaauaagacuu

SEQ ID NO: 718227 - RNA, 22 nt, Human
uucaacauuuaucaguuuauca

SEQ ID NO: 718228 - RNA, 22 nt, Human
agaagaaaugugaaggccacug

SEQ ID NO: 718229 - RNA, 22 nt, Human
ucaaaggaguuuaaguuacugg

SEQ ID NO: 718230 - RNA, 22 nt, Human
gggcuucuugcaggggcaacau

SEQ ID NO: 718231 - RNA, 22 nt, Human
gggcugaggaacauauuuuguu

SEQ ID NO: 718232 - RNA, 22 nt, Human
aagcucaggcuggaccuggcuu

SEQ ID NO: 718233 - RNA, 22 nt, Human
uauucaaaguaccuucauugcc

SEQ ID NO: 718234 - RNA, 22 nt, Human
uguggccagccacaggcauggu

SEQ ID NO: 718235 - RNA, 22 nt, Human
ccagggcugagcugugaccaug

SEQ ID NO: 718236 - RNA, 19 nt, Human
augucucuguagcacauac

SEQ ID NO: 718237 - RNA, 22 nt, Human
guuacagucaggagauauuuug

SEQ ID NO: 718238 - RNA, 22 nt, Human
gugaggggaguaaagccauguu

SEQ ID NO: 718239 - RNA, 22 nt, Human
ugcaggcugccuucacagagcc

SEQ ID NO: 718240 - RNA, 22 nt, Human
uaagugaauauuuucuucugua

SEQ ID NO: 718241 - RNA, 22 nt, Human
ccagucuggcaggagggggaac

SEQ ID NO: 718242 - RNA, 22 nt, Human
agagggcauuaacucugucuug

SEQ ID NO: 718243 - RNA, 19 nt, Human
caguuuaugcuuuggggac

SEQ ID NO: 718244 - RNA, 22 nt, Human
cuuggcugaacuccaggaugca

SEQ ID NO: 718245 - RNA, 22 nt, Human
caugggccauggugaagccagg

SEQ ID NO: 718246 - RNA, 22 nt, Human
uuccuguggcugucacuccugg

SEQ ID NO: 718247 - RNA, 22 nt, Human
ugccugucuucaggagugucac

SEQ ID NO: 718248 - RNA, 22 nt, Human
uauuuauauucugccuucugcu

SEQ ID NO: 718249 - RNA, 22 nt, Human
agaggccagcacugcagggaag

SEQ ID NO: 718250 - RNA, 22 nt, Human
cugagcagcaacccagagccuc

SEQ ID NO: 718251 - RNA, 22 nt, Human
gcaugugucccucagucugugc

SEQ ID NO: 718252 - RNA, 22 nt, Human
agacccacacuuugaguagcaa

SEQ ID NO: 718253 - RNA, 22 nt, Human
uacuuuuuagcacagugugugc

SEQ ID NO: 718254 - RNA, 22 nt, Human
auugcugugaugauguucugag

SEQ ID NO: 718255 - RNA, 17 nt, Human
ggagagugggaauggcc

SEQ ID NO: 718256 - RNA, 18 nt, Human
gcucugcccaggcugccc

SEQ ID NO: 718257 - RNA, 22 nt, Human
cugugcuggauucugaggcuac

SEQ ID NO: 718258 - RNA, 22 nt, Human
gucugaaacgcauuguuaucga

SEQ ID NO: 718259 - RNA, 22 nt, Human
gucugcuguucagagauguugc

SEQ ID NO: 718260 - RNA, 22 nt, Human
uuuugugagaugcguaugaaug

SEQ ID NO: 718261 - RNA, 22 nt, Human
gacaaagagaaguaacaguacc

SEQ ID NO: 718262 - RNA, 22 nt, Human
gaggcaaggccgcacgucucag

SEQ ID NO: 718263 - RNA, 22 nt, Human
uuugugcagugguuaagaccau

SEQ ID NO: 718264 - RNA, 22 nt, Human
cuggacucacuauggcuucaga

SEQ ID NO: 718265 - RNA, 22 nt, Human
acacagaguauuuagaaggggu

SEQ ID NO: 718266 - RNA, 22 nt, Human
auuccagaugaauugcauaguu

SEQ ID NO: 718267 - RNA, 22 nt, Human
agggcugggcugcuuguuguca

SEQ ID NO: 718268 - RNA, 22 nt, Human
aaggccugggaggccucucuuc

SEQ ID NO: 718269 - RNA, 22 nt, Human
ucaccauuggcaauuauaaaac

SEQ ID NO: 718270 - RNA, 17 nt, Human
gagccccuuuccaaguu

SEQ ID NO: 718271 - RNA, 22 nt, Human
caggguaguaauuuaauacaag

SEQ ID NO: 718272 - RNA, 22 nt, Human
auccugucuuuguuuuaaauau

SEQ ID NO: 718273 - RNA, 22 nt, Human
uuguuuuaucuuucuacagacu

SEQ ID NO: 718274 - RNA, 19 nt, Human
acugagaccacagacaagu

SEQ ID NO: 718275 - RNA, 22 nt, Human
agagcagugcugaagaguaggg

SEQ ID NO: 718276 - RNA, 22 nt, Human
ucucagggaguugaggcugccu

SEQ ID NO: 718277 - RNA, 22 nt, Human
gagcuaaggucacaagaagcag

SEQ ID NO: 718278 - RNA, 21 nt, Human
ucuguacuuugcuuccaugcu

SEQ ID NO: 718279 - RNA, 22 nt, Human
cuuuacuguuuggugcucuauu

SEQ ID NO: 718280 - RNA, 22 nt, Human
cugugucuaaucuuauacauca

SEQ ID NO: 718281 - RNA, 20 nt, Human
ucuguuauugcauguacaua

SEQ ID NO: 718282 - RNA, 22 nt, Human
agauguaccagguauuacagga

SEQ ID NO: 718283 - RNA, 20 nt, Human
uccaugaguuagagacuaua

SEQ ID NO: 718284 - RNA, 22 nt, Human
augucuguacgaguuacaaugg

SEQ ID NO: 718285 - RNA, 22 nt, Human
aagacauuuauuugaaucaauu

SEQ ID NO: 718286 - RNA, 22 nt, Human
gaaauuguaaaggauugcgcca

SEQ ID NO: 718287 - RNA, 21 nt, Human
uccccucacuugucuucugag

SEQ ID NO: 718288 - RNA, 22 nt, Human
aguguucuucuucaaagcucug

SEQ ID NO: 718289 - RNA, 22 nt, Human
uacauuaucuuguuaucuuuca

SEQ ID NO: 718290 - RNA, 22 nt, Human
auaaacaguagagaaagguggu

SEQ ID NO: 718291 - RNA, 23 nt, Human
uccaugagaugugggcuucuagu

SEQ ID NO: 718292 - RNA, 22 nt, Human
aaucaucccaacugagaauccc

SEQ ID NO: 718293 - RNA, 22 nt, Human
gcccuucaguuacuccuugaug

SEQ ID NO: 718294 - RNA, 22 nt, Human
uaucuguauccccaucuagcua

SEQ ID NO: 718295 - RNA, 22 nt, Human
gugagcagccucaccugagggu

SEQ ID NO: 718296 - RNA, 22 nt, Human
auggaauaggcugcucuuuaaa

SEQ ID NO: 718297 - RNA, 22 nt, Human
cgaugggggcaguguuacauug

SEQ ID NO: 718298 - RNA, 23 nt, Human
ccucaaauguagccuuuuuccca

SEQ ID NO: 718299 - RNA, 22 nt, Human
cugagggccugaggaccuagau

SEQ ID NO: 718300 - RNA, 22 nt, Human
cuucaugaugaccaacugccau

SEQ ID NO: 718301 - RNA, 23 nt, Human
uugcuuagagaccuccucaucag

SEQ ID NO: 718302 - RNA, 22 nt, Human
aagaccugccagccucauccug

SEQ ID NO: 718303 - RNA, 22 nt, Human
agagcuggcugcugcggugcuu

SEQ ID NO: 718304 - RNA, 22 nt, Human
aagucacacaguuaacaugagg

SEQ ID NO: 718305 - RNA, 22 nt, Human
uggaaccuaaaaaugucauugc

SEQ ID NO: 718306 - RNA, 22 nt, Human
gacagaguuguugauguaugcu

SEQ ID NO: 718307 - RNA, 22 nt, Human
uagcagggaaggugugcugagc

SEQ ID NO: 718308 - RNA, 22 nt, Human
gcuguguguucaauaaugugau

SEQ ID NO: 718309 - RNA, 22 nt, Human
uguaagaauaaugauuucuaag

SEQ ID NO: 718310 - RNA, 22 nt, Human
ggagaaggguauguguggcgga

SEQ ID NO: 718311 - RNA, 22 nt, Human
cggcuggggcuguccccaugac

SEQ ID NO: 718312 - RNA, 22 nt, Human
augcauguauucaugugugaca

SEQ ID NO: 718313 - RNA, 22 nt, Human
aaauggaucuguggaauacauu

SEQ ID NO: 718314 - RNA, 20 nt, Human
uuauuucucauucuccuacu

SEQ ID NO: 718315 - RNA, 22 nt, Human
cugagccaugagccugcgccca

SEQ ID NO: 718316 - RNA, 22 nt, Human
agguccugucuuaucucuguaa

SEQ ID NO: 718317 - RNA, 22 nt, Human
auuggcaaggcugcggugucug

SEQ ID NO: 718318 - RNA, 22 nt, Human
aggccucauaguagaccugccc

SEQ ID NO: 718319 - RNA, 22 nt, Human
gcugauccuuuuaugucuagcu

SEQ ID NO: 718320 - RNA, 22 nt, Human
cuuuaaggugaugagagaugcu

SEQ ID NO: 718321 - RNA, 22 nt, Human
acaucauuguccguugucauga

SEQ ID NO: 718322 - RNA, 22 nt, Human
aggcucagaggugagcaucugc

SEQ ID NO: 718323 - RNA, 22 nt, Human
gacagggacgaggcuucaggca

SEQ ID NO: 718324 - RNA, 22 nt, Human
aagauauucaaagauuuauuag

SEQ ID NO: 718325 - RNA, 22 nt, Human
uuagcugaguggugcuggcuca

SEQ ID NO: 718326 - RNA, 22 nt, Human
aaacacuguacaaucugcaggg

SEQ ID NO: 718327 - RNA, 22 nt, Human
uaacuuuaugacaugucuugcu

SEQ ID NO: 718328 - RNA, 22 nt, Human
gcagcugccaguccccuuccag

SEQ ID NO: 718329 - RNA, 22 nt, Human
agcacaggugaaacagucaggu

SEQ ID NO: 718330 - RNA, 22 nt, Human
uauacagauggaaagauacaca

SEQ ID NO: 718331 - RNA, 22 nt, Human
ugggcagaaugugggauccaga

SEQ ID NO: 718332 - RNA, 22 nt, Human
aguuauuuuggaaaaugaguca

SEQ ID NO: 718333 - RNA, 22 nt, Human
ucugucacucuagagauggcag

SEQ ID NO: 718334 - RNA, 22 nt, Human
aacacuguaacagcaucauuuu

SEQ ID NO: 718335 - RNA, 22 nt, Human
ugaauauguauuucuuauuuac

SEQ ID NO: 718336 - RNA, 21 nt, Human
cuucuuggggagcagcuagac

SEQ ID NO: 718337 - RNA, 22 nt, Human
uucauauuugaaacagaaguua

SEQ ID NO: 718338 - RNA, 22 nt, Human
ugcugaggaauuugguuuaugu

SEQ ID NO: 718339 - RNA, 22 nt, Human
cacauagauaggcagaagaaca

SEQ ID NO: 718340 - RNA, 22 nt, Human
uuccucuguaugcuuugcugcu

SEQ ID NO: 718341 - RNA, 22 nt, Human
aaguguguugacugaauugggg

SEQ ID NO: 718342 - RNA, 23 nt, Human
uuggcagcgggucaggcuguggg

SEQ ID NO: 718343 - RNA, 22 nt, Human
ucugggugacccugggcaaggc

SEQ ID NO: 718344 - RNA, 22 nt, Human
ucauauaagagcuuuagaguca

SEQ ID NO: 718345 - RNA, 22 nt, Human
gagggcucugucuggaagggaa

SEQ ID NO: 718346 - RNA, 19 nt, Human
cccaaggcccugggcaggc

SEQ ID NO: 718347 - RNA, 22 nt, Human
acuggaggggaaaaugguagua

SEQ ID NO: 718348 - RNA, 22 nt, Human
cuacaggaaggaucuugcucaa

SEQ ID NO: 718349 - RNA, 23 nt, Human
uuuguucacuccugggaaagaca

SEQ ID NO: 718350 - RNA, 22 nt, Human
aagagacuggaaacuaggguca

SEQ ID NO: 718351 - RNA, 22 nt, Human
cacagguggcuccaaguuagag

SEQ ID NO: 718352 - RNA, 22 nt, Human
aucagagaccggucaagucaug

SEQ ID NO: 718353 - RNA, 22 nt, Human
agggcuccuaugaugcucugcc

SEQ ID NO: 718354 - RNA, 22 nt, Human
ucuuccagagccuccaucccua

SEQ ID NO: 718355 - RNA, 23 nt, Human
ccagcucccaggucugaggacug

SEQ ID NO: 718356 - RNA, 22 nt, Human
uguguuucagaaccuucuuuca

SEQ ID NO: 718357 - RNA, 22 nt, Human
gcagcaguggucuguagaagga

SEQ ID NO: 718358 - RNA, 22 nt, Human
cccugggaggcuuccaggcaga

SEQ ID NO: 718359 - RNA, 22 nt, Human
aaaugugcuucuuacucucaau

SEQ ID NO: 718360 - RNA, 21 nt, Human
agcuuuucuguuuuauaucua

SEQ ID NO: 718361 - RNA, 18 nt, Human
gcugcaggcgccugcggu

SEQ ID NO: 718362 - RNA, 22 nt, Human
agcuggguggccucuccucggg

SEQ ID NO: 718363 - RNA, 22 nt, Human
uuggaaagcaagcuggacauac

SEQ ID NO: 718364 - RNA, 22 nt, Human
acacauuuacauguuuacguau

SEQ ID NO: 718365 - RNA, 22 nt, Human
ccugcuggcugguagaguuccg

SEQ ID NO: 718366 - RNA, 22 nt, Human
auucagcaguuccugcuucagu

SEQ ID NO: 718367 - RNA, 22 nt, Human
aggcuucaggaagucuccuggg

SEQ ID NO: 718368 - RNA, 22 nt, Human
uucugcaucucacagccagugc

SEQ ID NO: 718369 - RNA, 22 nt, Human
gaaacugugaucguguucuggg

SEQ ID NO: 718370 - RNA, 22 nt, Human
cggcuucaaagggagcgagauc

SEQ ID NO: 718371 - RNA, 22 nt, Human
ucacaugcuacugagccagacc

SEQ ID NO: 718372 - RNA, 22 nt, Human
ugaggggagcccgcccuggacg

SEQ ID NO: 718373 - RNA, 22 nt, Human
gcccugaggcaaaagaacaguc

SEQ ID NO: 718374 - RNA, 22 nt, Human
ccucugcaaagaauuugucucc

SEQ ID NO: 718375 - RNA, 22 nt, Human
acacagggcaaugcuuugaccu

SEQ ID NO: 718376 - RNA, 19 nt, Human
gguggguuggugguucccu

SEQ ID NO: 718377 - RNA, 22 nt, Human
aggcucucuagaaacugugccu

SEQ ID NO: 718378 - RNA, 22 nt, Human
aaauuccauuuugugacuauuc

SEQ ID NO: 718379 - RNA, 22 nt, Human
guaucuuuaucccucguuggag

SEQ ID NO: 718380 - RNA, 22 nt, Human
cuggguucucugcuuagggccu

SEQ ID NO: 718381 - RNA, 18 nt, Human
acucugggaccuguuauu

SEQ ID NO: 718382 - RNA, 22 nt, Human
uguggcuccacuccacauuaau

SEQ ID NO: 718383 - RNA, 22 nt, Human
aucaggaucacugggagucuug

SEQ ID NO: 718384 - RNA, 22 nt, Human
gggaauguaaucauggaaugcu

SEQ ID NO: 718385 - RNA, 22 nt, Human
ccagaggaguugaggcuuuggg

SEQ ID NO: 718386 - RNA, 17 nt, Human
uccagagcacagagcuc

SEQ ID NO: 718387 - RNA, 19 nt, Human
ucugguucauuucugcugu

SEQ ID NO: 718388 - RNA, 22 nt, Human
ugccauuuaaaaaugaccaaau

SEQ ID NO: 718389 - RNA, 19 nt, Human
aucacaugucaagagcagg

SEQ ID NO: 718390 - RNA, 22 nt, Human
cagucucucagcuuucagcugu

SEQ ID NO: 718391 - RNA, 22 nt, Human
gcugcugccuguagccagggug

SEQ ID NO: 718392 - RNA, 22 nt, Human
aggggcuccucucugagaguag

SEQ ID NO: 718393 - RNA, 22 nt, Human
uucaggccuaauuucuagcccc

SEQ ID NO: 718394 - RNA, 22 nt, Human
cucucugaggcaggccuguggg

SEQ ID NO: 718395 - RNA, 22 nt, Human
cagcccuuuccuucucagcuuu

SEQ ID NO: 718396 - RNA, 22 nt, Human
ugagaccuuggggagcccuguu

SEQ ID NO: 718397 - RNA, 22 nt, Human
ccucuggcucacagcaccaacu

SEQ ID NO: 718398 - RNA, 16 nt, Human
ucucuggguugcacag

SEQ ID NO: 718399 - RNA, 21 nt, Human
uggcagaguugaguaguuaug

SEQ ID NO: 718400 - RNA, 18 nt, Human
acugugugaauuagcucc

SEQ ID NO: 718401 - RNA, 22 nt, Human
guccugggggcagcugugucca

SEQ ID NO: 718402 - RNA, 22 nt, Human
uguuacaguggcuuuuuaaaca

SEQ ID NO: 718403 - RNA, 22 nt, Human
agcaaaauaagguaauuuauug

SEQ ID NO: 718404 - RNA, 22 nt, Human
ccacagagagugucagccuuug

SEQ ID NO: 718405 - RNA, 22 nt, Human
aggccagggucccacacucgca

SEQ ID NO: 718406 - RNA, 22 nt, Human
cauauucaagggguaaggcaaa

SEQ ID NO: 718407 - RNA, 22 nt, Human
gggagcugcacacgccccggaa

SEQ ID NO: 718408 - RNA, 22 nt, Human
uuucaggauuaguuuaagcagg

SEQ ID NO: 718409 - RNA, 22 nt, Human
ccugucauaauguccgauguca

SEQ ID NO: 718410 - RNA, 22 nt, Human
cccaggcuagaaaggccaacaa

SEQ ID NO: 718411 - RNA, 22 nt, Human
agugcagagagcaauacucuac

SEQ ID NO: 718412 - RNA, 22 nt, Human
aucucagacauguuguccauga

SEQ ID NO: 718413 - RNA, 22 nt, Human
acagccagugacuggacaagcu

SEQ ID NO: 718414 - RNA, 22 nt, Human
uucauuuuuaccgcgugucaaa

SEQ ID NO: 718415 - RNA, 21 nt, Human
acagcuggccgcgcgggucgg

SEQ ID NO: 718416 - RNA, 22 nt, Human
aacuuuuaaaauacacagacaa

SEQ ID NO: 718417 - RNA, 22 nt, Human
ggaaauauugauugcucuguau

SEQ ID NO: 718418 - RNA, 22 nt, Human
ugcugcucuucaccauggccuc

SEQ ID NO: 718419 - RNA, 22 nt, Human
uggacaugagcugagugggugu

SEQ ID NO: 718420 - RNA, 22 nt, Human
gaguucugaacugugaaaugca

SEQ ID NO: 718421 - RNA, 22 nt, Human
uuccuccacgugacaggagcca

SEQ ID NO: 718422 - RNA, 22 nt, Human
acauuuagaugguguuauagua

SEQ ID NO: 718423 - RNA, 22 nt, Human
acaugaaaccugagucuaacuc

SEQ ID NO: 718424 - RNA, 22 nt, Human
cuauuuggauguuagccucagu

SEQ ID NO: 718425 - RNA, 18 nt, Human
aagaggcuguucuguggg

SEQ ID NO: 718426 - RNA, 22 nt, Human
cacagaggcucaaagccaggug

SEQ ID NO: 718427 - RNA, 22 nt, Human
uaaucacagaaaugcccauuca

SEQ ID NO: 718428 - RNA, 22 nt, Human
aggaugagauugcuguguugua

SEQ ID NO: 718429 - RNA, 22 nt, Human
guuuuggagucaggcuuagaug

SEQ ID NO: 718430 - RNA, 22 nt, Human
uucucuuauucuggauaugcag

SEQ ID NO: 718431 - RNA, 22 nt, Human
ucucuagacauggggaauguca

SEQ ID NO: 718432 - RNA, 22 nt, Human
gcacagagaggcugugagcgcc

SEQ ID NO: 718433 - RNA, 22 nt, Human
guggccuuauuauguacaaaau

SEQ ID NO: 718434 - RNA, 22 nt, Human
ugggagcaguucagguguggcu

SEQ ID NO: 718435 - RNA, 22 nt, Human
agagcuucacuggagagcacau

SEQ ID NO: 718436 - RNA, 22 nt, Human
agcugaaucuugacuaggaaga

SEQ ID NO: 718437 - RNA, 22 nt, Human
uuccuaaaagaauacacuggau

SEQ ID NO: 718438 - RNA, 22 nt, Human
guuaacuuuuuacagaaaugaa

SEQ ID NO: 718439 - RNA, 22 nt, Human
ugcaaagaagccacagucccag

SEQ ID NO: 718440 - RNA, 22 nt, Human
acuguacacauucgucaagacu

SEQ ID NO: 718441 - RNA, 22 nt, Human
cccugcacacucgugucuugac

SEQ ID NO: 718442 - RNA, 22 nt, Human
acugggccugauugggucggag

SEQ ID NO: 718443 - RNA, 17 nt, Human
aagacaagacaaaugca

SEQ ID NO: 718444 - RNA, 22 nt, Human
ccacucugauuggucaccucug

SEQ ID NO: 718445 - RNA, 22 nt, Human
auaucacaguaguuguuuaguu

SEQ ID NO: 718446 - RNA, 22 nt, Human
guauuagacugagaaauggagu

SEQ ID NO: 718447 - RNA, 22 nt, Human
gaggcucauugcauugugcauu

SEQ ID NO: 718448 - RNA, 22 nt, Human
uagagcuauuuaucagccagaa

SEQ ID NO: 718449 - RNA, 19 nt, Human
ggccccucucacaggaguu

SEQ ID NO: 718450 - RNA, 22 nt, Human
auacaugaucacuguauuauaa

SEQ ID NO: 718451 - RNA, 22 nt, Human
cuucuuccaagcuuaugcucaa

SEQ ID NO: 718452 - RNA, 22 nt, Human
ccagagguggucauagaaagca

SEQ ID NO: 718453 - RNA, 22 nt, Human
cccaaggacacgggcagggaca

SEQ ID NO: 718454 - RNA, 22 nt, Human
cagcagcugacuccaagagagc

SEQ ID NO: 718455 - RNA, 22 nt, Human
agggcuuuguggcagucacuau

SEQ ID NO: 718456 - RNA, 22 nt, Human
ggucccaagcaaugcccuuggc

SEQ ID NO: 718457 - RNA, 22 nt, Human
acagggaacaggaauauacaaa

SEQ ID NO: 718458 - RNA, 22 nt, Human
gaagggcuuucugggagaagag

SEQ ID NO: 718459 - RNA, 22 nt, Human
aaggcacaacacaagaggguga

SEQ ID NO: 718460 - RNA, 22 nt, Human
ggcuccugauaggagaaugcgg

SEQ ID NO: 718461 - RNA, 22 nt, Human
agcuuucacgauuuggaacagg

SEQ ID NO: 718462 - RNA, 21 nt, Human
gcagaaaggaaucuuaggucc

SEQ ID NO: 718463 - RNA, 22 nt, Human
gcaugcaacucccaguucugcc

SEQ ID NO: 718464 - RNA, 22 nt, Human
gcucagaguggccuggcuaggg

SEQ ID NO: 718465 - RNA, 22 nt, Human
ucugccugugcuguguuuucau

SEQ ID NO: 718466 - RNA, 22 nt, Human
uggcccugcuaugauccugcaa

SEQ ID NO: 718467 - RNA, 22 nt, Human
uccagcucuggcuuggcuagcu

SEQ ID NO: 718468 - RNA, 22 nt, Human
ucucagugcagcuugacagaga

SEQ ID NO: 718469 - RNA, 22 nt, Human
cuagggccaaaggcugugaugc

SEQ ID NO: 718470 - RNA, 22 nt, Human
uuuccaauuugguagucaucgg

SEQ ID NO: 718471 - RNA, 22 nt, Human
ucuuggcugugcaugcaucuuc

SEQ ID NO: 718472 - RNA, 22 nt, Human
gucugagaaucuugcauaucau

SEQ ID NO: 718473 - RNA, 19 nt, Human
gaguuauugccagggcaug

SEQ ID NO: 718474 - RNA, 22 nt, Human
ugcagagaguuagggcccguau

SEQ ID NO: 718475 - RNA, 22 nt, Human
augcuugaaaaccccaugaaua

SEQ ID NO: 718476 - RNA, 20 nt, Human
ucugcccaccccggcuccca

SEQ ID NO: 718477 - RNA, 22 nt, Human
caagacaagaucuaagcaugcu

SEQ ID NO: 718478 - RNA, 22 nt, Human
ugagagcugcugagacuguccu

SEQ ID NO: 718479 - RNA, 22 nt, Human
aucaccaaggcuuuaggaauuu

SEQ ID NO: 718480 - RNA, 22 nt, Human
agcccagguucuaaagccaaac

SEQ ID NO: 718481 - RNA, 22 nt, Human
gacacagagauaggccuguguu

SEQ ID NO: 718482 - RNA, 20 nt, Human
cagcuucaaugucagcuuga

SEQ ID NO: 718483 - RNA, 17 nt, Human
ugaauucaaucugcacu

SEQ ID NO: 718484 - RNA, 22 nt, Human
acagguggagugguuagcaggc

SEQ ID NO: 718485 - RNA, 22 nt, Human
cugcucuggucucuucauguuu

SEQ ID NO: 718486 - RNA, 22 nt, Human
ucagggcugcagaagaggcagg

SEQ ID NO: 718487 - RNA, 22 nt, Human
agauggaaaauauagacagaga

SEQ ID NO: 718488 - RNA, 22 nt, Human
aguacuucagaggcugcccagg

SEQ ID NO: 718489 - RNA, 22 nt, Human
ucaaagacuauauauuuuauuu

SEQ ID NO: 718490 - RNA, 22 nt, Human
agugcuuuagcauccaacuguc

SEQ ID NO: 718491 - RNA, 22 nt, Human
uguccauggggaaggggaagug

SEQ ID NO: 718492 - RNA, 22 nt, Human
cagaaacugcuccccugguagg

SEQ ID NO: 718493 - RNA, 22 nt, Human
uuggaauugaggauuuacauag

SEQ ID NO: 718494 - RNA, 22 nt, Human
caaggcugcuggcuucugagcu

SEQ ID NO: 718495 - RNA, 22 nt, Human
cugagcccauugggugcuguua

SEQ ID NO: 718496 - RNA, 22 nt, Human
ucugcagcuucuugccagagag

SEQ ID NO: 718497 - RNA, 22 nt, Human
gccagaucugacauaguggaag

SEQ ID NO: 718498 - RNA, 22 nt, Human
ugcuccuuccucauccugugca

SEQ ID NO: 718499 - RNA, 22 nt, Human
uugaucaaaucagcuacugagg

SEQ ID NO: 718500 - RNA, 22 nt, Human
ucuagcuuggcguuugccuucu

SEQ ID NO: 718501 - RNA, 22 nt, Human
uggcuucucccuccccaucuag

SEQ ID NO: 718502 - RNA, 22 nt, Human
agcaaagauguccggggcaagc

SEQ ID NO: 718503 - RNA, 22 nt, Human
cagaggucaagaucugaaguga

SEQ ID NO: 718504 - RNA, 22 nt, Human
uaaaucucacuggguauauugg

SEQ ID NO: 718505 - RNA, 22 nt, Human
uccuucaguuaucacaguacug

SEQ ID NO: 718506 - RNA, 22 nt, Human
gagaaggcuggucuuaagucga

SEQ ID NO: 718507 - RNA, 17 nt, Human
aggcaugaggcaucacu

SEQ ID NO: 718508 - RNA, 21 nt, Human
cccaagggaggcaggauaagg

SEQ ID NO: 718509 - RNA, 22 nt, Human
uguaacaaaauaccuuggauug

SEQ ID NO: 718510 - RNA, 22 nt, Human
cugcagcuccucucugugcccc

SEQ ID NO: 718511 - RNA, 22 nt, Human
gucuggagccacugcugcugcu

SEQ ID NO: 718512 - RNA, 23 nt, Human
gcuguccuccugggcccagcagc

SEQ ID NO: 718513 - RNA, 22 nt, Human
cucccugcuuguuucccuucag

SEQ ID NO: 718514 - RNA, 22 nt, Human
gcaggugauucacccugggccu

SEQ ID NO: 718515 - RNA, 22 nt, Human
caguggugaagagcaggggcuc

SEQ ID NO: 718516 - RNA, 23 nt, Human
caggaaaugaauccaggaggaug

SEQ ID NO: 718517 - RNA, 22 nt, Human
agcucauggugcuaucucaggg

SEQ ID NO: 718518 - RNA, 22 nt, Human
uggggcaguuaauaaacauucu

SEQ ID NO: 718519 - RNA, 22 nt, Human
aggcacagaauggcauucagug

SEQ ID NO: 718520 - RNA, 22 nt, Human
uuguacaaaugcauauuccugg

SEQ ID NO: 718521 - RNA, 20 nt, Human
uguaaauaggcauuguaguu

SEQ ID NO: 718522 - RNA, 20 nt, Human
ccuggcugcauucaggacgg

SEQ ID NO: 718523 - RNA, 22 nt, Human
cugcauaugagaauaggagaaa

SEQ ID NO: 718524 - RNA, 22 nt, Human
gaccuggaggauccucuucuug

SEQ ID NO: 718525 - RNA, 22 nt, Human
uucaagauggccccagugagcc

SEQ ID NO: 718526 - RNA, 22 nt, Human
gggagagcgcgcuagggccgag

SEQ ID NO: 718527 - RNA, 21 nt, Human
uucugggccaugcugcuucuc

SEQ ID NO: 718528 - RNA, 21 nt, Human
ugauggaaaggauuuuggguc

SEQ ID NO: 718529 - RNA, 22 nt, Human
auugauauauuauuucuaacug

SEQ ID NO: 718530 - RNA, 22 nt, Human
aaacaaugaaauauuuuuaugg

SEQ ID NO: 718531 - RNA, 22 nt, Human
gucauuuuuuucguaauagugg

SEQ ID NO: 718532 - RNA, 19 nt, Human
guguccauggagcauggag

SEQ ID NO: 718533 - RNA, 22 nt, Human
auuaaauuaaguggcuaauuua

SEQ ID NO: 718534 - RNA, 22 nt, Human
cagcacaguuugcuuggcagag

SEQ ID NO: 718535 - RNA, 22 nt, Human
guuuauucuucagcaacaucug

SEQ ID NO: 718536 - RNA, 22 nt, Human
augaccugaggccuuacucuag

SEQ ID NO: 718537 - RNA, 21 nt, Human
ugcaagaaucaggaagcugcc

SEQ ID NO: 718538 - RNA, 22 nt, Human
augcuggggccucagaccagaa

SEQ ID NO: 718539 - RNA, 22 nt, Human
ucugucaucucuaaaauagaaa

SEQ ID NO: 718540 - RNA, 22 nt, Human
aguuaacacaaguaagauucca

SEQ ID NO: 718541 - RNA, 22 nt, Human
cuuggccagacagggagcucca

SEQ ID NO: 718542 - RNA, 22 nt, Human
cugggagucaccaggagcaagg

SEQ ID NO: 718543 - RNA, 22 nt, Human
aguaacagagcauggguucaga

SEQ ID NO: 718544 - RNA, 22 nt, Human
cacagacuccccgccauagugg

SEQ ID NO: 718545 - RNA, 22 nt, Human
gggaaagacccugagucuuauu

SEQ ID NO: 718546 - RNA, 22 nt, Human
aggucauuuccuuagaggcaga

SEQ ID NO: 718547 - RNA, 22 nt, Human
gaaauauuacaguggaggggau

SEQ ID NO: 718548 - RNA, 22 nt, Human
aguucugguugcccaugacauc

SEQ ID NO: 718549 - RNA, 22 nt, Human
agaauuagucacaauuauagga

SEQ ID NO: 718550 - RNA, 22 nt, Human
ugucaccuuuacccuuuuauag

SEQ ID NO: 718551 - RNA, 22 nt, Human
ugagccagugugguaaagcuga

SEQ ID NO: 718552 - RNA, 19 nt, Human
aaaagucuauucaauuaca

SEQ ID NO: 718553 - RNA, 22 nt, Human
caggcagaguuagagcaacugg

SEQ ID NO: 718554 - RNA, 22 nt, Human
auguuaugugcaagauacauaa

SEQ ID NO: 718555 - RNA, 22 nt, Human
ggaggaagagguuguucucuca

SEQ ID NO: 718556 - RNA, 22 nt, Human
ugcugccuuugggaccuggccu

SEQ ID NO: 718557 - RNA, 22 nt, Human
uuuuauugucaaugaagacaga

SEQ ID NO: 718558 - RNA, 22 nt, Human
cuggugucugauucuccccuga

SEQ ID NO: 718559 - RNA, 22 nt, Human
uaggcuuccgagucuugguauc

SEQ ID NO: 718560 - RNA, 22 nt, Human
caagcaggaugaagcccaggga

SEQ ID NO: 718561 - RNA, 22 nt, Human
ggcugccugaggcugaggcccg

SEQ ID NO: 718562 - RNA, 22 nt, Human
aaaaaguuucaacugccaacuc

SEQ ID NO: 718563 - RNA, 22 nt, Human
uauaggaaaggaguggucacaa

SEQ ID NO: 718564 - RNA, 22 nt, Human
uacacaugacaguggacugaga

SEQ ID NO: 718565 - RNA, 22 nt, Human
gugccugggguugagcuaugaa

SEQ ID NO: 718566 - RNA, 22 nt, Human
aggagaaggaggccccucacac

SEQ ID NO: 718567 - RNA, 22 nt, Human
cugccucugcgucccacagagu

SEQ ID NO: 718568 - RNA, 20 nt, Human
augcauauauguggugucug

SEQ ID NO: 718569 - RNA, 22 nt, Human
acuuugggcacagugaggccag

SEQ ID NO: 718570 - RNA, 22 nt, Human
ccagggacuuugcauuguuuau

SEQ ID NO: 718571 - RNA, 21 nt, Human
ucuuccugcuccacacucccc

SEQ ID NO: 718572 - RNA, 22 nt, Human
gaacauacaagaauuaaguaca

SEQ ID NO: 718573 - RNA, 22 nt, Human
agcugcccuuuaugaugcugaa

SEQ ID NO: 718574 - RNA, 22 nt, Human
uuuauacuucauaaugucuauu

SEQ ID NO: 718575 - RNA, 22 nt, Human
gaggcugaacagguucucauga

SEQ ID NO: 718576 - RNA, 22 nt, Human
ugucuccugagagcuggacaga

SEQ ID NO: 718577 - RNA, 22 nt, Human
cugugcguugugaaauguuuag

SEQ ID NO: 718578 - RNA, 22 nt, Human
aggccagaaaugucagggagug

SEQ ID NO: 718579 - RNA, 22 nt, Human
uguuucagucccuguguucaau

SEQ ID NO: 718580 - RNA, 22 nt, Human
ggccagcagaccucagggacuc

SEQ ID NO: 718581 - RNA, 22 nt, Human
acuacacuccaauuuucuaggu

SEQ ID NO: 718582 - RNA, 22 nt, Human
uauuuccaaaagccuauuauga

SEQ ID NO: 718583 - RNA, 22 nt, Human
cacagcugugagaagggagccu

SEQ ID NO: 718584 - RNA, 22 nt, Human
ggggcacuuccaggcugaggcu

SEQ ID NO: 718585 - RNA, 20 nt, Human
uaaacaguauuuacuaggag

SEQ ID NO: 718586 - RNA, 22 nt, Human
gaacuuguuguaagaaaauaug

SEQ ID NO: 718587 - RNA, 22 nt, Human
cauuuacaauguacagguugug

SEQ ID NO: 718588 - RNA, 18 nt, Human
ugcuggcaacuacuauug

SEQ ID NO: 718589 - RNA, 22 nt, Human
auggcccaaaaccuccucccuc

SEQ ID NO: 718590 - RNA, 22 nt, Human
cagggaagaauaguuagcaaag

SEQ ID NO: 718591 - RNA, 22 nt, Human
ccagcccucacugaggccucuc

SEQ ID NO: 718592 - RNA, 22 nt, Human
aagccaugcaagccacaaggug

SEQ ID NO: 718593 - RNA, 22 nt, Human
ucuuuagugacaguugugcaag

SEQ ID NO: 718594 - RNA, 22 nt, Human
acaggcugccacuugcauccaa

SEQ ID NO: 718595 - RNA, 22 nt, Human
uagugaaaccugacagaucaug

SEQ ID NO: 718596 - RNA, 22 nt, Human
uacuucaacaccauaugguccu

SEQ ID NO: 718597 - RNA, 22 nt, Human
aagagaaugacaaggagaaccu

SEQ ID NO: 718598 - RNA, 22 nt, Human
ucaaauaguugacauuaacuug

SEQ ID NO: 718599 - RNA, 22 nt, Human
agagacuguggcucuuugaagg

SEQ ID NO: 718600 - RNA, 21 nt, Human
gccaccucgucucggagcagc

SEQ ID NO: 718601 - RNA, 22 nt, Human
acugaaggaaacuuuuguguuu

SEQ ID NO: 718602 - RNA, 22 nt, Human
acacaugaggaugaggggauca

SEQ ID NO: 718603 - RNA, 22 nt, Human
ucuguguguugucaggaggauu

SEQ ID NO: 718604 - RNA, 22 nt, Human
agggugcaaaagcaaggacagu

SEQ ID NO: 718605 - RNA, 22 nt, Human
ccacugcccccugaagaccagg

SEQ ID NO: 718606 - RNA, 22 nt, Human
aauccaugcaugcaaggaaagg

SEQ ID NO: 718607 - RNA, 22 nt, Human
guggugagauugcuggaucaaa

SEQ ID NO: 718608 - RNA, 22 nt, Human
ccucagaccccacagggccugu

SEQ ID NO: 718609 - RNA, 22 nt, Human
aaacuguauguugagaugacag

SEQ ID NO: 718610 - RNA, 22 nt, Human
uuucuuaugugcagagugagua

SEQ ID NO: 718611 - RNA, 21 nt, Human
ucucuguggccuacccucuac

SEQ ID NO: 718612 - RNA, 22 nt, Human
cugggcugauuuagucacguuu

SEQ ID NO: 718613 - RNA, 22 nt, Human
gagcccagggugaaauagcagc

SEQ ID NO: 718614 - RNA, 22 nt, Human
aagcauaaaacguuacaacaug

SEQ ID NO: 718615 - RNA, 22 nt, Human
ccacacagauaaguguuuucua

SEQ ID NO: 718616 - RNA, 22 nt, Human
cagggcucuuccggagcaggga

SEQ ID NO: 718617 - RNA, 20 nt, Human
agaaauacaugcaugcauga

SEQ ID NO: 718618 - RNA, 22 nt, Human
agacaguaauaaaauagguaag

SEQ ID NO: 718619 - RNA, 22 nt, Human
uggggugaggcagccacauuua

SEQ ID NO: 718620 - RNA, 22 nt, Human
uucaacaagucuuuuuucacug

SEQ ID NO: 718621 - RNA, 22 nt, Human
cugaggccuaagacaugaauga

SEQ ID NO: 718622 - RNA, 22 nt, Human
cuggagcuggcccaggcuggcc

SEQ ID NO: 718623 - RNA, 19 nt, Human
aagauugccuuguuccauu

SEQ ID NO: 718624 - RNA, 22 nt, Human
ugaagcaggaaccagcagcauu

SEQ ID NO: 718625 - RNA, 22 nt, Human
gugcccucaugaaacgaaggau

SEQ ID NO: 718626 - RNA, 22 nt, Human
ugaggccaaugacccugggcag

SEQ ID NO: 718627 - RNA, 22 nt, Human
agaaugaauuaaucaacuggaa

SEQ ID NO: 718628 - RNA, 22 nt, Human
ucaaauaccagcuuuuccagaa

SEQ ID NO: 718629 - RNA, 22 nt, Human
accucugcaacccuggaauggg

SEQ ID NO: 718630 - RNA, 22 nt, Human
cuguggcacauguggcaaggcc

SEQ ID NO: 718631 - RNA, 22 nt, Human
cugugaauuaaguauuguuauc

SEQ ID NO: 718632 - RNA, 22 nt, Human
aagguagcuugcuuccugagua

SEQ ID NO: 718633 - RNA, 22 nt, Human
gccccagaaaguucaaggcaca

SEQ ID NO: 718634 - RNA, 22 nt, Human
aauaaaauggucaguuuucuca

SEQ ID NO: 718635 - RNA, 22 nt, Human
cacaucagggcugcuugggggu

SEQ ID NO: 718636 - RNA, 22 nt, Human
uguaucuucaguuugucuuucc

SEQ ID NO: 718637 - RNA, 18 nt, Human
auuuaaugaacugaaagc

SEQ ID NO: 718638 - RNA, 22 nt, Human
agcagggcuugccgcuuguccu

SEQ ID NO: 718639 - RNA, 22 nt, Human
uuagaguuuuaucauugccuua

SEQ ID NO: 718640 - RNA, 22 nt, Human
uuucuucuaugugugauauuuu

SEQ ID NO: 718641 - RNA, 22 nt, Human
ggaaaacugaggcucucagcag

SEQ ID NO: 718642 - RNA, 22 nt, Human
ucagcccaggagguugagacua

SEQ ID NO: 718643 - RNA, 22 nt, Human
ugaaacaaaauuaagauucucg

SEQ ID NO: 718644 - RNA, 23 nt, Human
agcuucauugaccuccgcagggg

SEQ ID NO: 718645 - RNA, 23 nt, Human
ugcuggaacccagggccuaacac

SEQ ID NO: 718646 - RNA, 22 nt, Human
augaacacauguacacauuucu

SEQ ID NO: 718647 - RNA, 22 nt, Human
ugcacagcuggcucuccuuuuc

SEQ ID NO: 718648 - RNA, 22 nt, Human
gagggagaaggacuaucaggcu

SEQ ID NO: 718649 - RNA, 22 nt, Human
ggaaggaagugaccaggauauc

SEQ ID NO: 718650 - RNA, 19 nt, Human
uccaggaggcugccauuga

SEQ ID NO: 718651 - RNA, 20 nt, Human
cugcaucugugacuugcaaa

SEQ ID NO: 718652 - RNA, 22 nt, Human
uugaaugauccuaucuagcaca

SEQ ID NO: 718653 - RNA, 22 nt, Human
aggugcugaacuggugaggucu

SEQ ID NO: 718654 - RNA, 22 nt, Human
acacaugaaagacauuaaggug

SEQ ID NO: 718655 - RNA, 22 nt, Human
cccaacuacucucaggcagcuu

SEQ ID NO: 718656 - RNA, 22 nt, Human
aguuuacagaugcuacaggagc

SEQ ID NO: 718657 - RNA, 22 nt, Human
gcaggagcuggaaagugauguu

SEQ ID NO: 718658 - RNA, 22 nt, Human
gguguucuuaguggcacuggca

SEQ ID NO: 718659 - RNA, 22 nt, Human
ucaggaagcucuugcugauucu

SEQ ID NO: 718660 - RNA, 22 nt, Human
acuucccugugggcagguagug

SEQ ID NO: 718661 - RNA, 22 nt, Human
caaaugcagucccuuuguugcu

SEQ ID NO: 718662 - RNA, 22 nt, Human
aaggaacucuagagccuugaac

SEQ ID NO: 718663 - RNA, 22 nt, Human
cacagguccuuccugcccuggg

SEQ ID NO: 718664 - RNA, 22 nt, Human
cagcugccaugacauguccugc

SEQ ID NO: 718665 - RNA, 22 nt, Human
uacacagaggcugaugucuuag

SEQ ID NO: 718666 - RNA, 22 nt, Human
uaucacacauaacuaagcugca

SEQ ID NO: 718667 - RNA, 23 nt, Human
uuucauguuggcaugacugacuu

SEQ ID NO: 718668 - RNA, 22 nt, Human
ucugacaagucaagucuugacu

SEQ ID NO: 718669 - RNA, 22 nt, Human
gcuucugggguucuggcaugcu

SEQ ID NO: 718670 - RNA, 22 nt, Human
aguugcugauucugucugugau

SEQ ID NO: 718671 - RNA, 22 nt, Human
uuaaaugaacgagauaugcaac

SEQ ID NO: 718672 - RNA, 22 nt, Human
ucaugcaaggcugaaacauggu

SEQ ID NO: 718673 - RNA, 22 nt, Human
gcccuguggacagugagaagug

SEQ ID NO: 718674 - RNA, 22 nt, Human
ugccugcccugaaaacugccca

SEQ ID NO: 718675 - RNA, 22 nt, Human
ugcucuggggagcuccucugcg

SEQ ID NO: 718676 - RNA, 23 nt, Human
uccagagcucaugcucucaacca

SEQ ID NO: 718677 - RNA, 22 nt, Human
cuuaggaugaguuuuugcguuu

SEQ ID NO: 718678 - RNA, 23 nt, Human
uggcuucugccccauucucucca

SEQ ID NO: 718679 - RNA, 22 nt, Human
agguaggauagauaggaagacc

SEQ ID NO: 718680 - RNA, 23 nt, Human
aaccagauaaauggcuccagggc

SEQ ID NO: 718681 - RNA, 22 nt, Human
cauucugcauuuggaaggggca

SEQ ID NO: 718682 - RNA, 22 nt, Human
aaauuccaccagaaucaguaau

SEQ ID NO: 718683 - RNA, 22 nt, Human
uucucugggaucuggcaaaagg

SEQ ID NO: 718684 - RNA, 22 nt, Human
ugagccagaggaggcugugugg

SEQ ID NO: 718685 - RNA, 22 nt, Human
cagucccaccaggaucgcucuu

SEQ ID NO: 718686 - RNA, 22 nt, Human
gcuuuacugucuggaaaguuug

SEQ ID NO: 718687 - RNA, 22 nt, Human
aguguggucgggagcgcggggc

SEQ ID NO: 718688 - RNA, 21 nt, Human
uagggcaggcauuggaagaga

SEQ ID NO: 718689 - RNA, 22 nt, Human
guguguacaaauuucauguaaa

SEQ ID NO: 718690 - RNA, 21 nt, Human
aggcugcuggcucaggguccu

SEQ ID NO: 718691 - RNA, 22 nt, Human
cugcauguuuucuuaauuguga

SEQ ID NO: 718692 - RNA, 22 nt, Human
uuccugggcaggacgagagucu

SEQ ID NO: 718693 - RNA, 22 nt, Human
cugccaggcacugggcucugca

SEQ ID NO: 718694 - RNA, 22 nt, Human
gcugucugccgcaggcugccac

SEQ ID NO: 718695 - RNA, 22 nt, Human
ucugggcagccaugugccuggc

SEQ ID NO: 718696 - RNA, 22 nt, Human
uuagcaagaaagauugcagcac

SEQ ID NO: 718697 - RNA, 22 nt, Human
cagcuccaaagccccacugucc

SEQ ID NO: 718698 - RNA, 22 nt, Human
gugcacagauucagagguuuug

SEQ ID NO: 718699 - RNA, 22 nt, Human
augagagucucagagucucuuc

SEQ ID NO: 718700 - RNA, 22 nt, Human
agccaggugcaguggcacacac

SEQ ID NO: 718701 - RNA, 22 nt, Human
agaauucucuuccauugaaaca

SEQ ID NO: 718702 - RNA, 22 nt, Human
auuaaugucuaccaguugugug

SEQ ID NO: 718703 - RNA, 22 nt, Human
aaccacagagcccccucagaug

SEQ ID NO: 718704 - RNA, 22 nt, Human
cugaggcaugaaugugggcuuu

SEQ ID NO: 718705 - RNA, 22 nt, Human
aggcacugauucuguuuuccau

SEQ ID NO: 718706 - RNA, 22 nt, Human
aguggcugacaacuggguuaac

SEQ ID NO: 718707 - RNA, 19 nt, Human
acaaaugauguugcacuga

SEQ ID NO: 718708 - RNA, 19 nt, Human
aucuuacagagcagaguac

SEQ ID NO: 718709 - RNA, 22 nt, Human
cuggugaccggaccucaguuuu

SEQ ID NO: 718710 - RNA, 22 nt, Human
aguccaggaguugggugacauu

SEQ ID NO: 718711 - RNA, 22 nt, Human
gaacaacucuucuugagagaug

SEQ ID NO: 718712 - RNA, 20 nt, Human
caguuuaacuuugagcaguu

SEQ ID NO: 718713 - RNA, 22 nt, Human
ccugggcaaauuauguuacuca

SEQ ID NO: 718714 - RNA, 22 nt, Human
uagaugaccuuguguuaggcaa

SEQ ID NO: 718715 - RNA, 22 nt, Human
gcuguguucauuuugcauaugu

SEQ ID NO: 718716 - RNA, 23 nt, Human
aggcaguggugguaacaugucaa

SEQ ID NO: 718717 - RNA, 22 nt, Human
guucucaguucaggaaggacau

SEQ ID NO: 718718 - RNA, 22 nt, Human
ugagacaggcuuccuucuuggg

SEQ ID NO: 718719 - RNA, 22 nt, Human
cgguuaguuauuuuucagauau

SEQ ID NO: 718720 - RNA, 22 nt, Human
uuacacagugcacaagcagagu

SEQ ID NO: 718721 - RNA, 22 nt, Human
guggcagcggugugcaaggagg

SEQ ID NO: 718722 - RNA, 22 nt, Human
uuuacagcugcuggcaagcuug

SEQ ID NO: 718723 - RNA, 22 nt, Human
cuugagaaaggaacaggaagcu

SEQ ID NO: 718724 - RNA, 22 nt, Human
uuggcacuuugaaugagcucag

SEQ ID NO: 718725 - RNA, 22 nt, Human
aaggcugagguagggccuaaaa

SEQ ID NO: 718726 - RNA, 20 nt, Human
uuccucaggagaggauguua

SEQ ID NO: 718727 - RNA, 22 nt, Human
cagccugagccuucuguagcaa

SEQ ID NO: 718728 - RNA, 21 nt, Human
cuggacugaggagacagucgc

SEQ ID NO: 718729 - RNA, 22 nt, Human
ccagcuccgggaguugcugcug

SEQ ID NO: 718730 - RNA, 22 nt, Human
uaguuucuaaacugaacuguca

SEQ ID NO: 718731 - RNA, 22 nt, Human
uaaaaaucuuaugaauggcaag

SEQ ID NO: 718732 - RNA, 22 nt, Human
aguuucaugagacagauuuuca

SEQ ID NO: 718733 - RNA, 22 nt, Human
ugaggcuuagagaagaugggau

SEQ ID NO: 718734 - RNA, 22 nt, Human
ugcuucauuaaaacaauauuuu

SEQ ID NO: 718735 - RNA, 22 nt, Human
caaacauucaaguacaagucuu

SEQ ID NO: 718736 - RNA, 22 nt, Human
gcagaagcccggucagcgcacg

SEQ ID NO: 718737 - RNA, 22 nt, Human
uauggcuuuuaacugucguaug

SEQ ID NO: 718738 - RNA, 22 nt, Human
uguguguacucuccaguccuga

SEQ ID NO: 718739 - RNA, 22 nt, Human
uuuccucacuucaugagaguuu

SEQ ID NO: 718740 - RNA, 20 nt, Human
ucaggcuggugggcuuuccc

SEQ ID NO: 718741 - RNA, 22 nt, Human
ucacucaaugguaucaggaggu

SEQ ID NO: 718742 - RNA, 22 nt, Human
acaguaacucuuuuacccuccu

SEQ ID NO: 718743 - RNA, 22 nt, Human
agcagcugauggggaaggaguu

SEQ ID NO: 718744 - RNA, 22 nt, Human
aaagugcugggauuacaagugu

SEQ ID NO: 718745 - RNA, 22 nt, Human
gcucaggggaaugggcugccgu

SEQ ID NO: 718746 - RNA, 22 nt, Human
uguuuaauaauucuaugauagu

SEQ ID NO: 718747 - RNA, 22 nt, Human
cagcagcaugaauucgagccac

SEQ ID NO: 718748 - RNA, 22 nt, Human
ucugggaaauagaggacccuag

SEQ ID NO: 718749 - RNA, 22 nt, Human
cuuaucaaacuggagcaggcuu

SEQ ID NO: 718750 - RNA, 17 nt, Human
uucaaagcuuaucaagg

SEQ ID NO: 718751 - RNA, 19 nt, Human
ucagugugugggagguggu

SEQ ID NO: 718752 - RNA, 22 nt, Human
aguguuuauugugugccacaca

SEQ ID NO: 718753 - RNA, 22 nt, Human
aaguucuacuguggguaaaaug

SEQ ID NO: 718754 - RNA, 22 nt, Human
aggcaaauccagauuuuuccac

SEQ ID NO: 718755 - RNA, 22 nt, Human
ucucacaucugcccugugcugg

SEQ ID NO: 718756 - RNA, 22 nt, Human
ugagaauauuugaagauguuag

SEQ ID NO: 718757 - RNA, 22 nt, Human
guuauucuugguggcccugcug

SEQ ID NO: 718758 - RNA, 22 nt, Human
ugaaacaauuagaauguaauga

SEQ ID NO: 718759 - RNA, 22 nt, Human
gucucagaccacccucuuuggc

SEQ ID NO: 718760 - RNA, 22 nt, Human
ucugauaagacagcugauuuga

SEQ ID NO: 718761 - RNA, 22 nt, Human
agaaaacagaaagucauuggug

SEQ ID NO: 718762 - RNA, 22 nt, Human
cccccaaaguuugcacggauaa

SEQ ID NO: 718763 - RNA, 22 nt, Human
uccacagggaugccugcggcuu

SEQ ID NO: 718764 - RNA, 22 nt, Human
cuguauuucuuggacaguugcu

SEQ ID NO: 718765 - RNA, 22 nt, Human
ucccuguggauaucugcagcug

SEQ ID NO: 718766 - RNA, 20 nt, Human
auguuuuauaaaagaacggg

SEQ ID NO: 718767 - RNA, 22 nt, Human
ucagcaucuucagcauggggaa

SEQ ID NO: 718768 - RNA, 22 nt, Human
aaaacauaaacugacagcccau

SEQ ID NO: 718769 - RNA, 22 nt, Human
ucuacaaagguugaggugcccu

SEQ ID NO: 718770 - RNA, 22 nt, Human
uuuuuuccagcuucuagaggcc

SEQ ID NO: 718771 - RNA, 22 nt, Human
uuccugggacuggagcagccca

SEQ ID NO: 718772 - RNA, 22 nt, Human
aaauaugauacucccuuuuagu

SEQ ID NO: 718773 - RNA, 22 nt, Human
uggggagacuggccgagauccu

SEQ ID NO: 718774 - RNA, 22 nt, Human
auuauuuauccucuuggucuau

SEQ ID NO: 718775 - RNA, 22 nt, Human
ccucuucugagugagacucccu

SEQ ID NO: 718776 - RNA, 22 nt, Human
ucauuucuaucuaugcagcuuc

SEQ ID NO: 718777 - RNA, 22 nt, Human
agacagggucuugaucagagcu

SEQ ID NO: 718778 - RNA, 22 nt, Human
ggcagacacucaaaagcuggga

SEQ ID NO: 718779 - RNA, 20 nt, Human
gcaauguugguuccugucac

SEQ ID NO: 718780 - RNA, 20 nt, Human
uggcccaguggggcagggug

SEQ ID NO: 718781 - RNA, 18 nt, Human
uucaccagguagauaggg

SEQ ID NO: 718782 - RNA, 22 nt, Human
aaugugaucgcuuuagaagcuu

SEQ ID NO: 718783 - RNA, 22 nt, Human
gcagcucugacaaugccuggaa

SEQ ID NO: 718784 - RNA, 22 nt, Human
uucagcacaguucaagauggua

SEQ ID NO: 718785 - RNA, 21 nt, Human
aggcuguccuuugccagcccu

SEQ ID NO: 718786 - RNA, 20 nt, Human
uacuguuguugcuguugcca

SEQ ID NO: 718787 - RNA, 22 nt, Human
ggagcuggccgccuaugugcag

SEQ ID NO: 718788 - RNA, 22 nt, Human
uuggcucaggaccccugugacu

SEQ ID NO: 718789 - RNA, 21 nt, Human
uguuuuccaccuugaggcaag

SEQ ID NO: 718790 - RNA, 22 nt, Human
cugccuuugugaucaguucuuu

SEQ ID NO: 718791 - RNA, 22 nt, Human
agucucugagguucagaugccu

SEQ ID NO: 718792 - RNA, 22 nt, Human
gcagggaagacccggagcagcg

SEQ ID NO: 718793 - RNA, 22 nt, Human
cugggagaucuccugagggcag

SEQ ID NO: 718794 - RNA, 22 nt, Human
gcucagggcuaaggcugagggg

SEQ ID NO: 718795 - RNA, 22 nt, Human
cugggaggacaacuuggagcuc

SEQ ID NO: 718796 - RNA, 21 nt, Human
aacugcaaaugaugcuggaga

SEQ ID NO: 718797 - RNA, 22 nt, Human
uucccacacccauauugugauu

SEQ ID NO: 718798 - RNA, 22 nt, Human
uuucuuccuaaauaugauuucc

SEQ ID NO: 718799 - RNA, 22 nt, Human
acaaguuaccaaaaaagauuca

SEQ ID NO: 718800 - RNA, 22 nt, Human
gauucuuuggccuuuauugaca

SEQ ID NO: 718801 - RNA, 22 nt, Human
cgcagagggcaggcagugcugg

SEQ ID NO: 718802 - RNA, 22 nt, Human
acaggcuggaggaggaccaaga

SEQ ID NO: 718803 - RNA, 22 nt, Human
gcagaggcauuucugacgcugc

SEQ ID NO: 718804 - RNA, 22 nt, Human
cugggcagaguccggaagaugg

SEQ ID NO: 718805 - RNA, 22 nt, Human
auguagaacagguuaaugacag

SEQ ID NO: 718806 - RNA, 22 nt, Human
uucuuuuagaauuuccuaaggu

SEQ ID NO: 718807 - RNA, 22 nt, Human
aguguaugcagguuuucaaugu

SEQ ID NO: 718808 - RNA, 20 nt, Human
gcuggcugaacugaaagcaa

SEQ ID NO: 718809 - RNA, 22 nt, Human
uagaacuagaacaaggauuuga

SEQ ID NO: 718810 - RNA, 19 nt, Human
agguggccauguccagccu

SEQ ID NO: 718811 - RNA, 22 nt, Human
ccugagguggcugcagcacugc

SEQ ID NO: 718812 - RNA, 22 nt, Human
aggucugauuuuuuauucccag

SEQ ID NO: 718813 - RNA, 22 nt, Human
ucaggcuuggugcuccagugcc

SEQ ID NO: 718814 - RNA, 17 nt, Human
agcagaagucagaggga

SEQ ID NO: 718815 - RNA, 22 nt, Human
cagugcuguugggcccagagag

SEQ ID NO: 718816 - RNA, 22 nt, Human
ccacugauucugccaggucucu

SEQ ID NO: 718817 - RNA, 20 nt, Human
uguauuuaaugaaggcuuuu

SEQ ID NO: 718818 - RNA, 22 nt, Human
agguuugguuugacaagacuga

SEQ ID NO: 718819 - RNA, 22 nt, Human
gggacacagccaucuguguuuu

SEQ ID NO: 718820 - RNA, 22 nt, Human
uaaaacuagugguugggacuaa

SEQ ID NO: 718821 - RNA, 22 nt, Human
ugaggccugacagaccaagccu

SEQ ID NO: 718822 - RNA, 22 nt, Human
auacacuugaccuggagugaag

SEQ ID NO: 718823 - RNA, 22 nt, Human
acaguaaugauucugagucucu

SEQ ID NO: 718824 - RNA, 22 nt, Human
cuuucacagcuugaaaaguauu

SEQ ID NO: 718825 - RNA, 22 nt, Human
uauguucucugcucuaggaugu

SEQ ID NO: 718826 - RNA, 19 nt, Human
cagaguuacauggcugugg

SEQ ID NO: 718827 - RNA, 22 nt, Human
auguucuuccaaaucuguaaca

SEQ ID NO: 718828 - RNA, 22 nt, Human
ucuguguuuuaaacaguagaaa

SEQ ID NO: 718829 - RNA, 22 nt, Human
uucugggaacaaaguggagugg

SEQ ID NO: 718830 - RNA, 22 nt, Human
ggcacucaauaaauguugccaa

SEQ ID NO: 718831 - RNA, 22 nt, Human
ucuguacaacaaagggaugaga

SEQ ID NO: 718832 - RNA, 22 nt, Human
gcaaaauuaaacuuagcaucau

SEQ ID NO: 718833 - RNA, 22 nt, Human
acagaccaaaaaaggauauugg

SEQ ID NO: 718834 - RNA, 23 nt, Human
caguacuuaguguagcguuaauu

SEQ ID NO: 718835 - RNA, 22 nt, Human
ggcuccugaggaccaggcacag

SEQ ID NO: 718836 - RNA, 22 nt, Human
ucauggaugggcccagcucugu

SEQ ID NO: 718837 - RNA, 22 nt, Human
aaggcugacucaacagggggcc

SEQ ID NO: 718838 - RNA, 19 nt, Human
agacucugugugagacuuu

SEQ ID NO: 718839 - RNA, 22 nt, Human
cucagucugucuugucuguguu

SEQ ID NO: 718840 - RNA, 22 nt, Human
auccaggcugcgggucucaagu

SEQ ID NO: 718841 - RNA, 22 nt, Human
uguguucuccaacuguagauuu

SEQ ID NO: 718842 - RNA, 17 nt, Human
cugagccccgggcagcu

SEQ ID NO: 718843 - RNA, 22 nt, Human
cacuguggugugagggcugaug

SEQ ID NO: 718844 - RNA, 22 nt, Human
uuuaaugauagcuguuucacau

SEQ ID NO: 718845 - RNA, 22 nt, Human
agcaaauauuuuguugaagugc

SEQ ID NO: 718846 - RNA, 22 nt, Human
cugggucuggcuacugcuuccu

SEQ ID NO: 718847 - RNA, 22 nt, Human
uauucuggguaccaaacuucaa

SEQ ID NO: 718848 - RNA, 22 nt, Human
ugcugggauauagcuucuaggg

SEQ ID NO: 718849 - RNA, 22 nt, Human
cuuguauuaugguucgcuuagu

SEQ ID NO: 718850 - RNA, 22 nt, Human
auuucaguguugguuagcaagc

SEQ ID NO: 718851 - RNA, 22 nt, Human
agggcacaggcuccggguccag

SEQ ID NO: 718852 - RNA, 20 nt, Human
agugacagagacuguguggc

SEQ ID NO: 718853 - RNA, 18 nt, Human
gauggaaaguguaugagu

SEQ ID NO: 718854 - RNA, 22 nt, Human
gaagccacaacuuuuucuuagc

SEQ ID NO: 718855 - RNA, 22 nt, Human
aguuuguaugccaacagcaaag

SEQ ID NO: 718856 - RNA, 22 nt, Human
uuuggaucacuguuccucuggg

SEQ ID NO: 718857 - RNA, 22 nt, Human
aucuacaacggguggaguaggg

SEQ ID NO: 718858 - RNA, 21 nt, Human
aagccucaagcagaagacaga

SEQ ID NO: 718859 - RNA, 18 nt, Human
gaggaaacaaggcagagg

SEQ ID NO: 718860 - RNA, 22 nt, Human
ucacuuugcccuguaccuuggg

SEQ ID NO: 718861 - RNA, 22 nt, Human
uucugcugcgacccaggaguua

SEQ ID NO: 718862 - RNA, 22 nt, Human
uggagcagaaauggccucuugu

SEQ ID NO: 718863 - RNA, 22 nt, Human
ccagggcugccgcaucccuggu

SEQ ID NO: 718864 - RNA, 22 nt, Human
ccauuauccacgggcuuccuga

SEQ ID NO: 718865 - RNA, 22 nt, Human
uauuaauucuugccaauucucc

SEQ ID NO: 718866 - RNA, 22 nt, Human
guucuucaucuuaaccaucugu

SEQ ID NO: 718867 - RNA, 22 nt, Human
uuggcuaugcuuguguucaguu

SEQ ID NO: 718868 - RNA, 22 nt, Human
aaacacuucaaggacuucuguc

SEQ ID NO: 718869 - RNA, 22 nt, Human
acuugggaugguggccagagcg

SEQ ID NO: 718870 - RNA, 22 nt, Human
ugcuucugacauguucuugguu

SEQ ID NO: 718871 - RNA, 22 nt, Human
auacacuguucacuagaucuuc

SEQ ID NO: 718872 - RNA, 22 nt, Human
uaaauuacccuuuagggaauug

SEQ ID NO: 718873 - RNA, 22 nt, Human
gcuggguccaugguccucgggu

SEQ ID NO: 718874 - RNA, 22 nt, Human
ucaucaaagucaaagaaugacu

SEQ ID NO: 718875 - RNA, 22 nt, Human
auugacaagaaagauauuuuua

SEQ ID NO: 718876 - RNA, 22 nt, Human
auucugggagguagaacugaaa

SEQ ID NO: 718877 - RNA, 22 nt, Human
gcuggccagcccucuuccucca

SEQ ID NO: 718878 - RNA, 22 nt, Human
ccagagguuacuuugccuugga

SEQ ID NO: 718879 - RNA, 22 nt, Human
uuacaguagcuuuauuuggagu

SEQ ID NO: 718880 - RNA, 21 nt, Human
uuucuaaguaacuggcagcau

SEQ ID NO: 718881 - RNA, 22 nt, Human
acacaggcaaugugagugggag

SEQ ID NO: 718882 - RNA, 22 nt, Human
ggcccagccuggcaacaaugac

SEQ ID NO: 718883 - RNA, 22 nt, Human
ggagggaaugucuagcauucuu

SEQ ID NO: 718884 - RNA, 22 nt, Human
ugcaucuguaguggaaaccuua

SEQ ID NO: 718885 - RNA, 22 nt, Human
ugcacagaucugguggcaagga

SEQ ID NO: 718886 - RNA, 23 nt, Human
uggccuggagagaaaagaugagu

SEQ ID NO: 718887 - RNA, 22 nt, Human
agcuggcugccuucuccuuagg

SEQ ID NO: 718888 - RNA, 23 nt, Human
ugguccugguugaggugggcccc

SEQ ID NO: 718889 - RNA, 22 nt, Human
ggagauaauccagggagggacu

SEQ ID NO: 718890 - RNA, 22 nt, Human
gagguauugacuaugggauggc

SEQ ID NO: 718891 - RNA, 22 nt, Human
uagcuuuccuuguugccugugc

SEQ ID NO: 718892 - RNA, 22 nt, Human
uguggaaaguggucuaagcaca

SEQ ID NO: 718893 - RNA, 22 nt, Human
uacaguaacauguuguacaagc

SEQ ID NO: 718894 - RNA, 22 nt, Human
uauuuccacccucaguaaggaa

SEQ ID NO: 718895 - RNA, 22 nt, Human
ucccuccuggccgucaccgcug

SEQ ID NO: 718896 - RNA, 22 nt, Human
uacaguaacuggaauucuucuu

SEQ ID NO: 718897 - RNA, 22 nt, Human
agaugguugguccauaggccua

SEQ ID NO: 718898 - RNA, 18 nt, Human
uccuagugaaaugccugu

SEQ ID NO: 718899 - RNA, 22 nt, Human
uauuaucuaguaacugauagug

SEQ ID NO: 718900 - RNA, 22 nt, Human
ccucacugcuauguguuugcuc

SEQ ID NO: 718901 - RNA, 22 nt, Human
uucugaauccucgaaacauagc

SEQ ID NO: 718902 - RNA, 22 nt, Human
acucucagaggguggcagcaau

SEQ ID NO: 718903 - RNA, 22 nt, Human
acaguagugcucaaucaguguu

SEQ ID NO: 718904 - RNA, 22 nt, Human
gagcagcugguaggugaaccca

SEQ ID NO: 718905 - RNA, 22 nt, Human
aggagcugcuuuggugcgguuu

SEQ ID NO: 718906 - RNA, 19 nt, Human
caguggagauuggaggagg

SEQ ID NO: 718907 - RNA, 22 nt, Human
ucugaaauaacugaugccagau

SEQ ID NO: 718908 - RNA, 16 nt, Human
uuuauuuacuaguguu

SEQ ID NO: 718909 - RNA, 22 nt, Human
ucagaguguuuuacuaaacaag

SEQ ID NO: 718910 - RNA, 22 nt, Human
uuccucucgcucuccggggccc

SEQ ID NO: 718911 - RNA, 22 nt, Human
auuuccuaggguagaugucaca

SEQ ID NO: 718912 - RNA, 22 nt, Human
cagcccucaucccgccugcguu

SEQ ID NO: 718913 - RNA, 22 nt, Human
ugagaaaauuacuauaauuguc

SEQ ID NO: 718914 - RNA, 22 nt, Human
ggcaggagcucagguugguucc

SEQ ID NO: 718915 - RNA, 22 nt, Human
ucaguguuggucaagaaucagu

SEQ ID NO: 718916 - RNA, 21 nt, Human
ccagacuggccuaugugguag

SEQ ID NO: 718917 - RNA, 22 nt, Human
acucuggcagcagaaccagugu

SEQ ID NO: 718918 - RNA, 19 nt, Human
accaggagacagugagcuu

SEQ ID NO: 718919 - RNA, 22 nt, Human
cucugugggccagagaggcccc

SEQ ID NO: 718920 - RNA, 22 nt, Human
uugucuggucaaaucacuugua

SEQ ID NO: 718921 - RNA, 22 nt, Human
cugacucagcagcugaugaucc

SEQ ID NO: 718922 - RNA, 22 nt, Human
gagcuaagagucuagaaaggcu

SEQ ID NO: 718923 - RNA, 22 nt, Human
gcaauauaaccaguugucaugc

SEQ ID NO: 718924 - RNA, 22 nt, Human
gacagacaggugugguaggcac

SEQ ID NO: 718925 - RNA, 22 nt, Human
cauuucacgcacacucauuacu

SEQ ID NO: 718926 - RNA, 16 nt, Human
agguggagaaguucac

SEQ ID NO: 718927 - RNA, 22 nt, Human
gcagcuccuuuaggcugcaaag

SEQ ID NO: 718928 - RNA, 22 nt, Human
auagcaaauauuuuaaugagca

SEQ ID NO: 718929 - RNA, 22 nt, Human
agaagagcccuuuaagggggaa

SEQ ID NO: 718930 - RNA, 22 nt, Human
ggcagcaugggugccuuuguga

SEQ ID NO: 718931 - RNA, 22 nt, Human
cgccggcuugaggcaggcggca

SEQ ID NO: 718932 - RNA, 22 nt, Human
ucagggcauccauugccuguug

SEQ ID NO: 718933 - RNA, 22 nt, Human
cagucacuggaauagcugagga

SEQ ID NO: 718934 - RNA, 22 nt, Human
aaggaggacacccaggacuggg

SEQ ID NO: 718935 - RNA, 22 nt, Human
cucugcugcuuugccaguggaa

SEQ ID NO: 718936 - RNA, 22 nt, Human
ugcuggcccaugaagacgcagu

SEQ ID NO: 718937 - RNA, 22 nt, Human
cugagaggugacagcgugcugg

SEQ ID NO: 718938 - RNA, 22 nt, Human
cagaugaaguuugccuagagcu

SEQ ID NO: 718939 - RNA, 22 nt, Human
ugcauaaagugccauaguauua

SEQ ID NO: 718940 - RNA, 22 nt, Human
uggcucagaggggaagugguuu

SEQ ID NO: 718941 - RNA, 22 nt, Human
agaagcugccuacaugaccagc

SEQ ID NO: 718942 - RNA, 22 nt, Human
ccuucaaggcaaggagggcugg

SEQ ID NO: 718943 - RNA, 18 nt, Human
ggcaugugagugcugagg

SEQ ID NO: 718944 - RNA, 21 nt, Human
aaaguguucagaccaguucug

SEQ ID NO: 718945 - RNA, 22 nt, Human
cucugggcaggaccaguggacc

SEQ ID NO: 718946 - RNA, 22 nt, Human
ggcuggacuuucugcugggcuc

SEQ ID NO: 718947 - RNA, 20 nt, Human
aacagggggcugcagagggc

SEQ ID NO: 718948 - RNA, 22 nt, Human
caggaaauauaggaaaaggaac

SEQ ID NO: 718949 - RNA, 22 nt, Human
acauguguggccgcuguagaca

SEQ ID NO: 718950 - RNA, 22 nt, Human
guuuguuuguagggaagccgug

SEQ ID NO: 718951 - RNA, 22 nt, Human
cccagggcuuuucucacuagac

SEQ ID NO: 718952 - RNA, 22 nt, Human
ugccauuugccccagcacuguc

SEQ ID NO: 718953 - RNA, 22 nt, Human
uucaugaaauucucguguaccu

SEQ ID NO: 718954 - RNA, 22 nt, Human
aguccuucacguccugcuuauu

SEQ ID NO: 718955 - RNA, 22 nt, Human
gcugacugauggacacagcacc

SEQ ID NO: 718956 - RNA, 22 nt, Human
guccagaaggaggucaaguugg

SEQ ID NO: 718957 - RNA, 22 nt, Human
auuaagaugugggaaaauuuaa

SEQ ID NO: 718958 - RNA, 19 nt, Human
gcugcugcuccucccucgc

SEQ ID NO: 718959 - RNA, 22 nt, Human
uuuguacauauaaaucuuguau

SEQ ID NO: 718960 - RNA, 22 nt, Human
auaguaugagcucauacacuug

SEQ ID NO: 718961 - RNA, 22 nt, Human
ucucccucuguaagaucagggg

SEQ ID NO: 718962 - RNA, 22 nt, Human
uuacgcagcugcuccaggaagc

SEQ ID NO: 718963 - RNA, 23 nt, Human
auggagcugguacuagcuaccuc

SEQ ID NO: 718964 - RNA, 17 nt, Human
agugagaaugucaugua

SEQ ID NO: 718965 - RNA, 22 nt, Human
uaauuuaugaugcaaagaaaag

SEQ ID NO: 718966 - RNA, 22 nt, Human
cugccucaugcugccugcagcc

SEQ ID NO: 718967 - RNA, 22 nt, Human
aacuccagggggucaauauuua

SEQ ID NO: 718968 - RNA, 22 nt, Human
gaagcuccguacuaugacuuuu

SEQ ID NO: 718969 - RNA, 18 nt, Human
cugccacuuaauguggug

SEQ ID NO: 718970 - RNA, 22 nt, Human
aacucuuuggucucaggaaagg

SEQ ID NO: 718971 - RNA, 23 nt, Human
uguguacacaauagaugagguuu

SEQ ID NO: 718972 - RNA, 19 nt, Human
uauguguguguauuuacau

SEQ ID NO: 718973 - RNA, 22 nt, Human
aaacuucagggaauaaaagagu

SEQ ID NO: 718974 - RNA, 22 nt, Human
cuggcuuucugcacagaauugg

SEQ ID NO: 718975 - RNA, 22 nt, Human
ccacagaguugaugcaauaaga

SEQ ID NO: 718976 - RNA, 22 nt, Human
ugcucuaguggguagagcauug

SEQ ID NO: 718977 - RNA, 20 nt, Human
caacaugagcaagugaacug

SEQ ID NO: 718978 - RNA, 22 nt, Human
cauggcuucugaucaaggaacu

SEQ ID NO: 718979 - RNA, 22 nt, Human
agcagggaggucuagcacgugg

SEQ ID NO: 718980 - RNA, 22 nt, Human
uccugggagacccagcugugga

SEQ ID NO: 718981 - RNA, 22 nt, Human
gaaugaaagauuugcauucuau

SEQ ID NO: 718982 - RNA, 22 nt, Human
aggcagccagauggcagccugc

SEQ ID NO: 718983 - RNA, 22 nt, Human
caaaauuguugaugcugcuuug

SEQ ID NO: 718984 - RNA, 22 nt, Human
uaaagcuguucagugcagaaag

SEQ ID NO: 718985 - RNA, 22 nt, Human
cuggagcucuguguguuccuga

SEQ ID NO: 718986 - RNA, 22 nt, Human
ucacaguauagaguuauuuugg

SEQ ID NO: 718987 - RNA, 22 nt, Human
ucagcuuugaucucaggcaauc

SEQ ID NO: 718988 - RNA, 21 nt, Human
gggcagcagcagcaacaaggg

SEQ ID NO: 718989 - RNA, 22 nt, Human
gggcuggucuggcuuagucagg

SEQ ID NO: 718990 - RNA, 22 nt, Human
uccugaagcaguuagcaugagc

SEQ ID NO: 718991 - RNA, 20 nt, Human
aggggucuagcagcagugcu

SEQ ID NO: 718992 - RNA, 23 nt, Human
cucccuggcccuugggagaccug

SEQ ID NO: 718993 - RNA, 22 nt, Human
guucuucagaggggaaagaacc

SEQ ID NO: 718994 - RNA, 22 nt, Human
gccagugugcaagaaaacagaa

SEQ ID NO: 718995 - RNA, 22 nt, Human
aacauugauugcaucuguucac

SEQ ID NO: 718996 - RNA, 22 nt, Human
ucagaacuauaguaguuucaug

SEQ ID NO: 718997 - RNA, 22 nt, Human
uugacuucagccuguacuugua

SEQ ID NO: 718998 - RNA, 20 nt, Human
uccuuuccuccuucuaaaug

SEQ ID NO: 718999 - RNA, 22 nt, Human
gcugaauaggcacagagggcau

SEQ ID NO: 719000 - RNA, 22 nt, Human
uaugaacuuuugaugugacaug

SEQ ID NO: 719001 - RNA, 22 nt, Human
uugggcuccuguugauccuguc

SEQ ID NO: 719002 - RNA, 22 nt, Human
gggcugcugccaccagguggau

SEQ ID NO: 719003 - RNA, 22 nt, Human
acuguaaaagaaggucuuugca

SEQ ID NO: 719004 - RNA, 21 nt, Human
ucaaaucauguacugaccaca

SEQ ID NO: 719005 - RNA, 21 nt, Human
cuggucuggccaauaaggucc

SEQ ID NO: 719006 - RNA, 22 nt, Human
gcugggaaccaugggaaggcag

SEQ ID NO: 719007 - RNA, 22 nt, Human
ucccuguguccaugccaggagg

SEQ ID NO: 719008 - RNA, 22 nt, Human
cugugagggcagggaccagagg

SEQ ID NO: 719009 - RNA, 22 nt, Human
gagugaugucuguagugaagaa

SEQ ID NO: 719010 - RNA, 21 nt, Human
ccaguauuauuucucuaugua

SEQ ID NO: 719011 - RNA, 22 nt, Human
cagcaguguggaagcugagggg

SEQ ID NO: 719012 - RNA, 22 nt, Human
uccugucuaaagaccugcaggc

SEQ ID NO: 719013 - RNA, 22 nt, Human
ugucagcagaaaucuggucugc

SEQ ID NO: 719014 - RNA, 22 nt, Human
cugggcagcugugcaaacaaua

SEQ ID NO: 719015 - RNA, 22 nt, Human
uaguuuagccccacgugugcuu

SEQ ID NO: 719016 - RNA, 22 nt, Human
caggucuguuuucaaggucagu

SEQ ID NO: 719017 - RNA, 22 nt, Human
gcuguuagucaguggaugcccc

SEQ ID NO: 719018 - RNA, 22 nt, Human
cugucugaauccuaagcuuccu

SEQ ID NO: 719019 - RNA, 22 nt, Human
uuucugaauuccuaggauguug

SEQ ID NO: 719020 - RNA, 22 nt, Human
uauaguaaaauuuucauuuaug

SEQ ID NO: 719021 - RNA, 22 nt, Human
acaguugguuaacacaaauauu

SEQ ID NO: 719022 - RNA, 18 nt, Human
gucagaggauggggaaau

SEQ ID NO: 719023 - RNA, 22 nt, Human
guggucagguuaucagaucaua

SEQ ID NO: 719024 - RNA, 22 nt, Human
ugcaaaaugacuucugaaaaga

SEQ ID NO: 719025 - RNA, 22 nt, Human
aauuucaguugcuaauaaguuc

SEQ ID NO: 719026 - RNA, 22 nt, Human
aaccaggugacucauggugagc

SEQ ID NO: 719027 - RNA, 22 nt, Human
acagcccagcucuuucucugca

SEQ ID NO: 719028 - RNA, 22 nt, Human
uaaucucuuuaugagaagaagg

SEQ ID NO: 719029 - RNA, 22 nt, Human
auguaaggcugccuaugacacu

SEQ ID NO: 719030 - RNA, 22 nt, Human
gagagguguguuucagauaaga

SEQ ID NO: 719031 - RNA, 22 nt, Human
gggcaugagaggcaggcaagug

SEQ ID NO: 719032 - RNA, 22 nt, Human
agaaguuaauuccugaaauucu

SEQ ID NO: 719033 - RNA, 22 nt, Human
uaucuuuagaggaagagaaucu

SEQ ID NO: 719034 - RNA, 22 nt, Human
gaguaauuuauccagugaagua

SEQ ID NO: 719035 - RNA, 22 nt, Human
acacaagucccuccauacucuc

SEQ ID NO: 719036 - RNA, 22 nt, Human
cagccagggagcaaagaguuga

SEQ ID NO: 719037 - RNA, 23 nt, Human
acucagugagggccuugggcugc

SEQ ID NO: 719038 - RNA, 22 nt, Human
uaacuucaagucuguggaucag

SEQ ID NO: 719039 - RNA, 22 nt, Human
ucaugguucaugaguguccuuu

SEQ ID NO: 719040 - RNA, 22 nt, Human
cccagggguucugagcagcagc

SEQ ID NO: 719041 - RNA, 22 nt, Human
uggagagcuguugaaaugcaga

SEQ ID NO: 719042 - RNA, 22 nt, Human
ccugugggagguucugugaguc

SEQ ID NO: 719043 - RNA, 22 nt, Human
ucuguagcaagugagaggcauu

SEQ ID NO: 719044 - RNA, 22 nt, Human
agcaauuauuguauaagaacaa

SEQ ID NO: 719045 - RNA, 22 nt, Human
cugcugugcacccaggaaggcu

SEQ ID NO: 719046 - RNA, 22 nt, Human
uucauucagugagacuaggacg

SEQ ID NO: 719047 - RNA, 22 nt, Human
uucaagaucuuccaaaggauac

SEQ ID NO: 719048 - RNA, 22 nt, Human
uauguaguacuuagugcauaca

SEQ ID NO: 719049 - RNA, 22 nt, Human
uucaggaggugagcaagaaggg

SEQ ID NO: 719050 - RNA, 22 nt, Human
cagaauaaaaacuccuaugucu

SEQ ID NO: 719051 - RNA, 22 nt, Human
ucaauagaaaugcagagucuca

SEQ ID NO: 719052 - RNA, 22 nt, Human
auauuuauaaggcaggcaagua

SEQ ID NO: 719053 - RNA, 22 nt, Human
gugcaugcaguaaguguuuuaa

SEQ ID NO: 719054 - RNA, 22 nt, Human
acauuucuuucuauucaguagc

SEQ ID NO: 719055 - RNA, 22 nt, Human
aaggcugaauucaaggguaggc

SEQ ID NO: 719056 - RNA, 17 nt, Human
cuccuggcagccucagg

SEQ ID NO: 719057 - RNA, 22 nt, Human
ucuggcucccagccugcucuca

SEQ ID NO: 719058 - RNA, 22 nt, Human
agguucuugguguccagauuuc

SEQ ID NO: 719059 - RNA, 22 nt, Human
acaaggaggucuggggggcccu

SEQ ID NO: 719060 - RNA, 22 nt, Human
uuuagagguuagaggcugauag

SEQ ID NO: 719061 - RNA, 22 nt, Human
aggcugagcaaagggccuuacc

SEQ ID NO: 719062 - RNA, 20 nt, Human
cugggcagguguuugaucuc

SEQ ID NO: 719063 - RNA, 20 nt, Human
uccaauuuaagaauuuagag

SEQ ID NO: 719064 - RNA, 22 nt, Human
ugccugccuaggaagcugugaa

SEQ ID NO: 719065 - RNA, 22 nt, Human
uggaggccaugccagagcccua

SEQ ID NO: 719066 - RNA, 18 nt, Human
cccacacagcaguagcuc

SEQ ID NO: 719067 - RNA, 22 nt, Human
ccugcaagagcggagaagccag

SEQ ID NO: 719068 - RNA, 19 nt, Human
agggaauccggcugaggga

SEQ ID NO: 719069 - RNA, 22 nt, Human
aagcccagcugaaagcauuuuu

SEQ ID NO: 719070 - RNA, 22 nt, Human
gccaggcagcuagcaaccccug

SEQ ID NO: 719071 - RNA, 22 nt, Human
ugggaugagggugagccacaug

SEQ ID NO: 719072 - RNA, 22 nt, Human
uaaguuuucuggaauaacuugg

SEQ ID NO: 719073 - RNA, 22 nt, Human
ugugugaguaaggcugagagag

SEQ ID NO: 719074 - RNA, 22 nt, Human
augucacaguugcaacaugaau

SEQ ID NO: 719075 - RNA, 22 nt, Human
acuggcagaggauagcacuaau

SEQ ID NO: 719076 - RNA, 22 nt, Human
uuauguaugaauauaguagaag

SEQ ID NO: 719077 - RNA, 22 nt, Human
uuucugaagucuucuaacagau

SEQ ID NO: 719078 - RNA, 22 nt, Human
uagcaaaauguggauguaguug

SEQ ID NO: 719079 - RNA, 22 nt, Human
ugucaccuggaaaucacucuaa

SEQ ID NO: 719080 - RNA, 22 nt, Human
ugggauggagccugaguauagu

SEQ ID NO: 719081 - RNA, 22 nt, Human
ucuccaggaaagacacuggacu

SEQ ID NO: 719082 - RNA, 22 nt, Human
aacaaaacauuugucuuguuuc

SEQ ID NO: 719083 - RNA, 23 nt, Human
ucucccugagguuguuagcauua

SEQ ID NO: 719084 - RNA, 22 nt, Human
ugucauguuucauguuuguagg

SEQ ID NO: 719085 - RNA, 22 nt, Human
uccauaggaucugcuucauacu

SEQ ID NO: 719086 - RNA, 22 nt, Human
aauaauuuuagcucagaguugu

SEQ ID NO: 719087 - RNA, 21 nt, Human
ugcuccagggcagcuuccagc

SEQ ID NO: 719088 - RNA, 22 nt, Human
ccaguggaauuaaaaauaagug

SEQ ID NO: 719089 - RNA, 22 nt, Human
cuuguaauuauaauguacuguu

SEQ ID NO: 719090 - RNA, 20 nt, Human
cugugcuuuggaaccuggaa

SEQ ID NO: 719091 - RNA, 22 nt, Human
guuauguaugggggccuuauga

SEQ ID NO: 719092 - RNA, 22 nt, Human
uugcagauuaaaacacugagcu

SEQ ID NO: 719093 - RNA, 22 nt, Human
uaggaagcuaugggagauguga

SEQ ID NO: 719094 - RNA, 22 nt, Human
ugcucugguccucccucggcgc

SEQ ID NO: 719095 - RNA, 22 nt, Human
cugccagucuaugcugcucggc

SEQ ID NO: 719096 - RNA, 22 nt, Human
auagucuuacuuuucucugcua

SEQ ID NO: 719097 - RNA, 22 nt, Human
uuuuuaucuacagauucucagc

SEQ ID NO: 719098 - RNA, 22 nt, Human
caaccaguagcugaguucaaaa

SEQ ID NO: 719099 - RNA, 22 nt, Human
cucacaggguucuaucgaagag

SEQ ID NO: 719100 - RNA, 22 nt, Human
cugucuucccgaggcccuggag

SEQ ID NO: 719101 - RNA, 21 nt, Human
caaaagagacugauucuugga

SEQ ID NO: 719102 - RNA, 22 nt, Human
ggguggucuggcaggcuggaaa

SEQ ID NO: 719103 - RNA, 22 nt, Human
aaccucaggcucucuggacaau

SEQ ID NO: 719104 - RNA, 22 nt, Human
caucuugaagguuucuuuagcu

SEQ ID NO: 719105 - RNA, 22 nt, Human
agcucaggcucugcagggacua

SEQ ID NO: 719106 - RNA, 22 nt, Human
cagagcagaaaccugggugauu

SEQ ID NO: 719107 - RNA, 22 nt, Human
uuuccuuucugguuuggucaua

SEQ ID NO: 719108 - RNA, 22 nt, Human
guccuucauaucauggauuaua

SEQ ID NO: 719109 - RNA, 22 nt, Human
ucaauacacaugccgcuguucu

SEQ ID NO: 719110 - RNA, 22 nt, Human
uggaaagaugaagauguuuaag

SEQ ID NO: 719111 - RNA, 22 nt, Human
gaaggggacuggcagcugcaga

SEQ ID NO: 719112 - RNA, 22 nt, Human
uuccuuaauaucccuuuuggaa

SEQ ID NO: 719113 - RNA, 22 nt, Human
uaagucaucccauaacagugcu

SEQ ID NO: 719114 - RNA, 22 nt, Human
gggcaugguggugcacaccugu

SEQ ID NO: 719115 - RNA, 22 nt, Human
ugaaaugcaacaguuauuuuug

SEQ ID NO: 719116 - RNA, 22 nt, Human
ucuucuguggcucucaccaccc

SEQ ID NO: 719117 - RNA, 22 nt, Human
gucugcuguagguaggacagca

SEQ ID NO: 719118 - RNA, 22 nt, Human
aacaggcaauuuaggacucuuu

SEQ ID NO: 719119 - RNA, 22 nt, Human
acuguagcugccacuggaugca

SEQ ID NO: 719120 - RNA, 22 nt, Human
cuucucugacagucuguuucac

SEQ ID NO: 719121 - RNA, 22 nt, Human
aauuacuuaacucucugggccu

SEQ ID NO: 719122 - RNA, 22 nt, Human
ugcugucaagaaaacaagcaau

SEQ ID NO: 719123 - RNA, 22 nt, Human
uccagccaccaccuugauugcc

SEQ ID NO: 719124 - RNA, 22 nt, Human
uggcuucauggcugugcaaucu

SEQ ID NO: 719125 - RNA, 22 nt, Human
cuuuacaaccuaaguugaagcu

SEQ ID NO: 719126 - RNA, 22 nt, Human
uacacuguguaaaaugcacuuu

SEQ ID NO: 719127 - RNA, 16 nt, Human
ccuuuucucaucucua

SEQ ID NO: 719128 - RNA, 22 nt, Human
acaguucugagcuauaauugcu

SEQ ID NO: 719129 - RNA, 22 nt, Human
ucccugagacucuggaguguaa

SEQ ID NO: 719130 - RNA, 22 nt, Human
caggagacucagcauccaggau

SEQ ID NO: 719131 - RNA, 22 nt, Human
gcaggccugacuguagggggca

SEQ ID NO: 719132 - RNA, 21 nt, Human
gaaggagaaagcaagugcugc

SEQ ID NO: 719133 - RNA, 22 nt, Human
cugaaaggagagcugcaaggau

SEQ ID NO: 719134 - RNA, 22 nt, Human
ggcagaagacaggcaaaucaug

SEQ ID NO: 719135 - RNA, 22 nt, Human
gucuuauuaugagguuagacuu

SEQ ID NO: 719136 - RNA, 22 nt, Human
uggccuuccuggugacucauga

SEQ ID NO: 719137 - RNA, 22 nt, Human
gaauguuuaaaaggugcaguuu

SEQ ID NO: 719138 - RNA, 22 nt, Human
gucacccacucccugcugcugu

SEQ ID NO: 719139 - RNA, 23 nt, Human
agaggggagcaucugcuggcuga

SEQ ID NO: 719140 - RNA, 23 nt, Human
auccugcugauggcccuccagga

SEQ ID NO: 719141 - RNA, 22 nt, Human
uaauaccacugugcucauuaua

SEQ ID NO: 719142 - RNA, 22 nt, Human
aggggagagaacauaaggaagu

SEQ ID NO: 719143 - RNA, 22 nt, Human
guugaacuauguuuuaucugac

SEQ ID NO: 719144 - RNA, 22 nt, Human
accagaggaggaauuaccuucc

SEQ ID NO: 719145 - RNA, 22 nt, Human
ucuccugcuucaacugauggac

SEQ ID NO: 719146 - RNA, 22 nt, Human
uaaaggcuucugcagggacuga

SEQ ID NO: 719147 - RNA, 22 nt, Human
caggaaagagcugccaggcagg

SEQ ID NO: 719148 - RNA, 22 nt, Human
ccagaggcuggguucaccucag

SEQ ID NO: 719149 - RNA, 22 nt, Human
aacacagggacucccaggagaa

SEQ ID NO: 719150 - RNA, 22 nt, Human
aucaaaguuucccagaaguugu

SEQ ID NO: 719151 - RNA, 22 nt, Human
agcagcaaggaagcgaggaugg

SEQ ID NO: 719152 - RNA, 22 nt, Human
gcaggcucaaaagcugguagga

SEQ ID NO: 719153 - RNA, 22 nt, Human
uucagggacuuagugucaguuu

SEQ ID NO: 719154 - RNA, 22 nt, Human
ccuccagcugccucagucucuu

SEQ ID NO: 719155 - RNA, 22 nt, Human
gugccugggacuugcuccggau

SEQ ID NO: 719156 - RNA, 18 nt, Human
gggcucugauccuucacc

SEQ ID NO: 719157 - RNA, 22 nt, Human
uuguaaaugaccuuuucuaauu

SEQ ID NO: 719158 - RNA, 22 nt, Human
cccucccuuccaaguugaggac

SEQ ID NO: 719159 - RNA, 22 nt, Human
cuaaacaagauacuaaugaggu

SEQ ID NO: 719160 - RNA, 22 nt, Human
aguucuaagaugcuccacagag

SEQ ID NO: 719161 - RNA, 22 nt, Human
gagccugcccagcccuguccac

SEQ ID NO: 719162 - RNA, 22 nt, Human
gggcggggcuuccguccuccac

SEQ ID NO: 719163 - RNA, 22 nt, Human
uggccacuccucccugcaggcu

SEQ ID NO: 719164 - RNA, 22 nt, Human
cuguggcuccauagaaguugca

SEQ ID NO: 719165 - RNA, 22 nt, Human
ucacaauacucacucaauggcu

SEQ ID NO: 719166 - RNA, 22 nt, Human
uggcagagaugaagaguuguuu

SEQ ID NO: 719167 - RNA, 22 nt, Human
gguuuaagacaggcuucacagu

SEQ ID NO: 719168 - RNA, 22 nt, Human
ggaagaggcugagccagguccc

SEQ ID NO: 719169 - RNA, 22 nt, Human
cagaggucagguuggacauuau

SEQ ID NO: 719170 - RNA, 22 nt, Human
uuugcuuucuugauucagauua

SEQ ID NO: 719171 - RNA, 22 nt, Human
uaucugugaaauguguuuguau

SEQ ID NO: 719172 - RNA, 22 nt, Human
ugcuggagaacugcucuguguu

SEQ ID NO: 719173 - RNA, 22 nt, Human
cucauccacccucacuaggaaa

SEQ ID NO: 719174 - RNA, 20 nt, Human
gcaccugaaugcaucuugga

SEQ ID NO: 719175 - RNA, 22 nt, Human
gagagcugaggggccuggcacu

SEQ ID NO: 719176 - RNA, 22 nt, Human
cuacuuuaauuuucugcagaga

SEQ ID NO: 719177 - RNA, 22 nt, Human
cagguuggagaucugucuaugg

SEQ ID NO: 719178 - RNA, 22 nt, Human
cagcaggaaagacaucugagca

SEQ ID NO: 719179 - RNA, 22 nt, Human
cuucccuuccccucacggagac

SEQ ID NO: 719180 - RNA, 22 nt, Human
auuuggggcucaccagggcuga

SEQ ID NO: 719181 - RNA, 22 nt, Human
agguaugugcuauuguuauauu

SEQ ID NO: 719182 - RNA, 22 nt, Human
ugauagaaaggaaauuaauugg

SEQ ID NO: 719183 - RNA, 22 nt, Human
augggcagggcaguguauaaga

SEQ ID NO: 719184 - RNA, 22 nt, Human
cugccaccaugccccagcagag

SEQ ID NO: 719185 - RNA, 22 nt, Human
gacaggugaaacagcaagguaa

SEQ ID NO: 719186 - RNA, 22 nt, Human
uuucacaugguacugccuguuu

SEQ ID NO: 719187 - RNA, 22 nt, Human
ucuuuguuauugugaauagggu

SEQ ID NO: 719188 - RNA, 19 nt, Human
uucuuugaguucuucugag

SEQ ID NO: 719189 - RNA, 22 nt, Human
accugucuauaaaagugaauac

SEQ ID NO: 719190 - RNA, 22 nt, Human
auccuuuauaagacuuguauuc

SEQ ID NO: 719191 - RNA, 22 nt, Human
gcuacuuugcagcuagcuagga

SEQ ID NO: 719192 - RNA, 20 nt, Human
accagagaccugaaucaguu

SEQ ID NO: 719193 - RNA, 22 nt, Human
aagucagauaggugaguccaaa

SEQ ID NO: 719194 - RNA, 22 nt, Human
ucugccugagcagagggaggcc

SEQ ID NO: 719195 - RNA, 22 nt, Human
caaagcaaggcucaguuugaac

SEQ ID NO: 719196 - RNA, 18 nt, Human
agugucuggauauuuggg

SEQ ID NO: 719197 - RNA, 22 nt, Human
uaggaaccagagcacucugggc

SEQ ID NO: 719198 - RNA, 17 nt, Human
gcucuggcacaggauug

SEQ ID NO: 719199 - RNA, 22 nt, Human
gaaggcuguuucugguagugau

SEQ ID NO: 719200 - RNA, 22 nt, Human
cugccagggcauccuguggugg

SEQ ID NO: 719201 - RNA, 22 nt, Human
cuauuugggguagaagauggau

SEQ ID NO: 719202 - RNA, 22 nt, Human
cugcugcauuacucuucucaag

SEQ ID NO: 719203 - RNA, 22 nt, Human
acagccugagaguggagcuggc

SEQ ID NO: 719204 - RNA, 22 nt, Human
uuucacaggaguuguaccauuu

SEQ ID NO: 719205 - RNA, 22 nt, Human
uguggcugggaagaagguaacu

SEQ ID NO: 719206 - RNA, 22 nt, Human
cccaauaaaauucauuuucauu

SEQ ID NO: 719207 - RNA, 22 nt, Human
gcagaggguccugugccagcag

SEQ ID NO: 719208 - RNA, 22 nt, Human
agagaucucugaagcugcugcu

SEQ ID NO: 719209 - RNA, 23 nt, Human
auuucccauugugucagcagagc

SEQ ID NO: 719210 - RNA, 22 nt, Human
uagaauaaguugaugauauaug

SEQ ID NO: 719211 - RNA, 22 nt, Human
gugaccagugaugcugaggagu

SEQ ID NO: 719212 - RNA, 22 nt, Human
cagaugcuaaguuaucagcagg

SEQ ID NO: 719213 - RNA, 22 nt, Human
gagggagggacuagcauucucu

SEQ ID NO: 719214 - RNA, 22 nt, Human
uccuguguuacccuugcaguga

SEQ ID NO: 719215 - RNA, 22 nt, Human
ucaguccagcuccucauuuccc

SEQ ID NO: 719216 - RNA, 22 nt, Human
uuuguucauuaguacaguugua

SEQ ID NO: 719217 - RNA, 20 nt, Human
gccaugaggggaggugacug

SEQ ID NO: 719218 - RNA, 22 nt, Human
agaccagggucccacagagucu

SEQ ID NO: 719219 - RNA, 22 nt, Human
cugucauuggcagggagugugu

SEQ ID NO: 719220 - RNA, 22 nt, Human
gaggcuccgguaguagccuuga

SEQ ID NO: 719221 - RNA, 22 nt, Human
aagaggccuuggucugaccuga

SEQ ID NO: 719222 - RNA, 22 nt, Human
ccaggacaaguguggccauggc

SEQ ID NO: 719223 - RNA, 22 nt, Human
cauagacauucagcacucacua

SEQ ID NO: 719224 - RNA, 22 nt, Human
cucagggaggagcuucugggcc

SEQ ID NO: 719225 - RNA, 20 nt, Human
agcaguuuccuaacucagcu

SEQ ID NO: 719226 - RNA, 22 nt, Human
gugacauuuacgaaucuuaucc

SEQ ID NO: 719227 - RNA, 22 nt, Human
gggccccaguccucccacgugg

SEQ ID NO: 719228 - RNA, 22 nt, Human
agcgggcucaaguggccagcag

SEQ ID NO: 719229 - RNA, 22 nt, Human
agggccagaugaagccacaagc

SEQ ID NO: 719230 - RNA, 22 nt, Human
uagcagcucacuaacucugcgu

SEQ ID NO: 719231 - RNA, 22 nt, Human
gucaaacauagggacuuugugg

SEQ ID NO: 719232 - RNA, 22 nt, Human
gcauugaaccaucuagauuucu

SEQ ID NO: 719233 - RNA, 22 nt, Human
cucccagagaccaagcugagaa

SEQ ID NO: 719234 - RNA, 19 nt, Human
gagcagcugcacccauuga

SEQ ID NO: 719235 - RNA, 22 nt, Human
uaucaucugcaaagcacaucua

SEQ ID NO: 719236 - RNA, 22 nt, Human
cuggcgugaagguggccaugag

SEQ ID NO: 719237 - RNA, 22 nt, Human
aaugcuuauuauuaauagaaug

SEQ ID NO: 719238 - RNA, 18 nt, Human
uauaaccuguuuugaugg

SEQ ID NO: 719239 - RNA, 22 nt, Human
ggguggagagaaagaaacguga

SEQ ID NO: 719240 - RNA, 22 nt, Human
gcugccugaucauacaccaggg

SEQ ID NO: 719241 - RNA, 22 nt, Human
ucaauagcaaucaagccuucca

SEQ ID NO: 719242 - RNA, 22 nt, Human
agggccugugcugaguagacga

SEQ ID NO: 719243 - RNA, 22 nt, Human
aagagcaucgguggagccccca

SEQ ID NO: 719244 - RNA, 22 nt, Human
cugccugcaugcugccauagcu

SEQ ID NO: 719245 - RNA, 22 nt, Human
cagccucugagccuuggcagau

SEQ ID NO: 719246 - RNA, 22 nt, Human
agagggaaauccaggagugcuu

SEQ ID NO: 719247 - RNA, 22 nt, Human
uuucuuuguaguagcauaauca

SEQ ID NO: 719248 - RNA, 21 nt, Human
gcaacuuaucgcauucugcag

SEQ ID NO: 719249 - RNA, 19 nt, Human
uuugaugagaauuuaagca

SEQ ID NO: 719250 - RNA, 18 nt, Human
aggcagcagcaucuucuc

SEQ ID NO: 719251 - RNA, 22 nt, Human
uccagcugcuagcuagaugcaa

SEQ ID NO: 719252 - RNA, 22 nt, Human
cugucugcccuggccagagccc

SEQ ID NO: 719253 - RNA, 22 nt, Human
gugcuuccaucuagagggucac

SEQ ID NO: 719254 - RNA, 22 nt, Human
auucacaugcccaagcagcacc

SEQ ID NO: 719255 - RNA, 22 nt, Human
ucugggagagucacaggcauug

SEQ ID NO: 719256 - RNA, 22 nt, Human
uaauacagaaguguauuaaaau

SEQ ID NO: 719257 - RNA, 22 nt, Human
aacagugaguugaugacugaau

SEQ ID NO: 719258 - RNA, 22 nt, Human
gggcugacaguuuccccugaaa

SEQ ID NO: 719259 - RNA, 22 nt, Human
uccugggaggaacauuuaccua

SEQ ID NO: 719260 - RNA, 22 nt, Human
gcuagaaaucgacuucagaauu

SEQ ID NO: 719261 - RNA, 22 nt, Human
agcagcaguccuuuguguaauu

SEQ ID NO: 719262 - RNA, 22 nt, Human
cuguuaauggaggacuacagga

SEQ ID NO: 719263 - RNA, 22 nt, Human
cucugggcccacuuaaaucugg

SEQ ID NO: 719264 - RNA, 22 nt, Human
auaggaaaucgcuauuaaccua

SEQ ID NO: 719265 - RNA, 22 nt, Human
aggucugagucccagggguacc

SEQ ID NO: 719266 - RNA, 22 nt, Human
cagagccucagaauccugugga

SEQ ID NO: 719267 - RNA, 22 nt, Human
uucaacuaauguuuauuuuaug

SEQ ID NO: 719268 - RNA, 22 nt, Human
uguuuuauauaagcagagcggu

SEQ ID NO: 719269 - RNA, 22 nt, Human
ucuuggaauaccccgaagguca

SEQ ID NO: 719270 - RNA, 22 nt, Human
uccuugggaaaucacuagcacu

SEQ ID NO: 719271 - RNA, 22 nt, Human
gaaguuaucaggauuaaaguug

SEQ ID NO: 719272 - RNA, 22 nt, Human
ggggagcaauugcccccuuaga

SEQ ID NO: 719273 - RNA, 22 nt, Human
uuauggaauggagaaagucugc

SEQ ID NO: 719274 - RNA, 20 nt, Human
ggaaggcuguuuuuccacca

SEQ ID NO: 719275 - RNA, 22 nt, Human
cagaaauauuuauugagugaca

SEQ ID NO: 719276 - RNA, 20 nt, Human
ugccccaggccugcaccugc

SEQ ID NO: 719277 - RNA, 22 nt, Human
uacaacaguaaucaagguuuuu

SEQ ID NO: 719278 - RNA, 22 nt, Human
uauaucagcaaagcauuuaaaa

SEQ ID NO: 719279 - RNA, 22 nt, Human
uauuuccuugagacggagucuc

SEQ ID NO: 719280 - RNA, 22 nt, Human
augauucuaaacuuaaggggga

SEQ ID NO: 719281 - RNA, 22 nt, Human
agugguggagccaggaaaugug

SEQ ID NO: 719282 - RNA, 22 nt, Human
ggaauauagccaguaacaguca

SEQ ID NO: 719283 - RNA, 22 nt, Human
auuucccaugugaaucaauugg

SEQ ID NO: 719284 - RNA, 22 nt, Human
ccaguucuaaacauaaagcuaa

SEQ ID NO: 719285 - RNA, 22 nt, Human
ugggucagagcagaccucugga

SEQ ID NO: 719286 - RNA, 22 nt, Human
cuuucugauguaaggaacuagg

SEQ ID NO: 719287 - RNA, 22 nt, Human
acccaggguagagugcaguggc

SEQ ID NO: 719288 - RNA, 22 nt, Human
ugaacccaggagguugcaguga

SEQ ID NO: 719289 - RNA, 22 nt, Human
uauguacaccggggaagguggg

SEQ ID NO: 719290 - RNA, 22 nt, Human
cugugaauugcaacaauugcaa

SEQ ID NO: 719291 - RNA, 22 nt, Human
uucagaaugcuauuucugaaau

SEQ ID NO: 719292 - RNA, 22 nt, Human
uuuauucucuaguuggucagau

SEQ ID NO: 719293 - RNA, 22 nt, Human
gucacacuagggccaaguggag

SEQ ID NO: 719294 - RNA, 22 nt, Human
uguguacacaaugauugcagag

SEQ ID NO: 719295 - RNA, 22 nt, Human
caucaaauggcaagugaaagcu

SEQ ID NO: 719296 - RNA, 22 nt, Human
gaaacuuacuuacucacauuuc

SEQ ID NO: 719297 - RNA, 19 nt, Human
aggagccuugagcagugag

SEQ ID NO: 719298 - RNA, 22 nt, Human
ccugggccuauccuagaaccaa

SEQ ID NO: 719299 - RNA, 21 nt, Human
uucaucagccagaaaucaagc

SEQ ID NO: 719300 - RNA, 22 nt, Human
acagagguggaccucagcaggc

SEQ ID NO: 719301 - RNA, 22 nt, Human
ggagaguuguuuuugccuagau

SEQ ID NO: 719302 - RNA, 22 nt, Human
agcugcugaagugagagaauug

SEQ ID NO: 719303 - RNA, 22 nt, Human
accugucugggcuacauuugca

SEQ ID NO: 719304 - RNA, 21 nt, Human
aguacaucucaaauguaaauc

SEQ ID NO: 719305 - RNA, 22 nt, Human
ugcuucugcucagcuuccuacu

SEQ ID NO: 719306 - RNA, 22 nt, Human
agaaaguucugugaguuguuca

SEQ ID NO: 719307 - RNA, 22 nt, Human
ucugaaaguaucuggaucuuuu

SEQ ID NO: 719308 - RNA, 22 nt, Human
agugcucuaacagucaaaaaag

SEQ ID NO: 719309 - RNA, 22 nt, Human
gaaccacaaugugaagaaggag

SEQ ID NO: 719310 - RNA, 22 nt, Human
ucucugagguuguuuccagcac

SEQ ID NO: 719311 - RNA, 22 nt, Human
cucucccuaugccucccaggag

SEQ ID NO: 719312 - RNA, 22 nt, Human
ccuagucuuccgcguccccacc

SEQ ID NO: 719313 - RNA, 19 nt, Human
uccaggggcuccaccuccu

SEQ ID NO: 719314 - RNA, 22 nt, Human
aguguuuauuuacagaugguuu

SEQ ID NO: 719315 - RNA, 22 nt, Human
gauggcuuugugcaccaugauu

SEQ ID NO: 719316 - RNA, 22 nt, Human
uugcagggauuaccuuauuuuu

SEQ ID NO: 719317 - RNA, 20 nt, Human
aagauucugauuuguagcgu

SEQ ID NO: 719318 - RNA, 22 nt, Human
augaagaugguucaacuggccu

SEQ ID NO: 719319 - RNA, 22 nt, Human
caaugcuucugagggaauuaca

SEQ ID NO: 719320 - RNA, 22 nt, Human
gaauuguauugauuuuucagag

SEQ ID NO: 719321 - RNA, 22 nt, Human
uaucagaaggcacauggagucu

SEQ ID NO: 719322 - RNA, 22 nt, Human
auuuuagcuguccaguggauug

SEQ ID NO: 719323 - RNA, 22 nt, Human
gcaggcccagagucgcuggccu

SEQ ID NO: 719324 - RNA, 22 nt, Human
cugagccagggccacacaugga

SEQ ID NO: 719325 - RNA, 22 nt, Human
agucccuugagggaguacuguu

SEQ ID NO: 719326 - RNA, 22 nt, Human
gcaggacauucagugaaugggc

SEQ ID NO: 719327 - RNA, 22 nt, Human
agccagaggccagccugccuca

SEQ ID NO: 719328 - RNA, 22 nt, Human
ugaggugguccaaagacuguuu

SEQ ID NO: 719329 - RNA, 22 nt, Human
gcagagcugcagcgaggccugg

SEQ ID NO: 719330 - RNA, 22 nt, Human
ugaagacaguuuuacucaugag

SEQ ID NO: 719331 - RNA, 22 nt, Human
guggagaccuccuaggaugugu

SEQ ID NO: 719332 - RNA, 23 nt, Human
ccuccucauaucuuugacuagug

SEQ ID NO: 719333 - RNA, 22 nt, Human
ccaaagucuggagcagcagagc

SEQ ID NO: 719334 - RNA, 22 nt, Human
gggguggaucaggcaggcccag

SEQ ID NO: 719335 - RNA, 22 nt, Human
aauuccagucucugcucuauuu

SEQ ID NO: 719336 - RNA, 22 nt, Human
guggcuugaccaucccugcuac

SEQ ID NO: 719337 - RNA, 22 nt, Human
aaucugaagggagauacaugua

SEQ ID NO: 719338 - RNA, 22 nt, Human
aagcucaggaaagagucugguu

SEQ ID NO: 719339 - RNA, 22 nt, Human
cuggcugugugcccccggcacc

SEQ ID NO: 719340 - RNA, 22 nt, Human
aacaggcuucuucugggcuccu

SEQ ID NO: 719341 - RNA, 22 nt, Human
gaggggcuguggagcucucugg

SEQ ID NO: 719342 - RNA, 22 nt, Human
aauauucuaauaaaugcccauc

SEQ ID NO: 719343 - RNA, 22 nt, Human
gcggcgccugggacccgccagc

SEQ ID NO: 719344 - RNA, 22 nt, Human
aaagacuugggagcaguaugcu

SEQ ID NO: 719345 - RNA, 22 nt, Human
cugccuggccugaucuccacgc

SEQ ID NO: 719346 - RNA, 22 nt, Human
auauacaaagggcaaccucgcu

SEQ ID NO: 719347 - RNA, 19 nt, Human
gucuuacaggcaacaugag

SEQ ID NO: 719348 - RNA, 22 nt, Human
acaugcuuuaacuuauuuugau

SEQ ID NO: 719349 - RNA, 20 nt, Human
uggaggcaccuguggagauc

SEQ ID NO: 719350 - RNA, 22 nt, Human
aacugcagagaacaucuggguu

SEQ ID NO: 719351 - RNA, 22 nt, Human
gggcaggaacaaaucaaaugau

SEQ ID NO: 719352 - RNA, 22 nt, Human
cuguaauucacuagggucagcg

SEQ ID NO: 719353 - RNA, 22 nt, Human
gcuguggccaacaaaccacuuu

SEQ ID NO: 719354 - RNA, 22 nt, Human
ccaggugcacucaagaccugcu

SEQ ID NO: 719355 - RNA, 22 nt, Human
gagagugaaggcuucccagcaa

SEQ ID NO: 719356 - RNA, 20 nt, Human
ccagucucuaucagaaauaa

SEQ ID NO: 719357 - RNA, 22 nt, Human
guaaaauugcaauuacuuuugc

SEQ ID NO: 719358 - RNA, 20 nt, Human
uagaggggacaaucauugcc

SEQ ID NO: 719359 - RNA, 22 nt, Human
gcagagauccuugcuggaugac

SEQ ID NO: 719360 - RNA, 22 nt, Human
aguuaacucauuuuauaaugcc

SEQ ID NO: 719361 - RNA, 23 nt, Human
gugcucuucaguuuuagggucau

SEQ ID NO: 719362 - RNA, 22 nt, Human
cuggcaguuugccaggagcucg

SEQ ID NO: 719363 - RNA, 22 nt, Human
ucaaaaauguuuuauauuggua

SEQ ID NO: 719364 - RNA, 17 nt, Human
uuucagauucacuuucu

SEQ ID NO: 719365 - RNA, 22 nt, Human
aguuuucugggaucacuggaau

SEQ ID NO: 719366 - RNA, 22 nt, Human
guaguaauuguuuuaagccacc

SEQ ID NO: 719367 - RNA, 19 nt, Human
agcaaccugucagagaugc

SEQ ID NO: 719368 - RNA, 22 nt, Human
gagaggccauggcugugcagug

SEQ ID NO: 719369 - RNA, 22 nt, Human
uggaacacuggcuuuccacugu

SEQ ID NO: 719370 - RNA, 22 nt, Human
agcaaugacuggcuauaugauu

SEQ ID NO: 719371 - RNA, 22 nt, Human
acacugugagcugaagggcugc

SEQ ID NO: 719372 - RNA, 22 nt, Human
aaauaaguaaugucuuccuuuu

SEQ ID NO: 719373 - RNA, 22 nt, Human
gcucugggaauucagaaagccu

SEQ ID NO: 719374 - RNA, 22 nt, Human
auggcagggcccuuggcuccca

SEQ ID NO: 719375 - RNA, 22 nt, Human
cagaugcugccugggaaugucu

SEQ ID NO: 719376 - RNA, 22 nt, Human
uagaauguuaagaauauguaua

SEQ ID NO: 719377 - RNA, 22 nt, Human
uucugaagggcuaagugucuau

SEQ ID NO: 719378 - RNA, 22 nt, Human
uauugcuuaaaaaauaugugag

SEQ ID NO: 719379 - RNA, 22 nt, Human
augucugcguuauaucaauauc

SEQ ID NO: 719380 - RNA, 22 nt, Human
cagccagaucaaacucagaugu

SEQ ID NO: 719381 - RNA, 22 nt, Human
gugacauuuauuagaugcuuac

SEQ ID NO: 719382 - RNA, 22 nt, Human
agcuaaugggagacccuuucac

SEQ ID NO: 719383 - RNA, 22 nt, Human
uugcaaaaaccacaauuacuuu

SEQ ID NO: 719384 - RNA, 22 nt, Human
ccugucagaugaaguaauugug

SEQ ID NO: 719385 - RNA, 18 nt, Human
cccaggcuuugugggucu

SEQ ID NO: 719386 - RNA, 22 nt, Human
auucaaguucuucugucuuugc

SEQ ID NO: 719387 - RNA, 22 nt, Human
caggcuucaugaauuaugcacc

SEQ ID NO: 719388 - RNA, 22 nt, Human
uauauuaucauaaaaccauuca

SEQ ID NO: 719389 - RNA, 22 nt, Human
aguguggguuuuauggagcccu

SEQ ID NO: 719390 - RNA, 20 nt, Human
auauaauaaauuuugguuac

SEQ ID NO: 719391 - RNA, 22 nt, Human
ugauuauauucuaacuucauaa

SEQ ID NO: 719392 - RNA, 22 nt, Human
gaacuacaggugcagcaaguga

SEQ ID NO: 719393 - RNA, 21 nt, Human
agggucaggaaccaggguacc

SEQ ID NO: 719394 - RNA, 22 nt, Human
cagggagcuuucccaggacccu

SEQ ID NO: 719395 - RNA, 19 nt, Human
guggccugcgcugggugcg

SEQ ID NO: 719396 - RNA, 22 nt, Human
uggccagaacucagacaugugg

SEQ ID NO: 719397 - RNA, 22 nt, Human
gcuucuccagaccuucaucccc

SEQ ID NO: 719398 - RNA, 22 nt, Human
uacaguaggauuuucagggucu

SEQ ID NO: 719399 - RNA, 22 nt, Human
ugggaacauuuugagcugagag

SEQ ID NO: 719400 - RNA, 23 nt, Human
ugcugaaguguuggcccugccca

SEQ ID NO: 719401 - RNA, 18 nt, Human
augugagagaaucuucuu

SEQ ID NO: 719402 - RNA, 20 nt, Human
ggcuccuucuuucauggccc

SEQ ID NO: 719403 - RNA, 22 nt, Human
gcagaggagaugaagauacuuu

SEQ ID NO: 719404 - RNA, 21 nt, Human
aacugcuggucuuuucugucu

SEQ ID NO: 719405 - RNA, 22 nt, Human
cacagcccugcgccccaguuug

SEQ ID NO: 719406 - RNA, 22 nt, Human
ucaaacagaggaacaauuguuu

SEQ ID NO: 719407 - RNA, 22 nt, Human
agggacacugaugagaaauucu

SEQ ID NO: 719408 - RNA, 22 nt, Human
uggaaccaucaaagagauccug

SEQ ID NO: 719409 - RNA, 22 nt, Human
uguugacaauaaagucuaccau

SEQ ID NO: 719410 - RNA, 22 nt, Human
acacuggaccauuuaaacuuga

SEQ ID NO: 719411 - RNA, 22 nt, Human
ucauguuucucuuacagcagcu

SEQ ID NO: 719412 - RNA, 22 nt, Human
aacugaaaguuucaccugaggu

SEQ ID NO: 719413 - RNA, 22 nt, Human
aaagugggaacaauggagagug

SEQ ID NO: 719414 - RNA, 22 nt, Human
cucuggaauggguguuucuaac

SEQ ID NO: 719415 - RNA, 22 nt, Human
gugcccuggagggguugaaggg

SEQ ID NO: 719416 - RNA, 23 nt, Human
ugucugguuucuuuuauuuagca

SEQ ID NO: 719417 - RNA, 23 nt, Human
agaauuguaaauagaauauaccu

SEQ ID NO: 719418 - RNA, 18 nt, Human
acaguaaagaaaggaauu

SEQ ID NO: 719419 - RNA, 22 nt, Human
guggguggagacugggugcaag

SEQ ID NO: 719420 - RNA, 22 nt, Human
cagcuaccaugguuuguuccag

SEQ ID NO: 719421 - RNA, 22 nt, Human
uacacuuguucaaacagcaaaa

SEQ ID NO: 719422 - RNA, 22 nt, Human
cuacauggagaagaaaauucuu

SEQ ID NO: 719423 - RNA, 22 nt, Human
ucauauuucaaaauggcuggag

SEQ ID NO: 719424 - RNA, 22 nt, Human
ugccugggccucugaggaaggc

SEQ ID NO: 719425 - RNA, 22 nt, Human
uacaaaugccugacacacagau

SEQ ID NO: 719426 - RNA, 22 nt, Human
uuauucaggaggugcucgaagg

SEQ ID NO: 719427 - RNA, 22 nt, Human
aggagagaauguuccaggcuug

SEQ ID NO: 719428 - RNA, 22 nt, Human
aacuaauacauuaauacaugug

SEQ ID NO: 719429 - RNA, 22 nt, Human
ccucuauguacacauuuccagc

SEQ ID NO: 719430 - RNA, 22 nt, Human
ccauuacuuuccaauauaucag

SEQ ID NO: 719431 - RNA, 22 nt, Human
acagcugggugucccacuucug

SEQ ID NO: 719432 - RNA, 22 nt, Human
cuggaaugccucccugucagag

SEQ ID NO: 719433 - RNA, 16 nt, Human
gagggcagaggcggaa

SEQ ID NO: 719434 - RNA, 22 nt, Human
ccugccuggggacaaaggaggg

SEQ ID NO: 719435 - RNA, 22 nt, Human
cuggucaggaagguggggacag

SEQ ID NO: 719436 - RNA, 23 nt, Human
gagagagauugcuaaaccacucc

SEQ ID NO: 719437 - RNA, 21 nt, Human
gguugguguguccaguggcca

SEQ ID NO: 719438 - RNA, 22 nt, Human
auuagagguacaaaccuucacu

SEQ ID NO: 719439 - RNA, 22 nt, Human
uggccagccauaaaagaaccca

SEQ ID NO: 719440 - RNA, 22 nt, Human
cagcacaguuucuggcccgccg

SEQ ID NO: 719441 - RNA, 22 nt, Human
cuucuugugcugggccagcuuc

SEQ ID NO: 719442 - RNA, 22 nt, Human
ucgagcucuggagccaaggaug

SEQ ID NO: 719443 - RNA, 22 nt, Human
uguccucuccaacagccucugu

SEQ ID NO: 719444 - RNA, 23 nt, Human
augguuuaugucacacuuuugau

SEQ ID NO: 719445 - RNA, 22 nt, Human
uugaggcauuacuguaaugaga

SEQ ID NO: 719446 - RNA, 22 nt, Human
auggccaagaaguauuccugac

SEQ ID NO: 719447 - RNA, 22 nt, Human
augcuggucugcagaguuggga

SEQ ID NO: 719448 - RNA, 22 nt, Human
ggucacaucuaaauggagcauu

SEQ ID NO: 719449 - RNA, 22 nt, Human
gaaaggcaucuucagucucuga

SEQ ID NO: 719450 - RNA, 22 nt, Human
uuuuucucuaaguagucccaaa

SEQ ID NO: 719451 - RNA, 22 nt, Human
uggcccugguggcacagccugc

SEQ ID NO: 719452 - RNA, 22 nt, Human
gccugcagcugcuuccacacac

SEQ ID NO: 719453 - RNA, 22 nt, Human
gagcuaggauaucaugagggua

SEQ ID NO: 719454 - RNA, 22 nt, Human
cugggagucuggccucuggucc

SEQ ID NO: 719455 - RNA, 18 nt, Human
ugaauuaguuugugguuu

SEQ ID NO: 719456 - RNA, 19 nt, Human
ucucagaggaaaaauugcu

SEQ ID NO: 719457 - RNA, 21 nt, Human
ugcuggaaaaagugguucuag

SEQ ID NO: 719458 - RNA, 22 nt, Human
uugucuuuggaaauuuaauguu

SEQ ID NO: 719459 - RNA, 22 nt, Human
cugcuguguggugaaacucagu

SEQ ID NO: 719460 - RNA, 22 nt, Human
gagcuagaguuuguaggguaga

SEQ ID NO: 719461 - RNA, 22 nt, Human
gaugagggccugguggcugugc

SEQ ID NO: 719462 - RNA, 22 nt, Human
guaugucaaaaucugcaugaua

SEQ ID NO: 719463 - RNA, 22 nt, Human
ugugaggauguuaaggggauga

SEQ ID NO: 719464 - RNA, 22 nt, Human
cagugucuuucagacucagaaa

SEQ ID NO: 719465 - RNA, 22 nt, Human
ggcuccaggaaccuccucuccu

SEQ ID NO: 719466 - RNA, 22 nt, Human
cuacaaauauguuaagguguuu

SEQ ID NO: 719467 - RNA, 22 nt, Human
uuguaaacuggauagaccuauu

SEQ ID NO: 719468 - RNA, 22 nt, Human
aucugggcauggaggaaagaga

SEQ ID NO: 719469 - RNA, 22 nt, Human
agcuguccugugggagggagug

SEQ ID NO: 719470 - RNA, 22 nt, Human
gggcuucuugccauggggacgg

SEQ ID NO: 719471 - RNA, 19 nt, Human
cuuuggaggaugaggcugg

SEQ ID NO: 719472 - RNA, 22 nt, Human
aucauucagugaccacuuccca

SEQ ID NO: 719473 - RNA, 22 nt, Human
uucccagaggagauuugcuuau

SEQ ID NO: 719474 - RNA, 22 nt, Human
ugucaacagauacuagagagcu

SEQ ID NO: 719475 - RNA, 22 nt, Human
aaugcauuccacugagauuugu

SEQ ID NO: 719476 - RNA, 22 nt, Human
ccauccaugguguugguuguau

SEQ ID NO: 719477 - RNA, 22 nt, Human
ggccuagggaguggccaugccu

SEQ ID NO: 719478 - RNA, 22 nt, Human
cucuugaagcaggggccaguuc

SEQ ID NO: 719479 - RNA, 18 nt, Human
cagaaaguuauuuacucu

SEQ ID NO: 719480 - RNA, 22 nt, Human
ggccauggaccccgagcugacc

SEQ ID NO: 719481 - RNA, 22 nt, Human
accugucaaguccagcgcaaca

SEQ ID NO: 719482 - RNA, 22 nt, Human
aggccugagguuccugugcuca

SEQ ID NO: 719483 - RNA, 22 nt, Human
uaaaacuucucauuuuuauggu

SEQ ID NO: 719484 - RNA, 22 nt, Human
agauuugcggcuuuacuuugca

SEQ ID NO: 719485 - RNA, 22 nt, Human
cuguaucugucagcuggucucg

SEQ ID NO: 719486 - RNA, 22 nt, Human
ggccuggaaggacagcgugaug

SEQ ID NO: 719487 - RNA, 22 nt, Human
auuuugaaaccaaguuauuucc

SEQ ID NO: 719488 - RNA, 22 nt, Human
agcacaguugguaaaauuguua

SEQ ID NO: 719489 - RNA, 22 nt, Human
ucagcucugcaaggucaccucc

SEQ ID NO: 719490 - RNA, 22 nt, Human
uguauuuucagaguggcauuuc

SEQ ID NO: 719491 - RNA, 22 nt, Human
gugcccugaucgcuaggcuccc

SEQ ID NO: 719492 - RNA, 22 nt, Human
uucuaaguuacuguuauggucu

SEQ ID NO: 719493 - RNA, 22 nt, Human
guuaaacugaaaggcucguuca

SEQ ID NO: 719494 - RNA, 22 nt, Human
aagugacacauggcacuucuau

SEQ ID NO: 719495 - RNA, 22 nt, Human
ugagccugcaauaagcacagcc

SEQ ID NO: 719496 - RNA, 22 nt, Human
cugucugcuaugcuuguuguca

SEQ ID NO: 719497 - RNA, 22 nt, Human
agccaaaggcaccagagacacu

SEQ ID NO: 719498 - RNA, 22 nt, Human
aguuuucuuucaucuaucagca

SEQ ID NO: 719499 - RNA, 22 nt, Human
agaaauacugugagagcagccu

SEQ ID NO: 719500 - RNA, 22 nt, Human
aaaaauaggucaaccguguaug

SEQ ID NO: 719501 - RNA, 22 nt, Human
ccugggcaaaugccagagacaa

SEQ ID NO: 719502 - RNA, 22 nt, Human
uucuuucucacucuuuaggaag

SEQ ID NO: 719503 - RNA, 22 nt, Human
ccucugcucugguccaugugcu

SEQ ID NO: 719504 - RNA, 22 nt, Human
acuccagggguugcuauuuaca

SEQ ID NO: 719505 - RNA, 22 nt, Human
ucccaccuuccguggaacccgu

SEQ ID NO: 719506 - RNA, 22 nt, Human
uaauuuugucccccugcacaua

SEQ ID NO: 719507 - RNA, 22 nt, Human
uaggaaagaaaugaguagugau

SEQ ID NO: 719508 - RNA, 22 nt, Human
gcugaaauuagacugcagaagu

SEQ ID NO: 719509 - RNA, 23 nt, Human
aaggguccauagcuaucauuaca

SEQ ID NO: 719510 - RNA, 22 nt, Human
uggcagucuuguaggcaucucc

SEQ ID NO: 719511 - RNA, 22 nt, Human
aguuggagaagaggucgggaau

SEQ ID NO: 719512 - RNA, 18 nt, Human
uccagggcuuccuccucu

SEQ ID NO: 719513 - RNA, 22 nt, Human
cacucugagcccaagcaggcug

SEQ ID NO: 719514 - RNA, 22 nt, Human
ugcuugugagaguuuuuucaga

SEQ ID NO: 719515 - RNA, 17 nt, Human
uggcgcucccagggugc

SEQ ID NO: 719516 - RNA, 23 nt, Human
uccccucaggcagccagugcccu

SEQ ID NO: 719517 - RNA, 22 nt, Human
gccuggaggggacagucucugg

SEQ ID NO: 719518 - RNA, 22 nt, Human
agucaggauuuaaacucagaca

SEQ ID NO: 719519 - RNA, 22 nt, Human
uuuaaagagaaugugaaggagu

SEQ ID NO: 719520 - RNA, 22 nt, Human
agaaaacacugcccccucucuc

SEQ ID NO: 719521 - RNA, 22 nt, Human
aacagugcugauuauuuuaccu

SEQ ID NO: 719522 - RNA, 22 nt, Human
gcagugacauaccuggagggca

SEQ ID NO: 719523 - RNA, 22 nt, Human
aggcucagucuguucaugcacu

SEQ ID NO: 719524 - RNA, 22 nt, Human
gcugguuucacccaaccgaugu

SEQ ID NO: 719525 - RNA, 22 nt, Human
aagggcuggaucucucugagca

SEQ ID NO: 719526 - RNA, 22 nt, Human
uuaacaaaaauaucaggcauca

SEQ ID NO: 719527 - RNA, 22 nt, Human
aaggcuaugaucuuuuucauga

SEQ ID NO: 719528 - RNA, 22 nt, Human
augugugugugcgcgcgcagga

SEQ ID NO: 719529 - RNA, 22 nt, Human
uaaggccaauuacauauguuca

SEQ ID NO: 719530 - RNA, 22 nt, Human
ggagacagugacuuagagacug

SEQ ID NO: 719531 - RNA, 23 nt, Human
cauggggagcagugcuccugacc

SEQ ID NO: 719532 - RNA, 18 nt, Human
ucuuuuguccccugcugc

SEQ ID NO: 719533 - RNA, 22 nt, Human
cccaaggccuucaagccagcuc

SEQ ID NO: 719534 - RNA, 22 nt, Human
aagcaguuuuucaacuguuuag

SEQ ID NO: 719535 - RNA, 19 nt, Human
uggcugggugccaauggcc

SEQ ID NO: 719536 - RNA, 22 nt, Human
cacagcaaagacacucucaacu

SEQ ID NO: 719537 - RNA, 22 nt, Human
uauaagaaacaaggcaaauuuu

SEQ ID NO: 719538 - RNA, 22 nt, Human
aauuuuacuucccucaguguag

SEQ ID NO: 719539 - RNA, 22 nt, Human
gccaggugggagacagacagca

SEQ ID NO: 719540 - RNA, 22 nt, Human
gaguccagcucauugucuggga

SEQ ID NO: 719541 - RNA, 22 nt, Human
ugagauaauaaauagcuuucuu

SEQ ID NO: 719542 - RNA, 22 nt, Human
acacacaauuaguuuuaugcuu

SEQ ID NO: 719543 - RNA, 22 nt, Human
ugugccagucauccagaugugu

SEQ ID NO: 719544 - RNA, 22 nt, Human
gcagauggcagcccaggcuggg

SEQ ID NO: 719545 - RNA, 22 nt, Human
aggaggcugguucaggccauau

SEQ ID NO: 719546 - RNA, 22 nt, Human
acaguuagguccuaaaauucug

SEQ ID NO: 719547 - RNA, 22 nt, Human
gaggcuguuggcugaucugagu

SEQ ID NO: 719548 - RNA, 22 nt, Human
aguguccaacucagcuugucaa

SEQ ID NO: 719549 - RNA, 22 nt, Human
agagccuuuggagcugcuauua

SEQ ID NO: 719550 - RNA, 22 nt, Human
ugacacugcauauauugaaguu

SEQ ID NO: 719551 - RNA, 22 nt, Human
acauacacgggaaaccucuuuu

SEQ ID NO: 719552 - RNA, 22 nt, Human
cagcgaggugaaggguacaagc

SEQ ID NO: 719553 - RNA, 22 nt, Human
cuggaagagugacuuugcauuu

SEQ ID NO: 719554 - RNA, 22 nt, Human
caugcucuccauuggacacaga

SEQ ID NO: 719555 - RNA, 20 nt, Human
cgcccaggagggcccaugug

SEQ ID NO: 719556 - RNA, 22 nt, Human
uuucucuguucucuaacuguaa

SEQ ID NO: 719557 - RNA, 22 nt, Human
guaugugugcaaauguaaauau

SEQ ID NO: 719558 - RNA, 22 nt, Human
gcugaggacauacacauugugc

SEQ ID NO: 719559 - RNA, 22 nt, Human
guggaagaggcaagauagcucu

SEQ ID NO: 719560 - RNA, 17 nt, Human
cucugggcagccugggg

SEQ ID NO: 719561 - RNA, 22 nt, Human
uuggccagugaaccaggccugg

SEQ ID NO: 719562 - RNA, 23 nt, Human
cacggcagccuccgagggugcug

SEQ ID NO: 719563 - RNA, 22 nt, Human
uugaaauaucaaguuauuagug

SEQ ID NO: 719564 - RNA, 22 nt, Human
aaagcagcagaaucucucaggg

SEQ ID NO: 719565 - RNA, 21 nt, Human
ucaaagacuggggcugugugc

SEQ ID NO: 719566 - RNA, 22 nt, Human
aaaccuuucugcucucagcgua

SEQ ID NO: 719567 - RNA, 22 nt, Human
uugcagggaaacaguuuaggaa

SEQ ID NO: 719568 - RNA, 22 nt, Human
acaggagaaaucuggucaaaag

SEQ ID NO: 719569 - RNA, 22 nt, Human
aggcccuauucaauggggccca

SEQ ID NO: 719570 - RNA, 22 nt, Human
acuuggaaagaugcaacacagu

SEQ ID NO: 719571 - RNA, 22 nt, Human
auaauggcuugugguguuauuc

SEQ ID NO: 719572 - RNA, 22 nt, Human
agcccaggugacucauacaccc

SEQ ID NO: 719573 - RNA, 22 nt, Human
uuggccaauuuagaacguguug

SEQ ID NO: 719574 - RNA, 22 nt, Human
acaccaugaugagugauguagc

SEQ ID NO: 719575 - RNA, 22 nt, Human
gaacacauuucucugacuguag

SEQ ID NO: 719576 - RNA, 23 nt, Human
uggcucugagcuuccugguggcc

SEQ ID NO: 719577 - RNA, 22 nt, Human
ccagccaguccagcauuggugu

SEQ ID NO: 719578 - RNA, 21 nt, Human
uguccuuaaugcaauguccuu

SEQ ID NO: 719579 - RNA, 23 nt, Human
ugucacauuuaguuggcauuguu

SEQ ID NO: 719580 - RNA, 22 nt, Human
uauuuugacuauuaaaccaaca

SEQ ID NO: 719581 - RNA, 22 nt, Human
ccauuuaacacagaguuuucca

SEQ ID NO: 719582 - RNA, 22 nt, Human
cuuacgugauaacuucucaaaa

SEQ ID NO: 719583 - RNA, 22 nt, Human
gugaggugggcuggccagagac

SEQ ID NO: 719584 - RNA, 22 nt, Human
uucuuacagaguuuacagagcc

SEQ ID NO: 719585 - RNA, 22 nt, Human
uuuuaaagagaugcugugcaua

SEQ ID NO: 719586 - RNA, 22 nt, Human
uaaaugcuuagauucauagaaa

SEQ ID NO: 719587 - RNA, 22 nt, Human
acagcaggcacacaaggauaga

SEQ ID NO: 719588 - RNA, 22 nt, Human
gacacagaugaucaggugugga

SEQ ID NO: 719589 - RNA, 22 nt, Human
uguggaggauucugaugccagc

SEQ ID NO: 719590 - RNA, 22 nt, Human
acccacagccgcugugcguccc

SEQ ID NO: 719591 - RNA, 22 nt, Human
uggcccuuguucaaauauguca

SEQ ID NO: 719592 - RNA, 22 nt, Human
caguccagccaguagggugugg

SEQ ID NO: 719593 - RNA, 22 nt, Human
ccugaccagagugagggcuuag

SEQ ID NO: 719594 - RNA, 22 nt, Human
aggcuucagguuugcuuugcag

SEQ ID NO: 719595 - RNA, 22 nt, Human
uagaaaguacuaaauuuaacug

SEQ ID NO: 719596 - RNA, 22 nt, Human
uguggcaggcaagauguacaga

SEQ ID NO: 719597 - RNA, 22 nt, Human
ugggagaggcugccaucuugca

SEQ ID NO: 719598 - RNA, 19 nt, Human
auagcuugucagcugcucc

SEQ ID NO: 719599 - RNA, 22 nt, Human
agaaagcacgggccccaggcuc

SEQ ID NO: 719600 - RNA, 22 nt, Human
agcaucagccucuguccuggag

SEQ ID NO: 719601 - RNA, 22 nt, Human
uacagaaagaccucucgggaaa

SEQ ID NO: 719602 - RNA, 22 nt, Human
auuagaaaaucuggaggugggg

SEQ ID NO: 719603 - RNA, 22 nt, Human
aacugcaaaaaugguagucuua

SEQ ID NO: 719604 - RNA, 22 nt, Human
ucucuguauucugauauucacu

SEQ ID NO: 719605 - RNA, 22 nt, Human
caggcaagauuagagaugagca

SEQ ID NO: 719606 - RNA, 22 nt, Human
ugauuaauaucaccaccauugg

SEQ ID NO: 719607 - RNA, 22 nt, Human
cacugcuuauaaauucuaggca

SEQ ID NO: 719608 - RNA, 22 nt, Human
caugaaauauuaguaacuguuu

SEQ ID NO: 719609 - RNA, 22 nt, Human
agaucuggcccucagcuugauu

SEQ ID NO: 719610 - RNA, 22 nt, Human
ucacaccaguuuccuuucaauu

SEQ ID NO: 719611 - RNA, 22 nt, Human
gcuuccagggcucagucacugc

SEQ ID NO: 719612 - RNA, 22 nt, Human
gcagggacagggcagggccuuu

SEQ ID NO: 719613 - RNA, 17 nt, Human
agcacuugaaaauuucu

SEQ ID NO: 719614 - RNA, 22 nt, Human
ucccugugucuuccucuugccc

SEQ ID NO: 719615 - RNA, 22 nt, Human
cugcaaaagucauugugguuuu

SEQ ID NO: 719616 - RNA, 22 nt, Human
ugugaaaaaaguucuagaagga

SEQ ID NO: 719617 - RNA, 20 nt, Human
aaaaucucccagaaacuuau

SEQ ID NO: 719618 - RNA, 22 nt, Human
uucugggcuaccuucccggcag

SEQ ID NO: 719619 - RNA, 22 nt, Human
ccuggcucuucgggaguuuguu

SEQ ID NO: 719620 - RNA, 22 nt, Human
caguagccacuagacacaugua

SEQ ID NO: 719621 - RNA, 22 nt, Human
uauuucagcccuacuacuuggc

SEQ ID NO: 719622 - RNA, 22 nt, Human
ggucagagggugggcugccugu

SEQ ID NO: 719623 - RNA, 18 nt, Human
gcugcugguggagggagc

SEQ ID NO: 719624 - RNA, 22 nt, Human
uccagccaggauggcccaggga

SEQ ID NO: 719625 - RNA, 22 nt, Human
gagcucuuccccaucuuacauc

SEQ ID NO: 719626 - RNA, 22 nt, Human
uggcauguguguguaggauaca

SEQ ID NO: 719627 - RNA, 22 nt, Human
uucuaaagagaaugcguuucug

SEQ ID NO: 719628 - RNA, 22 nt, Human
agucacauaguguuuuggaauc

SEQ ID NO: 719629 - RNA, 22 nt, Human
uuaggauuugaaaaggggcaga

SEQ ID NO: 719630 - RNA, 22 nt, Human
gccaccauguagcccauuagag

SEQ ID NO: 719631 - RNA, 22 nt, Human
gaggaggcuaagugggcucugg

SEQ ID NO: 719632 - RNA, 22 nt, Human
agguucagaugacuuuuaugcu

SEQ ID NO: 719633 - RNA, 22 nt, Human
gacugaacaguaagaggcuuua

SEQ ID NO: 719634 - RNA, 22 nt, Human
uuugcagcaaggagagagcauu

SEQ ID NO: 719635 - RNA, 22 nt, Human
ugaaaucuuauacuuugguagu

SEQ ID NO: 719636 - RNA, 22 nt, Human
ucugggaauuuauuggcacuuu

SEQ ID NO: 719637 - RNA, 22 nt, Human
guggccaaacaccaguuuagga

SEQ ID NO: 719638 - RNA, 20 nt, Human
ucauuacagugcuaagaugu

SEQ ID NO: 719639 - RNA, 22 nt, Human
uugguacauguuaaggaagagu

SEQ ID NO: 719640 - RNA, 22 nt, Human
ucuucauuuuacaggcagaccu

SEQ ID NO: 719641 - RNA, 22 nt, Human
gcagcugcuggagggaggcagg

SEQ ID NO: 719642 - RNA, 22 nt, Human
aaacucaugccauuaauccuuu

SEQ ID NO: 719643 - RNA, 22 nt, Human
cagugccugggacccggcugug

SEQ ID NO: 719644 - RNA, 22 nt, Human
aggagcugauagucuauggaga

SEQ ID NO: 719645 - RNA, 22 nt, Human
guccuuggagguguggaaucug

SEQ ID NO: 719646 - RNA, 22 nt, Human
ugcugugcaaaggugaugugag

SEQ ID NO: 719647 - RNA, 20 nt, Human
cugcacugaacaugucugag

SEQ ID NO: 719648 - RNA, 22 nt, Human
ugagggguaaguaaaggaauug

SEQ ID NO: 719649 - RNA, 22 nt, Human
gaggucaaggucaagagacaga

SEQ ID NO: 719650 - RNA, 22 nt, Human
gcuuucugccugggcuccauuu

SEQ ID NO: 719651 - RNA, 22 nt, Human
ucccaggcuaggccucugcguu

SEQ ID NO: 719652 - RNA, 22 nt, Human
cuagagaacaacauucauaugg

SEQ ID NO: 719653 - RNA, 22 nt, Human
uggcaguggcacugcccccaua

SEQ ID NO: 719654 - RNA, 22 nt, Human
agucugggaggcuuauaaacag

SEQ ID NO: 719655 - RNA, 22 nt, Human
aaguuuagauauagguauucug

SEQ ID NO: 719656 - RNA, 22 nt, Human
gccugaggaaugcuccugacuu

SEQ ID NO: 719657 - RNA, 23 nt, Human
ugcaaauaacaaggaguuuaagg

SEQ ID NO: 719658 - RNA, 22 nt, Human
ucacaucugaaaaaauauugag

SEQ ID NO: 719659 - RNA, 22 nt, Human
uuguugaauggauaaauaaauu

SEQ ID NO: 719660 - RNA, 22 nt, Human
ucuggcagugagcaacuugaca

SEQ ID NO: 719661 - RNA, 22 nt, Human
ucacgagaggcacagaauagag

SEQ ID NO: 719662 - RNA, 22 nt, Human
acagugcaaacccucgggaaag

SEQ ID NO: 719663 - RNA, 22 nt, Human
agcagcagggucauugcucuuu

SEQ ID NO: 719664 - RNA, 23 nt, Human
ccagcuccgugagccucgggcuc

SEQ ID NO: 719665 - RNA, 22 nt, Human
uggaaacacucaagcuuauauu

SEQ ID NO: 719666 - RNA, 22 nt, Human
ugagcacuuuaaaauauuccca

SEQ ID NO: 719667 - RNA, 22 nt, Human
cuucaaauucgaggaguagaug

SEQ ID NO: 719668 - RNA, 22 nt, Human
augcugaggacaaagagaucaa

SEQ ID NO: 719669 - RNA, 22 nt, Human
cagggagaggccucuguugccc

SEQ ID NO: 719670 - RNA, 22 nt, Human
cugggccucucagcucccgcgg

SEQ ID NO: 719671 - RNA, 22 nt, Human
gcucagugaaacaucaaauagu

SEQ ID NO: 719672 - RNA, 22 nt, Human
aaggcccuggaugguuuugaga

SEQ ID NO: 719673 - RNA, 22 nt, Human
aguagaaauguaagaaggauua

SEQ ID NO: 719674 - RNA, 22 nt, Human
ugauggaaauauguaaucuggu

SEQ ID NO: 719675 - RNA, 22 nt, Human
ucagaggaaagggaacauaguc

SEQ ID NO: 719676 - RNA, 22 nt, Human
ugcauuaaaaccaucgaccauc

SEQ ID NO: 719677 - RNA, 22 nt, Human
uagaagaaagugaagcugggga

SEQ ID NO: 719678 - RNA, 22 nt, Human
guggcaggagugggccuugaag

SEQ ID NO: 719679 - RNA, 22 nt, Human
gugcuuccucagagguucccau

SEQ ID NO: 719680 - RNA, 22 nt, Human
uuccugagaacauggcagcuua

SEQ ID NO: 719681 - RNA, 22 nt, Human
uuucuagaucaaacuuuuauau

SEQ ID NO: 719682 - RNA, 21 nt, Human
auuuagaaggaaauuuugcaa

SEQ ID NO: 719683 - RNA, 22 nt, Human
cccuggcauaaaacuucuccag

SEQ ID NO: 719684 - RNA, 22 nt, Human
gccccuguuguggcuuugucua

SEQ ID NO: 719685 - RNA, 22 nt, Human
agcagguuuaaacucuaaugca

SEQ ID NO: 719686 - RNA, 22 nt, Human
uggaacaaucccgguuuagcuc

SEQ ID NO: 719687 - RNA, 22 nt, Human
gugaacaggagaaagugaugga

SEQ ID NO: 719688 - RNA, 22 nt, Human
ggagggguggucgcgaagagca

SEQ ID NO: 719689 - RNA, 22 nt, Human
ucagaucaggaugcagcaacau

SEQ ID NO: 719690 - RNA, 22 nt, Human
uagugauuaaaggcagaauguu

SEQ ID NO: 719691 - RNA, 22 nt, Human
gaaugcagugacggaggcuuac

SEQ ID NO: 719692 - RNA, 22 nt, Human
gcagugugucuggaguacaugg

SEQ ID NO: 719693 - RNA, 22 nt, Human
ugggagcugggguuggacgucu

SEQ ID NO: 719694 - RNA, 22 nt, Human
agcacagaugugaguggaggcu

SEQ ID NO: 719695 - RNA, 20 nt, Human
uaggacaggcagccgagggg

SEQ ID NO: 719696 - RNA, 22 nt, Human
uggcaguguauagguggcuccu

SEQ ID NO: 719697 - RNA, 22 nt, Human
ucccugucuaauaugccaugaa

SEQ ID NO: 719698 - RNA, 22 nt, Human
gcccaggaaguugaggcugccg

SEQ ID NO: 719699 - RNA, 22 nt, Human
guacauauuaaaggucuauaaa

SEQ ID NO: 719700 - RNA, 23 nt, Human
gcccugacugcggccucccacuc

SEQ ID NO: 719701 - RNA, 22 nt, Human
gacaugaaccuaccauaaugau

SEQ ID NO: 719702 - RNA, 22 nt, Human
gcugccugucugcugacccagg

SEQ ID NO: 719703 - RNA, 23 nt, Human
ucauuucacagugagcuuccuag

SEQ ID NO: 719704 - RNA, 22 nt, Human
guuuucugccugaaggugacca

SEQ ID NO: 719705 - RNA, 22 nt, Human
uuaauccaauaacaagguucaa

SEQ ID NO: 719706 - RNA, 22 nt, Human
caaugcuaggcagauccugcgu

SEQ ID NO: 719707 - RNA, 22 nt, Human
aggcugaggggcgagggacccu

SEQ ID NO: 719708 - RNA, 21 nt, Human
cuguccuggucuagaggcaca

SEQ ID NO: 719709 - RNA, 22 nt, Human
aaauacuguagauaauagaguu

SEQ ID NO: 719710 - RNA, 23 nt, Human
acucagugaagcaaacagauagu

SEQ ID NO: 719711 - RNA, 17 nt, Human
gcugccugcaacugacu

SEQ ID NO: 719712 - RNA, 22 nt, Human
cucacagcauggaauuuucugg

SEQ ID NO: 719713 - RNA, 21 nt, Human
aguucauacugaguaacaaaa

SEQ ID NO: 719714 - RNA, 22 nt, Human
uuucuauaacuggacuggauug

SEQ ID NO: 719715 - RNA, 22 nt, Human
ugccugggcucaccgccucuuu

SEQ ID NO: 719716 - RNA, 22 nt, Human
aagauacagugaaagggcauug

SEQ ID NO: 719717 - RNA, 22 nt, Human
cagugguggaaugaggaauugu

SEQ ID NO: 719718 - RNA, 22 nt, Human
ugcuucuguuacauaccagaac

SEQ ID NO: 719719 - RNA, 22 nt, Human
aaggcugugguucuauacagaa

SEQ ID NO: 719720 - RNA, 22 nt, Human
uuggaaauacagcaguuacuuu

SEQ ID NO: 719721 - RNA, 22 nt, Human
uggccucugggaaagcagauuc

SEQ ID NO: 719722 - RNA, 20 nt, Human
ugcaggugggcccuucuggg

SEQ ID NO: 719723 - RNA, 17 nt, Human
agguggcugcugcgccu

SEQ ID NO: 719724 - RNA, 22 nt, Human
gucuggaagugucuuguuaagu

SEQ ID NO: 719725 - RNA, 22 nt, Human
uggcuuuauccaucaucgccaa

SEQ ID NO: 719726 - RNA, 22 nt, Human
caugucaauaaauauaacugca

SEQ ID NO: 719727 - RNA, 22 nt, Human
gccuggagaggaagccggugga

SEQ ID NO: 719728 - RNA, 22 nt, Human
gagcuuggcagugucacuaggg

SEQ ID NO: 719729 - RNA, 22 nt, Human
uugaauaaaugagcagugaauu

SEQ ID NO: 719730 - RNA, 22 nt, Human
ugauauggcuaaagaaaguuuc

SEQ ID NO: 719731 - RNA, 22 nt, Human
agcaggcagcugggggaguuga

SEQ ID NO: 719732 - RNA, 19 nt, Human
ggcggguggacuggagccc

SEQ ID NO: 719733 - RNA, 22 nt, Human
ugggaccugcuccuggaaugag

SEQ ID NO: 719734 - RNA, 22 nt, Human
ggcaggcuugauauggggggac

SEQ ID NO: 719735 - RNA, 22 nt, Human
uugcuuccuuuacagaugggca

SEQ ID NO: 719736 - RNA, 22 nt, Human
agauccguggauuauaauuuag

SEQ ID NO: 719737 - RNA, 22 nt, Human
ugucagcacaucuguaaucaca

SEQ ID NO: 719738 - RNA, 22 nt, Human
ccuggagguggagguugcagug

SEQ ID NO: 719739 - RNA, 22 nt, Human
ccuuggcuaggcagcggcuguc

SEQ ID NO: 719740 - RNA, 22 nt, Human
ccugggucuauagacuucaaga

SEQ ID NO: 719741 - RNA, 22 nt, Human
gugcaaaaguaauugcaguacu

SEQ ID NO: 719742 - RNA, 22 nt, Human
ucuaaacacgucucuuugaaua

SEQ ID NO: 719743 - RNA, 23 nt, Human
ugggccuggaaagccuuagagag

SEQ ID NO: 719744 - RNA, 22 nt, Human
aagugaguggccuggagaggug

SEQ ID NO: 719745 - RNA, 22 nt, Human
aaggacugacaaaugucuuccu

SEQ ID NO: 719746 - RNA, 22 nt, Human
agcugcccagguucauugggcc

SEQ ID NO: 719747 - RNA, 22 nt, Human
gaguauauaauuaauuggucug

SEQ ID NO: 719748 - RNA, 22 nt, Human
uuuugcuuuuguaacacagugu

SEQ ID NO: 719749 - RNA, 22 nt, Human
aggcuguggcauuaaacguuug

SEQ ID NO: 719750 - RNA, 17 nt, Human
gaggagcuccaguaggu

SEQ ID NO: 719751 - RNA, 22 nt, Human
cuuggcugucauaagguccugg

SEQ ID NO: 719752 - RNA, 22 nt, Human
aauacuugucagaugaauaaga

SEQ ID NO: 719753 - RNA, 22 nt, Human
gcaacacagaucuucuuuguug

SEQ ID NO: 719754 - RNA, 22 nt, Human
auauucaucguguagaaauacu

SEQ ID NO: 719755 - RNA, 22 nt, Human
uguugugacccagaccaagaag

SEQ ID NO: 719756 - RNA, 22 nt, Human
gcaugcaugauguuggcagugg

SEQ ID NO: 719757 - RNA, 22 nt, Human
cugggcaaauugugccagcuau

SEQ ID NO: 719758 - RNA, 22 nt, Human
caggagugaguuggggucuaca

SEQ ID NO: 719759 - RNA, 22 nt, Human
uggguccuucaaagcugggucu

SEQ ID NO: 719760 - RNA, 22 nt, Human
acugagggguuggagagugagg

SEQ ID NO: 719761 - RNA, 22 nt, Human
gcucugagcacugugcggcugg

SEQ ID NO: 719762 - RNA, 22 nt, Human
agcccugcacaguucgggagga

SEQ ID NO: 719763 - RNA, 22 nt, Human
ggaugagguagaugaacaaggg

SEQ ID NO: 719764 - RNA, 22 nt, Human
uagagagcuguuugaaagcagg

SEQ ID NO: 719765 - RNA, 22 nt, Human
ggcuccuguccccucagcugcu

SEQ ID NO: 719766 - RNA, 17 nt, Human
uguuccauuugaccacc

SEQ ID NO: 719767 - RNA, 22 nt, Human
ucuuccaguguagacaucugcc

SEQ ID NO: 719768 - RNA, 22 nt, Human
gaggcuccauggaggaguaugg

SEQ ID NO: 719769 - RNA, 22 nt, Human
aagugccugaccuagccuggag

SEQ ID NO: 719770 - RNA, 22 nt, Human
uauuguccaauaggauguuccu

SEQ ID NO: 719771 - RNA, 21 nt, Human
aaggucuguaaagugacagga

SEQ ID NO: 719772 - RNA, 16 nt, Human
aaggagggaagagaau

SEQ ID NO: 719773 - RNA, 22 nt, Human
cagcccacgucagggccacuca

SEQ ID NO: 719774 - RNA, 22 nt, Human
uucccucugcgcauugaauuuc

SEQ ID NO: 719775 - RNA, 22 nt, Human
uugcugggucagaagccaggag

SEQ ID NO: 719776 - RNA, 22 nt, Human
aacaauuacuaccaaggccugu

SEQ ID NO: 719777 - RNA, 22 nt, Human
uaagugaaauaagucagauaca

SEQ ID NO: 719778 - RNA, 22 nt, Human
auccgcuuaucucagcuggcag

SEQ ID NO: 719779 - RNA, 22 nt, Human
accuggaggcagagguugcagu

SEQ ID NO: 719780 - RNA, 22 nt, Human
ucccuggggcaguggcucggag

SEQ ID NO: 719781 - RNA, 22 nt, Human
ucucagcuugaguggaugagcu

SEQ ID NO: 719782 - RNA, 22 nt, Human
ugagaaagccuuuagucccagg

SEQ ID NO: 719783 - RNA, 22 nt, Human
gcuucuaauuuuuuacagaaua

SEQ ID NO: 719784 - RNA, 22 nt, Human
uaauuguaaaguaguaguacag

SEQ ID NO: 719785 - RNA, 22 nt, Human
gagguauuuuugcaugccugau

SEQ ID NO: 719786 - RNA, 22 nt, Human
uuuagugugacaguccccagua

SEQ ID NO: 719787 - RNA, 18 nt, Human
ugucauugccagggaagc

SEQ ID NO: 719788 - RNA, 22 nt, Human
uaaggagagaauuuagagguuu

SEQ ID NO: 719789 - RNA, 22 nt, Human
uauauuaaagugcuuugcagug

SEQ ID NO: 719790 - RNA, 22 nt, Human
uauuuaauuugcucauugugau

SEQ ID NO: 719791 - RNA, 22 nt, Human
aagcaucucaccugcccccacg

SEQ ID NO: 719792 - RNA, 22 nt, Human
cuuacauuaaguaagagauuga

SEQ ID NO: 719793 - RNA, 22 nt, Human
acuccagggcugaacgaggccc

SEQ ID NO: 719794 - RNA, 22 nt, Human
aggcugaguuucucauucucgc

SEQ ID NO: 719795 - RNA, 22 nt, Human
gaaaaggccacuccuaggagcu

SEQ ID NO: 719796 - RNA, 22 nt, Human
aagaggcgccggguacguggcg

SEQ ID NO: 719797 - RNA, 22 nt, Human
ugaggccucauuuagggagagg

SEQ ID NO: 719798 - RNA, 22 nt, Human
accacaucgggcggacacuggg

SEQ ID NO: 719799 - RNA, 22 nt, Human
gaucgauucagugugccuaccc

SEQ ID NO: 719800 - RNA, 22 nt, Human
uuaucuuagaggugauuguauu

SEQ ID NO: 719801 - RNA, 22 nt, Human
acacauauauacauauuugugc

SEQ ID NO: 719802 - RNA, 22 nt, Human
ucaggaguccugccugcagccu

SEQ ID NO: 719803 - RNA, 22 nt, Human
cugcugugccucuuuucacgug

SEQ ID NO: 719804 - RNA, 22 nt, Human
cagcaucucccaggcauuugcc

SEQ ID NO: 719805 - RNA, 21 nt, Human
gacacaaaggguaguaauggu

SEQ ID NO: 719806 - RNA, 22 nt, Human
gcagggcagccacaggcccccu

SEQ ID NO: 719807 - RNA, 22 nt, Human
ggcagcaugugugguccgcugg

SEQ ID NO: 719808 - RNA, 22 nt, Human
uggcauccuuuaucugcaggcu

SEQ ID NO: 719809 - RNA, 22 nt, Human
gccuggaaugcaaugugacgaa

SEQ ID NO: 719810 - RNA, 22 nt, Human
gcugggccccaucccucgagca

SEQ ID NO: 719811 - RNA, 22 nt, Human
aagcugccuugcugaggagaaa

SEQ ID NO: 719812 - RNA, 22 nt, Human
acauucaagaugcauucacuua

SEQ ID NO: 719813 - RNA, 22 nt, Human
ggccaggcuggucucagacuuc

SEQ ID NO: 719814 - RNA, 22 nt, Human
uuuaccacagaaaaaaguaacu

SEQ ID NO: 719815 - RNA, 22 nt, Human
cugaggccagcugcagagcucu

SEQ ID NO: 719816 - RNA, 22 nt, Human
agucacauagcucugguuucuu

SEQ ID NO: 719817 - RNA, 22 nt, Human
gcugggaugcgucuucccaggc

SEQ ID NO: 719818 - RNA, 21 nt, Human
acuaugucauuuaagucacug

SEQ ID NO: 719819 - RNA, 22 nt, Human
caaaugcaggucagcagguguc

SEQ ID NO: 719820 - RNA, 22 nt, Human
uuuuuuaguuaggucagaaugu

SEQ ID NO: 719821 - RNA, 22 nt, Human
uaacaauaguguuugcuaguca

SEQ ID NO: 719822 - RNA, 22 nt, Human
agcuuagaauguguuaggaaag

SEQ ID NO: 719823 - RNA, 22 nt, Human
cugaggcuaaccucgagagaca

SEQ ID NO: 719824 - RNA, 17 nt, Human
cccucuggggagggagg

SEQ ID NO: 719825 - RNA, 22 nt, Human
uuaaagcugcugaauccuauuu

SEQ ID NO: 719826 - RNA, 22 nt, Human
uucagagagaccaaguggcgug

SEQ ID NO: 719827 - RNA, 22 nt, Human
uggcuucuuucuuuccaugugu

SEQ ID NO: 719828 - RNA, 22 nt, Human
uaccuggauccugguagacauc

SEQ ID NO: 719829 - RNA, 22 nt, Human
ucaaaugcuguauuguaguaau

SEQ ID NO: 719830 - RNA, 22 nt, Human
uacuuuucaagcagcugguuau

SEQ ID NO: 719831 - RNA, 19 nt, Human
gugagcuucuuguaagagg

SEQ ID NO: 719832 - RNA, 22 nt, Human
gaauuuuagaauaugugggcuu

SEQ ID NO: 719833 - RNA, 22 nt, Human
aaccaggaauugcagggcugca

SEQ ID NO: 719834 - RNA, 22 nt, Human
aagaagcuguagggauuaacuc

SEQ ID NO: 719835 - RNA, 22 nt, Human
gccuguggccgacugagagccu

SEQ ID NO: 719836 - RNA, 22 nt, Human
aaugucuaugauccuuuaaguu

SEQ ID NO: 719837 - RNA, 22 nt, Human
caggugggagcgaggagcuacu

SEQ ID NO: 719838 - RNA, 22 nt, Human
cugugcuuagccaucacauuca

SEQ ID NO: 719839 - RNA, 23 nt, Human
ugggaguguugggaucucugcuc

SEQ ID NO: 719840 - RNA, 22 nt, Human
aaugcaaagcucuuuaauccuu

SEQ ID NO: 719841 - RNA, 22 nt, Human
ucucuuaacugguucagcaauu

SEQ ID NO: 719842 - RNA, 22 nt, Human
cagcaagggauaaacaaggacg

SEQ ID NO: 719843 - RNA, 22 nt, Human
gagccaggggucagcuccgagg

SEQ ID NO: 719844 - RNA, 22 nt, Human
ugaaaaaccucaguccgcuuua

SEQ ID NO: 719845 - RNA, 22 nt, Human
ugaguccaccuuaguauauggg

SEQ ID NO: 719846 - RNA, 22 nt, Human
aaaguucacugaccagcacugg

SEQ ID NO: 719847 - RNA, 22 nt, Human
ucagcccagggacagaggcccc

SEQ ID NO: 719848 - RNA, 22 nt, Human
uagggagaugcaagggacggag

SEQ ID NO: 719849 - RNA, 22 nt, Human
gugggcagaacauuuguaggcu

SEQ ID NO: 719850 - RNA, 22 nt, Human
gcugagguggcugccuuaguaa

SEQ ID NO: 719851 - RNA, 22 nt, Human
uuauauguuucuguuuggaggc

SEQ ID NO: 719852 - RNA, 22 nt, Human
cuauuaggcuuccauuucaugc

SEQ ID NO: 719853 - RNA, 22 nt, Human
cucugaaagacaagcucucauu

SEQ ID NO: 719854 - RNA, 21 nt, Human
agacagaacaacugcucucca

SEQ ID NO: 719855 - RNA, 22 nt, Human
uuagaacaaagccaccagguga

SEQ ID NO: 719856 - RNA, 22 nt, Human
uacauauuugucuuuguacugu

SEQ ID NO: 719857 - RNA, 22 nt, Human
gggccacauugaagggugggua

SEQ ID NO: 719858 - RNA, 22 nt, Human
caguuuuagggcaaugugaaga

SEQ ID NO: 719859 - RNA, 22 nt, Human
ucagggcuccggaaguggccuc

SEQ ID NO: 719860 - RNA, 22 nt, Human
ucuggggugugaccugagcaug

SEQ ID NO: 719861 - RNA, 22 nt, Human
ggacagagggcaggagcccaga

SEQ ID NO: 719862 - RNA, 22 nt, Human
ugagaaaagguugagaugauaa

SEQ ID NO: 719863 - RNA, 22 nt, Human
ugagacaggagaggccccuccu

SEQ ID NO: 719864 - RNA, 22 nt, Human
auucaguuuuuauuggaccagc

SEQ ID NO: 719865 - RNA, 22 nt, Human
caauugaacagaugaguuaaau

SEQ ID NO: 719866 - RNA, 22 nt, Human
ucagaggagaaguugggaaaau

SEQ ID NO: 719867 - RNA, 22 nt, Human
gcuggccugagggccgaggcuc

SEQ ID NO: 719868 - RNA, 22 nt, Human
uguuucauguggacauaguugu

SEQ ID NO: 719869 - RNA, 18 nt, Human
cgauguguaugugauuug

SEQ ID NO: 719870 - RNA, 22 nt, Human
ugggccugggagggcagacgcu

SEQ ID NO: 719871 - RNA, 18 nt, Human
aagcaggguccauugugc

SEQ ID NO: 719872 - RNA, 22 nt, Human
auuuauuggaugcuuacuuggg

SEQ ID NO: 719873 - RNA, 22 nt, Human
uguuuaagauccgucagucacu

SEQ ID NO: 719874 - RNA, 22 nt, Human
auucaguugucuacuacugccu

SEQ ID NO: 719875 - RNA, 22 nt, Human
ccauccuggccuugcuguccac

SEQ ID NO: 719876 - RNA, 22 nt, Human
agcucaggucauuccagggaug

SEQ ID NO: 719877 - RNA, 22 nt, Human
gcaggagugacauggaugugga

SEQ ID NO: 719878 - RNA, 22 nt, Human
acaugcuagguacagaucuaaa

SEQ ID NO: 719879 - RNA, 22 nt, Human
ugucuuuggggcuguaccuguu

SEQ ID NO: 719880 - RNA, 22 nt, Human
uaacauuccauggaucugcaga

SEQ ID NO: 719881 - RNA, 22 nt, Human
ggagagauaggaguccuggacu

SEQ ID NO: 719882 - RNA, 21 nt, Human
uucugcugugccaugccucug

SEQ ID NO: 719883 - RNA, 22 nt, Human
ugcaaggauauuuagucuagug

SEQ ID NO: 719884 - RNA, 22 nt, Human
aacuucauuuauaaugucauua

SEQ ID NO: 719885 - RNA, 22 nt, Human
ugaaagcauaugcuaaagacca

SEQ ID NO: 719886 - RNA, 22 nt, Human
cugugccuuggcgcugugccac

SEQ ID NO: 719887 - RNA, 22 nt, Human
ugggcagaggacagggaagauc

SEQ ID NO: 719888 - RNA, 22 nt, Human
agagucagucacuggcacuuug

SEQ ID NO: 719889 - RNA, 23 nt, Human
ucucugaguuguacuuucccuug

SEQ ID NO: 719890 - RNA, 22 nt, Human
ugaggauggggagauggugucu

SEQ ID NO: 719891 - RNA, 22 nt, Human
ugguccuggggaucugcaguga

SEQ ID NO: 719892 - RNA, 22 nt, Human
ccagccuucaccugcucugguc

SEQ ID NO: 719893 - RNA, 22 nt, Human
aaugaucaccugguaaagagag

SEQ ID NO: 719894 - RNA, 22 nt, Human
cugggccagauccagccucaca

SEQ ID NO: 719895 - RNA, 22 nt, Human
ugcaggaacagaacucacuccc

SEQ ID NO: 719896 - RNA, 22 nt, Human
caucaaaguugauauccaauua

SEQ ID NO: 719897 - RNA, 18 nt, Human
agagaugguguagaguuu

SEQ ID NO: 719898 - RNA, 22 nt, Human
ugugcugcucucagugacagcc

SEQ ID NO: 719899 - RNA, 22 nt, Human
gcaguccugggauucuguccuu

SEQ ID NO: 719900 - RNA, 22 nt, Human
aggucauuaaaguuaaaugagg

SEQ ID NO: 719901 - RNA, 22 nt, Human
acguuauaucugaaaaaaguga

SEQ ID NO: 719902 - RNA, 22 nt, Human
acugggaagucagagagaggcu

SEQ ID NO: 719903 - RNA, 22 nt, Human
agcauggggcuccgcaaugaac

SEQ ID NO: 719904 - RNA, 22 nt, Human
aggccagagaggggaccagccu

SEQ ID NO: 719905 - RNA, 22 nt, Human
aucuguuaacaaagaagacagc

SEQ ID NO: 719906 - RNA, 22 nt, Human
aaaugcauaucaaagacuugaa

SEQ ID NO: 719907 - RNA, 22 nt, Human
uauggcuuccaggcuggccagg

SEQ ID NO: 719908 - RNA, 22 nt, Human
uuucucugccaguuauuuuccu

SEQ ID NO: 719909 - RNA, 17 nt, Human
uucugcuguuuccccuu

SEQ ID NO: 719910 - RNA, 22 nt, Human
uuacauacaaaggcuggguuau

SEQ ID NO: 719911 - RNA, 22 nt, Human
cuggagccacugggucuuguau

SEQ ID NO: 719912 - RNA, 21 nt, Human
ugccagcauuaaacagucauu

SEQ ID NO: 719913 - RNA, 22 nt, Human
aacacuuuuuccuccugucugg

SEQ ID NO: 719914 - RNA, 23 nt, Human
uggccaggcauaaaggugggugg

SEQ ID NO: 719915 - RNA, 22 nt, Human
aagaguuaagcaacagauacca

SEQ ID NO: 719916 - RNA, 21 nt, Human
agacccugcauauguucagua

SEQ ID NO: 719917 - RNA, 20 nt, Human
ugcugagguugacaugccca

SEQ ID NO: 719918 - RNA, 22 nt, Human
gaucccugcccucagccuggac

SEQ ID NO: 719919 - RNA, 22 nt, Human
acugcuucuccaaugaauuaga

SEQ ID NO: 719920 - RNA, 22 nt, Human
gggcaagcucuucagaagcucu

SEQ ID NO: 719921 - RNA, 22 nt, Human
uccagaaaugcaagccaggugu

SEQ ID NO: 719922 - RNA, 22 nt, Human
gggcugacaaucucuuuacuua

SEQ ID NO: 719923 - RNA, 22 nt, Human
aucauuuacaaacucagcauug

SEQ ID NO: 719924 - RNA, 17 nt, Human
acauacacuggugaaca

SEQ ID NO: 719925 - RNA, 22 nt, Human
ccagugccugugggcauggugc

SEQ ID NO: 719926 - RNA, 22 nt, Human
cugccuggaugaauggcgccuu

SEQ ID NO: 719927 - RNA, 22 nt, Human
caaggccuaaucauacugcuaa

SEQ ID NO: 719928 - RNA, 22 nt, Human
acacagggcggaaagcaugaga

SEQ ID NO: 719929 - RNA, 22 nt, Human
uaacuucuuugguuuaaagaga

SEQ ID NO: 719930 - RNA, 22 nt, Human
uuaauuaaauucaugagcauug

SEQ ID NO: 719931 - RNA, 22 nt, Human
aauggcuuuaaguagucucaca

SEQ ID NO: 719932 - RNA, 22 nt, Human
gcuccaggaggaugaccuuccu

SEQ ID NO: 719933 - RNA, 22 nt, Human
gcacagccggaccgaggaaaag

SEQ ID NO: 719934 - RNA, 22 nt, Human
ucuuugaacuuggcugaucucu

SEQ ID NO: 719935 - RNA, 22 nt, Human
cauguuauuuauccauuaaaca

SEQ ID NO: 719936 - RNA, 22 nt, Human
uggguagacauuccugaaacuc

SEQ ID NO: 719937 - RNA, 22 nt, Human
caucauuuguuugcaugcagga

SEQ ID NO: 719938 - RNA, 22 nt, Human
uaacaguacauccuuuucucuu

SEQ ID NO: 719939 - RNA, 22 nt, Human
ccagggggcuuggugaggccau

SEQ ID NO: 719940 - RNA, 22 nt, Human
ccaggaagcugugagauuccaa

SEQ ID NO: 719941 - RNA, 22 nt, Human
aaaggucaagcuggacucaggu

SEQ ID NO: 719942 - RNA, 22 nt, Human
auuuugaaauacuugaaggaaa

SEQ ID NO: 719943 - RNA, 22 nt, Human
ucuccaggagaaauaugaagga

SEQ ID NO: 719944 - RNA, 22 nt, Human
ugucagaacucuauugaugucc

SEQ ID NO: 719945 - RNA, 22 nt, Human
uggcuggaggaaggaacugagg

SEQ ID NO: 719946 - RNA, 22 nt, Human
uguuuacucacuguauccacaa

SEQ ID NO: 719947 - RNA, 22 nt, Human
aguugcucuaggugaggucuuu

SEQ ID NO: 719948 - RNA, 22 nt, Human
ggucaggggcugcucuacagag

SEQ ID NO: 719949 - RNA, 22 nt, Human
gugacagauuugcugcgcaugg

SEQ ID NO: 719950 - RNA, 22 nt, Human
guguguggcauguccuauuuug

SEQ ID NO: 719951 - RNA, 20 nt, Human
auacacauucauagaaaaau

SEQ ID NO: 719952 - RNA, 22 nt, Human
uggugcugauaauggcaggauu

SEQ ID NO: 719953 - RNA, 22 nt, Human
aagccacugagauuucacugca

SEQ ID NO: 719954 - RNA, 22 nt, Human
cuaauacacccuauugcuuguu

SEQ ID NO: 719955 - RNA, 22 nt, Human
agugcucugucauuggugggau

SEQ ID NO: 719956 - RNA, 22 nt, Human
gccugcuguugagggaagagcu

SEQ ID NO: 719957 - RNA, 22 nt, Human
uuauuuugguaaauguuugccu

SEQ ID NO: 719958 - RNA, 22 nt, Human
cuccagcugcuggucugagacu

SEQ ID NO: 719959 - RNA, 22 nt, Human
augcacacguacccuacaaggc

SEQ ID NO: 719960 - RNA, 22 nt, Human
aaguucaaggugauaguggcag

SEQ ID NO: 719961 - RNA, 22 nt, Human
uaaugcuuccuauauagcacuc

SEQ ID NO: 719962 - RNA, 22 nt, Human
cugaggccuggccccaccacag

SEQ ID NO: 719963 - RNA, 22 nt, Human
cuggggacucauucagagcaua

SEQ ID NO: 719964 - RNA, 22 nt, Human
gugcagcaaacuagugcgaggg

SEQ ID NO: 719965 - RNA, 22 nt, Human
gagagaaagccccugcaucccu

SEQ ID NO: 719966 - RNA, 22 nt, Human
aauguguauaagggagagcuaa

SEQ ID NO: 719967 - RNA, 17 nt, Human
gcagugaaaagagauca

SEQ ID NO: 719968 - RNA, 22 nt, Human
gaugauggguugaugugaaggg

SEQ ID NO: 719969 - RNA, 22 nt, Human
ugccugaacaugaauaguuuau

SEQ ID NO: 719970 - RNA, 22 nt, Human
auuauauugaguauaaccagag

SEQ ID NO: 719971 - RNA, 22 nt, Human
uugcauuugacaaauuauuuaa

SEQ ID NO: 719972 - RNA, 22 nt, Human
ccggcgucucuuccacuuccua

SEQ ID NO: 719973 - RNA, 22 nt, Human
acagguagucugaacacugggu

SEQ ID NO: 719974 - RNA, 20 nt, Human
gauacacagcacagagggcc

SEQ ID NO: 719975 - RNA, 22 nt, Human
gaggaacagcagccacaugucc

SEQ ID NO: 719976 - RNA, 22 nt, Human
cagcuuccacagacuuggcucg

SEQ ID NO: 719977 - RNA, 22 nt, Human
uagcuuuaagacauggugaaug

SEQ ID NO: 719978 - RNA, 22 nt, Human
cuguguagagcggcugcgagcg

SEQ ID NO: 719979 - RNA, 22 nt, Human
aaacagugacugguacauaaua

SEQ ID NO: 719980 - RNA, 22 nt, Human
cccaggcugggaacgauucuag

SEQ ID NO: 719981 - RNA, 19 nt, Human
aguggcagaucuggaagua

SEQ ID NO: 719982 - RNA, 22 nt, Human
caggaaaaaugccaggagucag

SEQ ID NO: 719983 - RNA, 22 nt, Human
uauuuuguaauuggucauagcu

SEQ ID NO: 719984 - RNA, 22 nt, Human
uuaaagcacuaaaugaugaggg

SEQ ID NO: 719985 - RNA, 22 nt, Human
uuuuucauugcagccucucucc

SEQ ID NO: 719986 - RNA, 22 nt, Human
acaguacauagaucucuacccu

SEQ ID NO: 719987 - RNA, 23 nt, Human
caacuuuuggcuacaugcuuagc

SEQ ID NO: 719988 - RNA, 23 nt, Human
uuauaaauauuuucagguguguu

SEQ ID NO: 719989 - RNA, 22 nt, Human
agcugggcagacugcagugguu

SEQ ID NO: 719990 - RNA, 22 nt, Human
gccucccugagucacccaagca

SEQ ID NO: 719991 - RNA, 22 nt, Human
ggcagugagucccggagaggcc

SEQ ID NO: 719992 - RNA, 22 nt, Human
gcaugcaauuaugguauuagau

SEQ ID NO: 719993 - RNA, 22 nt, Human
ugagaggccccagcucuuggcc

SEQ ID NO: 719994 - RNA, 22 nt, Human
cgaggaggaaacgcggagaacu

SEQ ID NO: 719995 - RNA, 21 nt, Human
ugucacagauucucagcuugc

SEQ ID NO: 719996 - RNA, 22 nt, Human
aaaucaugguggaagaaacaga

SEQ ID NO: 719997 - RNA, 22 nt, Human
uguagaaagcucuucugaaauc

SEQ ID NO: 719998 - RNA, 22 nt, Human
cuuaguuuuugcccuggaguuu

SEQ ID NO: 719999 - RNA, 19 nt, Human
ggacuguugccaggccucu

SEQ ID NO: 720000 - RNA, 22 nt, Human
acuuguuugccuaaaauuuuga

SEQ ID NO: 720001 - RNA, 22 nt, Human
aaagugcugggauuaccggcau

SEQ ID NO: 720002 - RNA, 22 nt, Human
ggugaaauuccuuguggaaagu

SEQ ID NO: 720003 - RNA, 22 nt, Human
uaaaggcagccacugagcucaa

SEQ ID NO: 720004 - RNA, 22 nt, Human
uuggcucagcaucuuggugcca

SEQ ID NO: 720005 - RNA, 22 nt, Human
cucugacagccuucauuaugca

SEQ ID NO: 720006 - RNA, 22 nt, Human
cuggcucugacuccgcauauuu

SEQ ID NO: 720007 - RNA, 21 nt, Human
cagcuucuucugugaccuggu

SEQ ID NO: 720008 - RNA, 22 nt, Human
auggccaggcaccucuggcuga

SEQ ID NO: 720009 - RNA, 19 nt, Human
agagccagacagcauagga

SEQ ID NO: 720010 - RNA, 22 nt, Human
auggcuggugauacuggaguga

SEQ ID NO: 720011 - RNA, 22 nt, Human
uccuggagcuucaguuuccuuu

SEQ ID NO: 720012 - RNA, 22 nt, Human
ccugugaggucaucugugguaa

SEQ ID NO: 720013 - RNA, 22 nt, Human
aagcaagacagaaguuacugcc

SEQ ID NO: 720014 - RNA, 22 nt, Human
ucugcacacaauuuaucuuucu

SEQ ID NO: 720015 - RNA, 22 nt, Human
gagggauggugugagaggcuca

SEQ ID NO: 720016 - RNA, 22 nt, Human
ccuguaggaacgccuucauuug

SEQ ID NO: 720017 - RNA, 22 nt, Human
agagcaucuaacacauaagccu

SEQ ID NO: 720018 - RNA, 20 nt, Human
uuugcuguggguguaagaau

SEQ ID NO: 720019 - RNA, 22 nt, Human
gcaggcaccggguugcuccccu

SEQ ID NO: 720020 - RNA, 22 nt, Human
uguuaaaugagauuggaauuug

SEQ ID NO: 720021 - RNA, 22 nt, Human
uccagacugcccugcacaugug

SEQ ID NO: 720022 - RNA, 17 nt, Human
uuugaaaggaugucagu

SEQ ID NO: 720023 - RNA, 22 nt, Human
ccaggagagcaaaggucacucu

SEQ ID NO: 720024 - RNA, 22 nt, Human
gcagagugagccgaggcugcuc

SEQ ID NO: 720025 - RNA, 20 nt, Human
acacugugcuaaggauuuuc

SEQ ID NO: 720026 - RNA, 22 nt, Human
aguuuauuguauaugguaguuu

SEQ ID NO: 720027 - RNA, 22 nt, Human
gaaaggagggcucacaaaagug

SEQ ID NO: 720028 - RNA, 21 nt, Human
agagacugucacugcaguacc

SEQ ID NO: 720029 - RNA, 22 nt, Human
ucuuuucugccacagccugagc

SEQ ID NO: 720030 - RNA, 22 nt, Human
ucugccagguggggagaggcca

SEQ ID NO: 720031 - RNA, 22 nt, Human
cagaggcuucaagucauucucc

SEQ ID NO: 720032 - RNA, 22 nt, Human
guacauuucauuuaaaugaugu

SEQ ID NO: 720033 - RNA, 22 nt, Human
agaguuugggugggacagcuug

SEQ ID NO: 720034 - RNA, 18 nt, Human
ggcaggauuucaacuuuc

SEQ ID NO: 720035 - RNA, 22 nt, Human
cauggcacugagcagguaugca

SEQ ID NO: 720036 - RNA, 22 nt, Human
ggaggcugaggccccucacagg

SEQ ID NO: 720037 - RNA, 22 nt, Human
caugagauaauuuuucuccagu

SEQ ID NO: 720038 - RNA, 22 nt, Human
uuucauaaugucacagucaaaa

SEQ ID NO: 720039 - RNA, 22 nt, Human
uggcuuccuguuucccagaaag

SEQ ID NO: 720040 - RNA, 22 nt, Human
uaaauaucaccuggaauuguua

SEQ ID NO: 720041 - RNA, 22 nt, Human
aagguuagugcaucuuuuguuu

SEQ ID NO: 720042 - RNA, 22 nt, Human
auuauuagacuuauaugguagu

SEQ ID NO: 720043 - RNA, 19 nt, Human
auuugcuugucugcucugc

SEQ ID NO: 720044 - RNA, 22 nt, Human
augcugguugcuaagcagcgau

SEQ ID NO: 720045 - RNA, 22 nt, Human
uuggagccaugcccagcucucu

SEQ ID NO: 720046 - RNA, 22 nt, Human
ggcuggcuugccaagcucaggg

SEQ ID NO: 720047 - RNA, 22 nt, Human
agaggccacuuugccugugaug

SEQ ID NO: 720048 - RNA, 22 nt, Human
auucaaaccccauagacaacuu

SEQ ID NO: 720049 - RNA, 22 nt, Human
guacauuuauuuuugcagcaua

SEQ ID NO: 720050 - RNA, 22 nt, Human
aaucacauagccaucucuuuga

SEQ ID NO: 720051 - RNA, 22 nt, Human
agcugucuuucugccuccugau

SEQ ID NO: 720052 - RNA, 22 nt, Human
cuauuuuccgcagcaggaagua

SEQ ID NO: 720053 - RNA, 22 nt, Human
acaggcaaacacagaaaguagg

SEQ ID NO: 720054 - RNA, 22 nt, Human
aaucuagaguucccagcauaaa

SEQ ID NO: 720055 - RNA, 22 nt, Human
ugccuggguucccaccccaaag

SEQ ID NO: 720056 - RNA, 18 nt, Human
uaagagcagacuguaggc

SEQ ID NO: 720057 - RNA, 22 nt, Human
ccagggcucaggcucccagugg

SEQ ID NO: 720058 - RNA, 22 nt, Human
gugcugggugcugcagacaggu

SEQ ID NO: 720059 - RNA, 23 nt, Human
accaggagccaagaucucccugg

SEQ ID NO: 720060 - RNA, 22 nt, Human
caaccucuaucggucaggaagc

SEQ ID NO: 720061 - RNA, 22 nt, Human
ugccagugaaacguggucucau

SEQ ID NO: 720062 - RNA, 22 nt, Human
cguguuucagccagggccaccu

SEQ ID NO: 720063 - RNA, 22 nt, Human
acuucucugcuaccugcaaaga

SEQ ID NO: 720064 - RNA, 22 nt, Human
ccugcagaccacacucaguccu

SEQ ID NO: 720065 - RNA, 22 nt, Human
cugauggaugcuacguaagagg

SEQ ID NO: 720066 - RNA, 19 nt, Human
cccuggaggaguguuggcu

SEQ ID NO: 720067 - RNA, 22 nt, Human
cccaggagguggagguugcggu

SEQ ID NO: 720068 - RNA, 20 nt, Human
uccuggccucccuggggcuc

SEQ ID NO: 720069 - RNA, 22 nt, Human
acagaggcugaucuucaagccc

SEQ ID NO: 720070 - RNA, 22 nt, Human
ugaagcagcuucuuucugucaa

SEQ ID NO: 720071 - RNA, 22 nt, Human
gccaggagggaaaggacaauuu

SEQ ID NO: 720072 - RNA, 22 nt, Human
uuuuguuuaaaauccuggaugg

SEQ ID NO: 720073 - RNA, 22 nt, Human
agaugcugaauuauugugcuuu

SEQ ID NO: 720074 - RNA, 22 nt, Human
agugucuuuagcaaguuuaguc

SEQ ID NO: 720075 - RNA, 22 nt, Human
cuguauuuaguuaaaaugcuaa

SEQ ID NO: 720076 - RNA, 22 nt, Human
agcauuucuuggcccauuguag

SEQ ID NO: 720077 - RNA, 22 nt, Human
cuuauuugcccauguuucuuua

SEQ ID NO: 720078 - RNA, 20 nt, Human
ugcuggggacauacagggug

SEQ ID NO: 720079 - RNA, 22 nt, Human
cagguacauucguagacccauu

SEQ ID NO: 720080 - RNA, 22 nt, Human
cugugcccaggccccuggggau

SEQ ID NO: 720081 - RNA, 22 nt, Human
ggaauacaaaucuuuguucucu

SEQ ID NO: 720082 - RNA, 19 nt, Human
ucaaagucugagucacuuu

SEQ ID NO: 720083 - RNA, 22 nt, Human
gagaugcugucaggcuaucugu

SEQ ID NO: 720084 - RNA, 22 nt, Human
ucugaggccuuggcagcuaagg

SEQ ID NO: 720085 - RNA, 22 nt, Human
uaaaucacaaauuuucucauuu

SEQ ID NO: 720086 - RNA, 22 nt, Human
agcagguguuagggauccaaug

SEQ ID NO: 720087 - RNA, 22 nt, Human
gcucuugauacaucaagaacuu

SEQ ID NO: 720088 - RNA, 22 nt, Human
cauggcuuguaauaaauuuaua

SEQ ID NO: 720089 - RNA, 22 nt, Human
uggucaggggcuucugagcugu

SEQ ID NO: 720090 - RNA, 22 nt, Human
gaggagcucugcuccauccuuc

SEQ ID NO: 720091 - RNA, 22 nt, Human
ggacagugcgagacacaguaac

SEQ ID NO: 720092 - RNA, 22 nt, Human
uacuaguuucuaccuuacagaa

SEQ ID NO: 720093 - RNA, 22 nt, Human
auucauaacggcaaaugucacc

SEQ ID NO: 720094 - RNA, 22 nt, Human
guguaaggccccagguucuuua

SEQ ID NO: 720095 - RNA, 22 nt, Human
cuuauuagaguuguguucuguu

SEQ ID NO: 720096 - RNA, 22 nt, Human
ucugcuuuuucauugacugaaa

SEQ ID NO: 720097 - RNA, 22 nt, Human
uugcugccugaggagcaacacu

SEQ ID NO: 720098 - RNA, 22 nt, Human
caggauguaugucuuauucuuc

SEQ ID NO: 720099 - RNA, 22 nt, Human
uacaaagguaucuuuccuagau

SEQ ID NO: 720100 - RNA, 23 nt, Human
caggagauggcugcugugucagc

SEQ ID NO: 720101 - RNA, 22 nt, Human
uccaggggcugucuuggaaucu

SEQ ID NO: 720102 - RNA, 22 nt, Human
aacacuucaagcagaagguugg

SEQ ID NO: 720103 - RNA, 22 nt, Human
uaguucuacucaaagugugauc

SEQ ID NO: 720104 - RNA, 22 nt, Human
uuugugaauucuuggaagauug

SEQ ID NO: 720105 - RNA, 22 nt, Human
gcugcucucauagauggcuuca

SEQ ID NO: 720106 - RNA, 22 nt, Human
guauauuuugaucacccucuau

SEQ ID NO: 720107 - RNA, 22 nt, Human
gcugucugucucugucccacca

SEQ ID NO: 720108 - RNA, 22 nt, Human
gcucgcgccgcaccgguccacc

SEQ ID NO: 720109 - RNA, 22 nt, Human
aucagacucugcauugcagucu

SEQ ID NO: 720110 - RNA, 22 nt, Human
gagucauugcacacuagcucag

SEQ ID NO: 720111 - RNA, 22 nt, Human
cccaggcuggagugcaauggca

SEQ ID NO: 720112 - RNA, 22 nt, Human
gcacagcccugagcgcaugucu

SEQ ID NO: 720113 - RNA, 22 nt, Human
uagcuguuaaguuguuuggaaa

SEQ ID NO: 720114 - RNA, 22 nt, Human
ucauaaaguuacccaaauuuua

SEQ ID NO: 720115 - RNA, 22 nt, Human
guucuaauauuuuaaaagccaa

SEQ ID NO: 720116 - RNA, 22 nt, Human
ucagcucuguuuugaguggaac

SEQ ID NO: 720117 - RNA, 22 nt, Human
agaaggcucauuugacugcauu

SEQ ID NO: 720118 - RNA, 22 nt, Human
aucuggcuauugacauguuaua

SEQ ID NO: 720119 - RNA, 22 nt, Human
ucagugcucugagguccagggu

SEQ ID NO: 720120 - RNA, 22 nt, Human
cagaacaugauauaaacagaag

SEQ ID NO: 720121 - RNA, 22 nt, Human
cuggaaguauaggggagaugau

SEQ ID NO: 720122 - RNA, 22 nt, Human
ucucagcugccugcccugcucc

SEQ ID NO: 720123 - RNA, 22 nt, Human
cagauggcaacagcucugugac

SEQ ID NO: 720124 - RNA, 22 nt, Human
acuacaucuugcauaucuauaa

SEQ ID NO: 720125 - RNA, 22 nt, Human
aaguauugugggaaagcagaaa

SEQ ID NO: 720126 - RNA, 19 nt, Human
agcaggccacagggccagc

SEQ ID NO: 720127 - RNA, 22 nt, Human
cucugcagagccuccagcccag

SEQ ID NO: 720128 - RNA, 22 nt, Human
gcacagcucuccccaagacgaa

SEQ ID NO: 720129 - RNA, 22 nt, Human
gaggccagaugucaugucuuau

SEQ ID NO: 720130 - RNA, 22 nt, Human
aggaccagccuccaggucucuu

SEQ ID NO: 720131 - RNA, 22 nt, Human
aauaagaugugcuugaguuugg

SEQ ID NO: 720132 - RNA, 22 nt, Human
gcaggcuccaaggccugggaga

SEQ ID NO: 720133 - RNA, 22 nt, Human
caggccagguggcaggcaaaac

SEQ ID NO: 720134 - RNA, 22 nt, Human
agcuaucaguaggaccauguuc

SEQ ID NO: 720135 - RNA, 22 nt, Human
acuaguauugccuacuguacau

SEQ ID NO: 720136 - RNA, 22 nt, Human
aggggagcaacauagucacucu

SEQ ID NO: 720137 - RNA, 22 nt, Human
cuggaaaucacuacuagucaau

SEQ ID NO: 720138 - RNA, 22 nt, Human
cagccuguggcagaggucuaau

SEQ ID NO: 720139 - RNA, 22 nt, Human
uacgaauccuguggaugaaugu

SEQ ID NO: 720140 - RNA, 22 nt, Human
ccucugugggccgggccugcug

SEQ ID NO: 720141 - RNA, 22 nt, Human
agugcagagaccuggucaggca

SEQ ID NO: 720142 - RNA, 22 nt, Human
uugagucaguaauuccauuucu

SEQ ID NO: 720143 - RNA, 22 nt, Human
uggagaguggauaugggagcaa

SEQ ID NO: 720144 - RNA, 22 nt, Human
ugcauugggagagauuagggca

SEQ ID NO: 720145 - RNA, 19 nt, Human
aagguggcagcagguauua

SEQ ID NO: 720146 - RNA, 22 nt, Human
cugaguccuugggcuuagagug

SEQ ID NO: 720147 - RNA, 22 nt, Human
agccuauuccaggaugagcuca

SEQ ID NO: 720148 - RNA, 22 nt, Human
uacuguggggauauugauugua

SEQ ID NO: 720149 - RNA, 21 nt, Human
uggcucugcucagagcagucc

SEQ ID NO: 720150 - RNA, 21 nt, Human
ggcaguaagauuuacuuuaag

SEQ ID NO: 720151 - RNA, 22 nt, Human
ugcagggcccucauuccugucc

SEQ ID NO: 720152 - RNA, 22 nt, Human
uuuaauuuguauuucuagaggg

SEQ ID NO: 720153 - RNA, 22 nt, Human
auccccacgauauagccaaagc

SEQ ID NO: 720154 - RNA, 22 nt, Human
uauugaucuggauauuuagaca

SEQ ID NO: 720155 - RNA, 22 nt, Human
gaaccucuaguuuguucuuuga

SEQ ID NO: 720156 - RNA, 20 nt, Human
ugccaugguaacagagugug

SEQ ID NO: 720157 - RNA, 22 nt, Human
uuuuauauggcacauugguugg

SEQ ID NO: 720158 - RNA, 22 nt, Human
ggcugagcaauuuugaugacau

SEQ ID NO: 720159 - RNA, 22 nt, Human
aaguggagcuauaggcucagau

SEQ ID NO: 720160 - RNA, 22 nt, Human
uuuuacaagcugagucguuaaa

SEQ ID NO: 720161 - RNA, 16 nt, Human
cagccugcagugguca

SEQ ID NO: 720162 - RNA, 22 nt, Human
agugggagauaacuuaacagcu

SEQ ID NO: 720163 - RNA, 22 nt, Human
ggccugcuccgggggcugagcu

SEQ ID NO: 720164 - RNA, 22 nt, Human
gauuucuacuugaacuugcuaa

SEQ ID NO: 720165 - RNA, 22 nt, Human
agcuggugaggguugaggggua

SEQ ID NO: 720166 - RNA, 22 nt, Human
agcucugggucacggcugccga

SEQ ID NO: 720167 - RNA, 22 nt, Human
guccaggccaugguggacacag

SEQ ID NO: 720168 - RNA, 22 nt, Human
gggcaggugugcagagcuguug

SEQ ID NO: 720169 - RNA, 22 nt, Human
gcugcugggggaacaguuaaaa

SEQ ID NO: 720170 - RNA, 22 nt, Human
gaacuuuaaucccuugggcuua

SEQ ID NO: 720171 - RNA, 22 nt, Human
caucaguguggcaguucacugu

SEQ ID NO: 720172 - RNA, 22 nt, Human
guagagucaggacggcaauucu

SEQ ID NO: 720173 - RNA, 21 nt, Human
ucugagcugaguccucuaggu

SEQ ID NO: 720174 - RNA, 22 nt, Human
gccucugcaacuccgccuuggu

SEQ ID NO: 720175 - RNA, 22 nt, Human
aaugcauauguaggcaagcagu

SEQ ID NO: 720176 - RNA, 22 nt, Human
gagcuacugaaauauugauuuu

SEQ ID NO: 720177 - RNA, 21 nt, Human
gaucuuuacuuuccuacuuac

SEQ ID NO: 720178 - RNA, 22 nt, Human
cccucugcucaggugcauaggc

SEQ ID NO: 720179 - RNA, 22 nt, Human
ccugggucuucagucugcuggu

SEQ ID NO: 720180 - RNA, 22 nt, Human
gcacauguugcuaguuacuugc

SEQ ID NO: 720181 - RNA, 22 nt, Human
ccaggcucaggccugcucguug

SEQ ID NO: 720182 - RNA, 22 nt, Human
acacugagcugagcauucuugu

SEQ ID NO: 720183 - RNA, 22 nt, Human
aggccagcgcugcuagcucccg

SEQ ID NO: 720184 - RNA, 22 nt, Human
cccugagccacacagagcaggu

SEQ ID NO: 720185 - RNA, 22 nt, Human
aagcacugugccucauaucuga

SEQ ID NO: 720186 - RNA, 22 nt, Human
uucuggaauauuugacacaauu

SEQ ID NO: 720187 - RNA, 22 nt, Human
cagguggucaggcagaugggcu

SEQ ID NO: 720188 - RNA, 22 nt, Human
agcagcaaguguaacugaauau

SEQ ID NO: 720189 - RNA, 22 nt, Human
gagcuaagcccuggagaggucg

SEQ ID NO: 720190 - RNA, 22 nt, Human
ggagagugggagcaacuguugc

SEQ ID NO: 720191 - RNA, 22 nt, Human
gcuggagaugcuaugcagaggg

SEQ ID NO: 720192 - RNA, 22 nt, Human
auggcaguuuuagaacuuuuca

SEQ ID NO: 720193 - RNA, 22 nt, Human
gucuggaaccaagacguguagc

SEQ ID NO: 720194 - RNA, 22 nt, Human
accuucaccuccacaccuuggg

SEQ ID NO: 720195 - RNA, 22 nt, Human
ucccagcaagaaaggggguggc

SEQ ID NO: 720196 - RNA, 22 nt, Human
uucagaguuagacgaaaagcaa

SEQ ID NO: 720197 - RNA, 22 nt, Human
uguuagcaaggauaauuaugau

SEQ ID NO: 720198 - RNA, 22 nt, Human
aaguuccucuucucugcaggga

SEQ ID NO: 720199 - RNA, 22 nt, Human
uggacagccaugcaaaugagcu

SEQ ID NO: 720200 - RNA, 22 nt, Human
acagcagucuuaacacauugca

SEQ ID NO: 720201 - RNA, 22 nt, Human
gggcccugcguccggaagucug

SEQ ID NO: 720202 - RNA, 22 nt, Human
gucucugugccuucuccccacc

SEQ ID NO: 720203 - RNA, 22 nt, Human
cucaggauuuacuaauuucaag

SEQ ID NO: 720204 - RNA, 22 nt, Human
uucuuuaccagugaaauguuau

SEQ ID NO: 720205 - RNA, 22 nt, Human
agaguuauggacuuaaugcagg

SEQ ID NO: 720206 - RNA, 22 nt, Human
uggccuuguguuuuagagaaag

SEQ ID NO: 720207 - RNA, 22 nt, Human
cacacaugguagcagguacaag

SEQ ID NO: 720208 - RNA, 22 nt, Human
gaaaguuuucauauauaccaaa

SEQ ID NO: 720209 - RNA, 22 nt, Human
caggguggaagcuguagagugg

SEQ ID NO: 720210 - RNA, 22 nt, Human
cuucaugaggccggcuuuaucc

SEQ ID NO: 720211 - RNA, 23 nt, Human
ugacaguguauuugacuauaugg

SEQ ID NO: 720212 - RNA, 22 nt, Human
uucaacuuuggagauuuaauaa

SEQ ID NO: 720213 - RNA, 22 nt, Human
gcuccucuucucccacugaaug

SEQ ID NO: 720214 - RNA, 22 nt, Human
aaauucuuuggccuacuuugaa

SEQ ID NO: 720215 - RNA, 22 nt, Human
agcuccagccgcugauggguuu

SEQ ID NO: 720216 - RNA, 22 nt, Human
ucagauauagucauuuaaauaa

SEQ ID NO: 720217 - RNA, 22 nt, Human
cuauuuguaagagccccacacc

SEQ ID NO: 720218 - RNA, 22 nt, Human
ugugaggacauuggaggacuca

SEQ ID NO: 720219 - RNA, 22 nt, Human
caacagugauucugcaugagga

SEQ ID NO: 720220 - RNA, 22 nt, Human
gcccugagauucuuggauucug

SEQ ID NO: 720221 - RNA, 22 nt, Human
ugucucugucuuccagggcugu

SEQ ID NO: 720222 - RNA, 22 nt, Human
uauauuagugagauuuauccau

SEQ ID NO: 720223 - RNA, 22 nt, Human
guggcaguucugugucucuugu

SEQ ID NO: 720224 - RNA, 22 nt, Human
cagugucucaguuucacuugaa

SEQ ID NO: 720225 - RNA, 22 nt, Human
cuggagccccaggcugugcaga

SEQ ID NO: 720226 - RNA, 22 nt, Human
aaguccuuggagaauagaaagg

SEQ ID NO: 720227 - RNA, 22 nt, Human
uccuaaaggcugcuuuuauauu

SEQ ID NO: 720228 - RNA, 22 nt, Human
uuacacuuuggcaagcuauuaa

SEQ ID NO: 720229 - RNA, 22 nt, Human
cacaguccugccagagggccuu

SEQ ID NO: 720230 - RNA, 22 nt, Human
aaaguugcuggcuuugguucau

SEQ ID NO: 720231 - RNA, 22 nt, Human
uccauucauucagguauuuagu

SEQ ID NO: 720232 - RNA, 19 nt, Human
uaaaaugucuguggucagu

SEQ ID NO: 720233 - RNA, 22 nt, Human
uaacuuuaggaauagguaaucu

SEQ ID NO: 720234 - RNA, 22 nt, Human
ccagggcugguggcugcagagg

SEQ ID NO: 720235 - RNA, 21 nt, Human
acuuugggcacuuuccugccc

SEQ ID NO: 720236 - RNA, 22 nt, Human
uugcagcuuagugauguuaucu

SEQ ID NO: 720237 - RNA, 22 nt, Human
acugggaagacaagaaagauag

SEQ ID NO: 720238 - RNA, 22 nt, Human
gcuucuaucccuccacugcacu

SEQ ID NO: 720239 - RNA, 22 nt, Human
agaaaucaauaucuauauguug

SEQ ID NO: 720240 - RNA, 22 nt, Human
ugagcagggacuuuggagucug

SEQ ID NO: 720241 - RNA, 22 nt, Human
gugagagcugcuagacuguuau

SEQ ID NO: 720242 - RNA, 22 nt, Human
uggguggaauaaaucaguucug

SEQ ID NO: 720243 - RNA, 22 nt, Human
uuuuccuuuggaagaugcauau

SEQ ID NO: 720244 - RNA, 22 nt, Human
uuugauaauacacaagagaaag

SEQ ID NO: 720245 - RNA, 22 nt, Human
augcugacuucucucugcagug

SEQ ID NO: 720246 - RNA, 22 nt, Human
agugggcaggcagggugcgcag

SEQ ID NO: 720247 - RNA, 20 nt, Human
uuucacaucugucccuuuaa

SEQ ID NO: 720248 - RNA, 22 nt, Human
aacauguugaguugaaaguagc

SEQ ID NO: 720249 - RNA, 22 nt, Human
uuccuggggugaagauauuuuu

SEQ ID NO: 720250 - RNA, 22 nt, Human
ccuuuuucugaguuguagcuuc

SEQ ID NO: 720251 - RNA, 22 nt, Human
ugggaagaguuagagacagcug

SEQ ID NO: 720252 - RNA, 22 nt, Human
aaagcuucuauucacuuacuug

SEQ ID NO: 720253 - RNA, 22 nt, Human
cugccuucaucucugagcuggg

SEQ ID NO: 720254 - RNA, 20 nt, Human
agccuggcaaacacccccag

SEQ ID NO: 720255 - RNA, 22 nt, Human
gcaagggugugaaccaaugaga

SEQ ID NO: 720256 - RNA, 22 nt, Human
ucccucuacagggaagcgcuuu

SEQ ID NO: 720257 - RNA, 22 nt, Human
aauuaugagguagauaucacau

SEQ ID NO: 720258 - RNA, 22 nt, Human
uggccuggcucacagugagauu

SEQ ID NO: 720259 - RNA, 22 nt, Human
ucucuucuagcuucuugugguu

SEQ ID NO: 720260 - RNA, 22 nt, Human
aagauucucacugcucaacuuu

SEQ ID NO: 720261 - RNA, 22 nt, Human
gcugaagagcaaggcugggucu

SEQ ID NO: 720262 - RNA, 22 nt, Human
agggccugggaagaggaacccu

SEQ ID NO: 720263 - RNA, 22 nt, Human
ucuguaaauccugcucagcaac

SEQ ID NO: 720264 - RNA, 21 nt, Human
cuacuuaaguaggggauuagg

SEQ ID NO: 720265 - RNA, 22 nt, Human
gaagacuacuguugcacucaua

SEQ ID NO: 720266 - RNA, 22 nt, Human
ucugugcucuucucaguaucac

SEQ ID NO: 720267 - RNA, 22 nt, Human
agagcccugugguucugguaag

SEQ ID NO: 720268 - RNA, 22 nt, Human
agauguuuuggagacacuaacc

SEQ ID NO: 720269 - RNA, 21 nt, Human
gggagcuggaaacugggugac

SEQ ID NO: 720270 - RNA, 22 nt, Human
gagguaucuuagagaguguaga

SEQ ID NO: 720271 - RNA, 22 nt, Human
uugagauagguggaaucucuuu

SEQ ID NO: 720272 - RNA, 22 nt, Human
uaaugucagcauaguuuauuuu

SEQ ID NO: 720273 - RNA, 22 nt, Human
caaaucauggcucuagcuuaca

SEQ ID NO: 720274 - RNA, 22 nt, Human
ucagauuugaauauuccuuucg

SEQ ID NO: 720275 - RNA, 22 nt, Human
gccugggacuggauguguuugu

SEQ ID NO: 720276 - RNA, 22 nt, Human
cucuacuccaaaaggcuacaau

SEQ ID NO: 720277 - RNA, 22 nt, Human
ucuuucuuauuagccauuguuc

SEQ ID NO: 720278 - RNA, 22 nt, Human
gaaugcuaagcaugugggaguu

SEQ ID NO: 720279 - RNA, 22 nt, Human
gcagcaguaggaaauaacacag

SEQ ID NO: 720280 - RNA, 22 nt, Human
uuagcaguucauugauuaucgu

SEQ ID NO: 720281 - RNA, 22 nt, Human
gugccucccgggaccaugcacu

SEQ ID NO: 720282 - RNA, 20 nt, Human
ccagaagagaugaucaucca

SEQ ID NO: 720283 - RNA, 22 nt, Human
uucuucugagagaaaaagcuca

SEQ ID NO: 720284 - RNA, 22 nt, Human
caguguaucauuagugugauga

SEQ ID NO: 720285 - RNA, 22 nt, Human
auuuucuagauagaugaugcau

SEQ ID NO: 720286 - RNA, 22 nt, Human
cagcccugcacgcugccuccgc

SEQ ID NO: 720287 - RNA, 22 nt, Human
cugcuuuagguggaauguucua

SEQ ID NO: 720288 - RNA, 22 nt, Human
acccaggauagagugcugcagu

SEQ ID NO: 720289 - RNA, 22 nt, Human
gucauugacuagaauuccaaag

SEQ ID NO: 720290 - RNA, 22 nt, Human
augggagaaacaucaugaggca

SEQ ID NO: 720291 - RNA, 22 nt, Human
uauaaauuaaugugcccaugag

SEQ ID NO: 720292 - RNA, 22 nt, Human
gaacaaacauuuuuggcaguau

SEQ ID NO: 720293 - RNA, 22 nt, Human
uccagagccccagucuaguggg

SEQ ID NO: 720294 - RNA, 22 nt, Human
gcucuucuaaagaauguacagg

SEQ ID NO: 720295 - RNA, 22 nt, Human
agacagugauguaagcaggagu

SEQ ID NO: 720296 - RNA, 22 nt, Human
ggagagguuauccguguuaugu

SEQ ID NO: 720297 - RNA, 22 nt, Human
ugaagaucugucaaccccauau

SEQ ID NO: 720298 - RNA, 22 nt, Human
uucucaggaacucagugucagc

SEQ ID NO: 720299 - RNA, 19 nt, Human
ugggccucacaaugcuccc

SEQ ID NO: 720300 - RNA, 22 nt, Human
uucacagugccagggggcaggc

SEQ ID NO: 720301 - RNA, 22 nt, Human
ugcagggacacgaagacaaaua

SEQ ID NO: 720302 - RNA, 22 nt, Human
cugucuguucagauucauuacu

SEQ ID NO: 720303 - RNA, 18 nt, Human
uccauuguucuacuguga

SEQ ID NO: 720304 - RNA, 22 nt, Human
uccagguagggaauaaauguca

SEQ ID NO: 720305 - RNA, 22 nt, Human
cacaugaaggcuggggucguga

SEQ ID NO: 720306 - RNA, 22 nt, Human
ccuacacaucucaccucacagg

SEQ ID NO: 720307 - RNA, 22 nt, Human
acaaaggcagagaauucaacau

SEQ ID NO: 720308 - RNA, 22 nt, Human
acuagggaaaguuauguucaca

SEQ ID NO: 720309 - RNA, 22 nt, Human
aggcccuguuguagcauuuugg

SEQ ID NO: 720310 - RNA, 22 nt, Human
cuagauaaggauuucucaacuu

SEQ ID NO: 720311 - RNA, 22 nt, Human
cuccucugucuaccacgagggu

SEQ ID NO: 720312 - RNA, 22 nt, Human
aaagaucauucucugguccaga

SEQ ID NO: 720313 - RNA, 22 nt, Human
uucacaggugagcauuaggccg

SEQ ID NO: 720314 - RNA, 22 nt, Human
ugcuugucuucaggaaugcuga

SEQ ID NO: 720315 - RNA, 22 nt, Human
aaugaauucgagugaaggaaag

SEQ ID NO: 720316 - RNA, 22 nt, Human
aauggcugggaguguauuuugg

SEQ ID NO: 720317 - RNA, 22 nt, Human
uggccugggcaugaagcaucgu

SEQ ID NO: 720318 - RNA, 22 nt, Human
uucuuucccaguagaugugaaa

SEQ ID NO: 720319 - RNA, 22 nt, Human
gugcuuccugccuggugccuuu

SEQ ID NO: 720320 - RNA, 22 nt, Human
acauuucuccuugcaggaguca

SEQ ID NO: 720321 - RNA, 22 nt, Human
gggugacauuaggaagauagac

SEQ ID NO: 720322 - RNA, 22 nt, Human
auucuaggcuugaaacaugaag

SEQ ID NO: 720323 - RNA, 22 nt, Human
uuuguacauccuaauucugagu

SEQ ID NO: 720324 - RNA, 21 nt, Human
ugcagaaaugguuuuucuaag

SEQ ID NO: 720325 - RNA, 22 nt, Human
aagugcaaugaauagcugcaau

SEQ ID NO: 720326 - RNA, 22 nt, Human
uccucacacccauaccacugac

SEQ ID NO: 720327 - RNA, 22 nt, Human
ucugacaauuagccuaguccug

SEQ ID NO: 720328 - RNA, 22 nt, Human
ucagagguucuucucaguggcc

SEQ ID NO: 720329 - RNA, 19 nt, Human
agcauuuggaauucuacac

SEQ ID NO: 720330 - RNA, 22 nt, Human
auguaaacuuuaccagcucuga

SEQ ID NO: 720331 - RNA, 22 nt, Human
ugcaaaauaaugaacgauuuuu

SEQ ID NO: 720332 - RNA, 22 nt, Human
cuacaacauuaugcuuucuguc

SEQ ID NO: 720333 - RNA, 22 nt, Human
ggcugugguggcaucccugagc

SEQ ID NO: 720334 - RNA, 22 nt, Human
ugucaaauuuuuauugcaguau

SEQ ID NO: 720335 - RNA, 23 nt, Human
ggaagcucacguaguccugcacu

SEQ ID NO: 720336 - RNA, 20 nt, Human
uccugagaccugggaagguu

SEQ ID NO: 720337 - RNA, 22 nt, Human
gugaacaucagauuacaugaga

SEQ ID NO: 720338 - RNA, 22 nt, Human
gaggccagauacucucuucugc

SEQ ID NO: 720339 - RNA, 22 nt, Human
auuuguacucaggaauucugcu

SEQ ID NO: 720340 - RNA, 22 nt, Human
uccaguccuaucugcccuugga

SEQ ID NO: 720341 - RNA, 22 nt, Human
gaucauagcgucuucuugcagc

SEQ ID NO: 720342 - RNA, 22 nt, Human
ggaggggauuuaguagaugcua

SEQ ID NO: 720343 - RNA, 22 nt, Human
cuucagaaccagccagaagagg

SEQ ID NO: 720344 - RNA, 22 nt, Human
aggagcagcuucugaaccaugu

SEQ ID NO: 720345 - RNA, 22 nt, Human
auguuuacugaaaagauuucaa

SEQ ID NO: 720346 - RNA, 22 nt, Human
ugcauuugcaauggguacacaa

SEQ ID NO: 720347 - RNA, 22 nt, Human
uugaaagaacucuucagagaua

SEQ ID NO: 720348 - RNA, 22 nt, Human
acaguggaauggugggccugca

SEQ ID NO: 720349 - RNA, 22 nt, Human
caaccuggcccuagcccuggga

SEQ ID NO: 720350 - RNA, 22 nt, Human
gcugggaagaacaggagagaau

SEQ ID NO: 720351 - RNA, 21 nt, Human
ccaggcuccugaggcugguca

SEQ ID NO: 720352 - RNA, 22 nt, Human
uuauucaggcucucuuuggcua

SEQ ID NO: 720353 - RNA, 22 nt, Human
gugaggucaccggccguugcca

SEQ ID NO: 720354 - RNA, 22 nt, Human
ucaaaaguggccuguaaaaucu

SEQ ID NO: 720355 - RNA, 22 nt, Human
uggggucugaguaucugcauuu

SEQ ID NO: 720356 - RNA, 22 nt, Human
cagggugagccucuggagcccu

SEQ ID NO: 720357 - RNA, 22 nt, Human
auugaaagaguuuucugcugca

SEQ ID NO: 720358 - RNA, 22 nt, Human
agcugugggccugggagagcug

SEQ ID NO: 720359 - RNA, 22 nt, Human
aaugcaaagaguugcuuaucaa

SEQ ID NO: 720360 - RNA, 22 nt, Human
cugaguucugcccaaggucugg

SEQ ID NO: 720361 - RNA, 22 nt, Human
uacaauguaauucugauuaugu

SEQ ID NO: 720362 - RNA, 22 nt, Human
cuauagaaaauuguaucacacg

SEQ ID NO: 720363 - RNA, 22 nt, Human
cacaggaggcaaugguaagauu

SEQ ID NO: 720364 - RNA, 22 nt, Human
guuauauuggcagaagagaaga

SEQ ID NO: 720365 - RNA, 22 nt, Human
caguggguaggaaaggcucuuc

SEQ ID NO: 720366 - RNA, 22 nt, Human
ccaccaugggaagagagacuaa

SEQ ID NO: 720367 - RNA, 22 nt, Human
agcuuuauuaacucuccaggug

SEQ ID NO: 720368 - RNA, 22 nt, Human
ucagacuuuuaaagacugaaug

SEQ ID NO: 720369 - RNA, 22 nt, Human
aaaguauuugugauuuuuacca

SEQ ID NO: 720370 - RNA, 22 nt, Human
ugcagcauucuuggccacuacu

SEQ ID NO: 720371 - RNA, 22 nt, Human
gcaguauauacucuuugagggg

SEQ ID NO: 720372 - RNA, 22 nt, Human
gggucagggcugccugggcuca

SEQ ID NO: 720373 - RNA, 19 nt, Human
ccagcccugucacuucuug

SEQ ID NO: 720374 - RNA, 22 nt, Human
cucuggagguugagcccagcaa

SEQ ID NO: 720375 - RNA, 22 nt, Human
ggcuucucccauucuucagggg

SEQ ID NO: 720376 - RNA, 22 nt, Human
aaauacauacacuguacguggc

SEQ ID NO: 720377 - RNA, 22 nt, Human
ucacaguaaaagcauggaagag

SEQ ID NO: 720378 - RNA, 22 nt, Human
cagggacauaagaggaacaugg

SEQ ID NO: 720379 - RNA, 22 nt, Human
gccuggcaggccucaugagggg

SEQ ID NO: 720380 - RNA, 22 nt, Human
uuuccucugagugagcugggag

SEQ ID NO: 720381 - RNA, 22 nt, Human
cauaagaauauuccauccuuug

SEQ ID NO: 720382 - RNA, 22 nt, Human
gcucucuguuauuaagaucuuu

SEQ ID NO: 720383 - RNA, 22 nt, Human
ugaacacacaccuauguacaaa

SEQ ID NO: 720384 - RNA, 22 nt, Human
augcuucuugagauagaaacac

SEQ ID NO: 720385 - RNA, 22 nt, Human
aggggccaccaccaaggaaggu

SEQ ID NO: 720386 - RNA, 22 nt, Human
ggacaggccgccucgguggggg

SEQ ID NO: 720387 - RNA, 22 nt, Human
ggcuuucaacacaggcuuuccu

SEQ ID NO: 720388 - RNA, 22 nt, Human
aagacaauuugauacuaguugc

SEQ ID NO: 720389 - RNA, 22 nt, Human
cccuggaggcuggaggcaguag

SEQ ID NO: 720390 - RNA, 22 nt, Human
gucccuggagcugagcagugcu

SEQ ID NO: 720391 - RNA, 22 nt, Human
uugaucugccucauucuuguuc

SEQ ID NO: 720392 - RNA, 22 nt, Human
ggcuucaggggucugucugcac

SEQ ID NO: 720393 - RNA, 22 nt, Human
ggagggcaacuuuucaguaggu

SEQ ID NO: 720394 - RNA, 22 nt, Human
aagguauuuucuaauguauacu

SEQ ID NO: 720395 - RNA, 22 nt, Human
aguccagaccccggcagcuggu

SEQ ID NO: 720396 - RNA, 22 nt, Human
cagggugccucccgcucgccgg

SEQ ID NO: 720397 - RNA, 19 nt, Human
acaugcauauggacaguug

SEQ ID NO: 720398 - RNA, 22 nt, Human
ccagcgcuucccaucagggagg

SEQ ID NO: 720399 - RNA, 22 nt, Human
uggcuucuccagaaaucuuggu

SEQ ID NO: 720400 - RNA, 22 nt, Human
cacaugcauuggcaaaagugua

SEQ ID NO: 720401 - RNA, 22 nt, Human
guggccuggaaaggcuggucug

SEQ ID NO: 720402 - RNA, 22 nt, Human
ugucccuggagcuucugucccc

SEQ ID NO: 720403 - RNA, 22 nt, Human
guggaaaacugagaaaauugcu

SEQ ID NO: 720404 - RNA, 22 nt, Human
gacauugaacaaguuuccugac

SEQ ID NO: 720405 - RNA, 22 nt, Human
cccaaaaugugcauguucgaau

SEQ ID NO: 720406 - RNA, 22 nt, Human
uucaagaugacccagucacacg

SEQ ID NO: 720407 - RNA, 22 nt, Human
cuccugucagaagcauccugag

SEQ ID NO: 720408 - RNA, 22 nt, Human
uggcaggcucugaguagcaccu

SEQ ID NO: 720409 - RNA, 22 nt, Human
ugucucugucucccagguugug

SEQ ID NO: 720410 - RNA, 22 nt, Human
aaauaaguuagcagauuccagu

SEQ ID NO: 720411 - RNA, 22 nt, Human
cuggacaggcuggggacugcaa

SEQ ID NO: 720412 - RNA, 22 nt, Human
acuuuggguaagccaggugcua

SEQ ID NO: 720413 - RNA, 22 nt, Human
gggaucagaaacauagcccuga

SEQ ID NO: 720414 - RNA, 22 nt, Human
uccugcagccauuagaggucaa

SEQ ID NO: 720415 - RNA, 22 nt, Human
ucuucaaacugaaaauuuagaa

SEQ ID NO: 720416 - RNA, 22 nt, Human
uuuucuguuuacagagggaccu

SEQ ID NO: 720417 - RNA, 22 nt, Human
aauguuuucccagugcagacga

SEQ ID NO: 720418 - RNA, 22 nt, Human
gacucagauuuagaggguaaga

SEQ ID NO: 720419 - RNA, 20 nt, Human
ggcagagcuaugucuguugc

SEQ ID NO: 720420 - RNA, 22 nt, Human
aggucucacuuuguggaaguga

SEQ ID NO: 720421 - RNA, 20 nt, Human
ucauggaaucucacucuagu

SEQ ID NO: 720422 - RNA, 22 nt, Human
uugggguacgcaggucugggag

SEQ ID NO: 720423 - RNA, 19 nt, Human
ccagggcuccaagcugagu

SEQ ID NO: 720424 - RNA, 22 nt, Human
guucuacaugacacucaacauu

SEQ ID NO: 720425 - RNA, 22 nt, Human
aggcagcuuaagcccuggccca

SEQ ID NO: 720426 - RNA, 22 nt, Human
ccuuugggguccugccugggcu

SEQ ID NO: 720427 - RNA, 22 nt, Human
ccaaggacuggacacacagguu

SEQ ID NO: 720428 - RNA, 22 nt, Human
aggacagcauuuucagcaucuc

SEQ ID NO: 720429 - RNA, 22 nt, Human
cauguuuuguguacagaauauu

SEQ ID NO: 720430 - RNA, 22 nt, Human
acuguacuuuucuuggcuagau

SEQ ID NO: 720431 - RNA, 22 nt, Human
uccagagcugagcagucauucu

SEQ ID NO: 720432 - RNA, 22 nt, Human
uucugagaaggcuguggacaca

SEQ ID NO: 720433 - RNA, 22 nt, Human
ccucugggugggaggccgggcg

SEQ ID NO: 720434 - RNA, 22 nt, Human
cugagguauugaaguaucuucu

SEQ ID NO: 720435 - RNA, 22 nt, Human
aaugcaguuucauuuguagaau

SEQ ID NO: 720436 - RNA, 21 nt, Human
uuggccugauaucuuggagca

SEQ ID NO: 720437 - RNA, 22 nt, Human
uccugggaaguugcaucaccgu

SEQ ID NO: 720438 - RNA, 22 nt, Human
caggugcucccagagaagugcu

SEQ ID NO: 720439 - RNA, 22 nt, Human
agggugguggcgaugaggacau

SEQ ID NO: 720440 - RNA, 22 nt, Human
uaugccagacugugagcuucuu

SEQ ID NO: 720441 - RNA, 22 nt, Human
ugucacauugaauaugauuuau

SEQ ID NO: 720442 - RNA, 20 nt, Human
ugcuuccuggccacugcggg

SEQ ID NO: 720443 - RNA, 22 nt, Human
ugcaguguuuuucagggcauau

SEQ ID NO: 720444 - RNA, 22 nt, Human
cacacaguaggcacucauuaau

SEQ ID NO: 720445 - RNA, 22 nt, Human
aggcccugggcaguucuguagc

SEQ ID NO: 720446 - RNA, 22 nt, Human
gcugccugcucacccggccugg

SEQ ID NO: 720447 - RNA, 22 nt, Human
aaugauggauuuagacaagcug

SEQ ID NO: 720448 - RNA, 22 nt, Human
agcaccugccugcauuggcuau

SEQ ID NO: 720449 - RNA, 22 nt, Human
gacaggcuuccuaagugccaga

SEQ ID NO: 720450 - RNA, 22 nt, Human
aauguuuuacagaucccauuag

SEQ ID NO: 720451 - RNA, 22 nt, Human
uaacaaugggaaggacugauga

SEQ ID NO: 720452 - RNA, 22 nt, Human
uugcagggcuggaacauggaau

SEQ ID NO: 720453 - RNA, 22 nt, Human
uucugcaugaacaguuuauucc

SEQ ID NO: 720454 - RNA, 22 nt, Human
gaaaggagggaaacagagcggu

SEQ ID NO: 720455 - RNA, 22 nt, Human
cucagagagugaauuccugccu

SEQ ID NO: 720456 - RNA, 22 nt, Human
acccugggacuuccgaguugag

SEQ ID NO: 720457 - RNA, 22 nt, Human
uugaaauggaagugaaaauucu

SEQ ID NO: 720458 - RNA, 22 nt, Human
ccucugugcuuuguccagccuc

SEQ ID NO: 720459 - RNA, 22 nt, Human
uuuuaacuuaaaauacauagau

SEQ ID NO: 720460 - RNA, 22 nt, Human
ggaggguggcagcguccugggc

SEQ ID NO: 720461 - RNA, 22 nt, Human
ucagguggcuuggagggggacg

SEQ ID NO: 720462 - RNA, 22 nt, Human
acaguuugcccugacauucucc

SEQ ID NO: 720463 - RNA, 23 nt, Human
gucagggcuggggucagagugac

SEQ ID NO: 720464 - RNA, 22 nt, Human
aguacaugugguccuggccaga

SEQ ID NO: 720465 - RNA, 22 nt, Human
cauggccagcccccaguuccuc

SEQ ID NO: 720466 - RNA, 22 nt, Human
ggccucgcggcuucugguggcu

SEQ ID NO: 720467 - RNA, 22 nt, Human
agccagggugagagggcuuugu

SEQ ID NO: 720468 - RNA, 22 nt, Human
aauaauauuugaagcuucaaag

SEQ ID NO: 720469 - RNA, 22 nt, Human
aaguguuucaauaauuuggacc

SEQ ID NO: 720470 - RNA, 18 nt, Human
cagaugcuaggccuccag

SEQ ID NO: 720471 - RNA, 22 nt, Human
gcccuuaggcaagcagaagccc

SEQ ID NO: 720472 - RNA, 22 nt, Human
acacagcucacaacgugugcau

SEQ ID NO: 720473 - RNA, 22 nt, Human
cugugugugcuacaggcuucca

SEQ ID NO: 720474 - RNA, 22 nt, Human
agcaggcaggaaggcagcacug

SEQ ID NO: 720475 - RNA, 22 nt, Human
cugaaaauguuacacaggaaga

SEQ ID NO: 720476 - RNA, 22 nt, Human
acauugugauccgacugauuaa

SEQ ID NO: 720477 - RNA, 22 nt, Human
cugggccugguguggcaccugc

SEQ ID NO: 720478 - RNA, 22 nt, Human
auggcugcuuucccuuagcacc

SEQ ID NO: 720479 - RNA, 22 nt, Human
acugcagagcuuuucaguugag

SEQ ID NO: 720480 - RNA, 22 nt, Human
agcagauguucccuggucccuu

SEQ ID NO: 720481 - RNA, 23 nt, Human
agccuucaggcaaugucaguaga

SEQ ID NO: 720482 - RNA, 22 nt, Human
cuauggaagggaugcaaagaaa

SEQ ID NO: 720483 - RNA, 22 nt, Human
guuuuccugagcccagagaugc

SEQ ID NO: 720484 - RNA, 22 nt, Human
acauacacaagcguacaugaac

SEQ ID NO: 720485 - RNA, 22 nt, Human
ugugaaauugaaugcccauugc

SEQ ID NO: 720486 - RNA, 22 nt, Human
ugugcccaucucccagcuugac

SEQ ID NO: 720487 - RNA, 22 nt, Human
guuuaauuuuagguugucaagc

SEQ ID NO: 720488 - RNA, 22 nt, Human
auguggcuuaguuaggugcccc

SEQ ID NO: 720489 - RNA, 22 nt, Human
aaguucccgaggaccacaguug

SEQ ID NO: 720490 - RNA, 23 nt, Human
aggugccaacugagagcugagag

SEQ ID NO: 720491 - RNA, 19 nt, Human
gagaaaccccgucuuuagg

SEQ ID NO: 720492 - RNA, 22 nt, Human
ucaguuuaauacccagaugccu

SEQ ID NO: 720493 - RNA, 20 nt, Human
gagauggcuaagugcugaac

SEQ ID NO: 720494 - RNA, 22 nt, Human
aaaauguguuuaugcauuucgu

SEQ ID NO: 720495 - RNA, 23 nt, Human
agcuucauuauuuuccaugaucu

SEQ ID NO: 720496 - RNA, 19 nt, Human
gcugaacaagucagcaacc

SEQ ID NO: 720497 - RNA, 22 nt, Human
aaagaacaucggagugggcggg

SEQ ID NO: 720498 - RNA, 22 nt, Human
uaacacauuuuccucauacgga

SEQ ID NO: 720499 - RNA, 22 nt, Human
gcacccaggccggcgacugcag

SEQ ID NO: 720500 - RNA, 22 nt, Human
ucccagauuguugauggcuuaa

SEQ ID NO: 720501 - RNA, 20 nt, Human
uggggccuguuucugugguu

SEQ ID NO: 720502 - RNA, 22 nt, Human
cccagacucaucccugggagcu

SEQ ID NO: 720503 - RNA, 22 nt, Human
caggcccagcccagcccuucga

SEQ ID NO: 720504 - RNA, 22 nt, Human
ugugauauuugaguauugucaa

SEQ ID NO: 720505 - RNA, 22 nt, Human
cuuauucagaaggagaaaugga

SEQ ID NO: 720506 - RNA, 22 nt, Human
aaagucaaaaugcucuccuguc

SEQ ID NO: 720507 - RNA, 22 nt, Human
ugaaccagagucuccagugguu

SEQ ID NO: 720508 - RNA, 21 nt, Human
aucucuucaaggcugauuuac

SEQ ID NO: 720509 - RNA, 22 nt, Human
uuacacuuggguguggauuuua

SEQ ID NO: 720510 - RNA, 22 nt, Human
agcugccuuuugagaaagcuca

SEQ ID NO: 720511 - RNA, 22 nt, Human
accaaaugcuuggcugcuguga

SEQ ID NO: 720512 - RNA, 23 nt, Human
cuuauucauucauguagcccauu

SEQ ID NO: 720513 - RNA, 22 nt, Human
ugccuggauucgguuguuguca

SEQ ID NO: 720514 - RNA, 22 nt, Human
agucuucagcagccuucucagg

SEQ ID NO: 720515 - RNA, 22 nt, Human
ggagccagaguuuaauguggag

SEQ ID NO: 720516 - RNA, 22 nt, Human
ucuuacauauacgucauuuagu

SEQ ID NO: 720517 - RNA, 22 nt, Human
ccagcuccucuugucucuagca

SEQ ID NO: 720518 - RNA, 22 nt, Human
gcucugagagagcaaagucacc

SEQ ID NO: 720519 - RNA, 22 nt, Human
aggucuccucauauucugccuc

SEQ ID NO: 720520 - RNA, 23 nt, Human
cccugcaucugucccucaccagu

SEQ ID NO: 720521 - RNA, 22 nt, Human
ugagaaaugggucugcugaaga

SEQ ID NO: 720522 - RNA, 22 nt, Human
aucaccugcacaaauguguucc

SEQ ID NO: 720523 - RNA, 22 nt, Human
acuuuuugcauaguaagugucu

SEQ ID NO: 720524 - RNA, 22 nt, Human
ucacacguccuugcuacuccuc

SEQ ID NO: 720525 - RNA, 22 nt, Human
ucccaaauauaaugcaagagac

SEQ ID NO: 720526 - RNA, 22 nt, Human
ucuaaagagaguggguacaugu

SEQ ID NO: 720527 - RNA, 22 nt, Human
cuucucuugguaguucuuguug

SEQ ID NO: 720528 - RNA, 22 nt, Human
ugagaaugccauaagagcuauu

SEQ ID NO: 720529 - RNA, 22 nt, Human
uuccuugagguauucaguuuua

SEQ ID NO: 720530 - RNA, 22 nt, Human
cagggugccucugcucccacca

SEQ ID NO: 720531 - RNA, 22 nt, Human
guaaaggcccauucaaacagcu

SEQ ID NO: 720532 - RNA, 22 nt, Human
agugauucccagacuuccuggg

SEQ ID NO: 720533 - RNA, 22 nt, Human
ugucauuuauucucuuauucua

SEQ ID NO: 720534 - RNA, 22 nt, Human
aggaagccaugguggacgucua

SEQ ID NO: 720535 - RNA, 22 nt, Human
uuacaaagcaggucagcugaaa

SEQ ID NO: 720536 - RNA, 22 nt, Human
gucuggagccacccuaagcauu

SEQ ID NO: 720537 - RNA, 22 nt, Human
cagcaucuguauccuaggcuga

SEQ ID NO: 720538 - RNA, 22 nt, Human
agggaguuagaaauccaggaua

SEQ ID NO: 720539 - RNA, 22 nt, Human
ugucagccuugcuuuagcgguu

SEQ ID NO: 720540 - RNA, 22 nt, Human
gucccuggguagcucaguggcu

SEQ ID NO: 720541 - RNA, 22 nt, Human
aagaagcagagcuguggguguu

SEQ ID NO: 720542 - RNA, 22 nt, Human
acugggccuacccagauuggca

SEQ ID NO: 720543 - RNA, 22 nt, Human
gcuucucaauucucacccucca

SEQ ID NO: 720544 - RNA, 22 nt, Human
cugcuuugcauagcugccagag

SEQ ID NO: 720545 - RNA, 22 nt, Human
gcccaucaucacuguggaggcu

SEQ ID NO: 720546 - RNA, 22 nt, Human
accugucaugucaauguucagu

SEQ ID NO: 720547 - RNA, 22 nt, Human
ugucaugaguuauuucauagga

SEQ ID NO: 720548 - RNA, 22 nt, Human
caggacagagcccagacugugu

SEQ ID NO: 720549 - RNA, 22 nt, Human
gacuguggggggcggacacaag

SEQ ID NO: 720550 - RNA, 22 nt, Human
cagugcugguguaggcugacca

SEQ ID NO: 720551 - RNA, 22 nt, Human
ucagagcagcauuuuacaggau

SEQ ID NO: 720552 - RNA, 22 nt, Human
gcauugguucaagguugugcag

SEQ ID NO: 720553 - RNA, 22 nt, Human
ugagguggcacacacuuccugc

SEQ ID NO: 720554 - RNA, 22 nt, Human
agcugccaggccccugagaacc

SEQ ID NO: 720555 - RNA, 22 nt, Human
cucugcuuuuuaaaaggagucc

SEQ ID NO: 720556 - RNA, 22 nt, Human
aacacugagcuauuacggugga

SEQ ID NO: 720557 - RNA, 22 nt, Human
acaguuuauaaaaauaaugagg

SEQ ID NO: 720558 - RNA, 22 nt, Human
aauuaggggaggacguaucaua

SEQ ID NO: 720559 - RNA, 22 nt, Human
ggcuggacugccucccagaguc

SEQ ID NO: 720560 - RNA, 22 nt, Human
ucaggagcuugguagugugauu

SEQ ID NO: 720561 - RNA, 22 nt, Human
auggaauuuggacuggaagucc

SEQ ID NO: 720562 - RNA, 22 nt, Human
guguccauucacugcaacacuu

SEQ ID NO: 720563 - RNA, 22 nt, Human
gguguagcucugugucccacug

SEQ ID NO: 720564 - RNA, 22 nt, Human
acaagaauuauuucuaguuaac

SEQ ID NO: 720565 - RNA, 22 nt, Human
ucuccaggccuuucccaucuua

SEQ ID NO: 720566 - RNA, 22 nt, Human
gcauuuguuugggcuaaucuua

SEQ ID NO: 720567 - RNA, 19 nt, Human
acagaaauguaagugagac

SEQ ID NO: 720568 - RNA, 23 nt, Human
cagcucagcacauaggagguacu

SEQ ID NO: 720569 - RNA, 22 nt, Human
agguaggauggguggagaugau

SEQ ID NO: 720570 - RNA, 22 nt, Human
ccccagcugagauuugaggaga

SEQ ID NO: 720571 - RNA, 22 nt, Human
uucccagacuccacacugaggc

SEQ ID NO: 720572 - RNA, 22 nt, Human
gcuucugaugucagacuucugg

SEQ ID NO: 720573 - RNA, 22 nt, Human
agccacagggggugagggacaa

SEQ ID NO: 720574 - RNA, 22 nt, Human
cauuaaacaaccuugaaucaau

SEQ ID NO: 720575 - RNA, 22 nt, Human
ggaggaaauccuuaguaaggca

SEQ ID NO: 720576 - RNA, 22 nt, Human
ggccugugcugucagcccuagu

SEQ ID NO: 720577 - RNA, 22 nt, Human
uuuuuaucuuguaugugucucu

SEQ ID NO: 720578 - RNA, 22 nt, Human
ugugacagccaguaaaguaagc

SEQ ID NO: 720579 - RNA, 22 nt, Human
gucccugacacccggguggagg

SEQ ID NO: 720580 - RNA, 18 nt, Human
ucuuuaaguugucagagu

SEQ ID NO: 720581 - RNA, 22 nt, Human
agucaguauuuauuacuuagcu

SEQ ID NO: 720582 - RNA, 22 nt, Human
gcagcuggggccacacuuaggc

SEQ ID NO: 720583 - RNA, 22 nt, Human
gaggagcugucaccgugacuca

SEQ ID NO: 720584 - RNA, 22 nt, Human
gcccugugagucaugcggcaga

SEQ ID NO: 720585 - RNA, 22 nt, Human
uggcaccaggcgggguggcugu

SEQ ID NO: 720586 - RNA, 22 nt, Human
uacagcuuuucauauuuguguu

SEQ ID NO: 720587 - RNA, 18 nt, Human
aggcaggcuggagugacu

SEQ ID NO: 720588 - RNA, 22 nt, Human
ggcuggcaccugcccuccgcug

SEQ ID NO: 720589 - RNA, 22 nt, Human
uccuggccucgcuguccaccuu

SEQ ID NO: 720590 - RNA, 22 nt, Human
cuuuaguuugcuguccccuggg

SEQ ID NO: 720591 - RNA, 22 nt, Human
caauagaaggcacagauaggua

SEQ ID NO: 720592 - RNA, 22 nt, Human
uccagcagagucucugaggggg

SEQ ID NO: 720593 - RNA, 22 nt, Human
cugagcaggauauucacagcag

SEQ ID NO: 720594 - RNA, 22 nt, Human
uauugcuuauaauuuguugcaa

SEQ ID NO: 720595 - RNA, 22 nt, Human
ccccugaagacaauggagaggu

SEQ ID NO: 720596 - RNA, 22 nt, Human
gggaggacgguccagggcaaag

SEQ ID NO: 720597 - RNA, 22 nt, Human
agcugcagcguucauuuuucca

SEQ ID NO: 720598 - RNA, 22 nt, Human
gggcuccaggagcccuaagaga

SEQ ID NO: 720599 - RNA, 22 nt, Human
cuguucuguaagcugcuguugu

SEQ ID NO: 720600 - RNA, 22 nt, Human
gcauucaucuuccuccaugcag

SEQ ID NO: 720601 - RNA, 22 nt, Human
ccaggucuaucaaguugggcuc

SEQ ID NO: 720602 - RNA, 22 nt, Human
agaaggaagccaggagggugca

SEQ ID NO: 720603 - RNA, 22 nt, Human
acucccagaacaugcucuucuu

SEQ ID NO: 720604 - RNA, 22 nt, Human
uggucccugaucuaaugucuca

SEQ ID NO: 720605 - RNA, 22 nt, Human
uucauucuuauuugugaucugg

SEQ ID NO: 720606 - RNA, 17 nt, Human
ggcuggagcagcucccc

SEQ ID NO: 720607 - RNA, 22 nt, Human
uuugcugugggauauccaugug

SEQ ID NO: 720608 - RNA, 22 nt, Human
aaucugaauauuuauguguauu

SEQ ID NO: 720609 - RNA, 22 nt, Human
accuggagaaagccucucccug

SEQ ID NO: 720610 - RNA, 22 nt, Human
cucuccagagcccuuccggccc

SEQ ID NO: 720611 - RNA, 22 nt, Human
ucagaauugauuuucaaaacag

SEQ ID NO: 720612 - RNA, 21 nt, Human
ugacauuuaguagcauuguca

SEQ ID NO: 720613 - RNA, 22 nt, Human
uuccuucuuccaaacccaucau

SEQ ID NO: 720614 - RNA, 22 nt, Human
guggagacuucuacuagagacc

SEQ ID NO: 720615 - RNA, 22 nt, Human
uccagccugguugcgggcaucc

SEQ ID NO: 720616 - RNA, 22 nt, Human
cauguauagguccauagugaau

SEQ ID NO: 720617 - RNA, 22 nt, Human
cagcuggaucugccucgagcca

SEQ ID NO: 720618 - RNA, 23 nt, Human
aaccugaacuagggucuugcaua

SEQ ID NO: 720619 - RNA, 22 nt, Human
cagaggcagaggucaucucugg

SEQ ID NO: 720620 - RNA, 22 nt, Human
ggucucagcuggaguccuuggu

SEQ ID NO: 720621 - RNA, 22 nt, Human
cagggcuugcaggagaaaguuu

SEQ ID NO: 720622 - RNA, 22 nt, Human
cccucucugcugcauagaggaa

SEQ ID NO: 720623 - RNA, 18 nt, Human
ugucuuuggaccacugaa

SEQ ID NO: 720624 - RNA, 22 nt, Human
ugagcagaaaagaaugcugagc

SEQ ID NO: 720625 - RNA, 22 nt, Human
uccugccucuugccuucuucac

SEQ ID NO: 720626 - RNA, 22 nt, Human
gggcuggauuacugaacugagu

SEQ ID NO: 720627 - RNA, 22 nt, Human
cagagcagaagcgguccucaca

SEQ ID NO: 720628 - RNA, 22 nt, Human
cauuuguuaauuacuauuaucu

SEQ ID NO: 720629 - RNA, 22 nt, Human
uucucuuaucuggcauuauugg

SEQ ID NO: 720630 - RNA, 22 nt, Human
uggcuucacccguccuccccac

SEQ ID NO: 720631 - RNA, 22 nt, Human
gaggccugguuuccagcauccu

SEQ ID NO: 720632 - RNA, 20 nt, Human
cccagagcacuuuuucaugu

SEQ ID NO: 720633 - RNA, 23 nt, Human
ucuauuacuuauuguacucugga

SEQ ID NO: 720634 - RNA, 22 nt, Human
uggauaaauggugcuaucaccc

SEQ ID NO: 720635 - RNA, 22 nt, Human
acacagcuagugaguggcagag

SEQ ID NO: 720636 - RNA, 22 nt, Human
uccugcagcugauaaauacagu

SEQ ID NO: 720637 - RNA, 21 nt, Human
ccaggcagagcugugaguucu

SEQ ID NO: 720638 - RNA, 21 nt, Human
ggccucugccuugccccacuc

SEQ ID NO: 720639 - RNA, 22 nt, Human
gagccuggauagccuuguucca

SEQ ID NO: 720640 - RNA, 21 nt, Human
ucaauacaggugcaugugucu

SEQ ID NO: 720641 - RNA, 22 nt, Human
aggcauucuagaaguagaagua

SEQ ID NO: 720642 - RNA, 22 nt, Human
auuuccauguccaaaaauuagu

SEQ ID NO: 720643 - RNA, 22 nt, Human
aauuauggaauuuuuagagaag

SEQ ID NO: 720644 - RNA, 22 nt, Human
caguccugaauacuggacggug

SEQ ID NO: 720645 - RNA, 22 nt, Human
agauguuuguguuaucuccauu

SEQ ID NO: 720646 - RNA, 22 nt, Human
caaaguccuagaacagugcuug

SEQ ID NO: 720647 - RNA, 22 nt, Human
cugggacauauugcuaguguug

SEQ ID NO: 720648 - RNA, 22 nt, Human
cagcaugagaaaaugaaucaga

SEQ ID NO: 720649 - RNA, 22 nt, Human
gggaccuggucuagcacugagc

SEQ ID NO: 720650 - RNA, 22 nt, Human
cacuggaccaaggaaacucuuc

SEQ ID NO: 720651 - RNA, 22 nt, Human
acaauuccugagaauacuuguu

SEQ ID NO: 720652 - RNA, 22 nt, Human
aggcugcccugccgccaguggg

SEQ ID NO: 720653 - RNA, 22 nt, Human
uccagccacuugcacaguuaaa

SEQ ID NO: 720654 - RNA, 22 nt, Human
gcuccucugucaaaugagagug

SEQ ID NO: 720655 - RNA, 22 nt, Human
ugccauggugacugcaggaggu

SEQ ID NO: 720656 - RNA, 22 nt, Human
gaagcaucagcaauggcuggaa

SEQ ID NO: 720657 - RNA, 22 nt, Human
agcaaagcaguggcuaagcuga

SEQ ID NO: 720658 - RNA, 22 nt, Human
ugccaggccaauucuauuugac

SEQ ID NO: 720659 - RNA, 22 nt, Human
ugggcuggcugaacuucaaccu

SEQ ID NO: 720660 - RNA, 22 nt, Human
aaacauuuuucuaggucuuggu

SEQ ID NO: 720661 - RNA, 22 nt, Human
cugccagcaaugugaccaugcu

SEQ ID NO: 720662 - RNA, 22 nt, Human
uggcccugccacucacugcuga

SEQ ID NO: 720663 - RNA, 22 nt, Human
gaauguccuccuggaucacucc

SEQ ID NO: 720664 - RNA, 21 nt, Human
acaggcucuggggaugcuggg

SEQ ID NO: 720665 - RNA, 22 nt, Human
ggagagaacuggcuccuucuag

SEQ ID NO: 720666 - RNA, 22 nt, Human
uuggaauugugaacuaagugau

SEQ ID NO: 720667 - RNA, 22 nt, Human
cuuaguuucucuguauguuuac

SEQ ID NO: 720668 - RNA, 20 nt, Human
cucagcagauucuucuagaa

SEQ ID NO: 720669 - RNA, 22 nt, Human
acuuuacaagcuuauagccuag

SEQ ID NO: 720670 - RNA, 22 nt, Human
uuaagagguggucgugucugug

SEQ ID NO: 720671 - RNA, 22 nt, Human
ggagucuguuuuacaugcagga

SEQ ID NO: 720672 - RNA, 22 nt, Human
aaugcacagcuaaagugguucc

SEQ ID NO: 720673 - RNA, 22 nt, Human
ugugaaauugagaaacuuucac

SEQ ID NO: 720674 - RNA, 22 nt, Human
uccuggcagcccgcaggugcug

SEQ ID NO: 720675 - RNA, 22 nt, Human
ucaggaguacuggugucuacag

SEQ ID NO: 720676 - RNA, 19 nt, Human
ucaggcaguuauucacaaa

SEQ ID NO: 720677 - RNA, 22 nt, Human
ccugucacauauuugcuguuca

SEQ ID NO: 720678 - RNA, 22 nt, Human
auucuggguucaugagugagcu

SEQ ID NO: 720679 - RNA, 22 nt, Human
cagcagaguaggugcuacuucu

SEQ ID NO: 720680 - RNA, 23 nt, Human
caggaaauguucuugaagccuga

SEQ ID NO: 720681 - RNA, 22 nt, Human
acuguugaagugccagcuugau

SEQ ID NO: 720682 - RNA, 22 nt, Human
ucuugacauucaaucauguaua

SEQ ID NO: 720683 - RNA, 22 nt, Human
ugugaaauucuugaaaugcaca

SEQ ID NO: 720684 - RNA, 22 nt, Human
uccaugugcuuccucaggggaa

SEQ ID NO: 720685 - RNA, 22 nt, Human
gagggccuggcacagggaggcu

SEQ ID NO: 720686 - RNA, 22 nt, Human
ggucugagauauuuguucagcu

SEQ ID NO: 720687 - RNA, 22 nt, Human
ccugaggaugccagcaugggug

SEQ ID NO: 720688 - RNA, 17 nt, Human
aggauguggagaaaauu

SEQ ID NO: 720689 - RNA, 22 nt, Human
uuuuucaagacaaccugcaugu

SEQ ID NO: 720690 - RNA, 20 nt, Human
ugugugaauuagggcauguu

SEQ ID NO: 720691 - RNA, 22 nt, Human
auucugcuaguaacagaugaag

SEQ ID NO: 720692 - RNA, 18 nt, Human
uccccugcucuggugcuc

SEQ ID NO: 720693 - RNA, 22 nt, Human
agccaggacagggcagcucgcu

SEQ ID NO: 720694 - RNA, 19 nt, Human
uuugugaagaaaaugaugc

SEQ ID NO: 720695 - RNA, 22 nt, Human
caguguuuugagaagggcacgu

SEQ ID NO: 720696 - RNA, 22 nt, Human
aagccaaggagaauggccucag

SEQ ID NO: 720697 - RNA, 22 nt, Human
uaaauguggagacucaggaguc

SEQ ID NO: 720698 - RNA, 22 nt, Human
ccacagcuucgcagucugcugc

SEQ ID NO: 720699 - RNA, 22 nt, Human
uucaugcuuguuccuccaccug

SEQ ID NO: 720700 - RNA, 19 nt, Human
ucugcagaggaauucuuca

SEQ ID NO: 720701 - RNA, 22 nt, Human
caggcgggacgugggaggauca

SEQ ID NO: 720702 - RNA, 23 nt, Human
gugcuuuaugaucugcugucccu

SEQ ID NO: 720703 - RNA, 23 nt, Human
uaacaauggacuccucuuagcua

SEQ ID NO: 720704 - RNA, 22 nt, Human
gugcuuaaccuaguuucuagua

SEQ ID NO: 720705 - RNA, 19 nt, Human
auuccucaaggacagaaau

SEQ ID NO: 720706 - RNA, 22 nt, Human
gauacauuucaaggaggacugg

SEQ ID NO: 720707 - RNA, 22 nt, Human
caggaacauuguagaauugaaa

SEQ ID NO: 720708 - RNA, 21 nt, Human
cauugagauaggagagauugu

SEQ ID NO: 720709 - RNA, 22 nt, Human
gucugccuuuaucaucuccuua

SEQ ID NO: 720710 - RNA, 22 nt, Human
cagccccucccucaggcaggug

SEQ ID NO: 720711 - RNA, 22 nt, Human
aacaaugcaguuaaugggaaga

SEQ ID NO: 720712 - RNA, 22 nt, Human
ucaguugcaugggaaguucaga

SEQ ID NO: 720713 - RNA, 22 nt, Human
auuucuuaugaauauugacugu

SEQ ID NO: 720714 - RNA, 22 nt, Human
cugcuuuaaaacccucagcugg

SEQ ID NO: 720715 - RNA, 22 nt, Human
auauuugugguuuuuggcuccu

SEQ ID NO: 720716 - RNA, 22 nt, Human
cucagggacuuggauccuggcc

SEQ ID NO: 720717 - RNA, 22 nt, Human
acaggaguagggcugguggaga

SEQ ID NO: 720718 - RNA, 22 nt, Human
cagauugagucugggaaaaggc

SEQ ID NO: 720719 - RNA, 22 nt, Human
cugccacucugggugggccugg

SEQ ID NO: 720720 - RNA, 22 nt, Human
uaaugcacaugacugaacuauu

SEQ ID NO: 720721 - RNA, 22 nt, Human
aaagcuuuguaaauaaacaggu

SEQ ID NO: 720722 - RNA, 22 nt, Human
aaagguuuauuuguugcucaca

SEQ ID NO: 720723 - RNA, 19 nt, Human
ggcagaagguguaggggga

SEQ ID NO: 720724 - RNA, 22 nt, Human
cauagcaacagcaucaagucaa

SEQ ID NO: 720725 - RNA, 22 nt, Human
aaagugcaguaacuugcccaag

SEQ ID NO: 720726 - RNA, 22 nt, Human
aaagguuaagguguucaagaaa

SEQ ID NO: 720727 - RNA, 23 nt, Human
auuuacagguuaaaugaaaucag

SEQ ID NO: 720728 - RNA, 22 nt, Human
uugcauaugaagcugacuuaaa

SEQ ID NO: 720729 - RNA, 22 nt, Human
cugagcagugguucuugagcgc

SEQ ID NO: 720730 - RNA, 22 nt, Human
uuccuugguacagaguagcuuu

SEQ ID NO: 720731 - RNA, 22 nt, Human
augugagcuccggcagguggaa

SEQ ID NO: 720732 - RNA, 22 nt, Human
gcagcuggcucugggaaaaacu

SEQ ID NO: 720733 - RNA, 22 nt, Human
ugcagcuccugugcugagugug

SEQ ID NO: 720734 - RNA, 22 nt, Human
uaggggugggauccaggaauua

SEQ ID NO: 720735 - RNA, 22 nt, Human
gaagcagugugaacccauguaa

SEQ ID NO: 720736 - RNA, 22 nt, Human
acaguguagaauccuguacuua

SEQ ID NO: 720737 - RNA, 22 nt, Human
ucucacugcaaauauuauguau

SEQ ID NO: 720738 - RNA, 22 nt, Human
gcaaugucugcaaugggugugg

SEQ ID NO: 720739 - RNA, 22 nt, Human
uuuccucuaaacgcauuugcuu

SEQ ID NO: 720740 - RNA, 22 nt, Human
gcaucauuuucuucuuccugca

SEQ ID NO: 720741 - RNA, 22 nt, Human
uacagaaauacugggggguucu

SEQ ID NO: 720742 - RNA, 22 nt, Human
aaacuugggugacccugagcaa

SEQ ID NO: 720743 - RNA, 22 nt, Human
agcuccugucucaagggagccu

SEQ ID NO: 720744 - RNA, 22 nt, Human
caggaacagcaccaggagcuag

SEQ ID NO: 720745 - RNA, 22 nt, Human
ucagcugccucucccuggaaga

SEQ ID NO: 720746 - RNA, 18 nt, Human
agggcugaugaguuuggg

SEQ ID NO: 720747 - RNA, 22 nt, Human
ucuuucagaaacuuugucugcg

SEQ ID NO: 720748 - RNA, 22 nt, Human
cagaggaagagauacaagcccu

SEQ ID NO: 720749 - RNA, 22 nt, Human
uccuuguaaaggagcucuaaca

SEQ ID NO: 720750 - RNA, 22 nt, Human
cuggcuuccaccauggccccug

SEQ ID NO: 720751 - RNA, 22 nt, Human
cauggcuugcuaguggcccaag

SEQ ID NO: 720752 - RNA, 22 nt, Human
ugaguaggugguuaagcaugga

SEQ ID NO: 720753 - RNA, 22 nt, Human
ugaggcaggacauggacaacug

SEQ ID NO: 720754 - RNA, 20 nt, Human
auguccuguugcugccccag

SEQ ID NO: 720755 - RNA, 22 nt, Human
aaacuucaacuggaaugggcua

SEQ ID NO: 720756 - RNA, 22 nt, Human
ugcagggaagcaaggguggcuc

SEQ ID NO: 720757 - RNA, 22 nt, Human
cugugcuuaccugcccagguga

SEQ ID NO: 720758 - RNA, 21 nt, Human
uucauaaaccauucucaugca

SEQ ID NO: 720759 - RNA, 22 nt, Human
acugucacuaacuaagucuagu

SEQ ID NO: 720760 - RNA, 22 nt, Human
ucaguccuacacgcucagggac

SEQ ID NO: 720761 - RNA, 22 nt, Human
acagacuuguucccuagugagu

SEQ ID NO: 720762 - RNA, 22 nt, Human
cagauauauuuuauuuggucaa

SEQ ID NO: 720763 - RNA, 22 nt, Human
uuuguuuugaacuagcucagaa

SEQ ID NO: 720764 - RNA, 22 nt, Human
auggagagagaaggcuugcugu

SEQ ID NO: 720765 - RNA, 22 nt, Human
ucccagagcaguacuccaggag

SEQ ID NO: 720766 - RNA, 22 nt, Human
ucaugcagauaagaauaaguaa

SEQ ID NO: 720767 - RNA, 22 nt, Human
gggucagagccguaacaggacu

SEQ ID NO: 720768 - RNA, 22 nt, Human
gauuuuucaguauaaaauauau

SEQ ID NO: 720769 - RNA, 22 nt, Human
acucuguagccuguaagagagc

SEQ ID NO: 720770 - RNA, 23 nt, Human
cacaacuaaucagaaucucuagg

SEQ ID NO: 720771 - RNA, 22 nt, Human
cuaaaugcccuacaaugacugg

SEQ ID NO: 720772 - RNA, 18 nt, Human
uuguagcaaauggcagug

SEQ ID NO: 720773 - RNA, 22 nt, Human
ggccucugccccagccacaccu

SEQ ID NO: 720774 - RNA, 22 nt, Human
aaaccuauuggcaagaauaaua

SEQ ID NO: 720775 - RNA, 22 nt, Human
ccccaccugugcgucugccgca

SEQ ID NO: 720776 - RNA, 22 nt, Human
aguguuuaccccaaucaguuua

SEQ ID NO: 720777 - RNA, 22 nt, Human
ucuguguuugccauccuugcuc

SEQ ID NO: 720778 - RNA, 22 nt, Human
uagagcugaguugacuccauuu

SEQ ID NO: 720779 - RNA, 22 nt, Human
acaguguuuugucuggcagggc

SEQ ID NO: 720780 - RNA, 22 nt, Human
gugggccuugcagggugcaggg

SEQ ID NO: 720781 - RNA, 22 nt, Human
caacuuuaugauugguuuguca

SEQ ID NO: 720782 - RNA, 22 nt, Human
uuucaaaggaggcugagaggau

SEQ ID NO: 720783 - RNA, 22 nt, Human
acaguguguuggaggagacugu

SEQ ID NO: 720784 - RNA, 22 nt, Human
agcugccuggccggagccacug

SEQ ID NO: 720785 - RNA, 22 nt, Human
augagauaggaacaaacuuaca

SEQ ID NO: 720786 - RNA, 22 nt, Human
cagcauaucugaguugaaagag

SEQ ID NO: 720787 - RNA, 22 nt, Human
aacuucuaaucuguacaguuuu

SEQ ID NO: 720788 - RNA, 22 nt, Human
guggugcaggugucacugcaga

SEQ ID NO: 720789 - RNA, 21 nt, Human
auguccuggcuaccagcgcag

SEQ ID NO: 720790 - RNA, 22 nt, Human
gaaugaauagguguccagaugg

SEQ ID NO: 720791 - RNA, 22 nt, Human
gcccuuggaacagccuccugcu

SEQ ID NO: 720792 - RNA, 22 nt, Human
ugaaugauuucuuaggcaauug

SEQ ID NO: 720793 - RNA, 22 nt, Human
cugaggaagagguaccauuugu

SEQ ID NO: 720794 - RNA, 22 nt, Human
cucucucuuguguugcugcaga

SEQ ID NO: 720795 - RNA, 22 nt, Human
cucaggucgcuauuucucuuac

SEQ ID NO: 720796 - RNA, 22 nt, Human
cuggagagaaaugacaaagcua

SEQ ID NO: 720797 - RNA, 22 nt, Human
augcagggaccuuugcuuuggu

SEQ ID NO: 720798 - RNA, 22 nt, Human
gauguucuagaagugugguguu

SEQ ID NO: 720799 - RNA, 22 nt, Human
aggccagacagcuagaaacagg

SEQ ID NO: 720800 - RNA, 22 nt, Human
ucaggaacauaaugugagucag

SEQ ID NO: 720801 - RNA, 22 nt, Human
uggaacacaucuaaggaagcag

SEQ ID NO: 720802 - RNA, 22 nt, Human
augaggucacaguguuuggcau

SEQ ID NO: 720803 - RNA, 22 nt, Human
guccugugcccuggguggcgcu

SEQ ID NO: 720804 - RNA, 22 nt, Human
augcacacaagcuuauguauua

SEQ ID NO: 720805 - RNA, 22 nt, Human
aaaacugaaccuugagaucuuu

SEQ ID NO: 720806 - RNA, 23 nt, Human
gcugagguacauuuacaggaaga

SEQ ID NO: 720807 - RNA, 22 nt, Human
aaugcuuauggguuccauaaua

SEQ ID NO: 720808 - RNA, 22 nt, Human
gucuuauuagguuaacccugcu

SEQ ID NO: 720809 - RNA, 22 nt, Human
ccaggaaggccuggaugccccc

SEQ ID NO: 720810 - RNA, 22 nt, Human
augauacaucuucaugucagug

SEQ ID NO: 720811 - RNA, 23 nt, Human
augcaacauugccaguaugggca

SEQ ID NO: 720812 - RNA, 22 nt, Human
uccuggcuggaauuucucacuc

SEQ ID NO: 720813 - RNA, 22 nt, Human
gugugagagacugaagaaagcc

SEQ ID NO: 720814 - RNA, 22 nt, Human
auacacuucauguuuucaucug

SEQ ID NO: 720815 - RNA, 23 nt, Human
caauuguauaaagcaaaugguuu

SEQ ID NO: 720816 - RNA, 22 nt, Human
aacaucagaauauccauguugg

SEQ ID NO: 720817 - RNA, 22 nt, Human
gcccgcagagaucuuuaacaaa

SEQ ID NO: 720818 - RNA, 22 nt, Human
cagcugccccauaaaucacagu

SEQ ID NO: 720819 - RNA, 18 nt, Human
uggcucuggacuugcucc

SEQ ID NO: 720820 - RNA, 22 nt, Human
ugacacugaccuaaagaccugg

SEQ ID NO: 720821 - RNA, 22 nt, Human
aggaagcgugggucuggcugga

SEQ ID NO: 720822 - RNA, 18 nt, Human
ccuggcacacuggcucau

SEQ ID NO: 720823 - RNA, 22 nt, Human
aaaacaguuuuugcuaacugcu

SEQ ID NO: 720824 - RNA, 22 nt, Human
auauucuuauccuuuucucugu

SEQ ID NO: 720825 - RNA, 22 nt, Human
gcuggcagggacagcugcgugu

SEQ ID NO: 720826 - RNA, 22 nt, Human
acccucagcuucuuggauuaau

SEQ ID NO: 720827 - RNA, 22 nt, Human
uggauauguuggaggugaaggu

SEQ ID NO: 720828 - RNA, 19 nt, Human
ucugggaagccgggcucca

SEQ ID NO: 720829 - RNA, 22 nt, Human
cauagauucuuauuuccaucuu

SEQ ID NO: 720830 - RNA, 22 nt, Human
aggaccuguagggccugcaucc

SEQ ID NO: 720831 - RNA, 22 nt, Human
gcugcuccgucugagcucuggu

SEQ ID NO: 720832 - RNA, 22 nt, Human
cagcaggcaggugggccaaguc

SEQ ID NO: 720833 - RNA, 22 nt, Human
ccucuggacuugggacagugag

SEQ ID NO: 720834 - RNA, 22 nt, Human
auuuauugagagggaggggaau

SEQ ID NO: 720835 - RNA, 22 nt, Human
uggcaggaaaguaacagagcac

SEQ ID NO: 720836 - RNA, 22 nt, Human
uucuguuacuguuggucauaac

SEQ ID NO: 720837 - RNA, 22 nt, Human
agaaaguuguuuuagccaaacc

SEQ ID NO: 720838 - RNA, 23 nt, Human
acagccuucuggggcuucugggc

SEQ ID NO: 720839 - RNA, 22 nt, Human
ucacagugacuuacagagauug

SEQ ID NO: 720840 - RNA, 23 nt, Human
uggccucuccccaccuggcagaa

SEQ ID NO: 720841 - RNA, 22 nt, Human
aaacacuuccuguaacaugaca

SEQ ID NO: 720842 - RNA, 22 nt, Human
agcccagcugcuauguaccugg

SEQ ID NO: 720843 - RNA, 23 nt, Human
gccuucagcucgggaaggcuccc

SEQ ID NO: 720844 - RNA, 22 nt, Human
augaggucuggcaaucagaaac

SEQ ID NO: 720845 - RNA, 22 nt, Human
gaucuucucuuuaguagaaaca

SEQ ID NO: 720846 - RNA, 22 nt, Human
ccuguacauuagcugugaauug

SEQ ID NO: 720847 - RNA, 22 nt, Human
ccuggggcuuucuuuguaucau

SEQ ID NO: 720848 - RNA, 22 nt, Human
ugccuggcaucuagcccuggga

SEQ ID NO: 720849 - RNA, 22 nt, Human
uucaaugagcccggggccauag

SEQ ID NO: 720850 - RNA, 22 nt, Human
uugccaggagacaucuggagcc

SEQ ID NO: 720851 - RNA, 22 nt, Human
cagguaggaggcucccuagucc

SEQ ID NO: 720852 - RNA, 22 nt, Human
agggucugacugaauggaaaag

SEQ ID NO: 720853 - RNA, 22 nt, Human
gcuuucuguggugauguaaagg

SEQ ID NO: 720854 - RNA, 22 nt, Human
ucccaaagucaagcugugucuu

SEQ ID NO: 720855 - RNA, 22 nt, Human
ugaaugauacagaauuauguag

SEQ ID NO: 720856 - RNA, 22 nt, Human
ugccuuccuggagcugaaggcu

SEQ ID NO: 720857 - RNA, 22 nt, Human
aaacucaagucuaugaacaagg

SEQ ID NO: 720858 - RNA, 22 nt, Human
ucugggcuuuaagaacucuguu

SEQ ID NO: 720859 - RNA, 22 nt, Human
ucuggccacccgaggccccugc

SEQ ID NO: 720860 - RNA, 22 nt, Human
aggaccugaaauucuugcuuuu

SEQ ID NO: 720861 - RNA, 22 nt, Human
uggcuucauuauuguuuuuccu

SEQ ID NO: 720862 - RNA, 22 nt, Human
gccagccaagauugagaaggua

SEQ ID NO: 720863 - RNA, 21 nt, Human
gugugucuaauguaguggaaa

SEQ ID NO: 720864 - RNA, 22 nt, Human
cuugagcuaggaaggcugaggc

SEQ ID NO: 720865 - RNA, 22 nt, Human
ccucagugcguacugaacagug

SEQ ID NO: 720866 - RNA, 22 nt, Human
ugauuucaaguagugacaugcu

SEQ ID NO: 720867 - RNA, 22 nt, Human
aggacacacugcaagagccugg

SEQ ID NO: 720868 - RNA, 22 nt, Human
uccagcccucuggcccgcggug

SEQ ID NO: 720869 - RNA, 22 nt, Human
agaaguuugguccuauaaacuc

SEQ ID NO: 720870 - RNA, 22 nt, Human
cugcagauuggccugauguuca

SEQ ID NO: 720871 - RNA, 22 nt, Human
uacaaguauggaaugauucuca

SEQ ID NO: 720872 - RNA, 22 nt, Human
guguuauuagagcauuaauuuu

SEQ ID NO: 720873 - RNA, 22 nt, Human
ucuucuccauaaucaacacucu

SEQ ID NO: 720874 - RNA, 22 nt, Human
ccagugcaccauuucccucugu

SEQ ID NO: 720875 - RNA, 22 nt, Human
cagcgucucguugugggccucg

SEQ ID NO: 720876 - RNA, 22 nt, Human
gccaaaucuggauuuagcaaga

SEQ ID NO: 720877 - RNA, 22 nt, Human
cccaaggcauggcaugguggca

SEQ ID NO: 720878 - RNA, 22 nt, Human
uuaauuguaaaguuugccuguu

SEQ ID NO: 720879 - RNA, 22 nt, Human
aauuuguuuucaagucacugga

SEQ ID NO: 720880 - RNA, 22 nt, Human
gugcauguuaaugguguacaaa

SEQ ID NO: 720881 - RNA, 22 nt, Human
cccugagaacaacuuagggguc

SEQ ID NO: 720882 - RNA, 21 nt, Human
agagaagaggacuuucucaca

SEQ ID NO: 720883 - RNA, 22 nt, Human
gucuuauuuaaggacaagaaga

SEQ ID NO: 720884 - RNA, 22 nt, Human
uacaguaucuucuggcaagcau

SEQ ID NO: 720885 - RNA, 22 nt, Human
ccagugcgagccugugcuggcc

SEQ ID NO: 720886 - RNA, 22 nt, Human
uccuggccacccgacagaaguc

SEQ ID NO: 720887 - RNA, 17 nt, Human
uauguaguacuuauaaa

SEQ ID NO: 720888 - RNA, 22 nt, Human
gaggccacuuccuacuggagga

SEQ ID NO: 720889 - RNA, 22 nt, Human
gaguggggucugggcaucaguc

SEQ ID NO: 720890 - RNA, 20 nt, Human
ugcuccaucuaaagugauua

SEQ ID NO: 720891 - RNA, 22 nt, Human
augcugaaggccauccugcauc

SEQ ID NO: 720892 - RNA, 22 nt, Human
aauaguucuagcucagaagcuc

SEQ ID NO: 720893 - RNA, 22 nt, Human
ugaaacaagggccaugggaaac

SEQ ID NO: 720894 - RNA, 22 nt, Human
auaguaaauuaucguggagaga

SEQ ID NO: 720895 - RNA, 22 nt, Human
uagcugagagcucacuugagga

SEQ ID NO: 720896 - RNA, 22 nt, Human
cccaggcuggagggcaguguca

SEQ ID NO: 720897 - RNA, 22 nt, Human
ucauuuuucucuuacacguaga

SEQ ID NO: 720898 - RNA, 23 nt, Human
uggcagcagaucuuaaagugacc

SEQ ID NO: 720899 - RNA, 17 nt, Human
agauggcaggaggcaga

SEQ ID NO: 720900 - RNA, 22 nt, Human
auuugcuuguaaauguaugccu

SEQ ID NO: 720901 - RNA, 23 nt, Human
guaggaauuuucacuuccucuug

SEQ ID NO: 720902 - RNA, 22 nt, Human
uggcacuuuacacccauuuggc

SEQ ID NO: 720903 - RNA, 22 nt, Human
gcugggaggaauuuggggaaua

SEQ ID NO: 720904 - RNA, 22 nt, Human
uuaauuaauuaguuaagcaugu

SEQ ID NO: 720905 - RNA, 22 nt, Human
ggccuuccuucccagccuacug

SEQ ID NO: 720906 - RNA, 22 nt, Human
ugcauuguaggauguuuagcag

SEQ ID NO: 720907 - RNA, 17 nt, Human
gcccaggaaggacggcc

SEQ ID NO: 720908 - RNA, 22 nt, Human
ucugccugcgcucacggggccg

SEQ ID NO: 720909 - RNA, 22 nt, Human
gauacagaaaggcugcauugag

SEQ ID NO: 720910 - RNA, 22 nt, Human
gcaugcagacagucugagacca

SEQ ID NO: 720911 - RNA, 22 nt, Human
guuucuggcgccggggcaggcc

SEQ ID NO: 720912 - RNA, 20 nt, Human
aggcugagggugauuguguc

SEQ ID NO: 720913 - RNA, 22 nt, Human
gagcugggcgagccggggaagu

SEQ ID NO: 720914 - RNA, 22 nt, Human
ccaggugggaggaaagcagaga

SEQ ID NO: 720915 - RNA, 16 nt, Human
uugcaaggcguuuaua

SEQ ID NO: 720916 - RNA, 22 nt, Human
aauacagaggggucacaauuca

SEQ ID NO: 720917 - RNA, 22 nt, Human
gcagcaucuagggcacuggccu

SEQ ID NO: 720918 - RNA, 20 nt, Human
uauuaugaccuguguucugg

SEQ ID NO: 720919 - RNA, 22 nt, Human
guccuuggagcuccccucugua

SEQ ID NO: 720920 - RNA, 22 nt, Human
aguguccuugauuccuguuguu

SEQ ID NO: 720921 - RNA, 22 nt, Human
caguguuucugugcccaguggg

SEQ ID NO: 720922 - RNA, 22 nt, Human
gugccaaaagcuauaauuuggu

SEQ ID NO: 720923 - RNA, 22 nt, Human
uugcagcugugagcuuuacacg

SEQ ID NO: 720924 - RNA, 22 nt, Human
ucuccagggugagcuaggccag

SEQ ID NO: 720925 - RNA, 22 nt, Human
uucugccaaaggcuuuguuuug

SEQ ID NO: 720926 - RNA, 22 nt, Human
ucagcccaggaaugagccuucu

SEQ ID NO: 720927 - RNA, 22 nt, Human
ugugggaggauucagaauuggg

SEQ ID NO: 720928 - RNA, 22 nt, Human
gggcugaguuccugccucacuc

SEQ ID NO: 720929 - RNA, 22 nt, Human
ugaaucaguauaaauucucaaa

SEQ ID NO: 720930 - RNA, 22 nt, Human
cagcuucauguccagguacugu

SEQ ID NO: 720931 - RNA, 23 nt, Human
agcuucaucuugcugugucucag

SEQ ID NO: 720932 - RNA, 22 nt, Human
gcgcaggagccgcggagggccg

SEQ ID NO: 720933 - RNA, 22 nt, Human
aaauuggcaguucagggaauua

SEQ ID NO: 720934 - RNA, 22 nt, Human
gcagugaagauggcagguuggg

SEQ ID NO: 720935 - RNA, 20 nt, Human
acauccuggugacuagaacu

SEQ ID NO: 720936 - RNA, 22 nt, Human
aaaugccucugcuguacacaau

SEQ ID NO: 720937 - RNA, 22 nt, Human
cacagucccauucgagaguaau

SEQ ID NO: 720938 - RNA, 22 nt, Human
ucacagaagcaucauacccgga

SEQ ID NO: 720939 - RNA, 22 nt, Human
ggcaguggcuccucucuacucc

SEQ ID NO: 720940 - RNA, 22 nt, Human
caucuuauuuucuucuagugcu

SEQ ID NO: 720941 - RNA, 19 nt, Human
cauacaauuaccauaggau

SEQ ID NO: 720942 - RNA, 22 nt, Human
gugggcagacaugauagaagga

SEQ ID NO: 720943 - RNA, 22 nt, Human
cuggcugccagcauuuggggga

SEQ ID NO: 720944 - RNA, 22 nt, Human
aagacacuaagcuuucaggaua

SEQ ID NO: 720945 - RNA, 22 nt, Human
ccugggauuuccugagcacucu

SEQ ID NO: 720946 - RNA, 22 nt, Human
uuacuugaaaaccaccaguauu

SEQ ID NO: 720947 - RNA, 20 nt, Human
cccagcccgggccgcgcucg

SEQ ID NO: 720948 - RNA, 22 nt, Human
uugggguaaaaugucguaagag

SEQ ID NO: 720949 - RNA, 22 nt, Human
gccucugcgccucagccgaccu

SEQ ID NO: 720950 - RNA, 22 nt, Human
acacagcuucaaagucuaauuc

SEQ ID NO: 720951 - RNA, 22 nt, Human
aauaagcugcuaggaacuuagu

SEQ ID NO: 720952 - RNA, 22 nt, Human
ucagggacauuuagacacugau

SEQ ID NO: 720953 - RNA, 22 nt, Human
gaugcugugguaagccccaccg

SEQ ID NO: 720954 - RNA, 20 nt, Human
cuccaaggcuugcaggaggc

SEQ ID NO: 720955 - RNA, 22 nt, Human
acagcagaguugaguaguugca

SEQ ID NO: 720956 - RNA, 22 nt, Human
uauauagaaaagcagauguugg

SEQ ID NO: 720957 - RNA, 22 nt, Human
agggcugaaguuauggcugagc

SEQ ID NO: 720958 - RNA, 22 nt, Human
uccucccugaguggggacagcu

SEQ ID NO: 720959 - RNA, 22 nt, Human
cuggagauaaguaaagaggcaa

SEQ ID NO: 720960 - RNA, 22 nt, Human
agaauaaaucaaauguccugag

SEQ ID NO: 720961 - RNA, 21 nt, Human
gccucugcugucuuauuguga

SEQ ID NO: 720962 - RNA, 18 nt, Human
ggagccagucugucucug

SEQ ID NO: 720963 - RNA, 22 nt, Human
ucacagccuggucacucugccc

SEQ ID NO: 720964 - RNA, 22 nt, Human
ugcccaggauugugaggucagg

SEQ ID NO: 720965 - RNA, 22 nt, Human
cucuccagccacagaagcugcu

SEQ ID NO: 720966 - RNA, 22 nt, Human
acagugauuucauccuucuggg

SEQ ID NO: 720967 - RNA, 22 nt, Human
agauacagccugccagguucuu

SEQ ID NO: 720968 - RNA, 22 nt, Human
gaccucagauuuucccaggcca

SEQ ID NO: 720969 - RNA, 18 nt, Human
acauuucucucugcguga

SEQ ID NO: 720970 - RNA, 22 nt, Human
acugccuggcagagguuugcaa

SEQ ID NO: 720971 - RNA, 22 nt, Human
cuggaaggagcccgggcggauc

SEQ ID NO: 720972 - RNA, 22 nt, Human
guggcacaggguuguuggucau

SEQ ID NO: 720973 - RNA, 22 nt, Human
caguagcacuagauaugugugg

SEQ ID NO: 720974 - RNA, 22 nt, Human
ggugaauaagcugaacacuugg

SEQ ID NO: 720975 - RNA, 22 nt, Human
ugggcuacucugggagccuaac

SEQ ID NO: 720976 - RNA, 22 nt, Human
uuucuucuuucccagugauggg

SEQ ID NO: 720977 - RNA, 22 nt, Human
ugcuucugacugggucaguuga

SEQ ID NO: 720978 - RNA, 22 nt, Human
aggcacuguucccaguuauccu

SEQ ID NO: 720979 - RNA, 19 nt, Human
cugggacuccugauaccuu

SEQ ID NO: 720980 - RNA, 22 nt, Human
gcugagccaugaggccucuugc

SEQ ID NO: 720981 - RNA, 22 nt, Human
cugucacugaugcuccugccac

SEQ ID NO: 720982 - RNA, 23 nt, Human
acagaaaguucugcuggacagag

SEQ ID NO: 720983 - RNA, 22 nt, Human
cuggcuggccaugcagcgccag

SEQ ID NO: 720984 - RNA, 22 nt, Human
cuguuggaugguuuccaaaaga

SEQ ID NO: 720985 - RNA, 22 nt, Human
ggagggcaucaaucaggccugg

SEQ ID NO: 720986 - RNA, 22 nt, Human
acagauuuuaaaugacacuccc

SEQ ID NO: 720987 - RNA, 22 nt, Human
aggacagggauucaaacuccca

SEQ ID NO: 720988 - RNA, 17 nt, Human
caguggcagaucuucuc

SEQ ID NO: 720989 - RNA, 22 nt, Human
ugcagccaucgcagagucugua

SEQ ID NO: 720990 - RNA, 22 nt, Human
caugcuggucagccaguggaug

SEQ ID NO: 720991 - RNA, 22 nt, Human
cuugauggaggggccaggcuuu

SEQ ID NO: 720992 - RNA, 22 nt, Human
uggcagugaugcggcaggacau

SEQ ID NO: 720993 - RNA, 22 nt, Human
guuaauuuaguagaguccagau

SEQ ID NO: 720994 - RNA, 22 nt, Human
gcucuguuaacaguccagcuuu

SEQ ID NO: 720995 - RNA, 22 nt, Human
cugucaucacaguugagcagcc

SEQ ID NO: 720996 - RNA, 22 nt, Human
augcuucuguguauguuucagg

SEQ ID NO: 720997 - RNA, 22 nt, Human
aagcccuggauuaaagaugcca

SEQ ID NO: 720998 - RNA, 20 nt, Human
uccuucagacuuuggaguug

SEQ ID NO: 720999 - RNA, 22 nt, Human
agucugaguaucucugagccag

SEQ ID NO: 721000 - RNA, 22 nt, Human
aggaacaacugauucagucaac

SEQ ID NO: 721001 - RNA, 22 nt, Human
gacagcuuaggaaguuucuauu

SEQ ID NO: 721002 - RNA, 22 nt, Human
cugggagaauuuguugaaggau

SEQ ID NO: 721003 - RNA, 22 nt, Human
gcugugagcacugcugggugga

SEQ ID NO: 721004 - RNA, 22 nt, Human
agggcucaguaaacgguggauu

SEQ ID NO: 721005 - RNA, 22 nt, Human
ggcuuuugaauuccaaggcauu

SEQ ID NO: 721006 - RNA, 22 nt, Human
ucaggaacauuuaaccacaggg

SEQ ID NO: 721007 - RNA, 21 nt, Human
ugcugcugaucgggguuggcu

SEQ ID NO: 721008 - RNA, 22 nt, Human
guuaaccaaggcaccaagugua

SEQ ID NO: 721009 - RNA, 22 nt, Human
aaaggauuagagauaccaugcc

SEQ ID NO: 721010 - RNA, 22 nt, Human
ggucccaugaaagagggaggcc

SEQ ID NO: 721011 - RNA, 22 nt, Human
gggcacagagaagguuuuagug

SEQ ID NO: 721012 - RNA, 22 nt, Human
ucucagaaaugacaggagguac

SEQ ID NO: 721013 - RNA, 22 nt, Human
ucaggucuauagaagaggaggg

SEQ ID NO: 721014 - RNA, 22 nt, Human
cucccagccuucgccagucuga

SEQ ID NO: 721015 - RNA, 21 nt, Human
gccaccccuggcacaggugcu

SEQ ID NO: 721016 - RNA, 22 nt, Human
aaguauuucuggccugugaaag

SEQ ID NO: 721017 - RNA, 22 nt, Human
ggcuggcucagggcuugagaga

SEQ ID NO: 721018 - RNA, 22 nt, Human
accagggcggcuugaggaggca

SEQ ID NO: 721019 - RNA, 22 nt, Human
uaacaaugguuuugcugauaau

SEQ ID NO: 721020 - RNA, 19 nt, Human
acugggaaaaaggcacugg

SEQ ID NO: 721021 - RNA, 22 nt, Human
cauggccuugagugacugcacu

SEQ ID NO: 721022 - RNA, 22 nt, Human
uccaggggugauuuuugacuug

SEQ ID NO: 721023 - RNA, 22 nt, Human
cuucuuccugcugcagccucca

SEQ ID NO: 721024 - RNA, 22 nt, Human
ugugaucuuagacaacucacug

SEQ ID NO: 721025 - RNA, 22 nt, Human
gcaguguuuuucaaugcuucca

SEQ ID NO: 721026 - RNA, 22 nt, Human
cuccccuccuuaggucuucuag

SEQ ID NO: 721027 - RNA, 22 nt, Human
aaacacuaauaacaguggcugg

SEQ ID NO: 721028 - RNA, 22 nt, Human
ucugcauauuuaucaugagucu

SEQ ID NO: 721029 - RNA, 22 nt, Human
gaaagcacaggcucaggaacag

SEQ ID NO: 721030 - RNA, 22 nt, Human
uguaauaccacuguuggacauu

SEQ ID NO: 721031 - RNA, 22 nt, Human
ugccacaguuucauggauucug

SEQ ID NO: 721032 - RNA, 22 nt, Human
cagaagaugcagugucugagaa

SEQ ID NO: 721033 - RNA, 22 nt, Human
caaaaccuaaacagacugucca

SEQ ID NO: 721034 - RNA, 22 nt, Human
uacugaggguaugaagccaagg

SEQ ID NO: 721035 - RNA, 19 nt, Human
cuucuccagcuucuagaag

SEQ ID NO: 721036 - RNA, 22 nt, Human
aggaagcacuggaagggguugg

SEQ ID NO: 721037 - RNA, 22 nt, Human
uuuagacauagcugaaaucauu

SEQ ID NO: 721038 - RNA, 22 nt, Human
aguggcagccuuguucauuaug

SEQ ID NO: 721039 - RNA, 22 nt, Human
uuggcccacucucagaaugugg

SEQ ID NO: 721040 - RNA, 22 nt, Human
ucuccagaguaaccuuggagca

SEQ ID NO: 721041 - RNA, 22 nt, Human
cuucuucucuacauccuuugau

SEQ ID NO: 721042 - RNA, 22 nt, Human
guugucagguaaaacaguaugg

SEQ ID NO: 721043 - RNA, 22 nt, Human
gugccuguaaguuguaugggcu

SEQ ID NO: 721044 - RNA, 22 nt, Human
caggacaggaguggggucaaag

SEQ ID NO: 721045 - RNA, 19 nt, Human
ugcccaggccagguugggc

SEQ ID NO: 721046 - RNA, 22 nt, Human
ccauuuaguaaggaagaacagc

SEQ ID NO: 721047 - RNA, 19 nt, Human
ggcacuggggccaggacca

SEQ ID NO: 721048 - RNA, 22 nt, Human
uuuacgacugcuaaaugccugc

SEQ ID NO: 721049 - RNA, 20 nt, Human
caugcaacagauuauuuccc

SEQ ID NO: 721050 - RNA, 22 nt, Human
agguggccaagacuguuugaca

SEQ ID NO: 721051 - RNA, 22 nt, Human
aaugcugagggaugagagaggc

SEQ ID NO: 721052 - RNA, 22 nt, Human
uuugcauucuagaaaaauuucu

SEQ ID NO: 721053 - RNA, 20 nt, Human
ugggcacagcuuuggagggc

SEQ ID NO: 721054 - RNA, 22 nt, Human
ggcuccagguuuaaggguaugu

SEQ ID NO: 721055 - RNA, 22 nt, Human
ccccucccugaccugguugggc

SEQ ID NO: 721056 - RNA, 22 nt, Human
cagagguagcaugcuguggcuu

SEQ ID NO: 721057 - RNA, 22 nt, Human
acuuguguuaccaagguuuggu

SEQ ID NO: 721058 - RNA, 22 nt, Human
aggacaguguggaagagggugc

SEQ ID NO: 721059 - RNA, 22 nt, Human
ucagccaguuaaggcuuagaca

SEQ ID NO: 721060 - RNA, 22 nt, Human
aguagaauagauggauacuauu

SEQ ID NO: 721061 - RNA, 22 nt, Human
uggcagagcaaaaagauagaau

SEQ ID NO: 721062 - RNA, 19 nt, Human
ugagagugaggaaggcuuc

SEQ ID NO: 721063 - RNA, 22 nt, Human
acugugccacaauucaccaggg

SEQ ID NO: 721064 - RNA, 21 nt, Human
cauuugaucccucaucaggau

SEQ ID NO: 721065 - RNA, 22 nt, Human
cauguaaaaagaagaaucugga

SEQ ID NO: 721066 - RNA, 22 nt, Human
cuggggcugcgguggaggagcc

SEQ ID NO: 721067 - RNA, 22 nt, Human
agggcuccugaggcccuucugg

SEQ ID NO: 721068 - RNA, 22 nt, Human
uuugaacugauaaucuucuguu

SEQ ID NO: 721069 - RNA, 22 nt, Human
cgugucugggcucccauggcag

SEQ ID NO: 721070 - RNA, 22 nt, Human
ccagcagcccacaggcgucccu

SEQ ID NO: 721071 - RNA, 22 nt, Human
caugcauacacaggucaggcag

SEQ ID NO: 721072 - RNA, 22 nt, Human
acacaaaguuggaugacaaaau

SEQ ID NO: 721073 - RNA, 21 nt, Human
gaggccacuaauaggggcaga

SEQ ID NO: 721074 - RNA, 18 nt, Human
gcacauguaagaguaaag

SEQ ID NO: 721075 - RNA, 22 nt, Human
auauacaguauguacugugguu

SEQ ID NO: 721076 - RNA, 22 nt, Human
gggcuggacugcauugccucgc

SEQ ID NO: 721077 - RNA, 22 nt, Human
gggacacagguaucucaaauga

SEQ ID NO: 721078 - RNA, 22 nt, Human
gcugccuuugugagccaagggg

SEQ ID NO: 721079 - RNA, 22 nt, Human
aucaguuugagugcugugucaa

SEQ ID NO: 721080 - RNA, 22 nt, Human
gggcaggugauuuuggcuccau

SEQ ID NO: 721081 - RNA, 22 nt, Human
ucugcacaauugaucauggcaa

SEQ ID NO: 721082 - RNA, 22 nt, Human
ucugaacauuuuuugcagccua

SEQ ID NO: 721083 - RNA, 22 nt, Human
cugggcucagcccaugcugucc

SEQ ID NO: 721084 - RNA, 17 nt, Human
ccucccacaccgcccug

SEQ ID NO: 721085 - RNA, 22 nt, Human
uacaucaaaucaauguuccagu

SEQ ID NO: 721086 - RNA, 22 nt, Human
aaagucaucauuucuuuucaaa

SEQ ID NO: 721087 - RNA, 22 nt, Human
cacaauuauagaagaaagcaua

SEQ ID NO: 721088 - RNA, 22 nt, Human
aaaaugugcaguuuuuaagcug

SEQ ID NO: 721089 - RNA, 22 nt, Human
agugaaauugcuguaagaggaa

SEQ ID NO: 721090 - RNA, 22 nt, Human
uagauauaucugucauacuggu

SEQ ID NO: 721091 - RNA, 22 nt, Human
guguaugaggggagaauguuuu

SEQ ID NO: 721092 - RNA, 22 nt, Human
gaaggccacggaauggagcugg

SEQ ID NO: 721093 - RNA, 22 nt, Human
uaaggaaacaacuuguauuuuu

SEQ ID NO: 721094 - RNA, 22 nt, Human
gaguccaggcuguugcucaucu

SEQ ID NO: 721095 - RNA, 22 nt, Human
gucaggaaguggcauuggagaa

SEQ ID NO: 721096 - RNA, 22 nt, Human
gggcucagaggaguggccuggg

SEQ ID NO: 721097 - RNA, 22 nt, Human
gggucaggcucagcagggcagc

SEQ ID NO: 721098 - RNA, 22 nt, Human
uuacaacacuacuuauccuuga

SEQ ID NO: 721099 - RNA, 22 nt, Human
ucacauguguuuucucaccaac

SEQ ID NO: 721100 - RNA, 22 nt, Human
caggcagccaggggaccugucc

SEQ ID NO: 721101 - RNA, 22 nt, Human
gcccucaggcagggagucuuuc

SEQ ID NO: 721102 - RNA, 22 nt, Human
ugugauuuccagccauuaaaaa

SEQ ID NO: 721103 - RNA, 22 nt, Human
aguggcaguagaugagcugguu

SEQ ID NO: 721104 - RNA, 18 nt, Human
cagauccaggcagcuauu

SEQ ID NO: 721105 - RNA, 22 nt, Human
aagcaucuuagaccugaguucc

SEQ ID NO: 721106 - RNA, 22 nt, Human
gcaggaguguggugggacaucc

SEQ ID NO: 721107 - RNA, 22 nt, Human
guacauuuugagguuaaaacaa

SEQ ID NO: 721108 - RNA, 22 nt, Human
acauugaacauggcaggacauu

SEQ ID NO: 721109 - RNA, 19 nt, Human
gcucugugaugcugagggg

SEQ ID NO: 721110 - RNA, 22 nt, Human
uuaaagcuggcguuacaguuug

SEQ ID NO: 721111 - RNA, 22 nt, Human
ugagguaggugguaagagauac

SEQ ID NO: 721112 - RNA, 22 nt, Human
cuuuguuaucuguaaaugguua

SEQ ID NO: 721113 - RNA, 22 nt, Human
cacccccagcagggaaaggagg

SEQ ID NO: 721114 - RNA, 22 nt, Human
uuggaacuuaacccugauaggu

SEQ ID NO: 721115 - RNA, 22 nt, Human
gccaggacccuggagggcaucu

SEQ ID NO: 721116 - RNA, 22 nt, Human
agcaggcaggaaugguggaaca

SEQ ID NO: 721117 - RNA, 22 nt, Human
gaaguugauagaguacaugauu

SEQ ID NO: 721118 - RNA, 22 nt, Human
agcagccuauucuucucuugga

SEQ ID NO: 721119 - RNA, 22 nt, Human
gagucuccuacuggcuguccuu

SEQ ID NO: 721120 - RNA, 22 nt, Human
acugugggggagccagucccau

SEQ ID NO: 721121 - RNA, 22 nt, Human
agaagcucggguaagcuccauu

SEQ ID NO: 721122 - RNA, 22 nt, Human
cccagcucccauguucuccaau

SEQ ID NO: 721123 - RNA, 22 nt, Human
cauuauauuuuacugcauggga

SEQ ID NO: 721124 - RNA, 22 nt, Human
agaacaaaauuagaggagugca

SEQ ID NO: 721125 - RNA, 22 nt, Human
agcauggacaguggcagcagug

SEQ ID NO: 721126 - RNA, 22 nt, Human
uggagaugcacgagcaggugga

SEQ ID NO: 721127 - RNA, 22 nt, Human
cuccaugggggcuggccugugu

SEQ ID NO: 721128 - RNA, 22 nt, Human
cccaaguuaaaauucagugcuc

SEQ ID NO: 721129 - RNA, 22 nt, Human
ugccaggggaccuagggauguc

SEQ ID NO: 721130 - RNA, 22 nt, Human
guuuaaauaauuaggggccugu

SEQ ID NO: 721131 - RNA, 22 nt, Human
aggggcuuguggaguugcuggu

SEQ ID NO: 721132 - RNA, 22 nt, Human
acccagccauguucaguucucu

SEQ ID NO: 721133 - RNA, 19 nt, Human
agccacagaacuugcagga

SEQ ID NO: 721134 - RNA, 18 nt, Human
gaugaggcugucugagaa

SEQ ID NO: 721135 - RNA, 22 nt, Human
acaggcagugauuuccucuggu

SEQ ID NO: 721136 - RNA, 22 nt, Human
uaagagaugcuuuucuaaauaa

SEQ ID NO: 721137 - RNA, 22 nt, Human
auguguguguuuaauccucaaa

SEQ ID NO: 721138 - RNA, 22 nt, Human
ggcucuucuacuucagaugggg

SEQ ID NO: 721139 - RNA, 22 nt, Human
gaugggguuuugccaggcuggu

SEQ ID NO: 721140 - RNA, 22 nt, Human
ucagcaggugaacaucaugcca

SEQ ID NO: 721141 - RNA, 22 nt, Human
gcugcugguccucagagcucau

SEQ ID NO: 721142 - RNA, 22 nt, Human
uaaagguacgaagugagggauu

SEQ ID NO: 721143 - RNA, 22 nt, Human
uucaacaucaagaaugcaugga

SEQ ID NO: 721144 - RNA, 22 nt, Human
accuuagaaaaucaaaauuaga

SEQ ID NO: 721145 - RNA, 22 nt, Human
agcaggugggcaugaaagcuga

SEQ ID NO: 721146 - RNA, 22 nt, Human
cugccucuugacagaucguggc

SEQ ID NO: 721147 - RNA, 22 nt, Human
ccaggcccccgagcagaagaca

SEQ ID NO: 721148 - RNA, 22 nt, Human
cauaauuagucauguuaugcau

SEQ ID NO: 721149 - RNA, 22 nt, Human
aaaaguauaggguuuggaguca

SEQ ID NO: 721150 - RNA, 22 nt, Human
uuccucagacccucauugugag

SEQ ID NO: 721151 - RNA, 22 nt, Human
gaugaagcuaaaucuaagguuu

SEQ ID NO: 721152 - RNA, 20 nt, Human
aguggggagucaggagugcc

SEQ ID NO: 721153 - RNA, 22 nt, Human
acccagcaugacaccugcacau

SEQ ID NO: 721154 - RNA, 22 nt, Human
ugcagcaguuuaaugcaggguu

SEQ ID NO: 721155 - RNA, 22 nt, Human
acucuaaauagccucuuaaaca

SEQ ID NO: 721156 - RNA, 22 nt, Human
uacaguagaaugcggugccagu

SEQ ID NO: 721157 - RNA, 21 nt, Human
ucacaggucaaugugugaagg

SEQ ID NO: 721158 - RNA, 22 nt, Human
gagccagauuuuaugcaagaca

SEQ ID NO: 721159 - RNA, 22 nt, Human
cauguguggucuguggcuaucu

SEQ ID NO: 721160 - RNA, 22 nt, Human
uccuggcuccuggagaccugcu

SEQ ID NO: 721161 - RNA, 22 nt, Human
uuuagaguccaaguucuucacu

SEQ ID NO: 721162 - RNA, 22 nt, Human
ccagaagucaggaaugagucuu

SEQ ID NO: 721163 - RNA, 22 nt, Human
agacauauuggcuugcuuuaau

SEQ ID NO: 721164 - RNA, 22 nt, Human
cuagaucagauugcuguuucua

SEQ ID NO: 721165 - RNA, 22 nt, Human
ccagccuuacugcccuucagug

SEQ ID NO: 721166 - RNA, 20 nt, Human
guccagaguaaugugcugac

SEQ ID NO: 721167 - RNA, 22 nt, Human
acauguuuggcucuaugcuaua

SEQ ID NO: 721168 - RNA, 22 nt, Human
cuggccagccucccagguaccc

SEQ ID NO: 721169 - RNA, 22 nt, Human
uccagagaucucucuucccugu

SEQ ID NO: 721170 - RNA, 22 nt, Human
uuccuucagcaaguccugagca

SEQ ID NO: 721171 - RNA, 22 nt, Human
uaaaugcaaugugcuuuaccag

SEQ ID NO: 721172 - RNA, 22 nt, Human
cugugaauguuauaucucaaug

SEQ ID NO: 721173 - RNA, 22 nt, Human
augcagguccaaacgcuagugu

SEQ ID NO: 721174 - RNA, 22 nt, Human
uggcagcauuuuuuccagaaca

SEQ ID NO: 721175 - RNA, 22 nt, Human
acuuuagaaguaaggaugaguu

SEQ ID NO: 721176 - RNA, 21 nt, Human
caggaaacugaggccaugggg

SEQ ID NO: 721177 - RNA, 22 nt, Human
ccugccugucaucgccugcgcc

SEQ ID NO: 721178 - RNA, 22 nt, Human
aauaaucuugacuacugaauca

SEQ ID NO: 721179 - RNA, 22 nt, Human
auacacuuguacauuuuuuaau

SEQ ID NO: 721180 - RNA, 22 nt, Human
auaugguaagaguauauuuacu

SEQ ID NO: 721181 - RNA, 22 nt, Human
gaggccuggcugggaggaggug

SEQ ID NO: 721182 - RNA, 22 nt, Human
agauggggcagaauggagccau

SEQ ID NO: 721183 - RNA, 22 nt, Human
uucauuaauucauucagugacu

SEQ ID NO: 721184 - RNA, 22 nt, Human
ucuggcccaugauccugcuaac

SEQ ID NO: 721185 - RNA, 22 nt, Human
guggacuggcagugaccuuggu

SEQ ID NO: 721186 - RNA, 22 nt, Human
ccuggccagcagccccuuccuc

SEQ ID NO: 721187 - RNA, 22 nt, Human
accucugcaguagggcugugcc

SEQ ID NO: 721188 - RNA, 22 nt, Human
uaauugcagaacuuugggaggc

SEQ ID NO: 721189 - RNA, 22 nt, Human
guggcuagaaaaauaugggugc

SEQ ID NO: 721190 - RNA, 22 nt, Human
auauacaggugguauguguaaa

SEQ ID NO: 721191 - RNA, 22 nt, Human
ggcugcagcccucgccuagcca

SEQ ID NO: 721192 - RNA, 22 nt, Human
cacagagcaggugcugggaaga

SEQ ID NO: 721193 - RNA, 22 nt, Human
guuuggggucugcagagcggcg

SEQ ID NO: 721194 - RNA, 22 nt, Human
gagagcuauuuggcaagcauuu

SEQ ID NO: 721195 - RNA, 22 nt, Human
aauucaaagacuagaauuuugc

SEQ ID NO: 721196 - RNA, 22 nt, Human
ccaggguuauaaaugcaucugu

SEQ ID NO: 721197 - RNA, 20 nt, Human
uccaggcuccuccacuuagu

SEQ ID NO: 721198 - RNA, 19 nt, Human
agccagaguggcccagggg

SEQ ID NO: 721199 - RNA, 22 nt, Human
ugugugugacucauacuagaac

SEQ ID NO: 721200 - RNA, 22 nt, Human
auggacagcaacuggaagcuuc

SEQ ID NO: 721201 - RNA, 22 nt, Human
cugggcuguucugccccugggu

SEQ ID NO: 721202 - RNA, 22 nt, Human
uuuguaacugagugcucagagc

SEQ ID NO: 721203 - RNA, 22 nt, Human
ucacugggcccugaggugggac

SEQ ID NO: 721204 - RNA, 22 nt, Human
acaggaguuuaagaaauauuuc

SEQ ID NO: 721205 - RNA, 22 nt, Human
uuuugcaaugagaugcuuguca

SEQ ID NO: 721206 - RNA, 22 nt, Human
gagcucauucauucauugccug

SEQ ID NO: 721207 - RNA, 22 nt, Human
ucacacugugaagagacaagca

SEQ ID NO: 721208 - RNA, 22 nt, Human
gcagcagggagcagggguguca

SEQ ID NO: 721209 - RNA, 22 nt, Human
cucagcaacccuagaacauuug

SEQ ID NO: 721210 - RNA, 22 nt, Human
cacuauaauccuguuuuagaac

SEQ ID NO: 721211 - RNA, 22 nt, Human
gugccgcgacgcagucggugcc

SEQ ID NO: 721212 - RNA, 22 nt, Human
caaaacuaucaggcucaaagcu

SEQ ID NO: 721213 - RNA, 21 nt, Human
ccagccucagaucagggagcu

SEQ ID NO: 721214 - RNA, 22 nt, Human
cccuggcaaaacacucucuuga

SEQ ID NO: 721215 - RNA, 22 nt, Human
aauaagaucuuaaagguuauau

SEQ ID NO: 721216 - RNA, 20 nt, Human
uucucuagccuuccccuggg

SEQ ID NO: 721217 - RNA, 22 nt, Human
ugccagucucacccuggguccu

SEQ ID NO: 721218 - RNA, 22 nt, Human
ugugaagcauagauucuguaga

SEQ ID NO: 721219 - RNA, 22 nt, Human
acacagaguuugacacauggga

SEQ ID NO: 721220 - RNA, 22 nt, Human
aaggcccuucggcuuccucagc

SEQ ID NO: 721221 - RNA, 22 nt, Human
ugccauauugaugugcuguacc

SEQ ID NO: 721222 - RNA, 22 nt, Human
agauacaucauuuauaccuuca

SEQ ID NO: 721223 - RNA, 22 nt, Human
cagaauuuuucgaauguacugu

SEQ ID NO: 721224 - RNA, 22 nt, Human
ucagaacuacauggacauguua

SEQ ID NO: 721225 - RNA, 22 nt, Human
auaaucagaauucaugaaagau

SEQ ID NO: 721226 - RNA, 22 nt, Human
cagagcuggcucugcauguaca

SEQ ID NO: 721227 - RNA, 22 nt, Human
ugcauuggucauuugaaaauau

SEQ ID NO: 721228 - RNA, 22 nt, Human
ggagcccuucuauuccauggag

SEQ ID NO: 721229 - RNA, 22 nt, Human
ucucugaauuguuuaaguuauu

SEQ ID NO: 721230 - RNA, 22 nt, Human
ugugaggaguaggcugagggug

SEQ ID NO: 721231 - RNA, 22 nt, Human
uuggcaauggaccagccacugg

SEQ ID NO: 721232 - RNA, 22 nt, Human
auucucugaagucuuucagggc

SEQ ID NO: 721233 - RNA, 22 nt, Human
caacagagagaccagaaacagg

SEQ ID NO: 721234 - RNA, 22 nt, Human
caauacuuccuuguuagaggca

SEQ ID NO: 721235 - RNA, 22 nt, Human
ggcuccugagaaugggccauca

SEQ ID NO: 721236 - RNA, 22 nt, Human
uacaguuucccagcagaugcaa

SEQ ID NO: 721237 - RNA, 22 nt, Human
caucuggcagacccugccuccg

SEQ ID NO: 721238 - RNA, 22 nt, Human
cccagcucucgcacuuacuagc

SEQ ID NO: 721239 - RNA, 22 nt, Human
uuugcauugcagugguuuacag

SEQ ID NO: 721240 - RNA, 22 nt, Human
acugcuuuaucugagaaguccu

SEQ ID NO: 721241 - RNA, 22 nt, Human
aagaugcuuauugcuccugcag

SEQ ID NO: 721242 - RNA, 22 nt, Human
acugaucacagauauguauauu

SEQ ID NO: 721243 - RNA, 22 nt, Human
cugccugcucuauccaggccug

SEQ ID NO: 721244 - RNA, 22 nt, Human
augcaccacagauaucugcgua

SEQ ID NO: 721245 - RNA, 22 nt, Human
ggcaccaggggauguaaugucc

SEQ ID NO: 721246 - RNA, 22 nt, Human
gaacaaagacauggaggaggau

SEQ ID NO: 721247 - RNA, 22 nt, Human
aaugaaacuguauauagacugu

SEQ ID NO: 721248 - RNA, 22 nt, Human
acagggaaggauuuagugggaa

SEQ ID NO: 721249 - RNA, 22 nt, Human
gccucaggugcaucucucauuc

SEQ ID NO: 721250 - RNA, 21 nt, Human
aaacugaagagacaggaacuu

SEQ ID NO: 721251 - RNA, 22 nt, Human
uucuuaaagaggcaaaacacag

SEQ ID NO: 721252 - RNA, 22 nt, Human
uuuaacuugaucaguagagcau

SEQ ID NO: 721253 - RNA, 22 nt, Human
ggcaagggacggccgugagaca

SEQ ID NO: 721254 - RNA, 22 nt, Human
gcucugugagccacuugaugua

SEQ ID NO: 721255 - RNA, 22 nt, Human
auggccagucaagccucuggcu

SEQ ID NO: 721256 - RNA, 22 nt, Human
aaggagcuuguucgccuuccuc

SEQ ID NO: 721257 - RNA, 22 nt, Human
acaugucuuuuaaagucuaaua

SEQ ID NO: 721258 - RNA, 22 nt, Human
cuagggaacaagaugcccaggg

SEQ ID NO: 721259 - RNA, 22 nt, Human
uuuguuagagugugggaggcug

SEQ ID NO: 721260 - RNA, 22 nt, Human
ccugugcccucagccuggcucu

SEQ ID NO: 721261 - RNA, 22 nt, Human
gaaaggccagcucacagaugag

SEQ ID NO: 721262 - RNA, 22 nt, Human
uaggaagguguuuuuaaggagc

SEQ ID NO: 721263 - RNA, 22 nt, Human
gcuuugcuggcuugaaaugcug

SEQ ID NO: 721264 - RNA, 21 nt, Human
aagguagcauggguugcagcc

SEQ ID NO: 721265 - RNA, 22 nt, Human
gacuuuugaauaagguaggaua

SEQ ID NO: 721266 - RNA, 22 nt, Human
ccugugggccaaggaccugcca

SEQ ID NO: 721267 - RNA, 22 nt, Human
gggauggcugccugcaucagga

SEQ ID NO: 721268 - RNA, 22 nt, Human
cucucuauggaugcaguuuuuc

SEQ ID NO: 721269 - RNA, 22 nt, Human
ggcuccugaaagacuaugggaa

SEQ ID NO: 721270 - RNA, 22 nt, Human
ucugccugcaguguggcagggc

SEQ ID NO: 721271 - RNA, 22 nt, Human
aaaggucuuuuuucuaacacca

SEQ ID NO: 721272 - RNA, 22 nt, Human
gcagaugaggaagcuaaugcug

SEQ ID NO: 721273 - RNA, 22 nt, Human
aggcucugugcagccugcaucu

SEQ ID NO: 721274 - RNA, 22 nt, Human
ugccugaggagucagggcaggu

SEQ ID NO: 721275 - RNA, 22 nt, Human
uggagggaacccaggcugcucu

SEQ ID NO: 721276 - RNA, 22 nt, Human
gagggccaacuagcaccacuuu

SEQ ID NO: 721277 - RNA, 22 nt, Human
cacaccagcauggucucagugu

SEQ ID NO: 721278 - RNA, 22 nt, Human
uucauucauguauugucuaugg

SEQ ID NO: 721279 - RNA, 21 nt, Human
ucucacugucugcuuuguuua

SEQ ID NO: 721280 - RNA, 22 nt, Human
acagcugugaaaauccacagga

SEQ ID NO: 721281 - RNA, 22 nt, Human
uuuaaucuucaaaauagucuua

SEQ ID NO: 721282 - RNA, 22 nt, Human
uuuggaauuaugcuuaaaguuu

SEQ ID NO: 721283 - RNA, 22 nt, Human
ucauacaagaucacuuuggcca

SEQ ID NO: 721284 - RNA, 22 nt, Human
aagaguucucagaaacgugggu

SEQ ID NO: 721285 - RNA, 22 nt, Human
acaugggaucaaugaggcaggc

SEQ ID NO: 721286 - RNA, 22 nt, Human
uugugagcauguuuacuugauu

SEQ ID NO: 721287 - RNA, 22 nt, Human
cauuuucagcacccaucugaaa

SEQ ID NO: 721288 - RNA, 22 nt, Human
aguguaugaguuucaguucuuc

SEQ ID NO: 721289 - RNA, 22 nt, Human
aagaggaauggguguguuuaug

SEQ ID NO: 721290 - RNA, 20 nt, Human
ucugcagauaagggaaagac

SEQ ID NO: 721291 - RNA, 22 nt, Human
agcuaagguguccuggaggccc

SEQ ID NO: 721292 - RNA, 22 nt, Human
uggcccucguccgacagguggg

SEQ ID NO: 721293 - RNA, 22 nt, Human
cacacuguugaggacgagaugu

SEQ ID NO: 721294 - RNA, 22 nt, Human
cacacaaauauucuggaggcaa

SEQ ID NO: 721295 - RNA, 22 nt, Human
cuuuucuucucacggcugucag

SEQ ID NO: 721296 - RNA, 22 nt, Human
gccuccugguugcuucuccaac

SEQ ID NO: 721297 - RNA, 22 nt, Human
cucugcuugugucaggcaugcu

SEQ ID NO: 721298 - RNA, 22 nt, Human
cuguggcugugaaacuucucag

SEQ ID NO: 721299 - RNA, 18 nt, Human
cucuuaagccuuugucaa

SEQ ID NO: 721300 - RNA, 22 nt, Human
cucugcaaucugagcacuugua

SEQ ID NO: 721301 - RNA, 23 nt, Human
ugagacacucauucauggaguau

SEQ ID NO: 721302 - RNA, 22 nt, Human
ucgauaauaucuuacaugugcu

SEQ ID NO: 721303 - RNA, 22 nt, Human
uugcauuuguggcauggguguu

SEQ ID NO: 721304 - RNA, 22 nt, Human
gagcuaagaccugagggcaagu

SEQ ID NO: 721305 - RNA, 22 nt, Human
agggaagaaucacugggauguu

SEQ ID NO: 721306 - RNA, 22 nt, Human
uuucaaauggagucgugaaaug

SEQ ID NO: 721307 - RNA, 22 nt, Human
uuuuaugagaaugcgccacuug

SEQ ID NO: 721308 - RNA, 22 nt, Human
accaggcaguauggugcugcaa

SEQ ID NO: 721309 - RNA, 23 nt, Human
cugugcccggggcuccaccugau

SEQ ID NO: 721310 - RNA, 23 nt, Human
gcagugugaauccaguguuucag

SEQ ID NO: 721311 - RNA, 22 nt, Human
agagaacaaauuaaaggugguu

SEQ ID NO: 721312 - RNA, 22 nt, Human
ggcugggcaaacaagacucuuc

SEQ ID NO: 721313 - RNA, 22 nt, Human
gucugaggguugugcuggagga

SEQ ID NO: 721314 - RNA, 22 nt, Human
agcaggucuugcucucaacagg

SEQ ID NO: 721315 - RNA, 22 nt, Human
ugcauaacuagaguaauuacag

SEQ ID NO: 721316 - RNA, 20 nt, Human
ggcccagugaaccaggacgg

SEQ ID NO: 721317 - RNA, 20 nt, Human
aagagcugacucacaguggu

SEQ ID NO: 721318 - RNA, 22 nt, Human
gcacccagaauaaggacaggac

SEQ ID NO: 721319 - RNA, 20 nt, Human
acuuuggggucuuucucaga

SEQ ID NO: 721320 - RNA, 22 nt, Human
gcacagaacacuggugaguccc

SEQ ID NO: 721321 - RNA, 18 nt, Human
cuccuccacagccccugc

SEQ ID NO: 721322 - RNA, 22 nt, Human
acaugccagcccauuuaaaugg

SEQ ID NO: 721323 - RNA, 23 nt, Human
uccugcagauaagcugguugaca

SEQ ID NO: 721324 - RNA, 22 nt, Human
ucccucagaugagcuccuagca

SEQ ID NO: 721325 - RNA, 22 nt, Human
acuuuguauaagacaauaaaga

SEQ ID NO: 721326 - RNA, 22 nt, Human
gugaacaaaauagcacauauua

SEQ ID NO: 721327 - RNA, 19 nt, Human
gcuggcagauguggccgug

SEQ ID NO: 721328 - RNA, 22 nt, Human
ucagggcaaaagggaaaccauu

SEQ ID NO: 721329 - RNA, 22 nt, Human
uauucacaggcuggagugaugu

SEQ ID NO: 721330 - RNA, 22 nt, Human
ugggagcucacaggccuggcuc

SEQ ID NO: 721331 - RNA, 22 nt, Human
ccuccaucuccagcuucugccu

SEQ ID NO: 721332 - RNA, 22 nt, Human
gcuacaguagauaaggacgguc

SEQ ID NO: 721333 - RNA, 22 nt, Human
gccucugcaucaucacuccagc

SEQ ID NO: 721334 - RNA, 22 nt, Human
cuggccuuuuguuucuggagaa

SEQ ID NO: 721335 - RNA, 22 nt, Human
uggccuuggagaggcacggccc

SEQ ID NO: 721336 - RNA, 22 nt, Human
ucagaaagguucuauguuuuac

SEQ ID NO: 721337 - RNA, 22 nt, Human
cagcuguguaaacacaugugua

SEQ ID NO: 721338 - RNA, 22 nt, Human
cauguggcuuuggcaugugccc

SEQ ID NO: 721339 - RNA, 22 nt, Human
ugugaaauguguguauaauuaa

SEQ ID NO: 721340 - RNA, 22 nt, Human
ugcaggcucugugugugccugg

SEQ ID NO: 721341 - RNA, 22 nt, Human
ugggccugggucuuugcugcca

SEQ ID NO: 721342 - RNA, 22 nt, Human
ucucaaauuuguuagauaaaau

SEQ ID NO: 721343 - RNA, 22 nt, Human
gcucccaccaggcagaccuacc

SEQ ID NO: 721344 - RNA, 22 nt, Human
cccaggagauggugcguggucu

SEQ ID NO: 721345 - RNA, 22 nt, Human
uguuuccagaauguagcugcuu

SEQ ID NO: 721346 - RNA, 23 nt, Human
uaggccagggugaccuggggaga

SEQ ID NO: 721347 - RNA, 22 nt, Human
uuuaucugucauuucccauauc

SEQ ID NO: 721348 - RNA, 22 nt, Human
agagagaggggcgagcaaacac

SEQ ID NO: 721349 - RNA, 22 nt, Human
guuuacauuaaguauuagcauc

SEQ ID NO: 721350 - RNA, 21 nt, Human
aaugucauugaauggugagac

SEQ ID NO: 721351 - RNA, 22 nt, Human
cagcuacacaccagaacuauua

SEQ ID NO: 721352 - RNA, 22 nt, Human
ucugcaggaaaaaagugccugg

SEQ ID NO: 721353 - RNA, 22 nt, Human
uaaaucuccuguuuuucaucua

SEQ ID NO: 721354 - RNA, 22 nt, Human
uaugcuuugcaauuggaaaagg

SEQ ID NO: 721355 - RNA, 22 nt, Human
gaguccuuaauacacuggugga

SEQ ID NO: 721356 - RNA, 22 nt, Human
cccaggucccggggccagcugc

SEQ ID NO: 721357 - RNA, 22 nt, Human
ccuccagggccccucucacugg

SEQ ID NO: 721358 - RNA, 22 nt, Human
auucaguuaagggucuugagau

SEQ ID NO: 721359 - RNA, 22 nt, Human
uccuggggaggguucuggcucc

SEQ ID NO: 721360 - RNA, 22 nt, Human
ugaauaguucuacuacuugaca

SEQ ID NO: 721361 - RNA, 22 nt, Human
auggcugugaaaugguaggugg

SEQ ID NO: 721362 - RNA, 22 nt, Human
aaacuguuucccuccauaaccu

SEQ ID NO: 721363 - RNA, 22 nt, Human
aucuguaacaucaguagcagaa

SEQ ID NO: 721364 - RNA, 22 nt, Human
gggaucuguguugcgauggauu

SEQ ID NO: 721365 - RNA, 22 nt, Human
aagagauguugaaguuuauuag

SEQ ID NO: 721366 - RNA, 22 nt, Human
gaaaucuuuuaaccauucauuu

SEQ ID NO: 721367 - RNA, 22 nt, Human
cuuccaggguccaggaagagcc

SEQ ID NO: 721368 - RNA, 22 nt, Human
ugcccugcugugccuggagcca

SEQ ID NO: 721369 - RNA, 23 nt, Human
aggaugugcauaugaccuaauca

SEQ ID NO: 721370 - RNA, 22 nt, Human
gagccagcgccuugccucuggg

SEQ ID NO: 721371 - RNA, 22 nt, Human
caggagcaugcugaugccagaa

SEQ ID NO: 721372 - RNA, 22 nt, Human
ucucuccugcacugaauuaugu

SEQ ID NO: 721373 - RNA, 22 nt, Human
uugaaaggugcugugugcugau

SEQ ID NO: 721374 - RNA, 22 nt, Human
ccagugugauuguugcaagaau

SEQ ID NO: 721375 - RNA, 22 nt, Human
uuacacacaauuagcauaguaa

SEQ ID NO: 721376 - RNA, 22 nt, Human
gcuccagaugaaugcacuuguu

SEQ ID NO: 721377 - RNA, 22 nt, Human
ugcacuacugugauacacagcc

SEQ ID NO: 721378 - RNA, 22 nt, Human
ugucuccaccaucaucuuacca

SEQ ID NO: 721379 - RNA, 20 nt, Human
uggguccugcuucuuccuga

SEQ ID NO: 721380 - RNA, 23 nt, Human
agcuccagaacauagcacaggaa

SEQ ID NO: 721381 - RNA, 22 nt, Human
gggcucuggacccaggcaagag

SEQ ID NO: 721382 - RNA, 22 nt, Human
gcugggcuggccgccgagaucg

SEQ ID NO: 721383 - RNA, 22 nt, Human
uugggcuuuaauuccagagagg

SEQ ID NO: 721384 - RNA, 22 nt, Human
cuguuacaagagagagacauga

SEQ ID NO: 721385 - RNA, 22 nt, Human
uauuuucuggggagagugaacc

SEQ ID NO: 721386 - RNA, 22 nt, Human
gucugcuuuucugaauugccug

SEQ ID NO: 721387 - RNA, 22 nt, Human
aagacugucugggacaagauga

SEQ ID NO: 721388 - RNA, 22 nt, Human
caugauggaugugcacuucgcu

SEQ ID NO: 721389 - RNA, 16 nt, Human
gcuggagggagggguu

SEQ ID NO: 721390 - RNA, 22 nt, Human
gcuggcaggauaacuucuaagc

SEQ ID NO: 721391 - RNA, 22 nt, Human
ucauuauucucuuuaauguucu

SEQ ID NO: 721392 - RNA, 22 nt, Human
ggccuccuguuggcuaguguga

SEQ ID NO: 721393 - RNA, 22 nt, Human
gaauagauagcuuggaugguug

SEQ ID NO: 721394 - RNA, 22 nt, Human
guggcagcuguguugcaguuuu

SEQ ID NO: 721395 - RNA, 22 nt, Human
ucagagaaaugaaguagggauu

SEQ ID NO: 721396 - RNA, 22 nt, Human
cugggcauauacgugcaaguca

SEQ ID NO: 721397 - RNA, 22 nt, Human
gcaagcaguuguggcuucugag

SEQ ID NO: 721398 - RNA, 22 nt, Human
uuacuguaugagugugguaguc

SEQ ID NO: 721399 - RNA, 22 nt, Human
uuugaucuaugcgugguuuccc

SEQ ID NO: 721400 - RNA, 22 nt, Human
aucauuuuuaagagacucuucu

SEQ ID NO: 721401 - RNA, 22 nt, Human
aaaggagaguagguuacuccau

SEQ ID NO: 721402 - RNA, 22 nt, Human
accugagggagauuaggccuga

SEQ ID NO: 721403 - RNA, 22 nt, Human
cagcacagugaccagacccacu

SEQ ID NO: 721404 - RNA, 22 nt, Human
uucuucugaaacagugacagac

SEQ ID NO: 721405 - RNA, 22 nt, Human
uuuccuuugaggguccuacacu

SEQ ID NO: 721406 - RNA, 22 nt, Human
caacacugauuauggcugagcu

SEQ ID NO: 721407 - RNA, 22 nt, Human
uggggaagcacuuugaacuuaa

SEQ ID NO: 721408 - RNA, 20 nt, Human
ucacaauaugagcucauaca

SEQ ID NO: 721409 - RNA, 22 nt, Human
acagaguuaaaguggaguuuaa

SEQ ID NO: 721410 - RNA, 22 nt, Human
acacuucagcuccacaaacauu

SEQ ID NO: 721411 - RNA, 22 nt, Human
gcugcccugccucagacuccuc

SEQ ID NO: 721412 - RNA, 20 nt, Human
uccugccacaccucaguugc

SEQ ID NO: 721413 - RNA, 22 nt, Human
auuagcauugcuacucucaaga

SEQ ID NO: 721414 - RNA, 22 nt, Human
uggagcagugguccuggagaug

SEQ ID NO: 721415 - RNA, 22 nt, Human
cacuguguaagaagaugggcuu

SEQ ID NO: 721416 - RNA, 20 nt, Human
ucauauuuuugcccugggcc

SEQ ID NO: 721417 - RNA, 22 nt, Human
cugagccaaggggacagugaca

SEQ ID NO: 721418 - RNA, 22 nt, Human
agguuucugcuguccuccuucu

SEQ ID NO: 721419 - RNA, 22 nt, Human
agcagcuguuagaaacaggaag

SEQ ID NO: 721420 - RNA, 22 nt, Human
acagauuugaucugagaacaaa

SEQ ID NO: 721421 - RNA, 22 nt, Human
ugcuuguccgaggugaguacuu

SEQ ID NO: 721422 - RNA, 22 nt, Human
ggaacacagugccuuacaaacu

SEQ ID NO: 721423 - RNA, 22 nt, Human
agcucuuuugcucuccaaguuu

SEQ ID NO: 721424 - RNA, 22 nt, Human
ucaaggagcccacagucuaaug

SEQ ID NO: 721425 - RNA, 22 nt, Human
uguagaaaauuggagcauucau

SEQ ID NO: 721426 - RNA, 22 nt, Human
uucccagagauaagacgucuua

SEQ ID NO: 721427 - RNA, 22 nt, Human
acagauauuuggggaaagacgu

SEQ ID NO: 721428 - RNA, 22 nt, Human
ggcgccagcacugcagcgccuc

SEQ ID NO: 721429 - RNA, 22 nt, Human
ggcugggccagggccuguggac

SEQ ID NO: 721430 - RNA, 22 nt, Human
uucuuucugggaagaguucaga

SEQ ID NO: 721431 - RNA, 17 nt, Human
guggcugcacacacaug

SEQ ID NO: 721432 - RNA, 22 nt, Human
acagccuguuugaucuggugcu

SEQ ID NO: 721433 - RNA, 22 nt, Human
ugagaggcagaauggugccugc

SEQ ID NO: 721434 - RNA, 22 nt, Human
gagggugcagcugggccccacg

SEQ ID NO: 721435 - RNA, 22 nt, Human
acaaaugaacauauaagcuuga

SEQ ID NO: 721436 - RNA, 22 nt, Human
agucugaaauaaugucacuaag

SEQ ID NO: 721437 - RNA, 22 nt, Human
agugcaaaauucagaagcaauu

SEQ ID NO: 721438 - RNA, 20 nt, Human
ugcuccaggaacacuggccg

SEQ ID NO: 721439 - RNA, 22 nt, Human
agcccaggucucaaaguacagg

SEQ ID NO: 721440 - RNA, 22 nt, Human
agagcacagccaccauuuacaa

SEQ ID NO: 721441 - RNA, 21 nt, Human
cauccguuuauaucucugugg

SEQ ID NO: 721442 - RNA, 20 nt, Human
acaugaacagggcuacagca

SEQ ID NO: 721443 - RNA, 22 nt, Human
acugcccuguaacugccaggua

SEQ ID NO: 721444 - RNA, 23 nt, Human
ucccucaggccuuaucuccaucu

SEQ ID NO: 721445 - RNA, 22 nt, Human
gcacaagaaaucauggacugaa

SEQ ID NO: 721446 - RNA, 20 nt, Human
agugaguuaucagcuacagu

SEQ ID NO: 721447 - RNA, 22 nt, Human
caaaggcugccacuguggcugu

SEQ ID NO: 721448 - RNA, 22 nt, Human
cuuuaguuaguagauaauggca

SEQ ID NO: 721449 - RNA, 22 nt, Human
caggaaaucagaacucaagugg

SEQ ID NO: 721450 - RNA, 22 nt, Human
ugagagaaacguuccuuacauc

SEQ ID NO: 721451 - RNA, 22 nt, Human
uacagaagcugagacacugaga

SEQ ID NO: 721452 - RNA, 22 nt, Human
aguguaugucaaguauauacac

SEQ ID NO: 721453 - RNA, 22 nt, Human
gggucccuggaauuacuugaca

SEQ ID NO: 721454 - RNA, 22 nt, Human
uaggagggcccugaaaauggca

SEQ ID NO: 721455 - RNA, 22 nt, Human
gaggaaaaugggacaggcugua

SEQ ID NO: 721456 - RNA, 22 nt, Human
aacagcuaccuucucacugugc

SEQ ID NO: 721457 - RNA, 22 nt, Human
cauugcacgggcgucugucugu

SEQ ID NO: 721458 - RNA, 22 nt, Human
aggcuguggugaugauuggguc

SEQ ID NO: 721459 - RNA, 22 nt, Human
ucccagcuguguggaggagaug

SEQ ID NO: 721460 - RNA, 22 nt, Human
ccugaccacccuuggacaaggu

SEQ ID NO: 721461 - RNA, 23 nt, Human
cugcuguguuggucucgauggga

SEQ ID NO: 721462 - RNA, 22 nt, Human
ucuggacuuucggugcaagagu

SEQ ID NO: 721463 - RNA, 22 nt, Human
cugggaggcggagguuguagug

SEQ ID NO: 721464 - RNA, 20 nt, Human
ggcuuucugugauccucagu

SEQ ID NO: 721465 - RNA, 22 nt, Human
uuuuauugucuguauugccuau

SEQ ID NO: 721466 - RNA, 23 nt, Human
aggagccaggugcagcccuugug

SEQ ID NO: 721467 - RNA, 21 nt, Human
gggagcugacagcagcacggc

SEQ ID NO: 721468 - RNA, 22 nt, Human
aacugcuuguaaauaauguuga

SEQ ID NO: 721469 - RNA, 22 nt, Human
cucuuaguuuaucuuugacaaa

SEQ ID NO: 721470 - RNA, 22 nt, Human
aagcacagagaugggcacgccu

SEQ ID NO: 721471 - RNA, 22 nt, Human
acacugugaucuugagaaaggu

SEQ ID NO: 721472 - RNA, 22 nt, Human
uaugguuauguaaucaguuguu

SEQ ID NO: 721473 - RNA, 23 nt, Human
augaaaugcuggcucagggaggu

SEQ ID NO: 721474 - RNA, 22 nt, Human
uaggaacaacugcagguacaag

SEQ ID NO: 721475 - RNA, 22 nt, Human
aacaggagucauugucauuauu

SEQ ID NO: 721476 - RNA, 22 nt, Human
uacagcauuuuguagaguacua

SEQ ID NO: 721477 - RNA, 22 nt, Human
acaggagccaaacacaugccag

SEQ ID NO: 721478 - RNA, 22 nt, Human
ccacugagugagcagagcaggg

SEQ ID NO: 721479 - RNA, 22 nt, Human
uuauuaggaacucaggauuuuu

SEQ ID NO: 721480 - RNA, 22 nt, Human
guccuucagggagucaaacacu

SEQ ID NO: 721481 - RNA, 22 nt, Human
cuacagaaucuaccucaagcca

SEQ ID NO: 721482 - RNA, 19 nt, Human
gccuaugucuucaaaucau

SEQ ID NO: 721483 - RNA, 22 nt, Human
aggaucauguggucauuccuga

SEQ ID NO: 721484 - RNA, 22 nt, Human
guucuucaguaaaauuaaaugu

SEQ ID NO: 721485 - RNA, 22 nt, Human
uccuucaggguugaggccgacu

SEQ ID NO: 721486 - RNA, 23 nt, Human
gcccugcccuuagcacacucaca

SEQ ID NO: 721487 - RNA, 22 nt, Human
ggcagccauggacacuggcuag

SEQ ID NO: 721488 - RNA, 19 nt, Human
ugcugacugggccucaccg

SEQ ID NO: 721489 - RNA, 22 nt, Human
ucuggcccugcugcugugagca

SEQ ID NO: 721490 - RNA, 22 nt, Human
auccugggcaguuuugagugcu

SEQ ID NO: 721491 - RNA, 23 nt, Human
ugggcgaggcaggaguggagcac

SEQ ID NO: 721492 - RNA, 22 nt, Human
aauuagggaaaacauuugcuuu

SEQ ID NO: 721493 - RNA, 22 nt, Human
uguuucuuauccaaguggucug

SEQ ID NO: 721494 - RNA, 22 nt, Human
uguuuuauuucuccaagaggga

SEQ ID NO: 721495 - RNA, 19 nt, Human
ugcucuggagccagcucuc

SEQ ID NO: 721496 - RNA, 22 nt, Human
agcagcagauuauggucuacau

SEQ ID NO: 721497 - RNA, 18 nt, Human
agagacagcagcaaaaga

SEQ ID NO: 721498 - RNA, 22 nt, Human
aacuauaaugggguuaggaaau

SEQ ID NO: 721499 - RNA, 22 nt, Human
uccagcauauauagagaaugag

SEQ ID NO: 721500 - RNA, 22 nt, Human
cuuuauucugcaaauugccuug

SEQ ID NO: 721501 - RNA, 23 nt, Human
uugaaagguagcuggcagcuaga

SEQ ID NO: 721502 - RNA, 22 nt, Human
uggaccagcagccccagugccu

SEQ ID NO: 721503 - RNA, 21 nt, Human
ccauaaucuuaggaucaaaau

SEQ ID NO: 721504 - RNA, 22 nt, Human
gaugcauuacaaaagugauuau

SEQ ID NO: 721505 - RNA, 22 nt, Human
aggacugaugauggugcugaca

SEQ ID NO: 721506 - RNA, 22 nt, Human
guuuggcacuaugaugaggcua

SEQ ID NO: 721507 - RNA, 22 nt, Human
aagcuggagaguuaggugaaua

SEQ ID NO: 721508 - RNA, 22 nt, Human
uuggcaaugucuaaacacauuu

SEQ ID NO: 721509 - RNA, 22 nt, Human
gcugaagagagaugcguccagc

SEQ ID NO: 721510 - RNA, 22 nt, Human
cccugagagugagugccaccuu

SEQ ID NO: 721511 - RNA, 22 nt, Human
gagccagagauccaggauggcu

SEQ ID NO: 721512 - RNA, 22 nt, Human
caaugcaaugcaaugcaaugca

SEQ ID NO: 721513 - RNA, 22 nt, Human
gagggaccccaggcuggcccuu

SEQ ID NO: 721514 - RNA, 22 nt, Human
uagcaucuaacaucuuaggacu

SEQ ID NO: 721515 - RNA, 22 nt, Human
agggccucuaccauccaagguu

SEQ ID NO: 721516 - RNA, 22 nt, Human
cagcauuggguuaccuuuguuu

SEQ ID NO: 721517 - RNA, 22 nt, Human
ugcucagggacaauggagaggg

SEQ ID NO: 721518 - RNA, 22 nt, Human
guuaacuugguagucuaagugu

SEQ ID NO: 721519 - RNA, 22 nt, Human
aggagcuccagcccagggaagu

SEQ ID NO: 721520 - RNA, 22 nt, Human
cucugagaggugagaagcagca

SEQ ID NO: 721521 - RNA, 22 nt, Human
ggugucugcuucccuccagcug

SEQ ID NO: 721522 - RNA, 21 nt, Human
ugcagccucugcccagcagug

SEQ ID NO: 721523 - RNA, 19 nt, Human
uaggcccuagcucugcagu

SEQ ID NO: 721524 - RNA, 22 nt, Human
ugagagccagaagggccugagg

SEQ ID NO: 721525 - RNA, 22 nt, Human
uuuacagacaacuuaauagggg

SEQ ID NO: 721526 - RNA, 22 nt, Human
acgaagacgccguucuugccga

SEQ ID NO: 721527 - RNA, 22 nt, Human
aacuucagggggcacauucaag

SEQ ID NO: 721528 - RNA, 22 nt, Human
uagcagcucugauucugggccc

SEQ ID NO: 721529 - RNA, 22 nt, Human
agcuccagagccacauccauca

SEQ ID NO: 721530 - RNA, 22 nt, Human
guggagggugagcucauguuug

SEQ ID NO: 721531 - RNA, 22 nt, Human
gcugcugucagugguggcaguu

SEQ ID NO: 721532 - RNA, 23 nt, Human
ucucuuaucacaauucauuuugc

SEQ ID NO: 721533 - RNA, 22 nt, Human
acaguauauuuucuugauuguu

SEQ ID NO: 721534 - RNA, 21 nt, Human
ugaaacaaucagacagagucu

SEQ ID NO: 721535 - RNA, 22 nt, Human
cagcugcuguucaguuuuguuu

SEQ ID NO: 721536 - RNA, 22 nt, Human
aacaguuuaugauaaauucuua

SEQ ID NO: 721537 - RNA, 22 nt, Human
uaaaguguaugccaucucucau

SEQ ID NO: 721538 - RNA, 20 nt, Human
ucucccaggcucagggaaga

SEQ ID NO: 721539 - RNA, 22 nt, Human
gauuaaguaacugaacacuuug

SEQ ID NO: 721540 - RNA, 22 nt, Human
aggcuuuggaaucagaguucug

SEQ ID NO: 721541 - RNA, 22 nt, Human
caggcucccgaaaucacccaug

SEQ ID NO: 721542 - RNA, 22 nt, Human
uaauccuuuagguuaaaagagg

SEQ ID NO: 721543 - RNA, 22 nt, Human
cucucugcuguauccuuaggcu

SEQ ID NO: 721544 - RNA, 22 nt, Human
ucuuggccccaccugugccagc

SEQ ID NO: 721545 - RNA, 22 nt, Human
uugaaaaaauugguagaggaug

SEQ ID NO: 721546 - RNA, 22 nt, Human
cugcucugugguccaugagaca

SEQ ID NO: 721547 - RNA, 22 nt, Human
uagcacagagcuuuuaaacuuc

SEQ ID NO: 721548 - RNA, 22 nt, Human
gccugagagacccauggggcaa

SEQ ID NO: 721549 - RNA, 16 nt, Human
acccucagaaacugcu

SEQ ID NO: 721550 - RNA, 22 nt, Human
acauuaucccuggcacaacugc

SEQ ID NO: 721551 - RNA, 22 nt, Human
ggagucagaauggcaggguggu

SEQ ID NO: 721552 - RNA, 22 nt, Human
auguuguguuugacuguuaccc

SEQ ID NO: 721553 - RNA, 18 nt, Human
gggaucaggcugccuagg

SEQ ID NO: 721554 - RNA, 22 nt, Human
ugacaaacccugcaaauagcuc

SEQ ID NO: 721555 - RNA, 22 nt, Human
augauugaaaaugacauugcca

SEQ ID NO: 721556 - RNA, 23 nt, Human
uuugugaaaguguugagaggaga

SEQ ID NO: 721557 - RNA, 22 nt, Human
uucuacauauauuuuucucacu

SEQ ID NO: 721558 - RNA, 22 nt, Human
ccuucucucugaagaccccaaa

SEQ ID NO: 721559 - RNA, 22 nt, Human
gucuuuaguugaaacauguggu

SEQ ID NO: 721560 - RNA, 22 nt, Human
cugggggcagcaagaagccaug

SEQ ID NO: 721561 - RNA, 22 nt, Human
aaaugugaguuauagcaauaga

SEQ ID NO: 721562 - RNA, 21 nt, Human
uaaaccuggcgcuguucaaag

SEQ ID NO: 721563 - RNA, 22 nt, Human
ugccugggaaccaauccuggcu

SEQ ID NO: 721564 - RNA, 22 nt, Human
uggacaggcuccuagggguucc

SEQ ID NO: 721565 - RNA, 21 nt, Human
gccacugcacuccagccuggg

SEQ ID NO: 721566 - RNA, 22 nt, Human
cacacaugugggauccgcaggg

SEQ ID NO: 721567 - RNA, 22 nt, Human
uuagccaugugggaaaaacagc

SEQ ID NO: 721568 - RNA, 22 nt, Human
uuccuuggauacaaguaacuuu

SEQ ID NO: 721569 - RNA, 22 nt, Human
acuuggagagcauugcugggga

SEQ ID NO: 721570 - RNA, 22 nt, Human
ggaggccaccugaccugcuguu

SEQ ID NO: 721571 - RNA, 22 nt, Human
acaggaugauaaaggauggcca

SEQ ID NO: 721572 - RNA, 21 nt, Human
aagugccacccacagaugcau

SEQ ID NO: 721573 - RNA, 22 nt, Human
aggccucagccugccaggccug

SEQ ID NO: 721574 - RNA, 17 nt, Human
uuccucucacauuuuuu

SEQ ID NO: 721575 - RNA, 22 nt, Human
gggacacucaaugagaccugca

SEQ ID NO: 721576 - RNA, 22 nt, Human
ugcugaggacaccuagccuucu

SEQ ID NO: 721577 - RNA, 22 nt, Human
gcugcuggcgcugggcguccgg

SEQ ID NO: 721578 - RNA, 21 nt, Human
guuauugaccuccaggcuggc

SEQ ID NO: 721579 - RNA, 22 nt, Human
cagcugccuucugcgggaaguc

SEQ ID NO: 721580 - RNA, 22 nt, Human
cacucuaagaacacaaaggccc

SEQ ID NO: 721581 - RNA, 22 nt, Human
ccaaggagcugcaggcacuugu

SEQ ID NO: 721582 - RNA, 22 nt, Human
acaugcuacagugaaggaggaa

SEQ ID NO: 721583 - RNA, 22 nt, Human
caugcacagagcuuggucauug

SEQ ID NO: 721584 - RNA, 22 nt, Human
cacaugaagauucaacuggaug

SEQ ID NO: 721585 - RNA, 22 nt, Human
cugcuguccaggagugcccugu

SEQ ID NO: 721586 - RNA, 22 nt, Human
caccagcagaagacugagggug

SEQ ID NO: 721587 - RNA, 22 nt, Human
cccugaggggaguggugaggug

SEQ ID NO: 721588 - RNA, 22 nt, Human
cuccauugaacauccucucaga

SEQ ID NO: 721589 - RNA, 22 nt, Human
uauggcuucuuuugcaacuacu

SEQ ID NO: 721590 - RNA, 22 nt, Human
uucuucuucaagugcugcauuc

SEQ ID NO: 721591 - RNA, 22 nt, Human
agcaauaauuuaggccuuuccu

SEQ ID NO: 721592 - RNA, 22 nt, Human
ugcuaaauaaguggaauagaca

SEQ ID NO: 721593 - RNA, 22 nt, Human
ugggaaggcagucacuguccua

SEQ ID NO: 721594 - RNA, 22 nt, Human
aagggcuguuauguuuuuauac

SEQ ID NO: 721595 - RNA, 22 nt, Human
cagguauaacgugcauguugua

SEQ ID NO: 721596 - RNA, 22 nt, Human
uacaaaaggaagagggaucuua

SEQ ID NO: 721597 - RNA, 22 nt, Human
uaguaacagauuuauacagucu

SEQ ID NO: 721598 - RNA, 22 nt, Human
augaucauggaagugcacccau

SEQ ID NO: 721599 - RNA, 22 nt, Human
agcagagcccuuccauggccuu

SEQ ID NO: 721600 - RNA, 22 nt, Human
ccuggagaggcgcugcagagga

SEQ ID NO: 721601 - RNA, 21 nt, Human
agcugcagucaagccagaggu

SEQ ID NO: 721602 - RNA, 22 nt, Human
cugggugguucuaacuguugau

SEQ ID NO: 721603 - RNA, 22 nt, Human
uuuccagggcucuguagaagaa

SEQ ID NO: 721604 - RNA, 22 nt, Human
cugaggcucagcgugaggaaag

SEQ ID NO: 721605 - RNA, 22 nt, Human
ggaagggccucgggcgugggac

SEQ ID NO: 721606 - RNA, 22 nt, Human
guuuuucucugaaauaguugac

SEQ ID NO: 721607 - RNA, 22 nt, Human
uugaggcccggcaggccgagcg

SEQ ID NO: 721608 - RNA, 21 nt, Human
accaaaaccuauacuuucugu

SEQ ID NO: 721609 - RNA, 22 nt, Human
cucuuuguggaacggcaguguc

SEQ ID NO: 721610 - RNA, 22 nt, Human
uuugagaaguaauucaagacau

SEQ ID NO: 721611 - RNA, 22 nt, Human
cucccaguguuguuuucugaug

SEQ ID NO: 721612 - RNA, 22 nt, Human
cugcuuuaauguaagauauacc

SEQ ID NO: 721613 - RNA, 22 nt, Human
uuagaaauacaagugagguuga

SEQ ID NO: 721614 - RNA, 22 nt, Human
acacaauaaauuuauccuuuga

SEQ ID NO: 721615 - RNA, 22 nt, Human
acauuguuugagaauacagaug

SEQ ID NO: 721616 - RNA, 22 nt, Human
auguuacaguugaguaaauuaa

SEQ ID NO: 721617 - RNA, 22 nt, Human
aagacaugcaauuagcaaggaa

SEQ ID NO: 721618 - RNA, 22 nt, Human
agagagcuguccugggacaccc

SEQ ID NO: 721619 - RNA, 22 nt, Human
agcacaguuuucauugcagggu

SEQ ID NO: 721620 - RNA, 22 nt, Human
cauuuccacucugggagucaga

SEQ ID NO: 721621 - RNA, 22 nt, Human
gcuggccucuggagaagggcuu

SEQ ID NO: 721622 - RNA, 22 nt, Human
agaacagcaacaucagacaaag

SEQ ID NO: 721623 - RNA, 22 nt, Human
aggcccugcugaggccucccuc

SEQ ID NO: 721624 - RNA, 22 nt, Human
agagaugacugauggcugauua

SEQ ID NO: 721625 - RNA, 21 nt, Human
cagaggguuucucagguguuu

SEQ ID NO: 721626 - RNA, 22 nt, Human
ugcugccuccuuccugccagga

SEQ ID NO: 721627 - RNA, 22 nt, Human
ggcagauggaagaggcuggguc

SEQ ID NO: 721628 - RNA, 22 nt, Human
auacaucuuccuuuuaaaaugc

SEQ ID NO: 721629 - RNA, 22 nt, Human
ugaaaguauuugauuucuauua

SEQ ID NO: 721630 - RNA, 22 nt, Human
uccacagggccuuucuggugug

SEQ ID NO: 721631 - RNA, 22 nt, Human
cugagcuguuuaaucccagaua

SEQ ID NO: 721632 - RNA, 22 nt, Human
aguggggccgcgguccugcccu

SEQ ID NO: 721633 - RNA, 22 nt, Human
gaggugggagggcagucccuaa

SEQ ID NO: 721634 - RNA, 22 nt, Human
auacagaagaacuauagccacu

SEQ ID NO: 721635 - RNA, 22 nt, Human
ugugcacauaaaacaguacuag

SEQ ID NO: 721636 - RNA, 22 nt, Human
agaaaugggccuugggacacaa

SEQ ID NO: 721637 - RNA, 22 nt, Human
ggucugugaucuuauggauucu

SEQ ID NO: 721638 - RNA, 22 nt, Human
auggcagaccugggcuggagaa

SEQ ID NO: 721639 - RNA, 22 nt, Human
aaggcagggaaaguggauuagg

SEQ ID NO: 721640 - RNA, 23 nt, Human
acaggcucuuaaucagugcuccu

SEQ ID NO: 721641 - RNA, 22 nt, Human
accguauauguuugcugugccc

SEQ ID NO: 721642 - RNA, 17 nt, Human
agccagcaguagcuggu

SEQ ID NO: 721643 - RNA, 22 nt, Human
agugugugaccuuuuaauuuaa

SEQ ID NO: 721644 - RNA, 22 nt, Human
cuggucaggggauggggcucag

SEQ ID NO: 721645 - RNA, 22 nt, Human
aguacaaaaugcagcaucauca

SEQ ID NO: 721646 - RNA, 22 nt, Human
ucagcagggcugggagcuguga

SEQ ID NO: 721647 - RNA, 22 nt, Human
cucagcuucuaccuccugagug

SEQ ID NO: 721648 - RNA, 22 nt, Human
cagagcggccacuagagggcgc

SEQ ID NO: 721649 - RNA, 22 nt, Human
ugagcuucuuuauuuggccaga

SEQ ID NO: 721650 - RNA, 22 nt, Human
ucugaagagucuugcaagaaag

SEQ ID NO: 721651 - RNA, 18 nt, Human
ggauaggaccuuaggcag

SEQ ID NO: 721652 - RNA, 22 nt, Human
cuccacucaccagaugccagga

SEQ ID NO: 721653 - RNA, 22 nt, Human
cugaggaggcuaauuugaggau

SEQ ID NO: 721654 - RNA, 22 nt, Human
acagccuuauugcgagcaaggc

SEQ ID NO: 721655 - RNA, 22 nt, Human
ggcuggaaacucagguaggguu

SEQ ID NO: 721656 - RNA, 22 nt, Human
caggugggccgggguuuguucu

SEQ ID NO: 721657 - RNA, 22 nt, Human
uauuaugaggggcagagggcau

SEQ ID NO: 721658 - RNA, 22 nt, Human
gagggggcgaacagaagcaagg

SEQ ID NO: 721659 - RNA, 22 nt, Human
gaaaggccacgugccaagauua

SEQ ID NO: 721660 - RNA, 23 nt, Human
uccaagggcuacaaacacagacc

SEQ ID NO: 721661 - RNA, 22 nt, Human
uccaauguuccugcuuucagcu

SEQ ID NO: 721662 - RNA, 22 nt, Human
auucacacacauuuagagcaga

SEQ ID NO: 721663 - RNA, 22 nt, Human
ucccuggacaacagacuucacu

SEQ ID NO: 721664 - RNA, 22 nt, Human
cuuaaauuuucaucuacaagaa

SEQ ID NO: 721665 - RNA, 22 nt, Human
gcucugcuugcaucaugacugc

SEQ ID NO: 721666 - RNA, 22 nt, Human
gaguuacagagaggauuauggu

SEQ ID NO: 721667 - RNA, 22 nt, Human
aggccagguggucaugcuugcu

SEQ ID NO: 721668 - RNA, 22 nt, Human
auaaggcagucacuggaauguu

SEQ ID NO: 721669 - RNA, 22 nt, Human
ucuguuggagccuaggaugaca

SEQ ID NO: 721670 - RNA, 22 nt, Human
aagacauucaugaagaagggau

SEQ ID NO: 721671 - RNA, 22 nt, Human
gugaaggauaaggaucuaaauu

SEQ ID NO: 721672 - RNA, 22 nt, Human
uuuucuuccuggauuuuggcau

SEQ ID NO: 721673 - RNA, 22 nt, Human
ggaggccaugaggcucuaggug

SEQ ID NO: 721674 - RNA, 22 nt, Human
gcagacaggcccaguggaggga

SEQ ID NO: 721675 - RNA, 22 nt, Human
ggugccagccuagugcaguggu

SEQ ID NO: 721676 - RNA, 18 nt, Human
cacaggcucccagugagg

SEQ ID NO: 721677 - RNA, 22 nt, Human
gugccucucauuggcugagccc

SEQ ID NO: 721678 - RNA, 22 nt, Human
auucuguuacuuggugaucuuc

SEQ ID NO: 721679 - RNA, 22 nt, Human
cuguuauuaaaaagcucaggcu

SEQ ID NO: 721680 - RNA, 22 nt, Human
agcuggcauugcagggagcugc

SEQ ID NO: 721681 - RNA, 22 nt, Human
cagugcaauuacaagcuaauuc

SEQ ID NO: 721682 - RNA, 22 nt, Human
ucuggagccuuggaugggaaag

SEQ ID NO: 721683 - RNA, 22 nt, Human
acaaugcaccagcaucuucacc

SEQ ID NO: 721684 - RNA, 22 nt, Human
agaggccgggugccugcucaga

SEQ ID NO: 721685 - RNA, 23 nt, Human
acaaccagcacuggagggcacca

SEQ ID NO: 721686 - RNA, 22 nt, Human
aggugacaucccggcagcagag

SEQ ID NO: 721687 - RNA, 22 nt, Human
uacaguaguaucuucauuuguu

SEQ ID NO: 721688 - RNA, 18 nt, Human
gcaggagauggguggggu

SEQ ID NO: 721689 - RNA, 22 nt, Human
gucagcaugagcaagggcugac

SEQ ID NO: 721690 - RNA, 22 nt, Human
aauaugugggugcuaaucaaaa

SEQ ID NO: 721691 - RNA, 22 nt, Human
gcugggccgaccugggcugcag

SEQ ID NO: 721692 - RNA, 23 nt, Human
agcuucgccuuccuuucucugca

SEQ ID NO: 721693 - RNA, 22 nt, Human
gagagaacccuaaaugagauau

SEQ ID NO: 721694 - RNA, 22 nt, Human
gagagagaaccccgugcccuuc

SEQ ID NO: 721695 - RNA, 22 nt, Human
gcacaggcaauagauacagcua

SEQ ID NO: 721696 - RNA, 22 nt, Human
agaucuuuaaaaguuauuauua

SEQ ID NO: 721697 - RNA, 22 nt, Human
aggguucugccagugucuugag

SEQ ID NO: 721698 - RNA, 22 nt, Human
ccagcagguguagggcucaugg

SEQ ID NO: 721699 - RNA, 22 nt, Human
ugucuguaauagucacuaugug

SEQ ID NO: 721700 - RNA, 22 nt, Human
ucucugaaggggagcuguuuaa

SEQ ID NO: 721701 - RNA, 22 nt, Human
ugucacaacagaggaacugaau

SEQ ID NO: 721702 - RNA, 22 nt, Human
aaguaugcuaauuaacuagcac

SEQ ID NO: 721703 - RNA, 22 nt, Human
gaaguucuuuauagcaguguga

SEQ ID NO: 721704 - RNA, 22 nt, Human
gcagaaggucuggcacuucagg

SEQ ID NO: 721705 - RNA, 22 nt, Human
cugaggcacccaucuucuccug

SEQ ID NO: 721706 - RNA, 22 nt, Human
agcaaugaccagugaucuugua

SEQ ID NO: 721707 - RNA, 22 nt, Human
gaguucaguguuucuaguagug

SEQ ID NO: 721708 - RNA, 22 nt, Human
gacugcaaccuuagacuagaaa

SEQ ID NO: 721709 - RNA, 22 nt, Human
aaucuuucccuauuaaaugugg

SEQ ID NO: 721710 - RNA, 22 nt, Human
uaaagagccauuguaugguuuu

SEQ ID NO: 721711 - RNA, 22 nt, Human
gccuggcuccuaaggacuggcu

SEQ ID NO: 721712 - RNA, 19 nt, Human
acagggcuuggccugacau

SEQ ID NO: 721713 - RNA, 22 nt, Human
accuuuggauaauuugaguuug

SEQ ID NO: 721714 - RNA, 20 nt, Human
uacagaaugcaauaaaaugg

SEQ ID NO: 721715 - RNA, 22 nt, Human
auuguacagguuggaggaagug

SEQ ID NO: 721716 - RNA, 22 nt, Human
uuuguucugaaaaucuucccuu

SEQ ID NO: 721717 - RNA, 22 nt, Human
gugcuccuggccacaugaagcu

SEQ ID NO: 721718 - RNA, 22 nt, Human
aaacauagauaauagauagaug

SEQ ID NO: 721719 - RNA, 22 nt, Human
ccugggcuuucggcggcuuccu

SEQ ID NO: 721720 - RNA, 22 nt, Human
gcucugcuguguuuguucagca

SEQ ID NO: 721721 - RNA, 22 nt, Human
uuugcaguagacaucuuauuuu

SEQ ID NO: 721722 - RNA, 22 nt, Human
acacaguaugcaucuagaaauu

SEQ ID NO: 721723 - RNA, 20 nt, Human
gaggccucagccucagcucc

SEQ ID NO: 721724 - RNA, 22 nt, Human
gauucaauguugcagauggaau

SEQ ID NO: 721725 - RNA, 22 nt, Human
caugucuuuguuaugcucacca

SEQ ID NO: 721726 - RNA, 22 nt, Human
acacuucagcaguaugcuuggg

SEQ ID NO: 721727 - RNA, 23 nt, Human
aauuacaaccaagaacuggaagg

SEQ ID NO: 721728 - RNA, 22 nt, Human
ucacaucucucauugccucugc

SEQ ID NO: 721729 - RNA, 22 nt, Human
guguauaacuaucuaucuagua

SEQ ID NO: 721730 - RNA, 22 nt, Human
cacaggcuugucagcaugaggc

SEQ ID NO: 721731 - RNA, 22 nt, Human
uccagguaucuggcuuccacau

SEQ ID NO: 721732 - RNA, 22 nt, Human
ggcagugagcuggagggaagga

SEQ ID NO: 721733 - RNA, 22 nt, Human
gugugggcagggccgugcuccc

SEQ ID NO: 721734 - RNA, 22 nt, Human
ucacacuaggauguuguuucua

SEQ ID NO: 721735 - RNA, 22 nt, Human
ucgccagggaugcuguaaggaa

SEQ ID NO: 721736 - RNA, 22 nt, Human
uaaaggcacugcgucccucaaa

SEQ ID NO: 721737 - RNA, 22 nt, Human
uccugugggcucucggccucca

SEQ ID NO: 721738 - RNA, 22 nt, Human
ucaugcuuugguugcuguccuu

SEQ ID NO: 721739 - RNA, 22 nt, Human
ggccaugggaagagguggagag

SEQ ID NO: 721740 - RNA, 22 nt, Human
agggacccugaugacugaggag

SEQ ID NO: 721741 - RNA, 21 nt, Human
ucuuuuaacaccaggaauucc

SEQ ID NO: 721742 - RNA, 22 nt, Human
uuucuucucugauuaaggcuca

SEQ ID NO: 721743 - RNA, 22 nt, Human
agcaaagaagacacaggcuuca

SEQ ID NO: 721744 - RNA, 22 nt, Human
auggcuggcacuggccuggguu

SEQ ID NO: 721745 - RNA, 22 nt, Human
ccugaacagucugaaaggagac

SEQ ID NO: 721746 - RNA, 18 nt, Human
auggaggcagagagcuga

SEQ ID NO: 721747 - RNA, 22 nt, Human
ugagccaagaucaugccguugu

SEQ ID NO: 721748 - RNA, 22 nt, Human
accuguggaucagauucuugua

SEQ ID NO: 721749 - RNA, 22 nt, Human
gaugggcaucaaacaugacgug

SEQ ID NO: 721750 - RNA, 18 nt, Human
agcagguggcgucugcag

SEQ ID NO: 721751 - RNA, 22 nt, Human
aucgcaauguuuagaauuuugu

SEQ ID NO: 721752 - RNA, 22 nt, Human
ugccaggcccugugcuggaugc

SEQ ID NO: 721753 - RNA, 22 nt, Human
gagagaagggggauaugagccu

SEQ ID NO: 721754 - RNA, 22 nt, Human
aggucaggaggccucugccauu

SEQ ID NO: 721755 - RNA, 22 nt, Human
uggccugccucccggcuucuuu

SEQ ID NO: 721756 - RNA, 22 nt, Human
guuguacaauuguuucacaugc

SEQ ID NO: 721757 - RNA, 19 nt, Human
ggcugccuggagcgagggc

SEQ ID NO: 721758 - RNA, 22 nt, Human
uccugccucacaguugaaguuu

SEQ ID NO: 721759 - RNA, 22 nt, Human
auggggggaugaaggaguccaa

SEQ ID NO: 721760 - RNA, 22 nt, Human
ccaccacuucuggcuucuggug

SEQ ID NO: 721761 - RNA, 22 nt, Human
uggaguucucaggugagggcuu

SEQ ID NO: 721762 - RNA, 22 nt, Human
cagcaugcccagacugagcuaa

SEQ ID NO: 721763 - RNA, 22 nt, Human
aaaggcaugugcaacuacaaau

SEQ ID NO: 721764 - RNA, 19 nt, Human
cccuugguagacagcugca

SEQ ID NO: 721765 - RNA, 22 nt, Human
cacaggggcaaacuguagggga

SEQ ID NO: 721766 - RNA, 22 nt, Human
ucacugcagagaccucuaguca

SEQ ID NO: 721767 - RNA, 22 nt, Human
acuguuuucuuagcucccugcu

SEQ ID NO: 721768 - RNA, 22 nt, Human
cagcagcuagaggaagggcaga

SEQ ID NO: 721769 - RNA, 19 nt, Human
ugagcuggcugagccucuc

SEQ ID NO: 721770 - RNA, 19 nt, Human
uucacauuggaagaaguag

SEQ ID NO: 721771 - RNA, 22 nt, Human
aauucacauguugaaguccuaa

SEQ ID NO: 721772 - RNA, 22 nt, Human
auuguauuauaauuaggccaaa

SEQ ID NO: 721773 - RNA, 22 nt, Human
aagaguuucugggucaaggauu

SEQ ID NO: 721774 - RNA, 22 nt, Human
cagaaggcuggcagauugagau

SEQ ID NO: 721775 - RNA, 22 nt, Human
agcagcauucucugguaugggg

SEQ ID NO: 721776 - RNA, 22 nt, Human
acugagcaaugcagugggagcg

SEQ ID NO: 721777 - RNA, 22 nt, Human
guauuuuuagguaaggaaagua

SEQ ID NO: 721778 - RNA, 22 nt, Human
uuugcaaauaaauaagugcucg

SEQ ID NO: 721779 - RNA, 22 nt, Human
ucuaguguuuuggaacauggaa

SEQ ID NO: 721780 - RNA, 22 nt, Human
aaugcuuccaaaauaccaagcc

SEQ ID NO: 721781 - RNA, 22 nt, Human
ucuuggccagaugcacuuccuc

SEQ ID NO: 721782 - RNA, 22 nt, Human
uucugcucaguaguaagagugc

SEQ ID NO: 721783 - RNA, 22 nt, Human
cugggcaguaugaauauucaaa

SEQ ID NO: 721784 - RNA, 22 nt, Human
cugggcacaaguggcccuggau

SEQ ID NO: 721785 - RNA, 22 nt, Human
cuucucuacuuccuggaagggg

SEQ ID NO: 721786 - RNA, 18 nt, Human
uucuccagaaaacauagc

SEQ ID NO: 721787 - RNA, 22 nt, Human
gugcuggcaccccucuccaguu

SEQ ID NO: 721788 - RNA, 22 nt, Human
aaaagucuacaagcuucaacaa

SEQ ID NO: 721789 - RNA, 22 nt, Human
acacaccaugauuuauuuaccc

SEQ ID NO: 721790 - RNA, 22 nt, Human
caucaguaaggcaacauagcuu

SEQ ID NO: 721791 - RNA, 21 nt, Human
ggcuguggagccaugacucac

SEQ ID NO: 721792 - RNA, 22 nt, Human
cucagugcugaggaaaguugaa

SEQ ID NO: 721793 - RNA, 22 nt, Human
guguuccuggacagcaagugag

SEQ ID NO: 721794 - RNA, 22 nt, Human
agcagaacugaugagacuugag

SEQ ID NO: 721795 - RNA, 22 nt, Human
ugcagagauccuggacugagcg

SEQ ID NO: 721796 - RNA, 22 nt, Human
acagcugcauucuuaacaggaa

SEQ ID NO: 721797 - RNA, 22 nt, Human
uuaacacagggggagacaaagu

SEQ ID NO: 721798 - RNA, 22 nt, Human
cccagugucaccaacaggacac

SEQ ID NO: 721799 - RNA, 22 nt, Human
gccagcucucauuguauaggcu

SEQ ID NO: 721800 - RNA, 22 nt, Human
acaggccugagauuuugcauuu

SEQ ID NO: 721801 - RNA, 22 nt, Human
aaagcuguuguauggcccuugg

SEQ ID NO: 721802 - RNA, 22 nt, Human
acagacugugaguaugcauagu

SEQ ID NO: 721803 - RNA, 22 nt, Human
ugcagggaauccagucuagggu

SEQ ID NO: 721804 - RNA, 22 nt, Human
uccucaguaaggaucgucagcu

SEQ ID NO: 721805 - RNA, 22 nt, Human
cacaaaguauaacuugauggaa

SEQ ID NO: 721806 - RNA, 22 nt, Human
uccugggaaguggcuggcugag

SEQ ID NO: 721807 - RNA, 22 nt, Human
uaauuucuggagggagaaagag

SEQ ID NO: 721808 - RNA, 22 nt, Human
guggcccucagcaguugccaag

SEQ ID NO: 721809 - RNA, 22 nt, Human
uuggcacagagcugcagccugg

SEQ ID NO: 721810 - RNA, 22 nt, Human
cuguggaaggacuuagcgauac

SEQ ID NO: 721811 - RNA, 22 nt, Human
agcuucuggaagccuggcagca

SEQ ID NO: 721812 - RNA, 22 nt, Human
augucuuuggcuuugacauggc

SEQ ID NO: 721813 - RNA, 22 nt, Human
aacuguggagauucggaaggua

SEQ ID NO: 721814 - RNA, 22 nt, Human
cagcaagaggguaagguugaag

SEQ ID NO: 721815 - RNA, 22 nt, Human
cagaaguaagauuacugugagu

SEQ ID NO: 721816 - RNA, 22 nt, Human
ccacacuuugagaugacuagga

SEQ ID NO: 721817 - RNA, 21 nt, Human
ggguggguggaauuaggagug

SEQ ID NO: 721818 - RNA, 23 nt, Human
ucagucuuggcuucugauuuucc

SEQ ID NO: 721819 - RNA, 22 nt, Human
cugagcauggccgguccauggu

SEQ ID NO: 721820 - RNA, 22 nt, Human
gaguccuuuucauagcaguggg

SEQ ID NO: 721821 - RNA, 23 nt, Human
auuucuaggggauuuucuggugc

SEQ ID NO: 721822 - RNA, 22 nt, Human
ugaaguuuucugguugauuaag

SEQ ID NO: 721823 - RNA, 22 nt, Human
gaauggcauagcuuucuuuaca

SEQ ID NO: 721824 - RNA, 22 nt, Human
gacaaugugcaauugcagcuag

SEQ ID NO: 721825 - RNA, 22 nt, Human
auuguacauaugauguauguaa

SEQ ID NO: 721826 - RNA, 22 nt, Human
cugaggccuguguuggggcagu

SEQ ID NO: 721827 - RNA, 22 nt, Human
uacaguagucgucuuauuuuga

SEQ ID NO: 721828 - RNA, 22 nt, Human
ggggaccuggccacccauccuu

SEQ ID NO: 721829 - RNA, 22 nt, Human
aggcugaggaucguacuuucca

SEQ ID NO: 721830 - RNA, 22 nt, Human
gcugugcuggaaggggaccugc

SEQ ID NO: 721831 - RNA, 22 nt, Human
ccaggguugcuuuagauucuga

SEQ ID NO: 721832 - RNA, 22 nt, Human
caaggugaacuugcuguacagc

SEQ ID NO: 721833 - RNA, 22 nt, Human
aguggggaagauuuugcaguca

SEQ ID NO: 721834 - RNA, 22 nt, Human
uggaucugcucuaugaacugcu

SEQ ID NO: 721835 - RNA, 22 nt, Human
gcagggcuggggcugcuccuga

SEQ ID NO: 721836 - RNA, 20 nt, Human
gagccuuccccucaccacug

SEQ ID NO: 721837 - RNA, 22 nt, Human
gugcccagcuccaccucacaga

SEQ ID NO: 721838 - RNA, 22 nt, Human
ugcucaggaggaggcugugagg

SEQ ID NO: 721839 - RNA, 22 nt, Human
uagcaggguccaaugugaggca

SEQ ID NO: 721840 - RNA, 22 nt, Human
acagaugguuauugucauuucu

SEQ ID NO: 721841 - RNA, 22 nt, Human
uacacauguuuggcaaguaugu

SEQ ID NO: 721842 - RNA, 22 nt, Human
ggguuggggcccagcagucugc

SEQ ID NO: 721843 - RNA, 22 nt, Human
aaagagccagcuaccucaguuu

SEQ ID NO: 721844 - RNA, 22 nt, Human
auucaguuuuugaagggaaauu

SEQ ID NO: 721845 - RNA, 22 nt, Human
uggaggaaguggacaguugugu

SEQ ID NO: 721846 - RNA, 22 nt, Human
gggcacuggaggccaaggagcu

SEQ ID NO: 721847 - RNA, 22 nt, Human
ucucuggcagacaccucccuga

SEQ ID NO: 721848 - RNA, 22 nt, Human
gggcuccaucggacuuggguuu

SEQ ID NO: 721849 - RNA, 22 nt, Human
cagugaaguuuaaaguguagau

SEQ ID NO: 721850 - RNA, 22 nt, Human
acaucucagaacugaguaaccg

SEQ ID NO: 721851 - RNA, 22 nt, Human
aggggaggcagcgauaaaccug

SEQ ID NO: 721852 - RNA, 19 nt, Human
ucgagucaagacacuaggc

SEQ ID NO: 721853 - RNA, 22 nt, Human
agagucagcuuaugacacaguc

SEQ ID NO: 721854 - RNA, 22 nt, Human
guccuguggaaagcuagccgcu

SEQ ID NO: 721855 - RNA, 22 nt, Human
ucucuugauauauuacauagag

SEQ ID NO: 721856 - RNA, 22 nt, Human
acugaugaaagguaagacucca

SEQ ID NO: 721857 - RNA, 22 nt, Human
auuuucaguguaaauguuuuau

SEQ ID NO: 721858 - RNA, 22 nt, Human
acaguggaaagaaacgaauuag

SEQ ID NO: 721859 - RNA, 22 nt, Human
cugagcaauuucagcucucacu

SEQ ID NO: 721860 - RNA, 22 nt, Human
ccuguccccucacaaugccacu

SEQ ID NO: 721861 - RNA, 22 nt, Human
auuugucuucaguagguucuuc

SEQ ID NO: 721862 - RNA, 20 nt, Human
cagauucuccacuaacauau

SEQ ID NO: 721863 - RNA, 22 nt, Human
uuuagucugacuauuaccucca

SEQ ID NO: 721864 - RNA, 22 nt, Human
ccugagcucaagaaggugacca

SEQ ID NO: 721865 - RNA, 19 nt, Human
auauauguauacaaugugg

SEQ ID NO: 721866 - RNA, 19 nt, Human
ucagugcuccuauguccuu

SEQ ID NO: 721867 - RNA, 22 nt, Human
agcacaugcacagugcuacacu

SEQ ID NO: 721868 - RNA, 22 nt, Human
uuacuugauagggggauggggu

SEQ ID NO: 721869 - RNA, 22 nt, Human
gagcuuggccucuugaacgugg

SEQ ID NO: 721870 - RNA, 22 nt, Human
aacugcuuguagugacuugccu

SEQ ID NO: 721871 - RNA, 22 nt, Human
cuacaaugacagaauugaguag

SEQ ID NO: 721872 - RNA, 22 nt, Human
ccucugagaacaccuggcgucc

SEQ ID NO: 721873 - RNA, 22 nt, Human
uggaguucauccaugacagcuu

SEQ ID NO: 721874 - RNA, 22 nt, Human
ugcuucauuuugacuuagccag

SEQ ID NO: 721875 - RNA, 22 nt, Human
ggcagugguuagaaacaugagc

SEQ ID NO: 721876 - RNA, 22 nt, Human
agguaaaaugagucuccauuau

SEQ ID NO: 721877 - RNA, 22 nt, Human
accaucuuaaggggacuucuua

SEQ ID NO: 721878 - RNA, 22 nt, Human
gcagcuuuggagguggaacucu

SEQ ID NO: 721879 - RNA, 22 nt, Human
gguguguagcauguuuaagacc

SEQ ID NO: 721880 - RNA, 22 nt, Human
aggcuccaagagguuaagucac

SEQ ID NO: 721881 - RNA, 22 nt, Human
cagcaugguggagcugcucuuu

SEQ ID NO: 721882 - RNA, 22 nt, Human
agucagaggaaugggccaggcu

SEQ ID NO: 721883 - RNA, 22 nt, Human
ucauacauaacuuguacaguga

SEQ ID NO: 721884 - RNA, 22 nt, Human
gggguaggcaggugaucugauc

SEQ ID NO: 721885 - RNA, 22 nt, Human
uaucuagauauuuggauaaaug

SEQ ID NO: 721886 - RNA, 19 nt, Human
ucagcccaucagacucaca

SEQ ID NO: 721887 - RNA, 22 nt, Human
aacaaaguacuuuucagugcuu

SEQ ID NO: 721888 - RNA, 22 nt, Human
augauuucuauauaaacuuaaa

SEQ ID NO: 721889 - RNA, 17 nt, Human
ugaagaugcauggcagc

SEQ ID NO: 721890 - RNA, 22 nt, Human
aaggaagguucauagucaaaga

SEQ ID NO: 721891 - RNA, 18 nt, Human
ucugagggugcgggagcu

SEQ ID NO: 721892 - RNA, 22 nt, Human
aggaagaaaugugacuucaaac

SEQ ID NO: 721893 - RNA, 22 nt, Human
agcuuucaggauaaugaaaaag

SEQ ID NO: 721894 - RNA, 22 nt, Human
uguaugaagacuucuucugugu

SEQ ID NO: 721895 - RNA, 22 nt, Human
agcgcgcucuaggacaccgcgg

SEQ ID NO: 721896 - RNA, 23 nt, Human
acuuucccauagcauggcuuccu

SEQ ID NO: 721897 - RNA, 22 nt, Human
cauggaaggcaaaagacacaga

SEQ ID NO: 721898 - RNA, 22 nt, Human
acugugugcuggacaugauguu

SEQ ID NO: 721899 - RNA, 22 nt, Human
uugugcaauuuaaaaucuuccu

SEQ ID NO: 721900 - RNA, 22 nt, Human
gcugucuuccuugcuccaaggg

SEQ ID NO: 721901 - RNA, 22 nt, Human
uggcagagcccagaacugagca

SEQ ID NO: 721902 - RNA, 22 nt, Human
uguuuaaucuucaggacagucu

SEQ ID NO: 721903 - RNA, 22 nt, Human
aacacuucccgaccauauggcu

SEQ ID NO: 721904 - RNA, 22 nt, Human
ucaugcagaggaaggcuaguuu

SEQ ID NO: 721905 - RNA, 22 nt, Human
ggccuaagugguuaaauggcuu

SEQ ID NO: 721906 - RNA, 22 nt, Human
uguuuccuuucuggugagcaua

SEQ ID NO: 721907 - RNA, 22 nt, Human
ucugcugaacuugcugcccaga

SEQ ID NO: 721908 - RNA, 18 nt, Human
agcaggacuguggggugg

SEQ ID NO: 721909 - RNA, 22 nt, Human
aagucaugaguccucuucugug

SEQ ID NO: 721910 - RNA, 23 nt, Human
cuucucagaagucugugccagga

SEQ ID NO: 721911 - RNA, 22 nt, Human
gcaguauaaguggauuaugucc

SEQ ID NO: 721912 - RNA, 22 nt, Human
ucuccaggugagggugguuaga

SEQ ID NO: 721913 - RNA, 22 nt, Human
auguagagcuccuugauccucc

SEQ ID NO: 721914 - RNA, 22 nt, Human
uuacaugggcuugugaguccuu

SEQ ID NO: 721915 - RNA, 22 nt, Human
uuauuuaauuuucucacucaga

SEQ ID NO: 721916 - RNA, 22 nt, Human
aacagcuaguaccaauccacua

SEQ ID NO: 721917 - RNA, 22 nt, Human
cagagggcucggcggccgcucc

SEQ ID NO: 721918 - RNA, 22 nt, Human
uaaagugcccagggaaagcggg

SEQ ID NO: 721919 - RNA, 22 nt, Human
ucuggagaggaggauguggaca

SEQ ID NO: 721920 - RNA, 22 nt, Human
uuucuaaguaaacacagcauac

SEQ ID NO: 721921 - RNA, 22 nt, Human
gauugcgucugugucaccuuca

SEQ ID NO: 721922 - RNA, 22 nt, Human
acauguguauagccuguauaga

SEQ ID NO: 721923 - RNA, 20 nt, Human
aaagcauuuacuugugauug

SEQ ID NO: 721924 - RNA, 19 nt, Human
cagaggugauauaugccca

SEQ ID NO: 721925 - RNA, 22 nt, Human
uaaugaacaugcaucgugugua

SEQ ID NO: 721926 - RNA, 19 nt, Human
ggagccagcuguggaaggc

SEQ ID NO: 721927 - RNA, 22 nt, Human
uguuacaguacuacaauucugc

SEQ ID NO: 721928 - RNA, 22 nt, Human
aauaacagugccaugaaauuga

SEQ ID NO: 721929 - RNA, 22 nt, Human
ucaggagcucuucccuggugug

SEQ ID NO: 721930 - RNA, 22 nt, Human
agaggcaaggcaggauucuucu

SEQ ID NO: 721931 - RNA, 22 nt, Human
ucccagaggacuguuggugcua

SEQ ID NO: 721932 - RNA, 22 nt, Human
cguccauauuccugagggcuca

SEQ ID NO: 721933 - RNA, 22 nt, Human
ggcaggcauggccacucccuag

SEQ ID NO: 721934 - RNA, 22 nt, Human
aaaggcaguggguauguggauc

SEQ ID NO: 721935 - RNA, 22 nt, Human
ucugauaauggacuucucaucu

SEQ ID NO: 721936 - RNA, 19 nt, Human
ucuccagcuuugggcuuuu

SEQ ID NO: 721937 - RNA, 22 nt, Human
agcagccagaaagggcagucga

SEQ ID NO: 721938 - RNA, 22 nt, Human
aaacuguaaagcaggugaguag

SEQ ID NO: 721939 - RNA, 23 nt, Human
gggcauggaguguagguggaagg

SEQ ID NO: 721940 - RNA, 21 nt, Human
cugcccauuugugaugucccc

SEQ ID NO: 721941 - RNA, 22 nt, Human
ugugccuacugauagagccaag

SEQ ID NO: 721942 - RNA, 22 nt, Human
caggaaauggcugaauaaauuc

SEQ ID NO: 721943 - RNA, 22 nt, Human
caggaggcagagguugcagcga

SEQ ID NO: 721944 - RNA, 22 nt, Human
ccccacaacucauguugaaacu

SEQ ID NO: 721945 - RNA, 22 nt, Human
acaaugucaccucucauguuuu

SEQ ID NO: 721946 - RNA, 22 nt, Human
agagaugaaaaggguacugagg

SEQ ID NO: 721947 - RNA, 23 nt, Human
uuauuuggauuuuaguggaaaga

SEQ ID NO: 721948 - RNA, 22 nt, Human
gcccuggccuggcgcguuguca

SEQ ID NO: 721949 - RNA, 22 nt, Human
agggguggccugccuuacuccc

SEQ ID NO: 721950 - RNA, 22 nt, Human
cuagagaauugucuugagaguu

SEQ ID NO: 721951 - RNA, 22 nt, Human
agggaauucacuggaacgcccu

SEQ ID NO: 721952 - RNA, 22 nt, Human
acauuuaguaugagucucugua

SEQ ID NO: 721953 - RNA, 22 nt, Human
aaacucugaugcuuauugggaa

SEQ ID NO: 721954 - RNA, 22 nt, Human
uucaagucauguuaacugcuuc

SEQ ID NO: 721955 - RNA, 23 nt, Human
aguuuuuaauggucauagcugag

SEQ ID NO: 721956 - RNA, 22 nt, Human
auucuucugccuacuuucaucc

SEQ ID NO: 721957 - RNA, 22 nt, Human
aacagauggccaagugcauggg

SEQ ID NO: 721958 - RNA, 22 nt, Human
cagggccucauugucaguccug

SEQ ID NO: 721959 - RNA, 22 nt, Human
caggcagcucgaugccuuguug

SEQ ID NO: 721960 - RNA, 22 nt, Human
cugcccacuuggccaccuucua

SEQ ID NO: 721961 - RNA, 22 nt, Human
agccaggccuuuucucaagguu

SEQ ID NO: 721962 - RNA, 22 nt, Human
cuuaauuuuuguaguagaugga

SEQ ID NO: 721963 - RNA, 22 nt, Human
cauuugaaaccuggaaucuacc

SEQ ID NO: 721964 - RNA, 22 nt, Human
aacaaugccaacagcaugcugg

SEQ ID NO: 721965 - RNA, 22 nt, Human
ucacaaaucauuuuaucugugu

SEQ ID NO: 721966 - RNA, 22 nt, Human
ccacucugauuucaagggagau

SEQ ID NO: 721967 - RNA, 22 nt, Human
cuuaaaggucauucuguugaua

SEQ ID NO: 721968 - RNA, 22 nt, Human
acugugauguucucuaucuugg

SEQ ID NO: 721969 - RNA, 22 nt, Human
uaauaccuugaucucucuuguc

SEQ ID NO: 721970 - RNA, 21 nt, Human
ggacaccagucacacuggauu

SEQ ID NO: 721971 - RNA, 17 nt, Human
aggagggaaauagcuug

SEQ ID NO: 721972 - RNA, 22 nt, Human
uguacagacuuugcagugugca

SEQ ID NO: 721973 - RNA, 22 nt, Human
gagcagacgcugcagucuuggg

SEQ ID NO: 721974 - RNA, 22 nt, Human
agacaacaucuaguuuggugga

SEQ ID NO: 721975 - RNA, 22 nt, Human
uuacaauaguuccuucuuuugu

SEQ ID NO: 721976 - RNA, 22 nt, Human
gcucagucuuugugggguacgg

SEQ ID NO: 721977 - RNA, 22 nt, Human
ggcagcugguucuuuccauuaa

SEQ ID NO: 721978 - RNA, 22 nt, Human
acccgggaggcaggagucauag

SEQ ID NO: 721979 - RNA, 22 nt, Human
cugagcgcgggaccugaggcug

SEQ ID NO: 721980 - RNA, 22 nt, Human
aagacauuuugaaauuggaagc

SEQ ID NO: 721981 - RNA, 22 nt, Human
gccaucucggagcuaucaaagg

SEQ ID NO: 721982 - RNA, 22 nt, Human
uuugugugcuugguauugaaga

SEQ ID NO: 721983 - RNA, 20 nt, Human
agaagcugagacuggguuuu

SEQ ID NO: 721984 - RNA, 22 nt, Human
gggcuucucugggaguccuggu

SEQ ID NO: 721985 - RNA, 22 nt, Human
acaggcucucuauugagugcag

SEQ ID NO: 721986 - RNA, 17 nt, Human
cuccucucuggguuacu

SEQ ID NO: 721987 - RNA, 22 nt, Human
accccagguccagguuacagag

SEQ ID NO: 721988 - RNA, 22 nt, Human
uacacauuuugcggguacaugu

SEQ ID NO: 721989 - RNA, 22 nt, Human
uacauuccuucguuuagagauu

SEQ ID NO: 721990 - RNA, 22 nt, Human
guggcucucgccagccugcggg

SEQ ID NO: 721991 - RNA, 22 nt, Human
guuuuuccuugcugaggacccg

SEQ ID NO: 721992 - RNA, 22 nt, Human
cuacaguacuggaugcucagcc

SEQ ID NO: 721993 - RNA, 22 nt, Human
ugguggcaaaucaggacacuuc

SEQ ID NO: 721994 - RNA, 20 nt, Human
gaagccagaggggaaaggag

SEQ ID NO: 721995 - RNA, 22 nt, Human
cuuuccuagauggccaucuuuc

SEQ ID NO: 721996 - RNA, 22 nt, Human
gagcugccagacaugggaauga

SEQ ID NO: 721997 - RNA, 22 nt, Human
cagcuggcugcaugaugccaaa

SEQ ID NO: 721998 - RNA, 22 nt, Human
uccuggaguugucuguacucau

SEQ ID NO: 721999 - RNA, 22 nt, Human
cuggcagggcucuuugggugcu

SEQ ID NO: 722000 - RNA, 22 nt, Human
agccagugacauacgauuggga

SEQ ID NO: 722001 - RNA, 22 nt, Human
uggcucagaacuacuucuaguu

SEQ ID NO: 722002 - RNA, 22 nt, Human
auguacacuuuggaagagucac

SEQ ID NO: 722003 - RNA, 22 nt, Human
uucuuguucuccucauuuagag

SEQ ID NO: 722004 - RNA, 22 nt, Human
uaaagguaacaugaacugcuuu

SEQ ID NO: 722005 - RNA, 22 nt, Human
ccuggcuccagcugccuguccu

SEQ ID NO: 722006 - RNA, 22 nt, Human
gucuggcauucuuccuggagaa

SEQ ID NO: 722007 - RNA, 22 nt, Human
auccuugaacuuagacacuagg

SEQ ID NO: 722008 - RNA, 22 nt, Human
aucuuucucugcacuauacaau

SEQ ID NO: 722009 - RNA, 22 nt, Human
caagaucaagguaucagcagau

SEQ ID NO: 722010 - RNA, 22 nt, Human
agccuuguuggucugaguuugg

SEQ ID NO: 722011 - RNA, 22 nt, Human
gaggcugaugcugccucacaga

SEQ ID NO: 722012 - RNA, 22 nt, Human
aaguaaauaucuguuuauagca

SEQ ID NO: 722013 - RNA, 22 nt, Human
augcugugccuggaaagcggcu

SEQ ID NO: 722014 - RNA, 22 nt, Human
ucccugcucagcucaccuggca

SEQ ID NO: 722015 - RNA, 22 nt, Human
gccuggagggucccucucugga

SEQ ID NO: 722016 - RNA, 22 nt, Human
ugaggcagcaauugauuauuca

SEQ ID NO: 722017 - RNA, 19 nt, Human
ugggugugaccaucucugc

SEQ ID NO: 722018 - RNA, 22 nt, Human
aguaaacauuuucauauuuucu

SEQ ID NO: 722019 - RNA, 22 nt, Human
cggauccucagucgugcgggag

SEQ ID NO: 722020 - RNA, 22 nt, Human
ugggguagguaugaaaacuagg

SEQ ID NO: 722021 - RNA, 17 nt, Human
ucucuuucccuuucugc

SEQ ID NO: 722022 - RNA, 22 nt, Human
uuuaagaguuaaacuuugaccu

SEQ ID NO: 722023 - RNA, 22 nt, Human
uggaagggagcuggaauuugga

SEQ ID NO: 722024 - RNA, 22 nt, Human
aaaugucuuucuucugcuacgu

SEQ ID NO: 722025 - RNA, 22 nt, Human
agggauguaaauucuucuucuu

SEQ ID NO: 722026 - RNA, 22 nt, Human
acaggcauauuucuagauuaca

SEQ ID NO: 722027 - RNA, 22 nt, Human
aagguggcccugagcaugacaa

SEQ ID NO: 722028 - RNA, 22 nt, Human
uagcagaaccagucagugagcc

SEQ ID NO: 722029 - RNA, 19 nt, Human
uucucuauuaugucuucuc

SEQ ID NO: 722030 - RNA, 22 nt, Human
aggcacuggguaauuaguagcu

SEQ ID NO: 722031 - RNA, 22 nt, Human
uagagcaguuggcagcuguauu

SEQ ID NO: 722032 - RNA, 22 nt, Human
aggccugagcagaggaguggac

SEQ ID NO: 722033 - RNA, 22 nt, Human
uuagaaaauuugcuucuuugga

SEQ ID NO: 722034 - RNA, 22 nt, Human
uaugcaaaguccuaagaaagaa

SEQ ID NO: 722035 - RNA, 22 nt, Human
aggagaauuaggaacucaagau

SEQ ID NO: 722036 - RNA, 20 nt, Human
gaaccuggggaaggaguagg

SEQ ID NO: 722037 - RNA, 22 nt, Human
acaauaaguauugggcuuuuga

SEQ ID NO: 722038 - RNA, 22 nt, Human
aauuaugguggaucccaguggg

SEQ ID NO: 722039 - RNA, 22 nt, Human
aauaugugagguauguucagug

SEQ ID NO: 722040 - RNA, 22 nt, Human
gagggugggcuuuguuccucca

SEQ ID NO: 722041 - RNA, 19 nt, Human
ucucagagcccuagaggcc

SEQ ID NO: 722042 - RNA, 22 nt, Human
ugauucauauguaacaucccug

SEQ ID NO: 722043 - RNA, 22 nt, Human
ucugagcuuucuugugcucaag

SEQ ID NO: 722044 - RNA, 22 nt, Human
ggauacaacuagaagauggcag

SEQ ID NO: 722045 - RNA, 22 nt, Human
aagcaaagagauaaccuuuugg

SEQ ID NO: 722046 - RNA, 22 nt, Human
ucuugcuagaaucauuuggaga

SEQ ID NO: 722047 - RNA, 22 nt, Human
agugaguuuagggugcaggugu

SEQ ID NO: 722048 - RNA, 22 nt, Human
augaucauacagagcccuggua

SEQ ID NO: 722049 - RNA, 22 nt, Human
gagaaaaugucagacuuggucg

SEQ ID NO: 722050 - RNA, 22 nt, Human
gauuugucacgguugagagcca

SEQ ID NO: 722051 - RNA, 22 nt, Human
aaggcaggaugggaaaagauuu

SEQ ID NO: 722052 - RNA, 22 nt, Human
ccuuguccucugguuuccuguu

SEQ ID NO: 722053 - RNA, 22 nt, Human
uccugaagcucucuuaaggaaa

SEQ ID NO: 722054 - RNA, 22 nt, Human
cucuuugacgugcccauguccc

SEQ ID NO: 722055 - RNA, 22 nt, Human
gcucaccuucguccagcagccg

SEQ ID NO: 722056 - RNA, 22 nt, Human
cuugaaucuucugaguauuugc

SEQ ID NO: 722057 - RNA, 22 nt, Human
agcuacucagaguuccacucua

SEQ ID NO: 722058 - RNA, 22 nt, Human
caaggcaggaagccugucuuau

SEQ ID NO: 722059 - RNA, 22 nt, Human
uccagccucauuucuccugcuu

SEQ ID NO: 722060 - RNA, 19 nt, Human
aauuagggagucgguuaag

SEQ ID NO: 722061 - RNA, 20 nt, Human
gggcccugggauucagagca

SEQ ID NO: 722062 - RNA, 22 nt, Human
ugccucugugugcaggugagca

SEQ ID NO: 722063 - RNA, 22 nt, Human
aggcugagcuggcccuugaaau

SEQ ID NO: 722064 - RNA, 22 nt, Human
aacuggaaccuuuuauucaguc

SEQ ID NO: 722065 - RNA, 22 nt, Human
uuccacagucauccugggaauu

SEQ ID NO: 722066 - RNA, 22 nt, Human
cuggagaccucuccugagagug

SEQ ID NO: 722067 - RNA, 22 nt, Human
gauuucuucauucauuagaugg

SEQ ID NO: 722068 - RNA, 21 nt, Human
guuauacauucuauggauuug

SEQ ID NO: 722069 - RNA, 18 nt, Human
cauugacaguauaucuuu

SEQ ID NO: 722070 - RNA, 22 nt, Human
uuacacagacauggcaucauga

SEQ ID NO: 722071 - RNA, 22 nt, Human
aguucaggcauaaggcaugaac

SEQ ID NO: 722072 - RNA, 22 nt, Human
uggcuucugcauauuuuuagag

SEQ ID NO: 722073 - RNA, 22 nt, Human
uggcugcugcucacucagccuc

SEQ ID NO: 722074 - RNA, 22 nt, Human
uaguuuauaguuagcgagcacg

SEQ ID NO: 722075 - RNA, 22 nt, Human
aacaucuuguccuuagauuaaa

SEQ ID NO: 722076 - RNA, 22 nt, Human
acaggcacaccuuccugcaggc

SEQ ID NO: 722077 - RNA, 22 nt, Human
acagguggcuuauuggcugauu

SEQ ID NO: 722078 - RNA, 22 nt, Human
uccagucaucucccuucacauu

SEQ ID NO: 722079 - RNA, 22 nt, Human
augaggcaaucaugguccaguu

SEQ ID NO: 722080 - RNA, 22 nt, Human
uguucuaagcugccaaaaugcu

SEQ ID NO: 722081 - RNA, 22 nt, Human
cagaggaggcgguauacacugc

SEQ ID NO: 722082 - RNA, 22 nt, Human
ucuggcucuccagugcucuuag

SEQ ID NO: 722083 - RNA, 22 nt, Human
cacugaacuccuuguuuguccu

SEQ ID NO: 722084 - RNA, 22 nt, Human
uggaacaaauuacaauuaacuu

SEQ ID NO: 722085 - RNA, 22 nt, Human
uagagguagauggucagccaau

SEQ ID NO: 722086 - RNA, 21 nt, Human
ggggccucuccacacagccgg

SEQ ID NO: 722087 - RNA, 22 nt, Human
gcagugcauuacucacauguuu

SEQ ID NO: 722088 - RNA, 22 nt, Human
gaggcacugcugggccccugua

SEQ ID NO: 722089 - RNA, 23 nt, Human
ugagagccuggcagccuggguuc

SEQ ID NO: 722090 - RNA, 22 nt, Human
uggugacaccccaucucuaaag

SEQ ID NO: 722091 - RNA, 22 nt, Human
ucuucagacuguuguucuuuug

SEQ ID NO: 722092 - RNA, 22 nt, Human
gcagagaugagcuaucaggaca

SEQ ID NO: 722093 - RNA, 22 nt, Human
uccuuagagacaagaccaguuu

SEQ ID NO: 722094 - RNA, 18 nt, Human
acaaucugaaaccuguca

SEQ ID NO: 722095 - RNA, 22 nt, Human
gugcagagaaaugagaagucga

SEQ ID NO: 722096 - RNA, 22 nt, Human
uggcagguggagacagcagagc

SEQ ID NO: 722097 - RNA, 22 nt, Human
accaggguugagucagcugcgu

SEQ ID NO: 722098 - RNA, 22 nt, Human
gucuuugcugucuuugcucuca

SEQ ID NO: 722099 - RNA, 22 nt, Human
aaugucuuuugcaguucaagau

SEQ ID NO: 722100 - RNA, 22 nt, Human
ucugaaauaggagccauguaga

SEQ ID NO: 722101 - RNA, 22 nt, Human
caggcagagaggagcauuuaau

SEQ ID NO: 722102 - RNA, 22 nt, Human
uccuucuguagucccugucccu

SEQ ID NO: 722103 - RNA, 22 nt, Human
ugcagagagaccccugggccag

SEQ ID NO: 722104 - RNA, 22 nt, Human
acuucauguacuguucaaggcc

SEQ ID NO: 722105 - RNA, 22 nt, Human
aagucacaaagugcuguacaug

SEQ ID NO: 722106 - RNA, 20 nt, Human
aauuagauguuuaaucaaua

SEQ ID NO: 722107 - RNA, 22 nt, Human
uuuuaagaaauguaugacuguc

SEQ ID NO: 722108 - RNA, 22 nt, Human
gucugggcuuagggacauggca

SEQ ID NO: 722109 - RNA, 22 nt, Human
ccaggagcgcgugaacaggcug

SEQ ID NO: 722110 - RNA, 22 nt, Human
uucauuguagcuugacuaauua

SEQ ID NO: 722111 - RNA, 22 nt, Human
uuauugcaacuccuaaauagag

SEQ ID NO: 722112 - RNA, 22 nt, Human
aacaaugccugaugaccuccug

SEQ ID NO: 722113 - RNA, 22 nt, Human
ggguggagccugagaauuugca

SEQ ID NO: 722114 - RNA, 22 nt, Human
uacagggcaugugcagacacau

SEQ ID NO: 722115 - RNA, 22 nt, Human
uggaguuccuuugaaaggcucu

SEQ ID NO: 722116 - RNA, 22 nt, Human
ugugugacccccagugaagccu

SEQ ID NO: 722117 - RNA, 22 nt, Human
caguauaaugcccccugugggg

SEQ ID NO: 722118 - RNA, 21 nt, Human
uggagcugaauuuuuggcauc

SEQ ID NO: 722119 - RNA, 22 nt, Human
uuuagugauaagaauuaugaaa

SEQ ID NO: 722120 - RNA, 22 nt, Human
gugggaguggggaagcagagug

SEQ ID NO: 722121 - RNA, 22 nt, Human
uucucagugaaguuuagaacau

SEQ ID NO: 722122 - RNA, 22 nt, Human
gaggugugaggaaugaaugggg

SEQ ID NO: 722123 - RNA, 22 nt, Human
aucuggguucaccaugcuccug

SEQ ID NO: 722124 - RNA, 17 nt, Human
gcuguaguuugauaaga

SEQ ID NO: 722125 - RNA, 22 nt, Human
ucuggaaguuagaggaggaaag

SEQ ID NO: 722126 - RNA, 23 nt, Human
gugcacagucaagcccagcuuag

SEQ ID NO: 722127 - RNA, 20 nt, Human
auguuucucugucgugauuu

SEQ ID NO: 722128 - RNA, 22 nt, Human
uuguguauuuuuugauacuaac

SEQ ID NO: 722129 - RNA, 22 nt, Human
cgcauccagggcgcaggaucug

SEQ ID NO: 722130 - RNA, 22 nt, Human
aguccaaagcagaugagggcca

SEQ ID NO: 722131 - RNA, 22 nt, Human
agggcugcuauguugauucaga

SEQ ID NO: 722132 - RNA, 22 nt, Human
cuggcugguuacuauuucuggu

SEQ ID NO: 722133 - RNA, 22 nt, Human
ugcacacauucuauggggcuga

SEQ ID NO: 722134 - RNA, 22 nt, Human
aacacagggcagcugcugggaa

SEQ ID NO: 722135 - RNA, 22 nt, Human
uggcucagaugcucuuccagug

SEQ ID NO: 722136 - RNA, 22 nt, Human
ccucaggggcuuuucguuguug

SEQ ID NO: 722137 - RNA, 23 nt, Human
auauuuccagguuagugagguaa

SEQ ID NO: 722138 - RNA, 22 nt, Human
gguaaaaaucacaaauacuuua

SEQ ID NO: 722139 - RNA, 22 nt, Human
ucucagucuuugcaaggaugcu

SEQ ID NO: 722140 - RNA, 22 nt, Human
ucaagaugaaagauguagccau

SEQ ID NO: 722141 - RNA, 22 nt, Human
ucacuuuuugauaucauucugc

SEQ ID NO: 722142 - RNA, 22 nt, Human
guucugcugugucucagcaggu

SEQ ID NO: 722143 - RNA, 22 nt, Human
agcccaggagguggagguugca

SEQ ID NO: 722144 - RNA, 22 nt, Human
uacugaagcaccauuaaagaca

SEQ ID NO: 722145 - RNA, 22 nt, Human
agacucugaagucauugcauga

SEQ ID NO: 722146 - RNA, 23 nt, Human
uuuggcauguuaacuucacuuac

SEQ ID NO: 722147 - RNA, 22 nt, Human
ccuuucccgcuuugagggcaag

SEQ ID NO: 722148 - RNA, 22 nt, Human
uguguuauugccacugaagacc

SEQ ID NO: 722149 - RNA, 22 nt, Human
gguuuaaaagccaugcaugggg

SEQ ID NO: 722150 - RNA, 22 nt, Human
gccagagggauuccuggugugu

SEQ ID NO: 722151 - RNA, 22 nt, Human
cacugaaauauuaauaucuuau

SEQ ID NO: 722152 - RNA, 22 nt, Human
uggcucagucuggguugacuga

SEQ ID NO: 722153 - RNA, 22 nt, Human
guuucauuuacaucuguaggua

SEQ ID NO: 722154 - RNA, 22 nt, Human
ugugucauugccaugaaaaggc

SEQ ID NO: 722155 - RNA, 22 nt, Human
gccagcagcgagaguuuaaccu

SEQ ID NO: 722156 - RNA, 20 nt, Human
ugccugccccugcuuuuucc

SEQ ID NO: 722157 - RNA, 22 nt, Human
auuuguugaauaaauuaguauu

SEQ ID NO: 722158 - RNA, 22 nt, Human
uucaugucugccuuuucaagug

SEQ ID NO: 722159 - RNA, 22 nt, Human
uggacuccagugucuguguucu

SEQ ID NO: 722160 - RNA, 22 nt, Human
ggggaugguagaccggugacgu

SEQ ID NO: 722161 - RNA, 22 nt, Human
agagaagcagggagucaucugu

SEQ ID NO: 722162 - RNA, 22 nt, Human
uaccagcaucacagcauguugg

SEQ ID NO: 722163 - RNA, 22 nt, Human
gcuucagacugugcuucuguug

SEQ ID NO: 722164 - RNA, 22 nt, Human
acugucugcaaaacucauacuc

SEQ ID NO: 722165 - RNA, 17 nt, Human
gcuugggcugccuguug

SEQ ID NO: 722166 - RNA, 22 nt, Human
aggauaaaugaucuagauuuuc

SEQ ID NO: 722167 - RNA, 22 nt, Human
uguggugagaaacugguagauu

SEQ ID NO: 722168 - RNA, 22 nt, Human
cucuuuaguuugaaauccacau

SEQ ID NO: 722169 - RNA, 22 nt, Human
aucugcuugaaacuucuuauac

SEQ ID NO: 722170 - RNA, 22 nt, Human
ucacagaagaaguagauugcau

SEQ ID NO: 722171 - RNA, 22 nt, Human
cccaggagguggagcuugcagu

SEQ ID NO: 722172 - RNA, 22 nt, Human
ccauccuggccucgcuguccac

SEQ ID NO: 722173 - RNA, 22 nt, Human
accaucagucacauguagagaa

SEQ ID NO: 722174 - RNA, 16 nt, Human
ccucugggauguuugc

SEQ ID NO: 722175 - RNA, 22 nt, Human
agaaacuaagucauaacucuuu

SEQ ID NO: 722176 - RNA, 22 nt, Human
agccccugggaguagcugcugc

SEQ ID NO: 722177 - RNA, 22 nt, Human
cuggaguaaguuaagauguucc

SEQ ID NO: 722178 - RNA, 22 nt, Human
acaggggaauuuacugucauua

SEQ ID NO: 722179 - RNA, 22 nt, Human
gaaggccauuagagccugugcc

SEQ ID NO: 722180 - RNA, 22 nt, Human
ggaggccaucuggcuggaggcu

SEQ ID NO: 722181 - RNA, 22 nt, Human
agggcucacugggaggcuauaa

SEQ ID NO: 722182 - RNA, 22 nt, Human
caguagcaggauuugggauuau

SEQ ID NO: 722183 - RNA, 22 nt, Human
acaacuucaauugggauucucc

SEQ ID NO: 722184 - RNA, 22 nt, Human
ugcaauaaguuguguuaucacu

SEQ ID NO: 722185 - RNA, 22 nt, Human
aaauaaguaguuuaguguugug

SEQ ID NO: 722186 - RNA, 22 nt, Human
agcuucucaggagucugaggca

SEQ ID NO: 722187 - RNA, 22 nt, Human
ugaacacuguauauucuucuug

SEQ ID NO: 722188 - RNA, 22 nt, Human
gcagcugcagguggucccaugc

SEQ ID NO: 722189 - RNA, 22 nt, Human
ggcuagggaaaaugauuggaua

SEQ ID NO: 722190 - RNA, 22 nt, Human
auuagcaaucacgcagucauuu

SEQ ID NO: 722191 - RNA, 22 nt, Human
ggcuuccuaauacucccuacac

SEQ ID NO: 722192 - RNA, 22 nt, Human
gccagccuucuguggccugcaa

SEQ ID NO: 722193 - RNA, 22 nt, Human
uggaagggggaagacagcucug

SEQ ID NO: 722194 - RNA, 22 nt, Human
caugagaagggguggaguuaga

SEQ ID NO: 722195 - RNA, 22 nt, Human
auacuuuggucacuauuauugg

SEQ ID NO: 722196 - RNA, 22 nt, Human
ccugagauggggauuauuccaa

SEQ ID NO: 722197 - RNA, 22 nt, Human
acauaacacucuucucuaguga

SEQ ID NO: 722198 - RNA, 20 nt, Human
aaaaagacaaaacgaguugg

SEQ ID NO: 722199 - RNA, 18 nt, Human
aaacuguauuucuuucua

SEQ ID NO: 722200 - RNA, 22 nt, Human
uuugaaagaaaccagugaguga

SEQ ID NO: 722201 - RNA, 22 nt, Human
uuaacauuguccuuagcagauu

SEQ ID NO: 722202 - RNA, 22 nt, Human
agcaggugaauuccuggaugug

SEQ ID NO: 722203 - RNA, 22 nt, Human
uaagacuucauuaguaauaugg

SEQ ID NO: 722204 - RNA, 21 nt, Human
acugccuggggugcuggccaa

SEQ ID NO: 722205 - RNA, 22 nt, Human
ucuguaaagauguuuauaccuu

SEQ ID NO: 722206 - RNA, 22 nt, Human
caagcucugcgggcuccaagau

SEQ ID NO: 722207 - RNA, 22 nt, Human
agcaggcugggcaauaugggca

SEQ ID NO: 722208 - RNA, 18 nt, Human
ugauucaaguugcccucc

SEQ ID NO: 722209 - RNA, 22 nt, Human
gauuugucuauauucaaauaug

SEQ ID NO: 722210 - RNA, 22 nt, Human
uuuaucuauuguauuguugaug

SEQ ID NO: 722211 - RNA, 22 nt, Human
ugaggccagucucaucacaggc

SEQ ID NO: 722212 - RNA, 23 nt, Human
gugcaugugucuuuacaguagca

SEQ ID NO: 722213 - RNA, 22 nt, Human
uggaacaagggcguggcggucg

SEQ ID NO: 722214 - RNA, 22 nt, Human
cugaggaggggccugagugaga

SEQ ID NO: 722215 - RNA, 17 nt, Human
cagcccugccguuccca

SEQ ID NO: 722216 - RNA, 22 nt, Human
ccagcauucacacugguuccuu

SEQ ID NO: 722217 - RNA, 22 nt, Human
augauuuccaguuguugcuaag

SEQ ID NO: 722218 - RNA, 22 nt, Human
gcaucucuuacccacgagccag

SEQ ID NO: 722219 - RNA, 18 nt, Human
gccucccuggcuacacuu

SEQ ID NO: 722220 - RNA, 22 nt, Human
uacaccauucccagguggauuu
